United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 68

SEQ ID NO: 2867071 - DNA, 18 bp, Homo sapiens
tcccacaggacatttctc

SEQ ID NO: 2867072 - DNA, 21 bp, Homo sapiens
tcccacaggacatttctctaa

SEQ ID NO: 2867073 - DNA, 20 bp, Homo sapiens
tcccaccaccttggactcct

SEQ ID NO: 2867074 - DNA, 21 bp, Homo sapiens
tcccaccaccttggactcctc

SEQ ID NO: 2867075 - DNA, 14 bp, Homo sapiens
tcccagaccaggaa

SEQ ID NO: 2867076 - DNA, 16 bp, Homo sapiens
tcccagataatgtgaa

SEQ ID NO: 2867077 - DNA, 20 bp, Homo sapiens
tcccagatttttactttttc

SEQ ID NO: 2867078 - DNA, 22 bp, Homo sapiens
tcccagcagctcaacctaccct

SEQ ID NO: 2867079 - DNA, 15 bp, Homo sapiens
tcccaggcccgagat

SEQ ID NO: 2867080 - DNA, 14 bp, Homo sapiens
tcccatctggcttt

SEQ ID NO: 2867081 - DNA, 21 bp, Homo sapiens
tcccatctggctttttctgcc

SEQ ID NO: 2867082 - DNA, 19 bp, Homo sapiens
tccccaccctccactcagc

SEQ ID NO: 2867083 - DNA, 13 bp, Homo sapiens
tccccaccttccc

SEQ ID NO: 2867084 - DNA, 16 bp, Homo sapiens
tccccagactcagctc

SEQ ID NO: 2867085 - DNA, 21 bp, Homo sapiens
tccccagactcagctccagaa

SEQ ID NO: 2867086 - DNA, 20 bp, Homo sapiens
tcccccatcccctttcctcc

SEQ ID NO: 2867087 - DNA, 15 bp, Homo sapiens
tccccctctgtccag

SEQ ID NO: 2867088 - DNA, 20 bp, Homo sapiens
tcccctaagcagaccactga

SEQ ID NO: 2867089 - DNA, 16 bp, Homo sapiens
tcccctccctcttcct

SEQ ID NO: 2867090 - DNA, 13 bp, Homo sapiens
tcccctttcctcc

SEQ ID NO: 2867091 - DNA, 22 bp, Homo sapiens
tcccgagcacctccacatcctc

SEQ ID NO: 2867092 - DNA, 16 bp, Homo sapiens
tccctcatctgtccct

SEQ ID NO: 2867093 - DNA, 14 bp, Homo sapiens
tccctccgggacct

SEQ ID NO: 2867094 - DNA, 14 bp, Homo sapiens
tccctctaatttat

SEQ ID NO: 2867095 - DNA, 16 bp, Homo sapiens
tccctctaatttatct

SEQ ID NO: 2867096 - DNA, 15 bp, Homo sapiens
tccctctcactcccc

SEQ ID NO: 2867097 - DNA, 16 bp, Homo sapiens
tccctgactcattctg

SEQ ID NO: 2867098 - DNA, 19 bp, Homo sapiens
tccctgactcattctgaag

SEQ ID NO: 2867099 - DNA, 14 bp, Homo sapiens
tccctgactgggag

SEQ ID NO: 2867100 - DNA, 15 bp, Homo sapiens
tccctgactgggagt

SEQ ID NO: 2867101 - DNA, 19 bp, Homo sapiens
tccctgtaacctcttcaga

SEQ ID NO: 2867102 - DNA, 15 bp, Homo sapiens
tcccttaaacaaaaa

SEQ ID NO: 2867103 - DNA, 10 bp, Homo sapiens
tcccttccca

SEQ ID NO: 2867104 - DNA, 14 bp, Homo sapiens
tcccttgggctccc

SEQ ID NO: 2867105 - DNA, 12 bp, Homo sapiens
tccctttttcat

SEQ ID NO: 2867106 - DNA, 16 bp, Homo sapiens
tccctttttcataatt

SEQ ID NO: 2867107 - DNA, 17 bp, Homo sapiens
tccgcagcagggaagct

SEQ ID NO: 2867108 - DNA, 17 bp, Homo sapiens
tccggactggcagaagc

SEQ ID NO: 2867109 - DNA, 17 bp, Homo sapiens
tctgtataacagccttt

SEQ ID NO: 2867110 - DNA, 17 bp, Homo sapiens
tctgtctcatccatcat

SEQ ID NO: 2867111 - DNA, 21 bp, Homo sapiens
tctgtctcatccatcatcatg

SEQ ID NO: 2867112 - DNA, 23 bp, Homo sapiens
tctgtgtaacatccaagccagag

SEQ ID NO: 2867113 - DNA, 20 bp, Homo sapiens
tctgtgtaaccagctcagtg

SEQ ID NO: 2867114 - DNA, 15 bp, Homo sapiens
tctgttaatttagta

SEQ ID NO: 2867115 - DNA, 15 bp, Homo sapiens
tcttaggaagagaaa

SEQ ID NO: 2867116 - DNA, 19 bp, Homo sapiens
tcttaggaagagaaaccag

SEQ ID NO: 2867117 - DNA, 17 bp, Homo sapiens
tcttatgtgaaaaatta

SEQ ID NO: 2867118 - DNA, 18 bp, Homo sapiens
tcttcaatatgaatctat

SEQ ID NO: 2867119 - DNA, 23 bp, Homo sapiens
tcttcatggcatcttcaatatga

SEQ ID NO: 2867120 - DNA, 13 bp, Homo sapiens
tcttccatttgca

SEQ ID NO: 2867121 - DNA, 14 bp, Homo sapiens
tcttcccttcccag

SEQ ID NO: 2867122 - DNA, 18 bp, Homo sapiens
tcttcctagatctgcagg

SEQ ID NO: 2867123 - DNA, 19 bp, Homo sapiens
tcttcgctgctagagaagg

SEQ ID NO: 2867124 - DNA, 15 bp, Homo sapiens
tcttcttcaccattt

SEQ ID NO: 2867125 - DNA, 13 bp, Homo sapiens
tcttgaaacctga

SEQ ID NO: 2867126 - DNA, 18 bp, Homo sapiens
tcttgaaacctgatgtca

SEQ ID NO: 2867127 - DNA, 14 bp, Homo sapiens
tcttgaaagctgtg

SEQ ID NO: 2867128 - DNA, 13 bp, Homo sapiens
tcttgatgcatgc

SEQ ID NO: 2867129 - DNA, 13 bp, Homo sapiens
tcttggttgagga

SEQ ID NO: 2867130 - DNA, 14 bp, Homo sapiens
tcttgtctctgggc

SEQ ID NO: 2867131 - DNA, 15 bp, Homo sapiens
tcttgtctctgggct

SEQ ID NO: 2867132 - DNA, 14 bp, Homo sapiens
tcttgtttgtcagc

SEQ ID NO: 2867133 - DNA, 22 bp, Homo sapiens
tctttaggggaagtaaaacagt

SEQ ID NO: 2867134 - DNA, 14 bp, Homo sapiens
tctttatatttcaa

SEQ ID NO: 2867135 - DNA, 15 bp, Homo sapiens
tctttatatttcaat

SEQ ID NO: 2867136 - DNA, 18 bp, Homo sapiens
ttcataatcagtaaatag

SEQ ID NO: 2867137 - DNA, 21 bp, Homo sapiens
ttcataatcagtaaatagtgt

SEQ ID NO: 2867138 - DNA, 19 bp, Homo sapiens
ttcatagtaagtgcgaaga

SEQ ID NO: 2867139 - DNA, 13 bp, Homo sapiens
ttcatattgtaat

SEQ ID NO: 2867140 - DNA, 22 bp, Homo sapiens
ttcatgattatagcaactaatg

SEQ ID NO: 2867141 - DNA, 17 bp, Homo sapiens
ttcatgcctgatgaaag

SEQ ID NO: 2867142 - DNA, 19 bp, Homo sapiens
ttcattattcaagaatgaa

SEQ ID NO: 2867143 - DNA, 22 bp, Homo sapiens
ttcattggcattctttgcaata

SEQ ID NO: 2867144 - DNA, 23 bp, Homo sapiens
ttccaaattgccctatgctgtgc

SEQ ID NO: 2867145 - DNA, 21 bp, Homo sapiens
ttccacggagccactcctctg

SEQ ID NO: 2867146 - DNA, 22 bp, Homo sapiens
ttccacggagccactcctctga

SEQ ID NO: 2867147 - DNA, 11 bp, Homo sapiens
ttccaggctga

SEQ ID NO: 2867148 - DNA, 18 bp, Homo sapiens
ttccaggctgagccatga

SEQ ID NO: 2867149 - DNA, 13 bp, Homo sapiens
ttccatttgcaag

SEQ ID NO: 2867150 - DNA, 17 bp, Homo sapiens
ttccatttgcaagggaa

SEQ ID NO: 2867151 - DNA, 14 bp, Homo sapiens
ttccattttccccc

SEQ ID NO: 2867152 - DNA, 16 bp, Homo sapiens
ttccattttcccccac

SEQ ID NO: 2867153 - DNA, 14 bp, Homo sapiens
ttcccaattcacat

SEQ ID NO: 2867154 - DNA, 18 bp, Homo sapiens
ttcccacaggacatttct

SEQ ID NO: 2867155 - DNA, 19 bp, Homo sapiens
ttcccagtaaccctaagga

SEQ ID NO: 2867156 - DNA, 20 bp, Homo sapiens
ttcccatctggctttttctg

SEQ ID NO: 2867157 - DNA, 22 bp, Homo sapiens
ttcccatctggctttttctgcc

SEQ ID NO: 2867158 - DNA, 22 bp, Homo sapiens
ttccccagactcagctccagaa

SEQ ID NO: 2867159 - DNA, 17 bp, Homo sapiens
ttcccccactactgcag

SEQ ID NO: 2867160 - DNA, 15 bp, Homo sapiens
ttccccttccactga

SEQ ID NO: 2867161 - DNA, 16 bp, Homo sapiens
ttccctgactcattct

SEQ ID NO: 2867162 - DNA, 13 bp, Homo sapiens
ttcccttcccaga

SEQ ID NO: 2867163 - DNA, 13 bp, Homo sapiens
ttccgcttggagc

SEQ ID NO: 2867164 - DNA, 19 bp, Homo sapiens
ttccgcttggagcagaggg

SEQ ID NO: 2867165 - DNA, 14 bp, Homo sapiens
ttcctaacaaaatg

SEQ ID NO: 2867166 - DNA, 22 bp, Homo sapiens
ttcctaataaagttctgtactc

SEQ ID NO: 2867167 - DNA, 18 bp, Homo sapiens
ttcctagatctgcaggct

SEQ ID NO: 2867168 - DNA, 22 bp, Homo sapiens
ttcctagatctgcaggctgcac

SEQ ID NO: 2867169 - DNA, 13 bp, Homo sapiens
ttcctatacgcag

SEQ ID NO: 2867170 - DNA, 11 bp, Homo sapiens
ttcctcctggg

SEQ ID NO: 2867171 - DNA, 23 bp, Homo sapiens
ttcctgacactcaataaacagtc

SEQ ID NO: 2867172 - DNA, 21 bp, Homo sapiens
ttcctgtgtgtactctgtcca

SEQ ID NO: 2867173 - DNA, 23 bp, Homo sapiens
ttccttcccccatcccctttcct

SEQ ID NO: 2867174 - DNA, 10 bp, Homo sapiens
ttcctttcct

SEQ ID NO: 2867175 - DNA, 11 bp, Homo sapiens
ttcctttcctc

SEQ ID NO: 2867176 - DNA, 23 bp, Homo sapiens
ttcctttcctgtgtgtactctgt

SEQ ID NO: 2867177 - DNA, 17 bp, Homo sapiens
ttcgctgctagagaagg

SEQ ID NO: 2867178 - DNA, 17 bp, Homo sapiens
ttctaaccttcacgatt

SEQ ID NO: 2867179 - DNA, 12 bp, Homo sapiens
ttctaagtcttt

SEQ ID NO: 2867180 - DNA, 15 bp, Homo sapiens
ttctaagtctttcca

SEQ ID NO: 2867181 - DNA, 14 bp, Homo sapiens
ttctaattgtaagt

SEQ ID NO: 2867182 - DNA, 23 bp, Homo sapiens
ttctaattgtaagtgaaattaag

SEQ ID NO: 2867183 - DNA, 22 bp, Homo sapiens
ttctacctacatatttgtatgt

SEQ ID NO: 2867184 - DNA, 17 bp, Homo sapiens
ttctatgacaaattcaa

SEQ ID NO: 2867185 - DNA, 21 bp, Homo sapiens
ttctatttttatgatgacaat

SEQ ID NO: 2867186 - DNA, 14 bp, Homo sapiens
ttctcaaatgtgtg

SEQ ID NO: 2867187 - DNA, 22 bp, Homo sapiens
ttctcataagtagcattcatgt

SEQ ID NO: 2867188 - DNA, 24 bp, Homo sapiens
ttctctaagagaacaatgtgctat

SEQ ID NO: 2867189 - DNA, 17 bp, Homo sapiens
ttctctagctctctagg

SEQ ID NO: 2867190 - DNA, 22 bp, Homo sapiens
ttctctagctctctaggcctct

SEQ ID NO: 2867191 - DNA, 16 bp, Homo sapiens
ttctctgagctgtgca

SEQ ID NO: 2867192 - DNA, 17 bp, Homo sapiens
ttctctgtctcatccat

SEQ ID NO: 2867193 - DNA, 20 bp, Homo sapiens
ttctcttcctagatctgcag

SEQ ID NO: 2867194 - DNA, 16 bp, Homo sapiens
ttctgccactgaggag

SEQ ID NO: 2867195 - DNA, 20 bp, Homo sapiens
ttctgctcatcattctctgt

SEQ ID NO: 2867196 - DNA, 21 bp, Homo sapiens
ttctgggaagcttgagcctcc

SEQ ID NO: 2867197 - DNA, 17 bp, Homo sapiens
ttctgtagagccaatta

SEQ ID NO: 2867198 - DNA, 12 bp, Homo sapiens
ttcttcagattg

SEQ ID NO: 2867199 - DNA, 12 bp, Homo sapiens
ttgaaagctgtg

SEQ ID NO: 2867200 - DNA, 22 bp, Homo sapiens
ttgaaagctgtggccagcttgt

SEQ ID NO: 2867201 - DNA, 22 bp, Homo sapiens
ttgaaatacgtttgtgtttcta

SEQ ID NO: 2867202 - DNA, 18 bp, Homo sapiens
ttgaaattaacctctcac

SEQ ID NO: 2867203 - DNA, 13 bp, Homo sapiens
ttgaactttggaa

SEQ ID NO: 2867204 - DNA, 23 bp, Homo sapiens
ttgaatgtccaaaatttatattt

SEQ ID NO: 2867205 - DNA, 15 bp, Homo sapiens
ttgaattgtaactgt

SEQ ID NO: 2867206 - DNA, 22 bp, Homo sapiens
ttttctaaataaaaatatgtaa

SEQ ID NO: 2867207 - DNA, 17 bp, Homo sapiens
ttttctcctgcagaaag

SEQ ID NO: 2867208 - DNA, 13 bp, Homo sapiens
ttttgaaacaaag

SEQ ID NO: 2867209 - DNA, 22 bp, Homo sapiens
ttttgaaacaaagtactcttta

SEQ ID NO: 2867210 - DNA, 17 bp, Homo sapiens
ttttgaaattaacctct

SEQ ID NO: 2867211 - DNA, 19 bp, Homo sapiens
ttttgacaggttttccaaa

SEQ ID NO: 2867212 - DNA, 17 bp, Homo sapiens
ttttgcaacctcgctgg

SEQ ID NO: 2867213 - DNA, 16 bp, Homo sapiens
ttttggggttcaagaa

SEQ ID NO: 2867214 - DNA, 16 bp, Homo sapiens
ttttgttggtgctttg

SEQ ID NO: 2867215 - DNA, 14 bp, Homo sapiens
tttttagtgttaaa

SEQ ID NO: 2867216 - DNA, 22 bp, Homo sapiens
tttttcacttctacctacatat

SEQ ID NO: 2867217 - DNA, 12 bp, Homo sapiens
tttttgtgaaga

SEQ ID NO: 2867218 - DNA, 18 bp, Homo sapiens
ttttttcaatatttatta

SEQ ID NO: 2867219 - DNA, 13 bp, Homo sapiens
tttttttaactgt

SEQ ID NO: 2867220 - DNA, 14 bp, Homo sapiens
tttttttaactgtg

SEQ ID NO: 2867221 - DNA, 12 bp, Homo sapiens
tctttccaaatt

SEQ ID NO: 2867222 - DNA, 19 bp, Homo sapiens
tctttccacggagccactc

SEQ ID NO: 2867223 - DNA, 17 bp, Homo sapiens
tctttcctactttctat

SEQ ID NO: 2867224 - DNA, 15 bp, Homo sapiens
tcttttttctcttcc

SEQ ID NO: 2867225 - DNA, 18 bp, Homo sapiens
tgaaaaaatgtatatgca

SEQ ID NO: 2867226 - DNA, 11 bp, Homo sapiens
tgaaaaattaa

SEQ ID NO: 2867227 - DNA, 16 bp, Homo sapiens
tgaaaaattaactttt

SEQ ID NO: 2867228 - DNA, 22 bp, Homo sapiens
tgaaaagtactaatagaacttg

SEQ ID NO: 2867229 - DNA, 16 bp, Homo sapiens
tgaaacagttgctgtg

SEQ ID NO: 2867230 - DNA, 19 bp, Homo sapiens
tgaaacatgggctgtgatt

SEQ ID NO: 2867231 - DNA, 20 bp, Homo sapiens
tgaaacccattaggcatgcc

SEQ ID NO: 2867232 - DNA, 21 bp, Homo sapiens
tgaaacccattaggcatgcct

SEQ ID NO: 2867233 - DNA, 23 bp, Homo sapiens
tgaaacttctcagtccagcagtt

SEQ ID NO: 2867234 - DNA, 11 bp, Homo sapiens
tgaaagctgtg

SEQ ID NO: 2867235 - DNA, 16 bp, Homo sapiens
tgaaatgtacgtcatt

SEQ ID NO: 2867236 - DNA, 17 bp, Homo sapiens
tgaaattaacctctcac

SEQ ID NO: 2867237 - DNA, 20 bp, Homo sapiens
tgaactaccttggttccccc

SEQ ID NO: 2867238 - DNA, 12 bp, Homo sapiens
tgaactttggaa

SEQ ID NO: 2867239 - DNA, 18 bp, Homo sapiens
tgaactttgtcagtgttg

SEQ ID NO: 2867240 - DNA, 13 bp, Homo sapiens
tgaactttgtgct

SEQ ID NO: 2867241 - DNA, 16 bp, Homo sapiens
tgaagaaagtcaaaaa

SEQ ID NO: 2867242 - DNA, 22 bp, Homo sapiens
tgaagaaagtcaaaaaattatt

SEQ ID NO: 2867243 - DNA, 16 bp, Homo sapiens
tgaagaagggggtggg

SEQ ID NO: 2867244 - DNA, 20 bp, Homo sapiens
tgaagaagggggtgggggga

SEQ ID NO: 2867245 - DNA, 16 bp, Homo sapiens
tgaagaatcaagaggg

SEQ ID NO: 2867246 - DNA, 21 bp, Homo sapiens
tgaagagggacataagataaa

SEQ ID NO: 2867247 - DNA, 17 bp, Homo sapiens
tgaagatctttatattt

SEQ ID NO: 2867248 - DNA, 16 bp, Homo sapiens
tgaagccgactctggc

SEQ ID NO: 2867249 - DNA, 22 bp, Homo sapiens
tgaaggagccccattcctggga

SEQ ID NO: 2867250 - DNA, 23 bp, Homo sapiens
tgaaggagccccattcctgggaa

SEQ ID NO: 2867251 - DNA, 14 bp, Homo sapiens
tgaagggaagtggg

SEQ ID NO: 2867252 - DNA, 18 bp, Homo sapiens
tgaagggaagtggggagt

SEQ ID NO: 2867253 - DNA, 17 bp, Homo sapiens
tgaagtctgagggaaac

SEQ ID NO: 2867254 - DNA, 21 bp, Homo sapiens
tgaagtgttccctttttcata

SEQ ID NO: 2867255 - DNA, 21 bp, Homo sapiens
tgaatgggatattttgaaatg

SEQ ID NO: 2867256 - DNA, 12 bp, Homo sapiens
tgaatgtgtgag

SEQ ID NO: 2867257 - DNA, 21 bp, Homo sapiens
tgaattcttggttgaggaaac

SEQ ID NO: 2867258 - DNA, 14 bp, Homo sapiens
tgaatttgtatatg

SEQ ID NO: 2867259 - DNA, 19 bp, Homo sapiens
tgaattttataaataaaat

SEQ ID NO: 2867260 - DNA, 20 bp, Homo sapiens
tgacaactcattttcatatt

SEQ ID NO: 2867261 - DNA, 16 bp, Homo sapiens
tgacaagctgtatcac

SEQ ID NO: 2867262 - DNA, 19 bp, Homo sapiens
tgacaagctgtatcactgc

SEQ ID NO: 2867263 - DNA, 20 bp, Homo sapiens
tgacaggttttccaaaagta

SEQ ID NO: 2867264 - DNA, 22 bp, Homo sapiens
tgacaggttttccaaaagtaaa

SEQ ID NO: 2867265 - DNA, 15 bp, Homo sapiens
tgacagtttccaaat

SEQ ID NO: 2867266 - DNA, 21 bp, Homo sapiens
tgacatttatttttcatttag

SEQ ID NO: 2867267 - DNA, 13 bp, Homo sapiens
tgaccaatgtctt

SEQ ID NO: 2867268 - DNA, 14 bp, Homo sapiens
tgaccaatgtcttg

SEQ ID NO: 2867269 - DNA, 15 bp, Homo sapiens
tgaccaatgtcttga

SEQ ID NO: 2867270 - DNA, 22 bp, Homo sapiens
tgaccacaccaaccaggccttc

SEQ ID NO: 2867271 - DNA, 21 bp, Homo sapiens
tgaccacgctttctagctgtt

SEQ ID NO: 2867272 - DNA, 13 bp, Homo sapiens
tgaccatctgtga

SEQ ID NO: 2867273 - DNA, 16 bp, Homo sapiens
tgaccatctgtgacta

SEQ ID NO: 2867274 - DNA, 18 bp, Homo sapiens
tgacccagccccttgaga

SEQ ID NO: 2867275 - DNA, 23 bp, Homo sapiens
tgacccagccccttgagaaacct

SEQ ID NO: 2867276 - DNA, 13 bp, Homo sapiens
tgacctccctcta

SEQ ID NO: 2867277 - DNA, 14 bp, Homo sapiens
tgacctccctctaa

SEQ ID NO: 2867278 - DNA, 22 bp, Homo sapiens
tgacctccctctaatttatctt

SEQ ID NO: 2867279 - DNA, 17 bp, Homo sapiens
tgactaggttctgtaga

SEQ ID NO: 2867280 - DNA, 15 bp, Homo sapiens
tgactataaagctgt

SEQ ID NO: 2867281 - DNA, 17 bp, Homo sapiens
tgactataaagctgtta

SEQ ID NO: 2867282 - DNA, 13 bp, Homo sapiens
tgactcagggctc

SEQ ID NO: 2867283 - DNA, 21 bp, Homo sapiens
tgacttaggtttcaggaagtt

SEQ ID NO: 2867284 - DNA, 15 bp, Homo sapiens
tgagaaacactattt

SEQ ID NO: 2867285 - DNA, 23 bp, Homo sapiens
tgagaaaccttattgtacctctc

SEQ ID NO: 2867286 - DNA, 20 bp, Homo sapiens
tgagagtccaacagacacaa

SEQ ID NO: 2867287 - DNA, 20 bp, Homo sapiens
tgagataccagcgaggaggc

SEQ ID NO: 2867288 - DNA, 21 bp, Homo sapiens
tgagataccagcgaggaggct

SEQ ID NO: 2867289 - DNA, 17 bp, Homo sapiens
tgagatgggtgtacaaa

SEQ ID NO: 2867290 - DNA, 16 bp, Homo sapiens
tgagcatagagaacaa

SEQ ID NO: 2867291 - DNA, 12 bp, Homo sapiens
tgagcctccccc

SEQ ID NO: 2867292 - DNA, 22 bp, Homo sapiens
tgagcgaggagatgctccttgg

SEQ ID NO: 2867293 - DNA, 16 bp, Homo sapiens
tgagcttctctgtgaa

SEQ ID NO: 2867294 - DNA, 14 bp, Homo sapiens
tgaggagcgtggac

SEQ ID NO: 2867295 - DNA, 15 bp, Homo sapiens
tgaggccagggcaga

SEQ ID NO: 2867296 - DNA, 15 bp, Homo sapiens
tgaggctgagaaagc

SEQ ID NO: 2867297 - DNA, 11 bp, Homo sapiens
tgagggcagtc

SEQ ID NO: 2867298 - DNA, 12 bp, Homo sapiens
tgagggggtggt

SEQ ID NO: 2867299 - DNA, 16 bp, Homo sapiens
tgaggtcaggagttcc

SEQ ID NO: 2867300 - DNA, 14 bp, Homo sapiens
tgataatatatatt

SEQ ID NO: 2867301 - DNA, 21 bp, Homo sapiens
tgatatcatgcccctgtactc

SEQ ID NO: 2867302 - DNA, 13 bp, Homo sapiens
tatacattttcta

SEQ ID NO: 2867303 - DNA, 16 bp, Homo sapiens
tatatatgtatttcta

SEQ ID NO: 2867304 - DNA, 13 bp, Homo sapiens
tatatgactgcat

SEQ ID NO: 2867305 - DNA, 19 bp, Homo sapiens
tatatgactgcatttgtgt

SEQ ID NO: 2867306 - DNA, 21 bp, Homo sapiens
tatatgcacttataattttcc

SEQ ID NO: 2867307 - DNA, 21 bp, Homo sapiens
tatatgtattttttgaatcta

SEQ ID NO: 2867308 - DNA, 17 bp, Homo sapiens
tatattacccaatggaa

SEQ ID NO: 2867309 - DNA, 18 bp, Homo sapiens
tatatttttttaactgtg

SEQ ID NO: 2867310 - DNA, 18 bp, Homo sapiens
tatcaaataaaatatcat

SEQ ID NO: 2867311 - DNA, 21 bp, Homo sapiens
tatcaggacccagaggaaggg

SEQ ID NO: 2867312 - DNA, 21 bp, Homo sapiens
tatcagtaatgctaaatgtgt

SEQ ID NO: 2867313 - DNA, 20 bp, Homo sapiens
tatcattatctttgctgtta

SEQ ID NO: 2867314 - DNA, 14 bp, Homo sapiens
tatccaactttttc

SEQ ID NO: 2867315 - DNA, 21 bp, Homo sapiens
tatccaggtaatccaagatat

SEQ ID NO: 2867316 - DNA, 15 bp, Homo sapiens
tatgaatgaaacatg

SEQ ID NO: 2867317 - DNA, 16 bp, Homo sapiens
tatgaatgaatgggat

SEQ ID NO: 2867318 - DNA, 16 bp, Homo sapiens
aagatagaaagctgga

SEQ ID NO: 2867319 - DNA, 17 bp, Homo sapiens
aagatagaaagctggac

SEQ ID NO: 2867320 - DNA, 18 bp, Homo sapiens
aagatagaaagctggact

SEQ ID NO: 2867321 - DNA, 19 bp, Homo sapiens
aagatattttaaaatctgt

SEQ ID NO: 2867322 - DNA, 20 bp, Homo sapiens
aagatctttatatttcaata

SEQ ID NO: 2867323 - DNA, 22 bp, Homo sapiens
aagatctttatatttcaataaa

SEQ ID NO: 2867324 - DNA, 14 bp, Homo sapiens
aagatgcagaagca

SEQ ID NO: 2867325 - DNA, 22 bp, Homo sapiens
aagatgctacttcccactgtat

SEQ ID NO: 2867326 - DNA, 14 bp, Homo sapiens
aagatggctgctgc

SEQ ID NO: 2867327 - DNA, 16 bp, Homo sapiens
aagattctttcccaat

SEQ ID NO: 2867328 - DNA, 16 bp, Homo sapiens
aagcaggaaggatggc

SEQ ID NO: 2867329 - DNA, 12 bp, Homo sapiens
aagcattcacaa

SEQ ID NO: 2867330 - DNA, 17 bp, Homo sapiens
aagcattttgaaacaaa

SEQ ID NO: 2867331 - DNA, 19 bp, Homo sapiens
aagccacaggagccccacc

SEQ ID NO: 2867332 - DNA, 22 bp, Homo sapiens
aagccagagtttttaaagcctt

SEQ ID NO: 2867333 - DNA, 20 bp, Homo sapiens
aagccagcgtcctcctctgt

SEQ ID NO: 2867334 - DNA, 14 bp, Homo sapiens
aagccccaactttc

SEQ ID NO: 2867335 - DNA, 19 bp, Homo sapiens
aagccgactctggccctgg

SEQ ID NO: 2867336 - DNA, 21 bp, Homo sapiens
aagccggcctgagaaacacta

SEQ ID NO: 2867337 - DNA, 13 bp, Homo sapiens
aagcctaaaattg

SEQ ID NO: 2867338 - DNA, 14 bp, Homo sapiens
aagcctaaaattga

SEQ ID NO: 2867339 - DNA, 15 bp, Homo sapiens
aagccttctggatcc

SEQ ID NO: 2867340 - DNA, 20 bp, Homo sapiens
aagccttctggatccatggg

SEQ ID NO: 2867341 - DNA, 21 bp, Homo sapiens
aagccttctggatccatgggg

SEQ ID NO: 2867342 - DNA, 13 bp, Homo sapiens
aagctggactgac

SEQ ID NO: 2867343 - DNA, 19 bp, Homo sapiens
aagctgggcatgaacgcac

SEQ ID NO: 2867344 - DNA, 15 bp, Homo sapiens
aagctgggggaaggg

SEQ ID NO: 2867345 - DNA, 14 bp, Homo sapiens
aagcttgaggccaa

SEQ ID NO: 2867346 - DNA, 22 bp, Homo sapiens
aagcttgaggccaagatggctg

SEQ ID NO: 2867347 - DNA, 23 bp, Homo sapiens
aagctttcatgtaaactgtgcac

SEQ ID NO: 2867348 - DNA, 16 bp, Homo sapiens
aaggaaacattttatc

SEQ ID NO: 2867349 - DNA, 14 bp, Homo sapiens
aaggaacaagagaa

SEQ ID NO: 2867350 - DNA, 13 bp, Homo sapiens
aaggacaatgcct

SEQ ID NO: 2867351 - DNA, 17 bp, Homo sapiens
aaggagccccattcctg

SEQ ID NO: 2867352 - DNA, 15 bp, Homo sapiens
aaggcaaacccatca

SEQ ID NO: 2867353 - DNA, 21 bp, Homo sapiens
aaggctgtgtttagattgtat

SEQ ID NO: 2867354 - DNA, 23 bp, Homo sapiens
aaggctgtgtttagattgtatta

SEQ ID NO: 2867355 - DNA, 13 bp, Homo sapiens
aaggcttggctgg

SEQ ID NO: 2867356 - DNA, 16 bp, Homo sapiens
aagggaaaagtctctt

SEQ ID NO: 2867357 - DNA, 17 bp, Homo sapiens
aaggggccagaggctcg

SEQ ID NO: 2867358 - DNA, 18 bp, Homo sapiens
aagggtggtctgagcacc

SEQ ID NO: 2867359 - DNA, 13 bp, Homo sapiens
aaggtgaactttg

SEQ ID NO: 2867360 - DNA, 16 bp, Homo sapiens
aagtagaagaggagga

SEQ ID NO: 2867361 - DNA, 13 bp, Homo sapiens
aagtagtaaatca

SEQ ID NO: 2867362 - DNA, 22 bp, Homo sapiens
aagtatgcaatgcttcattatt

SEQ ID NO: 2867363 - DNA, 14 bp, Homo sapiens
aagtcaaaaaatta

SEQ ID NO: 2867364 - DNA, 20 bp, Homo sapiens
aagtcaaagcaaggaaacta

SEQ ID NO: 2867365 - DNA, 16 bp, Homo sapiens
aagtcaacctgcctga

SEQ ID NO: 2867366 - DNA, 18 bp, Homo sapiens
aagtcagaatttttaact

SEQ ID NO: 2867367 - DNA, 17 bp, Homo sapiens
aagtctccagaagaaaa

SEQ ID NO: 2867368 - DNA, 11 bp, Homo sapiens
aagtgaaatta

SEQ ID NO: 2867369 - DNA, 14 bp, Homo sapiens
aagtgatatggtga

SEQ ID NO: 2867370 - DNA, 14 bp, Homo sapiens
aagtgcatgaaaaa

SEQ ID NO: 2867371 - DNA, 13 bp, Homo sapiens
aagtgcccaaagt

SEQ ID NO: 2867372 - DNA, 17 bp, Homo sapiens
aagtgcccaaagtgggg

SEQ ID NO: 2867373 - DNA, 22 bp, Homo sapiens
aagtgcgtccacgagctgttta

SEQ ID NO: 2867374 - DNA, 20 bp, Homo sapiens
aagtgggatttggggcctca

SEQ ID NO: 2867375 - DNA, 14 bp, Homo sapiens
aagtgtaaaaaatg

SEQ ID NO: 2867376 - DNA, 19 bp, Homo sapiens
aagttctgtactcaaatgt

SEQ ID NO: 2867377 - DNA, 16 bp, Homo sapiens
aataaaaataaatttg

SEQ ID NO: 2867378 - DNA, 17 bp, Homo sapiens
aataaaaatatgtaatt

SEQ ID NO: 2867379 - DNA, 18 bp, Homo sapiens
aataaaatgtttcattat

SEQ ID NO: 2867380 - DNA, 11 bp, Homo sapiens
aataaacagtc

SEQ ID NO: 2867381 - DNA, 12 bp, Homo sapiens
aataaagtactt

SEQ ID NO: 2867382 - DNA, 22 bp, Homo sapiens
aataagaaacaactctttgaga

SEQ ID NO: 2867383 - DNA, 18 bp, Homo sapiens
aataatgtaacatgattt

SEQ ID NO: 2867384 - DNA, 16 bp, Homo sapiens
aataattcttttctga

SEQ ID NO: 2867385 - DNA, 16 bp, Homo sapiens
aataatttgaactttg

SEQ ID NO: 2867386 - DNA, 12 bp, Homo sapiens
aatacatttgta

SEQ ID NO: 2867387 - DNA, 20 bp, Homo sapiens
aatactgccaaaacatttat

SEQ ID NO: 2867388 - DNA, 22 bp, Homo sapiens
aatactgccaaaacatttatga

SEQ ID NO: 2867389 - DNA, 23 bp, Homo sapiens
aatactgccaaaacatttatgac

SEQ ID NO: 2867390 - DNA, 11 bp, Homo sapiens
aatacttttgc

SEQ ID NO: 2867391 - DNA, 14 bp, Homo sapiens
aatagagcctgagg

SEQ ID NO: 2867392 - DNA, 16 bp, Homo sapiens
aatagagcctgaggga

SEQ ID NO: 2867393 - DNA, 21 bp, Homo sapiens
aatagatttgggtcatttaga

SEQ ID NO: 2867394 - DNA, 19 bp, Homo sapiens
aatagctttagtgaattaa

SEQ ID NO: 2867395 - DNA, 21 bp, Homo sapiens
aatagtcaccttcatgattat

SEQ ID NO: 2867396 - DNA, 17 bp, Homo sapiens
aatatacattttctaaa

SEQ ID NO: 2867397 - DNA, 18 bp, Homo sapiens
aatatacattttctaaat

SEQ ID NO: 2867398 - DNA, 16 bp, Homo sapiens
aatatatattaagtgt

SEQ ID NO: 2867399 - DNA, 12 bp, Homo sapiens
aatatcaaataa

SEQ ID NO: 2867400 - DNA, 13 bp, Homo sapiens
aatatcataaagc

SEQ ID NO: 2867401 - DNA, 14 bp, Homo sapiens
aatatcataaagca

SEQ ID NO: 2867402 - DNA, 16 bp, Homo sapiens
aatatcataaagcatt

SEQ ID NO: 2867403 - DNA, 15 bp, Homo sapiens
aatattccctagaaa

SEQ ID NO: 2867404 - DNA, 13 bp, Homo sapiens
aatatttattacc

SEQ ID NO: 2867405 - DNA, 16 bp, Homo sapiens
aatatttattacctct

SEQ ID NO: 2867406 - DNA, 19 bp, Homo sapiens
aatatttattattttcacc

SEQ ID NO: 2867407 - DNA, 20 bp, Homo sapiens
aatatttattattttcacct

SEQ ID NO: 2867408 - DNA, 13 bp, Homo sapiens
aatcaaactgctt

SEQ ID NO: 2867409 - DNA, 21 bp, Homo sapiens
aatcaaagccggcctgagaaa

SEQ ID NO: 2867410 - DNA, 22 bp, Homo sapiens
aatcacagctcaagcattctgt

SEQ ID NO: 2867411 - DNA, 20 bp, Homo sapiens
aatcagctccttcctggaga

SEQ ID NO: 2867412 - DNA, 12 bp, Homo sapiens
aatcatttctat

SEQ ID NO: 2867413 - DNA, 18 bp, Homo sapiens
aatccatccatgtacttc

SEQ ID NO: 2867414 - DNA, 23 bp, Homo sapiens
aatccttactaagtaggtgatga

SEQ ID NO: 2867415 - DNA, 23 bp, Homo sapiens
aatcggatctggggctctgggat

SEQ ID NO: 2867416 - DNA, 14 bp, Homo sapiens
aatctaactacaag

SEQ ID NO: 2867417 - DNA, 22 bp, Homo sapiens
aatctatgaacctgaaaagggt

SEQ ID NO: 2867418 - DNA, 18 bp, Homo sapiens
aatctatggcttatttct

SEQ ID NO: 2867419 - DNA, 19 bp, Homo sapiens
aatctatggcttatttcta

SEQ ID NO: 2867420 - DNA, 15 bp, Homo sapiens
aatctatgtttataa

SEQ ID NO: 2867421 - DNA, 20 bp, Homo sapiens
aatctctttttgctttcgaa

SEQ ID NO: 2867422 - DNA, 22 bp, Homo sapiens
aatctgtcacgtagaacttgga

SEQ ID NO: 2867423 - DNA, 17 bp, Homo sapiens
aatcttggggctgatga

SEQ ID NO: 2867424 - DNA, 20 bp, Homo sapiens
aatgaactttgtcagtgttg

SEQ ID NO: 2867425 - DNA, 23 bp, Homo sapiens
aatgaatgggatattttgaaatg

SEQ ID NO: 2867426 - DNA, 15 bp, Homo sapiens
aatgaccattcaatt

SEQ ID NO: 2867427 - DNA, 15 bp, Homo sapiens
aatgataagcaggaa

SEQ ID NO: 2867428 - DNA, 15 bp, Homo sapiens
agagcctgtcaccag

SEQ ID NO: 2867429 - DNA, 16 bp, Homo sapiens
agagcctgtcaccaga

SEQ ID NO: 2867430 - DNA, 16 bp, Homo sapiens
agagctagaaaaataa

SEQ ID NO: 2867431 - DNA, 17 bp, Homo sapiens
agagctagaaaaataaa

SEQ ID NO: 2867432 - DNA, 17 bp, Homo sapiens
agagctgtattaagcca

SEQ ID NO: 2867433 - DNA, 19 bp, Homo sapiens
agagctgtattaagccact

SEQ ID NO: 2867434 - DNA, 12 bp, Homo sapiens
agagcttccctg

SEQ ID NO: 2867435 - DNA, 16 bp, Homo sapiens
agagcttccctgactc

SEQ ID NO: 2867436 - DNA, 16 bp, Homo sapiens
agagcttctctgggct

SEQ ID NO: 2867437 - DNA, 17 bp, Homo sapiens
agagcttctctgggctg

SEQ ID NO: 2867438 - DNA, 21 bp, Homo sapiens
agagcttctctgggctgaatg

SEQ ID NO: 2867439 - DNA, 16 bp, Homo sapiens
agaggaaggggccaga

SEQ ID NO: 2867440 - DNA, 18 bp, Homo sapiens
agaggaaggggccagagg

SEQ ID NO: 2867441 - DNA, 16 bp, Homo sapiens
agaggagttgccaggg

SEQ ID NO: 2867442 - DNA, 14 bp, Homo sapiens
agagggactcaagg

SEQ ID NO: 2867443 - DNA, 21 bp, Homo sapiens
agagggcagcccccactttcc

SEQ ID NO: 2867444 - DNA, 19 bp, Homo sapiens
agaggtggattcctgggca

SEQ ID NO: 2867445 - DNA, 22 bp, Homo sapiens
agaggtggattcctgggcaaga

SEQ ID NO: 2867446 - DNA, 17 bp, Homo sapiens
agagtgccagtcagcag

SEQ ID NO: 2867447 - DNA, 15 bp, Homo sapiens
agagtgtctttccac

SEQ ID NO: 2867448 - DNA, 16 bp, Homo sapiens
agataaatgagctttc

SEQ ID NO: 2867449 - DNA, 13 bp, Homo sapiens
agataaattataa

SEQ ID NO: 2867450 - DNA, 18 bp, Homo sapiens
agataatgtgaaaatggt

SEQ ID NO: 2867451 - DNA, 21 bp, Homo sapiens
agataccagcgaggaggctcc

SEQ ID NO: 2867452 - DNA, 20 bp, Homo sapiens
agatccatttggacaaaatg

SEQ ID NO: 2867453 - DNA, 22 bp, Homo sapiens
agatccatttggacaaaatgga

SEQ ID NO: 2867454 - DNA, 16 bp, Homo sapiens
agatcctgggtttcca

SEQ ID NO: 2867455 - DNA, 20 bp, Homo sapiens
agatgctccttgggcccttt

SEQ ID NO: 2867456 - DNA, 22 bp, Homo sapiens
agatggaagttgcagtgagctg

SEQ ID NO: 2867457 - DNA, 20 bp, Homo sapiens
agatgtgacccaccagtgcc

SEQ ID NO: 2867458 - DNA, 20 bp, Homo sapiens
agatgttctaagtctttcca

SEQ ID NO: 2867459 - DNA, 22 bp, Homo sapiens
agatgttctaagtctttccatt

SEQ ID NO: 2867460 - DNA, 12 bp, Homo sapiens
agattctttccc

SEQ ID NO: 2867461 - DNA, 12 bp, Homo sapiens
agattgaacttt

SEQ ID NO: 2867462 - DNA, 18 bp, Homo sapiens
agattggccaattaaaaa

SEQ ID NO: 2867463 - DNA, 17 bp, Homo sapiens
agattgtattaactatc

SEQ ID NO: 2867464 - DNA, 19 bp, Homo sapiens
agcaaaaagactggatttg

SEQ ID NO: 2867465 - DNA, 13 bp, Homo sapiens
agcaaattccaga

SEQ ID NO: 2867466 - DNA, 23 bp, Homo sapiens
agcaacgcttgtagaactcactc

SEQ ID NO: 2867467 - DNA, 12 bp, Homo sapiens
agcaatatgcat

SEQ ID NO: 2867468 - DNA, 15 bp, Homo sapiens
agcaatgtgagtccc

SEQ ID NO: 2867469 - DNA, 16 bp, Homo sapiens
agcaatgtgagtccca

SEQ ID NO: 2867470 - DNA, 21 bp, Homo sapiens
agcaattccaggctgagccat

SEQ ID NO: 2867471 - DNA, 22 bp, Homo sapiens
agcaattccaggctgagccatg

SEQ ID NO: 2867472 - DNA, 16 bp, Homo sapiens
agcaccccctcattcc

SEQ ID NO: 2867473 - DNA, 17 bp, Homo sapiens
agcactgcttgaggaaa

SEQ ID NO: 2867474 - DNA, 16 bp, Homo sapiens
agcactttgggaggct

SEQ ID NO: 2867475 - DNA, 21 bp, Homo sapiens
agcagattttaattttgaata

SEQ ID NO: 2867476 - DNA, 23 bp, Homo sapiens
agcaggaaatgaaaatgtcttgt

SEQ ID NO: 2867477 - DNA, 24 bp, Homo sapiens
agcagggaagctcttttctcctgc

SEQ ID NO: 2867478 - DNA, 20 bp, Homo sapiens
agcagtgaatgattcagtgt

SEQ ID NO: 2867479 - DNA, 18 bp, Homo sapiens
agcatctcagtggtgtgt

SEQ ID NO: 2867480 - DNA, 12 bp, Homo sapiens
agcatctgacca

SEQ ID NO: 2867481 - DNA, 18 bp, Homo sapiens
agcatctgaccatctgtg

SEQ ID NO: 2867482 - DNA, 18 bp, Homo sapiens
agcattcacaacttgttt

SEQ ID NO: 2867483 - DNA, 15 bp, Homo sapiens
agcattgcctggact

SEQ ID NO: 2867484 - DNA, 16 bp, Homo sapiens
agcattgcctggactg

SEQ ID NO: 2867485 - DNA, 20 bp, Homo sapiens
agcattgcctggactgacca

SEQ ID NO: 2867486 - DNA, 13 bp, Homo sapiens
agcattgtaatta

SEQ ID NO: 2867487 - DNA, 14 bp, Homo sapiens
agccaaaggcagct

SEQ ID NO: 2867488 - DNA, 18 bp, Homo sapiens
agccaaaggcagctaaga

SEQ ID NO: 2867489 - DNA, 15 bp, Homo sapiens
agccaacctggactt

SEQ ID NO: 2867490 - DNA, 19 bp, Homo sapiens
agccaacctggacttcctg

SEQ ID NO: 2867491 - DNA, 12 bp, Homo sapiens
agccactcctct

SEQ ID NO: 2867492 - DNA, 14 bp, Homo sapiens
agccactcctctga

SEQ ID NO: 2867493 - DNA, 17 bp, Homo sapiens
agccacttaaaatgttc

SEQ ID NO: 2867494 - DNA, 19 bp, Homo sapiens
agccagattggccaattaa

SEQ ID NO: 2867495 - DNA, 19 bp, Homo sapiens
agccagcgtcctcctctgt

SEQ ID NO: 2867496 - DNA, 13 bp, Homo sapiens
agccagctctctc

SEQ ID NO: 2867497 - DNA, 23 bp, Homo sapiens
agccaggagtaagacaagtggga

SEQ ID NO: 2867498 - DNA, 17 bp, Homo sapiens
agccatagacctacaga

SEQ ID NO: 2867499 - DNA, 20 bp, Homo sapiens
agccatagacctacagacct

SEQ ID NO: 2867500 - DNA, 19 bp, Homo sapiens
agccatgaggagcgtggac

SEQ ID NO: 2867501 - DNA, 20 bp, Homo sapiens
agccatgaggagcgtggact

SEQ ID NO: 2867502 - DNA, 23 bp, Homo sapiens
agccatgaggagcgtggactctg

SEQ ID NO: 2867503 - DNA, 20 bp, Homo sapiens
agcccaatattataattttt

SEQ ID NO: 2867504 - DNA, 14 bp, Homo sapiens
agcccagagcctgg

SEQ ID NO: 2867505 - DNA, 21 bp, Homo sapiens
agcccagagcctggctgccca

SEQ ID NO: 2867506 - DNA, 21 bp, Homo sapiens
agcccagcactgcttgaggaa

SEQ ID NO: 2867507 - DNA, 20 bp, Homo sapiens
agcccatccattaggccagc

SEQ ID NO: 2867508 - DNA, 21 bp, Homo sapiens
agcccatccattaggccagca

SEQ ID NO: 2867509 - DNA, 23 bp, Homo sapiens
agcccatccattaggccagcaac

SEQ ID NO: 2867510 - DNA, 20 bp, Homo sapiens
agccccacccctaagtgccc

SEQ ID NO: 2867511 - DNA, 21 bp, Homo sapiens
agcccctcctccagcccctgt

SEQ ID NO: 2867512 - DNA, 13 bp, Homo sapiens
agcccctgtccca

SEQ ID NO: 2867513 - DNA, 14 bp, Homo sapiens
agcccgcttttgtt

SEQ ID NO: 2867514 - DNA, 22 bp, Homo sapiens
agcccgcttttgttcttcccca

SEQ ID NO: 2867515 - DNA, 16 bp, Homo sapiens
agccctcatcccgagc

SEQ ID NO: 2867516 - DNA, 15 bp, Homo sapiens
agccgactctggccc

SEQ ID NO: 2867517 - DNA, 20 bp, Homo sapiens
agccgactctggccctggcc

SEQ ID NO: 2867518 - DNA, 14 bp, Homo sapiens
agccgaggggagag

SEQ ID NO: 2867519 - DNA, 15 bp, Homo sapiens
agccgaggggagaga

SEQ ID NO: 2867520 - DNA, 20 bp, Homo sapiens
agccgaggggagagagggac

SEQ ID NO: 2867521 - DNA, 16 bp, Homo sapiens
agccgtggtcctttgg

SEQ ID NO: 2867522 - DNA, 14 bp, Homo sapiens
agcctacctgtatg

SEQ ID NO: 2867523 - DNA, 15 bp, Homo sapiens
agcctcccccaaagc

SEQ ID NO: 2867524 - DNA, 16 bp, Homo sapiens
agcctcccctgccagg

SEQ ID NO: 2867525 - DNA, 14 bp, Homo sapiens
agcctccttctttc

SEQ ID NO: 2867526 - DNA, 17 bp, Homo sapiens
agcctggagggatgcca

SEQ ID NO: 2867527 - DNA, 20 bp, Homo sapiens
agcctggatgccaaggagcc

SEQ ID NO: 2867528 - DNA, 16 bp, Homo sapiens
agcctggccccatggt

SEQ ID NO: 2867529 - DNA, 16 bp, Homo sapiens
agcctgtcaccagagc

SEQ ID NO: 2867530 - DNA, 18 bp, Homo sapiens
agcctgtcaccagagctt

SEQ ID NO: 2867531 - DNA, 19 bp, Homo sapiens
agcctgtcaccagagcttc

SEQ ID NO: 2867532 - DNA, 12 bp, Homo sapiens
agcggcagagca

SEQ ID NO: 2867533 - DNA, 15 bp, Homo sapiens
agcgtggactctgct

SEQ ID NO: 2867534 - DNA, 18 bp, Homo sapiens
agctaagatagaaagctg

SEQ ID NO: 2867535 - DNA, 14 bp, Homo sapiens
agctaataaaccag

SEQ ID NO: 2867536 - DNA, 17 bp, Homo sapiens
agctacttgggaggctg

SEQ ID NO: 2867537 - DNA, 17 bp, Homo sapiens
agctctctaggcctctc

SEQ ID NO: 2867538 - DNA, 16 bp, Homo sapiens
atcttttttttttccc

SEQ ID NO: 2867539 - DNA, 13 bp, Homo sapiens
atgaaaatgtctt

SEQ ID NO: 2867540 - DNA, 15 bp, Homo sapiens
atgaaaatgtcttgt

SEQ ID NO: 2867541 - DNA, 12 bp, Homo sapiens
atgaaacttctc

SEQ ID NO: 2867542 - DNA, 13 bp, Homo sapiens
atgaaacttctca

SEQ ID NO: 2867543 - DNA, 13 bp, Homo sapiens
atgaactttgtca

SEQ ID NO: 2867544 - DNA, 17 bp, Homo sapiens
atgaagaagggggtggg

SEQ ID NO: 2867545 - DNA, 15 bp, Homo sapiens
atgaatgaatgggat

SEQ ID NO: 2867546 - DNA, 22 bp, Homo sapiens
atgaatgataagcaggaaggat

SEQ ID NO: 2867547 - DNA, 19 bp, Homo sapiens
atgaatgggatattttgaa

SEQ ID NO: 2867548 - DNA, 19 bp, Homo sapiens
atgagacagacattcacct

SEQ ID NO: 2867549 - DNA, 17 bp, Homo sapiens
atgaggagcgtggactc

SEQ ID NO: 2867550 - DNA, 13 bp, Homo sapiens
atgagggggtggt

SEQ ID NO: 2867551 - DNA, 23 bp, Homo sapiens
atgagggggtggttattggactc

SEQ ID NO: 2867552 - DNA, 14 bp, Homo sapiens
atgagtacctcaaa

SEQ ID NO: 2867553 - DNA, 22 bp, Homo sapiens
atgatgttatacatcaatatgt

SEQ ID NO: 2867554 - DNA, 21 bp, Homo sapiens
atgatttccctccagagaaag

SEQ ID NO: 2867555 - DNA, 17 bp, Homo sapiens
atgcaagccccaacttt

SEQ ID NO: 2867556 - DNA, 18 bp, Homo sapiens
atgcaagccccaactttc

SEQ ID NO: 2867557 - DNA, 15 bp, Homo sapiens
atgcaattcagtgtt

SEQ ID NO: 2867558 - DNA, 19 bp, Homo sapiens
atgcacttataattttcct

SEQ ID NO: 2867559 - DNA, 13 bp, Homo sapiens
atgcagaagcaat

SEQ ID NO: 2867560 - DNA, 16 bp, Homo sapiens
atgcatcatcagccta

SEQ ID NO: 2867561 - DNA, 20 bp, Homo sapiens
atgccacccagcaacacaga

SEQ ID NO: 2867562 - DNA, 11 bp, Homo sapiens
atgccagagcc

SEQ ID NO: 2867563 - DNA, 13 bp, Homo sapiens
atgccagagccaa

SEQ ID NO: 2867564 - DNA, 18 bp, Homo sapiens
atgccagagccaacctgg

SEQ ID NO: 2867565 - DNA, 19 bp, Homo sapiens
atgccagagccaacctgga

SEQ ID NO: 2867566 - DNA, 22 bp, Homo sapiens
atgccagagccaacctggactt

SEQ ID NO: 2867567 - DNA, 24 bp, Homo sapiens
atgccagagccaacctggacttcc

SEQ ID NO: 2867568 - DNA, 15 bp, Homo sapiens
atgccatcatctcct

SEQ ID NO: 2867569 - DNA, 22 bp, Homo sapiens
atgcccagacatcagcctcctt

SEQ ID NO: 2867570 - DNA, 20 bp, Homo sapiens
atgcccctgtactccagcct

SEQ ID NO: 2867571 - DNA, 18 bp, Homo sapiens
atgcctaatatttaggca

SEQ ID NO: 2867572 - DNA, 15 bp, Homo sapiens
atgctaaatgtgtaa

SEQ ID NO: 2867573 - DNA, 20 bp, Homo sapiens
atgctcccacctgaatttgt

SEQ ID NO: 2867574 - DNA, 22 bp, Homo sapiens
atgctcccacctgaatttgtat

SEQ ID NO: 2867575 - DNA, 15 bp, Homo sapiens
atgctccttgggccc

SEQ ID NO: 2867576 - DNA, 21 bp, Homo sapiens
atgctgatcttttaaaatcat

SEQ ID NO: 2867577 - DNA, 20 bp, Homo sapiens
atgctgtttctaagaaaatg

SEQ ID NO: 2867578 - DNA, 13 bp, Homo sapiens
atgcttcattatt

SEQ ID NO: 2867579 - DNA, 21 bp, Homo sapiens
atggagtgggagatcagccac

SEQ ID NO: 2867580 - DNA, 19 bp, Homo sapiens
atggatgcccagaggactc

SEQ ID NO: 2867581 - DNA, 15 bp, Homo sapiens
atggcatcttcaata

SEQ ID NO: 2867582 - DNA, 23 bp, Homo sapiens
atggcatttctctttaaactatg

SEQ ID NO: 2867583 - DNA, 14 bp, Homo sapiens
atggcttatttcta

SEQ ID NO: 2867584 - DNA, 12 bp, Homo sapiens
atgggagccagg

SEQ ID NO: 2867585 - DNA, 13 bp, Homo sapiens
atgggagccagga

SEQ ID NO: 2867586 - DNA, 16 bp, Homo sapiens
atgggctgtgattact

SEQ ID NO: 2867587 - DNA, 20 bp, Homo sapiens
atgggctgtgattactgcaa

SEQ ID NO: 2867588 - DNA, 21 bp, Homo sapiens
atgggctgtgattactgcaat

SEQ ID NO: 2867589 - DNA, 19 bp, Homo sapiens
atgggggagattgaacttt

SEQ ID NO: 2867590 - DNA, 19 bp, Homo sapiens
atggtcctatttttgtgaa

SEQ ID NO: 2867591 - DNA, 21 bp, Homo sapiens
atggtcctatttttgtgaaga

SEQ ID NO: 2867592 - DNA, 24 bp, Homo sapiens
atggtgaaaccccgtctctactaa

SEQ ID NO: 2867593 - DNA, 22 bp, Homo sapiens
atggtgaagggaagtggggagt

SEQ ID NO: 2867594 - DNA, 17 bp, Homo sapiens
atggtgtggtgaatgtg

SEQ ID NO: 2867595 - DNA, 19 bp, Homo sapiens
atggtgtggtgaatgtgtg

SEQ ID NO: 2867596 - DNA, 12 bp, Homo sapiens
atgtaacatgat

SEQ ID NO: 2867597 - DNA, 23 bp, Homo sapiens
atgtaacatgatttccctccaga

SEQ ID NO: 2867598 - DNA, 13 bp, Homo sapiens
atgtaatttcaaa

SEQ ID NO: 2867599 - DNA, 17 bp, Homo sapiens
atgtaatttcaaaatac

SEQ ID NO: 2867600 - DNA, 14 bp, Homo sapiens
atgtacaaaaatta

SEQ ID NO: 2867601 - DNA, 17 bp, Homo sapiens
atgtacatagaccctct

SEQ ID NO: 2867602 - DNA, 12 bp, Homo sapiens
atgtacttccct

SEQ ID NO: 2867603 - DNA, 14 bp, Homo sapiens
atgtaggaagtagg

SEQ ID NO: 2867604 - DNA, 13 bp, Homo sapiens
atgtatatatgta

SEQ ID NO: 2867605 - DNA, 20 bp, Homo sapiens
atgtatccaaggaaacattt

SEQ ID NO: 2867606 - DNA, 22 bp, Homo sapiens
atgtatccaaggaaacatttta

SEQ ID NO: 2867607 - DNA, 21 bp, Homo sapiens
atgtattttttgaatctatga

SEQ ID NO: 2867608 - DNA, 23 bp, Homo sapiens
atgtcaatgaccattcaattagt

SEQ ID NO: 2867609 - DNA, 16 bp, Homo sapiens
atgtcacctacatatg

SEQ ID NO: 2867610 - DNA, 23 bp, Homo sapiens
atgtcagtgctataaatgccaga

SEQ ID NO: 2867611 - DNA, 23 bp, Homo sapiens
atgtcttgatgcatgcactgttc

SEQ ID NO: 2867612 - DNA, 11 bp, Homo sapiens
atgtcttgtgt

SEQ ID NO: 2867613 - DNA, 15 bp, Homo sapiens
atgtgaaaaattaac

SEQ ID NO: 2867614 - DNA, 17 bp, Homo sapiens
atgtgacccaccagtgc

SEQ ID NO: 2867615 - DNA, 19 bp, Homo sapiens
atgtgatgaatactgtatt

SEQ ID NO: 2867616 - DNA, 22 bp, Homo sapiens
atgtggtctgccaatctgtaca

SEQ ID NO: 2867617 - DNA, 15 bp, Homo sapiens
atgtgtaataatgta

SEQ ID NO: 2867618 - DNA, 21 bp, Homo sapiens
atgtgtaataatgtaacatga

SEQ ID NO: 2867619 - DNA, 16 bp, Homo sapiens
atgtgtgagaaaaact

SEQ ID NO: 2867620 - DNA, 22 bp, Homo sapiens
atgtgtgtccacgactgtctcc

SEQ ID NO: 2867621 - DNA, 23 bp, Homo sapiens
atgtgtgtccacgactgtctcca

SEQ ID NO: 2867622 - DNA, 17 bp, Homo sapiens
atgttcccaaaacaatg

SEQ ID NO: 2867623 - DNA, 18 bp, Homo sapiens
atgttcctaacaaaatga

SEQ ID NO: 2867624 - DNA, 19 bp, Homo sapiens
atgttcctaacaaaatgag

SEQ ID NO: 2867625 - DNA, 19 bp, Homo sapiens
atgtttaaaagaaatatat

SEQ ID NO: 2867626 - DNA, 20 bp, Homo sapiens
atgtttaaaagaaatatatt

SEQ ID NO: 2867627 - DNA, 13 bp, Homo sapiens
atgtttgaacaaa

SEQ ID NO: 2867628 - DNA, 14 bp, Homo sapiens
atgtttttctgtat

SEQ ID NO: 2867629 - DNA, 18 bp, Homo sapiens
atgtttttctgtataaca

SEQ ID NO: 2867630 - DNA, 23 bp, Homo sapiens
atgtttttgttttaaaacgtgta

SEQ ID NO: 2867631 - DNA, 18 bp, Homo sapiens
attaaaaacgaaaacctg

SEQ ID NO: 2867632 - DNA, 13 bp, Homo sapiens
attaaaacaaata

SEQ ID NO: 2867633 - DNA, 14 bp, Homo sapiens
attaaataacatgt

SEQ ID NO: 2867634 - DNA, 22 bp, Homo sapiens
attaaccaaccttgtttaatag

SEQ ID NO: 2867635 - DNA, 21 bp, Homo sapiens
attaactatcttctttggact

SEQ ID NO: 2867636 - DNA, 17 bp, Homo sapiens
attaactgtgaaatgta

SEQ ID NO: 2867637 - DNA, 16 bp, Homo sapiens
attaactgttgcactt

SEQ ID NO: 2867638 - DNA, 21 bp, Homo sapiens
attaactgttgcacttttgaa

SEQ ID NO: 2867639 - DNA, 17 bp, Homo sapiens
attaagccacttaaaat

SEQ ID NO: 2867640 - DNA, 19 bp, Homo sapiens
attaattcaccttccagtg

SEQ ID NO: 2867641 - DNA, 13 bp, Homo sapiens
attacctcctgag

SEQ ID NO: 2867642 - DNA, 21 bp, Homo sapiens
attactgaataatatcaaata

SEQ ID NO: 2867643 - DNA, 15 bp, Homo sapiens
attactgcaatcact

SEQ ID NO: 2867644 - DNA, 23 bp, Homo sapiens
attagaaacaaacaaaactctta

SEQ ID NO: 2867645 - DNA, 18 bp, Homo sapiens
attagacttgaaatacgt

SEQ ID NO: 2867646 - DNA, 18 bp, Homo sapiens
attagccgggcatggtgg

SEQ ID NO: 2867647 - DNA, 17 bp, Homo sapiens
cactctcccctccctct

SEQ ID NO: 2867648 - DNA, 15 bp, Homo sapiens
cactctcccttgtac

SEQ ID NO: 2867649 - DNA, 16 bp, Homo sapiens
cactctgcttgttatt

SEQ ID NO: 2867650 - DNA, 16 bp, Homo sapiens
cactcttttgctgtgc

SEQ ID NO: 2867651 - DNA, 19 bp, Homo sapiens
cactgagataccagcgagg

SEQ ID NO: 2867652 - DNA, 11 bp, Homo sapiens
cactgaggaga

SEQ ID NO: 2867653 - DNA, 21 bp, Homo sapiens
cactgaggagacagaaagcct

SEQ ID NO: 2867654 - DNA, 22 bp, Homo sapiens
cactgaggagacagaaagcctc

SEQ ID NO: 2867655 - DNA, 14 bp, Homo sapiens
cactgagggcagtc

SEQ ID NO: 2867656 - DNA, 20 bp, Homo sapiens
cactgagttttgtttcactt

SEQ ID NO: 2867657 - DNA, 17 bp, Homo sapiens
cactgcctgcctcccct

SEQ ID NO: 2867658 - DNA, 18 bp, Homo sapiens
cactgccttcgtttatat

SEQ ID NO: 2867659 - DNA, 20 bp, Homo sapiens
cactgccttcgtttatattt

SEQ ID NO: 2867660 - DNA, 22 bp, Homo sapiens
cactgccttcgtttatattttt

SEQ ID NO: 2867661 - DNA, 14 bp, Homo sapiens
cactgcggaagcca

SEQ ID NO: 2867662 - DNA, 15 bp, Homo sapiens
cactgcggaagccaa

SEQ ID NO: 2867663 - DNA, 18 bp, Homo sapiens
cactgcggaagccaaagg

SEQ ID NO: 2867664 - DNA, 14 bp, Homo sapiens
cactgcttgaggaa

SEQ ID NO: 2867665 - DNA, 19 bp, Homo sapiens
cactggtaggttgggacac

SEQ ID NO: 2867666 - DNA, 14 bp, Homo sapiens
cactgtccttccct

SEQ ID NO: 2867667 - DNA, 22 bp, Homo sapiens
cacttcaacccccagctaataa

SEQ ID NO: 2867668 - DNA, 22 bp, Homo sapiens
cacttcattcttgaaagctgtg

SEQ ID NO: 2867669 - DNA, 18 bp, Homo sapiens
cacttgaggtcaggagtt

SEQ ID NO: 2867670 - DNA, 16 bp, Homo sapiens
cactttaaccctctct

SEQ ID NO: 2867671 - DNA, 19 bp, Homo sapiens
cactttaaccctctcttcc

SEQ ID NO: 2867672 - DNA, 13 bp, Homo sapiens
cactttgggaggc

SEQ ID NO: 2867673 - DNA, 11 bp, Homo sapiens
cagaaaaccac

SEQ ID NO: 2867674 - DNA, 20 bp, Homo sapiens
cagaaagcctccgctgggct

SEQ ID NO: 2867675 - DNA, 22 bp, Homo sapiens
cagaaagcctccgctgggcttc

SEQ ID NO: 2867676 - DNA, 17 bp, Homo sapiens
cagaacccccaggtggc

SEQ ID NO: 2867677 - DNA, 15 bp, Homo sapiens
cagaactctttcaaa

SEQ ID NO: 2867678 - DNA, 19 bp, Homo sapiens
cagaacttcagcattgtaa

SEQ ID NO: 2867679 - DNA, 14 bp, Homo sapiens
cagaagcattgcct

SEQ ID NO: 2867680 - DNA, 20 bp, Homo sapiens
cagaagcattgcctggactg

SEQ ID NO: 2867681 - DNA, 21 bp, Homo sapiens
cagaagcattgcctggactga

SEQ ID NO: 2867682 - DNA, 16 bp, Homo sapiens
cagaaggatgcccaga

SEQ ID NO: 2867683 - DNA, 14 bp, Homo sapiens
cagaaggtgaactt

SEQ ID NO: 2867684 - DNA, 20 bp, Homo sapiens
cagaaggtgaactttgtgct

SEQ ID NO: 2867685 - DNA, 21 bp, Homo sapiens
cagaataccttcttcgctgct

SEQ ID NO: 2867686 - DNA, 16 bp, Homo sapiens
cagaatttttaactgt

SEQ ID NO: 2867687 - DNA, 18 bp, Homo sapiens
cagaatttttaactgtac

SEQ ID NO: 2867688 - DNA, 19 bp, Homo sapiens
cagacattcacctgtatat

SEQ ID NO: 2867689 - DNA, 15 bp, Homo sapiens
cagacccacacatgt

SEQ ID NO: 2867690 - DNA, 13 bp, Homo sapiens
cagacctggctct

SEQ ID NO: 2867691 - DNA, 16 bp, Homo sapiens
cagacgcctgaggaac

SEQ ID NO: 2867692 - DNA, 16 bp, Homo sapiens
cagactcagctccaga

SEQ ID NO: 2867693 - DNA, 15 bp, Homo sapiens
cagagaccccttcct

SEQ ID NO: 2867694 - DNA, 16 bp, Homo sapiens
cagagaccccttcctt

SEQ ID NO: 2867695 - DNA, 19 bp, Homo sapiens
cagagacttggggaccaga

SEQ ID NO: 2867696 - DNA, 20 bp, Homo sapiens
cagagacttggggaccagag

SEQ ID NO: 2867697 - DNA, 18 bp, Homo sapiens
cagagaggagttgccagg

SEQ ID NO: 2867698 - DNA, 16 bp, Homo sapiens
cagagcaattccaggc

SEQ ID NO: 2867699 - DNA, 15 bp, Homo sapiens
cagagcagagagcag

SEQ ID NO: 2867700 - DNA, 17 bp, Homo sapiens
cagagccaacctggact

SEQ ID NO: 2867701 - DNA, 20 bp, Homo sapiens
cagagccaacctggacttcc

SEQ ID NO: 2867702 - DNA, 22 bp, Homo sapiens
cagagccaacctggacttcctg

SEQ ID NO: 2867703 - DNA, 20 bp, Homo sapiens
cagagccgtggtcctttggg

SEQ ID NO: 2867704 - DNA, 23 bp, Homo sapiens
cagagctggcgactgcagctgca

SEQ ID NO: 2867705 - DNA, 13 bp, Homo sapiens
cagagcttccctg

SEQ ID NO: 2867706 - DNA, 23 bp, Homo sapiens
cagagcttccctgactcattctg

SEQ ID NO: 2867707 - DNA, 16 bp, Homo sapiens
cagagcttctctgggc

SEQ ID NO: 2867708 - DNA, 20 bp, Homo sapiens
cagaggaaaaatgggagcca

SEQ ID NO: 2867709 - DNA, 18 bp, Homo sapiens
cagaggaaggggccagag

SEQ ID NO: 2867710 - DNA, 20 bp, Homo sapiens
cagaggaaggggccagaggc

SEQ ID NO: 2867711 - DNA, 21 bp, Homo sapiens
cagaggattgctgccccatca

SEQ ID NO: 2867712 - DNA, 19 bp, Homo sapiens
cagaggccctcgctgccag

SEQ ID NO: 2867713 - DNA, 20 bp, Homo sapiens
cagaggccctcgctgccagc

SEQ ID NO: 2867714 - DNA, 14 bp, Homo sapiens
cagagggcactctg

SEQ ID NO: 2867715 - DNA, 20 bp, Homo sapiens
cagagtctgtatttttctaa

SEQ ID NO: 2867716 - DNA, 17 bp, Homo sapiens
cagagtttttaaagcct

SEQ ID NO: 2867717 - DNA, 20 bp, Homo sapiens
cagagtttttaaagccttct

SEQ ID NO: 2867718 - DNA, 19 bp, Homo sapiens
cagatcttttttttttccc

SEQ ID NO: 2867719 - DNA, 19 bp, Homo sapiens
cagatgatgctttggaaga

SEQ ID NO: 2867720 - DNA, 15 bp, Homo sapiens
cagattggccaatta

SEQ ID NO: 2867721 - DNA, 23 bp, Homo sapiens
cagattttaattttgaataaata

SEQ ID NO: 2867722 - DNA, 21 bp, Homo sapiens
cagcaaacactccaccctcca

SEQ ID NO: 2867723 - DNA, 16 bp, Homo sapiens
cagcaaattccagatt

SEQ ID NO: 2867724 - DNA, 14 bp, Homo sapiens
cagcaacacagagc

SEQ ID NO: 2867725 - DNA, 18 bp, Homo sapiens
cagcaacgcttgtagaac

SEQ ID NO: 2867726 - DNA, 16 bp, Homo sapiens
cagcactgcttgagga

SEQ ID NO: 2867727 - DNA, 17 bp, Homo sapiens
cagcactttaaccctct

SEQ ID NO: 2867728 - DNA, 20 bp, Homo sapiens
cagcactttaaccctctctt

SEQ ID NO: 2867729 - DNA, 23 bp, Homo sapiens
cagcactttaaccctctcttccc

SEQ ID NO: 2867730 - DNA, 16 bp, Homo sapiens
cagcactttgggaggc

SEQ ID NO: 2867731 - DNA, 22 bp, Homo sapiens
cagcagctcaacctaccctggt

SEQ ID NO: 2867732 - DNA, 14 bp, Homo sapiens
cagcagggaagctc

SEQ ID NO: 2867733 - DNA, 11 bp, Homo sapiens
cagcagggcta

SEQ ID NO: 2867734 - DNA, 19 bp, Homo sapiens
cagcagtgtgaggccaggg

SEQ ID NO: 2867735 - DNA, 13 bp, Homo sapiens
cagcatctgacca

SEQ ID NO: 2867736 - DNA, 17 bp, Homo sapiens
cagcatctgaccatctg

SEQ ID NO: 2867737 - DNA, 18 bp, Homo sapiens
cagcatctgaccatctgt

SEQ ID NO: 2867738 - DNA, 21 bp, Homo sapiens
cagcatctgaccatctgtgac

SEQ ID NO: 2867739 - DNA, 22 bp, Homo sapiens
cagcatctgaccatctgtgact

SEQ ID NO: 2867740 - DNA, 13 bp, Homo sapiens
cagcattgtaatt

SEQ ID NO: 2867741 - DNA, 18 bp, Homo sapiens
cagcattgtaattatgta

SEQ ID NO: 2867742 - DNA, 12 bp, Homo sapiens
cagcccatccat

SEQ ID NO: 2867743 - DNA, 18 bp, Homo sapiens
cagcccatccattaggcc

SEQ ID NO: 2867744 - DNA, 21 bp, Homo sapiens
cagcccatccattaggccagc

SEQ ID NO: 2867745 - DNA, 14 bp, Homo sapiens
cagcccctgtccca

SEQ ID NO: 2867746 - DNA, 13 bp, Homo sapiens
cagccctcatccc

SEQ ID NO: 2867747 - DNA, 19 bp, Homo sapiens
cagccgctgagcgaggaga

SEQ ID NO: 2867748 - DNA, 21 bp, Homo sapiens
cagcctgctctagtgggacag

SEQ ID NO: 2867749 - DNA, 13 bp, Homo sapiens
cagcggcagagca

SEQ ID NO: 2867750 - DNA, 15 bp, Homo sapiens
cagcgtgctttaaaa

SEQ ID NO: 2867751 - DNA, 23 bp, Homo sapiens
cagctaagatagaaagctggact

SEQ ID NO: 2867752 - DNA, 16 bp, Homo sapiens
cagctacttgggaggc

SEQ ID NO: 2867753 - DNA, 15 bp, Homo sapiens
cagctcaacctaccc

SEQ ID NO: 2867754 - DNA, 13 bp, Homo sapiens
cagctccttcctg

SEQ ID NO: 2867755 - DNA, 16 bp, Homo sapiens
cagctctctctacccg

SEQ ID NO: 2867756 - DNA, 18 bp, Homo sapiens
cagctctgaaaccagtgt

SEQ ID NO: 2867757 - DNA, 20 bp, Homo sapiens
ccagctgggcctcctgcctc

SEQ ID NO: 2867758 - DNA, 16 bp, Homo sapiens
ccagcttgttatttat

SEQ ID NO: 2867759 - DNA, 17 bp, Homo sapiens
ccagcttgttatttata

SEQ ID NO: 2867760 - DNA, 16 bp, Homo sapiens
ccaggcaggggtggga

SEQ ID NO: 2867761 - DNA, 18 bp, Homo sapiens
ccaggcaggggtgggaga

SEQ ID NO: 2867762 - DNA, 19 bp, Homo sapiens
ccaggcaggggtgggagag

SEQ ID NO: 2867763 - DNA, 13 bp, Homo sapiens
ccaggcctgacca

SEQ ID NO: 2867764 - DNA, 15 bp, Homo sapiens
ccaggcctgaccagg

SEQ ID NO: 2867765 - DNA, 13 bp, Homo sapiens
ccaggcctgttgc

SEQ ID NO: 2867766 - DNA, 16 bp, Homo sapiens
ccaggctgagccatga

SEQ ID NO: 2867767 - DNA, 18 bp, Homo sapiens
ccagggttgaccccagag

SEQ ID NO: 2867768 - DNA, 12 bp, Homo sapiens
ccaggtggcctg

SEQ ID NO: 2867769 - DNA, 16 bp, Homo sapiens
ccagtcagcagtcatg

SEQ ID NO: 2867770 - DNA, 16 bp, Homo sapiens
ccagttaagaatggaa

SEQ ID NO: 2867771 - DNA, 12 bp, Homo sapiens
ccagtttcccac

SEQ ID NO: 2867772 - DNA, 13 bp, Homo sapiens
ccagtttcccacc

SEQ ID NO: 2867773 - DNA, 17 bp, Homo sapiens
ccagtttgcacctgtcc

SEQ ID NO: 2867774 - DNA, 24 bp, Homo sapiens
ccatagacctacagacctggctct

SEQ ID NO: 2867775 - DNA, 11 bp, Homo sapiens
ccatattttaa

SEQ ID NO: 2867776 - DNA, 18 bp, Homo sapiens
ccatcaacaaaaattgtc

SEQ ID NO: 2867777 - DNA, 14 bp, Homo sapiens
ccatcagggtgggc

SEQ ID NO: 2867778 - DNA, 16 bp, Homo sapiens
ccatccattaggccag

SEQ ID NO: 2867779 - DNA, 17 bp, Homo sapiens
ccatccattaggccagc

SEQ ID NO: 2867780 - DNA, 14 bp, Homo sapiens
ccatcccctttcct

SEQ ID NO: 2867781 - DNA, 15 bp, Homo sapiens
ccatcccctttcctc

SEQ ID NO: 2867782 - DNA, 15 bp, Homo sapiens
ccatctggctttttc

SEQ ID NO: 2867783 - DNA, 16 bp, Homo sapiens
ccatctggctttttct

SEQ ID NO: 2867784 - DNA, 21 bp, Homo sapiens
ccatgaggagcgtggactctg

SEQ ID NO: 2867785 - DNA, 14 bp, Homo sapiens
ccatgggcagagcc

SEQ ID NO: 2867786 - DNA, 16 bp, Homo sapiens
ccatgggcagagccca

SEQ ID NO: 2867787 - DNA, 16 bp, Homo sapiens
ccatgtagaaaatttg

SEQ ID NO: 2867788 - DNA, 16 bp, Homo sapiens
ccattaggcatgccta

SEQ ID NO: 2867789 - DNA, 13 bp, Homo sapiens
ccattaggccagc

SEQ ID NO: 2867790 - DNA, 14 bp, Homo sapiens
ccattaggccagca

SEQ ID NO: 2867791 - DNA, 23 bp, Homo sapiens
ccattgaagccgactctggccct

SEQ ID NO: 2867792 - DNA, 13 bp, Homo sapiens
ccatttctattta

SEQ ID NO: 2867793 - DNA, 17 bp, Homo sapiens
ccatttctatttattta

SEQ ID NO: 2867794 - DNA, 19 bp, Homo sapiens
cccaaagtggggagggaca

SEQ ID NO: 2867795 - DNA, 20 bp, Homo sapiens
cccaaccctggcttggggtc

SEQ ID NO: 2867796 - DNA, 11 bp, Homo sapiens
cccaatattat

SEQ ID NO: 2867797 - DNA, 15 bp, Homo sapiens
cccaatccatcgtat

SEQ ID NO: 2867798 - DNA, 20 bp, Homo sapiens
cccacacatgtttacagaac

SEQ ID NO: 2867799 - DNA, 12 bp, Homo sapiens
cccacagccata

SEQ ID NO: 2867800 - DNA, 20 bp, Homo sapiens
cccacaggcacattaactgt

SEQ ID NO: 2867801 - DNA, 23 bp, Homo sapiens
cccaccaccttggactcctccca

SEQ ID NO: 2867802 - DNA, 11 bp, Homo sapiens
cccaccagtgc

SEQ ID NO: 2867803 - DNA, 13 bp, Homo sapiens
cccaccagtgcct

SEQ ID NO: 2867804 - DNA, 17 bp, Homo sapiens
cccacccctaagtgccc

SEQ ID NO: 2867805 - DNA, 13 bp, Homo sapiens
cccaccctccact

SEQ ID NO: 2867806 - DNA, 13 bp, Homo sapiens
cccaccttcccca

SEQ ID NO: 2867807 - DNA, 15 bp, Homo sapiens
cccactactgcagca

SEQ ID NO: 2867808 - DNA, 19 bp, Homo sapiens
cccactttcctacaaaatg

SEQ ID NO: 2867809 - DNA, 24 bp, Homo sapiens
cccagaccaggaaaggcttggctg

SEQ ID NO: 2867810 - DNA, 16 bp, Homo sapiens
cccagactcagctcca

SEQ ID NO: 2867811 - DNA, 21 bp, Homo sapiens
cccagagaccccttcctttcc

SEQ ID NO: 2867812 - DNA, 15 bp, Homo sapiens
cccagcactttggga

SEQ ID NO: 2867813 - DNA, 20 bp, Homo sapiens
cccagcagctcaacctaccc

SEQ ID NO: 2867814 - DNA, 16 bp, Homo sapiens
cccagctaataaacca

SEQ ID NO: 2867815 - DNA, 17 bp, Homo sapiens
cccagctaataaaccag

SEQ ID NO: 2867816 - DNA, 18 bp, Homo sapiens
cccagctaataaaccaga

SEQ ID NO: 2867817 - DNA, 14 bp, Homo sapiens
cccagctctgaaac

SEQ ID NO: 2867818 - DNA, 18 bp, Homo sapiens
cccagctcttctcttcct

SEQ ID NO: 2867819 - DNA, 22 bp, Homo sapiens
cccatcagtgctccctcacatg

SEQ ID NO: 2867820 - DNA, 14 bp, Homo sapiens
cccatccattaggc

SEQ ID NO: 2867821 - DNA, 15 bp, Homo sapiens
cccatccattaggcc

SEQ ID NO: 2867822 - DNA, 19 bp, Homo sapiens
cccatccattaggccagca

SEQ ID NO: 2867823 - DNA, 14 bp, Homo sapiens
cccatcccctttcc

SEQ ID NO: 2867824 - DNA, 16 bp, Homo sapiens
cccatcccctttcctc

SEQ ID NO: 2867825 - DNA, 13 bp, Homo sapiens
cccatctggcttt

SEQ ID NO: 2867826 - DNA, 22 bp, Homo sapiens
ccccacaggcacattaactgtt

SEQ ID NO: 2867827 - DNA, 19 bp, Homo sapiens
ccccacccctaagtgccca

SEQ ID NO: 2867828 - DNA, 20 bp, Homo sapiens
ccccacccctaagtgcccaa

SEQ ID NO: 2867829 - DNA, 19 bp, Homo sapiens
ccccactactgcagcacct

SEQ ID NO: 2867830 - DNA, 21 bp, Homo sapiens
ccccactactgcagcacctcc

SEQ ID NO: 2867831 - DNA, 21 bp, Homo sapiens
ccccactttcctacaaaatgg

SEQ ID NO: 2867832 - DNA, 19 bp, Homo sapiens
ccccagactcagctccaga

SEQ ID NO: 2867833 - DNA, 23 bp, Homo sapiens
ccccagcccatccattaggccag

SEQ ID NO: 2867834 - DNA, 18 bp, Homo sapiens
ccccagctaataaaccag

SEQ ID NO: 2867835 - DNA, 21 bp, Homo sapiens
ccccaggtggcctgcgtcttt

SEQ ID NO: 2867836 - DNA, 13 bp, Homo sapiens
ccccatcagtgct

SEQ ID NO: 2867837 - DNA, 17 bp, Homo sapiens
ccccatttctatttatt

SEQ ID NO: 2867838 - DNA, 20 bp, Homo sapiens
ccccatttctatttatttac

SEQ ID NO: 2867839 - DNA, 19 bp, Homo sapiens
cccctaagtgcccaaagtg

SEQ ID NO: 2867840 - DNA, 13 bp, Homo sapiens
cccctccgcagca

SEQ ID NO: 2867841 - DNA, 22 bp, Homo sapiens
cccctcctccagcccctgtccc

SEQ ID NO: 2867842 - DNA, 19 bp, Homo sapiens
cccctcgtgtgactctctt

SEQ ID NO: 2867843 - DNA, 11 bp, Homo sapiens
cccctgtgcag

SEQ ID NO: 2867844 - DNA, 19 bp, Homo sapiens
cccctgtgcagccgctgag

SEQ ID NO: 2867845 - DNA, 21 bp, Homo sapiens
ccccttaccccaaagagaaag

SEQ ID NO: 2867846 - DNA, 14 bp, Homo sapiens
cccctttcctcccc

SEQ ID NO: 2867847 - DNA, 23 bp, Homo sapiens
cccgagatgtgacccaccagtgc

SEQ ID NO: 2867848 - DNA, 11 bp, Homo sapiens
cccggggagga

SEQ ID NO: 2867849 - DNA, 14 bp, Homo sapiens
ccctaagtgcccaa

SEQ ID NO: 2867850 - DNA, 16 bp, Homo sapiens
ccctaagtgcccaaag

SEQ ID NO: 2867851 - DNA, 12 bp, Homo sapiens
ccctcattcccc

SEQ ID NO: 2867852 - DNA, 15 bp, Homo sapiens
ccctccaccttccat

SEQ ID NO: 2867853 - DNA, 14 bp, Homo sapiens
ccctccctctccca

SEQ ID NO: 2867854 - DNA, 23 bp, Homo sapiens
ccctccgcagcagggaagctctt

SEQ ID NO: 2867855 - DNA, 19 bp, Homo sapiens
ccctcctccagcccctgtc

SEQ ID NO: 2867856 - DNA, 15 bp, Homo sapiens
ccctctacagagctt

SEQ ID NO: 2867857 - DNA, 21 bp, Homo sapiens
ccctctcactccccagcccca

SEQ ID NO: 2867858 - DNA, 16 bp, Homo sapiens
ccctctcccaggcccg

SEQ ID NO: 2867859 - DNA, 15 bp, Homo sapiens
ccctctctgctctgc

SEQ ID NO: 2867860 - DNA, 23 bp, Homo sapiens
ccctctttcttgtttgtcagcat

SEQ ID NO: 2867861 - DNA, 17 bp, Homo sapiens
ccctgacctccctctaa

SEQ ID NO: 2867862 - DNA, 15 bp, Homo sapiens
ccctgactcattctg

SEQ ID NO: 2867863 - DNA, 19 bp, Homo sapiens
ccctgactcattctgaagg

SEQ ID NO: 2867864 - DNA, 17 bp, Homo sapiens
ccctgagctgaggcagc

SEQ ID NO: 2867865 - DNA, 19 bp, Homo sapiens
ccctgagctgaggcagcag

SEQ ID NO: 2867866 - DNA, 13 bp, Homo sapiens
ccctgcagcctgg

SEQ ID NO: 2867867 - DNA, 21 bp, Homo sapiens
ccctgccacttcaacccccag

SEQ ID NO: 2867868 - DNA, 17 bp, Homo sapiens
ctgtgagccttgcatga

SEQ ID NO: 2867869 - DNA, 18 bp, Homo sapiens
ctgtgattactgcaatca

SEQ ID NO: 2867870 - DNA, 21 bp, Homo sapiens
ctgtgctatcggcagatgatg

SEQ ID NO: 2867871 - DNA, 11 bp, Homo sapiens
ctgtgctgaac

SEQ ID NO: 2867872 - DNA, 21 bp, Homo sapiens
ctgtgcttcgggcccttccca

SEQ ID NO: 2867873 - DNA, 22 bp, Homo sapiens
ctgtggccagcttgttatttat

SEQ ID NO: 2867874 - DNA, 23 bp, Homo sapiens
ctgtggccagcttgttatttata

SEQ ID NO: 2867875 - DNA, 14 bp, Homo sapiens
ctgtgggatgggat

SEQ ID NO: 2867876 - DNA, 22 bp, Homo sapiens
ctgtggtgtgtccccctctgtc

SEQ ID NO: 2867877 - DNA, 23 bp, Homo sapiens
ctgtgtaacatccaagccagagt

SEQ ID NO: 2867878 - DNA, 23 bp, Homo sapiens
ctgtgtaaccagctcagtgtttt

SEQ ID NO: 2867879 - DNA, 17 bp, Homo sapiens
ctgtgtggcagttaatt

SEQ ID NO: 2867880 - DNA, 20 bp, Homo sapiens
ctgtgtttgcagcctgctct

SEQ ID NO: 2867881 - DNA, 23 bp, Homo sapiens
ctgtgtttgcagcctgctctagt

SEQ ID NO: 2867882 - DNA, 17 bp, Homo sapiens
ctgttatcagtaatgct

SEQ ID NO: 2867883 - DNA, 20 bp, Homo sapiens
ctgttatcagtaatgctaaa

SEQ ID NO: 2867884 - DNA, 17 bp, Homo sapiens
ctgttgcacttttgaat

SEQ ID NO: 2867885 - DNA, 21 bp, Homo sapiens
ctgttttagtgtttatgttta

SEQ ID NO: 2867886 - DNA, 15 bp, Homo sapiens
ctgtttttaagctgt

SEQ ID NO: 2867887 - DNA, 13 bp, Homo sapiens
cttaaacaaaaat

SEQ ID NO: 2867888 - DNA, 18 bp, Homo sapiens
cttaatttaactttccag

SEQ ID NO: 2867889 - DNA, 23 bp, Homo sapiens
cttacagtaggagcccagctctg

SEQ ID NO: 2867890 - DNA, 21 bp, Homo sapiens
cttacatgttcccaaaacaat

SEQ ID NO: 2867891 - DNA, 18 bp, Homo sapiens
cttaccccaaagagaaag

SEQ ID NO: 2867892 - DNA, 19 bp, Homo sapiens
cttaccccaaagagaaaga

SEQ ID NO: 2867893 - DNA, 14 bp, Homo sapiens
cttagatgttctaa

SEQ ID NO: 2867894 - DNA, 22 bp, Homo sapiens
cttagctgaggctgagaaagct

SEQ ID NO: 2867895 - DNA, 17 bp, Homo sapiens
cttagggcactgggctg

SEQ ID NO: 2867896 - DNA, 18 bp, Homo sapiens
cttagggcactgggctgt

SEQ ID NO: 2867897 - DNA, 14 bp, Homo sapiens
cttatagaatattt

SEQ ID NO: 2867898 - DNA, 14 bp, Homo sapiens
cttatccaactttt

SEQ ID NO: 2867899 - DNA, 20 bp, Homo sapiens
cttatgaaaagtactaatag

SEQ ID NO: 2867900 - DNA, 14 bp, Homo sapiens
cttatgtgaaaaat

SEQ ID NO: 2867901 - DNA, 18 bp, Homo sapiens
cttatgtgaaaaattaac

SEQ ID NO: 2867902 - DNA, 21 bp, Homo sapiens
cttatgtgaaaaattaacttt

SEQ ID NO: 2867903 - DNA, 21 bp, Homo sapiens
cttattagagtgtctttccac

SEQ ID NO: 2867904 - DNA, 18 bp, Homo sapiens
cttatttctatgacaaat

SEQ ID NO: 2867905 - DNA, 20 bp, Homo sapiens
cttattttgttggtgctttg

SEQ ID NO: 2867906 - DNA, 17 bp, Homo sapiens
cttcaccatttggcaat

SEQ ID NO: 2867907 - DNA, 17 bp, Homo sapiens
cttccaaagactaagac

SEQ ID NO: 2867908 - DNA, 16 bp, Homo sapiens
cttccaaatcccctaa

SEQ ID NO: 2867909 - DNA, 20 bp, Homo sapiens
cttccaaatcccctaagcag

SEQ ID NO: 2867910 - DNA, 15 bp, Homo sapiens
cttccactgagggca

SEQ ID NO: 2867911 - DNA, 14 bp, Homo sapiens
cttccatttgcaag

SEQ ID NO: 2867912 - DNA, 10 bp, Homo sapiens
cttcccagac

SEQ ID NO: 2867913 - DNA, 12 bp, Homo sapiens
cttcccagacca

SEQ ID NO: 2867914 - DNA, 12 bp, Homo sapiens
cttccccagact

SEQ ID NO: 2867915 - DNA, 13 bp, Homo sapiens
cttccccagactc

SEQ ID NO: 2867916 - DNA, 13 bp, Homo sapiens
cttcccccatccc

SEQ ID NO: 2867917 - DNA, 21 bp, Homo sapiens
cttcccccatcccctttcctc

SEQ ID NO: 2867918 - DNA, 22 bp, Homo sapiens
cttcccccatcccctttcctcc

SEQ ID NO: 2867919 - DNA, 23 bp, Homo sapiens
cttcccccatcccctttcctccc

SEQ ID NO: 2867920 - DNA, 13 bp, Homo sapiens
cttccctgccact

SEQ ID NO: 2867921 - DNA, 15 bp, Homo sapiens
cttcctcctgggccc

SEQ ID NO: 2867922 - DNA, 12 bp, Homo sapiens
cttccttccccc

SEQ ID NO: 2867923 - DNA, 23 bp, Homo sapiens
cttctcagtccagcagtttccag

SEQ ID NO: 2867924 - DNA, 14 bp, Homo sapiens
cttctccatccaca

SEQ ID NO: 2867925 - DNA, 13 bp, Homo sapiens
cttctctctgtgg

SEQ ID NO: 2867926 - DNA, 14 bp, Homo sapiens
cttctctgggctga

SEQ ID NO: 2867927 - DNA, 17 bp, Homo sapiens
cttctggatccatgggg

SEQ ID NO: 2867928 - DNA, 15 bp, Homo sapiens
cttctgggagggcag

SEQ ID NO: 2867929 - DNA, 19 bp, Homo sapiens
cttctgggagggcagcagg

SEQ ID NO: 2867930 - DNA, 13 bp, Homo sapiens
cttcttcaccatt

SEQ ID NO: 2867931 - DNA, 19 bp, Homo sapiens
cttcttcgctgctagagaa

SEQ ID NO: 2867932 - DNA, 20 bp, Homo sapiens
cttctttggacttctgaaga

SEQ ID NO: 2867933 - DNA, 17 bp, Homo sapiens
cttgaaacctgatgtca

SEQ ID NO: 2867934 - DNA, 22 bp, Homo sapiens
cttgaattgtaactgttcttga

SEQ ID NO: 2867935 - DNA, 19 bp, Homo sapiens
cttgactacctactggtgt

SEQ ID NO: 2867936 - DNA, 12 bp, Homo sapiens
cttgagaaacct

SEQ ID NO: 2867937 - DNA, 13 bp, Homo sapiens
cttgagaaacctt

SEQ ID NO: 2867938 - DNA, 13 bp, Homo sapiens
cttgagattctga

SEQ ID NO: 2867939 - DNA, 11 bp, Homo sapiens
cttgagcctcc

SEQ ID NO: 2867940 - DNA, 17 bp, Homo sapiens
cttgaggccaagatggc

SEQ ID NO: 2867941 - DNA, 21 bp, Homo sapiens
cttgatgcatgcactgttccc

SEQ ID NO: 2867942 - DNA, 17 bp, Homo sapiens
cttgcccactgcctgcc

SEQ ID NO: 2867943 - DNA, 21 bp, Homo sapiens
cttgcctctaaatagcacttt

SEQ ID NO: 2867944 - DNA, 13 bp, Homo sapiens
cttggactcctcc

SEQ ID NO: 2867945 - DNA, 14 bp, Homo sapiens
cttggactcctccc

SEQ ID NO: 2867946 - DNA, 15 bp, Homo sapiens
cttggactcctccca

SEQ ID NO: 2867947 - DNA, 18 bp, Homo sapiens
cttggagaatactgccaa

SEQ ID NO: 2867948 - DNA, 21 bp, Homo sapiens
cttggctggtgtatgcacagg

SEQ ID NO: 2867949 - DNA, 21 bp, Homo sapiens
cttgggctccctgtaacctct

SEQ ID NO: 2867950 - DNA, 15 bp, Homo sapiens
cttggggctgatgaa

SEQ ID NO: 2867951 - DNA, 19 bp, Homo sapiens
cttggggctgatgaagaag

SEQ ID NO: 2867952 - DNA, 15 bp, Homo sapiens
cttggggtcaagaaa

SEQ ID NO: 2867953 - DNA, 14 bp, Homo sapiens
cttggttgaggaaa

SEQ ID NO: 2867954 - DNA, 16 bp, Homo sapiens
cttggttgaggaaaca

SEQ ID NO: 2867955 - DNA, 23 bp, Homo sapiens
cttggttgatgtttaaagagaag

SEQ ID NO: 2867956 - DNA, 13 bp, Homo sapiens
cttgtctctgggc

SEQ ID NO: 2867957 - DNA, 22 bp, Homo sapiens
cttgtgttcagctctttccaaa

SEQ ID NO: 2867958 - DNA, 15 bp, Homo sapiens
cttgttatttataac

SEQ ID NO: 2867959 - DNA, 21 bp, Homo sapiens
cttgttgctgattcaagaaac

SEQ ID NO: 2867960 - DNA, 16 bp, Homo sapiens
cttgtttagagagcct

SEQ ID NO: 2867961 - DNA, 16 bp, Homo sapiens
cttgtttgtcagcatc

SEQ ID NO: 2867962 - DNA, 21 bp, Homo sapiens
cttgtttgtcagcatctgacc

SEQ ID NO: 2867963 - DNA, 23 bp, Homo sapiens
ctttaaactatgttcctaacaaa

SEQ ID NO: 2867964 - DNA, 18 bp, Homo sapiens
ctttaacatacaagaaaa

SEQ ID NO: 2867965 - DNA, 21 bp, Homo sapiens
ctttaacatacaagaaaatgt

SEQ ID NO: 2867966 - DNA, 19 bp, Homo sapiens
ctttatatttcaataaatg

SEQ ID NO: 2867967 - DNA, 20 bp, Homo sapiens
ctttatatttcaataaatga

SEQ ID NO: 2867968 - DNA, 14 bp, Homo sapiens
ctttattaagtaaa

SEQ ID NO: 2867969 - DNA, 13 bp, Homo sapiens
ctttattgcaatg

SEQ ID NO: 2867970 - DNA, 14 bp, Homo sapiens
ctttattgcaatgc

SEQ ID NO: 2867971 - DNA, 20 bp, Homo sapiens
ctttcatgtaaactgtgcac

SEQ ID NO: 2867972 - DNA, 14 bp, Homo sapiens
ctttccaaattaaa

SEQ ID NO: 2867973 - DNA, 15 bp, Homo sapiens
ctttccaaattaaaa

SEQ ID NO: 2867974 - DNA, 19 bp, Homo sapiens
ctttccaaattaaaacaaa

SEQ ID NO: 2867975 - DNA, 19 bp, Homo sapiens
ctttcctccccaccttccc

SEQ ID NO: 2867976 - DNA, 14 bp, Homo sapiens
ctttctagctgttg

SEQ ID NO: 2867977 - DNA, 23 bp, Homo sapiens
ctttctagctgttgagctgtttt

SEQ ID NO: 2867978 - DNA, 17 bp, Homo sapiens
gccctcgctgccagctc

SEQ ID NO: 2867979 - DNA, 19 bp, Homo sapiens
gccctcggaggtccagctg

SEQ ID NO: 2867980 - DNA, 14 bp, Homo sapiens
gccctgcaaaagga

SEQ ID NO: 2867981 - DNA, 19 bp, Homo sapiens
gccctgccttgtccctctc

SEQ ID NO: 2867982 - DNA, 12 bp, Homo sapiens
gccgactctggc

SEQ ID NO: 2867983 - DNA, 14 bp, Homo sapiens
gccgggtctgcctc

SEQ ID NO: 2867984 - DNA, 20 bp, Homo sapiens
gccgtggccatcagggtggg

SEQ ID NO: 2867985 - DNA, 18 bp, Homo sapiens
gcctaatatttaggcaag

SEQ ID NO: 2867986 - DNA, 20 bp, Homo sapiens
gcctaatatttaggcaagag

SEQ ID NO: 2867987 - DNA, 22 bp, Homo sapiens
gcctagtgaaggcttctctctg

SEQ ID NO: 2867988 - DNA, 23 bp, Homo sapiens
gcctcaagaaatatactctccca

SEQ ID NO: 2867989 - DNA, 18 bp, Homo sapiens
gcctccgctgggcttcat

SEQ ID NO: 2867990 - DNA, 21 bp, Homo sapiens
gcctctccagtttgcacctgt

SEQ ID NO: 2867991 - DNA, 14 bp, Homo sapiens
gcctcttctgggag

SEQ ID NO: 2867992 - DNA, 18 bp, Homo sapiens
gcctcttctgggagggca

SEQ ID NO: 2867993 - DNA, 22 bp, Homo sapiens
gcctgacatttggagtgttccc

SEQ ID NO: 2867994 - DNA, 14 bp, Homo sapiens
gcctgctcatggcc

SEQ ID NO: 2867995 - DNA, 17 bp, Homo sapiens
gcctggactgaccacac

SEQ ID NO: 2867996 - DNA, 17 bp, Homo sapiens
gcctggcccacgccctc

SEQ ID NO: 2867997 - DNA, 20 bp, Homo sapiens
gcctgggtgacagagcaaga

SEQ ID NO: 2867998 - DNA, 18 bp, Homo sapiens
gcctgtcaccagagcttc

SEQ ID NO: 2867999 - DNA, 20 bp, Homo sapiens
gcctgtcaccagagcttctc

SEQ ID NO: 2868000 - DNA, 15 bp, Homo sapiens
gcctgtgctaaagaa

SEQ ID NO: 2868001 - DNA, 19 bp, Homo sapiens
gccttagggcactgggctg

SEQ ID NO: 2868002 - DNA, 19 bp, Homo sapiens
gccttcatcctcctcccca

SEQ ID NO: 2868003 - DNA, 16 bp, Homo sapiens
gccttcctcctgggcc

SEQ ID NO: 2868004 - DNA, 14 bp, Homo sapiens
gccttcgtttatat

SEQ ID NO: 2868005 - DNA, 17 bp, Homo sapiens
gccttcgtttatatttt

SEQ ID NO: 2868006 - DNA, 15 bp, Homo sapiens
gccttgtccctctca

SEQ ID NO: 2868007 - DNA, 23 bp, Homo sapiens
gccttgtccctctcactccccag

SEQ ID NO: 2868008 - DNA, 21 bp, Homo sapiens
gcgactctatagactctagga

SEQ ID NO: 2868009 - DNA, 13 bp, Homo sapiens
gcggaagccaaag

SEQ ID NO: 2868010 - DNA, 14 bp, Homo sapiens
gcgtcctcctctgt

SEQ ID NO: 2868011 - DNA, 15 bp, Homo sapiens
gcgtcctcctctgtg

SEQ ID NO: 2868012 - DNA, 19 bp, Homo sapiens
gcgttctaaatatgaatga

SEQ ID NO: 2868013 - DNA, 19 bp, Homo sapiens
gctaaagcaatatgcattt

SEQ ID NO: 2868014 - DNA, 21 bp, Homo sapiens
gctaagatagaaagctggact

SEQ ID NO: 2868015 - DNA, 23 bp, Homo sapiens
gctaagatagaaagctggactga

SEQ ID NO: 2868016 - DNA, 13 bp, Homo sapiens
gctacttgggagg

SEQ ID NO: 2868017 - DNA, 15 bp, Homo sapiens
gctagactcctcagg

SEQ ID NO: 2868018 - DNA, 15 bp, Homo sapiens
gctataaatgccaga

SEQ ID NO: 2868019 - DNA, 19 bp, Homo sapiens
gctataaatgccagagcca

SEQ ID NO: 2868020 - DNA, 20 bp, Homo sapiens
gctataaatgccagagccaa

SEQ ID NO: 2868021 - DNA, 20 bp, Homo sapiens
gctatggcaggataagaaag

SEQ ID NO: 2868022 - DNA, 16 bp, Homo sapiens
gctcacccccttctcc

SEQ ID NO: 2868023 - DNA, 20 bp, Homo sapiens
gctcacccccttctccatcc

SEQ ID NO: 2868024 - DNA, 22 bp, Homo sapiens
gctcacccccttctccatccac

SEQ ID NO: 2868025 - DNA, 20 bp, Homo sapiens
gctcatcattctctgtctca

SEQ ID NO: 2868026 - DNA, 21 bp, Homo sapiens
gctccagagggcactctgctt

SEQ ID NO: 2868027 - DNA, 18 bp, Homo sapiens
gctccctgactgggagtt

SEQ ID NO: 2868028 - DNA, 17 bp, Homo sapiens
gctccttgggccctttg

SEQ ID NO: 2868029 - DNA, 14 bp, Homo sapiens
gctctagtgggaca

SEQ ID NO: 2868030 - DNA, 22 bp, Homo sapiens
gctctgatccctctacagagct

SEQ ID NO: 2868031 - DNA, 22 bp, Homo sapiens
gctctgcgtgtcacctgtgctt

SEQ ID NO: 2868032 - DNA, 19 bp, Homo sapiens
gctctgtatcaggacccag

SEQ ID NO: 2868033 - DNA, 22 bp, Homo sapiens
gctctgtatcaggacccagagg

SEQ ID NO: 2868034 - DNA, 15 bp, Homo sapiens
gctgaggctgagaaa

SEQ ID NO: 2868035 - DNA, 14 bp, Homo sapiens
gctgagggagcctg

SEQ ID NO: 2868036 - DNA, 17 bp, Homo sapiens
gctgataccatatgaat

SEQ ID NO: 2868037 - DNA, 13 bp, Homo sapiens
gctgatgaagaag

SEQ ID NO: 2868038 - DNA, 13 bp, Homo sapiens
gctgattcaagaa

SEQ ID NO: 2868039 - DNA, 17 bp, Homo sapiens
gctgcccatcatgtggc

SEQ ID NO: 2868040 - DNA, 19 bp, Homo sapiens
gctgcccatcatgtggccc

SEQ ID NO: 2868041 - DNA, 17 bp, Homo sapiens
gctgctagagaaggggg

SEQ ID NO: 2868042 - DNA, 22 bp, Homo sapiens
gctggactgaccaaagactgca

SEQ ID NO: 2868043 - DNA, 20 bp, Homo sapiens
gctggactggaggcccctgg

SEQ ID NO: 2868044 - DNA, 14 bp, Homo sapiens
gctgggcctcctgc

SEQ ID NO: 2868045 - DNA, 16 bp, Homo sapiens
gctgggcctcctgcct

SEQ ID NO: 2868046 - DNA, 23 bp, Homo sapiens
gctgggcttcattccggactggc

SEQ ID NO: 2868047 - DNA, 16 bp, Homo sapiens
gctgggggaagggtgg

SEQ ID NO: 2868048 - DNA, 16 bp, Homo sapiens
gctgtaacgtggcact

SEQ ID NO: 2868049 - DNA, 18 bp, Homo sapiens
gctgtgctccatatttga

SEQ ID NO: 2868050 - DNA, 17 bp, Homo sapiens
gctgtgtttgcagcctg

SEQ ID NO: 2868051 - DNA, 18 bp, Homo sapiens
gctgttattcttgttata

SEQ ID NO: 2868052 - DNA, 15 bp, Homo sapiens
gctgtttactaggga

SEQ ID NO: 2868053 - DNA, 13 bp, Homo sapiens
gctgtttccatag

SEQ ID NO: 2868054 - DNA, 21 bp, Homo sapiens
gctgtttgggttgttggtctg

SEQ ID NO: 2868055 - DNA, 22 bp, Homo sapiens
gctgtttgggttgttggtctgt

SEQ ID NO: 2868056 - DNA, 23 bp, Homo sapiens
gcttatttctatgacaaattcaa

SEQ ID NO: 2868057 - DNA, 22 bp, Homo sapiens
gcttcaggttagtgacatttaa

SEQ ID NO: 2868058 - DNA, 16 bp, Homo sapiens
gcttcattccggactg

SEQ ID NO: 2868059 - DNA, 12 bp, Homo sapiens
gcttgagcctcc

SEQ ID NO: 2868060 - DNA, 20 bp, Homo sapiens
gcttgagcctcccccaaagc

SEQ ID NO: 2868061 - DNA, 14 bp, Homo sapiens
gcttggagcagagg

SEQ ID NO: 2868062 - DNA, 18 bp, Homo sapiens
gcttgtagaactcactct

SEQ ID NO: 2868063 - DNA, 22 bp, Homo sapiens
gcttgtagaactcactctgggc

SEQ ID NO: 2868064 - DNA, 23 bp, Homo sapiens
gcttgtagaactcactctgggct

SEQ ID NO: 2868065 - DNA, 15 bp, Homo sapiens
gctttagtgaattaa

SEQ ID NO: 2868066 - DNA, 21 bp, Homo sapiens
gctttcatgtaaactgtgcac

SEQ ID NO: 2868067 - DNA, 23 bp, Homo sapiens
gctttgcattttgatattgctgt

SEQ ID NO: 2868068 - DNA, 13 bp, Homo sapiens
gctttttctgcca

SEQ ID NO: 2868069 - DNA, 19 bp, Homo sapiens
ggaaaaatgggagccagga

SEQ ID NO: 2868070 - DNA, 22 bp, Homo sapiens
ggaaaagaatccctgcagcctg

SEQ ID NO: 2868071 - DNA, 22 bp, Homo sapiens
ggaaacccaaggaacaagagaa

SEQ ID NO: 2868072 - DNA, 15 bp, Homo sapiens
ggaaaggcttggctg

SEQ ID NO: 2868073 - DNA, 14 bp, Homo sapiens
ggaagaaggaggaa

SEQ ID NO: 2868074 - DNA, 16 bp, Homo sapiens
ggaagccaaaggcagc

SEQ ID NO: 2868075 - DNA, 17 bp, Homo sapiens
ggaaggggccagaggct

SEQ ID NO: 2868076 - DNA, 15 bp, Homo sapiens
ggaagtaaaacagtc

SEQ ID NO: 2868077 - DNA, 13 bp, Homo sapiens
ggaagtggggagt

SEQ ID NO: 2868078 - DNA, 19 bp, Homo sapiens
ggacaagggattctgggaa

SEQ ID NO: 2868079 - DNA, 18 bp, Homo sapiens
ggacagcccagagcctgg

SEQ ID NO: 2868080 - DNA, 18 bp, Homo sapiens
ggacataagataaaatga

SEQ ID NO: 2868081 - DNA, 19 bp, Homo sapiens
ggaccagtcaacctgggca

SEQ ID NO: 2868082 - DNA, 14 bp, Homo sapiens
ggacgcctgggggt

SEQ ID NO: 2868083 - DNA, 13 bp, Homo sapiens
ggactccaggcct

SEQ ID NO: 2868084 - DNA, 15 bp, Homo sapiens
ggactccaggcctga

SEQ ID NO: 2868085 - DNA, 18 bp, Homo sapiens
ggactcccaaccctggct

SEQ ID NO: 2868086 - DNA, 15 bp, Homo sapiens
ggactcctcccacaa

SEQ ID NO: 2868087 - DNA, 22 bp, Homo sapiens
gtgggtccatgggcagagccca

SEQ ID NO: 2868088 - DNA, 19 bp, Homo sapiens
gtggtgaatgtgtgagaaa

SEQ ID NO: 2868089 - DNA, 20 bp, Homo sapiens
gtggttattggactccaggc

SEQ ID NO: 2868090 - DNA, 14 bp, Homo sapiens
gtgtaaaaaatgtc

SEQ ID NO: 2868091 - DNA, 21 bp, Homo sapiens
gtgtaacatccaagccagagt

SEQ ID NO: 2868092 - DNA, 19 bp, Homo sapiens
gtgtaaccagctcagtgtt

SEQ ID NO: 2868093 - DNA, 18 bp, Homo sapiens
gtgtccccctctgtccag

SEQ ID NO: 2868094 - DNA, 16 bp, Homo sapiens
gtgtgaagtttggaga

SEQ ID NO: 2868095 - DNA, 17 bp, Homo sapiens
gtgtgaagtttggagat

SEQ ID NO: 2868096 - DNA, 18 bp, Homo sapiens
gtgtgacagtttccaaat

SEQ ID NO: 2868097 - DNA, 19 bp, Homo sapiens
gtgtgacagtttccaaatt

SEQ ID NO: 2868098 - DNA, 14 bp, Homo sapiens
gtgtgaggccaggg

SEQ ID NO: 2868099 - DNA, 17 bp, Homo sapiens
gtgtgtactctgtccag

SEQ ID NO: 2868100 - DNA, 19 bp, Homo sapiens
gtgtgtccacgactgtctc

SEQ ID NO: 2868101 - DNA, 17 bp, Homo sapiens
gtgtgttttcagcaaat

SEQ ID NO: 2868102 - DNA, 16 bp, Homo sapiens
gtgttagggaagggcc

SEQ ID NO: 2868103 - DNA, 23 bp, Homo sapiens
gtgttcagctctttccaaattaa

SEQ ID NO: 2868104 - DNA, 18 bp, Homo sapiens
gttaagaatggaagaaaa

SEQ ID NO: 2868105 - DNA, 21 bp, Homo sapiens
gttaccactcttttgctgtgc

SEQ ID NO: 2868106 - DNA, 20 bp, Homo sapiens
gttagatgggaggatgaatt

SEQ ID NO: 2868107 - DNA, 16 bp, Homo sapiens
gttagtgacatttaat

SEQ ID NO: 2868108 - DNA, 15 bp, Homo sapiens
gttataaagatacag

SEQ ID NO: 2868109 - DNA, 21 bp, Homo sapiens
gttatcagtaatgctaaatgt

SEQ ID NO: 2868110 - DNA, 12 bp, Homo sapiens
gttattggactc

SEQ ID NO: 2868111 - DNA, 22 bp, Homo sapiens
gttccattgaagccgactctgg

SEQ ID NO: 2868112 - DNA, 15 bp, Homo sapiens
gttccccttccactg

SEQ ID NO: 2868113 - DNA, 17 bp, Homo sapiens
gttctaagtctttccat

SEQ ID NO: 2868114 - DNA, 23 bp, Homo sapiens
gttctgctcatcattctctgtct

SEQ ID NO: 2868115 - DNA, 16 bp, Homo sapiens
gttctgtagagccaat

SEQ ID NO: 2868116 - DNA, 14 bp, Homo sapiens
gttgaccccagagg

SEQ ID NO: 2868117 - DNA, 16 bp, Homo sapiens
gttgatgtttaaagag

SEQ ID NO: 2868118 - DNA, 18 bp, Homo sapiens
gttgcctcttgcaatgcc

SEQ ID NO: 2868119 - DNA, 20 bp, Homo sapiens
gttgctgattcaagaaacag

SEQ ID NO: 2868120 - DNA, 22 bp, Homo sapiens
gttgctgattcaagaaacagaa

SEQ ID NO: 2868121 - DNA, 22 bp, Homo sapiens
gttgtcttatgtgaaaaattaa

SEQ ID NO: 2868122 - DNA, 12 bp, Homo sapiens
gttgttgctgct

SEQ ID NO: 2868123 - DNA, 20 bp, Homo sapiens
gtttacactgcggaagccaa

SEQ ID NO: 2868124 - DNA, 22 bp, Homo sapiens
gtttacactgcggaagccaaag

SEQ ID NO: 2868125 - DNA, 17 bp, Homo sapiens
gtttagagagcctgtca

SEQ ID NO: 2868126 - DNA, 23 bp, Homo sapiens
gtttagagagcctgtcaccagag

SEQ ID NO: 2868127 - DNA, 13 bp, Homo sapiens
gtttagattgtat

SEQ ID NO: 2868128 - DNA, 22 bp, Homo sapiens
gtttatatttttttaactgtga

SEQ ID NO: 2868129 - DNA, 14 bp, Homo sapiens
gtttcccaccacct

SEQ ID NO: 2868130 - DNA, 15 bp, Homo sapiens
gtttgcacctgtccc

SEQ ID NO: 2868131 - DNA, 16 bp, Homo sapiens
gtttgtcagcatctga

SEQ ID NO: 2868132 - DNA, 15 bp, Homo sapiens
gtttgtctgtcttca

SEQ ID NO: 2868133 - DNA, 19 bp, Homo sapiens
gttttcagcaaattccaga

SEQ ID NO: 2868134 - DNA, 14 bp, Homo sapiens
gttttccaaaagta

SEQ ID NO: 2868135 - DNA, 21 bp, Homo sapiens
gttttccctgacctccctcta

SEQ ID NO: 2868136 - DNA, 18 bp, Homo sapiens
gttttgcactgacaagat

SEQ ID NO: 2868137 - DNA, 14 bp, Homo sapiens
gtttttaagctgtt

SEQ ID NO: 2868138 - DNA, 15 bp, Homo sapiens
gtttttaagctgttt

SEQ ID NO: 2868139 - DNA, 21 bp, Homo sapiens
gtttttgacatttatattaaa

SEQ ID NO: 2868140 - DNA, 18 bp, Homo sapiens
gtttttggtttttaaaac

SEQ ID NO: 2868141 - DNA, 15 bp, Homo sapiens
taaaacaaatataca

SEQ ID NO: 2868142 - DNA, 21 bp, Homo sapiens
taaaacaaatatacattttct

SEQ ID NO: 2868143 - DNA, 17 bp, Homo sapiens
taaaacgtgtaaatgaa

SEQ ID NO: 2868144 - DNA, 20 bp, Homo sapiens
taaaaggtactggtactata

SEQ ID NO: 2868145 - DNA, 19 bp, Homo sapiens
taaaatagaataattcttt

SEQ ID NO: 2868146 - DNA, 14 bp, Homo sapiens
taaaatctgtcacg

SEQ ID NO: 2868147 - DNA, 20 bp, Homo sapiens
taaactgactttttcccccc

SEQ ID NO: 2868148 - DNA, 12 bp, Homo sapiens
taaactgtgcac

SEQ ID NO: 2868149 - DNA, 17 bp, Homo sapiens
taaagaagtgcatgaaa

SEQ ID NO: 2868150 - DNA, 18 bp, Homo sapiens
taaagagataaagaataa

SEQ ID NO: 2868151 - DNA, 16 bp, Homo sapiens
taaagatattctttag

SEQ ID NO: 2868152 - DNA, 14 bp, Homo sapiens
taaagctgttattc

SEQ ID NO: 2868153 - DNA, 15 bp, Homo sapiens
taaagtacaaatgaa

SEQ ID NO: 2868154 - DNA, 22 bp, Homo sapiens
taaagtacaaatgaagaaagtc

SEQ ID NO: 2868155 - DNA, 17 bp, Homo sapiens
taaagtacttgactacc

SEQ ID NO: 2868156 - DNA, 20 bp, Homo sapiens
taaatacagtcttccatttg

SEQ ID NO: 2868157 - DNA, 22 bp, Homo sapiens
taaatacagtcttccatttgca

SEQ ID NO: 2868158 - DNA, 23 bp, Homo sapiens
taaatacagtcttccatttgcaa

SEQ ID NO: 2868159 - DNA, 14 bp, Homo sapiens
taaatatgaatgaa

SEQ ID NO: 2868160 - DNA, 14 bp, Homo sapiens
taaatcagaaagta

SEQ ID NO: 2868161 - DNA, 12 bp, Homo sapiens
taaatgccagag

SEQ ID NO: 2868162 - DNA, 12 bp, Homo sapiens
taaatgtgtaat

SEQ ID NO: 2868163 - DNA, 14 bp, Homo sapiens
taacaaaatgagat

SEQ ID NO: 2868164 - DNA, 14 bp, Homo sapiens
taacaatcagctcc

SEQ ID NO: 2868165 - DNA, 23 bp, Homo sapiens
taacaatctatggcttatttcta

SEQ ID NO: 2868166 - DNA, 14 bp, Homo sapiens
taacaattcctcta

SEQ ID NO: 2868167 - DNA, 17 bp, Homo sapiens
taacagccttttccttc

SEQ ID NO: 2868168 - DNA, 14 bp, Homo sapiens
taacatccaagcca

SEQ ID NO: 2868169 - DNA, 16 bp, Homo sapiens
taacatccaagccaga

SEQ ID NO: 2868170 - DNA, 21 bp, Homo sapiens
taacatgtttctctataaagt

SEQ ID NO: 2868171 - DNA, 20 bp, Homo sapiens
taaccagctcagtgttttgg

SEQ ID NO: 2868172 - DNA, 19 bp, Homo sapiens
taaccctctcttccctatt

SEQ ID NO: 2868173 - DNA, 18 bp, Homo sapiens
taacctttctaaccttca

SEQ ID NO: 2868174 - DNA, 19 bp, Homo sapiens
taacctttctaaccttcac

SEQ ID NO: 2868175 - DNA, 18 bp, Homo sapiens
taactagaatttattcaa

SEQ ID NO: 2868176 - DNA, 20 bp, Homo sapiens
taactctaaccaaggctgtg

SEQ ID NO: 2868177 - DNA, 22 bp, Homo sapiens
taacttttttgtggcaattagt

SEQ ID NO: 2868178 - DNA, 20 bp, Homo sapiens
taagaaacaactctttgaga

SEQ ID NO: 2868179 - DNA, 13 bp, Homo sapiens
taagaatggaaga

SEQ ID NO: 2868180 - DNA, 22 bp, Homo sapiens
taagataaaatgatgttataca

SEQ ID NO: 2868181 - DNA, 17 bp, Homo sapiens
taagatagaaagctgga

SEQ ID NO: 2868182 - DNA, 18 bp, Homo sapiens
taagatagaaagctggac

SEQ ID NO: 2868183 - DNA, 20 bp, Homo sapiens
taagcagaccactgataaaa

SEQ ID NO: 2868184 - DNA, 14 bp, Homo sapiens
taagcaggaaggat

SEQ ID NO: 2868185 - DNA, 19 bp, Homo sapiens
taagcattttgaaacaaag

SEQ ID NO: 2868186 - DNA, 20 bp, Homo sapiens
taagcattttgaaacaaagt

SEQ ID NO: 2868187 - DNA, 17 bp, Homo sapiens
taagccacttaaaatgt

SEQ ID NO: 2868188 - DNA, 20 bp, Homo sapiens
taagccacttaaaatgttca

SEQ ID NO: 2868189 - DNA, 19 bp, Homo sapiens
taaggccattattgtactt

SEQ ID NO: 2868190 - DNA, 17 bp, Homo sapiens
taagtcaacctgcctga

SEQ ID NO: 2868191 - DNA, 22 bp, Homo sapiens
taagtgatgtgctgaattttat

SEQ ID NO: 2868192 - DNA, 14 bp, Homo sapiens
taagtgcccaaagt

SEQ ID NO: 2868193 - DNA, 18 bp, Homo sapiens
taagtgtaaaaaatgtct

SEQ ID NO: 2868194 - DNA, 14 bp, Homo sapiens
taagtgtgccaaat

SEQ ID NO: 2868195 - DNA, 18 bp, Homo sapiens
taagtgtgccaaatcagt

SEQ ID NO: 2868196 - DNA, 23 bp, Homo sapiens
tcccagcagctcaacctaccctg

SEQ ID NO: 2868197 - DNA, 22 bp, Homo sapiens
tccccacaggcacattaactgt

SEQ ID NO: 2868198 - DNA, 12 bp, Homo sapiens
tccccagactca

SEQ ID NO: 2868199 - DNA, 15 bp, Homo sapiens
tccccagccccaccc

SEQ ID NO: 2868200 - DNA, 22 bp, Homo sapiens
tccccagctcttctcttcctag

SEQ ID NO: 2868201 - DNA, 24 bp, Homo sapiens
tcccccactactgcagcacctcca

SEQ ID NO: 2868202 - DNA, 18 bp, Homo sapiens
tcccccatcccctttcct

SEQ ID NO: 2868203 - DNA, 12 bp, Homo sapiens
tcccctccctct

SEQ ID NO: 2868204 - DNA, 18 bp, Homo sapiens
tcccctccctcttccttc

SEQ ID NO: 2868205 - DNA, 21 bp, Homo sapiens
tcccctccgcagcagggaagc

SEQ ID NO: 2868206 - DNA, 17 bp, Homo sapiens
tccccttccactgaggg

SEQ ID NO: 2868207 - DNA, 15 bp, Homo sapiens
tccctccgggacctg

SEQ ID NO: 2868208 - DNA, 22 bp, Homo sapiens
tccctctacagagcttccctga

SEQ ID NO: 2868209 - DNA, 18 bp, Homo sapiens
tccctcttccttccccca

SEQ ID NO: 2868210 - DNA, 17 bp, Homo sapiens
tccctgacctccctcta

SEQ ID NO: 2868211 - DNA, 15 bp, Homo sapiens
tccctgccacttcaa

SEQ ID NO: 2868212 - DNA, 21 bp, Homo sapiens
tccctgccacttcaaccccca

SEQ ID NO: 2868213 - DNA, 18 bp, Homo sapiens
tccctgtaacctcttcag

SEQ ID NO: 2868214 - DNA, 19 bp, Homo sapiens
tcccttcccagaccaggaa

SEQ ID NO: 2868215 - DNA, 12 bp, Homo sapiens
tcccttgggctc

SEQ ID NO: 2868216 - DNA, 18 bp, Homo sapiens
tccgaaaccagttaagaa

SEQ ID NO: 2868217 - DNA, 13 bp, Homo sapiens
tccgctgggcttc

SEQ ID NO: 2868218 - DNA, 14 bp, Homo sapiens
tccggactggcaga

SEQ ID NO: 2868219 - DNA, 18 bp, Homo sapiens
tcctaaaagttctcaatg

SEQ ID NO: 2868220 - DNA, 20 bp, Homo sapiens
tcctaaaagttctcaatgta

SEQ ID NO: 2868221 - DNA, 13 bp, Homo sapiens
tcctacaaaatgg

SEQ ID NO: 2868222 - DNA, 14 bp, Homo sapiens
tcctacaaaatgga

SEQ ID NO: 2868223 - DNA, 13 bp, Homo sapiens
tcctactttctat

SEQ ID NO: 2868224 - DNA, 18 bp, Homo sapiens
tcctagatctgcaggctg

SEQ ID NO: 2868225 - DNA, 17 bp, Homo sapiens
tcctatttttgtgaaga

SEQ ID NO: 2868226 - DNA, 12 bp, Homo sapiens
tcctcaatccag

SEQ ID NO: 2868227 - DNA, 13 bp, Homo sapiens
tcctccccagctc

SEQ ID NO: 2868228 - DNA, 12 bp, Homo sapiens
tcctcctctgtg

SEQ ID NO: 2868229 - DNA, 15 bp, Homo sapiens
tcctcctgggccctc

SEQ ID NO: 2868230 - DNA, 17 bp, Homo sapiens
tcctctactaacaatca

SEQ ID NO: 2868231 - DNA, 16 bp, Homo sapiens
tcctctgactcagggc

SEQ ID NO: 2868232 - DNA, 19 bp, Homo sapiens
tcctgacactcaataaaca

SEQ ID NO: 2868233 - DNA, 11 bp, Homo sapiens
tcctgcaaagt

SEQ ID NO: 2868234 - DNA, 23 bp, Homo sapiens
tcctgcagaaagggccacccatg

SEQ ID NO: 2868235 - DNA, 14 bp, Homo sapiens
tcctgccttcctcc

SEQ ID NO: 2868236 - DNA, 19 bp, Homo sapiens
tcctgccttcctcctgggc

SEQ ID NO: 2868237 - DNA, 23 bp, Homo sapiens
tcctgccttcctcctgggccctc

SEQ ID NO: 2868238 - DNA, 21 bp, Homo sapiens
tcctgggccctctctgctctg

SEQ ID NO: 2868239 - DNA, 17 bp, Homo sapiens
tcctgggttttgtattc

SEQ ID NO: 2868240 - DNA, 14 bp, Homo sapiens
tccttaaaatgtgg

SEQ ID NO: 2868241 - DNA, 16 bp, Homo sapiens
tccttgggccctttga

SEQ ID NO: 2868242 - DNA, 22 bp, Homo sapiens
tcgccccaacactgtccttccc

SEQ ID NO: 2868243 - DNA, 20 bp, Homo sapiens
tcgctgccagctctgtatca

SEQ ID NO: 2868244 - DNA, 20 bp, Homo sapiens
tcgctggactctcagtctct

SEQ ID NO: 2868245 - DNA, 13 bp, Homo sapiens
tcggaaacactga

SEQ ID NO: 2868246 - DNA, 23 bp, Homo sapiens
tcggaggtccagctgggcctcct

SEQ ID NO: 2868247 - DNA, 20 bp, Homo sapiens
tcggatctggggctctggga

SEQ ID NO: 2868248 - DNA, 16 bp, Homo sapiens
tctaaataaaaatatg

SEQ ID NO: 2868249 - DNA, 20 bp, Homo sapiens
tctaaccaaggctgtgttta

SEQ ID NO: 2868250 - DNA, 15 bp, Homo sapiens
tctaactacaaggac

SEQ ID NO: 2868251 - DNA, 13 bp, Homo sapiens
tctaagaaaatgt

SEQ ID NO: 2868252 - DNA, 16 bp, Homo sapiens
tctaagaaaatgtagt

SEQ ID NO: 2868253 - DNA, 13 bp, Homo sapiens
tctaagtctttcc

SEQ ID NO: 2868254 - DNA, 12 bp, Homo sapiens
tctaattgtaag

SEQ ID NO: 2868255 - DNA, 19 bp, Homo sapiens
tctacagagcttccctgac

SEQ ID NO: 2868256 - DNA, 14 bp, Homo sapiens
tctagactttctca

SEQ ID NO: 2868257 - DNA, 11 bp, Homo sapiens
tctagctgttg

SEQ ID NO: 2868258 - DNA, 15 bp, Homo sapiens
tctaggcctctccag

SEQ ID NO: 2868259 - DNA, 12 bp, Homo sapiens
tctataaagtat

SEQ ID NO: 2868260 - DNA, 16 bp, Homo sapiens
tctataagtagtaaat

SEQ ID NO: 2868261 - DNA, 17 bp, Homo sapiens
tctataagtagtaaatc

SEQ ID NO: 2868262 - DNA, 19 bp, Homo sapiens
tctataagtagtaaatcag

SEQ ID NO: 2868263 - DNA, 21 bp, Homo sapiens
tctataagtagtaaatcagaa

SEQ ID NO: 2868264 - DNA, 22 bp, Homo sapiens
tctataagtagtaaatcagaaa

SEQ ID NO: 2868265 - DNA, 14 bp, Homo sapiens
tctatatagacttg

SEQ ID NO: 2868266 - DNA, 15 bp, Homo sapiens
tctatttatttactg

SEQ ID NO: 2868267 - DNA, 16 bp, Homo sapiens
tctatttctcctccat

SEQ ID NO: 2868268 - DNA, 14 bp, Homo sapiens
tctattttcataat

SEQ ID NO: 2868269 - DNA, 21 bp, Homo sapiens
tctcactccccagccccaccc

SEQ ID NO: 2868270 - DNA, 20 bp, Homo sapiens
tctcagaggaaaaatgggag

SEQ ID NO: 2868271 - DNA, 11 bp, Homo sapiens
tctcagtctct

SEQ ID NO: 2868272 - DNA, 13 bp, Homo sapiens
tctcagtctctga

SEQ ID NO: 2868273 - DNA, 16 bp, Homo sapiens
tctcagtggtgtgtga

SEQ ID NO: 2868274 - DNA, 14 bp, Homo sapiens
tctcatccatcatc

SEQ ID NO: 2868275 - DNA, 20 bp, Homo sapiens
tctcattggacccttccatg

SEQ ID NO: 2868276 - DNA, 18 bp, Homo sapiens
tctccagtttgcacctgt

SEQ ID NO: 2868277 - DNA, 16 bp, Homo sapiens
tctcctgccttcctcc

SEQ ID NO: 2868278 - DNA, 17 bp, Homo sapiens
tctcctgccttcctcct

SEQ ID NO: 2868279 - DNA, 23 bp, Homo sapiens
tctctattttcataatcagtaaa

SEQ ID NO: 2868280 - DNA, 14 bp, Homo sapiens
tctctgtctcatcc

SEQ ID NO: 2868281 - DNA, 23 bp, Homo sapiens
tctctgtgaacgatttagaaaga

SEQ ID NO: 2868282 - DNA, 13 bp, Homo sapiens
tctcttcccttcc

SEQ ID NO: 2868283 - DNA, 15 bp, Homo sapiens
tctcttcccttccca

SEQ ID NO: 2868284 - DNA, 18 bp, Homo sapiens
tctctttttgctttcgaa

SEQ ID NO: 2868285 - DNA, 15 bp, Homo sapiens
tctgaaaccagtgtt

SEQ ID NO: 2868286 - DNA, 21 bp, Homo sapiens
tctgaaggagccccattcctg

SEQ ID NO: 2868287 - DNA, 19 bp, Homo sapiens
tctgaagtatgaagtctga

SEQ ID NO: 2868288 - DNA, 14 bp, Homo sapiens
tctgaccatctgtg

SEQ ID NO: 2868289 - DNA, 16 bp, Homo sapiens
tctgaccatctgtgac

SEQ ID NO: 2868290 - DNA, 20 bp, Homo sapiens
tctgaccatctgtgactata

SEQ ID NO: 2868291 - DNA, 15 bp, Homo sapiens
tctgactcagggctc

SEQ ID NO: 2868292 - DNA, 14 bp, Homo sapiens
tctgagcaccccct

SEQ ID NO: 2868293 - DNA, 23 bp, Homo sapiens
tctgcagcactttaaccctctct

SEQ ID NO: 2868294 - DNA, 17 bp, Homo sapiens
tctgcagcggcagagca

SEQ ID NO: 2868295 - DNA, 18 bp, Homo sapiens
tctgccaatctgtacaaa

SEQ ID NO: 2868296 - DNA, 16 bp, Homo sapiens
tctgccacagagagtc

SEQ ID NO: 2868297 - DNA, 19 bp, Homo sapiens
tctgccacagagagtcctt

SEQ ID NO: 2868298 - DNA, 23 bp, Homo sapiens
tctgccacagagagtcctttggg

SEQ ID NO: 2868299 - DNA, 20 bp, Homo sapiens
tctgccactgaggagacaga

SEQ ID NO: 2868300 - DNA, 18 bp, Homo sapiens
tctgcctcttctgggagg

SEQ ID NO: 2868301 - DNA, 19 bp, Homo sapiens
tctgcctcttctgggaggg

SEQ ID NO: 2868302 - DNA, 13 bp, Homo sapiens
tctgctagactcc

SEQ ID NO: 2868303 - DNA, 16 bp, Homo sapiens
tctgctagactcctca

SEQ ID NO: 2868304 - DNA, 17 bp, Homo sapiens
tctgctagactcctcag

SEQ ID NO: 2868305 - DNA, 18 bp, Homo sapiens
tctgctagactcctcagg

SEQ ID NO: 2868306 - DNA, 17 bp, Homo sapiens
tgtacatagaccctctt

SEQ ID NO: 2868307 - DNA, 18 bp, Homo sapiens
tgtacctgcccccaatcc

SEQ ID NO: 2868308 - DNA, 22 bp, Homo sapiens
tgtacttccctcttgaaacctg

SEQ ID NO: 2868309 - DNA, 15 bp, Homo sapiens
tgtatatatgtattt

SEQ ID NO: 2868310 - DNA, 17 bp, Homo sapiens
tgtatatatgtatttct

SEQ ID NO: 2868311 - DNA, 19 bp, Homo sapiens
tgtatatatgtatttctat

SEQ ID NO: 2868312 - DNA, 13 bp, Homo sapiens
tgtatatgactgc

SEQ ID NO: 2868313 - DNA, 22 bp, Homo sapiens
tgtatccaaggaaacattttat

SEQ ID NO: 2868314 - DNA, 15 bp, Homo sapiens
tgtatgtcagtgcta

SEQ ID NO: 2868315 - DNA, 13 bp, Homo sapiens
tgtattctctgag

SEQ ID NO: 2868316 - DNA, 20 bp, Homo sapiens
tgtattctctgagctgtgca

SEQ ID NO: 2868317 - DNA, 21 bp, Homo sapiens
tgtattctctgagctgtgcag

SEQ ID NO: 2868318 - DNA, 22 bp, Homo sapiens
tgtatttctctattttcataat

SEQ ID NO: 2868319 - DNA, 14 bp, Homo sapiens
tgtattttgtattg

SEQ ID NO: 2868320 - DNA, 18 bp, Homo sapiens
tgtatttttctaaactcc

SEQ ID NO: 2868321 - DNA, 18 bp, Homo sapiens
tgtcaataaacaacagct

SEQ ID NO: 2868322 - DNA, 12 bp, Homo sapiens
tgtcaccagagc

SEQ ID NO: 2868323 - DNA, 19 bp, Homo sapiens
tgtcaccagagcttctctg

SEQ ID NO: 2868324 - DNA, 12 bp, Homo sapiens
tgtcagcatctg

SEQ ID NO: 2868325 - DNA, 16 bp, Homo sapiens
tgtcagcatctgacca

SEQ ID NO: 2868326 - DNA, 17 bp, Homo sapiens
tgtcagcatctgaccat

SEQ ID NO: 2868327 - DNA, 21 bp, Homo sapiens
tgtcagcatctgaccatctgt

SEQ ID NO: 2868328 - DNA, 22 bp, Homo sapiens
tgtcagcatctgaccatctgtg

SEQ ID NO: 2868329 - DNA, 20 bp, Homo sapiens
tgtcagctgctgttgaactt

SEQ ID NO: 2868330 - DNA, 16 bp, Homo sapiens
tgtccaaaatttatat

SEQ ID NO: 2868331 - DNA, 14 bp, Homo sapiens
tgtccaatcctatg

SEQ ID NO: 2868332 - DNA, 17 bp, Homo sapiens
tgtccacctcaccaggg

SEQ ID NO: 2868333 - DNA, 22 bp, Homo sapiens
tgtccccaccctccactcagct

SEQ ID NO: 2868334 - DNA, 15 bp, Homo sapiens
tgtccttaaaatgtg

SEQ ID NO: 2868335 - DNA, 21 bp, Homo sapiens
tgtctagaggtgagaccaaag

SEQ ID NO: 2868336 - DNA, 22 bp, Homo sapiens
tgtctagaggtgagaccaaagg

SEQ ID NO: 2868337 - DNA, 11 bp, Homo sapiens
tgtctcatcca

SEQ ID NO: 2868338 - DNA, 20 bp, Homo sapiens
tgtctgaccttccaaagact

SEQ ID NO: 2868339 - DNA, 14 bp, Homo sapiens
tgtcttatgtgaaa

SEQ ID NO: 2868340 - DNA, 15 bp, Homo sapiens
tgtcttcatagcaga

SEQ ID NO: 2868341 - DNA, 13 bp, Homo sapiens
tgtgaaaaattaa

SEQ ID NO: 2868342 - DNA, 15 bp, Homo sapiens
tgtgacccaccagtg

SEQ ID NO: 2868343 - DNA, 18 bp, Homo sapiens
tgtgacccaccagtgcct

SEQ ID NO: 2868344 - DNA, 17 bp, Homo sapiens
tgtgactataaagctgt

SEQ ID NO: 2868345 - DNA, 12 bp, Homo sapiens
tgtgactctctt

SEQ ID NO: 2868346 - DNA, 14 bp, Homo sapiens
tgtgagccttgcat

SEQ ID NO: 2868347 - DNA, 17 bp, Homo sapiens
tgtgagtcccagagccc

SEQ ID NO: 2868348 - DNA, 21 bp, Homo sapiens
tgtgcacatacgggctttaat

SEQ ID NO: 2868349 - DNA, 17 bp, Homo sapiens
tgtgcacatctgtgtct

SEQ ID NO: 2868350 - DNA, 20 bp, Homo sapiens
tgtgcacatctgtgtcttgt

SEQ ID NO: 2868351 - DNA, 13 bp, Homo sapiens
tgtgcaccagggt

SEQ ID NO: 2868352 - DNA, 13 bp, Homo sapiens
tgtggccccaccc

SEQ ID NO: 2868353 - DNA, 12 bp, Homo sapiens
tgtgtaacatcc

SEQ ID NO: 2868354 - DNA, 18 bp, Homo sapiens
tgtgtaacatccaagcca

SEQ ID NO: 2868355 - DNA, 19 bp, Homo sapiens
tgtgtaataatgtaacatg

SEQ ID NO: 2868356 - DNA, 17 bp, Homo sapiens
tgtgtccacgactgtct

SEQ ID NO: 2868357 - DNA, 19 bp, Homo sapiens
tgtgttcagctctttccaa

SEQ ID NO: 2868358 - DNA, 21 bp, Homo sapiens
tgtgttgttgttgctgctgtt

SEQ ID NO: 2868359 - DNA, 15 bp, Homo sapiens
tgttaaagagataaa

SEQ ID NO: 2868360 - DNA, 16 bp, Homo sapiens
tgttacctgaaaacac

SEQ ID NO: 2868361 - DNA, 22 bp, Homo sapiens
tgttacctgaaaacactgtgca

SEQ ID NO: 2868362 - DNA, 20 bp, Homo sapiens
tgttactgtatttttcagaa

SEQ ID NO: 2868363 - DNA, 21 bp, Homo sapiens
tgttattagagattacctcct

SEQ ID NO: 2868364 - DNA, 22 bp, Homo sapiens
tgttcaaagccagcgtcctcct

SEQ ID NO: 2868365 - DNA, 18 bp, Homo sapiens
tgttcagctctttccaaa

SEQ ID NO: 2868366 - DNA, 20 bp, Homo sapiens
tgttcagctctttccaaatt

SEQ ID NO: 2868367 - DNA, 21 bp, Homo sapiens
tgttcagctctttccaaatta

SEQ ID NO: 2868368 - DNA, 14 bp, Homo sapiens
tgttccccttccac

SEQ ID NO: 2868369 - DNA, 16 bp, Homo sapiens
tgttcctaacaaaatg

SEQ ID NO: 2868370 - DNA, 22 bp, Homo sapiens
tgttgcacttttgaatgtccaa

SEQ ID NO: 2868371 - DNA, 18 bp, Homo sapiens
tgtttaaaagaaatatat

SEQ ID NO: 2868372 - DNA, 18 bp, Homo sapiens
tgtttagagagcctgtca

SEQ ID NO: 2868373 - DNA, 14 bp, Homo sapiens
tgtttagattgtat

SEQ ID NO: 2868374 - DNA, 22 bp, Homo sapiens
tgtttgggttgttggtctgtgt

SEQ ID NO: 2868375 - DNA, 13 bp, Homo sapiens
tgtttgtcagcat

SEQ ID NO: 2868376 - DNA, 14 bp, Homo sapiens
tgtttgtcagcatc

SEQ ID NO: 2868377 - DNA, 19 bp, Homo sapiens
tgtttgtcagcatctgacc

SEQ ID NO: 2868378 - DNA, 21 bp, Homo sapiens
tgtttgtcagcatctgaccat

SEQ ID NO: 2868379 - DNA, 13 bp, Homo sapiens
tgtttgtgctgtg

SEQ ID NO: 2868380 - DNA, 18 bp, Homo sapiens
tgttttaaaacgtgtaaa

SEQ ID NO: 2868381 - DNA, 16 bp, Homo sapiens
tgttttccctgacctc

SEQ ID NO: 2868382 - DNA, 14 bp, Homo sapiens
tgttttgcactgac

SEQ ID NO: 2868383 - DNA, 15 bp, Homo sapiens
tgttttggtggaaaa

SEQ ID NO: 2868384 - DNA, 20 bp, Homo sapiens
tgttttggtggaaaaaacat

SEQ ID NO: 2868385 - DNA, 17 bp, Homo sapiens
tgtttttaagctgtttc

SEQ ID NO: 2868386 - DNA, 11 bp, Homo sapiens
tgtttttcatt

SEQ ID NO: 2868387 - DNA, 17 bp, Homo sapiens
ttaaaaattacctttaa

SEQ ID NO: 2868388 - DNA, 20 bp, Homo sapiens
ttaaaaattacctttaattt

SEQ ID NO: 2868389 - DNA, 19 bp, Homo sapiens
ttaaaacaaatatacattt

SEQ ID NO: 2868390 - DNA, 18 bp, Homo sapiens
ttaaaacaatccttacta

SEQ ID NO: 2868391 - DNA, 15 bp, Homo sapiens
ttaaacgattagtga

SEQ ID NO: 2868392 - DNA, 22 bp, Homo sapiens
ttaaacgattagtgatgtcctt

SEQ ID NO: 2868393 - DNA, 16 bp, Homo sapiens
ttaacatacaagaaaa

SEQ ID NO: 2868394 - DNA, 15 bp, Homo sapiens
ttaaccctttttcca

SEQ ID NO: 2868395 - DNA, 16 bp, Homo sapiens
ttaactagaatttatt

SEQ ID NO: 2868396 - DNA, 22 bp, Homo sapiens
ttaatcaatcatgccctgcctt

SEQ ID NO: 2868397 - DNA, 12 bp, Homo sapiens
ttaatttaactt

SEQ ID NO: 2868398 - DNA, 21 bp, Homo sapiens
ttaatttaactttccagtctt

SEQ ID NO: 2868399 - DNA, 13 bp, Homo sapiens
ttaatttagtaaa

SEQ ID NO: 2868400 - DNA, 19 bp, Homo sapiens
ttaatttagtaaataaaca

SEQ ID NO: 2868401 - DNA, 13 bp, Homo sapiens
ttaattttaatgc

SEQ ID NO: 2868402 - DNA, 17 bp, Homo sapiens
ttacagtaggagcccag

SEQ ID NO: 2868403 - DNA, 18 bp, Homo sapiens
ttaccccaaagagaaaga

SEQ ID NO: 2868404 - DNA, 19 bp, Homo sapiens
ttaccccaaagagaaagag

SEQ ID NO: 2868405 - DNA, 21 bp, Homo sapiens
ttacgaatgcccctgttcatg

SEQ ID NO: 2868406 - DNA, 23 bp, Homo sapiens
ttactagggatccctcatctgtc

SEQ ID NO: 2868407 - DNA, 20 bp, Homo sapiens
ttactgaataatatcaaata

SEQ ID NO: 2868408 - DNA, 22 bp, Homo sapiens
ttactgaataatatcaaataaa

SEQ ID NO: 2868409 - DNA, 13 bp, Homo sapiens
ttactgagcttct

SEQ ID NO: 2868410 - DNA, 17 bp, Homo sapiens
ttactgagcttctctgt

SEQ ID NO: 2868411 - DNA, 15 bp, Homo sapiens
ttactgcaatcactg

SEQ ID NO: 2868412 - DNA, 12 bp, Homo sapiens
ttactgtatttt

SEQ ID NO: 2868413 - DNA, 20 bp, Homo sapiens
ttactgtatttttcagaaat

SEQ ID NO: 2868414 - DNA, 20 bp, Homo sapiens
ttagaaacaaacaaaactct

SEQ ID NO: 2868415 - DNA, 17 bp, Homo sapiens
ttagagagcctgtcacc

SEQ ID NO: 2868416 - DNA, 19 bp, Homo sapiens
caccagggttgaccccaga

SEQ ID NO: 2868417 - DNA, 12 bp, Homo sapiens
caccagtgcctt

SEQ ID NO: 2868418 - DNA, 21 bp, Homo sapiens
cacccaatcaagggaagaagg

SEQ ID NO: 2868419 - DNA, 16 bp, Homo sapiens
cacccacagccataga

SEQ ID NO: 2868420 - DNA, 18 bp, Homo sapiens
cacccatgatactccact

SEQ ID NO: 2868421 - DNA, 11 bp, Homo sapiens
caccccctcat

SEQ ID NO: 2868422 - DNA, 12 bp, Homo sapiens
cacccccttccc

SEQ ID NO: 2868423 - DNA, 13 bp, Homo sapiens
cacccccttcccc

SEQ ID NO: 2868424 - DNA, 13 bp, Homo sapiens
caccctccacctt

SEQ ID NO: 2868425 - DNA, 15 bp, Homo sapiens
cacccttttccagct

SEQ ID NO: 2868426 - DNA, 18 bp, Homo sapiens
cacctccaggcctgttgc

SEQ ID NO: 2868427 - DNA, 17 bp, Homo sapiens
cacctctggctagagcc

SEQ ID NO: 2868428 - DNA, 21 bp, Homo sapiens
cacctctggctagagccgagg

SEQ ID NO: 2868429 - DNA, 15 bp, Homo sapiens
cacctgaatttgtat

SEQ ID NO: 2868430 - DNA, 17 bp, Homo sapiens
cacctgaatttgtatat

SEQ ID NO: 2868431 - DNA, 20 bp, Homo sapiens
cacctgtccccaccctccac

SEQ ID NO: 2868432 - DNA, 19 bp, Homo sapiens
cacctgtgcttcgggccct

SEQ ID NO: 2868433 - DNA, 19 bp, Homo sapiens
cacctgtttttaagctgtt

SEQ ID NO: 2868434 - DNA, 16 bp, Homo sapiens
caccttggactcctcc

SEQ ID NO: 2868435 - DNA, 19 bp, Homo sapiens
cacctttgttttgcactga

SEQ ID NO: 2868436 - DNA, 16 bp, Homo sapiens
cacgactgtctccatg

SEQ ID NO: 2868437 - DNA, 13 bp, Homo sapiens
cacgcacacatgg

SEQ ID NO: 2868438 - DNA, 18 bp, Homo sapiens
cacggagccactcctctg

SEQ ID NO: 2868439 - DNA, 19 bp, Homo sapiens
cactactgcagcacctcca

SEQ ID NO: 2868440 - DNA, 14 bp, Homo sapiens
cactatttgtgact

SEQ ID NO: 2868441 - DNA, 16 bp, Homo sapiens
cactcaataaacagtc

SEQ ID NO: 2868442 - DNA, 17 bp, Homo sapiens
cactcaataaacagtca

SEQ ID NO: 2868443 - DNA, 22 bp, Homo sapiens
cactcagctgtcctgcagcaaa

SEQ ID NO: 2868444 - DNA, 12 bp, Homo sapiens
cactccaccctc

SEQ ID NO: 2868445 - DNA, 16 bp, Homo sapiens
cactcccttgggctcc

SEQ ID NO: 2868446 - DNA, 21 bp, Homo sapiens
cactcctctgactcagggctc

SEQ ID NO: 2868447 - DNA, 23 bp, Homo sapiens
cactcctctgactcagggctcct

SEQ ID NO: 2868448 - DNA, 12 bp, Homo sapiens
cactctcccctc

SEQ ID NO: 2868449 - DNA, 16 bp, Homo sapiens
cactctcccctccctc

SEQ ID NO: 2868450 - DNA, 18 bp, Homo sapiens
cactctcccctccctctt

SEQ ID NO: 2868451 - DNA, 16 bp, Homo sapiens
cactctcccttgtaca

SEQ ID NO: 2868452 - DNA, 22 bp, Homo sapiens
cactgacttaggtttcaggaag

SEQ ID NO: 2868453 - DNA, 14 bp, Homo sapiens
cactgcctgcctcc

SEQ ID NO: 2868454 - DNA, 17 bp, Homo sapiens
cactgcggaagccaaag

SEQ ID NO: 2868455 - DNA, 19 bp, Homo sapiens
cactgcggaagccaaaggc

SEQ ID NO: 2868456 - DNA, 13 bp, Homo sapiens
cactgcttgagga

SEQ ID NO: 2868457 - DNA, 15 bp, Homo sapiens
cactgcttgaggaaa

SEQ ID NO: 2868458 - DNA, 20 bp, Homo sapiens
cactgcttgaggaaaacaag

SEQ ID NO: 2868459 - DNA, 18 bp, Homo sapiens
cactgtccttccctgcca

SEQ ID NO: 2868460 - DNA, 19 bp, Homo sapiens
cactgtccttccctgccac

SEQ ID NO: 2868461 - DNA, 22 bp, Homo sapiens
cactgtgcacatctgtgtcttg

SEQ ID NO: 2868462 - DNA, 17 bp, Homo sapiens
cactgttccccctgtgc

SEQ ID NO: 2868463 - DNA, 20 bp, Homo sapiens
cacttcaacccccagctaat

SEQ ID NO: 2868464 - DNA, 16 bp, Homo sapiens
cacttcattttgtata

SEQ ID NO: 2868465 - DNA, 22 bp, Homo sapiens
cacttgtgggtttttgttttgt

SEQ ID NO: 2868466 - DNA, 16 bp, Homo sapiens
cagaacccccaggtgg

SEQ ID NO: 2868467 - DNA, 18 bp, Homo sapiens
cagaagcattgcctggac

SEQ ID NO: 2868468 - DNA, 19 bp, Homo sapiens
cagaagcattgcctggact

SEQ ID NO: 2868469 - DNA, 12 bp, Homo sapiens
cagaagcttcca

SEQ ID NO: 2868470 - DNA, 18 bp, Homo sapiens
cagaaggcaaacccatca

SEQ ID NO: 2868471 - DNA, 19 bp, Homo sapiens
cagaatgcggcctctgaga

SEQ ID NO: 2868472 - DNA, 13 bp, Homo sapiens
cagaccaggaaag

SEQ ID NO: 2868473 - DNA, 12 bp, Homo sapiens
cagacctggctc

SEQ ID NO: 2868474 - DNA, 21 bp, Homo sapiens
cagacctggctctcagaggaa

SEQ ID NO: 2868475 - DNA, 13 bp, Homo sapiens
cagactcagctcc

SEQ ID NO: 2868476 - DNA, 22 bp, Homo sapiens
cagagaccccttcctttcctct

SEQ ID NO: 2868477 - DNA, 14 bp, Homo sapiens
cagagacttgggga

SEQ ID NO: 2868478 - DNA, 20 bp, Homo sapiens
cagagcaattccaggctgag

SEQ ID NO: 2868479 - DNA, 13 bp, Homo sapiens
cagagccaacctg

SEQ ID NO: 2868480 - DNA, 14 bp, Homo sapiens
cagagccaacctgg

SEQ ID NO: 2868481 - DNA, 18 bp, Homo sapiens
cagagccaacctggactt

SEQ ID NO: 2868482 - DNA, 23 bp, Homo sapiens
cagagccaacctggacttcctgt

SEQ ID NO: 2868483 - DNA, 16 bp, Homo sapiens
cagagcccctcctcca

SEQ ID NO: 2868484 - DNA, 19 bp, Homo sapiens
cagagccgtggtcctttgg

SEQ ID NO: 2868485 - DNA, 14 bp, Homo sapiens
cagagcttccctga

SEQ ID NO: 2868486 - DNA, 18 bp, Homo sapiens
cagagcttccctgactca

SEQ ID NO: 2868487 - DNA, 14 bp, Homo sapiens
cagagcttctctgg

SEQ ID NO: 2868488 - DNA, 18 bp, Homo sapiens
cagagcttctctgggctg

SEQ ID NO: 2868489 - DNA, 22 bp, Homo sapiens
cagagcttctctgggctgaatg

SEQ ID NO: 2868490 - DNA, 21 bp, Homo sapiens
cagaggaaaaatgggagccag

SEQ ID NO: 2868491 - DNA, 22 bp, Homo sapiens
cagaggaaaaatgggagccagg

SEQ ID NO: 2868492 - DNA, 17 bp, Homo sapiens
cagagtgagacccagcc

SEQ ID NO: 2868493 - DNA, 18 bp, Homo sapiens
cagagtttttaaagcctt

SEQ ID NO: 2868494 - DNA, 23 bp, Homo sapiens
cagagtttttaaagccttctgga

SEQ ID NO: 2868495 - DNA, 16 bp, Homo sapiens
cagataacttctttag

SEQ ID NO: 2868496 - DNA, 18 bp, Homo sapiens
cagatgatgctttggaag

SEQ ID NO: 2868497 - DNA, 17 bp, Homo sapiens
cagcaacgcttgtagaa

SEQ ID NO: 2868498 - DNA, 14 bp, Homo sapiens
cagcacctccaggc

SEQ ID NO: 2868499 - DNA, 18 bp, Homo sapiens
cagcacctccaggcctgt

SEQ ID NO: 2868500 - DNA, 18 bp, Homo sapiens
cagcactgcttgaggaaa

SEQ ID NO: 2868501 - DNA, 19 bp, Homo sapiens
cagcactgcttgaggaaaa

SEQ ID NO: 2868502 - DNA, 18 bp, Homo sapiens
cagcactttaaccctctc

SEQ ID NO: 2868503 - DNA, 21 bp, Homo sapiens
cagcactttaaccctctcttc

SEQ ID NO: 2868504 - DNA, 24 bp, Homo sapiens
cagcactttaaccctctcttccct

SEQ ID NO: 2868505 - DNA, 15 bp, Homo sapiens
cagcactttgggagg

SEQ ID NO: 2868506 - DNA, 11 bp, Homo sapiens
cagcatctgac

SEQ ID NO: 2868507 - DNA, 21 bp, Homo sapiens
cagccatagacctacagacct

SEQ ID NO: 2868508 - DNA, 18 bp, Homo sapiens
cagcccagagcctggctg

SEQ ID NO: 2868509 - DNA, 15 bp, Homo sapiens
cagcccccactttcc

SEQ ID NO: 2868510 - DNA, 17 bp, Homo sapiens
cagccccttgagaaacc

SEQ ID NO: 2868511 - DNA, 18 bp, Homo sapiens
cagccccttgagaaacct

SEQ ID NO: 2868512 - DNA, 15 bp, Homo sapiens
cagcccggggaggaa

SEQ ID NO: 2868513 - DNA, 19 bp, Homo sapiens
cagcctcccctgccagggc

SEQ ID NO: 2868514 - DNA, 22 bp, Homo sapiens
cagcctcccctgccagggcagg

SEQ ID NO: 2868515 - DNA, 16 bp, Homo sapiens
cagcctcttccccacc

SEQ ID NO: 2868516 - DNA, 18 bp, Homo sapiens
cagcctggtagaattggg

SEQ ID NO: 2868517 - DNA, 18 bp, Homo sapiens
cagcgatataattttatt

SEQ ID NO: 2868518 - DNA, 18 bp, Homo sapiens
cagcgtcctcctctgtga

SEQ ID NO: 2868519 - DNA, 19 bp, Homo sapiens
cagcgtgctttaaaaaata

SEQ ID NO: 2868520 - DNA, 12 bp, Homo sapiens
cagctaaagcaa

SEQ ID NO: 2868521 - DNA, 19 bp, Homo sapiens
cagctaaagcaatatgcat

SEQ ID NO: 2868522 - DNA, 18 bp, Homo sapiens
cagctaagatagaaagct

SEQ ID NO: 2868523 - DNA, 20 bp, Homo sapiens
cagctaagatagaaagctgg

SEQ ID NO: 2868524 - DNA, 21 bp, Homo sapiens
cagctaagatagaaagctgga

SEQ ID NO: 2868525 - DNA, 15 bp, Homo sapiens
cagctacttgggagg

SEQ ID NO: 2868526 - DNA, 11 bp, Homo sapiens
ccactgaggag

SEQ ID NO: 2868527 - DNA, 21 bp, Homo sapiens
ccactgaggagacagaaagcc

SEQ ID NO: 2868528 - DNA, 13 bp, Homo sapiens
ccacttaaaatgt

SEQ ID NO: 2868529 - DNA, 15 bp, Homo sapiens
ccagaagaaaatttg

SEQ ID NO: 2868530 - DNA, 13 bp, Homo sapiens
ccagactcagctc

SEQ ID NO: 2868531 - DNA, 18 bp, Homo sapiens
ccagagaccccttccttt

SEQ ID NO: 2868532 - DNA, 14 bp, Homo sapiens
ccagagccaacctg

SEQ ID NO: 2868533 - DNA, 17 bp, Homo sapiens
ccagagccaacctggac

SEQ ID NO: 2868534 - DNA, 18 bp, Homo sapiens
ccagagccaacctggact

SEQ ID NO: 2868535 - DNA, 21 bp, Homo sapiens
ccagagccaacctggacttcc

SEQ ID NO: 2868536 - DNA, 22 bp, Homo sapiens
ccagagccaacctggacttcct

SEQ ID NO: 2868537 - DNA, 15 bp, Homo sapiens
ccagaggactcccaa

SEQ ID NO: 2868538 - DNA, 20 bp, Homo sapiens
ccagaggactcccaaccctg

SEQ ID NO: 2868539 - DNA, 21 bp, Homo sapiens
ccagaggattgctgccccatc

SEQ ID NO: 2868540 - DNA, 21 bp, Homo sapiens
ccagagtttttaaagccttct

SEQ ID NO: 2868541 - DNA, 22 bp, Homo sapiens
ccagcactgcttgaggaaaaca

SEQ ID NO: 2868542 - DNA, 21 bp, Homo sapiens
ccagcccatccattaggccag

SEQ ID NO: 2868543 - DNA, 22 bp, Homo sapiens
ccagcccatccattaggccagc

SEQ ID NO: 2868544 - DNA, 22 bp, Homo sapiens
ccagctatgttatattgaaaaa

SEQ ID NO: 2868545 - DNA, 16 bp, Homo sapiens
ccagctctctctaccc

SEQ ID NO: 2868546 - DNA, 15 bp, Homo sapiens
ccagctctgaaacca

SEQ ID NO: 2868547 - DNA, 21 bp, Homo sapiens
ccagctctgtatcaggaccca

SEQ ID NO: 2868548 - DNA, 22 bp, Homo sapiens
ccagctcttctcttcctagatc

SEQ ID NO: 2868549 - DNA, 16 bp, Homo sapiens
ccaggaaaggcttggc

SEQ ID NO: 2868550 - DNA, 23 bp, Homo sapiens
ccaggaccagtcaacctgggcaa

SEQ ID NO: 2868551 - DNA, 20 bp, Homo sapiens
ccaggagaaggccaattcct

SEQ ID NO: 2868552 - DNA, 15 bp, Homo sapiens
ccaggagtaagacaa

SEQ ID NO: 2868553 - DNA, 16 bp, Homo sapiens
ccaggcattgccaagg

SEQ ID NO: 2868554 - DNA, 13 bp, Homo sapiens
ccaggctgagcca

SEQ ID NO: 2868555 - DNA, 14 bp, Homo sapiens
ccaggctgagccat

SEQ ID NO: 2868556 - DNA, 20 bp, Homo sapiens
ccaggctgagccatgaggag

SEQ ID NO: 2868557 - DNA, 23 bp, Homo sapiens
ccagggggcccgaacagggactt

SEQ ID NO: 2868558 - DNA, 16 bp, Homo sapiens
ccaggtggcctgcgtc

SEQ ID NO: 2868559 - DNA, 14 bp, Homo sapiens
ccagtcgggaggag

SEQ ID NO: 2868560 - DNA, 18 bp, Homo sapiens
ccatagacctacagacct

SEQ ID NO: 2868561 - DNA, 13 bp, Homo sapiens
ccatatgaatgaa

SEQ ID NO: 2868562 - DNA, 16 bp, Homo sapiens
ccatatttgatttcta

SEQ ID NO: 2868563 - DNA, 18 bp, Homo sapiens
ccatatttgatttctaat

SEQ ID NO: 2868564 - DNA, 15 bp, Homo sapiens
ccatattttaaattc

SEQ ID NO: 2868565 - DNA, 17 bp, Homo sapiens
ccatcaacaaaaattgt

SEQ ID NO: 2868566 - DNA, 12 bp, Homo sapiens
ccatcagtgctc

SEQ ID NO: 2868567 - DNA, 13 bp, Homo sapiens
ccatcccctttcc

SEQ ID NO: 2868568 - DNA, 21 bp, Homo sapiens
ccatcccctttcctccccacc

SEQ ID NO: 2868569 - DNA, 13 bp, Homo sapiens
ccatctggctttt

SEQ ID NO: 2868570 - DNA, 22 bp, Homo sapiens
ccatctgtgactataaagctgt

SEQ ID NO: 2868571 - DNA, 23 bp, Homo sapiens
ccatctgtgactataaagctgtt

SEQ ID NO: 2868572 - DNA, 20 bp, Homo sapiens
ccatgatactccactcccag

SEQ ID NO: 2868573 - DNA, 23 bp, Homo sapiens
ccatgatactccactcccagcag

SEQ ID NO: 2868574 - DNA, 19 bp, Homo sapiens
ccatggtgtgatcgtctga

SEQ ID NO: 2868575 - DNA, 15 bp, Homo sapiens
ccatgtagaaaattt

SEQ ID NO: 2868576 - DNA, 20 bp, Homo sapiens
ccattaggccagcaacgctt

SEQ ID NO: 2868577 - DNA, 22 bp, Homo sapiens
ccattcctgggaaatattccct

SEQ ID NO: 2868578 - DNA, 19 bp, Homo sapiens
ccattgaagccgactctgg

SEQ ID NO: 2868579 - DNA, 20 bp, Homo sapiens
ccattgaagccgactctggc

SEQ ID NO: 2868580 - DNA, 13 bp, Homo sapiens
ccattgaattctt

SEQ ID NO: 2868581 - DNA, 15 bp, Homo sapiens
ccattggatctcatt

SEQ ID NO: 2868582 - DNA, 12 bp, Homo sapiens
ccatttctattt

SEQ ID NO: 2868583 - DNA, 18 bp, Homo sapiens
ccatttggacaaaatgga

SEQ ID NO: 2868584 - DNA, 14 bp, Homo sapiens
cccaaagagaaaga

SEQ ID NO: 2868585 - DNA, 14 bp, Homo sapiens
cccaatatatgtat

SEQ ID NO: 2868586 - DNA, 12 bp, Homo sapiens
cccaatattata

SEQ ID NO: 2868587 - DNA, 17 bp, Homo sapiens
cccaatattataatttt

SEQ ID NO: 2868588 - DNA, 20 bp, Homo sapiens
cccacaggacatttctctaa

SEQ ID NO: 2868589 - DNA, 20 bp, Homo sapiens
cccaccaccttggactcctc

SEQ ID NO: 2868590 - DNA, 22 bp, Homo sapiens
cccaccaccttggactcctccc

SEQ ID NO: 2868591 - DNA, 15 bp, Homo sapiens
cccaccttccccaga

SEQ ID NO: 2868592 - DNA, 17 bp, Homo sapiens
cccagagaccccttcct

SEQ ID NO: 2868593 - DNA, 23 bp, Homo sapiens
cccagagaccccttcctttcctc

SEQ ID NO: 2868594 - DNA, 20 bp, Homo sapiens
cccagagcccctcctccagc

SEQ ID NO: 2868595 - DNA, 11 bp, Homo sapiens
cccagagcccg

SEQ ID NO: 2868596 - DNA, 19 bp, Homo sapiens
cccagagcccgcttttgtt

SEQ ID NO: 2868597 - DNA, 20 bp, Homo sapiens
cccagagcctggctgcccat

SEQ ID NO: 2868598 - DNA, 23 bp, Homo sapiens
cccagaggaaggggccagaggct

SEQ ID NO: 2868599 - DNA, 24 bp, Homo sapiens
cccagaggaaggggccagaggctc

SEQ ID NO: 2868600 - DNA, 15 bp, Homo sapiens
cccagccccacccct

SEQ ID NO: 2868601 - DNA, 21 bp, Homo sapiens
cccagccccacccctaagtgc

SEQ ID NO: 2868602 - DNA, 19 bp, Homo sapiens
cccagccctcatcccgagc

SEQ ID NO: 2868603 - DNA, 13 bp, Homo sapiens
cccaggcccgaga

SEQ ID NO: 2868604 - DNA, 13 bp, Homo sapiens
cccaggtggcctg

SEQ ID NO: 2868605 - DNA, 12 bp, Homo sapiens
cccatccccttt

SEQ ID NO: 2868606 - DNA, 19 bp, Homo sapiens
cccatcccctttcctcccc

SEQ ID NO: 2868607 - DNA, 21 bp, Homo sapiens
cccatgatactccactcccag

SEQ ID NO: 2868608 - DNA, 22 bp, Homo sapiens
cccatgatactccactcccagc

SEQ ID NO: 2868609 - DNA, 18 bp, Homo sapiens
cccattaggcatgcctaa

SEQ ID NO: 2868610 - DNA, 14 bp, Homo sapiens
cccattcctgggaa

SEQ ID NO: 2868611 - DNA, 17 bp, Homo sapiens
cccatttctatttattt

SEQ ID NO: 2868612 - DNA, 20 bp, Homo sapiens
cccatttctatttatttact

SEQ ID NO: 2868613 - DNA, 19 bp, Homo sapiens
ccccaacactgtccttccc

SEQ ID NO: 2868614 - DNA, 20 bp, Homo sapiens
ccccacaggcacattaactg

SEQ ID NO: 2868615 - DNA, 14 bp, Homo sapiens
ccccacccctaagt

SEQ ID NO: 2868616 - DNA, 21 bp, Homo sapiens
ccccacccctaagtgcccaaa

SEQ ID NO: 2868617 - DNA, 13 bp, Homo sapiens
ccccaccttcccc

SEQ ID NO: 2868618 - DNA, 19 bp, Homo sapiens
ccccagagcccctcctcca

SEQ ID NO: 2868619 - DNA, 21 bp, Homo sapiens
ccccagagcccctcctccagc

SEQ ID NO: 2868620 - DNA, 20 bp, Homo sapiens
ccccagctcttctcttccta

SEQ ID NO: 2868621 - DNA, 19 bp, Homo sapiens
ccccatggtcagccctagg

SEQ ID NO: 2868622 - DNA, 23 bp, Homo sapiens
ccccattcctgggaaatattccc

SEQ ID NO: 2868623 - DNA, 19 bp, Homo sapiens
cccccaggtggcctgcgtc

SEQ ID NO: 2868624 - DNA, 11 bp, Homo sapiens
cccccatcccc

SEQ ID NO: 2868625 - DNA, 21 bp, Homo sapiens
ccccctgtgcagccgctgagc

SEQ ID NO: 2868626 - DNA, 14 bp, Homo sapiens
ccccgtctctacta

SEQ ID NO: 2868627 - DNA, 17 bp, Homo sapiens
cccctaagtgcccaaag

SEQ ID NO: 2868628 - DNA, 13 bp, Homo sapiens
cccctcctccagc

SEQ ID NO: 2868629 - DNA, 14 bp, Homo sapiens
cccctctgtccagg

SEQ ID NO: 2868630 - DNA, 23 bp, Homo sapiens
cccctgccagggcagggccccag

SEQ ID NO: 2868631 - DNA, 11 bp, Homo sapiens
cccctggagcc

SEQ ID NO: 2868632 - DNA, 14 bp, Homo sapiens
ccccttccactgag

SEQ ID NO: 2868633 - DNA, 15 bp, Homo sapiens
ccccttcctttcctc

SEQ ID NO: 2868634 - DNA, 23 bp, Homo sapiens
ccccttcctttcctctgcagcac

SEQ ID NO: 2868635 - DNA, 10 bp, Homo sapiens
ctctttgaga

SEQ ID NO: 2868636 - DNA, 19 bp, Homo sapiens
ctcttttaatggcatttct

SEQ ID NO: 2868637 - DNA, 13 bp, Homo sapiens
ctgaaggagcccc

SEQ ID NO: 2868638 - DNA, 16 bp, Homo sapiens
ctgaagtatgaagtct

SEQ ID NO: 2868639 - DNA, 17 bp, Homo sapiens
ctgaatttgtatatgac

SEQ ID NO: 2868640 - DNA, 20 bp, Homo sapiens
ctgacaagatggaaaataaa

SEQ ID NO: 2868641 - DNA, 17 bp, Homo sapiens
ctgacactcccttgggc

SEQ ID NO: 2868642 - DNA, 18 bp, Homo sapiens
ctgaccaaagactgcaga

SEQ ID NO: 2868643 - DNA, 15 bp, Homo sapiens
ctgaccatctgtgac

SEQ ID NO: 2868644 - DNA, 17 bp, Homo sapiens
ctgaccatctgtgacta

SEQ ID NO: 2868645 - DNA, 20 bp, Homo sapiens
ctgacctccctctaatttat

SEQ ID NO: 2868646 - DNA, 12 bp, Homo sapiens
ctgactcagggc

SEQ ID NO: 2868647 - DNA, 15 bp, Homo sapiens
ctgactcagggctcc

SEQ ID NO: 2868648 - DNA, 17 bp, Homo sapiens
ctgactttttcccccca

SEQ ID NO: 2868649 - DNA, 20 bp, Homo sapiens
ctgagaaacactatttgtga

SEQ ID NO: 2868650 - DNA, 18 bp, Homo sapiens
ctgagcaccccctcattc

SEQ ID NO: 2868651 - DNA, 20 bp, Homo sapiens
ctgagcagtgaatgattcag

SEQ ID NO: 2868652 - DNA, 22 bp, Homo sapiens
ctgagccagattggccaattaa

SEQ ID NO: 2868653 - DNA, 14 bp, Homo sapiens
ctgagccatgagga

SEQ ID NO: 2868654 - DNA, 18 bp, Homo sapiens
ctgagctgaggcagcagt

SEQ ID NO: 2868655 - DNA, 22 bp, Homo sapiens
ctgaggaacccttacagtagga

SEQ ID NO: 2868656 - DNA, 13 bp, Homo sapiens
ctgaggagacaga

SEQ ID NO: 2868657 - DNA, 14 bp, Homo sapiens
ctgaggagacagaa

SEQ ID NO: 2868658 - DNA, 20 bp, Homo sapiens
ctgaggagacagaaagcctc

SEQ ID NO: 2868659 - DNA, 23 bp, Homo sapiens
ctgaggcagcagtgtgaggccag

SEQ ID NO: 2868660 - DNA, 24 bp, Homo sapiens
ctgaggcagcagtgtgaggccagg

SEQ ID NO: 2868661 - DNA, 16 bp, Homo sapiens
ctgaggctgagaaagc

SEQ ID NO: 2868662 - DNA, 12 bp, Homo sapiens
ctgagggagcct

SEQ ID NO: 2868663 - DNA, 13 bp, Homo sapiens
ctgagggagcctg

SEQ ID NO: 2868664 - DNA, 16 bp, Homo sapiens
ctgagggcagtcgata

SEQ ID NO: 2868665 - DNA, 12 bp, Homo sapiens
ctgatacctcaa

SEQ ID NO: 2868666 - DNA, 13 bp, Homo sapiens
ctgatccctctac

SEQ ID NO: 2868667 - DNA, 13 bp, Homo sapiens
ctgatcttttaaa

SEQ ID NO: 2868668 - DNA, 17 bp, Homo sapiens
ctgatcttttaaaatca

SEQ ID NO: 2868669 - DNA, 18 bp, Homo sapiens
ctgatcttttaaaatcat

SEQ ID NO: 2868670 - DNA, 12 bp, Homo sapiens
ctgatgaagaag

SEQ ID NO: 2868671 - DNA, 20 bp, Homo sapiens
ctgatgaagaagggggtggg

SEQ ID NO: 2868672 - DNA, 17 bp, Homo sapiens
ctgattcaagaaacaga

SEQ ID NO: 2868673 - DNA, 17 bp, Homo sapiens
ctgcaaaaggactctca

SEQ ID NO: 2868674 - DNA, 14 bp, Homo sapiens
ctgcaatcactgtg

SEQ ID NO: 2868675 - DNA, 14 bp, Homo sapiens
ctgcaccatcacac

SEQ ID NO: 2868676 - DNA, 24 bp, Homo sapiens
ctgcacctctggctagagccgagg

SEQ ID NO: 2868677 - DNA, 21 bp, Homo sapiens
ctgcagaacccccaggtggcc

SEQ ID NO: 2868678 - DNA, 18 bp, Homo sapiens
ctgcagcaaacactccac

SEQ ID NO: 2868679 - DNA, 18 bp, Homo sapiens
ctgcagcggcagagcaat

SEQ ID NO: 2868680 - DNA, 12 bp, Homo sapiens
ctgcaggctgca

SEQ ID NO: 2868681 - DNA, 12 bp, Homo sapiens
ctgcagggaaaa

SEQ ID NO: 2868682 - DNA, 23 bp, Homo sapiens
ctgcagggaaaattatttgcata

SEQ ID NO: 2868683 - DNA, 18 bp, Homo sapiens
ctgccaatctgtacaaaa

SEQ ID NO: 2868684 - DNA, 19 bp, Homo sapiens
ctgccaatctgtacaaaat

SEQ ID NO: 2868685 - DNA, 23 bp, Homo sapiens
ctgccacagcctcccctgccagg

SEQ ID NO: 2868686 - DNA, 17 bp, Homo sapiens
ctgccactgaggagaca

SEQ ID NO: 2868687 - DNA, 19 bp, Homo sapiens
ctgccactgaggagacaga

SEQ ID NO: 2868688 - DNA, 20 bp, Homo sapiens
ctgccactgaggagacagaa

SEQ ID NO: 2868689 - DNA, 21 bp, Homo sapiens
ctgccacttcaacccccagct

SEQ ID NO: 2868690 - DNA, 22 bp, Homo sapiens
ctgccacttcaacccccagcta

SEQ ID NO: 2868691 - DNA, 17 bp, Homo sapiens
ctgccagctctgtatca

SEQ ID NO: 2868692 - DNA, 11 bp, Homo sapiens
ctgccagggca

SEQ ID NO: 2868693 - DNA, 15 bp, Homo sapiens
ctgccagggcagggc

SEQ ID NO: 2868694 - DNA, 23 bp, Homo sapiens
ctgcctgacatttggagtgttcc

SEQ ID NO: 2868695 - DNA, 15 bp, Homo sapiens
ctgcctgcctcccct

SEQ ID NO: 2868696 - DNA, 20 bp, Homo sapiens
ctgcctgctcatggccctcg

SEQ ID NO: 2868697 - DNA, 16 bp, Homo sapiens
ctgccttcctcctggg

SEQ ID NO: 2868698 - DNA, 13 bp, Homo sapiens
ctgccttcgttta

SEQ ID NO: 2868699 - DNA, 15 bp, Homo sapiens
ctgccttgtccctct

SEQ ID NO: 2868700 - DNA, 19 bp, Homo sapiens
ctgccttgtccctctcact

SEQ ID NO: 2868701 - DNA, 20 bp, Homo sapiens
ctgcgtcttttttctcttcc

SEQ ID NO: 2868702 - DNA, 21 bp, Homo sapiens
ctgcgtcttttttctcttccc

SEQ ID NO: 2868703 - DNA, 13 bp, Homo sapiens
ctgctagactcct

SEQ ID NO: 2868704 - DNA, 17 bp, Homo sapiens
ctgctagactcctcagg

SEQ ID NO: 2868705 - DNA, 19 bp, Homo sapiens
ctgctagactcctcaggag

SEQ ID NO: 2868706 - DNA, 12 bp, Homo sapiens
ctgctgttgaac

SEQ ID NO: 2868707 - DNA, 15 bp, Homo sapiens
ctgctgttgaacttt

SEQ ID NO: 2868708 - DNA, 13 bp, Homo sapiens
ctgcttaattgct

SEQ ID NO: 2868709 - DNA, 13 bp, Homo sapiens
ctgcttgaggaaa

SEQ ID NO: 2868710 - DNA, 14 bp, Homo sapiens
ctgcttgaggaaaa

SEQ ID NO: 2868711 - DNA, 16 bp, Homo sapiens
ctgcttgaggaaaaca

SEQ ID NO: 2868712 - DNA, 19 bp, Homo sapiens
ctggactctcagtctctga

SEQ ID NO: 2868713 - DNA, 21 bp, Homo sapiens
ctggactgaccaaagactgca

SEQ ID NO: 2868714 - DNA, 12 bp, Homo sapiens
ctggacttcctg

SEQ ID NO: 2868715 - DNA, 14 bp, Homo sapiens
ctggaggcccctgg

SEQ ID NO: 2868716 - DNA, 14 bp, Homo sapiens
ctggaggcctcgcc

SEQ ID NO: 2868717 - DNA, 15 bp, Homo sapiens
ctggagggatgccac

SEQ ID NO: 2868718 - DNA, 18 bp, Homo sapiens
ctggatgccaaggagccc

SEQ ID NO: 2868719 - DNA, 18 bp, Homo sapiens
ctggatttgcagaagttt

SEQ ID NO: 2868720 - DNA, 13 bp, Homo sapiens
ctggcagaagcat

SEQ ID NO: 2868721 - DNA, 18 bp, Homo sapiens
ctggcagaagcattgcct

SEQ ID NO: 2868722 - DNA, 22 bp, Homo sapiens
ctggcgacacgtagcagcttag

SEQ ID NO: 2868723 - DNA, 18 bp, Homo sapiens
ctggcgactgcagctgca

SEQ ID NO: 2868724 - DNA, 19 bp, Homo sapiens
ctggctagagccgagggga

SEQ ID NO: 2868725 - DNA, 14 bp, Homo sapiens
ctggctctcagagg

SEQ ID NO: 2868726 - DNA, 15 bp, Homo sapiens
ctggctctcagagga

SEQ ID NO: 2868727 - DNA, 22 bp, Homo sapiens
ctggctttttctgccactgagg

SEQ ID NO: 2868728 - DNA, 23 bp, Homo sapiens
ctgggaagcttgagcctccccca

SEQ ID NO: 2868729 - DNA, 11 bp, Homo sapiens
ctgggagggca

SEQ ID NO: 2868730 - DNA, 15 bp, Homo sapiens
ctgggagggcagcag

SEQ ID NO: 2868731 - DNA, 17 bp, Homo sapiens
ctgggagggcagcaggg

SEQ ID NO: 2868732 - DNA, 13 bp, Homo sapiens
ctgggccctctct

SEQ ID NO: 2868733 - DNA, 13 bp, Homo sapiens
ctgggcctcctgc

SEQ ID NO: 2868734 - DNA, 19 bp, Homo sapiens
ctgggcctcctgcctccgg

SEQ ID NO: 2868735 - DNA, 19 bp, Homo sapiens
ctgggctgagggagcctgg

SEQ ID NO: 2868736 - DNA, 23 bp, Homo sapiens
ctgggctgtaacgtggcactggt

SEQ ID NO: 2868737 - DNA, 21 bp, Homo sapiens
ctgggcttcattccggactgg

SEQ ID NO: 2868738 - DNA, 22 bp, Homo sapiens
ctgggcttcattccggactggc

SEQ ID NO: 2868739 - DNA, 20 bp, Homo sapiens
ctgggcttggggcttcctaa

SEQ ID NO: 2868740 - DNA, 16 bp, Homo sapiens
ctgggggaagggtggt

SEQ ID NO: 2868741 - DNA, 19 bp, Homo sapiens
ctgggggtgccaggaccag

SEQ ID NO: 2868742 - DNA, 16 bp, Homo sapiens
ctggtaggttgggaca

SEQ ID NO: 2868743 - DNA, 15 bp, Homo sapiens
ctggtcttcactgcc

SEQ ID NO: 2868744 - DNA, 17 bp, Homo sapiens
ctggtgtaatctcaatg

SEQ ID NO: 2868745 - DNA, 18 bp, Homo sapiens
gcccctcctccagcccct

SEQ ID NO: 2868746 - DNA, 14 bp, Homo sapiens
gcccctggagccag

SEQ ID NO: 2868747 - DNA, 16 bp, Homo sapiens
gcccgaacagggactt

SEQ ID NO: 2868748 - DNA, 17 bp, Homo sapiens
gcccgaacagggacttg

SEQ ID NO: 2868749 - DNA, 23 bp, Homo sapiens
gcccgcttttgttcttccccaca

SEQ ID NO: 2868750 - DNA, 14 bp, Homo sapiens
gccctatgctgtgc

SEQ ID NO: 2868751 - DNA, 24 bp, Homo sapiens
gccctcggaggtccagctgggcct

SEQ ID NO: 2868752 - DNA, 16 bp, Homo sapiens
gccctctctgctctgc

SEQ ID NO: 2868753 - DNA, 16 bp, Homo sapiens
gccctctgaaataatg

SEQ ID NO: 2868754 - DNA, 16 bp, Homo sapiens
gccgactctggccctg

SEQ ID NO: 2868755 - DNA, 17 bp, Homo sapiens
gccgaggggagagaggg

SEQ ID NO: 2868756 - DNA, 17 bp, Homo sapiens
gccgctgagcgaggaga

SEQ ID NO: 2868757 - DNA, 21 bp, Homo sapiens
gccgggtctgcctcttctggg

SEQ ID NO: 2868758 - DNA, 23 bp, Homo sapiens
gcctaatatttaggcaagagaaa

SEQ ID NO: 2868759 - DNA, 14 bp, Homo sapiens
gcctacctgtatgt

SEQ ID NO: 2868760 - DNA, 23 bp, Homo sapiens
gcctagtgaaggcttctctctgt

SEQ ID NO: 2868761 - DNA, 12 bp, Homo sapiens
gcctcactgaaa

SEQ ID NO: 2868762 - DNA, 13 bp, Homo sapiens
gcctcccccaaag

SEQ ID NO: 2868763 - DNA, 14 bp, Homo sapiens
gcctcccctgccag

SEQ ID NO: 2868764 - DNA, 18 bp, Homo sapiens
gcctcccctgccagggca

SEQ ID NO: 2868765 - DNA, 14 bp, Homo sapiens
gcctccgctgggct

SEQ ID NO: 2868766 - DNA, 23 bp, Homo sapiens
gcctgcctcccctccgcagcagg

SEQ ID NO: 2868767 - DNA, 14 bp, Homo sapiens
gcctggactgacca

SEQ ID NO: 2868768 - DNA, 16 bp, Homo sapiens
gcctggactgaccaca

SEQ ID NO: 2868769 - DNA, 21 bp, Homo sapiens
gcctggatgccaaggagcccc

SEQ ID NO: 2868770 - DNA, 18 bp, Homo sapiens
gcctggcccacgccctcc

SEQ ID NO: 2868771 - DNA, 17 bp, Homo sapiens
gcctgggggtgccagga

SEQ ID NO: 2868772 - DNA, 21 bp, Homo sapiens
gcctgggggtgccaggaccag

SEQ ID NO: 2868773 - DNA, 14 bp, Homo sapiens
gcctgtcaccagag

SEQ ID NO: 2868774 - DNA, 22 bp, Homo sapiens
gcctgtcaccagagcttctctg

SEQ ID NO: 2868775 - DNA, 20 bp, Homo sapiens
gccttcatcctcctccccag

SEQ ID NO: 2868776 - DNA, 23 bp, Homo sapiens
gccttcatcctcctccccagctc

SEQ ID NO: 2868777 - DNA, 13 bp, Homo sapiens
gccttcctcctgg

SEQ ID NO: 2868778 - DNA, 17 bp, Homo sapiens
gccttcctcctgggccc

SEQ ID NO: 2868779 - DNA, 15 bp, Homo sapiens
gccttcgtttatatt

SEQ ID NO: 2868780 - DNA, 22 bp, Homo sapiens
gccttgtccctctcactcccca

SEQ ID NO: 2868781 - DNA, 22 bp, Homo sapiens
gccttttccttctggttctaac

SEQ ID NO: 2868782 - DNA, 19 bp, Homo sapiens
gcgaggagatgctccttgg

SEQ ID NO: 2868783 - DNA, 17 bp, Homo sapiens
gcgaggaggctccagag

SEQ ID NO: 2868784 - DNA, 17 bp, Homo sapiens
gcggcagagcaattcca

SEQ ID NO: 2868785 - DNA, 19 bp, Homo sapiens
gcggcagagcaattccagg

SEQ ID NO: 2868786 - DNA, 20 bp, Homo sapiens
gcgttctaaatatgaatgaa

SEQ ID NO: 2868787 - DNA, 17 bp, Homo sapiens
gctaaagcaatatgcat

SEQ ID NO: 2868788 - DNA, 18 bp, Homo sapiens
gctaagatagaaagctgg

SEQ ID NO: 2868789 - DNA, 20 bp, Homo sapiens
gctaagatagaaagctggac

SEQ ID NO: 2868790 - DNA, 22 bp, Homo sapiens
gctaagatagaaagctggactg

SEQ ID NO: 2868791 - DNA, 16 bp, Homo sapiens
gctagactcctcagga

SEQ ID NO: 2868792 - DNA, 22 bp, Homo sapiens
gctagactcctcaggagagacc

SEQ ID NO: 2868793 - DNA, 21 bp, Homo sapiens
gctataaatgccagagccaac

SEQ ID NO: 2868794 - DNA, 18 bp, Homo sapiens
gctatcggcagatgatgc

SEQ ID NO: 2868795 - DNA, 14 bp, Homo sapiens
gctatgacatgcaa

SEQ ID NO: 2868796 - DNA, 20 bp, Homo sapiens
gctcaagcattctgtttatc

SEQ ID NO: 2868797 - DNA, 18 bp, Homo sapiens
gctcacccccttctccat

SEQ ID NO: 2868798 - DNA, 13 bp, Homo sapiens
gctcatggccctc

SEQ ID NO: 2868799 - DNA, 12 bp, Homo sapiens
gctccagagggc

SEQ ID NO: 2868800 - DNA, 20 bp, Homo sapiens
gctccagagggcactctgct

SEQ ID NO: 2868801 - DNA, 14 bp, Homo sapiens
gctccataaagtac

SEQ ID NO: 2868802 - DNA, 16 bp, Homo sapiens
gctccctgactgggag

SEQ ID NO: 2868803 - DNA, 22 bp, Homo sapiens
gctcgtaaatattccctgacga

SEQ ID NO: 2868804 - DNA, 14 bp, Homo sapiens
gctctcagaggaaa

SEQ ID NO: 2868805 - DNA, 15 bp, Homo sapiens
gctctctaggcctct

SEQ ID NO: 2868806 - DNA, 19 bp, Homo sapiens
gctctctaggcctctccag

SEQ ID NO: 2868807 - DNA, 22 bp, Homo sapiens
gctctctctacccggcccagag

SEQ ID NO: 2868808 - DNA, 23 bp, Homo sapiens
gctctctctacccggcccagaga

SEQ ID NO: 2868809 - DNA, 17 bp, Homo sapiens
gctctgcgtgtcacctg

SEQ ID NO: 2868810 - DNA, 23 bp, Homo sapiens
gctctgtatcaggacccagagga

SEQ ID NO: 2868811 - DNA, 13 bp, Homo sapiens
gctcttctcttcc

SEQ ID NO: 2868812 - DNA, 17 bp, Homo sapiens
gctctttccaaattaaa

SEQ ID NO: 2868813 - DNA, 15 bp, Homo sapiens
gctgagccatgagga

SEQ ID NO: 2868814 - DNA, 16 bp, Homo sapiens
gctgagccatgaggag

SEQ ID NO: 2868815 - DNA, 18 bp, Homo sapiens
gctgagccatgaggagcg

SEQ ID NO: 2868816 - DNA, 23 bp, Homo sapiens
gctgagccatgaggagcgtggac

SEQ ID NO: 2868817 - DNA, 13 bp, Homo sapiens
gctgaggcagcag

SEQ ID NO: 2868818 - DNA, 23 bp, Homo sapiens
gctgaggcagcagtgtgaggcca

SEQ ID NO: 2868819 - DNA, 16 bp, Homo sapiens
gctgaggctgagaaag

SEQ ID NO: 2868820 - DNA, 17 bp, Homo sapiens
gctgaggctgagaaagc

SEQ ID NO: 2868821 - DNA, 15 bp, Homo sapiens
gctgcaccatcacac

SEQ ID NO: 2868822 - DNA, 19 bp, Homo sapiens
gctgcaccatcacacatgc

SEQ ID NO: 2868823 - DNA, 20 bp, Homo sapiens
gctgcacctctggctagagc

SEQ ID NO: 2868824 - DNA, 21 bp, Homo sapiens
gctgcacctctggctagagcc

SEQ ID NO: 2868825 - DNA, 21 bp, Homo sapiens
gctgcctctacctgacactcc

SEQ ID NO: 2868826 - DNA, 16 bp, Homo sapiens
gctgctgcctgctcat

SEQ ID NO: 2868827 - DNA, 15 bp, Homo sapiens
gctgctgttgaactt

SEQ ID NO: 2868828 - DNA, 16 bp, Homo sapiens
gctgctgtttgggttg

SEQ ID NO: 2868829 - DNA, 22 bp, Homo sapiens
gctggactctcagtctctgagc

SEQ ID NO: 2868830 - DNA, 23 bp, Homo sapiens
gctggactggaggcccctggagc

SEQ ID NO: 2868831 - DNA, 20 bp, Homo sapiens
gctggatgagaatttgagtg

SEQ ID NO: 2868832 - DNA, 17 bp, Homo sapiens
gctgggcctcctgcctc

SEQ ID NO: 2868833 - DNA, 15 bp, Homo sapiens
gctgggggaagggtg

SEQ ID NO: 2868834 - DNA, 18 bp, Homo sapiens
gctgtaacgtggcactgg

SEQ ID NO: 2868835 - DNA, 23 bp, Homo sapiens
gctgtggtgtgtccccctctgtc

SEQ ID NO: 2868836 - DNA, 13 bp, Homo sapiens
gctgttgaacttt

SEQ ID NO: 2868837 - DNA, 12 bp, Homo sapiens
gctgttgagctg

SEQ ID NO: 2868838 - DNA, 17 bp, Homo sapiens
gctgttttccctgacct

SEQ ID NO: 2868839 - DNA, 23 bp, Homo sapiens
gcttcattccggactggcagaag

SEQ ID NO: 2868840 - DNA, 23 bp, Homo sapiens
gcttcctttcctgtgtgtactct

SEQ ID NO: 2868841 - DNA, 18 bp, Homo sapiens
gcttcgggcccttcccac

SEQ ID NO: 2868842 - DNA, 14 bp, Homo sapiens
gcttctctctgtgg

SEQ ID NO: 2868843 - DNA, 16 bp, Homo sapiens
gcttctctctgtggga

SEQ ID NO: 2868844 - DNA, 13 bp, Homo sapiens
gcttctctgggct

SEQ ID NO: 2868845 - DNA, 16 bp, Homo sapiens
gcttgagcctccccca

SEQ ID NO: 2868846 - DNA, 16 bp, Homo sapiens
gcttggagcagagggg

SEQ ID NO: 2868847 - DNA, 18 bp, Homo sapiens
gcttggagcagaggggct

SEQ ID NO: 2868848 - DNA, 18 bp, Homo sapiens
gcttggctggtgtatgca

SEQ ID NO: 2868849 - DNA, 15 bp, Homo sapiens
gcttgttatttataa

SEQ ID NO: 2868850 - DNA, 12 bp, Homo sapiens
gctttcatgtaa

SEQ ID NO: 2868851 - DNA, 15 bp, Homo sapiens
gctttcatgtaaact

SEQ ID NO: 2868852 - DNA, 20 bp, Homo sapiens
gctttcatgtaaactgtgca

SEQ ID NO: 2868853 - DNA, 23 bp, Homo sapiens
gctttggcgaccccaatatatgt

SEQ ID NO: 2868854 - DNA, 20 bp, Homo sapiens
taaaatatcataaagcattt

SEQ ID NO: 2868855 - DNA, 15 bp, Homo sapiens
taaaatcctcaatcc

SEQ ID NO: 2868856 - DNA, 13 bp, Homo sapiens
taaaatctgtcac

SEQ ID NO: 2868857 - DNA, 16 bp, Homo sapiens
taaaatgatgttatac

SEQ ID NO: 2868858 - DNA, 22 bp, Homo sapiens
taaaatgttcacttttgacaaa

SEQ ID NO: 2868859 - DNA, 14 bp, Homo sapiens
taaacgattagtga

SEQ ID NO: 2868860 - DNA, 20 bp, Homo sapiens
taaactatgttcctaacaaa

SEQ ID NO: 2868861 - DNA, 13 bp, Homo sapiens
taaactgactttt

SEQ ID NO: 2868862 - DNA, 14 bp, Homo sapiens
taaactgtgcacca

SEQ ID NO: 2868863 - DNA, 23 bp, Homo sapiens
taaagatacagaactctttcaaa

SEQ ID NO: 2868864 - DNA, 22 bp, Homo sapiens
taaagtacttgactacctactg

SEQ ID NO: 2868865 - DNA, 23 bp, Homo sapiens
taaagttctgtactcaaatgtag

SEQ ID NO: 2868866 - DNA, 19 bp, Homo sapiens
taaataaaaatatgtaatt

SEQ ID NO: 2868867 - DNA, 18 bp, Homo sapiens
taaataaaatcatgtagt

SEQ ID NO: 2868868 - DNA, 13 bp, Homo sapiens
taaataacatgtt

SEQ ID NO: 2868869 - DNA, 21 bp, Homo sapiens
taaataagaaacaactctttg

SEQ ID NO: 2868870 - DNA, 22 bp, Homo sapiens
taaataagaaacaactctttga

SEQ ID NO: 2868871 - DNA, 18 bp, Homo sapiens
taaatagtgtcatataaa

SEQ ID NO: 2868872 - DNA, 21 bp, Homo sapiens
taaatagtgtcatataaactc

SEQ ID NO: 2868873 - DNA, 22 bp, Homo sapiens
taaatcagaaagtaacaatcta

SEQ ID NO: 2868874 - DNA, 13 bp, Homo sapiens
taaatgagctttc

SEQ ID NO: 2868875 - DNA, 20 bp, Homo sapiens
taaatgccagagccaacctg

SEQ ID NO: 2868876 - DNA, 19 bp, Homo sapiens
taaatgtatcttattcaca

SEQ ID NO: 2868877 - DNA, 14 bp, Homo sapiens
taaatgtgtaataa

SEQ ID NO: 2868878 - DNA, 18 bp, Homo sapiens
taaatgtgtaataatgta

SEQ ID NO: 2868879 - DNA, 20 bp, Homo sapiens
taaatgtgtaataatgtaac

SEQ ID NO: 2868880 - DNA, 22 bp, Homo sapiens
taaatgtgtaataatgtaacat

SEQ ID NO: 2868881 - DNA, 18 bp, Homo sapiens
taacatacaagaaaatgt

SEQ ID NO: 2868882 - DNA, 17 bp, Homo sapiens
taacatccaagccagag

SEQ ID NO: 2868883 - DNA, 20 bp, Homo sapiens
taacatgatttccctccaga

SEQ ID NO: 2868884 - DNA, 13 bp, Homo sapiens
taacatgtttctc

SEQ ID NO: 2868885 - DNA, 17 bp, Homo sapiens
taacatgtttctctata

SEQ ID NO: 2868886 - DNA, 22 bp, Homo sapiens
taacatgtttctctataaagta

SEQ ID NO: 2868887 - DNA, 15 bp, Homo sapiens
taaccaaccttgttt

SEQ ID NO: 2868888 - DNA, 17 bp, Homo sapiens
taaccaaggctgtgttt

SEQ ID NO: 2868889 - DNA, 18 bp, Homo sapiens
taaccagctcagtgtttt

SEQ ID NO: 2868890 - DNA, 18 bp, Homo sapiens
taacctcatcttcttcac

SEQ ID NO: 2868891 - DNA, 17 bp, Homo sapiens
taacctcttcagaggcc

SEQ ID NO: 2868892 - DNA, 21 bp, Homo sapiens
taactgccctctgaaataatg

SEQ ID NO: 2868893 - DNA, 23 bp, Homo sapiens
taactgttgcacttttgaatgtc

SEQ ID NO: 2868894 - DNA, 22 bp, Homo sapiens
taacttaaaaaactgcatccca

SEQ ID NO: 2868895 - DNA, 19 bp, Homo sapiens
taagaaagcctaaaattga

SEQ ID NO: 2868896 - DNA, 14 bp, Homo sapiens
taagaatggaagaa

SEQ ID NO: 2868897 - DNA, 17 bp, Homo sapiens
taagataaaatgatgtt

SEQ ID NO: 2868898 - DNA, 21 bp, Homo sapiens
taagatagaaagctggactga

SEQ ID NO: 2868899 - DNA, 16 bp, Homo sapiens
taagtagcattcatgt

SEQ ID NO: 2868900 - DNA, 15 bp, Homo sapiens
taagtagtaaatcag

SEQ ID NO: 2868901 - DNA, 13 bp, Homo sapiens
taagtatttcaaa

SEQ ID NO: 2868902 - DNA, 19 bp, Homo sapiens
taagtgatgtgctgaattt

SEQ ID NO: 2868903 - DNA, 16 bp, Homo sapiens
taagtgcccaaagtgg

SEQ ID NO: 2868904 - DNA, 16 bp, Homo sapiens
taagtgtaaaaaatgt

SEQ ID NO: 2868905 - DNA, 14 bp, Homo sapiens
taataaaaagaaag

SEQ ID NO: 2868906 - DNA, 15 bp, Homo sapiens
taataaaaagaaaga

SEQ ID NO: 2868907 - DNA, 17 bp, Homo sapiens
taataagtgatgtgctg

SEQ ID NO: 2868908 - DNA, 16 bp, Homo sapiens
taataatgtaacatga

SEQ ID NO: 2868909 - DNA, 15 bp, Homo sapiens
taatactactactgt

SEQ ID NO: 2868910 - DNA, 16 bp, Homo sapiens
taatatcaaataaaat

SEQ ID NO: 2868911 - DNA, 12 bp, Homo sapiens
taatatttaggc

SEQ ID NO: 2868912 - DNA, 15 bp, Homo sapiens
taatatttaggcaag

SEQ ID NO: 2868913 - DNA, 15 bp, Homo sapiens
taatctcaatgcaag

SEQ ID NO: 2868914 - DNA, 17 bp, Homo sapiens
taatgaagaaagtggaa

SEQ ID NO: 2868915 - DNA, 21 bp, Homo sapiens
taatgatcagcaaaaagactg

SEQ ID NO: 2868916 - DNA, 18 bp, Homo sapiens
taatgctaaatgtgtaat

SEQ ID NO: 2868917 - DNA, 14 bp, Homo sapiens
taatgctgtttcta

SEQ ID NO: 2868918 - DNA, 16 bp, Homo sapiens
taatgctgtttctaag

SEQ ID NO: 2868919 - DNA, 19 bp, Homo sapiens
taatgctgtttctaagaaa

SEQ ID NO: 2868920 - DNA, 14 bp, Homo sapiens
taatgtaacatgat

SEQ ID NO: 2868921 - DNA, 19 bp, Homo sapiens
taatgttgataatatatat

SEQ ID NO: 2868922 - DNA, 14 bp, Homo sapiens
taatgtttgaacaa

SEQ ID NO: 2868923 - DNA, 15 bp, Homo sapiens
taattcttttctgag

SEQ ID NO: 2868924 - DNA, 13 bp, Homo sapiens
taatttaactttc

SEQ ID NO: 2868925 - DNA, 24 bp, Homo sapiens
taatttagtaaataaacaagtcaa

SEQ ID NO: 2868926 - DNA, 17 bp, Homo sapiens
taatttgaactttggaa

SEQ ID NO: 2868927 - DNA, 18 bp, Homo sapiens
taatttgaactttggaac

SEQ ID NO: 2868928 - DNA, 17 bp, Homo sapiens
taattttcctaataaag

SEQ ID NO: 2868929 - DNA, 19 bp, Homo sapiens
tacaaatactcttaggaag

SEQ ID NO: 2868930 - DNA, 21 bp, Homo sapiens
tacaaatgaagaaagtcaaaa

SEQ ID NO: 2868931 - DNA, 18 bp, Homo sapiens
tacaagaaaatgtatcca

SEQ ID NO: 2868932 - DNA, 20 bp, Homo sapiens
tacactgcggaagccaaagg

SEQ ID NO: 2868933 - DNA, 17 bp, Homo sapiens
tacagaactctttcaaa

SEQ ID NO: 2868934 - DNA, 16 bp, Homo sapiens
tacagagcttccctga

SEQ ID NO: 2868935 - DNA, 22 bp, Homo sapiens
tacagtaggagcccagctctga

SEQ ID NO: 2868936 - DNA, 18 bp, Homo sapiens
tacagtcttccatttgca

SEQ ID NO: 2868937 - DNA, 19 bp, Homo sapiens
tacatatgctgatctttta

SEQ ID NO: 2868938 - DNA, 16 bp, Homo sapiens
tacatatttgtatgtt

SEQ ID NO: 2868939 - DNA, 17 bp, Homo sapiens
tacatcaatatgtatat

SEQ ID NO: 2868940 - DNA, 19 bp, Homo sapiens
tacattgtttgtctgtctt

SEQ ID NO: 2868941 - DNA, 23 bp, Homo sapiens
tacattgtttgtctgtcttcata

SEQ ID NO: 2868942 - DNA, 14 bp, Homo sapiens
tacattttctaaat

SEQ ID NO: 2868943 - DNA, 21 bp, Homo sapiens
tacattttctaaataaaaata

SEQ ID NO: 2868944 - DNA, 13 bp, Homo sapiens
taccaatgaaaaa

SEQ ID NO: 2868945 - DNA, 15 bp, Homo sapiens
taccaatgaaaaaat

SEQ ID NO: 2868946 - DNA, 17 bp, Homo sapiens
taccaatgaaaaaatgt

SEQ ID NO: 2868947 - DNA, 15 bp, Homo sapiens
taccagcgaggaggc

SEQ ID NO: 2868948 - DNA, 15 bp, Homo sapiens
taccatatgaatgaa

SEQ ID NO: 2868949 - DNA, 16 bp, Homo sapiens
taccatatgaatgaaa

SEQ ID NO: 2868950 - DNA, 22 bp, Homo sapiens
tacccggcccagagaccccttc

SEQ ID NO: 2868951 - DNA, 22 bp, Homo sapiens
taccctggtccagtcgggagga

SEQ ID NO: 2868952 - DNA, 13 bp, Homo sapiens
tacctcctgagaa

SEQ ID NO: 2868953 - DNA, 14 bp, Homo sapiens
tacctctgatacct

SEQ ID NO: 2868954 - DNA, 13 bp, Homo sapiens
tacctgaaaacac

SEQ ID NO: 2868955 - DNA, 17 bp, Homo sapiens
tacctgacactcccttg

SEQ ID NO: 2868956 - DNA, 16 bp, Homo sapiens
tacggttgtctagagg

SEQ ID NO: 2868957 - DNA, 14 bp, Homo sapiens
tactactactgtta

SEQ ID NO: 2868958 - DNA, 21 bp, Homo sapiens
tactagggatccctcatctgt

SEQ ID NO: 2868959 - DNA, 13 bp, Homo sapiens
tactctcccagat

SEQ ID NO: 2868960 - DNA, 21 bp, Homo sapiens
tactgcagcacctccaggcct

SEQ ID NO: 2868961 - DNA, 20 bp, Homo sapiens
tactgccaaaacatttatga

SEQ ID NO: 2868962 - DNA, 23 bp, Homo sapiens
tactgtattttgtattgtttcaa

SEQ ID NO: 2868963 - DNA, 16 bp, Homo sapiens
tactgtatttttcaga

SEQ ID NO: 2868964 - DNA, 16 bp, Homo sapiens
tccagcccctgtccca

SEQ ID NO: 2868965 - DNA, 14 bp, Homo sapiens
tccagctgggcctc

SEQ ID NO: 2868966 - DNA, 17 bp, Homo sapiens
tccagctgggcctcctg

SEQ ID NO: 2868967 - DNA, 23 bp, Homo sapiens
tccagctgggcctcctgcctccg

SEQ ID NO: 2868968 - DNA, 16 bp, Homo sapiens
tccaggagaaggccaa

SEQ ID NO: 2868969 - DNA, 20 bp, Homo sapiens
tccaggagaaggccaattcc

SEQ ID NO: 2868970 - DNA, 23 bp, Homo sapiens
tccaggagaaggccaattcctat

SEQ ID NO: 2868971 - DNA, 14 bp, Homo sapiens
tccaggcactgaga

SEQ ID NO: 2868972 - DNA, 15 bp, Homo sapiens
tccaggcctgaccag

SEQ ID NO: 2868973 - DNA, 16 bp, Homo sapiens
tccaggctgagccatg

SEQ ID NO: 2868974 - DNA, 21 bp, Homo sapiens
tccaggctgagccatgaggag

SEQ ID NO: 2868975 - DNA, 15 bp, Homo sapiens
tccagtcgggaggag

SEQ ID NO: 2868976 - DNA, 16 bp, Homo sapiens
tccagtgtctcggagg

SEQ ID NO: 2868977 - DNA, 22 bp, Homo sapiens
tccagttaaaaaaaattttaat

SEQ ID NO: 2868978 - DNA, 15 bp, Homo sapiens
tccagttcctttaga

SEQ ID NO: 2868979 - DNA, 17 bp, Homo sapiens
tccagttcctttagaaa

SEQ ID NO: 2868980 - DNA, 12 bp, Homo sapiens
tccagtttccca

SEQ ID NO: 2868981 - DNA, 19 bp, Homo sapiens
tccagtttgcacctgtccc

SEQ ID NO: 2868982 - DNA, 20 bp, Homo sapiens
tccataccccgccaaggaaa

SEQ ID NO: 2868983 - DNA, 16 bp, Homo sapiens
tccatatttgatttct

SEQ ID NO: 2868984 - DNA, 18 bp, Homo sapiens
tccatatttgatttctaa

SEQ ID NO: 2868985 - DNA, 15 bp, Homo sapiens
tccatccacatggga

SEQ ID NO: 2868986 - DNA, 15 bp, Homo sapiens
tccatccttgagatt

SEQ ID NO: 2868987 - DNA, 16 bp, Homo sapiens
tccatgggcagagccc

SEQ ID NO: 2868988 - DNA, 22 bp, Homo sapiens
tccatgggcagagcccaaggga

SEQ ID NO: 2868989 - DNA, 17 bp, Homo sapiens
tccattaggccagcaac

SEQ ID NO: 2868990 - DNA, 20 bp, Homo sapiens
tccattaggccagcaacgct

SEQ ID NO: 2868991 - DNA, 21 bp, Homo sapiens
tccattgaagccgactctggc

SEQ ID NO: 2868992 - DNA, 16 bp, Homo sapiens
tccattggatctcatt

SEQ ID NO: 2868993 - DNA, 15 bp, Homo sapiens
tccatttgcaaggga

SEQ ID NO: 2868994 - DNA, 17 bp, Homo sapiens
tccatttggacaaaatg

SEQ ID NO: 2868995 - DNA, 15 bp, Homo sapiens
tcccaaccctggctt

SEQ ID NO: 2868996 - DNA, 15 bp, Homo sapiens
tcccaattcacatct

SEQ ID NO: 2868997 - DNA, 16 bp, Homo sapiens
tcccagaccaggaaag

SEQ ID NO: 2868998 - DNA, 14 bp, Homo sapiens
tcccagagcccgct

SEQ ID NO: 2868999 - DNA, 18 bp, Homo sapiens
tcccagcactttgggagg

SEQ ID NO: 2869000 - DNA, 19 bp, Homo sapiens
tcccagcactttgggaggc

SEQ ID NO: 2869001 - DNA, 16 bp, Homo sapiens
tcccagctacttggga

SEQ ID NO: 2869002 - DNA, 18 bp, Homo sapiens
tcccagctacttgggagg

SEQ ID NO: 2869003 - DNA, 19 bp, Homo sapiens
tcccagctacttgggaggc

SEQ ID NO: 2869004 - DNA, 13 bp, Homo sapiens
tcccatctggctt

SEQ ID NO: 2869005 - DNA, 23 bp, Homo sapiens
tccccacaggcacattaactgtt

SEQ ID NO: 2869006 - DNA, 13 bp, Homo sapiens
tccccaccctcca

SEQ ID NO: 2869007 - DNA, 15 bp, Homo sapiens
tccccaccctccact

SEQ ID NO: 2869008 - DNA, 20 bp, Homo sapiens
tccccaccttccccagactc

SEQ ID NO: 2869009 - DNA, 17 bp, Homo sapiens
tccccagactcagctcc

SEQ ID NO: 2869010 - DNA, 18 bp, Homo sapiens
tcccccactactgcagca

SEQ ID NO: 2869011 - DNA, 14 bp, Homo sapiens
tcccctaacctcat

SEQ ID NO: 2869012 - DNA, 17 bp, Homo sapiens
tcccctcccacccacag

SEQ ID NO: 2869013 - DNA, 20 bp, Homo sapiens
tcccctcccacccacagcca

SEQ ID NO: 2869014 - DNA, 14 bp, Homo sapiens
tcccctccctcttc

SEQ ID NO: 2869015 - DNA, 15 bp, Homo sapiens
tcccctccctcttcc

SEQ ID NO: 2869016 - DNA, 15 bp, Homo sapiens
tcccctgccagggca

SEQ ID NO: 2869017 - DNA, 13 bp, Homo sapiens
tccccttccactg

SEQ ID NO: 2869018 - DNA, 18 bp, Homo sapiens
tccccttccactgagggc

SEQ ID NO: 2869019 - DNA, 18 bp, Homo sapiens
tccccttcgctgaaattg

SEQ ID NO: 2869020 - DNA, 12 bp, Homo sapiens
tcccctttcctc

SEQ ID NO: 2869021 - DNA, 18 bp, Homo sapiens
tccctagaaacttccaaa

SEQ ID NO: 2869022 - DNA, 21 bp, Homo sapiens
tccctctacagagcttccctg

SEQ ID NO: 2869023 - DNA, 16 bp, Homo sapiens
tccctctcactcccca

SEQ ID NO: 2869024 - DNA, 17 bp, Homo sapiens
tccctctcactccccag

SEQ ID NO: 2869025 - DNA, 17 bp, Homo sapiens
tccctctcccaggcccg

SEQ ID NO: 2869026 - DNA, 15 bp, Homo sapiens
tccctcttccttccc

SEQ ID NO: 2869027 - DNA, 16 bp, Homo sapiens
tccctcttccttcccc

SEQ ID NO: 2869028 - DNA, 21 bp, Homo sapiens
tccctgacctccctctaattt

SEQ ID NO: 2869029 - DNA, 24 bp, Homo sapiens
tccctgacgacactgaagaatcaa

SEQ ID NO: 2869030 - DNA, 14 bp, Homo sapiens
tccctgtaacctct

SEQ ID NO: 2869031 - DNA, 23 bp, Homo sapiens
tccctgtaacctcttcagaggcc

SEQ ID NO: 2869032 - DNA, 14 bp, Homo sapiens
tcccttcccagacc

SEQ ID NO: 2869033 - DNA, 15 bp, Homo sapiens
tccgcagcagggaag

SEQ ID NO: 2869034 - DNA, 14 bp, Homo sapiens
tccgctgggcttca

SEQ ID NO: 2869035 - DNA, 21 bp, Homo sapiens
tccgggacctggtgctgcctc

SEQ ID NO: 2869036 - DNA, 16 bp, Homo sapiens
tcctagatctgcaggc

SEQ ID NO: 2869037 - DNA, 14 bp, Homo sapiens
tcctatttttgtga

SEQ ID NO: 2869038 - DNA, 15 bp, Homo sapiens
tcctatttttgtgaa

SEQ ID NO: 2869039 - DNA, 16 bp, Homo sapiens
tcctatttttgtgaag

SEQ ID NO: 2869040 - DNA, 14 bp, Homo sapiens
tcctcaatccagct

SEQ ID NO: 2869041 - DNA, 19 bp, Homo sapiens
tcctccacgttctgctcat

SEQ ID NO: 2869042 - DNA, 23 bp, Homo sapiens
tcctccacgttctgctcatcatt

SEQ ID NO: 2869043 - DNA, 12 bp, Homo sapiens
tcctccagcccc

SEQ ID NO: 2869044 - DNA, 14 bp, Homo sapiens
tcctccagcccctg

SEQ ID NO: 2869045 - DNA, 15 bp, Homo sapiens
tcctccagcccctgt

SEQ ID NO: 2869046 - DNA, 13 bp, Homo sapiens
tcctcccacaatc

SEQ ID NO: 2869047 - DNA, 19 bp, Homo sapiens
tcctccccaccttccccag

SEQ ID NO: 2869048 - DNA, 22 bp, Homo sapiens
tcctccccaccttccccagact

SEQ ID NO: 2869049 - DNA, 22 bp, Homo sapiens
tcctccccagctcttctcttcc

SEQ ID NO: 2869050 - DNA, 13 bp, Homo sapiens
tcctcctccccag

SEQ ID NO: 2869051 - DNA, 11 bp, Homo sapiens
tcctcctctgt

SEQ ID NO: 2869052 - DNA, 18 bp, Homo sapiens
tcctctactaacaatcag

SEQ ID NO: 2869053 - DNA, 15 bp, Homo sapiens
tcctctgactcaggg

SEQ ID NO: 2869054 - DNA, 17 bp, Homo sapiens
tcctctgactcagggct

SEQ ID NO: 2869055 - DNA, 21 bp, Homo sapiens
tcctctgtgaccaatgtcttg

SEQ ID NO: 2869056 - DNA, 22 bp, Homo sapiens
tcctgacactcaataaacagtc

SEQ ID NO: 2869057 - DNA, 14 bp, Homo sapiens
tcctgatcagagcc

SEQ ID NO: 2869058 - DNA, 20 bp, Homo sapiens
tcctgcctccgggcaggcaa

SEQ ID NO: 2869059 - DNA, 22 bp, Homo sapiens
tcctgccttcctcctgggccct

SEQ ID NO: 2869060 - DNA, 22 bp, Homo sapiens
tcctggacatgaagattctttc

SEQ ID NO: 2869061 - DNA, 21 bp, Homo sapiens
tcctgggaaatattccctaga

SEQ ID NO: 2869062 - DNA, 13 bp, Homo sapiens
tccttaaaatgtg

SEQ ID NO: 2869063 - DNA, 9 bp, Homo sapiens
tccttcccc

SEQ ID NO: 2869064 - DNA, 22 bp, Homo sapiens
tccttcccccatcccctttcct

SEQ ID NO: 2869065 - DNA, 14 bp, Homo sapiens
tccttccctgccac

SEQ ID NO: 2869066 - DNA, 17 bp, Homo sapiens
tccttgagattctgaag

SEQ ID NO: 2869067 - DNA, 13 bp, Homo sapiens
tccttgggccctt

SEQ ID NO: 2869068 - DNA, 14 bp, Homo sapiens
tccttgggcccttt

SEQ ID NO: 2869069 - DNA, 23 bp, Homo sapiens
tcgccccaacactgtccttccct

SEQ ID NO: 2869070 - DNA, 19 bp, Homo sapiens
tcgcggcaggttctctttg

SEQ ID NO: 2869071 - DNA, 12 bp, Homo sapiens
tcggaaacactg

SEQ ID NO: 2869072 - DNA, 16 bp, Homo sapiens
tcggaaacactgactt

SEQ ID NO: 2869073 - DNA, 13 bp, Homo sapiens
tcgggacagagag

SEQ ID NO: 2869074 - DNA, 15 bp, Homo sapiens
tgcagcacctccagg

SEQ ID NO: 2869075 - DNA, 16 bp, Homo sapiens
tgcagcacctccaggc

SEQ ID NO: 2869076 - DNA, 22 bp, Homo sapiens
tgcagcactttaaccctctctt

SEQ ID NO: 2869077 - DNA, 23 bp, Homo sapiens
tgcagcactttaaccctctcttc

SEQ ID NO: 2869078 - DNA, 23 bp, Homo sapiens
tgcagcggcagagcaattccagg

SEQ ID NO: 2869079 - DNA, 18 bp, Homo sapiens
tgcataacaattcctcta

SEQ ID NO: 2869080 - DNA, 13 bp, Homo sapiens
tgcatatttgcca

SEQ ID NO: 2869081 - DNA, 18 bp, Homo sapiens
tgcatcccacgttctgtt

SEQ ID NO: 2869082 - DNA, 18 bp, Homo sapiens
tgcatctcccagataatg

SEQ ID NO: 2869083 - DNA, 19 bp, Homo sapiens
tgcatgcactgttccccct

SEQ ID NO: 2869084 - DNA, 22 bp, Homo sapiens
tgcatgcactgttccccctgtg

SEQ ID NO: 2869085 - DNA, 22 bp, Homo sapiens
tgcatttaaatacagtcttcca

SEQ ID NO: 2869086 - DNA, 14 bp, Homo sapiens
tgcattttgatatt

SEQ ID NO: 2869087 - DNA, 19 bp, Homo sapiens
tgcattttgatattgctgt

SEQ ID NO: 2869088 - DNA, 21 bp, Homo sapiens
tgccacagcctcccctgccag

SEQ ID NO: 2869089 - DNA, 20 bp, Homo sapiens
tgccacccagcaacacagag

SEQ ID NO: 2869090 - DNA, 21 bp, Homo sapiens
tgccacccagcaacacagagc

SEQ ID NO: 2869091 - DNA, 14 bp, Homo sapiens
tgccactgaggaga

SEQ ID NO: 2869092 - DNA, 23 bp, Homo sapiens
tgccactgaggagacagaaagcc

SEQ ID NO: 2869093 - DNA, 17 bp, Homo sapiens
tgccagagccaacctgg

SEQ ID NO: 2869094 - DNA, 23 bp, Homo sapiens
tgccagagccaacctggacttcc

SEQ ID NO: 2869095 - DNA, 23 bp, Homo sapiens
tgccagctctgtatcaggaccca

SEQ ID NO: 2869096 - DNA, 20 bp, Homo sapiens
tgccaggaccagtcaacctg

SEQ ID NO: 2869097 - DNA, 12 bp, Homo sapiens
tgccagggcagg

SEQ ID NO: 2869098 - DNA, 15 bp, Homo sapiens
tgccagggcagggcc

SEQ ID NO: 2869099 - DNA, 16 bp, Homo sapiens
tgccatcatctcctgc

SEQ ID NO: 2869100 - DNA, 22 bp, Homo sapiens
tgcccaaagtggggagggacaa

SEQ ID NO: 2869101 - DNA, 21 bp, Homo sapiens
tgcccagacatcagcctcctt

SEQ ID NO: 2869102 - DNA, 22 bp, Homo sapiens
tgcccatcatgtggccccaccc

SEQ ID NO: 2869103 - DNA, 16 bp, Homo sapiens
tgccccatcagtgctc

SEQ ID NO: 2869104 - DNA, 13 bp, Homo sapiens
tgcctcaagaaca

SEQ ID NO: 2869105 - DNA, 14 bp, Homo sapiens
tgcctcccctccgc

SEQ ID NO: 2869106 - DNA, 15 bp, Homo sapiens
tgcctcccctccgca

SEQ ID NO: 2869107 - DNA, 17 bp, Homo sapiens
tgcctctacctgacact

SEQ ID NO: 2869108 - DNA, 13 bp, Homo sapiens
tgcctcttctggg

SEQ ID NO: 2869109 - DNA, 21 bp, Homo sapiens
tgcctcttctgggagggcagc

SEQ ID NO: 2869110 - DNA, 11 bp, Homo sapiens
tgcctggactg

SEQ ID NO: 2869111 - DNA, 12 bp, Homo sapiens
tgcctggactga

SEQ ID NO: 2869112 - DNA, 13 bp, Homo sapiens
tgcctggactgac

SEQ ID NO: 2869113 - DNA, 15 bp, Homo sapiens
tgcctggactgacca

SEQ ID NO: 2869114 - DNA, 21 bp, Homo sapiens
tgccttattagagtgtctttc

SEQ ID NO: 2869115 - DNA, 14 bp, Homo sapiens
tgccttcctcctgg

SEQ ID NO: 2869116 - DNA, 16 bp, Homo sapiens
tgccttcctcctgggc

SEQ ID NO: 2869117 - DNA, 19 bp, Homo sapiens
tgcgtccacgagctgttta

SEQ ID NO: 2869118 - DNA, 14 bp, Homo sapiens
tgcgtcttttttct

SEQ ID NO: 2869119 - DNA, 16 bp, Homo sapiens
tgcgtcttttttctct

SEQ ID NO: 2869120 - DNA, 20 bp, Homo sapiens
tgcgtcttttttctcttccc

SEQ ID NO: 2869121 - DNA, 14 bp, Homo sapiens
tgctaaatgtgtaa

SEQ ID NO: 2869122 - DNA, 12 bp, Homo sapiens
tgctacttccca

SEQ ID NO: 2869123 - DNA, 19 bp, Homo sapiens
tgctacttcccactgtatg

SEQ ID NO: 2869124 - DNA, 21 bp, Homo sapiens
tgctagactcctcaggagaga

SEQ ID NO: 2869125 - DNA, 22 bp, Homo sapiens
tgctataaatgccagagccaac

SEQ ID NO: 2869126 - DNA, 23 bp, Homo sapiens
tgctataaatgccagagccaacc

SEQ ID NO: 2869127 - DNA, 20 bp, Homo sapiens
tgctatggcaggataagaaa

SEQ ID NO: 2869128 - DNA, 19 bp, Homo sapiens
tgctcatcattctctgtct

SEQ ID NO: 2869129 - DNA, 20 bp, Homo sapiens
tgctcatcattctctgtctc

SEQ ID NO: 2869130 - DNA, 23 bp, Homo sapiens
tgctcatcattctctgtctcatc

SEQ ID NO: 2869131 - DNA, 15 bp, Homo sapiens
tgctccctcacatgt

SEQ ID NO: 2869132 - DNA, 21 bp, Homo sapiens
tgctccttgggccctttgagt

SEQ ID NO: 2869133 - DNA, 16 bp, Homo sapiens
tgctctagtgggacag

SEQ ID NO: 2869134 - DNA, 19 bp, Homo sapiens
tgctgaacataacttctca

SEQ ID NO: 2869135 - DNA, 15 bp, Homo sapiens
tgctgatcttttaaa

SEQ ID NO: 2869136 - DNA, 9 bp, Homo sapiens
tgctgctgt

SEQ ID NO: 2869137 - DNA, 10 bp, Homo sapiens
tgctgctgtt

SEQ ID NO: 2869138 - DNA, 21 bp, Homo sapiens
tgctggactggaggcccctgg

SEQ ID NO: 2869139 - DNA, 15 bp, Homo sapiens
tgctgtggtgtgtcc

SEQ ID NO: 2869140 - DNA, 16 bp, Homo sapiens
tgctgtggtgtgtccc

SEQ ID NO: 2869141 - DNA, 17 bp, Homo sapiens
tgctgtggtgtgtcccc

SEQ ID NO: 2869142 - DNA, 23 bp, Homo sapiens
tgctgttaaaattaatatatcat

SEQ ID NO: 2869143 - DNA, 13 bp, Homo sapiens
tgctgtttctaag

SEQ ID NO: 2869144 - DNA, 23 bp, Homo sapiens
tgctgtttgggttgttggtctgt

SEQ ID NO: 2869145 - DNA, 13 bp, Homo sapiens
tgcttcgggccct

SEQ ID NO: 2869146 - DNA, 18 bp, Homo sapiens
tgcttcgggcccttccca

SEQ ID NO: 2869147 - DNA, 12 bp, Homo sapiens
tgcttgaggaaa

SEQ ID NO: 2869148 - DNA, 13 bp, Homo sapiens
tgcttgaggaaaa

SEQ ID NO: 2869149 - DNA, 23 bp, Homo sapiens
tggaaaagaatccctgcagcctg

SEQ ID NO: 2869150 - DNA, 17 bp, Homo sapiens
tggaagatgcagaagca

SEQ ID NO: 2869151 - DNA, 22 bp, Homo sapiens
tggaagatgcagaagcaataat

SEQ ID NO: 2869152 - DNA, 13 bp, Homo sapiens
tggacaaaatgga

SEQ ID NO: 2869153 - DNA, 14 bp, Homo sapiens
tggacaaaatggaa

SEQ ID NO: 2869154 - DNA, 20 bp, Homo sapiens
tggacacagacccacacatg

SEQ ID NO: 2869155 - DNA, 18 bp, Homo sapiens
tggacatgaagattcttt

SEQ ID NO: 2869156 - DNA, 22 bp, Homo sapiens
tggactctcagtctctgagcag

SEQ ID NO: 2869157 - DNA, 23 bp, Homo sapiens
tggactggaggcccctggagcca

SEQ ID NO: 2869158 - DNA, 16 bp, Homo sapiens
tggacttctgaagaga

SEQ ID NO: 2869159 - DNA, 17 bp, Homo sapiens
tggaggcccctggagcc

SEQ ID NO: 2869160 - DNA, 20 bp, Homo sapiens
tggaggcccctggagccaga

SEQ ID NO: 2869161 - DNA, 13 bp, Homo sapiens
tggagtgggagat

SEQ ID NO: 2869162 - DNA, 19 bp, Homo sapiens
tggagtgttccccttccac

SEQ ID NO: 2869163 - DNA, 22 bp, Homo sapiens
tggagtgttccccttccactga

SEQ ID NO: 2869164 - DNA, 18 bp, Homo sapiens
tggatcctcagttctcaa

SEQ ID NO: 2869165 - DNA, 22 bp, Homo sapiens
tggcaagagggtgacagcttcc

SEQ ID NO: 2869166 - DNA, 19 bp, Homo sapiens
tggcaatgccatcatctcc

SEQ ID NO: 2869167 - DNA, 17 bp, Homo sapiens
tggcatcttcaatatga

SEQ ID NO: 2869168 - DNA, 18 bp, Homo sapiens
tggccaattaaaaacgaa

SEQ ID NO: 2869169 - DNA, 21 bp, Homo sapiens
tggccctcggaggtccagctg

SEQ ID NO: 2869170 - DNA, 13 bp, Homo sapiens
tggccctggccct

SEQ ID NO: 2869171 - DNA, 16 bp, Homo sapiens
tggcgactgcagctgc

SEQ ID NO: 2869172 - DNA, 14 bp, Homo sapiens
tggctagagccgag

SEQ ID NO: 2869173 - DNA, 14 bp, Homo sapiens
tggctctcagagga

SEQ ID NO: 2869174 - DNA, 22 bp, Homo sapiens
tggctgcccatcatgtggcccc

SEQ ID NO: 2869175 - DNA, 16 bp, Homo sapiens
tggctgctgcctgctc

SEQ ID NO: 2869176 - DNA, 13 bp, Homo sapiens
tggcttatttcta

SEQ ID NO: 2869177 - DNA, 23 bp, Homo sapiens
tggctttttctgccactgaggag

SEQ ID NO: 2869178 - DNA, 17 bp, Homo sapiens
tgggaagcttgagcctc

SEQ ID NO: 2869179 - DNA, 19 bp, Homo sapiens
tgggaagcttgagcctccc

SEQ ID NO: 2869180 - DNA, 13 bp, Homo sapiens
tgggagccaggag

SEQ ID NO: 2869181 - DNA, 14 bp, Homo sapiens
tgggagccaggagt

SEQ ID NO: 2869182 - DNA, 22 bp, Homo sapiens
tgggaggctcacccccttctcc

SEQ ID NO: 2869183 - DNA, 21 bp, Homo sapiens
ttcacaatcttggggctgatg

SEQ ID NO: 2869184 - DNA, 11 bp, Homo sapiens
ttcacacctta

SEQ ID NO: 2869185 - DNA, 19 bp, Homo sapiens
ttcacatctaacctcatct

SEQ ID NO: 2869186 - DNA, 24 bp, Homo sapiens
ttcaccatttggcaatgccatcat

SEQ ID NO: 2869187 - DNA, 19 bp, Homo sapiens
ttcacctgtatatttcttt

SEQ ID NO: 2869188 - DNA, 19 bp, Homo sapiens
ttcacctgtttttaagctg

SEQ ID NO: 2869189 - DNA, 23 bp, Homo sapiens
ttcacctgtttttaagctgtttc

SEQ ID NO: 2869190 - DNA, 23 bp, Homo sapiens
ttcacgattaactgtgaaatgta

SEQ ID NO: 2869191 - DNA, 18 bp, Homo sapiens
ttcactactcatgcgtga

SEQ ID NO: 2869192 - DNA, 20 bp, Homo sapiens
ttcacttttgacaaaggcaa

SEQ ID NO: 2869193 - DNA, 16 bp, Homo sapiens
ttcagcaaattccaga

SEQ ID NO: 2869194 - DNA, 19 bp, Homo sapiens
ttcagctctttccaaatta

SEQ ID NO: 2869195 - DNA, 18 bp, Homo sapiens
ttcagtgttaaatgtgat

SEQ ID NO: 2869196 - DNA, 14 bp, Homo sapiens
ttcatattgtaatc

SEQ ID NO: 2869197 - DNA, 20 bp, Homo sapiens
ttcatcctcctccccagctc

SEQ ID NO: 2869198 - DNA, 22 bp, Homo sapiens
ttcatcctcctccccagctctt

SEQ ID NO: 2869199 - DNA, 16 bp, Homo sapiens
ttcatgattatagcaa

SEQ ID NO: 2869200 - DNA, 15 bp, Homo sapiens
ttcatgcctgatgaa

SEQ ID NO: 2869201 - DNA, 18 bp, Homo sapiens
ttcatgtaaactgtgcac

SEQ ID NO: 2869202 - DNA, 18 bp, Homo sapiens
ttcatgtaataaacaggt

SEQ ID NO: 2869203 - DNA, 22 bp, Homo sapiens
ttcattatgcacttttagaaat

SEQ ID NO: 2869204 - DNA, 9 bp, Homo sapiens
ttcattcag

SEQ ID NO: 2869205 - DNA, 13 bp, Homo sapiens
ttcattcttgaaa

SEQ ID NO: 2869206 - DNA, 19 bp, Homo sapiens
ttcattcttgaaagctgtg

SEQ ID NO: 2869207 - DNA, 19 bp, Homo sapiens
ttccaagtctctgtgtaac

SEQ ID NO: 2869208 - DNA, 15 bp, Homo sapiens
ttccacggagccact

SEQ ID NO: 2869209 - DNA, 16 bp, Homo sapiens
ttccactgagggcagt

SEQ ID NO: 2869210 - DNA, 15 bp, Homo sapiens
ttccaggctgagcca

SEQ ID NO: 2869211 - DNA, 20 bp, Homo sapiens
ttccagtcctaacaaatgct

SEQ ID NO: 2869212 - DNA, 17 bp, Homo sapiens
ttcccaaaacaatggtg

SEQ ID NO: 2869213 - DNA, 11 bp, Homo sapiens
ttcccagacca

SEQ ID NO: 2869214 - DNA, 21 bp, Homo sapiens
ttcccagaccaggaaaggctt

SEQ ID NO: 2869215 - DNA, 18 bp, Homo sapiens
ttccccaaccacttcatt

SEQ ID NO: 2869216 - DNA, 13 bp, Homo sapiens
ttccccagactca

SEQ ID NO: 2869217 - DNA, 17 bp, Homo sapiens
ttccccagactcagctc

SEQ ID NO: 2869218 - DNA, 21 bp, Homo sapiens
ttccccagactcagctccaga

SEQ ID NO: 2869219 - DNA, 18 bp, Homo sapiens
ttcccccactactgcagc

SEQ ID NO: 2869220 - DNA, 14 bp, Homo sapiens
ttccccttccactg

SEQ ID NO: 2869221 - DNA, 21 bp, Homo sapiens
ttccccttccactgagggcag

SEQ ID NO: 2869222 - DNA, 22 bp, Homo sapiens
ttccctagaaacttccaaatcc

SEQ ID NO: 2869223 - DNA, 24 bp, Homo sapiens
ttccctccagagaaagcacaattt

SEQ ID NO: 2869224 - DNA, 13 bp, Homo sapiens
ttccctgactcat

SEQ ID NO: 2869225 - DNA, 12 bp, Homo sapiens
ttccctgccact

SEQ ID NO: 2869226 - DNA, 19 bp, Homo sapiens
ttccctgccacttcaaccc

SEQ ID NO: 2869227 - DNA, 15 bp, Homo sapiens
ttcctaataaagttc

SEQ ID NO: 2869228 - DNA, 19 bp, Homo sapiens
ttcctatacgcagcgtgct

SEQ ID NO: 2869229 - DNA, 14 bp, Homo sapiens
ttcctcctgggccc

SEQ ID NO: 2869230 - DNA, 15 bp, Homo sapiens
ttcctcctgggccct

SEQ ID NO: 2869231 - DNA, 21 bp, Homo sapiens
ttcctcctgggccctctctgc

SEQ ID NO: 2869232 - DNA, 17 bp, Homo sapiens
ttcctgggaaatattcc

SEQ ID NO: 2869233 - DNA, 14 bp, Homo sapiens
ttcctgggcaagaa

SEQ ID NO: 2869234 - DNA, 18 bp, Homo sapiens
ttccttctggttctaact

SEQ ID NO: 2869235 - DNA, 15 bp, Homo sapiens
ttcctttcctctgca

SEQ ID NO: 2869236 - DNA, 23 bp, Homo sapiens
ttcgaggggttccttccacttct

SEQ ID NO: 2869237 - DNA, 11 bp, Homo sapiens
ttcggaaacac

SEQ ID NO: 2869238 - DNA, 13 bp, Homo sapiens
ttcgtttatattt

SEQ ID NO: 2869239 - DNA, 23 bp, Homo sapiens
ttctaaactccctggctgttctg

SEQ ID NO: 2869240 - DNA, 17 bp, Homo sapiens
ttctaaatatgaatgaa

SEQ ID NO: 2869241 - DNA, 17 bp, Homo sapiens
ttctaagaaaatgtagt

SEQ ID NO: 2869242 - DNA, 22 bp, Homo sapiens
ttctaagaaaatgtagttagct

SEQ ID NO: 2869243 - DNA, 14 bp, Homo sapiens
ttctaatagaactc

SEQ ID NO: 2869244 - DNA, 16 bp, Homo sapiens
ttctacctacatattt

SEQ ID NO: 2869245 - DNA, 12 bp, Homo sapiens
ttctagctgttg

SEQ ID NO: 2869246 - DNA, 20 bp, Homo sapiens
ttctagctgttgagctgttt

SEQ ID NO: 2869247 - DNA, 21 bp, Homo sapiens
ttctagctgttgagctgtttt

SEQ ID NO: 2869248 - DNA, 14 bp, Homo sapiens
ttctatgacaaatt

SEQ ID NO: 2869249 - DNA, 16 bp, Homo sapiens
ttctatgacaaattca

SEQ ID NO: 2869250 - DNA, 17 bp, Homo sapiens
ttctatttctcctccat

SEQ ID NO: 2869251 - DNA, 11 bp, Homo sapiens
ttctcaatgta

SEQ ID NO: 2869252 - DNA, 24 bp, Homo sapiens
ttctcataagtagcattcatgtaa

SEQ ID NO: 2869253 - DNA, 20 bp, Homo sapiens
ttctccatccacatgggagc

SEQ ID NO: 2869254 - DNA, 18 bp, Homo sapiens
ttctctagctctctaggc

SEQ ID NO: 2869255 - DNA, 20 bp, Homo sapiens
ttctctgtgaacgatttaga

SEQ ID NO: 2869256 - DNA, 16 bp, Homo sapiens
ttctgaagtatgaagt

SEQ ID NO: 2869257 - DNA, 18 bp, Homo sapiens
ttctgaagtatgaagtct

SEQ ID NO: 2869258 - DNA, 20 bp, Homo sapiens
ttctgaagtatgaagtctga

SEQ ID NO: 2869259 - DNA, 15 bp, Homo sapiens
ttctgccactgagga

SEQ ID NO: 2869260 - DNA, 13 bp, Homo sapiens
ttctgctcatcat

SEQ ID NO: 2869261 - DNA, 20 bp, Homo sapiens
ttctgggaagcttgagcctc

SEQ ID NO: 2869262 - DNA, 22 bp, Homo sapiens
ttctgggaagcttgagcctccc

SEQ ID NO: 2869263 - DNA, 21 bp, Homo sapiens
ttctgggagggcagcagggct

SEQ ID NO: 2869264 - DNA, 15 bp, Homo sapiens
ttctggtcttcactg

SEQ ID NO: 2869265 - DNA, 21 bp, Homo sapiens
ttctggttctaactgctgtta

SEQ ID NO: 2869266 - DNA, 18 bp, Homo sapiens
ttctgtactcaaatgtag

SEQ ID NO: 2869267 - DNA, 18 bp, Homo sapiens
ttcttcgctgctagagaa

SEQ ID NO: 2869268 - DNA, 13 bp, Homo sapiens
ttcttgaaagctg

SEQ ID NO: 2869269 - DNA, 14 bp, Homo sapiens
ttcttgaaagctgt

SEQ ID NO: 2869270 - DNA, 16 bp, Homo sapiens
ttcttggttgaggaaa

SEQ ID NO: 2869271 - DNA, 14 bp, Homo sapiens
ttcttgtttgtcag

SEQ ID NO: 2869272 - DNA, 12 bp, Homo sapiens
ttctttgcaata

SEQ ID NO: 2869273 - DNA, 17 bp, Homo sapiens
ttctttgcaatactgct

SEQ ID NO: 2869274 - DNA, 20 bp, Homo sapiens
ttgaaaaaatagagcctgag

SEQ ID NO: 2869275 - DNA, 22 bp, Homo sapiens
ttgaaaaaatagagcctgaggg

SEQ ID NO: 2869276 - DNA, 19 bp, Homo sapiens
ttgaagccgactctggccc

SEQ ID NO: 2869277 - DNA, 12 bp, Homo sapiens
ttgaataaataa

SEQ ID NO: 2869278 - DNA, 18 bp, Homo sapiens
ttgacaaaggcaagcact

SEQ ID NO: 2869279 - DNA, 18 bp, Homo sapiens
ttgacaggttttccaaaa

SEQ ID NO: 2869280 - DNA, 22 bp, Homo sapiens
ttgagaaaccttattgtacctc

SEQ ID NO: 2869281 - DNA, 18 bp, Homo sapiens
ttgagaggaggacttggt

SEQ ID NO: 2869282 - DNA, 12 bp, Homo sapiens
ttgagctgtttt

SEQ ID NO: 2869283 - DNA, 18 bp, Homo sapiens
ttgagctgttttccctga

SEQ ID NO: 2869284 - DNA, 23 bp, Homo sapiens
ttgaggaaaacaagcattcacaa

SEQ ID NO: 2869285 - DNA, 21 bp, Homo sapiens
ttgataagctattgtctgtaa

SEQ ID NO: 2869286 - DNA, 22 bp, Homo sapiens
ttgataagctattgtctgtaat

SEQ ID NO: 2869287 - DNA, 13 bp, Homo sapiens
ttgcaagggaaaa

SEQ ID NO: 2869288 - DNA, 11 bp, Homo sapiens
ttgcaatgcag

SEQ ID NO: 2869289 - DNA, 22 bp, Homo sapiens
ttgcacttttgaatgtccaaaa

SEQ ID NO: 2869290 - DNA, 23 bp, Homo sapiens
ttgcagcctgctctagtgggaca

SEQ ID NO: 2869291 - DNA, 19 bp, Homo sapiens
ttgcccactgcctgcctcc

SEQ ID NO: 2869292 - DNA, 19 bp, Homo sapiens
ttgctgataccatatgaat

SEQ ID NO: 2869293 - DNA, 19 bp, Homo sapiens
ccaacctggacttcctgtc

SEQ ID NO: 2869294 - DNA, 18 bp, Homo sapiens
ccaagatggctgctgcct

SEQ ID NO: 2869295 - DNA, 20 bp, Homo sapiens
ccaagatggctgctgcctgc

SEQ ID NO: 2869296 - DNA, 16 bp, Homo sapiens
aggcacattaactgtt

SEQ ID NO: 2869297 - DNA, 22 bp, Homo sapiens
aggcagctaagatagaaagctg

SEQ ID NO: 2869298 - DNA, 23 bp, Homo sapiens
aggcagctaagatagaaagctgg

SEQ ID NO: 2869299 - DNA, 15 bp, Homo sapiens
aggcaggggtgggag

SEQ ID NO: 2869300 - DNA, 17 bp, Homo sapiens
aggcaggggtgggagag

SEQ ID NO: 2869301 - DNA, 18 bp, Homo sapiens
aggcaggggtgggagagc

SEQ ID NO: 2869302 - DNA, 16 bp, Homo sapiens
aggcattgccaagggc

SEQ ID NO: 2869303 - DNA, 18 bp, Homo sapiens
aggcattgccaagggctt

SEQ ID NO: 2869304 - DNA, 21 bp, Homo sapiens
aggcattgccaagggctttgt

SEQ ID NO: 2869305 - DNA, 16 bp, Homo sapiens
aggccaagatggctgc

SEQ ID NO: 2869306 - DNA, 18 bp, Homo sapiens
aggccaagatggctgctg

SEQ ID NO: 2869307 - DNA, 14 bp, Homo sapiens
aggcccctggagcc

SEQ ID NO: 2869308 - DNA, 17 bp, Homo sapiens
aggccctcgctgccagc

SEQ ID NO: 2869309 - DNA, 22 bp, Homo sapiens
aggccctcgctgccagctctgt

SEQ ID NO: 2869310 - DNA, 21 bp, Homo sapiens
aggcctctccagtttgcacct

SEQ ID NO: 2869311 - DNA, 23 bp, Homo sapiens
aggcctctccagtttgcacctgt

SEQ ID NO: 2869312 - DNA, 20 bp, Homo sapiens
aggcctgttgctatagagcc

SEQ ID NO: 2869313 - DNA, 21 bp, Homo sapiens
aggccttcatcctcctcccca

SEQ ID NO: 2869314 - DNA, 19 bp, Homo sapiens
aggctcacccccttctcca

SEQ ID NO: 2869315 - DNA, 13 bp, Homo sapiens
aggctccagaggg

SEQ ID NO: 2869316 - DNA, 16 bp, Homo sapiens
aggctgagccatgagg

SEQ ID NO: 2869317 - DNA, 19 bp, Homo sapiens
cctgagaaacactatttgt

SEQ ID NO: 2869318 - DNA, 16 bp, Homo sapiens
cctgagctgaggcagc

SEQ ID NO: 2869319 - DNA, 21 bp, Homo sapiens
cctgatgtcagctgctgttga

SEQ ID NO: 2869320 - DNA, 17 bp, Homo sapiens
cctgcaaaaggactctc

SEQ ID NO: 2869321 - DNA, 19 bp, Homo sapiens
cctgcagcaaacactccac

SEQ ID NO: 2869322 - DNA, 15 bp, Homo sapiens
cctgcagcctggtag

SEQ ID NO: 2869323 - DNA, 15 bp, Homo sapiens
cctgcccccaatcca

SEQ ID NO: 2869324 - DNA, 16 bp, Homo sapiens
cctgcccccaatccat

SEQ ID NO: 2869325 - DNA, 19 bp, Homo sapiens
cctgcctcccctccgcagc

SEQ ID NO: 2869326 - DNA, 14 bp, Homo sapiens
cctgccttcctcct

SEQ ID NO: 2869327 - DNA, 17 bp, Homo sapiens
cctgccttcctcctggg

SEQ ID NO: 2869328 - DNA, 22 bp, Homo sapiens
cctgccttcctcctgggccctc

SEQ ID NO: 2869329 - DNA, 11 bp, Homo sapiens
ctagagccgag

SEQ ID NO: 2869330 - DNA, 20 bp, Homo sapiens
ctagagccgaggggagagag

SEQ ID NO: 2869331 - DNA, 21 bp, Homo sapiens
ctagagccgaggggagagagg

SEQ ID NO: 2869332 - DNA, 19 bp, Homo sapiens
ctagatctgcaggctgcac

SEQ ID NO: 2869333 - DNA, 15 bp, Homo sapiens
ctagctctctaggcc

SEQ ID NO: 2869334 - DNA, 18 bp, Homo sapiens
ctagctgttgagctgttt

SEQ ID NO: 2869335 - DNA, 12 bp, Homo sapiens
ctaggccgggcg

SEQ ID NO: 2869336 - DNA, 15 bp, Homo sapiens
ctaggcctctccagt

SEQ ID NO: 2869337 - DNA, 17 bp, Homo sapiens
ctagtgggacagcccag

SEQ ID NO: 2869338 - DNA, 18 bp, Homo sapiens
ctagtgggacagcccaga

SEQ ID NO: 2869339 - DNA, 22 bp, Homo sapiens
ctagtgggacagcccagagcct

SEQ ID NO: 2869340 - DNA, 13 bp, Homo sapiens
ctataaagctgtt

SEQ ID NO: 2869341 - DNA, 17 bp, Homo sapiens
ctatcagttgatttttc

SEQ ID NO: 2869342 - DNA, 17 bp, Homo sapiens
ctatccacactgtcaaa

SEQ ID NO: 2869343 - DNA, 15 bp, Homo sapiens
ctatcttctttggac

SEQ ID NO: 2869344 - DNA, 18 bp, Homo sapiens
ctatcttctttggacttc

SEQ ID NO: 2869345 - DNA, 20 bp, Homo sapiens
ctggaggcccctggagccag

SEQ ID NO: 2869346 - DNA, 21 bp, Homo sapiens
ctggaggcccctggagccaga

SEQ ID NO: 2869347 - DNA, 19 bp, Homo sapiens
ctggatgccaaggagcccc

SEQ ID NO: 2869348 - DNA, 17 bp, Homo sapiens
ctggatttgcagaagtt

SEQ ID NO: 2869349 - DNA, 22 bp, Homo sapiens
ctggcagaagcattgcctggac

SEQ ID NO: 2869350 - DNA, 23 bp, Homo sapiens
ctggcagaagcattgcctggact

SEQ ID NO: 2869351 - DNA, 16 bp, Homo sapiens
ctggcccacgccctcc

SEQ ID NO: 2869352 - DNA, 22 bp, Homo sapiens
ctggcccacgccctccctctcc

SEQ ID NO: 2869353 - DNA, 19 bp, Homo sapiens
ctggcccttacttgcttct

SEQ ID NO: 2869354 - DNA, 16 bp, Homo sapiens
ctggcgactgcagctg

SEQ ID NO: 2869355 - DNA, 16 bp, Homo sapiens
ctggctctcagaggaa

SEQ ID NO: 2869356 - DNA, 17 bp, Homo sapiens
ctggctctcagaggaaa

SEQ ID NO: 2869357 - DNA, 23 bp, Homo sapiens
ctggctgttctgatcggccagtt

SEQ ID NO: 2869358 - DNA, 20 bp, Homo sapiens
ctggctttttctgccactga

SEQ ID NO: 2869359 - DNA, 20 bp, Homo sapiens
ctgggaagcttgagcctccc

SEQ ID NO: 2869360 - DNA, 22 bp, Homo sapiens
ctgggagggcagcagggctacc

SEQ ID NO: 2869361 - DNA, 23 bp, Homo sapiens
ctgggagttgatcgcctttccca

SEQ ID NO: 2869362 - DNA, 14 bp, Homo sapiens
ctgggccctctctg

SEQ ID NO: 2869363 - DNA, 15 bp, Homo sapiens
ctgggccctctctgc

SEQ ID NO: 2869364 - DNA, 16 bp, Homo sapiens
ctgggcctcctgcctc

SEQ ID NO: 2869365 - DNA, 12 bp, Homo sapiens
ctgggctgaggg

SEQ ID NO: 2869366 - DNA, 18 bp, Homo sapiens
ctgggctgagggagcctg

SEQ ID NO: 2869367 - DNA, 23 bp, Homo sapiens
ctgggctgagggagcctggcccc

SEQ ID NO: 2869368 - DNA, 12 bp, Homo sapiens
ctgggctgttgt

SEQ ID NO: 2869369 - DNA, 19 bp, Homo sapiens
ctgggcttcattccggact

SEQ ID NO: 2869370 - DNA, 20 bp, Homo sapiens
ctgggcttcattccggactg

SEQ ID NO: 2869371 - DNA, 14 bp, Homo sapiens
ctggggctctggga

SEQ ID NO: 2869372 - DNA, 13 bp, Homo sapiens
ctgggtgacagag

SEQ ID NO: 2869373 - DNA, 20 bp, Homo sapiens
ctggtaggttgggacaccag

SEQ ID NO: 2869374 - DNA, 22 bp, Homo sapiens
ctggtaggttgggacaccaggg

SEQ ID NO: 2869375 - DNA, 16 bp, Homo sapiens
ctggtcttcactgcca

SEQ ID NO: 2869376 - DNA, 19 bp, Homo sapiens
ctggtgctgcctctacctg

SEQ ID NO: 2869377 - DNA, 12 bp, Homo sapiens
ctggtgtatgca

SEQ ID NO: 2869378 - DNA, 19 bp, Homo sapiens
ctgtaacctcttcagaggc

SEQ ID NO: 2869379 - DNA, 13 bp, Homo sapiens
ctgtacaaaatgg

SEQ ID NO: 2869380 - DNA, 17 bp, Homo sapiens
ctgtagagccaattaga

SEQ ID NO: 2869381 - DNA, 14 bp, Homo sapiens
ctgtatcactgcct

SEQ ID NO: 2869382 - DNA, 15 bp, Homo sapiens
ctgtattaagccact

SEQ ID NO: 2869383 - DNA, 20 bp, Homo sapiens
ctgtattactgaataatatc

SEQ ID NO: 2869384 - DNA, 20 bp, Homo sapiens
ctgtattttgtattgtttca

SEQ ID NO: 2869385 - DNA, 23 bp, Homo sapiens
ctgtcaccagagcttctctgggc

SEQ ID NO: 2869386 - DNA, 23 bp, Homo sapiens
ctgtcattttcacaatcttgggg

SEQ ID NO: 2869387 - DNA, 21 bp, Homo sapiens
ctgtccctccgggacctggtg

SEQ ID NO: 2869388 - DNA, 14 bp, Homo sapiens
ctgtcctgcagcaa

SEQ ID NO: 2869389 - DNA, 15 bp, Homo sapiens
ctgtcctgcagcaaa

SEQ ID NO: 2869390 - DNA, 17 bp, Homo sapiens
ctgtccttccctgccac

SEQ ID NO: 2869391 - DNA, 22 bp, Homo sapiens
ctgtcttcatagcagattttaa

SEQ ID NO: 2869392 - DNA, 16 bp, Homo sapiens
ctgtgaacgatttaga

SEQ ID NO: 2869393 - DNA, 16 bp, Homo sapiens
ctgtgaccaatgtctt

SEQ ID NO: 2869394 - DNA, 17 bp, Homo sapiens
ctgtgattactgcaatc

SEQ ID NO: 2869395 - DNA, 20 bp, Homo sapiens
ctgtgcacatctgtgtcttg

SEQ ID NO: 2869396 - DNA, 17 bp, Homo sapiens
ctgtgcagccgctgagc

SEQ ID NO: 2869397 - DNA, 23 bp, Homo sapiens
ctgtgctatcggcagatgatgct

SEQ ID NO: 2869398 - DNA, 22 bp, Homo sapiens
ctgtgctgaacataacttctca

SEQ ID NO: 2869399 - DNA, 17 bp, Homo sapiens
ctgtgcttcgggccctt

SEQ ID NO: 2869400 - DNA, 22 bp, Homo sapiens
ctgtgtaacatccaagccagag

SEQ ID NO: 2869401 - DNA, 15 bp, Homo sapiens
ctgttattcttgtta

SEQ ID NO: 2869402 - DNA, 17 bp, Homo sapiens
ctgttattcttgttata

SEQ ID NO: 2869403 - DNA, 12 bp, Homo sapiens
ctgttgaacttt

SEQ ID NO: 2869404 - DNA, 15 bp, Homo sapiens
ctgttgagctgtttt

SEQ ID NO: 2869405 - DNA, 20 bp, Homo sapiens
ctgttgagctgttttccctg

SEQ ID NO: 2869406 - DNA, 15 bp, Homo sapiens
ctgttgcacttttga

SEQ ID NO: 2869407 - DNA, 23 bp, Homo sapiens
ctgttgctatagagcctacctgt

SEQ ID NO: 2869408 - DNA, 14 bp, Homo sapiens
ctgtttctaagaaa

SEQ ID NO: 2869409 - DNA, 13 bp, Homo sapiens
ctgttttccctga

SEQ ID NO: 2869410 - DNA, 17 bp, Homo sapiens
ctgtttttaagctgttt

SEQ ID NO: 2869411 - DNA, 19 bp, Homo sapiens
ctgtttttaagctgtttcc

SEQ ID NO: 2869412 - DNA, 14 bp, Homo sapiens
cttaaaaaactgca

SEQ ID NO: 2869413 - DNA, 24 bp, Homo sapiens
cttaaaatgttcacttttgacaaa

SEQ ID NO: 2869414 - DNA, 19 bp, Homo sapiens
cttaaacaaaaattaaaat

SEQ ID NO: 2869415 - DNA, 17 bp, Homo sapiens
cttaagtcctaaaagtt

SEQ ID NO: 2869416 - DNA, 23 bp, Homo sapiens
cttacgaatacttttgccctttg

SEQ ID NO: 2869417 - DNA, 15 bp, Homo sapiens
cttagctgaggctga

SEQ ID NO: 2869418 - DNA, 18 bp, Homo sapiens
cttagctgaggctgagaa

SEQ ID NO: 2869419 - DNA, 17 bp, Homo sapiens
cttaggtttcaggaagt

SEQ ID NO: 2869420 - DNA, 15 bp, Homo sapiens
cttatagaatattta

SEQ ID NO: 2869421 - DNA, 16 bp, Homo sapiens
cttatagaatatttat

SEQ ID NO: 2869422 - DNA, 19 bp, Homo sapiens
cttatgaaaagtactaata

SEQ ID NO: 2869423 - DNA, 13 bp, Homo sapiens
cttattgtacctc

SEQ ID NO: 2869424 - DNA, 19 bp, Homo sapiens
cttatttacagataacttc

SEQ ID NO: 2869425 - DNA, 20 bp, Homo sapiens
cttatttacagataacttct

SEQ ID NO: 2869426 - DNA, 16 bp, Homo sapiens
cttatttctatgacaa

SEQ ID NO: 2869427 - DNA, 17 bp, Homo sapiens
cttatttctatgacaaa

SEQ ID NO: 2869428 - DNA, 22 bp, Homo sapiens
cttattttgttggtgctttgca

SEQ ID NO: 2869429 - DNA, 23 bp, Homo sapiens
cttcaaactagggccaagcccag

SEQ ID NO: 2869430 - DNA, 18 bp, Homo sapiens
cttcatagcagattttaa

SEQ ID NO: 2869431 - DNA, 15 bp, Homo sapiens
cttcatcctcctccc

SEQ ID NO: 2869432 - DNA, 17 bp, Homo sapiens
cttcatgcctgatgaaa

SEQ ID NO: 2869433 - DNA, 19 bp, Homo sapiens
cttcatgcctgatgaaagc

SEQ ID NO: 2869434 - DNA, 21 bp, Homo sapiens
cttcatggcagaaggcaaacc

SEQ ID NO: 2869435 - DNA, 23 bp, Homo sapiens
cttcatggcatcttcaatatgaa

SEQ ID NO: 2869436 - DNA, 14 bp, Homo sapiens
cttcattccggact

SEQ ID NO: 2869437 - DNA, 17 bp, Homo sapiens
cttcattttgtataatc

SEQ ID NO: 2869438 - DNA, 14 bp, Homo sapiens
cttccactgagggc

SEQ ID NO: 2869439 - DNA, 18 bp, Homo sapiens
cttccactgagggcagtc

SEQ ID NO: 2869440 - DNA, 16 bp, Homo sapiens
cttcccagaccaggaa

SEQ ID NO: 2869441 - DNA, 18 bp, Homo sapiens
cttccccagactcagctc

SEQ ID NO: 2869442 - DNA, 20 bp, Homo sapiens
cttccccagactcagctcca

SEQ ID NO: 2869443 - DNA, 14 bp, Homo sapiens
cttcccccagccca

SEQ ID NO: 2869444 - DNA, 20 bp, Homo sapiens
cttccctgactcattctgaa

SEQ ID NO: 2869445 - DNA, 12 bp, Homo sapiens
cttcccttccca

SEQ ID NO: 2869446 - DNA, 18 bp, Homo sapiens
cttcctagatctgcaggc

SEQ ID NO: 2869447 - DNA, 23 bp, Homo sapiens
cttcctagatctgcaggctgcac

SEQ ID NO: 2869448 - DNA, 12 bp, Homo sapiens
cttcctcctggg

SEQ ID NO: 2869449 - DNA, 22 bp, Homo sapiens
cttcctggagactgcccagcta

SEQ ID NO: 2869450 - DNA, 13 bp, Homo sapiens
cttcgctgaaatt

SEQ ID NO: 2869451 - DNA, 16 bp, Homo sapiens
cttcgggcccttccca

SEQ ID NO: 2869452 - DNA, 23 bp, Homo sapiens
cttctcttcctagatctgcaggc

SEQ ID NO: 2869453 - DNA, 19 bp, Homo sapiens
cttctgcctcccactccat

SEQ ID NO: 2869454 - DNA, 18 bp, Homo sapiens
attattcaagaatgaaaa

SEQ ID NO: 2869455 - DNA, 13 bp, Homo sapiens
attattcagtgtc

SEQ ID NO: 2869456 - DNA, 11 bp, Homo sapiens
attatttgcat

SEQ ID NO: 2869457 - DNA, 20 bp, Homo sapiens
attcaagagctagaaaaata

SEQ ID NO: 2869458 - DNA, 16 bp, Homo sapiens
attcaattcctctggg

SEQ ID NO: 2869459 - DNA, 20 bp, Homo sapiens
attcacatctaacctcatct

SEQ ID NO: 2869460 - DNA, 14 bp, Homo sapiens
attcatgtaataaa

SEQ ID NO: 2869461 - DNA, 17 bp, Homo sapiens
attcatgtaataaacag

SEQ ID NO: 2869462 - DNA, 18 bp, Homo sapiens
attccaggctgagccatg

SEQ ID NO: 2869463 - DNA, 21 bp, Homo sapiens
attccaggctgagccatgagg

SEQ ID NO: 2869464 - DNA, 21 bp, Homo sapiens
caagccagagtttttaaagcc

SEQ ID NO: 2869465 - DNA, 22 bp, Homo sapiens
caagccagagtttttaaagcct

SEQ ID NO: 2869466 - DNA, 17 bp, Homo sapiens
caagcccagcactgctt

SEQ ID NO: 2869467 - DNA, 14 bp, Homo sapiens
caagccccaacttt

SEQ ID NO: 2869468 - DNA, 14 bp, Homo sapiens
caagcttgaggcca

SEQ ID NO: 2869469 - DNA, 17 bp, Homo sapiens
caaggaacaagagaaaa

SEQ ID NO: 2869470 - DNA, 12 bp, Homo sapiens
caaggaagtcaa

SEQ ID NO: 2869471 - DNA, 19 bp, Homo sapiens
caaggacaatgccttggga

SEQ ID NO: 2869472 - DNA, 16 bp, Homo sapiens
caagggaaaagtctct

SEQ ID NO: 2869473 - DNA, 21 bp, Homo sapiens
caagggaaaggcaagcttgag

SEQ ID NO: 2869474 - DNA, 23 bp, Homo sapiens
caagggaaaggcaagcttgaggc

SEQ ID NO: 2869475 - DNA, 13 bp, Homo sapiens
caagggattctgg

SEQ ID NO: 2869476 - DNA, 16 bp, Homo sapiens
caagggattctgggaa

SEQ ID NO: 2869477 - DNA, 15 bp, Homo sapiens
caataataaagtact

SEQ ID NO: 2869478 - DNA, 14 bp, Homo sapiens
caatatgtatatat

SEQ ID NO: 2869479 - DNA, 23 bp, Homo sapiens
caatatgtatatatgtatttcta

SEQ ID NO: 2869480 - DNA, 13 bp, Homo sapiens
caatattataatt

SEQ ID NO: 2869481 - DNA, 12 bp, Homo sapiens
caatatttatta

SEQ ID NO: 2869482 - DNA, 14 bp, Homo sapiens
caatatttattatt

SEQ ID NO: 2869483 - DNA, 15 bp, Homo sapiens
caatcactgtgctat

SEQ ID NO: 2869484 - DNA, 18 bp, Homo sapiens
caatcagctccttcctgg

SEQ ID NO: 2869485 - DNA, 21 bp, Homo sapiens
caatctatggcttatttctat

SEQ ID NO: 2869486 - DNA, 18 bp, Homo sapiens
caatctgtacaaaatggt

SEQ ID NO: 2869487 - DNA, 17 bp, Homo sapiens
caatcttggggctgatg

SEQ ID NO: 2869488 - DNA, 19 bp, Homo sapiens
caatcttggggctgatgaa

SEQ ID NO: 2869489 - DNA, 20 bp, Homo sapiens
caatcttggggctgatgaag

SEQ ID NO: 2869490 - DNA, 19 bp, Homo sapiens
caatgaccattcaattagt

SEQ ID NO: 2869491 - DNA, 15 bp, Homo sapiens
caatgcttcattatt

SEQ ID NO: 2869492 - DNA, 20 bp, Homo sapiens
caatggtgtggtgaatgtgt

SEQ ID NO: 2869493 - DNA, 14 bp, Homo sapiens
caatgtgagtccca

SEQ ID NO: 2869494 - DNA, 20 bp, Homo sapiens
caattaaaaacgaaaacctg

SEQ ID NO: 2869495 - DNA, 13 bp, Homo sapiens
caattagacttga

SEQ ID NO: 2869496 - DNA, 14 bp, Homo sapiens
caattagacttgaa

SEQ ID NO: 2869497 - DNA, 15 bp, Homo sapiens
caattagacttgaaa

SEQ ID NO: 2869498 - DNA, 22 bp, Homo sapiens
caattagtgtgacagtttccaa

SEQ ID NO: 2869499 - DNA, 20 bp, Homo sapiens
caattcacatctaacctcat

SEQ ID NO: 2869500 - DNA, 18 bp, Homo sapiens
caattccaggctgagcca

SEQ ID NO: 2869501 - DNA, 13 bp, Homo sapiens
caatttatactgc

SEQ ID NO: 2869502 - DNA, 20 bp, Homo sapiens
caatttctactttgaagtca

SEQ ID NO: 2869503 - DNA, 21 bp, Homo sapiens
caatttctactttgaagtcat

SEQ ID NO: 2869504 - DNA, 21 bp, Homo sapiens
cacaaaacctgtattactgaa

SEQ ID NO: 2869505 - DNA, 18 bp, Homo sapiens
cacaatctgggactttca

SEQ ID NO: 2869506 - DNA, 16 bp, Homo sapiens
cacaatcttggggctg

SEQ ID NO: 2869507 - DNA, 18 bp, Homo sapiens
cacaatggagtgggagat

SEQ ID NO: 2869508 - DNA, 16 bp, Homo sapiens
cacaatttaaaacaat

SEQ ID NO: 2869509 - DNA, 15 bp, Homo sapiens
cacaccaaccaggcc

SEQ ID NO: 2869510 - DNA, 16 bp, Homo sapiens
cacaccaaccaggcct

SEQ ID NO: 2869511 - DNA, 12 bp, Homo sapiens
cacaccttaggt

SEQ ID NO: 2869512 - DNA, 18 bp, Homo sapiens
cacagaaggtgaactttg

SEQ ID NO: 2869513 - DNA, 22 bp, Homo sapiens
cacagaaggtgaactttgtgct

SEQ ID NO: 2869514 - DNA, 16 bp, Homo sapiens
cacagacccacacatg

SEQ ID NO: 2869515 - DNA, 21 bp, Homo sapiens
cacagagctggcgactgcagc

SEQ ID NO: 2869516 - DNA, 14 bp, Homo sapiens
cacagcctcccctg

SEQ ID NO: 2869517 - DNA, 23 bp, Homo sapiens
cacagcctcccctgccagggcag

SEQ ID NO: 2869518 - DNA, 21 bp, Homo sapiens
cacagctcaagcattctgttt

SEQ ID NO: 2869519 - DNA, 17 bp, Homo sapiens
cacagggtgtggtatga

SEQ ID NO: 2869520 - DNA, 21 bp, Homo sapiens
cacatctatccacactgtcaa

SEQ ID NO: 2869521 - DNA, 20 bp, Homo sapiens
cacatgtcagtaccttcaaa

SEQ ID NO: 2869522 - DNA, 13 bp, Homo sapiens
cacattaactgtt

SEQ ID NO: 2869523 - DNA, 14 bp, Homo sapiens
cacattcttcagtt

SEQ ID NO: 2869524 - DNA, 20 bp, Homo sapiens
caccaccttggactcctccc

SEQ ID NO: 2869525 - DNA, 15 bp, Homo sapiens
caccagggaagaaga

SEQ ID NO: 2869526 - DNA, 22 bp, Homo sapiens
caccaggggtgctatgacatgc

SEQ ID NO: 2869527 - DNA, 22 bp, Homo sapiens
caccagggttgaccccagagga

SEQ ID NO: 2869528 - DNA, 17 bp, Homo sapiens
caccatttggcaatgcc

SEQ ID NO: 2869529 - DNA, 16 bp, Homo sapiens
caccccctcattcccc

SEQ ID NO: 2869530 - DNA, 18 bp, Homo sapiens
cacccccttctccatcca

SEQ ID NO: 2869531 - DNA, 15 bp, Homo sapiens
cacccctaagtgccc

SEQ ID NO: 2869532 - DNA, 17 bp, Homo sapiens
cacccctaagtgcccaa

SEQ ID NO: 2869533 - DNA, 17 bp, Homo sapiens
cacccttttccagctgg

SEQ ID NO: 2869534 - DNA, 20 bp, Homo sapiens
caccgggttctgcagcggca

SEQ ID NO: 2869535 - DNA, 18 bp, Homo sapiens
caccgtgggctccctgac

SEQ ID NO: 2869536 - DNA, 13 bp, Homo sapiens
cacctccaggcct

SEQ ID NO: 2869537 - DNA, 15 bp, Homo sapiens
cacctccaggcctgt

SEQ ID NO: 2869538 - DNA, 19 bp, Homo sapiens
cacctgtatatttctttta

SEQ ID NO: 2869539 - DNA, 22 bp, Homo sapiens
cacctgtatatttcttttaatg

SEQ ID NO: 2869540 - DNA, 20 bp, Homo sapiens
cacctgtttttaagctgttt

SEQ ID NO: 2869541 - DNA, 11 bp, Homo sapiens
caccttcccca

SEQ ID NO: 2869542 - DNA, 16 bp, Homo sapiens
caccttccccagactc

SEQ ID NO: 2869543 - DNA, 18 bp, Homo sapiens
caccttggactcctccca

SEQ ID NO: 2869544 - DNA, 13 bp, Homo sapiens
cacgactgtctcc

SEQ ID NO: 2869545 - DNA, 20 bp, Homo sapiens
cacgagctgtttactaggga

SEQ ID NO: 2869546 - DNA, 12 bp, Homo sapiens
cacgcaggaagc

SEQ ID NO: 2869547 - DNA, 18 bp, Homo sapiens
cacgccctccctctccca

SEQ ID NO: 2869548 - DNA, 17 bp, Homo sapiens
cacggagccactcctct

SEQ ID NO: 2869549 - DNA, 19 bp, Homo sapiens
cacggagccactcctctga

SEQ ID NO: 2869550 - DNA, 23 bp, Homo sapiens
cacggagccactcctctgactca

SEQ ID NO: 2869551 - DNA, 16 bp, Homo sapiens
cacgtgtttgtgctgt

SEQ ID NO: 2869552 - DNA, 17 bp, Homo sapiens
cactactgcagcacctc

SEQ ID NO: 2869553 - DNA, 13 bp, Homo sapiens
cactatttgtgac

SEQ ID NO: 2869554 - DNA, 15 bp, Homo sapiens
cactatttgtgactt

SEQ ID NO: 2869555 - DNA, 18 bp, Homo sapiens
cactcagctgtcctgcag

SEQ ID NO: 2869556 - DNA, 20 bp, Homo sapiens
cactcagctgtcctgcagca

SEQ ID NO: 2869557 - DNA, 18 bp, Homo sapiens
cactccacattcttcagt

SEQ ID NO: 2869558 - DNA, 15 bp, Homo sapiens
cactccaccctccac

SEQ ID NO: 2869559 - DNA, 18 bp, Homo sapiens
cactcccagcagctcaac

SEQ ID NO: 2869560 - DNA, 15 bp, Homo sapiens
cactccccagcccca

SEQ ID NO: 2869561 - DNA, 12 bp, Homo sapiens
cactcctctgac

SEQ ID NO: 2869562 - DNA, 13 bp, Homo sapiens
cactctcccctcc

SEQ ID NO: 2869563 - DNA, 14 bp, Homo sapiens
cactgaggagacag

SEQ ID NO: 2869564 - DNA, 19 bp, Homo sapiens
cactgaggagacagaaagc

SEQ ID NO: 2869565 - DNA, 20 bp, Homo sapiens
cactgaggagacagaaagcc

SEQ ID NO: 2869566 - DNA, 11 bp, Homo sapiens
cactgccatgc

SEQ ID NO: 2869567 - DNA, 16 bp, Homo sapiens
cactgcggaagccaaa

SEQ ID NO: 2869568 - DNA, 21 bp, Homo sapiens
cactggtaggttgggacacca

SEQ ID NO: 2869569 - DNA, 22 bp, Homo sapiens
cactggtaggttgggacaccag

SEQ ID NO: 2869570 - DNA, 18 bp, Homo sapiens
agccagcgtcctcctctg

SEQ ID NO: 2869571 - DNA, 21 bp, Homo sapiens
agccagcgtcctcctctgtga

SEQ ID NO: 2869572 - DNA, 23 bp, Homo sapiens
agccagcgtcctcctctgtgacc

SEQ ID NO: 2869573 - DNA, 19 bp, Homo sapiens
agccatagacctacagacc

SEQ ID NO: 2869574 - DNA, 21 bp, Homo sapiens
agccatagacctacagacctg

SEQ ID NO: 2869575 - DNA, 20 bp, Homo sapiens
agccatcccttccctgtcca

SEQ ID NO: 2869576 - DNA, 17 bp, Homo sapiens
agcccagagcctggctg

SEQ ID NO: 2869577 - DNA, 15 bp, Homo sapiens
agcccagcactgctt

SEQ ID NO: 2869578 - DNA, 13 bp, Homo sapiens
agccccattcctg

SEQ ID NO: 2869579 - DNA, 23 bp, Homo sapiens
agcccccactttcctacaaaatg

SEQ ID NO: 2869580 - DNA, 13 bp, Homo sapiens
agcccctcctcca

SEQ ID NO: 2869581 - DNA, 20 bp, Homo sapiens
agcccctcctccagcccctg

SEQ ID NO: 2869582 - DNA, 11 bp, Homo sapiens
agcccctgtcc

SEQ ID NO: 2869583 - DNA, 12 bp, Homo sapiens
agcccctgtccc

SEQ ID NO: 2869584 - DNA, 17 bp, Homo sapiens
agccccttgagaaacct

SEQ ID NO: 2869585 - DNA, 17 bp, Homo sapiens
agccctagggtggagag

SEQ ID NO: 2869586 - DNA, 19 bp, Homo sapiens
agccgactctggccctggc

SEQ ID NO: 2869587 - DNA, 21 bp, Homo sapiens
agccgactctggccctggccc

SEQ ID NO: 2869588 - DNA, 12 bp, Homo sapiens
agccgaggggag

SEQ ID NO: 2869589 - DNA, 17 bp, Homo sapiens
agccgaggggagagagg

SEQ ID NO: 2869590 - DNA, 19 bp, Homo sapiens
agccgaggggagagaggga

SEQ ID NO: 2869591 - DNA, 18 bp, Homo sapiens
agccggcctgagaaacac

SEQ ID NO: 2869592 - DNA, 16 bp, Homo sapiens
agccgggtctgcctct

SEQ ID NO: 2869593 - DNA, 20 bp, Homo sapiens
agccgggtctgcctcttctg

SEQ ID NO: 2869594 - DNA, 23 bp, Homo sapiens
agcctagtgaaggcttctctctg

SEQ ID NO: 2869595 - DNA, 14 bp, Homo sapiens
agcctcccctgcca

SEQ ID NO: 2869596 - DNA, 20 bp, Homo sapiens
agcctcccctgccagggcag

SEQ ID NO: 2869597 - DNA, 22 bp, Homo sapiens
agcctcccctgccagggcaggg

SEQ ID NO: 2869598 - DNA, 16 bp, Homo sapiens
agcctccgctgggctt

SEQ ID NO: 2869599 - DNA, 17 bp, Homo sapiens
agcctccgctgggcttc

SEQ ID NO: 2869600 - DNA, 17 bp, Homo sapiens
agcctggctgcccatca

SEQ ID NO: 2869601 - DNA, 15 bp, Homo sapiens
agcctgtcaccagag

SEQ ID NO: 2869602 - DNA, 17 bp, Homo sapiens
agcctgtcaccagagct

SEQ ID NO: 2869603 - DNA, 21 bp, Homo sapiens
agcctgtcaccagagcttctc

SEQ ID NO: 2869604 - DNA, 13 bp, Homo sapiens
agccttctggatc

SEQ ID NO: 2869605 - DNA, 15 bp, Homo sapiens
agcgaggaggctcca

SEQ ID NO: 2869606 - DNA, 22 bp, Homo sapiens
agcggcagagcaattccaggct

SEQ ID NO: 2869607 - DNA, 15 bp, Homo sapiens
agcgtcctcctctgt

SEQ ID NO: 2869608 - DNA, 16 bp, Homo sapiens
agcgtcctcctctgtg

SEQ ID NO: 2869609 - DNA, 17 bp, Homo sapiens
agcgtcctcctctgtga

SEQ ID NO: 2869610 - DNA, 23 bp, Homo sapiens
agcgtgggtgttgaatccagcac

SEQ ID NO: 2869611 - DNA, 21 bp, Homo sapiens
agctaaagtttggttttgaca

SEQ ID NO: 2869612 - DNA, 17 bp, Homo sapiens
agctaagatagaaagct

SEQ ID NO: 2869613 - DNA, 19 bp, Homo sapiens
agctaagatagaaagctgg

SEQ ID NO: 2869614 - DNA, 23 bp, Homo sapiens
agctaagatagaaagctggactg

SEQ ID NO: 2869615 - DNA, 12 bp, Homo sapiens
agctaataaacc

SEQ ID NO: 2869616 - DNA, 14 bp, Homo sapiens
agctacttgggagg

SEQ ID NO: 2869617 - DNA, 18 bp, Homo sapiens
agctagaaaaataaaatg

SEQ ID NO: 2869618 - DNA, 19 bp, Homo sapiens
agctagaaaaataaaatgt

SEQ ID NO: 2869619 - DNA, 13 bp, Homo sapiens
agctccttcctgg

SEQ ID NO: 2869620 - DNA, 13 bp, Homo sapiens
agctctctaggcc

SEQ ID NO: 2869621 - DNA, 22 bp, Homo sapiens
agctctctaggcctctccagtt

SEQ ID NO: 2869622 - DNA, 18 bp, Homo sapiens
agctctgaaaccagtgtt

SEQ ID NO: 2869623 - DNA, 19 bp, Homo sapiens
agctctgaaaccagtgtta

SEQ ID NO: 2869624 - DNA, 16 bp, Homo sapiens
agctcttctcttccta

SEQ ID NO: 2869625 - DNA, 17 bp, Homo sapiens
agctcttctcttcctag

SEQ ID NO: 2869626 - DNA, 13 bp, Homo sapiens
agctctttccaaa

SEQ ID NO: 2869627 - DNA, 22 bp, Homo sapiens
agctctttccaaattaaaacaa

SEQ ID NO: 2869628 - DNA, 19 bp, Homo sapiens
agctcttttctcctgcaga

SEQ ID NO: 2869629 - DNA, 16 bp, Homo sapiens
agctgacccagcccct

SEQ ID NO: 2869630 - DNA, 15 bp, Homo sapiens
agctgaggcagcagt

SEQ ID NO: 2869631 - DNA, 16 bp, Homo sapiens
agctgctgttgaactt

SEQ ID NO: 2869632 - DNA, 17 bp, Homo sapiens
agctgctgttgaacttt

SEQ ID NO: 2869633 - DNA, 18 bp, Homo sapiens
agctgctgttgaactttt

SEQ ID NO: 2869634 - DNA, 20 bp, Homo sapiens
agctgctgttgaacttttta

SEQ ID NO: 2869635 - DNA, 15 bp, Homo sapiens
agctgggcctcctgc

SEQ ID NO: 2869636 - DNA, 16 bp, Homo sapiens
agctgggcctcctgcc

SEQ ID NO: 2869637 - DNA, 19 bp, Homo sapiens
agctgggcctcctgcctcc

SEQ ID NO: 2869638 - DNA, 20 bp, Homo sapiens
agctgggcctcctgcctccg

SEQ ID NO: 2869639 - DNA, 17 bp, Homo sapiens
agctgttgagctgtttt

SEQ ID NO: 2869640 - DNA, 22 bp, Homo sapiens
agctgtttactagggatccctc

SEQ ID NO: 2869641 - DNA, 14 bp, Homo sapiens
agctgtttccatag

SEQ ID NO: 2869642 - DNA, 15 bp, Homo sapiens
agcttagactaaggc

SEQ ID NO: 2869643 - DNA, 19 bp, Homo sapiens
agcttcatggcagaaggca

SEQ ID NO: 2869644 - DNA, 23 bp, Homo sapiens
agcttccattccaagcctgacca

SEQ ID NO: 2869645 - DNA, 13 bp, Homo sapiens
agcttctctgggc

SEQ ID NO: 2869646 - DNA, 13 bp, Homo sapiens
agcttctctgtga

SEQ ID NO: 2869647 - DNA, 15 bp, Homo sapiens
agcttgagcctcccc

SEQ ID NO: 2869648 - DNA, 23 bp, Homo sapiens
agcttgaggccaagatggctgct

SEQ ID NO: 2869649 - DNA, 18 bp, Homo sapiens
agctttagtgaattaaat

SEQ ID NO: 2869650 - DNA, 16 bp, Homo sapiens
aggaaaggcttggctg

SEQ ID NO: 2869651 - DNA, 20 bp, Homo sapiens
aggaaaggcttggctggtgt

SEQ ID NO: 2869652 - DNA, 13 bp, Homo sapiens
aggaacaagagaa

SEQ ID NO: 2869653 - DNA, 19 bp, Homo sapiens
aggaacccttacagtagga

SEQ ID NO: 2869654 - DNA, 14 bp, Homo sapiens
aggaagagaaacca

SEQ ID NO: 2869655 - DNA, 13 bp, Homo sapiens
aggaaggatggca

SEQ ID NO: 2869656 - DNA, 16 bp, Homo sapiens
aggaaggggccagagg

SEQ ID NO: 2869657 - DNA, 18 bp, Homo sapiens
aggaagtcaaagcaagga

SEQ ID NO: 2869658 - DNA, 15 bp, Homo sapiens
aggacaatgccttgg

SEQ ID NO: 2869659 - DNA, 19 bp, Homo sapiens
aggacaatgccttgggaga

SEQ ID NO: 2869660 - DNA, 19 bp, Homo sapiens
aggaccagtcaacctgggc

SEQ ID NO: 2869661 - DNA, 15 bp, Homo sapiens
aggacccagaggaag

SEQ ID NO: 2869662 - DNA, 18 bp, Homo sapiens
aggagacaagaaatccag

SEQ ID NO: 2869663 - DNA, 11 bp, Homo sapiens
aggagagaccc

SEQ ID NO: 2869664 - DNA, 18 bp, Homo sapiens
aggagatgctccttgggc

SEQ ID NO: 2869665 - DNA, 20 bp, Homo sapiens
aggagatggaagttgcagtg

SEQ ID NO: 2869666 - DNA, 19 bp, Homo sapiens
aggagcagcccggggagga

SEQ ID NO: 2869667 - DNA, 15 bp, Homo sapiens
aggagccccattcct

SEQ ID NO: 2869668 - DNA, 15 bp, Homo sapiens
aggagcgtggactct

SEQ ID NO: 2869669 - DNA, 19 bp, Homo sapiens
aggagcgtggactctgcta

SEQ ID NO: 2869670 - DNA, 13 bp, Homo sapiens
aggaggctccaga

SEQ ID NO: 2869671 - DNA, 15 bp, Homo sapiens
aggagtaagacaagt

SEQ ID NO: 2869672 - DNA, 16 bp, Homo sapiens
aggagttgccagggaa

SEQ ID NO: 2869673 - DNA, 13 bp, Homo sapiens
aggataagaaagc

SEQ ID NO: 2869674 - DNA, 21 bp, Homo sapiens
aggataagaaagcctaaaatt

SEQ ID NO: 2869675 - DNA, 19 bp, Homo sapiens
aggatgaattgtcacatct

SEQ ID NO: 2869676 - DNA, 22 bp, Homo sapiens
aggcaaacccatcaacaaaaat

SEQ ID NO: 2869677 - DNA, 17 bp, Homo sapiens
aggcaagcttgaggcca

SEQ ID NO: 2869678 - DNA, 20 bp, Homo sapiens
aggcaagcttgaggccaaga

SEQ ID NO: 2869679 - DNA, 21 bp, Homo sapiens
aggcaagcttgaggccaagat

SEQ ID NO: 2869680 - DNA, 15 bp, Homo sapiens
aggcacattaactgt

SEQ ID NO: 2869681 - DNA, 22 bp, Homo sapiens
agagattttgtcgggacagaga

SEQ ID NO: 2869682 - DNA, 14 bp, Homo sapiens
agagcaagactctg

SEQ ID NO: 2869683 - DNA, 17 bp, Homo sapiens
agagcaattccaggctg

SEQ ID NO: 2869684 - DNA, 19 bp, Homo sapiens
agagcaattccaggctgag

SEQ ID NO: 2869685 - DNA, 20 bp, Homo sapiens
agagcaattccaggctgagc

SEQ ID NO: 2869686 - DNA, 18 bp, Homo sapiens
agagccaacctggacttc

SEQ ID NO: 2869687 - DNA, 20 bp, Homo sapiens
agagccaacctggacttcct

SEQ ID NO: 2869688 - DNA, 23 bp, Homo sapiens
agagccaacctggacttcctgtc

SEQ ID NO: 2869689 - DNA, 17 bp, Homo sapiens
agagccaattagacttg

SEQ ID NO: 2869690 - DNA, 15 bp, Homo sapiens
agagccaccaagagg

SEQ ID NO: 2869691 - DNA, 12 bp, Homo sapiens
agagccagctct

SEQ ID NO: 2869692 - DNA, 13 bp, Homo sapiens
agagccagctctc

SEQ ID NO: 2869693 - DNA, 16 bp, Homo sapiens
agagccagctctctct

SEQ ID NO: 2869694 - DNA, 23 bp, Homo sapiens
agagcccctcctccagcccctgt

SEQ ID NO: 2869695 - DNA, 19 bp, Homo sapiens
agagcctgtcaccagagct

SEQ ID NO: 2869696 - DNA, 22 bp, Homo sapiens
agagcctgtcaccagagcttct

SEQ ID NO: 2869697 - DNA, 18 bp, Homo sapiens
agagcctgtgctaaagaa

SEQ ID NO: 2869698 - DNA, 23 bp, Homo sapiens
agaggaaaaatgggagccaggag

SEQ ID NO: 2869699 - DNA, 15 bp, Homo sapiens
agaggaaggggccag

SEQ ID NO: 2869700 - DNA, 20 bp, Homo sapiens
agaggaaggggccagaggct

SEQ ID NO: 2869701 - DNA, 19 bp, Homo sapiens
agaggccctcgctgccagc

SEQ ID NO: 2869702 - DNA, 22 bp, Homo sapiens
agaggctcgttgactggctgtg

SEQ ID NO: 2869703 - DNA, 15 bp, Homo sapiens
agagggacgcctggg

SEQ ID NO: 2869704 - DNA, 18 bp, Homo sapiens
agagggactcaagggaaa

SEQ ID NO: 2869705 - DNA, 21 bp, Homo sapiens
agaggggctgaatagcagaag

SEQ ID NO: 2869706 - DNA, 17 bp, Homo sapiens
agaggtggattcctggg

SEQ ID NO: 2869707 - DNA, 14 bp, Homo sapiens
agataaaatgatgt

SEQ ID NO: 2869708 - DNA, 15 bp, Homo sapiens
agataaaatgatgtt

SEQ ID NO: 2869709 - DNA, 12 bp, Homo sapiens
agataatgtgaa

SEQ ID NO: 2869710 - DNA, 14 bp, Homo sapiens
agataccagcgagg

SEQ ID NO: 2869711 - DNA, 19 bp, Homo sapiens
agataccagcgaggaggct

SEQ ID NO: 2869712 - DNA, 16 bp, Homo sapiens
agatacttacatgttc

SEQ ID NO: 2869713 - DNA, 12 bp, Homo sapiens
agatagaaagct

SEQ ID NO: 2869714 - DNA, 14 bp, Homo sapiens
agatcagccacgga

SEQ ID NO: 2869715 - DNA, 21 bp, Homo sapiens
agatccatttggacaaaatgg

SEQ ID NO: 2869716 - DNA, 15 bp, Homo sapiens
agatctgcaggctgc

SEQ ID NO: 2869717 - DNA, 19 bp, Homo sapiens
agatctgcaggctgcacct

SEQ ID NO: 2869718 - DNA, 21 bp, Homo sapiens
agatgctacttcccactgtat

SEQ ID NO: 2869719 - DNA, 15 bp, Homo sapiens
agatgctccttgggc

SEQ ID NO: 2869720 - DNA, 13 bp, Homo sapiens
agatggctgctgc

SEQ ID NO: 2869721 - DNA, 16 bp, Homo sapiens
agatggctgctgcctg

SEQ ID NO: 2869722 - DNA, 19 bp, Homo sapiens
agattgatagggagtttta

SEQ ID NO: 2869723 - DNA, 13 bp, Homo sapiens
agatttgtttcct

SEQ ID NO: 2869724 - DNA, 18 bp, Homo sapiens
agattttgtcgggacaga

SEQ ID NO: 2869725 - DNA, 19 bp, Homo sapiens
agatttttattttgaaaaa

SEQ ID NO: 2869726 - DNA, 17 bp, Homo sapiens
agcaaattccagatttg

SEQ ID NO: 2869727 - DNA, 21 bp, Homo sapiens
agcaactaatgtttgaacaaa

SEQ ID NO: 2869728 - DNA, 12 bp, Homo sapiens
agcaagactctg

SEQ ID NO: 2869729 - DNA, 15 bp, Homo sapiens
agcaattccaggctg

SEQ ID NO: 2869730 - DNA, 16 bp, Homo sapiens
agcaattccaggctga

SEQ ID NO: 2869731 - DNA, 24 bp, Homo sapiens
agcaattccaggctgagccatgag

SEQ ID NO: 2869732 - DNA, 13 bp, Homo sapiens
agcaccccctcat

SEQ ID NO: 2869733 - DNA, 14 bp, Homo sapiens
agcaccccctcatt

SEQ ID NO: 2869734 - DNA, 21 bp, Homo sapiens
agcaccccctcattcccctcg

SEQ ID NO: 2869735 - DNA, 15 bp, Homo sapiens
agcacctccaggcct

SEQ ID NO: 2869736 - DNA, 17 bp, Homo sapiens
agcacctccaggcctgt

SEQ ID NO: 2869737 - DNA, 15 bp, Homo sapiens
agcacgggacaggag

SEQ ID NO: 2869738 - DNA, 21 bp, Homo sapiens
agcacttgtgggtttttgttt

SEQ ID NO: 2869739 - DNA, 17 bp, Homo sapiens
agcactttaaccctctc

SEQ ID NO: 2869740 - DNA, 21 bp, Homo sapiens
agcactttaaccctctcttcc

SEQ ID NO: 2869741 - DNA, 22 bp, Homo sapiens
agcagattttaattttgaataa

SEQ ID NO: 2869742 - DNA, 15 bp, Homo sapiens
agcagcccggggagg

SEQ ID NO: 2869743 - DNA, 16 bp, Homo sapiens
agcagcccggggagga

SEQ ID NO: 2869744 - DNA, 18 bp, Homo sapiens
agcagcccggggaggaac

SEQ ID NO: 2869745 - DNA, 15 bp, Homo sapiens
agcaggaaatgaaaa

SEQ ID NO: 2869746 - DNA, 21 bp, Homo sapiens
agcaggaaatgaaaatgtctt

SEQ ID NO: 2869747 - DNA, 19 bp, Homo sapiens
agcaggaaggatggcaagc

SEQ ID NO: 2869748 - DNA, 22 bp, Homo sapiens
agcagtgaatgattcagtgtta

SEQ ID NO: 2869749 - DNA, 14 bp, Homo sapiens
agcatctgaccatc

SEQ ID NO: 2869750 - DNA, 22 bp, Homo sapiens
agcatctgaccatctgtgacta

SEQ ID NO: 2869751 - DNA, 14 bp, Homo sapiens
agcattgcctggac

SEQ ID NO: 2869752 - DNA, 21 bp, Homo sapiens
agcattgcctggactgaccac

SEQ ID NO: 2869753 - DNA, 22 bp, Homo sapiens
agcattgcctggactgaccaca

SEQ ID NO: 2869754 - DNA, 21 bp, Homo sapiens
agcattgtaattatgtaaata

SEQ ID NO: 2869755 - DNA, 18 bp, Homo sapiens
agccaacctggacttcct

SEQ ID NO: 2869756 - DNA, 20 bp, Homo sapiens
agccaacctggacttcctgt

SEQ ID NO: 2869757 - DNA, 22 bp, Homo sapiens
agccaacctggacttcctgtca

SEQ ID NO: 2869758 - DNA, 23 bp, Homo sapiens
agccaacctggacttcctgtcat

SEQ ID NO: 2869759 - DNA, 16 bp, Homo sapiens
agccaagggcctcggg

SEQ ID NO: 2869760 - DNA, 22 bp, Homo sapiens
agccagagtttttaaagccttc

SEQ ID NO: 2869761 - DNA, 18 bp, Homo sapiens
agccagattggccaatta

SEQ ID NO: 2869762 - DNA, 21 bp, Homo sapiens
agccagattggccaattaaaa

SEQ ID NO: 2869763 - DNA, 13 bp, Homo sapiens
tgccatattttca

SEQ ID NO: 2869764 - DNA, 13 bp, Homo sapiens
tgccatcatctcc

SEQ ID NO: 2869765 - DNA, 23 bp, Homo sapiens
tgccatcatctcctgccttcctc

SEQ ID NO: 2869766 - DNA, 17 bp, Homo sapiens
tgcccaaagtggggagg

SEQ ID NO: 2869767 - DNA, 17 bp, Homo sapiens
tgcccactgcctgcctc

SEQ ID NO: 2869768 - DNA, 19 bp, Homo sapiens
tgcccactgcctgcctccc

SEQ ID NO: 2869769 - DNA, 21 bp, Homo sapiens
tgcccactgcctgcctcccct

SEQ ID NO: 2869770 - DNA, 18 bp, Homo sapiens
tgcccatcatgtggcccc

SEQ ID NO: 2869771 - DNA, 18 bp, Homo sapiens
tgccccatcagtgctccc

SEQ ID NO: 2869772 - DNA, 15 bp, Homo sapiens
tgccctatgctgtgc

SEQ ID NO: 2869773 - DNA, 15 bp, Homo sapiens
tgcctcttctgggag

SEQ ID NO: 2869774 - DNA, 16 bp, Homo sapiens
tgcctcttctgggagg

SEQ ID NO: 2869775 - DNA, 20 bp, Homo sapiens
tgcctcttctgggagggcag

SEQ ID NO: 2869776 - DNA, 18 bp, Homo sapiens
tgcctgacatttggagtg

SEQ ID NO: 2869777 - DNA, 14 bp, Homo sapiens
tgcctggactgacc

SEQ ID NO: 2869778 - DNA, 16 bp, Homo sapiens
tgccttctgtctgctc

SEQ ID NO: 2869779 - DNA, 19 bp, Homo sapiens
tgcgaccttaatttaactt

SEQ ID NO: 2869780 - DNA, 19 bp, Homo sapiens
tgcgtcttttttctcttcc

SEQ ID NO: 2869781 - DNA, 17 bp, Homo sapiens
tgctagactcctcagga

SEQ ID NO: 2869782 - DNA, 17 bp, Homo sapiens
tgctataaatgccagag

SEQ ID NO: 2869783 - DNA, 18 bp, Homo sapiens
tgctataaatgccagagc

SEQ ID NO: 2869784 - DNA, 19 bp, Homo sapiens
tgctataaatgccagagcc

SEQ ID NO: 2869785 - DNA, 18 bp, Homo sapiens
tgctatagagcctacctg

SEQ ID NO: 2869786 - DNA, 17 bp, Homo sapiens
tgctatcggcagatgat

SEQ ID NO: 2869787 - DNA, 23 bp, Homo sapiens
tgctatcggcagatgatgctttg

SEQ ID NO: 2869788 - DNA, 15 bp, Homo sapiens
tgctcatcattctct

SEQ ID NO: 2869789 - DNA, 17 bp, Homo sapiens
tgctcatcattctctgt

SEQ ID NO: 2869790 - DNA, 21 bp, Homo sapiens
tgctcatcattctctgtctca

SEQ ID NO: 2869791 - DNA, 14 bp, Homo sapiens
tgctccttgggccc

SEQ ID NO: 2869792 - DNA, 15 bp, Homo sapiens
tgctccttgggccct

SEQ ID NO: 2869793 - DNA, 14 bp, Homo sapiens
tgctctgatccctc

SEQ ID NO: 2869794 - DNA, 16 bp, Homo sapiens
tgctctgatccctcta

SEQ ID NO: 2869795 - DNA, 22 bp, Homo sapiens
tgctctgcgtgtcacctgtgct

SEQ ID NO: 2869796 - DNA, 22 bp, Homo sapiens
tgctgaacataacttctcatgt

SEQ ID NO: 2869797 - DNA, 21 bp, Homo sapiens
tgctgataccatatgaatgaa

SEQ ID NO: 2869798 - DNA, 21 bp, Homo sapiens
tgctgattcaagaaacagaag

SEQ ID NO: 2869799 - DNA, 16 bp, Homo sapiens
tgctgtgaactttcat

SEQ ID NO: 2869800 - DNA, 22 bp, Homo sapiens
tgctgttgaactttttaaagaa

SEQ ID NO: 2869801 - DNA, 16 bp, Homo sapiens
tgctgtttctaagaaa

SEQ ID NO: 2869802 - DNA, 15 bp, Homo sapiens
tgcttaattgctgat

SEQ ID NO: 2869803 - DNA, 22 bp, Homo sapiens
tgcttctctagctctctaggcc

SEQ ID NO: 2869804 - DNA, 21 bp, Homo sapiens
tgctttggaagatgcagaagc

SEQ ID NO: 2869805 - DNA, 16 bp, Homo sapiens
tggaaaatataatgat

SEQ ID NO: 2869806 - DNA, 17 bp, Homo sapiens
tggaacagggttggcat

SEQ ID NO: 2869807 - DNA, 21 bp, Homo sapiens
tggaagatgcagaagcaataa

SEQ ID NO: 2869808 - DNA, 21 bp, Homo sapiens
tggacatgaagattctttccc

SEQ ID NO: 2869809 - DNA, 22 bp, Homo sapiens
tggacatgaagattctttccca

SEQ ID NO: 2869810 - DNA, 13 bp, Homo sapiens
tggacccttccat

SEQ ID NO: 2869811 - DNA, 13 bp, Homo sapiens
tggactccaggcc

SEQ ID NO: 2869812 - DNA, 20 bp, Homo sapiens
tggactccaggcctgaccag

SEQ ID NO: 2869813 - DNA, 13 bp, Homo sapiens
tggactcctccca

SEQ ID NO: 2869814 - DNA, 15 bp, Homo sapiens
tggactctcagtctc

SEQ ID NO: 2869815 - DNA, 14 bp, Homo sapiens
tggactctgctaga

SEQ ID NO: 2869816 - DNA, 10 bp, Homo sapiens
tggactgacc

SEQ ID NO: 2869817 - DNA, 14 bp, Homo sapiens
tggactgaccaaag

SEQ ID NO: 2869818 - DNA, 22 bp, Homo sapiens
tggactgaccaaagactgcaga

SEQ ID NO: 2869819 - DNA, 15 bp, Homo sapiens
tggacttcctgtcat

SEQ ID NO: 2869820 - DNA, 12 bp, Homo sapiens
tggagaatactg

SEQ ID NO: 2869821 - DNA, 13 bp, Homo sapiens
tggagaatactgc

SEQ ID NO: 2869822 - DNA, 12 bp, Homo sapiens
tggagcagaggg

SEQ ID NO: 2869823 - DNA, 16 bp, Homo sapiens
tggagcagaggggctg

SEQ ID NO: 2869824 - DNA, 21 bp, Homo sapiens
tggagcttcatggcagaaggc

SEQ ID NO: 2869825 - DNA, 13 bp, Homo sapiens
tggaggcccctgg

SEQ ID NO: 2869826 - DNA, 13 bp, Homo sapiens
tggagggatgcca

SEQ ID NO: 2869827 - DNA, 16 bp, Homo sapiens
tggatcccgttcagaa

SEQ ID NO: 2869828 - DNA, 20 bp, Homo sapiens
tggatcccgttcagaaaacc

SEQ ID NO: 2869829 - DNA, 19 bp, Homo sapiens
tggatgccaaggagcccct

SEQ ID NO: 2869830 - DNA, 13 bp, Homo sapiens
tggatttgcagaa

SEQ ID NO: 2869831 - DNA, 22 bp, Homo sapiens
tggcactggtaggttgggacac

SEQ ID NO: 2869832 - DNA, 20 bp, Homo sapiens
tggcattctttgcaatactg

SEQ ID NO: 2869833 - DNA, 22 bp, Homo sapiens
tggcattctttgcaatactgct

SEQ ID NO: 2869834 - DNA, 16 bp, Homo sapiens
tggcatttctctttaa

SEQ ID NO: 2869835 - DNA, 16 bp, Homo sapiens
tggccatcagggtggg

SEQ ID NO: 2869836 - DNA, 12 bp, Homo sapiens
tggcccacgccc

SEQ ID NO: 2869837 - DNA, 19 bp, Homo sapiens
tggcccacgccctccctct

SEQ ID NO: 2869838 - DNA, 20 bp, Homo sapiens
tggccctcggaggtccagct

SEQ ID NO: 2869839 - DNA, 15 bp, Homo sapiens
tggccctgcaaaagg

SEQ ID NO: 2869840 - DNA, 23 bp, Homo sapiens
tggcccttacttgcttctctagc

SEQ ID NO: 2869841 - DNA, 13 bp, Homo sapiens
tggctagagccga

SEQ ID NO: 2869842 - DNA, 19 bp, Homo sapiens
tggctagagccgaggggag

SEQ ID NO: 2869843 - DNA, 13 bp, Homo sapiens
tggctctcagagg

SEQ ID NO: 2869844 - DNA, 14 bp, Homo sapiens
tggctgctgcctgc

SEQ ID NO: 2869845 - DNA, 23 bp, Homo sapiens
tggcttggggtcaagaaacagcc

SEQ ID NO: 2869846 - DNA, 16 bp, Homo sapiens
tggctttttctgccac

SEQ ID NO: 2869847 - DNA, 17 bp, Homo sapiens
tggctttttctgccact

SEQ ID NO: 2869848 - DNA, 16 bp, Homo sapiens
tgggaagcttgagcct

SEQ ID NO: 2869849 - DNA, 18 bp, Homo sapiens
tgggaagcttgagcctcc

SEQ ID NO: 2869850 - DNA, 14 bp, Homo sapiens
tgttgataatatat

SEQ ID NO: 2869851 - DNA, 11 bp, Homo sapiens
tgttgcacttt

SEQ ID NO: 2869852 - DNA, 18 bp, Homo sapiens
tgttgcacttttgaatgt

SEQ ID NO: 2869853 - DNA, 14 bp, Homo sapiens
tgttgcctcttgca

SEQ ID NO: 2869854 - DNA, 10 bp, Homo sapiens
tgttgctgct

SEQ ID NO: 2869855 - DNA, 12 bp, Homo sapiens
tgttgctgctgt

SEQ ID NO: 2869856 - DNA, 14 bp, Homo sapiens
tgttggtctgtgta

SEQ ID NO: 2869857 - DNA, 13 bp, Homo sapiens
tgtttacagaact

SEQ ID NO: 2869858 - DNA, 14 bp, Homo sapiens
tgtttacagaactg

SEQ ID NO: 2869859 - DNA, 19 bp, Homo sapiens
tgtttactagggatccctc

SEQ ID NO: 2869860 - DNA, 14 bp, Homo sapiens
tgtttagagagcct

SEQ ID NO: 2869861 - DNA, 19 bp, Homo sapiens
tgtttagagagcctgtcac

SEQ ID NO: 2869862 - DNA, 22 bp, Homo sapiens
tgtttagagagcctgtcaccag

SEQ ID NO: 2869863 - DNA, 15 bp, Homo sapiens
tgtttatgtttaaaa

SEQ ID NO: 2869864 - DNA, 16 bp, Homo sapiens
tgtttcaattgcatct

SEQ ID NO: 2869865 - DNA, 23 bp, Homo sapiens
tgtttccttttggcctcctgcaa

SEQ ID NO: 2869866 - DNA, 19 bp, Homo sapiens
tgtttctctataaagtatg

SEQ ID NO: 2869867 - DNA, 23 bp, Homo sapiens
tgtttgtcagcatctgaccatct

SEQ ID NO: 2869868 - DNA, 19 bp, Homo sapiens
tgtttgtctgtcttcatag

SEQ ID NO: 2869869 - DNA, 14 bp, Homo sapiens
tgtttgtgctgtgg

SEQ ID NO: 2869870 - DNA, 19 bp, Homo sapiens
tgttttaaaacgtgtaaat

SEQ ID NO: 2869871 - DNA, 20 bp, Homo sapiens
tgttttaaaacgtgtaaatg

SEQ ID NO: 2869872 - DNA, 22 bp, Homo sapiens
tgttttaaaacgtgtaaatgaa

SEQ ID NO: 2869873 - DNA, 21 bp, Homo sapiens
tgttttagtgtttatgtttaa

SEQ ID NO: 2869874 - DNA, 15 bp, Homo sapiens
tgtttttaagctgtt

SEQ ID NO: 2869875 - DNA, 16 bp, Homo sapiens
ttaaaacaaatataca

SEQ ID NO: 2869876 - DNA, 12 bp, Homo sapiens
ttaaaatcctca

SEQ ID NO: 2869877 - DNA, 16 bp, Homo sapiens
ttaaactatgttccta

SEQ ID NO: 2869878 - DNA, 18 bp, Homo sapiens
ttaaactatgttcctaac

SEQ ID NO: 2869879 - DNA, 20 bp, Homo sapiens
ttaacatacaagaaaatgta

SEQ ID NO: 2869880 - DNA, 21 bp, Homo sapiens
ttaacatacaagaaaatgtat

SEQ ID NO: 2869881 - DNA, 13 bp, Homo sapiens
ttaaccctctctt

SEQ ID NO: 2869882 - DNA, 20 bp, Homo sapiens
ttaactatcttctttggact

SEQ ID NO: 2869883 - DNA, 18 bp, Homo sapiens
ttaactgtgaaatgtacg

SEQ ID NO: 2869884 - DNA, 17 bp, Homo sapiens
ttaagaatggaagaaaa

SEQ ID NO: 2869885 - DNA, 22 bp, Homo sapiens
ttaagcattttgaaacaaagta

SEQ ID NO: 2869886 - DNA, 23 bp, Homo sapiens
ttaagtcctaaaagttctcaatg

SEQ ID NO: 2869887 - DNA, 18 bp, Homo sapiens
ttaatgaagaaagtggaa

SEQ ID NO: 2869888 - DNA, 21 bp, Homo sapiens
ttaatgctgtttctaagaaaa

SEQ ID NO: 2869889 - DNA, 23 bp, Homo sapiens
ttaatgctgtttctaagaaaatg

SEQ ID NO: 2869890 - DNA, 20 bp, Homo sapiens
ttaattttaatgctgtttct

SEQ ID NO: 2869891 - DNA, 17 bp, Homo sapiens
ttacactgcggaagcca

SEQ ID NO: 2869892 - DNA, 19 bp, Homo sapiens
ttacactgcggaagccaaa

SEQ ID NO: 2869893 - DNA, 20 bp, Homo sapiens
ttacactgcggaagccaaag

SEQ ID NO: 2869894 - DNA, 11 bp, Homo sapiens
ttacctcctga

SEQ ID NO: 2869895 - DNA, 19 bp, Homo sapiens
ttacctcctgagaaaaaag

SEQ ID NO: 2869896 - DNA, 18 bp, Homo sapiens
ttacctgaaaacactgtg

SEQ ID NO: 2869897 - DNA, 20 bp, Homo sapiens
ttacctgaaaacactgtgca

SEQ ID NO: 2869898 - DNA, 22 bp, Homo sapiens
ttacctgaaaacactgtgcaca

SEQ ID NO: 2869899 - DNA, 16 bp, Homo sapiens
ttactagggatccctc

SEQ ID NO: 2869900 - DNA, 14 bp, Homo sapiens
ttactgagcttctc

SEQ ID NO: 2869901 - DNA, 19 bp, Homo sapiens
ttactgagcttctctgtga

SEQ ID NO: 2869902 - DNA, 13 bp, Homo sapiens
ttactgcaatcac

SEQ ID NO: 2869903 - DNA, 18 bp, Homo sapiens
ttactgtatttttcagaa

SEQ ID NO: 2869904 - DNA, 21 bp, Homo sapiens
ttagagagcctgtcaccagag

SEQ ID NO: 2869905 - DNA, 17 bp, Homo sapiens
ttagagtgtctttccac

SEQ ID NO: 2869906 - DNA, 24 bp, Homo sapiens
ttagctccataaagtacaaatgaa

SEQ ID NO: 2869907 - DNA, 20 bp, Homo sapiens
ttagctgaggctgagaaagc

SEQ ID NO: 2869908 - DNA, 14 bp, Homo sapiens
ttaggcatgcctaa

SEQ ID NO: 2869909 - DNA, 12 bp, Homo sapiens
ttagtaacatgt

SEQ ID NO: 2869910 - DNA, 12 bp, Homo sapiens
ttagtgatgtcc

SEQ ID NO: 2869911 - DNA, 17 bp, Homo sapiens
ttagtgtgacagtttcc

SEQ ID NO: 2869912 - DNA, 20 bp, Homo sapiens
ttagtgtgacagtttccaaa

SEQ ID NO: 2869913 - DNA, 21 bp, Homo sapiens
ttagtgtgacagtttccaaat

SEQ ID NO: 2869914 - DNA, 18 bp, Homo sapiens
ttatacatcaatatgtat

SEQ ID NO: 2869915 - DNA, 15 bp, Homo sapiens
ttatagaatatttat

SEQ ID NO: 2869916 - DNA, 23 bp, Homo sapiens
ttatagaatatttattacctctg

SEQ ID NO: 2869917 - DNA, 18 bp, Homo sapiens
ttatagcaactaatgttt

SEQ ID NO: 2869918 - DNA, 16 bp, Homo sapiens
ttatatttcaataaat

SEQ ID NO: 2869919 - DNA, 22 bp, Homo sapiens
ttatattttagaaataataaaa

SEQ ID NO: 2869920 - DNA, 17 bp, Homo sapiens
ttatatttttttaactg

SEQ ID NO: 2869921 - DNA, 20 bp, Homo sapiens
ttatatttttttaactgtga

SEQ ID NO: 2869922 - DNA, 23 bp, Homo sapiens
ttatatttttttaactgtgataa

SEQ ID NO: 2869923 - DNA, 18 bp, Homo sapiens
ttatcagtaatgctaaat

SEQ ID NO: 2869924 - DNA, 20 bp, Homo sapiens
ttatcagtaatgctaaatgt

SEQ ID NO: 2869925 - DNA, 23 bp, Homo sapiens
ttatcagtaatgctaaatgtgta

SEQ ID NO: 2869926 - DNA, 17 bp, Homo sapiens
ttatcttgtctctgggc

SEQ ID NO: 2869927 - DNA, 15 bp, Homo sapiens
ttatgaaaagtacta

SEQ ID NO: 2869928 - DNA, 22 bp, Homo sapiens
ttatgacaagctgtatcactgc

SEQ ID NO: 2869929 - DNA, 18 bp, Homo sapiens
ttatgcacttttagaaat

SEQ ID NO: 2869930 - DNA, 19 bp, Homo sapiens
ttattcaagaatgaaaaat

SEQ ID NO: 2869931 - DNA, 15 bp, Homo sapiens
ttattggactccagg

SEQ ID NO: 2869932 - DNA, 18 bp, Homo sapiens
ttattggactccaggcct

SEQ ID NO: 2869933 - DNA, 17 bp, Homo sapiens
ttatttactgagcttct

SEQ ID NO: 2869934 - DNA, 21 bp, Homo sapiens
ttatttactgagcttctctgt

SEQ ID NO: 2869935 - DNA, 13 bp, Homo sapiens
ttcaaagccagcg

SEQ ID NO: 2869936 - DNA, 23 bp, Homo sapiens
ttcaaagccagcgtcctcctctg

SEQ ID NO: 2869937 - DNA, 17 bp, Homo sapiens
ttcaaccacgcaggaag

SEQ ID NO: 2869938 - DNA, 18 bp, Homo sapiens
ttcaagaagtaatcagta

SEQ ID NO: 2869939 - DNA, 22 bp, Homo sapiens
ttcaagaagtaatcagtatgca

SEQ ID NO: 2869940 - DNA, 20 bp, Homo sapiens
ttcaagagctagaaaaataa

SEQ ID NO: 2869941 - DNA, 19 bp, Homo sapiens
ttcaaggacattggtgaga

SEQ ID NO: 2869942 - DNA, 16 bp, Homo sapiens
ttcaataaatgatata

SEQ ID NO: 2869943 - DNA, 11 bp, Homo sapiens
ttcaatattta

SEQ ID NO: 2869944 - DNA, 14 bp, Homo sapiens
tcccctgccagggc

SEQ ID NO: 2869945 - DNA, 20 bp, Homo sapiens
tcccctgccagggcagggcc

SEQ ID NO: 2869946 - DNA, 19 bp, Homo sapiens
tccctagaaacttccaaat

SEQ ID NO: 2869947 - DNA, 21 bp, Homo sapiens
tccctcatctgtccctccggg

SEQ ID NO: 2869948 - DNA, 16 bp, Homo sapiens
tccctgacctccctct

SEQ ID NO: 2869949 - DNA, 14 bp, Homo sapiens
tccctgactcattc

SEQ ID NO: 2869950 - DNA, 22 bp, Homo sapiens
tccctgactcattctgaaggag

SEQ ID NO: 2869951 - DNA, 22 bp, Homo sapiens
tccctgccacttcaacccccag

SEQ ID NO: 2869952 - DNA, 22 bp, Homo sapiens
tccctgtaacctcttcagaggc

SEQ ID NO: 2869953 - DNA, 22 bp, Homo sapiens
tcccttaaacaaaaattaaaat

SEQ ID NO: 2869954 - DNA, 15 bp, Homo sapiens
tcccttcccagacca

SEQ ID NO: 2869955 - DNA, 17 bp, Homo sapiens
tcccttcccagaccagg

SEQ ID NO: 2869956 - DNA, 17 bp, Homo sapiens
tcctaaaagttctcaat

SEQ ID NO: 2869957 - DNA, 22 bp, Homo sapiens
tcctactttctatttttatgat

SEQ ID NO: 2869958 - DNA, 19 bp, Homo sapiens
tcctagatctgcaggctgc

SEQ ID NO: 2869959 - DNA, 18 bp, Homo sapiens
tcctatacgcagcgtgct

SEQ ID NO: 2869960 - DNA, 19 bp, Homo sapiens
tcctatacgcagcgtgctt

SEQ ID NO: 2869961 - DNA, 18 bp, Homo sapiens
tcctatgtttttgttcaa

SEQ ID NO: 2869962 - DNA, 19 bp, Homo sapiens
tcctatgtttttgttcaaa

SEQ ID NO: 2869963 - DNA, 21 bp, Homo sapiens
tcctccacgttctgctcatca

SEQ ID NO: 2869964 - DNA, 22 bp, Homo sapiens
tcctccacgttctgctcatcat

SEQ ID NO: 2869965 - DNA, 18 bp, Homo sapiens
tcctccagcccctgtccc

SEQ ID NO: 2869966 - DNA, 17 bp, Homo sapiens
tcctccccaccttcccc

SEQ ID NO: 2869967 - DNA, 20 bp, Homo sapiens
tcctccccaccttccccaga

SEQ ID NO: 2869968 - DNA, 14 bp, Homo sapiens
tcctccccagctct

SEQ ID NO: 2869969 - DNA, 16 bp, Homo sapiens
tcctcctgggccctct

SEQ ID NO: 2869970 - DNA, 22 bp, Homo sapiens
tcctcctgggccctctctgctc

SEQ ID NO: 2869971 - DNA, 19 bp, Homo sapiens
tcctctactaacaatcagc

SEQ ID NO: 2869972 - DNA, 18 bp, Homo sapiens
tcctctgactcagggctc

SEQ ID NO: 2869973 - DNA, 14 bp, Homo sapiens
tcctctgcagcact

SEQ ID NO: 2869974 - DNA, 15 bp, Homo sapiens
tcctctgcagcactt

SEQ ID NO: 2869975 - DNA, 19 bp, Homo sapiens
tcctctgtgaccaatgtct

SEQ ID NO: 2869976 - DNA, 20 bp, Homo sapiens
tcctctgtgaccaatgtctt

SEQ ID NO: 2869977 - DNA, 21 bp, Homo sapiens
tcctgacactcaataaacagt

SEQ ID NO: 2869978 - DNA, 18 bp, Homo sapiens
tcctgcaaagtctccaga

SEQ ID NO: 2869979 - DNA, 19 bp, Homo sapiens
tcctgcagcaaacactcca

SEQ ID NO: 2869980 - DNA, 20 bp, Homo sapiens
tcctgggaaatattccctag

SEQ ID NO: 2869981 - DNA, 16 bp, Homo sapiens
tcctgggccctctctg

SEQ ID NO: 2869982 - DNA, 17 bp, Homo sapiens
tcctgggccctctctgc

SEQ ID NO: 2869983 - DNA, 20 bp, Homo sapiens
tcctgggttttgtattctct

SEQ ID NO: 2869984 - DNA, 23 bp, Homo sapiens
tcctgggttttgtattctctgag

SEQ ID NO: 2869985 - DNA, 18 bp, Homo sapiens
tccttcccccatcccctt

SEQ ID NO: 2869986 - DNA, 15 bp, Homo sapiens
tccttccctgccact

SEQ ID NO: 2869987 - DNA, 13 bp, Homo sapiens
tccttctggttct

SEQ ID NO: 2869988 - DNA, 23 bp, Homo sapiens
tcgcctttcccaggtgctacacc

SEQ ID NO: 2869989 - DNA, 14 bp, Homo sapiens
tcgctgaaattgct

SEQ ID NO: 2869990 - DNA, 22 bp, Homo sapiens
tcgctggactctcagtctctga

SEQ ID NO: 2869991 - DNA, 16 bp, Homo sapiens
tcggaggtccagctgg

SEQ ID NO: 2869992 - DNA, 22 bp, Homo sapiens
tcggcagatgatgctttggaag

SEQ ID NO: 2869993 - DNA, 23 bp, Homo sapiens
tcggccagttttcggaaacactg

SEQ ID NO: 2869994 - DNA, 14 bp, Homo sapiens
tctaaataaaaata

SEQ ID NO: 2869995 - DNA, 18 bp, Homo sapiens
tctaaataaaaatatgta

SEQ ID NO: 2869996 - DNA, 18 bp, Homo sapiens
tctaacctcatcttcttc

SEQ ID NO: 2869997 - DNA, 21 bp, Homo sapiens
tctaaccttcacgattaactg

SEQ ID NO: 2869998 - DNA, 22 bp, Homo sapiens
tctaatagaactcagttttaac

SEQ ID NO: 2869999 - DNA, 20 bp, Homo sapiens
tctaattgtaagtgaaatta

SEQ ID NO: 2870000 - DNA, 16 bp, Homo sapiens
tctacagagcttccct

SEQ ID NO: 2870001 - DNA, 18 bp, Homo sapiens
tctacagagcttccctga

SEQ ID NO: 2870002 - DNA, 14 bp, Homo sapiens
tctaccaatacaaa

SEQ ID NO: 2870003 - DNA, 17 bp, Homo sapiens
tctacccggcccagaga

SEQ ID NO: 2870004 - DNA, 19 bp, Homo sapiens
tctacccggcccagagacc

SEQ ID NO: 2870005 - DNA, 22 bp, Homo sapiens
tctacccggcccagagacccct

SEQ ID NO: 2870006 - DNA, 19 bp, Homo sapiens
tctagaatcacagctcaag

SEQ ID NO: 2870007 - DNA, 17 bp, Homo sapiens
tctagactttctcagtg

SEQ ID NO: 2870008 - DNA, 22 bp, Homo sapiens
tctagaggtgagaccaaaggat

SEQ ID NO: 2870009 - DNA, 14 bp, Homo sapiens
tctagctctctagg

SEQ ID NO: 2870010 - DNA, 19 bp, Homo sapiens
tctagctgttgagctgttt

SEQ ID NO: 2870011 - DNA, 14 bp, Homo sapiens
tctaggcctctcca

SEQ ID NO: 2870012 - DNA, 15 bp, Homo sapiens
tctagtgggacagcc

SEQ ID NO: 2870013 - DNA, 19 bp, Homo sapiens
tctagtgggacagcccaga

SEQ ID NO: 2870014 - DNA, 20 bp, Homo sapiens
tctatggcttatttctatga

SEQ ID NO: 2870015 - DNA, 12 bp, Homo sapiens
tctatgtttata

SEQ ID NO: 2870016 - DNA, 14 bp, Homo sapiens
tctatttctcctcc

SEQ ID NO: 2870017 - DNA, 12 bp, Homo sapiens
tctcaaatgtgt

SEQ ID NO: 2870018 - DNA, 13 bp, Homo sapiens
tctcaatgtacat

SEQ ID NO: 2870019 - DNA, 18 bp, Homo sapiens
tctcactccccagcccca

SEQ ID NO: 2870020 - DNA, 23 bp, Homo sapiens
tctcactccccagccccacccct

SEQ ID NO: 2870021 - DNA, 23 bp, Homo sapiens
tctcagaggaaaaatgggagcca

SEQ ID NO: 2870022 - DNA, 18 bp, Homo sapiens
tctcagtccagcagtttc

SEQ ID NO: 2870023 - DNA, 15 bp, Homo sapiens
tctcagtctctgagc

SEQ ID NO: 2870024 - DNA, 17 bp, Homo sapiens
tctcagtggtgtgtgaa

SEQ ID NO: 2870025 - DNA, 19 bp, Homo sapiens
tctcagtggtgtgtgaagt

SEQ ID NO: 2870026 - DNA, 21 bp, Homo sapiens
tctcataagtagcattcatgt

SEQ ID NO: 2870027 - DNA, 14 bp, Homo sapiens
tctcatgtcaatga

SEQ ID NO: 2870028 - DNA, 13 bp, Homo sapiens
tctccatccacat

SEQ ID NO: 2870029 - DNA, 19 bp, Homo sapiens
tctccatccacatgggagc

SEQ ID NO: 2870030 - DNA, 15 bp, Homo sapiens
tctccatggccctgc

SEQ ID NO: 2870031 - DNA, 18 bp, Homo sapiens
tctccatggccctgcaaa

SEQ ID NO: 2870032 - DNA, 16 bp, Homo sapiens
tctcccagataatgtg

SEQ ID NO: 2870033 - DNA, 21 bp, Homo sapiens
tctcccagataatgtgaaaat

SEQ ID NO: 2870034 - DNA, 13 bp, Homo sapiens
tctcccaggcccg

SEQ ID NO: 2870035 - DNA, 15 bp, Homo sapiens
tctcccctccctctt

SEQ ID NO: 2870036 - DNA, 20 bp, Homo sapiens
tctcctccatgggagaaaat

SEQ ID NO: 2870037 - DNA, 20 bp, Homo sapiens
tctcctgccttcctcctggg

SEQ ID NO: 2870038 - DNA, 18 bp, Homo sapiens
tctctacccggcccagag

SEQ ID NO: 2870039 - DNA, 19 bp, Homo sapiens
tctctaggcctctccagtt

SEQ ID NO: 2870040 - DNA, 15 bp, Homo sapiens
tctctattttcataa

SEQ ID NO: 2870041 - DNA, 14 bp, Homo sapiens
tctctgagcagtga

SEQ ID NO: 2870042 - DNA, 15 bp, Homo sapiens
tctctgagctgtgca

SEQ ID NO: 2870043 - DNA, 16 bp, Homo sapiens
tctctgagctgtgcag

SEQ ID NO: 2870044 - DNA, 18 bp, Homo sapiens
tctctgctctgcgtgtca

SEQ ID NO: 2870045 - DNA, 23 bp, Homo sapiens
tctctgctctgcgtgtcacctgt

SEQ ID NO: 2870046 - DNA, 12 bp, Homo sapiens
tctctgtctcat

SEQ ID NO: 2870047 - DNA, 16 bp, Homo sapiens
tctctgtctcatccat

SEQ ID NO: 2870048 - DNA, 23 bp, Homo sapiens
tctctgtctcatccatcatcatg

SEQ ID NO: 2870049 - DNA, 18 bp, Homo sapiens
tctcttatagaatattta

SEQ ID NO: 2870050 - DNA, 12 bp, Homo sapiens
tctcttccctat

SEQ ID NO: 2870051 - DNA, 20 bp, Homo sapiens
tctgaaaccagtgttaggga

SEQ ID NO: 2870052 - DNA, 23 bp, Homo sapiens
tctgaagagaccactcaatccat

SEQ ID NO: 2870053 - DNA, 18 bp, Homo sapiens
ggcaattagtgtgacagt

SEQ ID NO: 2870054 - DNA, 12 bp, Homo sapiens
ggcactgggctg

SEQ ID NO: 2870055 - DNA, 22 bp, Homo sapiens
ggcactgggctgttgttccatt

SEQ ID NO: 2870056 - DNA, 21 bp, Homo sapiens
ggcactggtaggttgggacac

SEQ ID NO: 2870057 - DNA, 22 bp, Homo sapiens
ggcagagcaattccaggctgag

SEQ ID NO: 2870058 - DNA, 12 bp, Homo sapiens
ggcagagcccaa

SEQ ID NO: 2870059 - DNA, 18 bp, Homo sapiens
ggcagcagggctaccctg

SEQ ID NO: 2870060 - DNA, 13 bp, Homo sapiens
ggcagcagtgtga

SEQ ID NO: 2870061 - DNA, 22 bp, Homo sapiens
ggcagcagtgtgaggccagggc

SEQ ID NO: 2870062 - DNA, 23 bp, Homo sapiens
ggcagctaagatagaaagctgga

SEQ ID NO: 2870063 - DNA, 15 bp, Homo sapiens
ggcatgaacgcactt

SEQ ID NO: 2870064 - DNA, 22 bp, Homo sapiens
ggcattcaaccacgcaggaagc

SEQ ID NO: 2870065 - DNA, 14 bp, Homo sapiens
ggccaagatggctg

SEQ ID NO: 2870066 - DNA, 20 bp, Homo sapiens
ggccaagatggctgctgcct

SEQ ID NO: 2870067 - DNA, 20 bp, Homo sapiens
ggccactctcccctccctct

SEQ ID NO: 2870068 - DNA, 22 bp, Homo sapiens
ggccactctcccctccctcttc

SEQ ID NO: 2870069 - DNA, 16 bp, Homo sapiens
ggcccagagacccctt

SEQ ID NO: 2870070 - DNA, 17 bp, Homo sapiens
ggcccgaacagggactt

SEQ ID NO: 2870071 - DNA, 16 bp, Homo sapiens
ggccctcgctgccagc

SEQ ID NO: 2870072 - DNA, 14 bp, Homo sapiens
ggccctctctgctc

SEQ ID NO: 2870073 - DNA, 19 bp, Homo sapiens
ggcccttcccacaggacat

SEQ ID NO: 2870074 - DNA, 12 bp, Homo sapiens
ggcctcctgcct

SEQ ID NO: 2870075 - DNA, 13 bp, Homo sapiens
ggcctgaccaggg

SEQ ID NO: 2870076 - DNA, 15 bp, Homo sapiens
ggcctgttgctatag

SEQ ID NO: 2870077 - DNA, 21 bp, Homo sapiens
ggcctgttgctatagagccta

SEQ ID NO: 2870078 - DNA, 15 bp, Homo sapiens
ggccttagggcactg

SEQ ID NO: 2870079 - DNA, 22 bp, Homo sapiens
ggcgcgcacctgtaatcccagc

SEQ ID NO: 2870080 - DNA, 14 bp, Homo sapiens
ggctagagccgagg

SEQ ID NO: 2870081 - DNA, 16 bp, Homo sapiens
ggctccagagggcact

SEQ ID NO: 2870082 - DNA, 18 bp, Homo sapiens
ggctccctgactgggagt

SEQ ID NO: 2870083 - DNA, 18 bp, Homo sapiens
ggctcgttgactggctgt

SEQ ID NO: 2870084 - DNA, 23 bp, Homo sapiens
ggctctgggatagctgacccagc

SEQ ID NO: 2870085 - DNA, 16 bp, Homo sapiens
ggctgaatagcagaag

SEQ ID NO: 2870086 - DNA, 16 bp, Homo sapiens
ggctgagccatgagga

SEQ ID NO: 2870087 - DNA, 15 bp, Homo sapiens
ggctgagggagcctg

SEQ ID NO: 2870088 - DNA, 14 bp, Homo sapiens
ggctgatgaagaag

SEQ ID NO: 2870089 - DNA, 22 bp, Homo sapiens
ggctgatgaagaagggggtggg

SEQ ID NO: 2870090 - DNA, 12 bp, Homo sapiens
ggctgctgcctg

SEQ ID NO: 2870091 - DNA, 13 bp, Homo sapiens
ggctgctgcctgc

SEQ ID NO: 2870092 - DNA, 14 bp, Homo sapiens
ggctgctgcctgct

SEQ ID NO: 2870093 - DNA, 18 bp, Homo sapiens
ggctggtgtatgcacagg

SEQ ID NO: 2870094 - DNA, 21 bp, Homo sapiens
gggaagctgggggaagggtgg

SEQ ID NO: 2870095 - DNA, 20 bp, Homo sapiens
gggaagcttgagcctccccc

SEQ ID NO: 2870096 - DNA, 21 bp, Homo sapiens
gggaagcttgagcctccccca

SEQ ID NO: 2870097 - DNA, 18 bp, Homo sapiens
gggacaagggattctggg

SEQ ID NO: 2870098 - DNA, 19 bp, Homo sapiens
gggacagcccagagcctgg

SEQ ID NO: 2870099 - DNA, 22 bp, Homo sapiens
gggacgttcgtggtcctgcgct

SEQ ID NO: 2870100 - DNA, 20 bp, Homo sapiens
gggacttgtttagagagcct

SEQ ID NO: 2870101 - DNA, 23 bp, Homo sapiens
gggacttgtttagagagcctgtc

SEQ ID NO: 2870102 - DNA, 14 bp, Homo sapiens
gggagattgaactt

SEQ ID NO: 2870103 - DNA, 10 bp, Homo sapiens
gggagccagg

SEQ ID NO: 2870104 - DNA, 11 bp, Homo sapiens
gggagggcagc

SEQ ID NO: 2870105 - DNA, 22 bp, Homo sapiens
gggatattttgaaatgaacttt

SEQ ID NO: 2870106 - DNA, 12 bp, Homo sapiens
gggcagagccca

SEQ ID NO: 2870107 - DNA, 18 bp, Homo sapiens
gggccactctcccctccc

SEQ ID NO: 2870108 - DNA, 20 bp, Homo sapiens
gggctaccctgagctgaggc

SEQ ID NO: 2870109 - DNA, 15 bp, Homo sapiens
gggctgaatgtatgt

SEQ ID NO: 2870110 - DNA, 16 bp, Homo sapiens
gggctgaatgtatgtc

SEQ ID NO: 2870111 - DNA, 14 bp, Homo sapiens
gggctgagggagcc

SEQ ID NO: 2870112 - DNA, 20 bp, Homo sapiens
ggggattggagggaagacag

SEQ ID NO: 2870113 - DNA, 23 bp, Homo sapiens
ggggccaggcaggggtgggagag

SEQ ID NO: 2870114 - DNA, 20 bp, Homo sapiens
ggggccttagggcactgggc

SEQ ID NO: 2870115 - DNA, 15 bp, Homo sapiens
gggtgggccactctc

SEQ ID NO: 2870116 - DNA, 21 bp, Homo sapiens
gggtggtctgagcaccccctc

SEQ ID NO: 2870117 - DNA, 17 bp, Homo sapiens
gggtggttattggactc

SEQ ID NO: 2870118 - DNA, 19 bp, Homo sapiens
gggtgtggtatgagggggt

SEQ ID NO: 2870119 - DNA, 18 bp, Homo sapiens
gggttctgcagcggcaga

SEQ ID NO: 2870120 - DNA, 18 bp, Homo sapiens
ggtaatattgataagcta

SEQ ID NO: 2870121 - DNA, 19 bp, Homo sapiens
ggtaggttgggacaccagg

SEQ ID NO: 2870122 - DNA, 21 bp, Homo sapiens
ggtcaagaaacagccagcaag

SEQ ID NO: 2870123 - DNA, 11 bp, Homo sapiens
ggtcataaaat

SEQ ID NO: 2870124 - DNA, 11 bp, Homo sapiens
ggtccaggaga

SEQ ID NO: 2870125 - DNA, 18 bp, Homo sapiens
ggtccagtcgggaggagc

SEQ ID NO: 2870126 - DNA, 17 bp, Homo sapiens
ggtctgagcaccccctc

SEQ ID NO: 2870127 - DNA, 22 bp, Homo sapiens
ggtctgagcaccccctcattcc

SEQ ID NO: 2870128 - DNA, 22 bp, Homo sapiens
ggtctgtgtaacatccaagcca

SEQ ID NO: 2870129 - DNA, 13 bp, Homo sapiens
ggtgaagggaagt

SEQ ID NO: 2870130 - DNA, 18 bp, Homo sapiens
ggtgaagggaagtgggga

SEQ ID NO: 2870131 - DNA, 14 bp, Homo sapiens
ggtggcctgcgtct

SEQ ID NO: 2870132 - DNA, 20 bp, Homo sapiens
ggtgggtccatgggcagagc

SEQ ID NO: 2870133 - DNA, 17 bp, Homo sapiens
ggtgtcacatggggcct

SEQ ID NO: 2870134 - DNA, 23 bp, Homo sapiens
ggtgtcacatggggcctggccca

SEQ ID NO: 2870135 - DNA, 15 bp, Homo sapiens
ggtgtgatcgtctga

SEQ ID NO: 2870136 - DNA, 15 bp, Homo sapiens
ggtgtggtgaatgtg

SEQ ID NO: 2870137 - DNA, 21 bp, Homo sapiens
ggttccgcttggagcagaggg

SEQ ID NO: 2870138 - DNA, 22 bp, Homo sapiens
ggttccgcttggagcagagggg

SEQ ID NO: 2870139 - DNA, 23 bp, Homo sapiens
ggttccgcttggagcagaggggc

SEQ ID NO: 2870140 - DNA, 15 bp, Homo sapiens
ggttgttggtctgtg

SEQ ID NO: 2870141 - DNA, 16 bp, Homo sapiens
ggtttttaaaacccag

SEQ ID NO: 2870142 - DNA, 23 bp, Homo sapiens
gtaaaaaatgtctcatgtcaatg

SEQ ID NO: 2870143 - DNA, 12 bp, Homo sapiens
gtaaaagtagtg

SEQ ID NO: 2870144 - DNA, 16 bp, Homo sapiens
gtaaatgaagatcttt

SEQ ID NO: 2870145 - DNA, 20 bp, Homo sapiens
gtaaatgaagatctttatat

SEQ ID NO: 2870146 - DNA, 16 bp, Homo sapiens
gtaacatccaagccag

SEQ ID NO: 2870147 - DNA, 17 bp, Homo sapiens
gtaacatccaagccaga

SEQ ID NO: 2870148 - DNA, 19 bp, Homo sapiens
gtaacatccaagccagagt

SEQ ID NO: 2870149 - DNA, 17 bp, Homo sapiens
gtaaccagctcagtgtt

SEQ ID NO: 2870150 - DNA, 15 bp, Homo sapiens
gtaagtgaaattaag

SEQ ID NO: 2870151 - DNA, 16 bp, Homo sapiens
gtaatcccagctactt

SEQ ID NO: 2870152 - DNA, 16 bp, Homo sapiens
gtaatctatgtttata

SEQ ID NO: 2870153 - DNA, 20 bp, Homo sapiens
gtaatctatgtttataatac

SEQ ID NO: 2870154 - DNA, 17 bp, Homo sapiens
gtaatgctaaatgtgta

SEQ ID NO: 2870155 - DNA, 22 bp, Homo sapiens
gtaatgctaaatgtgtaataat

SEQ ID NO: 2870156 - DNA, 15 bp, Homo sapiens
gtaattagtaacatg

SEQ ID NO: 2870157 - DNA, 23 bp, Homo sapiens
gtaattagtaacatgtgttaagt

SEQ ID NO: 2870158 - DNA, 12 bp, Homo sapiens
gtaatttcaaaa

SEQ ID NO: 2870159 - DNA, 15 bp, Homo sapiens
gtactcaaatgtagc

SEQ ID NO: 2870160 - DNA, 14 bp, Homo sapiens
gtactctttaacat

SEQ ID NO: 2870161 - DNA, 16 bp, Homo sapiens
gtagaactcactctgg

SEQ ID NO: 2870162 - DNA, 19 bp, Homo sapiens
gtagaactcactctgggct

SEQ ID NO: 2870163 - DNA, 15 bp, Homo sapiens
taagtcaacctgcct

SEQ ID NO: 2870164 - DNA, 12 bp, Homo sapiens
taagtgcccaaa

SEQ ID NO: 2870165 - DNA, 23 bp, Homo sapiens
taagtgcgaagactgagccagat

SEQ ID NO: 2870166 - DNA, 15 bp, Homo sapiens
taagtgtaaaaaatg

SEQ ID NO: 2870167 - DNA, 17 bp, Homo sapiens
taataatgtaacatgat

SEQ ID NO: 2870168 - DNA, 19 bp, Homo sapiens
taatagctttagtgaatta

SEQ ID NO: 2870169 - DNA, 14 bp, Homo sapiens
taatatgtctgcca

SEQ ID NO: 2870170 - DNA, 19 bp, Homo sapiens
taatatttttgtatttctc

SEQ ID NO: 2870171 - DNA, 13 bp, Homo sapiens
taatcagtaaata

SEQ ID NO: 2870172 - DNA, 19 bp, Homo sapiens
taatcccagctacttggga

SEQ ID NO: 2870173 - DNA, 19 bp, Homo sapiens
taatccgaatctctttttg

SEQ ID NO: 2870174 - DNA, 15 bp, Homo sapiens
taatctatgtttata

SEQ ID NO: 2870175 - DNA, 13 bp, Homo sapiens
taatctcaatgca

SEQ ID NO: 2870176 - DNA, 16 bp, Homo sapiens
taatgaagaaagtgga

SEQ ID NO: 2870177 - DNA, 22 bp, Homo sapiens
taatgaagaaagtggaaaacaa

SEQ ID NO: 2870178 - DNA, 20 bp, Homo sapiens
taatgctgtttctaagaaaa

SEQ ID NO: 2870179 - DNA, 13 bp, Homo sapiens
taatgggattaga

SEQ ID NO: 2870180 - DNA, 14 bp, Homo sapiens
taattggatgttca

SEQ ID NO: 2870181 - DNA, 16 bp, Homo sapiens
taattgtaagtgaaat

SEQ ID NO: 2870182 - DNA, 18 bp, Homo sapiens
taattgtaagtgaaatta

SEQ ID NO: 2870183 - DNA, 14 bp, Homo sapiens
taatttcaaaatac

SEQ ID NO: 2870184 - DNA, 21 bp, Homo sapiens
taatttcaaaatacatttgta

SEQ ID NO: 2870185 - DNA, 13 bp, Homo sapiens
taatttgaacttt

SEQ ID NO: 2870186 - DNA, 16 bp, Homo sapiens
taatttttttcaatat

SEQ ID NO: 2870187 - DNA, 22 bp, Homo sapiens
taatttttttcaatatttatta

SEQ ID NO: 2870188 - DNA, 20 bp, Homo sapiens
tacaaaaattatgcaattca

SEQ ID NO: 2870189 - DNA, 10 bp, Homo sapiens
tacaaaatgg

SEQ ID NO: 2870190 - DNA, 11 bp, Homo sapiens
tacaaaatgga

SEQ ID NO: 2870191 - DNA, 23 bp, Homo sapiens
tacaaactcatcctcttttaatg

SEQ ID NO: 2870192 - DNA, 23 bp, Homo sapiens
tacaaatactcttaggaagagaa

SEQ ID NO: 2870193 - DNA, 15 bp, Homo sapiens
tacacccttttccag

SEQ ID NO: 2870194 - DNA, 16 bp, Homo sapiens
tacactgcggaagcca

SEQ ID NO: 2870195 - DNA, 19 bp, Homo sapiens
tacactgcggaagccaaag

SEQ ID NO: 2870196 - DNA, 16 bp, Homo sapiens
tacagataacttcttt

SEQ ID NO: 2870197 - DNA, 13 bp, Homo sapiens
tacagccttattt

SEQ ID NO: 2870198 - DNA, 13 bp, Homo sapiens
tacagtaggagcc

SEQ ID NO: 2870199 - DNA, 18 bp, Homo sapiens
tacagtaggagcccagct

SEQ ID NO: 2870200 - DNA, 22 bp, Homo sapiens
tacagtcttccatttgcaaggg

SEQ ID NO: 2870201 - DNA, 20 bp, Homo sapiens
tacatagaccctctttcttg

SEQ ID NO: 2870202 - DNA, 18 bp, Homo sapiens
tacatatgctgatctttt

SEQ ID NO: 2870203 - DNA, 13 bp, Homo sapiens
tacatatttgtat

SEQ ID NO: 2870204 - DNA, 15 bp, Homo sapiens
tacatcaatatgtat

SEQ ID NO: 2870205 - DNA, 16 bp, Homo sapiens
tacatgacatttattt

SEQ ID NO: 2870206 - DNA, 21 bp, Homo sapiens
tacatgacatttatttttcat

SEQ ID NO: 2870207 - DNA, 16 bp, Homo sapiens
tacattttctaaataa

SEQ ID NO: 2870208 - DNA, 20 bp, Homo sapiens
tacattttctaaataaaaat

SEQ ID NO: 2870209 - DNA, 19 bp, Homo sapiens
taccactcttttgctgtgc

SEQ ID NO: 2870210 - DNA, 20 bp, Homo sapiens
tacctacatatttgtatgtt

SEQ ID NO: 2870211 - DNA, 22 bp, Homo sapiens
tacctcaacccccatttctatt

SEQ ID NO: 2870212 - DNA, 21 bp, Homo sapiens
tacctgaaaacactgtgcaca

SEQ ID NO: 2870213 - DNA, 16 bp, Homo sapiens
tacctttaattttaat

SEQ ID NO: 2870214 - DNA, 17 bp, Homo sapiens
tacgaatgcccctgttc

SEQ ID NO: 2870215 - DNA, 22 bp, Homo sapiens
tacgaatgcccctgttcatgtt

SEQ ID NO: 2870216 - DNA, 22 bp, Homo sapiens
tacgcagcgtgctttaaaaaat

SEQ ID NO: 2870217 - DNA, 18 bp, Homo sapiens
tactaaaattatgttact

SEQ ID NO: 2870218 - DNA, 20 bp, Homo sapiens
tactaaaattatgttactgt

SEQ ID NO: 2870219 - DNA, 12 bp, Homo sapiens
tactctcccaga

SEQ ID NO: 2870220 - DNA, 18 bp, Homo sapiens
tactcttaggaagagaaa

SEQ ID NO: 2870221 - DNA, 15 bp, Homo sapiens
tactgaataatatca

SEQ ID NO: 2870222 - DNA, 18 bp, Homo sapiens
tactgaataatatcaaat

SEQ ID NO: 2870223 - DNA, 19 bp, Homo sapiens
tactgaataatatcaaata

SEQ ID NO: 2870224 - DNA, 17 bp, Homo sapiens
tactgagcttctctgtg

SEQ ID NO: 2870225 - DNA, 14 bp, Homo sapiens
tactgcaatcactg

SEQ ID NO: 2870226 - DNA, 20 bp, Homo sapiens
tactgcaatcactgtgctat

SEQ ID NO: 2870227 - DNA, 16 bp, Homo sapiens
tactgcagcacctcca

SEQ ID NO: 2870228 - DNA, 21 bp, Homo sapiens
tactgtatttttcagaaatca

SEQ ID NO: 2870229 - DNA, 12 bp, Homo sapiens
tacttacatgtt

SEQ ID NO: 2870230 - DNA, 20 bp, Homo sapiens
tactttttcccatctggctt

SEQ ID NO: 2870231 - DNA, 21 bp, Homo sapiens
tactttttcccatctggcttt

SEQ ID NO: 2870232 - DNA, 21 bp, Homo sapiens
tagaaagaagcccaatattat

SEQ ID NO: 2870233 - DNA, 14 bp, Homo sapiens
tagaaagctggact

SEQ ID NO: 2870234 - DNA, 20 bp, Homo sapiens
tagaaagctggactgaccaa

SEQ ID NO: 2870235 - DNA, 18 bp, Homo sapiens
tagaactcactctgggct

SEQ ID NO: 2870236 - DNA, 20 bp, Homo sapiens
tagaactttattaagtaaaa

SEQ ID NO: 2870237 - DNA, 14 bp, Homo sapiens
tagaataattcttt

SEQ ID NO: 2870238 - DNA, 15 bp, Homo sapiens
tagaatatttattac

SEQ ID NO: 2870239 - DNA, 22 bp, Homo sapiens
tagaatttattcaattcctctg

SEQ ID NO: 2870240 - DNA, 19 bp, Homo sapiens
tagaccctctttcttgttt

SEQ ID NO: 2870241 - DNA, 23 bp, Homo sapiens
tagactaaggccattattgtact

SEQ ID NO: 2870242 - DNA, 14 bp, Homo sapiens
tagactcctcagga

SEQ ID NO: 2870243 - DNA, 18 bp, Homo sapiens
tagactcctcaggagaga

SEQ ID NO: 2870244 - DNA, 23 bp, Homo sapiens
tagacttggagaatactgccaaa

SEQ ID NO: 2870245 - DNA, 19 bp, Homo sapiens
tagactttctcagtgggac

SEQ ID NO: 2870246 - DNA, 20 bp, Homo sapiens
tagagagcctgtcaccagag

SEQ ID NO: 2870247 - DNA, 12 bp, Homo sapiens
tagagccaatta

SEQ ID NO: 2870248 - DNA, 14 bp, Homo sapiens
tagagccgagggga

SEQ ID NO: 2870249 - DNA, 21 bp, Homo sapiens
tagagccgaggggagagaggg

SEQ ID NO: 2870250 - DNA, 20 bp, Homo sapiens
tagagctgtattaagccact

SEQ ID NO: 2870251 - DNA, 21 bp, Homo sapiens
tagatccatttggacaaaatg

SEQ ID NO: 2870252 - DNA, 22 bp, Homo sapiens
tagatccatttggacaaaatgg

SEQ ID NO: 2870253 - DNA, 19 bp, Homo sapiens
tagatctgcaggctgcacc

SEQ ID NO: 2870254 - DNA, 16 bp, Homo sapiens
tagatgggaggatgaa

SEQ ID NO: 2870255 - DNA, 21 bp, Homo sapiens
tagatgttctaagtctttcca

SEQ ID NO: 2870256 - DNA, 15 bp, Homo sapiens
tagcaactaatgttt

SEQ ID NO: 2870257 - DNA, 14 bp, Homo sapiens
tagcagattttaat

SEQ ID NO: 2870258 - DNA, 14 bp, Homo sapiens
tagctctctaggcc

SEQ ID NO: 2870259 - DNA, 13 bp, Homo sapiens
tagctgttgagct

SEQ ID NO: 2870260 - DNA, 14 bp, Homo sapiens
taggaagagaaacc

SEQ ID NO: 2870261 - DNA, 20 bp, Homo sapiens
taggacataaattagaggtc

SEQ ID NO: 2870262 - DNA, 14 bp, Homo sapiens
taggcatgcctaat

SEQ ID NO: 2870263 - DNA, 21 bp, Homo sapiens
taggccacagaaggtgaactt

SEQ ID NO: 2870264 - DNA, 15 bp, Homo sapiens
tagggcactgggctg

SEQ ID NO: 2870265 - DNA, 16 bp, Homo sapiens
tagggccaagcccagc

SEQ ID NO: 2870266 - DNA, 19 bp, Homo sapiens
taggttctgtagagccaat

SEQ ID NO: 2870267 - DNA, 11 bp, Homo sapiens
tagtgacattt

SEQ ID NO: 2870268 - DNA, 14 bp, Homo sapiens
tagtggtcataaaa

SEQ ID NO: 2870269 - DNA, 16 bp, Homo sapiens
tagtgttgtccaggaa

SEQ ID NO: 2870270 - DNA, 17 bp, Homo sapiens
tagttaaataactgtgt

SEQ ID NO: 2870271 - DNA, 18 bp, Homo sapiens
tagtttgttcttcagatt

SEQ ID NO: 2870272 - DNA, 22 bp, Homo sapiens
tataaagctgttattcttgtta

SEQ ID NO: 2870273 - DNA, 19 bp, Homo sapiens
tcagaaagtaacaatctat

SEQ ID NO: 2870274 - DNA, 16 bp, Homo sapiens
tcagacgcctgaggaa

SEQ ID NO: 2870275 - DNA, 20 bp, Homo sapiens
tcagagccgtggtcctttgg

SEQ ID NO: 2870276 - DNA, 22 bp, Homo sapiens
tcagaggaaaaatgggagccag

SEQ ID NO: 2870277 - DNA, 13 bp, Homo sapiens
tcagcagtcatgc

SEQ ID NO: 2870278 - DNA, 20 bp, Homo sapiens
tcagcatctgaccatctgtg

SEQ ID NO: 2870279 - DNA, 19 bp, Homo sapiens
tcagccctagggtggagag

SEQ ID NO: 2870280 - DNA, 16 bp, Homo sapiens
tcagctccttcctgga

SEQ ID NO: 2870281 - DNA, 15 bp, Homo sapiens
tcagctgctgttgaa

SEQ ID NO: 2870282 - DNA, 19 bp, Homo sapiens
tcagctgctgttgaacttt

SEQ ID NO: 2870283 - DNA, 18 bp, Homo sapiens
tcagctgtcctgcagcaa

SEQ ID NO: 2870284 - DNA, 15 bp, Homo sapiens
tcaggaaaggaatca

SEQ ID NO: 2870285 - DNA, 15 bp, Homo sapiens
tcaggacccagagga

SEQ ID NO: 2870286 - DNA, 14 bp, Homo sapiens
tcagggctcctggg

SEQ ID NO: 2870287 - DNA, 23 bp, Homo sapiens
tcagggtgggccactctcccctc

SEQ ID NO: 2870288 - DNA, 17 bp, Homo sapiens
tcagtagcatctcagtg

SEQ ID NO: 2870289 - DNA, 15 bp, Homo sapiens
tcagtctctgagcag

SEQ ID NO: 2870290 - DNA, 13 bp, Homo sapiens
tcagtgctccctc

SEQ ID NO: 2870291 - DNA, 15 bp, Homo sapiens
tcagtgttaaatgtg

SEQ ID NO: 2870292 - DNA, 14 bp, Homo sapiens
tcagttctcaaatg

SEQ ID NO: 2870293 - DNA, 13 bp, Homo sapiens
tcagtttttcact

SEQ ID NO: 2870294 - DNA, 16 bp, Homo sapiens
tcataaaatagaataa

SEQ ID NO: 2870295 - DNA, 14 bp, Homo sapiens
tcataatcagtaaa

SEQ ID NO: 2870296 - DNA, 16 bp, Homo sapiens
tcataatcagtaaata

SEQ ID NO: 2870297 - DNA, 18 bp, Homo sapiens
tcatagcagattttaatt

SEQ ID NO: 2870298 - DNA, 18 bp, Homo sapiens
tcatagtaagtgcgaaga

SEQ ID NO: 2870299 - DNA, 15 bp, Homo sapiens
tcatataaactcatt

SEQ ID NO: 2870300 - DNA, 17 bp, Homo sapiens
tcatataaactcattta

SEQ ID NO: 2870301 - DNA, 13 bp, Homo sapiens
tcatcattctctg

SEQ ID NO: 2870302 - DNA, 14 bp, Homo sapiens
tcatcattctctgt

SEQ ID NO: 2870303 - DNA, 18 bp, Homo sapiens
tcatcattctctgtctca

SEQ ID NO: 2870304 - DNA, 15 bp, Homo sapiens
tcatccatcatcatg

SEQ ID NO: 2870305 - DNA, 13 bp, Homo sapiens
tcatcctcctccc

SEQ ID NO: 2870306 - DNA, 16 bp, Homo sapiens
tcatcctcctccccag

SEQ ID NO: 2870307 - DNA, 17 bp, Homo sapiens
tcatcctcttttaatgg

SEQ ID NO: 2870308 - DNA, 21 bp, Homo sapiens
tcatctcctgccttcctcctg

SEQ ID NO: 2870309 - DNA, 22 bp, Homo sapiens
tcatctcctgccttcctcctgg

SEQ ID NO: 2870310 - DNA, 12 bp, Homo sapiens
tcatctgtccct

SEQ ID NO: 2870311 - DNA, 18 bp, Homo sapiens
tcatctgtccctccggga

SEQ ID NO: 2870312 - DNA, 22 bp, Homo sapiens
tcatgattatagcaactaatgt

SEQ ID NO: 2870313 - DNA, 21 bp, Homo sapiens
tcatgcctgatgaaagctttg

SEQ ID NO: 2870314 - DNA, 22 bp, Homo sapiens
tcatggcagaaggcaaacccat

SEQ ID NO: 2870315 - DNA, 14 bp, Homo sapiens
tcatgtaaactgtg

SEQ ID NO: 2870316 - DNA, 23 bp, Homo sapiens
tcatgtatattacccaatggaaa

SEQ ID NO: 2870317 - DNA, 12 bp, Homo sapiens
tcatgtgtgtcc

SEQ ID NO: 2870318 - DNA, 23 bp, Homo sapiens
tcattatgcacttttagaaatgc

SEQ ID NO: 2870319 - DNA, 18 bp, Homo sapiens
tcattattcaagaatgaa

SEQ ID NO: 2870320 - DNA, 12 bp, Homo sapiens
tcattcccctcg

SEQ ID NO: 2870321 - DNA, 13 bp, Homo sapiens
tcattcccctcgt

SEQ ID NO: 2870322 - DNA, 22 bp, Homo sapiens
tcattccggactggcagaagca

SEQ ID NO: 2870323 - DNA, 14 bp, Homo sapiens
tcattctctgtctc

SEQ ID NO: 2870324 - DNA, 19 bp, Homo sapiens
tcattctctgtctcatcca

SEQ ID NO: 2870325 - DNA, 18 bp, Homo sapiens
tcattctgaaggagcccc

SEQ ID NO: 2870326 - DNA, 19 bp, Homo sapiens
tcattggcattctttgcaa

SEQ ID NO: 2870327 - DNA, 21 bp, Homo sapiens
tcattggcattctttgcaata

SEQ ID NO: 2870328 - DNA, 19 bp, Homo sapiens
tcatttagtttgattattc

SEQ ID NO: 2870329 - DNA, 21 bp, Homo sapiens
tcatttctatttctcctccat

SEQ ID NO: 2870330 - DNA, 17 bp, Homo sapiens
tccaaaatttatatttt

SEQ ID NO: 2870331 - DNA, 19 bp, Homo sapiens
tccaaattaaaacaaatat

SEQ ID NO: 2870332 - DNA, 17 bp, Homo sapiens
tccaagtctctgtgtaa

SEQ ID NO: 2870333 - DNA, 16 bp, Homo sapiens
tccaatcctatgtttt

SEQ ID NO: 2870334 - DNA, 13 bp, Homo sapiens
cttgtttgtcagc

SEQ ID NO: 2870335 - DNA, 14 bp, Homo sapiens
cttgtttgtcagca

SEQ ID NO: 2870336 - DNA, 17 bp, Homo sapiens
cttgtttgtcagcatct

SEQ ID NO: 2870337 - DNA, 19 bp, Homo sapiens
cttgtttgtcagcatctga

SEQ ID NO: 2870338 - DNA, 19 bp, Homo sapiens
ctttaaccctctcttccct

SEQ ID NO: 2870339 - DNA, 23 bp, Homo sapiens
ctttaatagtcaccttcatgatt

SEQ ID NO: 2870340 - DNA, 14 bp, Homo sapiens
ctttatatttcaat

SEQ ID NO: 2870341 - DNA, 16 bp, Homo sapiens
ctttatatttcaataa

SEQ ID NO: 2870342 - DNA, 16 bp, Homo sapiens
ctttattaagtaaaat

SEQ ID NO: 2870343 - DNA, 16 bp, Homo sapiens
ctttattgcaatgcag

SEQ ID NO: 2870344 - DNA, 19 bp, Homo sapiens
ctttcaaaaccttttgaaa

SEQ ID NO: 2870345 - DNA, 11 bp, Homo sapiens
ctttccaaatt

SEQ ID NO: 2870346 - DNA, 18 bp, Homo sapiens
ctttccaaattaaaacaa

SEQ ID NO: 2870347 - DNA, 21 bp, Homo sapiens
ctttccacggagccactcctc

SEQ ID NO: 2870348 - DNA, 15 bp, Homo sapiens
ctttcctacaaaatg

SEQ ID NO: 2870349 - DNA, 16 bp, Homo sapiens
ctttcctactttctat

SEQ ID NO: 2870350 - DNA, 11 bp, Homo sapiens
ctttcctcccc

SEQ ID NO: 2870351 - DNA, 13 bp, Homo sapiens
ctttcctccccac

SEQ ID NO: 2870352 - DNA, 15 bp, Homo sapiens
ctttcctccccacct

SEQ ID NO: 2870353 - DNA, 17 bp, Homo sapiens
ctttcctccccaccttc

SEQ ID NO: 2870354 - DNA, 18 bp, Homo sapiens
ctttcctctgcagcactt

SEQ ID NO: 2870355 - DNA, 21 bp, Homo sapiens
ctttgatgattaattcacctt

SEQ ID NO: 2870356 - DNA, 14 bp, Homo sapiens
ctttggacttctga

SEQ ID NO: 2870357 - DNA, 16 bp, Homo sapiens
ctttggacttctgaag

SEQ ID NO: 2870358 - DNA, 13 bp, Homo sapiens
ctttgtcagtgtt

SEQ ID NO: 2870359 - DNA, 14 bp, Homo sapiens
ctttgtcagtgttg

SEQ ID NO: 2870360 - DNA, 15 bp, Homo sapiens
ctttgttttgcactg

SEQ ID NO: 2870361 - DNA, 16 bp, Homo sapiens
ctttgttttgcactga

SEQ ID NO: 2870362 - DNA, 23 bp, Homo sapiens
cttttaatggcatttctctttaa

SEQ ID NO: 2870363 - DNA, 14 bp, Homo sapiens
cttttagaaatgca

SEQ ID NO: 2870364 - DNA, 12 bp, Homo sapiens
cttttgctgtgc

SEQ ID NO: 2870365 - DNA, 16 bp, Homo sapiens
cttttggcctcctgca

SEQ ID NO: 2870366 - DNA, 19 bp, Homo sapiens
cttttttgtggcaattagt

SEQ ID NO: 2870367 - DNA, 16 bp, Homo sapiens
gaaaaataaaatgttt

SEQ ID NO: 2870368 - DNA, 15 bp, Homo sapiens
gaaaaatgggagcca

SEQ ID NO: 2870369 - DNA, 14 bp, Homo sapiens
gaaaaattaacttt

SEQ ID NO: 2870370 - DNA, 12 bp, Homo sapiens
gaaaacaaggaa

SEQ ID NO: 2870371 - DNA, 14 bp, Homo sapiens
gaaaacactgtgca

SEQ ID NO: 2870372 - DNA, 21 bp, Homo sapiens
gaaaacactgtgcacatctgt

SEQ ID NO: 2870373 - DNA, 13 bp, Homo sapiens
gaaaaccacttta

SEQ ID NO: 2870374 - DNA, 14 bp, Homo sapiens
gaaaaccactttat

SEQ ID NO: 2870375 - DNA, 14 bp, Homo sapiens
gaaaatgtcttgtg

SEQ ID NO: 2870376 - DNA, 15 bp, Homo sapiens
gaaaattatttgcat

SEQ ID NO: 2870377 - DNA, 21 bp, Homo sapiens
gaaaatttgttattttgcaac

SEQ ID NO: 2870378 - DNA, 17 bp, Homo sapiens
gaaacaaagtactcttt

SEQ ID NO: 2870379 - DNA, 23 bp, Homo sapiens
gaaacactatttgtgacttttta

SEQ ID NO: 2870380 - DNA, 17 bp, Homo sapiens
gaaacagttgctgtgaa

SEQ ID NO: 2870381 - DNA, 22 bp, Homo sapiens
gaaacccattaggcatgcctaa

SEQ ID NO: 2870382 - DNA, 20 bp, Homo sapiens
gaaaccttattgtacctctc

SEQ ID NO: 2870383 - DNA, 18 bp, Homo sapiens
gaaagcctccgctgggct

SEQ ID NO: 2870384 - DNA, 17 bp, Homo sapiens
gaaagctggactgacca

SEQ ID NO: 2870385 - DNA, 14 bp, Homo sapiens
gaaaggcaagcttg

SEQ ID NO: 2870386 - DNA, 13 bp, Homo sapiens
gaaataatgggat

SEQ ID NO: 2870387 - DNA, 22 bp, Homo sapiens
gaaatacgtttgtgtttctaga

SEQ ID NO: 2870388 - DNA, 21 bp, Homo sapiens
gaaatgaactttgtcagtgtt

SEQ ID NO: 2870389 - DNA, 23 bp, Homo sapiens
gaacaaagtaaaagtagtgttgt

SEQ ID NO: 2870390 - DNA, 13 bp, Homo sapiens
gaacaagagaaaa

SEQ ID NO: 2870391 - DNA, 21 bp, Homo sapiens
gaacaatgtgctatgtgaaga

SEQ ID NO: 2870392 - DNA, 18 bp, Homo sapiens
gaacacagttgaattttt

SEQ ID NO: 2870393 - DNA, 21 bp, Homo sapiens
gaacacctttgttttgcactg

SEQ ID NO: 2870394 - DNA, 22 bp, Homo sapiens
gaacataacttctcatgtatat

SEQ ID NO: 2870395 - DNA, 18 bp, Homo sapiens
gaacgatttagaaagaag

SEQ ID NO: 2870396 - DNA, 16 bp, Homo sapiens
gaactcactctgggct

SEQ ID NO: 2870397 - DNA, 16 bp, Homo sapiens
gaactttgtcagtgtt

SEQ ID NO: 2870398 - DNA, 13 bp, Homo sapiens
gaactttgtgctt

SEQ ID NO: 2870399 - DNA, 20 bp, Homo sapiens
gaagcattgcctggactgac

SEQ ID NO: 2870400 - DNA, 22 bp, Homo sapiens
gaagcattgcctggactgacca

SEQ ID NO: 2870401 - DNA, 21 bp, Homo sapiens
gaagccgactctggccctggc

SEQ ID NO: 2870402 - DNA, 22 bp, Homo sapiens
gaagccgactctggccctggcc

SEQ ID NO: 2870403 - DNA, 20 bp, Homo sapiens
gaagctcttttctcctgcag

SEQ ID NO: 2870404 - DNA, 15 bp, Homo sapiens
gaagcttgagcctcc

SEQ ID NO: 2870405 - DNA, 16 bp, Homo sapiens
gaagcttgagcctccc

SEQ ID NO: 2870406 - DNA, 18 bp, Homo sapiens
gaagcttgagcctccccc

SEQ ID NO: 2870407 - DNA, 19 bp, Homo sapiens
gaagcttgagcctccccca

SEQ ID NO: 2870408 - DNA, 20 bp, Homo sapiens
gaaggagccccattcctggg

SEQ ID NO: 2870409 - DNA, 22 bp, Homo sapiens
gaaggaggaatgctggactgga

SEQ ID NO: 2870410 - DNA, 19 bp, Homo sapiens
gaagggtggtctgagcacc

SEQ ID NO: 2870411 - DNA, 19 bp, Homo sapiens
gaaggtgaactttgtgctt

SEQ ID NO: 2870412 - DNA, 16 bp, Homo sapiens
gaagtaaaacagtcat

SEQ ID NO: 2870413 - DNA, 20 bp, Homo sapiens
gaagtcagaatttttaactg

SEQ ID NO: 2870414 - DNA, 12 bp, Homo sapiens
gaatatttacta

SEQ ID NO: 2870415 - DNA, 13 bp, Homo sapiens
gaatatttattac

SEQ ID NO: 2870416 - DNA, 22 bp, Homo sapiens
gccaaggaaaggcatgtacaaa

SEQ ID NO: 2870417 - DNA, 22 bp, Homo sapiens
gccaatctttcctactttctat

SEQ ID NO: 2870418 - DNA, 18 bp, Homo sapiens
gccacagaaggtgaactt

SEQ ID NO: 2870419 - DNA, 21 bp, Homo sapiens
gccacagcctcccctgccagg

SEQ ID NO: 2870420 - DNA, 14 bp, Homo sapiens
gccaccaagaggga

SEQ ID NO: 2870421 - DNA, 22 bp, Homo sapiens
gccaccaagagggacgcctggg

SEQ ID NO: 2870422 - DNA, 16 bp, Homo sapiens
gccacccagcaacaca

SEQ ID NO: 2870423 - DNA, 23 bp, Homo sapiens
gccactctcccctccctcttcct

SEQ ID NO: 2870424 - DNA, 18 bp, Homo sapiens
gccactgaggagacagaa

SEQ ID NO: 2870425 - DNA, 13 bp, Homo sapiens
gccacttcaaccc

SEQ ID NO: 2870426 - DNA, 11 bp, Homo sapiens
gccagagccaa

SEQ ID NO: 2870427 - DNA, 15 bp, Homo sapiens
gccagagccaacctg

SEQ ID NO: 2870428 - DNA, 20 bp, Homo sapiens
gccagagccaacctggactt

SEQ ID NO: 2870429 - DNA, 22 bp, Homo sapiens
gccagagccaacctggacttcc

SEQ ID NO: 2870430 - DNA, 21 bp, Homo sapiens
gccagattggccaattaaaaa

SEQ ID NO: 2870431 - DNA, 12 bp, Homo sapiens
gccagcgtcctc

SEQ ID NO: 2870432 - DNA, 13 bp, Homo sapiens
gccagcgtcctcc

SEQ ID NO: 2870433 - DNA, 22 bp, Homo sapiens
gccagcgtcctcctctgtgacc

SEQ ID NO: 2870434 - DNA, 23 bp, Homo sapiens
gccagctctgtatcaggacccag

SEQ ID NO: 2870435 - DNA, 22 bp, Homo sapiens
gccaggaccagtcaacctgggc

SEQ ID NO: 2870436 - DNA, 17 bp, Homo sapiens
gccaggagtaagacaag

SEQ ID NO: 2870437 - DNA, 13 bp, Homo sapiens
gccaggatgacta

SEQ ID NO: 2870438 - DNA, 22 bp, Homo sapiens
gccaggcaggggtgggagagcc

SEQ ID NO: 2870439 - DNA, 15 bp, Homo sapiens
gccagggcagagtga

SEQ ID NO: 2870440 - DNA, 19 bp, Homo sapiens
gccagggcagggccccagg

SEQ ID NO: 2870441 - DNA, 19 bp, Homo sapiens
gccatagacctacagacct

SEQ ID NO: 2870442 - DNA, 23 bp, Homo sapiens
gccatagacctacagacctggct

SEQ ID NO: 2870443 - DNA, 17 bp, Homo sapiens
gccatattttcaccatt

SEQ ID NO: 2870444 - DNA, 24 bp, Homo sapiens
gccatcagggtgggccactctccc

SEQ ID NO: 2870445 - DNA, 16 bp, Homo sapiens
gcccaaagtggggagg

SEQ ID NO: 2870446 - DNA, 20 bp, Homo sapiens
gcccacgccctccctctccc

SEQ ID NO: 2870447 - DNA, 21 bp, Homo sapiens
gcccacgccctccctctccca

SEQ ID NO: 2870448 - DNA, 16 bp, Homo sapiens
gcccagagaccccttc

SEQ ID NO: 2870449 - DNA, 18 bp, Homo sapiens
gcccagagaccccttcct

SEQ ID NO: 2870450 - DNA, 13 bp, Homo sapiens
gcccagagcctgg

SEQ ID NO: 2870451 - DNA, 21 bp, Homo sapiens
gcccagaggactcccaaccct

SEQ ID NO: 2870452 - DNA, 21 bp, Homo sapiens
gcccagcactgcttgaggaaa

SEQ ID NO: 2870453 - DNA, 19 bp, Homo sapiens
gcccatccattaggccagc

SEQ ID NO: 2870454 - DNA, 23 bp, Homo sapiens
gccccacccctaagtgcccaaag

SEQ ID NO: 2870455 - DNA, 14 bp, Homo sapiens
gccccatcagtgct

SEQ ID NO: 2870456 - DNA, 23 bp, Homo sapiens
gcccccactttcctacaaaatgg

SEQ ID NO: 2870457 - DNA, 13 bp, Homo sapiens
gcccctcctccag

SEQ ID NO: 2870458 - DNA, 13 bp, Homo sapiens
gcccctggagcca

SEQ ID NO: 2870459 - DNA, 15 bp, Homo sapiens
gcccctggagccaga

SEQ ID NO: 2870460 - DNA, 15 bp, Homo sapiens
gcccggggaggaact

SEQ ID NO: 2870461 - DNA, 15 bp, Homo sapiens
gccctccctctccca

SEQ ID NO: 2870462 - DNA, 14 bp, Homo sapiens
gccctcgctgccag

SEQ ID NO: 2870463 - DNA, 15 bp, Homo sapiens
gccctcgctgccagc

SEQ ID NO: 2870464 - DNA, 18 bp, Homo sapiens
gccctgcaaaaggactct

SEQ ID NO: 2870465 - DNA, 14 bp, Homo sapiens
gccgactctggccc

SEQ ID NO: 2870466 - DNA, 17 bp, Homo sapiens
gccgactctggccctgg

SEQ ID NO: 2870467 - DNA, 15 bp, Homo sapiens
gccgaggggagagag

SEQ ID NO: 2870468 - DNA, 19 bp, Homo sapiens
gccgaggggagagagggac

SEQ ID NO: 2870469 - DNA, 20 bp, Homo sapiens
gccgaggggagagagggact

SEQ ID NO: 2870470 - DNA, 18 bp, Homo sapiens
gccggatgaaacttctca

SEQ ID NO: 2870471 - DNA, 20 bp, Homo sapiens
gccggatgaaacttctcagt

SEQ ID NO: 2870472 - DNA, 15 bp, Homo sapiens
gccggcctgagaaac

SEQ ID NO: 2870473 - DNA, 16 bp, Homo sapiens
gccgtggtcctttggg

SEQ ID NO: 2870474 - DNA, 20 bp, Homo sapiens
gcctcactgaaacatggctg

SEQ ID NO: 2870475 - DNA, 14 bp, Homo sapiens
gcctcccccaaagc

SEQ ID NO: 2870476 - DNA, 15 bp, Homo sapiens
gcctcccctgccagg

SEQ ID NO: 2870477 - DNA, 17 bp, Homo sapiens
gcctcctgcctccgggc

SEQ ID NO: 2870478 - DNA, 12 bp, Homo sapiens
gcctgagaaaca

SEQ ID NO: 2870479 - DNA, 23 bp, Homo sapiens
gcctgagaaacactatttgtgac

SEQ ID NO: 2870480 - DNA, 22 bp, Homo sapiens
gcctgcgtcttttttctcttcc

SEQ ID NO: 2870481 - DNA, 16 bp, Homo sapiens
gcctggccccatggtc

SEQ ID NO: 2870482 - DNA, 21 bp, Homo sapiens
gcctggtagaattgggaagct

SEQ ID NO: 2870483 - DNA, 18 bp, Homo sapiens
gcctgtaatcccagcact

SEQ ID NO: 2870484 - DNA, 13 bp, Homo sapiens
gcctgtcaccaga

SEQ ID NO: 2870485 - DNA, 15 bp, Homo sapiens
gcctgtcaccagagc

SEQ ID NO: 2870486 - DNA, 16 bp, Homo sapiens
gcctgtcaccagagct

SEQ ID NO: 2870487 - DNA, 17 bp, Homo sapiens
gcctgtcaccagagctt

SEQ ID NO: 2870488 - DNA, 17 bp, Homo sapiens
gccttagggcactgggc

SEQ ID NO: 2870489 - DNA, 14 bp, Homo sapiens
gccttcctcctggg

SEQ ID NO: 2870490 - DNA, 22 bp, Homo sapiens
gccttcctcctgggccctctct

SEQ ID NO: 2870491 - DNA, 15 bp, Homo sapiens
gccttctggatccat

SEQ ID NO: 2870492 - DNA, 20 bp, Homo sapiens
gccttctggatccatggggg

SEQ ID NO: 2870493 - DNA, 16 bp, Homo sapiens
gcgaagactgagccag

SEQ ID NO: 2870494 - DNA, 20 bp, Homo sapiens
gcggaagccaaaggcagcta

SEQ ID NO: 2870495 - DNA, 21 bp, Homo sapiens
gcggcagagcaattccaggct

SEQ ID NO: 2870496 - DNA, 16 bp, Homo sapiens
gcgtcctcctctgtga

SEQ ID NO: 2870497 - DNA, 19 bp, Homo sapiens
gcgtcttttttctcttccc

SEQ ID NO: 2870498 - DNA, 17 bp, Homo sapiens
gcgtggactctgctaga

SEQ ID NO: 2870499 - DNA, 17 bp, Homo sapiens
gcgtgtcacctgtgctt

SEQ ID NO: 2870500 - DNA, 12 bp, Homo sapiens
gctaataaacca

SEQ ID NO: 2870501 - DNA, 19 bp, Homo sapiens
gctacacccttttccagct

SEQ ID NO: 2870502 - DNA, 12 bp, Homo sapiens
gctaccctgagc

SEQ ID NO: 2870503 - DNA, 14 bp, Homo sapiens
gctaccctgagctg

SEQ ID NO: 2870504 - DNA, 19 bp, Homo sapiens
gctaccctgagctgaggca

SEQ ID NO: 2870505 - DNA, 17 bp, Homo sapiens
gctacttcccactgtat

SEQ ID NO: 2870506 - DNA, 13 bp, Homo sapiens
gctagaaaaataa

SEQ ID NO: 2870507 - DNA, 20 bp, Homo sapiens
gctagactcctcaggagaga

SEQ ID NO: 2870508 - DNA, 18 bp, Homo sapiens
gctagagccgaggggaga

SEQ ID NO: 2870509 - DNA, 16 bp, Homo sapiens
gctataaatgccagag

SEQ ID NO: 2870510 - DNA, 17 bp, Homo sapiens
gctataaatgccagagc

SEQ ID NO: 2870511 - DNA, 18 bp, Homo sapiens
gctataaatgccagagcc

SEQ ID NO: 2870512 - DNA, 20 bp, Homo sapiens
gctatcttttttagtgttaa

SEQ ID NO: 2870513 - DNA, 19 bp, Homo sapiens
gctatggcaggataagaaa

SEQ ID NO: 2870514 - DNA, 16 bp, Homo sapiens
gctcaacctaccctgg

SEQ ID NO: 2870515 - DNA, 19 bp, Homo sapiens
gctcaagcattctgtttat

SEQ ID NO: 2870516 - DNA, 21 bp, Homo sapiens
gctccatatttgatttctaat

SEQ ID NO: 2870517 - DNA, 21 bp, Homo sapiens
gctccctgtaacctcttcaga

SEQ ID NO: 2870518 - DNA, 14 bp, Homo sapiens
gctccttcctggag

SEQ ID NO: 2870519 - DNA, 23 bp, Homo sapiens
gctccttcctggagactgcccag

SEQ ID NO: 2870520 - DNA, 11 bp, Homo sapiens
gctccttgggc

SEQ ID NO: 2870521 - DNA, 14 bp, Homo sapiens
gctccttgggccct

SEQ ID NO: 2870522 - DNA, 15 bp, Homo sapiens
gctctagtgggacag

SEQ ID NO: 2870523 - DNA, 20 bp, Homo sapiens
gctctagtgggacagcccag

SEQ ID NO: 2870524 - DNA, 23 bp, Homo sapiens
gctctgatccctctacagagctt

SEQ ID NO: 2870525 - DNA, 18 bp, Homo sapiens
gctctgtatcaggaccca

SEQ ID NO: 2870526 - DNA, 12 bp, Homo sapiens
gctctttccaaa

SEQ ID NO: 2870527 - DNA, 16 bp, Homo sapiens
gctctttccaaattaa

SEQ ID NO: 2870528 - DNA, 20 bp, Homo sapiens
gctctttccaaattaaaaca

SEQ ID NO: 2870529 - DNA, 23 bp, Homo sapiens
gctctttccaaattaaaacaaat

SEQ ID NO: 2870530 - DNA, 21 bp, Homo sapiens
gctgaaattgcttatttttgg

SEQ ID NO: 2870531 - DNA, 20 bp, Homo sapiens
gctgaatgtatgtcagtgct

SEQ ID NO: 2870532 - DNA, 14 bp, Homo sapiens
gctgagccatgagg

SEQ ID NO: 2870533 - DNA, 13 bp, Homo sapiens
gctgataccatat

SEQ ID NO: 2870534 - DNA, 16 bp, Homo sapiens
gctgattcaagaaaca

SEQ ID NO: 2870535 - DNA, 18 bp, Homo sapiens
gctgcacctctggctaga

SEQ ID NO: 2870536 - DNA, 18 bp, Homo sapiens
gctgccagctctgtatca

SEQ ID NO: 2870537 - DNA, 18 bp, Homo sapiens
gctgccccatcagtgctc

SEQ ID NO: 2870538 - DNA, 14 bp, Homo sapiens
gctgctagagaagg

SEQ ID NO: 2870539 - DNA, 9 bp, Homo sapiens
gctgctgtt

SEQ ID NO: 2870540 - DNA, 21 bp, Homo sapiens
gctggactctcagtctctgag

SEQ ID NO: 2870541 - DNA, 13 bp, Homo sapiens
gctggactgacca

SEQ ID NO: 2870542 - DNA, 19 bp, Homo sapiens
gctggactgaccaaagact

SEQ ID NO: 2870543 - DNA, 17 bp, Homo sapiens
gctggtgtatgcacagg

SEQ ID NO: 2870544 - DNA, 17 bp, Homo sapiens
gctgtattaagccactt

SEQ ID NO: 2870545 - DNA, 19 bp, Homo sapiens
gctgtgtttgcagcctgct

SEQ ID NO: 2870546 - DNA, 16 bp, Homo sapiens
gctgttattcttgtta

SEQ ID NO: 2870547 - DNA, 16 bp, Homo sapiens
gctgttgaacttttta

SEQ ID NO: 2870548 - DNA, 16 bp, Homo sapiens
gctgttgagctgtttt

SEQ ID NO: 2870549 - DNA, 18 bp, Homo sapiens
gctgttgagctgttttcc

SEQ ID NO: 2870550 - DNA, 12 bp, Homo sapiens
gctgtttctaag

SEQ ID NO: 2870551 - DNA, 19 bp, Homo sapiens
gcttatttctatgacaaat

SEQ ID NO: 2870552 - DNA, 17 bp, Homo sapiens
gcttcatggcagaaggc

SEQ ID NO: 2870553 - DNA, 19 bp, Homo sapiens
gcttcattccggactggca

SEQ ID NO: 2870554 - DNA, 22 bp, Homo sapiens
gcttcattccggactggcagaa

SEQ ID NO: 2870555 - DNA, 22 bp, Homo sapiens
gcttctctagctctctaggcct

SEQ ID NO: 2870556 - DNA, 19 bp, Homo sapiens
gcttctctgtgaacgattt

SEQ ID NO: 2870557 - DNA, 19 bp, Homo sapiens
gcttgaggccaagatggct

SEQ ID NO: 2870558 - DNA, 20 bp, Homo sapiens
gcttgaggccaagatggctg

SEQ ID NO: 2870559 - DNA, 23 bp, Homo sapiens
gcttgaggccaagatggctgctg

SEQ ID NO: 2870560 - DNA, 12 bp, Homo sapiens
gcttggctggtg

SEQ ID NO: 2870561 - DNA, 16 bp, Homo sapiens
gcttggggcttcctaa

SEQ ID NO: 2870562 - DNA, 19 bp, Homo sapiens
gcttgtagaactcactctg

SEQ ID NO: 2870563 - DNA, 22 bp, Homo sapiens
gcttgtcttcgtccatctgttg

SEQ ID NO: 2870564 - DNA, 15 bp, Homo sapiens
gctttaatcaatcat

SEQ ID NO: 2870565 - DNA, 15 bp, Homo sapiens
ttgcattttgatatt

SEQ ID NO: 2870566 - DNA, 12 bp, Homo sapiens
ttgcctggactg

SEQ ID NO: 2870567 - DNA, 22 bp, Homo sapiens
ttgcctggactgaccacaccaa

SEQ ID NO: 2870568 - DNA, 23 bp, Homo sapiens
ttgcctggactgaccacaccaac

SEQ ID NO: 2870569 - DNA, 22 bp, Homo sapiens
ttgctatggcaggataagaaag

SEQ ID NO: 2870570 - DNA, 19 bp, Homo sapiens
ttgctgccccatcagtgct

SEQ ID NO: 2870571 - DNA, 20 bp, Homo sapiens
ttgctgccccatcagtgctc

SEQ ID NO: 2870572 - DNA, 17 bp, Homo sapiens
ttgctgtgagccttgca

SEQ ID NO: 2870573 - DNA, 17 bp, Homo sapiens
ttttccccctatcagtt

SEQ ID NO: 2870574 - DNA, 20 bp, Homo sapiens
ttttcctaataaagttctgt

SEQ ID NO: 2870575 - DNA, 16 bp, Homo sapiens
ttttcggaaacactga

SEQ ID NO: 2870576 - DNA, 16 bp, Homo sapiens
ttttctaaataaaaat

SEQ ID NO: 2870577 - DNA, 19 bp, Homo sapiens
ttttctcttcccttcccag

SEQ ID NO: 2870578 - DNA, 22 bp, Homo sapiens
ttttctgaggatagtagttaaa

SEQ ID NO: 2870579 - DNA, 19 bp, Homo sapiens
ttttctgccactgaggaga

SEQ ID NO: 2870580 - DNA, 15 bp, Homo sapiens
ttttgaaacaaagta

SEQ ID NO: 2870581 - DNA, 21 bp, Homo sapiens
ttttgcaacctcgctggactc

SEQ ID NO: 2870582 - DNA, 13 bp, Homo sapiens
ttttgccctttga

SEQ ID NO: 2870583 - DNA, 16 bp, Homo sapiens
ttttgttcaaagccag

SEQ ID NO: 2870584 - DNA, 17 bp, Homo sapiens
ttttgtttttcattcag

SEQ ID NO: 2870585 - DNA, 21 bp, Homo sapiens
tttttaaagccttctggatcc

SEQ ID NO: 2870586 - DNA, 12 bp, Homo sapiens
tttttaactgta

SEQ ID NO: 2870587 - DNA, 17 bp, Homo sapiens
tttttagtgttaaagag

SEQ ID NO: 2870588 - DNA, 22 bp, Homo sapiens
tttttgtatttctctattttca

SEQ ID NO: 2870589 - DNA, 22 bp, Homo sapiens
ctctctgctctgcgtgtcacct

SEQ ID NO: 2870590 - DNA, 18 bp, Homo sapiens
ctctcttatagaatattt

SEQ ID NO: 2870591 - DNA, 21 bp, Homo sapiens
ctctcttatagaatatttatt

SEQ ID NO: 2870592 - DNA, 23 bp, Homo sapiens
ctctcttatagaatatttattac

SEQ ID NO: 2870593 - DNA, 13 bp, Homo sapiens
ctctgaaataatg

SEQ ID NO: 2870594 - DNA, 15 bp, Homo sapiens
ctctgactcagggct

SEQ ID NO: 2870595 - DNA, 15 bp, Homo sapiens
ctctgagctgtgcag

SEQ ID NO: 2870596 - DNA, 16 bp, Homo sapiens
ctctgagctgtgcagg

SEQ ID NO: 2870597 - DNA, 12 bp, Homo sapiens
ctctgctagact

SEQ ID NO: 2870598 - DNA, 11 bp, Homo sapiens
ctctgggctgt

SEQ ID NO: 2870599 - DNA, 22 bp, Homo sapiens
ctctgtatcaggacccagagga

SEQ ID NO: 2870600 - DNA, 18 bp, Homo sapiens
ctctgtgaacgatttaga

SEQ ID NO: 2870601 - DNA, 18 bp, Homo sapiens
ctctgtgaccaatgtctt

SEQ ID NO: 2870602 - DNA, 19 bp, Homo sapiens
ctctgtgaccaatgtcttg

SEQ ID NO: 2870603 - DNA, 13 bp, Homo sapiens
ctctgtgtaacca

SEQ ID NO: 2870604 - DNA, 19 bp, Homo sapiens
ctcttaggaagagaaacca

SEQ ID NO: 2870605 - DNA, 16 bp, Homo sapiens
ctcttatagaatattt

SEQ ID NO: 2870606 - DNA, 18 bp, Homo sapiens
ctcttatagaatatttat

SEQ ID NO: 2870607 - DNA, 14 bp, Homo sapiens
ctcttcccttccca

SEQ ID NO: 2870608 - DNA, 21 bp, Homo sapiens
cattattcaagaatgaaaaat

SEQ ID NO: 2870609 - DNA, 19 bp, Homo sapiens
cattcacctgtatatttct

SEQ ID NO: 2870610 - DNA, 19 bp, Homo sapiens
cattccggactggcagaag

SEQ ID NO: 2870611 - DNA, 17 bp, Homo sapiens
cattcttcagtttttca

SEQ ID NO: 2870612 - DNA, 21 bp, Homo sapiens
cattcttcagtttttcacttc

SEQ ID NO: 2870613 - DNA, 18 bp, Homo sapiens
cattctttgcaatactgc

SEQ ID NO: 2870614 - DNA, 23 bp, Homo sapiens
cattgaattcttggttgaggaaa

SEQ ID NO: 2870615 - DNA, 16 bp, Homo sapiens
cattgcctggactgac

SEQ ID NO: 2870616 - DNA, 17 bp, Homo sapiens
cattgcctggactgacc

SEQ ID NO: 2870617 - DNA, 16 bp, Homo sapiens
cattgtaattatgtaa

SEQ ID NO: 2870618 - DNA, 19 bp, Homo sapiens
cattgtaattatgtaaata

SEQ ID NO: 2870619 - DNA, 22 bp, Homo sapiens
cattgtaattatgtaaataact

SEQ ID NO: 2870620 - DNA, 23 bp, Homo sapiens
cattgtaattatgtaaataactc

SEQ ID NO: 2870621 - DNA, 19 bp, Homo sapiens
cattgtccaatcctatgtt

SEQ ID NO: 2870622 - DNA, 21 bp, Homo sapiens
catttatattaaataacatgt

SEQ ID NO: 2870623 - DNA, 21 bp, Homo sapiens
catttatgacaagctgtatca

SEQ ID NO: 2870624 - DNA, 18 bp, Homo sapiens
catttctatttatttact

SEQ ID NO: 2870625 - DNA, 19 bp, Homo sapiens
catttctatttctcctcca

SEQ ID NO: 2870626 - DNA, 14 bp, Homo sapiens
catttctctttaaa

SEQ ID NO: 2870627 - DNA, 23 bp, Homo sapiens
catttggagtgttccccttccac

SEQ ID NO: 2870628 - DNA, 20 bp, Homo sapiens
catttggcaatgccatcatc

SEQ ID NO: 2870629 - DNA, 15 bp, Homo sapiens
cattttatcattaaa

SEQ ID NO: 2870630 - DNA, 16 bp, Homo sapiens
cattttcatattgtaa

SEQ ID NO: 2870631 - DNA, 21 bp, Homo sapiens
cattttcccccactactgcag

SEQ ID NO: 2870632 - DNA, 11 bp, Homo sapiens
catttttgaac

SEQ ID NO: 2870633 - DNA, 13 bp, Homo sapiens
ccaaagactgcag

SEQ ID NO: 2870634 - DNA, 16 bp, Homo sapiens
ccaaagactgcagaac

SEQ ID NO: 2870635 - DNA, 20 bp, Homo sapiens
ccaaagcaatgtgagtccca

SEQ ID NO: 2870636 - DNA, 16 bp, Homo sapiens
ccaaagctttcatgta

SEQ ID NO: 2870637 - DNA, 12 bp, Homo sapiens
ccaaaggcagct

SEQ ID NO: 2870638 - DNA, 22 bp, Homo sapiens
ccaacactgtccttccctgcca

SEQ ID NO: 2870639 - DNA, 18 bp, Homo sapiens
ccaacctggacttcctgt

SEQ ID NO: 2870640 - DNA, 14 bp, Homo sapiens
ccaaccttgtttaa

SEQ ID NO: 2870641 - DNA, 17 bp, Homo sapiens
ccaactttttcatagta

SEQ ID NO: 2870642 - DNA, 15 bp, Homo sapiens
ccaagatggctgctg

SEQ ID NO: 2870643 - DNA, 16 bp, Homo sapiens
ccaagatggctgctgc

SEQ ID NO: 2870644 - DNA, 15 bp, Homo sapiens
ccaagtctctgtgta

SEQ ID NO: 2870645 - DNA, 14 bp, Homo sapiens
ccaatatatgtatt

SEQ ID NO: 2870646 - DNA, 12 bp, Homo sapiens
ccaatattataa

SEQ ID NO: 2870647 - DNA, 13 bp, Homo sapiens
ccaatattataat

SEQ ID NO: 2870648 - DNA, 14 bp, Homo sapiens
ccaatcctatgttt

SEQ ID NO: 2870649 - DNA, 11 bp, Homo sapiens
ccaatctgtac

SEQ ID NO: 2870650 - DNA, 14 bp, Homo sapiens
ccaatctgtacaaa

SEQ ID NO: 2870651 - DNA, 17 bp, Homo sapiens
ccaatctttcctacttt

SEQ ID NO: 2870652 - DNA, 19 bp, Homo sapiens
ccacaatggagtgggagat

SEQ ID NO: 2870653 - DNA, 12 bp, Homo sapiens
ccacagccatag

SEQ ID NO: 2870654 - DNA, 16 bp, Homo sapiens
ccacaggacatttctc

SEQ ID NO: 2870655 - DNA, 21 bp, Homo sapiens
ccacaggacatttctctaaga

SEQ ID NO: 2870656 - DNA, 19 bp, Homo sapiens
ccacaggcacattaactgt

SEQ ID NO: 2870657 - DNA, 20 bp, Homo sapiens
ccacaggcacattaactgtt

SEQ ID NO: 2870658 - DNA, 23 bp, Homo sapiens
ccacattcttcagtttttcactt

SEQ ID NO: 2870659 - DNA, 17 bp, Homo sapiens
ccacccacagccataga

SEQ ID NO: 2870660 - DNA, 19 bp, Homo sapiens
ccacccatgatactccact

SEQ ID NO: 2870661 - DNA, 14 bp, Homo sapiens
ccacccccatgcag

SEQ ID NO: 2870662 - DNA, 14 bp, Homo sapiens
ccacccctaagtgc

SEQ ID NO: 2870663 - DNA, 22 bp, Homo sapiens
ccaccgggttctgcagcggcag

SEQ ID NO: 2870664 - DNA, 15 bp, Homo sapiens
ccaccttccccagac

SEQ ID NO: 2870665 - DNA, 19 bp, Homo sapiens
ccaccttggactcctccca

SEQ ID NO: 2870666 - DNA, 23 bp, Homo sapiens
ccaccttggactcctcccacaat

SEQ ID NO: 2870667 - DNA, 16 bp, Homo sapiens
ccacgactgtctccat

SEQ ID NO: 2870668 - DNA, 13 bp, Homo sapiens
ccactactgcagc

SEQ ID NO: 2870669 - DNA, 15 bp, Homo sapiens
ccactcagctgtcct

SEQ ID NO: 2870670 - DNA, 12 bp, Homo sapiens
ccactcccagca

SEQ ID NO: 2870671 - DNA, 14 bp, Homo sapiens
ccactcctctgact

SEQ ID NO: 2870672 - DNA, 22 bp, Homo sapiens
ccactctcccctccctcttcct

SEQ ID NO: 2870673 - DNA, 12 bp, Homo sapiens
ccactgaggaga

SEQ ID NO: 2870674 - DNA, 21 bp, Homo sapiens
ccactgcctgcctcccctccg

SEQ ID NO: 2870675 - DNA, 16 bp, Homo sapiens
ccacttcaacccccag

SEQ ID NO: 2870676 - DNA, 12 bp, Homo sapiens
ccacttcatttt

SEQ ID NO: 2870677 - DNA, 16 bp, Homo sapiens
ccagaccaggaaaggc

SEQ ID NO: 2870678 - DNA, 22 bp, Homo sapiens
ccagaccaggaaaggcttggct

SEQ ID NO: 2870679 - DNA, 20 bp, Homo sapiens
ccagagaccccttcctttcc

SEQ ID NO: 2870680 - DNA, 22 bp, Homo sapiens
ccagagaccccttcctttcctc

SEQ ID NO: 2870681 - DNA, 19 bp, Homo sapiens
ccagagccaacctggactt

SEQ ID NO: 2870682 - DNA, 21 bp, Homo sapiens
ccagagcccctcctccagccc

SEQ ID NO: 2870683 - DNA, 17 bp, Homo sapiens
ccagagcttctctgggc

SEQ ID NO: 2870684 - DNA, 19 bp, Homo sapiens
ccagagcttctctgggctg

SEQ ID NO: 2870685 - DNA, 20 bp, Homo sapiens
ccagagcttctctgggctga

SEQ ID NO: 2870686 - DNA, 19 bp, Homo sapiens
ccagaggaaggggccagag

SEQ ID NO: 2870687 - DNA, 22 bp, Homo sapiens
ccagaggaaggggccagaggct

SEQ ID NO: 2870688 - DNA, 11 bp, Homo sapiens
ccagaggctcg

SEQ ID NO: 2870689 - DNA, 18 bp, Homo sapiens
ccagagtttttaaagcct

SEQ ID NO: 2870690 - DNA, 22 bp, Homo sapiens
ccagagtttttaaagccttctg

SEQ ID NO: 2870691 - DNA, 14 bp, Homo sapiens
ccagattggccaat

SEQ ID NO: 2870692 - DNA, 15 bp, Homo sapiens
ccagcaacacagagc

SEQ ID NO: 2870693 - DNA, 12 bp, Homo sapiens
ccagcactgctt

SEQ ID NO: 2870694 - DNA, 15 bp, Homo sapiens
ccagcactgcttgag

SEQ ID NO: 2870695 - DNA, 18 bp, Homo sapiens
ccagcactgcttgaggaa

SEQ ID NO: 2870696 - DNA, 16 bp, Homo sapiens
ccagcgaggaggctcc

SEQ ID NO: 2870697 - DNA, 23 bp, Homo sapiens
ccagctaataaaccagattccag

SEQ ID NO: 2870698 - DNA, 21 bp, Homo sapiens
ccagctctgaaaccagtgtta

SEQ ID NO: 2870699 - DNA, 18 bp, Homo sapiens
ccagctctgtatcaggac

SEQ ID NO: 2870700 - DNA, 17 bp, Homo sapiens
ccagctcttctcttcct

SEQ ID NO: 2870701 - DNA, 19 bp, Homo sapiens
ccagctcttctcttcctag

SEQ ID NO: 2870702 - DNA, 21 bp, Homo sapiens
ccagctcttctcttcctagat

SEQ ID NO: 2870703 - DNA, 16 bp, Homo sapiens
ccagctgggcctcctg

SEQ ID NO: 2870704 - DNA, 19 bp, Homo sapiens
ccagctgggcctcctgcct

SEQ ID NO: 2870705 - DNA, 15 bp, Homo sapiens
ccagcttgttattta

SEQ ID NO: 2870706 - DNA, 22 bp, Homo sapiens
ccaggaaaggcttggctggtgt

SEQ ID NO: 2870707 - DNA, 16 bp, Homo sapiens
ccaggagtaagacaag

SEQ ID NO: 2870708 - DNA, 14 bp, Homo sapiens
ccaggcctgaccag

SEQ ID NO: 2870709 - DNA, 23 bp, Homo sapiens
ccaggccttcatcctcctcccca

SEQ ID NO: 2870710 - DNA, 19 bp, Homo sapiens
ccaggctgagccatgagga

SEQ ID NO: 2870711 - DNA, 21 bp, Homo sapiens
ccaggctgagccatgaggagc

SEQ ID NO: 2870712 - DNA, 20 bp, Homo sapiens
ccaggggtgctatgacatgc

SEQ ID NO: 2870713 - DNA, 16 bp, Homo sapiens
ccagggttgaccccag

SEQ ID NO: 2870714 - DNA, 13 bp, Homo sapiens
ccaggtggcctgc

SEQ ID NO: 2870715 - DNA, 17 bp, Homo sapiens
ccaggtggcctgcgtct

SEQ ID NO: 2870716 - DNA, 14 bp, Homo sapiens
ccagtcaacctggg

SEQ ID NO: 2870717 - DNA, 15 bp, Homo sapiens
ccagtcagcagtcat

SEQ ID NO: 2870718 - DNA, 20 bp, Homo sapiens
ccagtgttagggaagggcct

SEQ ID NO: 2870719 - DNA, 17 bp, Homo sapiens
ccagttaaaaaaaattt

SEQ ID NO: 2870720 - DNA, 14 bp, Homo sapiens
ccagtttcccacca

SEQ ID NO: 2870721 - DNA, 19 bp, Homo sapiens
ccagttttcggaaacactg

SEQ ID NO: 2870722 - DNA, 20 bp, Homo sapiens
ccatagacctacagacctgg

SEQ ID NO: 2870723 - DNA, 13 bp, Homo sapiens
ccatcagggtggg

SEQ ID NO: 2870724 - DNA, 22 bp, Homo sapiens
ccatcagggtgggccactctcc

SEQ ID NO: 2870725 - DNA, 24 bp, Homo sapiens
ccatcagggtgggccactctcccc

SEQ ID NO: 2870726 - DNA, 16 bp, Homo sapiens
ccatcatcatgtgtgt

SEQ ID NO: 2870727 - DNA, 18 bp, Homo sapiens
ccatccattaggccagca

SEQ ID NO: 2870728 - DNA, 18 bp, Homo sapiens
ccatcccctttcctcccc

SEQ ID NO: 2870729 - DNA, 17 bp, Homo sapiens
ccatcgtattaaaaaac

SEQ ID NO: 2870730 - DNA, 23 bp, Homo sapiens
ccatcgtattaaaaaacaattaa

SEQ ID NO: 2870731 - DNA, 21 bp, Homo sapiens
ccatctggctttttctgccac

SEQ ID NO: 2870732 - DNA, 16 bp, Homo sapiens
ccatgaggagcgtgga

SEQ ID NO: 2870733 - DNA, 17 bp, Homo sapiens
ccatgggcagagcccaa

SEQ ID NO: 2870734 - DNA, 14 bp, Homo sapiens
ccatggggggagaa

SEQ ID NO: 2870735 - DNA, 15 bp, Homo sapiens
ccattaggcatgcct

SEQ ID NO: 2870736 - DNA, 16 bp, Homo sapiens
ccattaggccagcaac

SEQ ID NO: 2870737 - DNA, 13 bp, Homo sapiens
ccattcaattagt

SEQ ID NO: 2870738 - DNA, 21 bp, Homo sapiens
ccattcactactcatgcgtga

SEQ ID NO: 2870739 - DNA, 22 bp, Homo sapiens
ccattgaattcttggttgagga

SEQ ID NO: 2870740 - DNA, 14 bp, Homo sapiens
ccatttctatttat

SEQ ID NO: 2870741 - DNA, 22 bp, Homo sapiens
ccattttcccccactactgcag

SEQ ID NO: 2870742 - DNA, 15 bp, Homo sapiens
cccaaagtggggagg

SEQ ID NO: 2870743 - DNA, 15 bp, Homo sapiens
cccaatattataatt

SEQ ID NO: 2870744 - DNA, 11 bp, Homo sapiens
cccacacatgt

SEQ ID NO: 2870745 - DNA, 21 bp, Homo sapiens
cccacacatgtttacagaact

SEQ ID NO: 2870746 - DNA, 21 bp, Homo sapiens
cccacaggcacattaactgtt

SEQ ID NO: 2870747 - DNA, 20 bp, Homo sapiens
cccaccacgtgctcaatcat

SEQ ID NO: 2870748 - DNA, 14 bp, Homo sapiens
cccaccttccccag

SEQ ID NO: 2870749 - DNA, 17 bp, Homo sapiens
cccaccttccccagact

SEQ ID NO: 2870750 - DNA, 18 bp, Homo sapiens
cccacgttctgttaattt

SEQ ID NO: 2870751 - DNA, 19 bp, Homo sapiens
cccagaccaggaaaggctt

SEQ ID NO: 2870752 - DNA, 22 bp, Homo sapiens
cccagaggaaggggccagaggc

SEQ ID NO: 2870753 - DNA, 21 bp, Homo sapiens
cccagcactgcttgaggaaaa

SEQ ID NO: 2870754 - DNA, 15 bp, Homo sapiens
cccagccctcatccc

SEQ ID NO: 2870755 - DNA, 19 bp, Homo sapiens
cccagctcttctcttccta

SEQ ID NO: 2870756 - DNA, 20 bp, Homo sapiens
cccaggtggcctgcgtcttt

SEQ ID NO: 2870757 - DNA, 23 bp, Homo sapiens
cccatcccctttcctccccacct

SEQ ID NO: 2870758 - DNA, 12 bp, Homo sapiens
cccatctggctt

SEQ ID NO: 2870759 - DNA, 17 bp, Homo sapiens
cccatctggctttttct

SEQ ID NO: 2870760 - DNA, 16 bp, Homo sapiens
cccatttctatttatt

SEQ ID NO: 2870761 - DNA, 19 bp, Homo sapiens
cccatttctatttatttac

SEQ ID NO: 2870762 - DNA, 12 bp, Homo sapiens
ccccaataaaag

SEQ ID NO: 2870763 - DNA, 21 bp, Homo sapiens
ccccacaggcacattaactgt

SEQ ID NO: 2870764 - DNA, 16 bp, Homo sapiens
ccccaccttccccaga

SEQ ID NO: 2870765 - DNA, 17 bp, Homo sapiens
ccccaccttccccagac

SEQ ID NO: 2870766 - DNA, 23 bp, Homo sapiens
ccccactactgcagcacctccag

SEQ ID NO: 2870767 - DNA, 22 bp, Homo sapiens
ccccactttcctacaaaatgga

SEQ ID NO: 2870768 - DNA, 17 bp, Homo sapiens
ccccagactcagctcca

SEQ ID NO: 2870769 - DNA, 17 bp, Homo sapiens
ccccagctaataaacca

SEQ ID NO: 2870770 - DNA, 18 bp, Homo sapiens
ccccagctcttctcttcc

SEQ ID NO: 2870771 - DNA, 20 bp, Homo sapiens
ccccatcagtgctccctcac

SEQ ID NO: 2870772 - DNA, 13 bp, Homo sapiens
cccccaatccatg

SEQ ID NO: 2870773 - DNA, 12 bp, Homo sapiens
ccccctctgtcc

SEQ ID NO: 2870774 - DNA, 12 bp, Homo sapiens
ccccctgtgcag

SEQ ID NO: 2870775 - DNA, 13 bp, Homo sapiens
cccctaagtgccc

SEQ ID NO: 2870776 - DNA, 18 bp, Homo sapiens
cccctatcagttgatttt

SEQ ID NO: 2870777 - DNA, 18 bp, Homo sapiens
cccctcccacccacagcc

SEQ ID NO: 2870778 - DNA, 14 bp, Homo sapiens
cccctccctcttcc

SEQ ID NO: 2870779 - DNA, 20 bp, Homo sapiens
cccctccctcttccttcccc

SEQ ID NO: 2870780 - DNA, 14 bp, Homo sapiens
cccctgccagggca

SEQ ID NO: 2870781 - DNA, 19 bp, Homo sapiens
cccctgccagggcagggcc

SEQ ID NO: 2870782 - DNA, 13 bp, Homo sapiens
ccccttcctttcc

SEQ ID NO: 2870783 - DNA, 20 bp, Homo sapiens
cccctttgatgattaattca

SEQ ID NO: 2870784 - DNA, 20 bp, Homo sapiens
cccgagatgtgacccaccag

SEQ ID NO: 2870785 - DNA, 20 bp, Homo sapiens
cccgcttttgttcttcccca

SEQ ID NO: 2870786 - DNA, 12 bp, Homo sapiens
ccctaagtgccc

SEQ ID NO: 2870787 - DNA, 13 bp, Homo sapiens
ccctcatctgtcc

SEQ ID NO: 2870788 - DNA, 14 bp, Homo sapiens
ccctcattcccctc

SEQ ID NO: 2870789 - DNA, 21 bp, Homo sapiens
ccctccactcagctgtcctgc

SEQ ID NO: 2870790 - DNA, 23 bp, Homo sapiens
ccctccagagaaagcacaattta

SEQ ID NO: 2870791 - DNA, 14 bp, Homo sapiens
ccctcgctgccagc

SEQ ID NO: 2870792 - DNA, 16 bp, Homo sapiens
ccctctcactccccag

SEQ ID NO: 2870793 - DNA, 16 bp, Homo sapiens
ccctctctgctctgcg

SEQ ID NO: 2870794 - DNA, 17 bp, Homo sapiens
ccctctcttccctatta

SEQ ID NO: 2870795 - DNA, 20 bp, Homo sapiens
ccctctgtccaggcactgag

SEQ ID NO: 2870796 - DNA, 24 bp, Homo sapiens
ccctctgtccaggcactgagatac

SEQ ID NO: 2870797 - DNA, 12 bp, Homo sapiens
ccctcttccttc

SEQ ID NO: 2870798 - DNA, 21 bp, Homo sapiens
ccctgactcattctgaaggag

SEQ ID NO: 2870799 - DNA, 13 bp, Homo sapiens
ccctgactgggag

SEQ ID NO: 2870800 - DNA, 13 bp, Homo sapiens
ccctgagctgagg

SEQ ID NO: 2870801 - DNA, 16 bp, Homo sapiens
ccctgagctgaggcag

SEQ ID NO: 2870802 - DNA, 12 bp, Homo sapiens
ccctgcagcctg

SEQ ID NO: 2870803 - DNA, 12 bp, Homo sapiens
ccctgccagggc

SEQ ID NO: 2870804 - DNA, 14 bp, Homo sapiens
ccctgccagggcag

SEQ ID NO: 2870805 - DNA, 12 bp, Homo sapiens
ccctggagccag

SEQ ID NO: 2870806 - DNA, 15 bp, Homo sapiens
ccctgtcccaccccc

SEQ ID NO: 2870807 - DNA, 14 bp, Homo sapiens
ccctgttcatgttt

SEQ ID NO: 2870808 - DNA, 20 bp, Homo sapiens
cccttacttgcttctctagc

SEQ ID NO: 2870809 - DNA, 16 bp, Homo sapiens
cccttccactgagggc

SEQ ID NO: 2870810 - DNA, 14 bp, Homo sapiens
cccttcccacagga

SEQ ID NO: 2870811 - DNA, 20 bp, Homo sapiens
cccttcctttcctctgcagc

SEQ ID NO: 2870812 - DNA, 14 bp, Homo sapiens
cccttgagaaacct

SEQ ID NO: 2870813 - DNA, 22 bp, Homo sapiens
cccttgagaaaccttattgtac

SEQ ID NO: 2870814 - DNA, 12 bp, Homo sapiens
ccctttcctccc

SEQ ID NO: 2870815 - DNA, 12 bp, Homo sapiens
ccctttgagtgc

SEQ ID NO: 2870816 - DNA, 23 bp, Homo sapiens
ccgaatctctttttgctttcgaa

SEQ ID NO: 2870817 - DNA, 19 bp, Homo sapiens
ccgactctggccctggccc

SEQ ID NO: 2870818 - DNA, 20 bp, Homo sapiens
ccgagatgtgacccaccagt

SEQ ID NO: 2870819 - DNA, 21 bp, Homo sapiens
ccgagatgtgacccaccagtg

SEQ ID NO: 2870820 - DNA, 19 bp, Homo sapiens
ccgaggggagagagggact

SEQ ID NO: 2870821 - DNA, 22 bp, Homo sapiens
ccgaggggagagagggactcaa

SEQ ID NO: 2870822 - DNA, 13 bp, Homo sapiens
ccgcttttgttct

SEQ ID NO: 2870823 - DNA, 17 bp, Homo sapiens
ccggactggcagaagca

SEQ ID NO: 2870824 - DNA, 18 bp, Homo sapiens
ccggcccagagacccctt

SEQ ID NO: 2870825 - DNA, 17 bp, Homo sapiens
ccgggacctggtgctgc

SEQ ID NO: 2870826 - DNA, 23 bp, Homo sapiens
ccgggttctgcagcggcagagca

SEQ ID NO: 2870827 - DNA, 17 bp, Homo sapiens
cctaagtgcccaaagtg

SEQ ID NO: 2870828 - DNA, 23 bp, Homo sapiens
cctacatatttgtatgtttttct

SEQ ID NO: 2870829 - DNA, 13 bp, Homo sapiens
cctactatttaaa

SEQ ID NO: 2870830 - DNA, 18 bp, Homo sapiens
cctagtgaaggcttctct

SEQ ID NO: 2870831 - DNA, 19 bp, Homo sapiens
cctagtgaaggcttctctc

SEQ ID NO: 2870832 - DNA, 14 bp, Homo sapiens
cctcagttctcaaa

SEQ ID NO: 2870833 - DNA, 20 bp, Homo sapiens
cctcagttctcaaatgtgtg

SEQ ID NO: 2870834 - DNA, 20 bp, Homo sapiens
cctcatcccgagcacctcca

SEQ ID NO: 2870835 - DNA, 15 bp, Homo sapiens
cctcatcttcttcac

SEQ ID NO: 2870836 - DNA, 15 bp, Homo sapiens
cctcattcccctcgt

SEQ ID NO: 2870837 - DNA, 20 bp, Homo sapiens
cctccacatcctccacgttc

SEQ ID NO: 2870838 - DNA, 21 bp, Homo sapiens
cctccacgttctgctcatcat

SEQ ID NO: 2870839 - DNA, 14 bp, Homo sapiens
cctccagagaaagc

SEQ ID NO: 2870840 - DNA, 15 bp, Homo sapiens
cctccagcccctgtc

SEQ ID NO: 2870841 - DNA, 20 bp, Homo sapiens
cctcccacccacagccatag

SEQ ID NO: 2870842 - DNA, 14 bp, Homo sapiens
cctccccaccttcc

SEQ ID NO: 2870843 - DNA, 16 bp, Homo sapiens
cctccccaccttcccc

SEQ ID NO: 2870844 - DNA, 22 bp, Homo sapiens
cctccccagctcttctcttcct

SEQ ID NO: 2870845 - DNA, 13 bp, Homo sapiens
cctcccctcccac

SEQ ID NO: 2870846 - DNA, 12 bp, Homo sapiens
cctcccctgcca

SEQ ID NO: 2870847 - DNA, 13 bp, Homo sapiens
cctccctctccca

SEQ ID NO: 2870848 - DNA, 22 bp, Homo sapiens
cctccctctcccaggcccgaga

SEQ ID NO: 2870849 - DNA, 18 bp, Homo sapiens
cctccctcttccttcccc

SEQ ID NO: 2870850 - DNA, 20 bp, Homo sapiens
cctccctcttccttccccca

SEQ ID NO: 2870851 - DNA, 13 bp, Homo sapiens
cctccgctgggct

SEQ ID NO: 2870852 - DNA, 18 bp, Homo sapiens
cctccgggacctggtgct

SEQ ID NO: 2870853 - DNA, 18 bp, Homo sapiens
cctcctccagcccctgtc

SEQ ID NO: 2870854 - DNA, 12 bp, Homo sapiens
cctcctgagaaa

SEQ ID NO: 2870855 - DNA, 21 bp, Homo sapiens
cctcctgggccctctctgctc

SEQ ID NO: 2870856 - DNA, 13 bp, Homo sapiens
cctcgctgccagc

SEQ ID NO: 2870857 - DNA, 17 bp, Homo sapiens
cctcgctggactctcag

SEQ ID NO: 2870858 - DNA, 21 bp, Homo sapiens
cctcggggagcgttctaaata

SEQ ID NO: 2870859 - DNA, 24 bp, Homo sapiens
cctctacagagcttccctgactca

SEQ ID NO: 2870860 - DNA, 21 bp, Homo sapiens
cctctccagtttgcacctgtc

SEQ ID NO: 2870861 - DNA, 17 bp, Homo sapiens
cctctgactcagggctc

SEQ ID NO: 2870862 - DNA, 19 bp, Homo sapiens
cctctgactcagggctcct

SEQ ID NO: 2870863 - DNA, 21 bp, Homo sapiens
cctctgactcagggctcctgg

SEQ ID NO: 2870864 - DNA, 15 bp, Homo sapiens
cctctgatacctcaa

SEQ ID NO: 2870865 - DNA, 16 bp, Homo sapiens
cctctgcagcacttta

SEQ ID NO: 2870866 - DNA, 16 bp, Homo sapiens
cctctggctagagccg

SEQ ID NO: 2870867 - DNA, 19 bp, Homo sapiens
cctctggctagagccgagg

SEQ ID NO: 2870868 - DNA, 21 bp, Homo sapiens
cctctgtccaggcactgagat

SEQ ID NO: 2870869 - DNA, 21 bp, Homo sapiens
cctctgtgaccaatgtcttga

SEQ ID NO: 2870870 - DNA, 16 bp, Homo sapiens
cctcttcagaggccct

SEQ ID NO: 2870871 - DNA, 13 bp, Homo sapiens
cctcttccttccc

SEQ ID NO: 2870872 - DNA, 18 bp, Homo sapiens
cctcttctgggagggcag

SEQ ID NO: 2870873 - DNA, 21 bp, Homo sapiens
cctcttctgggagggcagcag

SEQ ID NO: 2870874 - DNA, 18 bp, Homo sapiens
cctgaaaacactgtgcac

SEQ ID NO: 2870875 - DNA, 16 bp, Homo sapiens
cctgacctccctctaa

SEQ ID NO: 2870876 - DNA, 17 bp, Homo sapiens
cctgactaggttctgta

SEQ ID NO: 2870877 - DNA, 19 bp, Homo sapiens
cctgactaggttctgtaga

SEQ ID NO: 2870878 - DNA, 18 bp, Homo sapiens
cctgagctgaggcagcag

SEQ ID NO: 2870879 - DNA, 19 bp, Homo sapiens
cctgcaaaaggactctcag

SEQ ID NO: 2870880 - DNA, 18 bp, Homo sapiens
cctgcagcaaacactcca

SEQ ID NO: 2870881 - DNA, 21 bp, Homo sapiens
cctgcagcaaacactccaccc

SEQ ID NO: 2870882 - DNA, 13 bp, Homo sapiens
cctgccagggcag

SEQ ID NO: 2870883 - DNA, 19 bp, Homo sapiens
cctgctcatggccctcgga

SEQ ID NO: 2870884 - DNA, 12 bp, Homo sapiens
cctggactgacc

SEQ ID NO: 2870885 - DNA, 13 bp, Homo sapiens
cctggatgccaag

SEQ ID NO: 2870886 - DNA, 18 bp, Homo sapiens
cctggccccatggtcagc

SEQ ID NO: 2870887 - DNA, 18 bp, Homo sapiens
cctggcccttacttgctt

SEQ ID NO: 2870888 - DNA, 14 bp, Homo sapiens
cctggctctcagag

SEQ ID NO: 2870889 - DNA, 16 bp, Homo sapiens
cctggctctcagagga

SEQ ID NO: 2870890 - DNA, 23 bp, Homo sapiens
cctggctgcccatcatgtggccc

SEQ ID NO: 2870891 - DNA, 14 bp, Homo sapiens
cctggctgttctga

SEQ ID NO: 2870892 - DNA, 17 bp, Homo sapiens
cctgggaaatattccct

SEQ ID NO: 2870893 - DNA, 19 bp, Homo sapiens
cctgggttttgtattctct

SEQ ID NO: 2870894 - DNA, 20 bp, Homo sapiens
cctggtgctgcctctacctg

SEQ ID NO: 2870895 - DNA, 16 bp, Homo sapiens
cctgtaacctcttcag

SEQ ID NO: 2870896 - DNA, 21 bp, Homo sapiens
cctgtaacctcttcagaggcc

SEQ ID NO: 2870897 - DNA, 15 bp, Homo sapiens
cctgtcaccagagct

SEQ ID NO: 2870898 - DNA, 12 bp, Homo sapiens
cctgtcccaccc

SEQ ID NO: 2870899 - DNA, 16 bp, Homo sapiens
cctgtcccaccccctt

SEQ ID NO: 2870900 - DNA, 18 bp, Homo sapiens
cctgtgcagccgctgagc

SEQ ID NO: 2870901 - DNA, 20 bp, Homo sapiens
cctgtgcagccgctgagcga

SEQ ID NO: 2870902 - DNA, 22 bp, Homo sapiens
cctgttcatgtttttgttttaa

SEQ ID NO: 2870903 - DNA, 18 bp, Homo sapiens
cctgtttttaagctgttt

SEQ ID NO: 2870904 - DNA, 19 bp, Homo sapiens
cctgtttttaagctgtttc

SEQ ID NO: 2870905 - DNA, 20 bp, Homo sapiens
ccttaaacaaaaattaaaat

SEQ ID NO: 2870906 - DNA, 17 bp, Homo sapiens
ccttaagagtcatccag

SEQ ID NO: 2870907 - DNA, 17 bp, Homo sapiens
ccttacagtaggagccc

SEQ ID NO: 2870908 - DNA, 16 bp, Homo sapiens
ccttattagagtgtct

SEQ ID NO: 2870909 - DNA, 21 bp, Homo sapiens
ccttattagagtgtctttcca

SEQ ID NO: 2870910 - DNA, 17 bp, Homo sapiens
ccttccactgagggcag

SEQ ID NO: 2870911 - DNA, 20 bp, Homo sapiens
ccttccattttcccccacta

SEQ ID NO: 2870912 - DNA, 15 bp, Homo sapiens
ccttcccagaccagg

SEQ ID NO: 2870913 - DNA, 22 bp, Homo sapiens
ccttcccccatcccctttcctc

SEQ ID NO: 2870914 - DNA, 12 bp, Homo sapiens
ccttcctcctgg

SEQ ID NO: 2870915 - DNA, 13 bp, Homo sapiens
ccttcctcctggg

SEQ ID NO: 2870916 - DNA, 13 bp, Homo sapiens
ccttcctttcctc

SEQ ID NO: 2870917 - DNA, 11 bp, Homo sapiens
ccttctccatc

SEQ ID NO: 2870918 - DNA, 22 bp, Homo sapiens
ccttctccatccacatgggagc

SEQ ID NO: 2870919 - DNA, 19 bp, Homo sapiens
ccttctggatccatggggg

SEQ ID NO: 2870920 - DNA, 14 bp, Homo sapiens
ccttgagaaacctt

SEQ ID NO: 2870921 - DNA, 18 bp, Homo sapiens
ccttggactcctcccaca

SEQ ID NO: 2870922 - DNA, 12 bp, Homo sapiens
ccttgggccctt

SEQ ID NO: 2870923 - DNA, 24 bp, Homo sapiens
cctttcctgtgtgtactctgtcca

SEQ ID NO: 2870924 - DNA, 19 bp, Homo sapiens
cctttgagtgcagtcctga

SEQ ID NO: 2870925 - DNA, 22 bp, Homo sapiens
cctttgagtgcagtcctgatca

SEQ ID NO: 2870926 - DNA, 20 bp, Homo sapiens
cctttgttttgcactgacaa

SEQ ID NO: 2870927 - DNA, 20 bp, Homo sapiens
cgaatgcccctgttcatgtt

SEQ ID NO: 2870928 - DNA, 20 bp, Homo sapiens
cgagatgtgacccaccagtg

SEQ ID NO: 2870929 - DNA, 19 bp, Homo sapiens
cgaggaggctccagagggc

SEQ ID NO: 2870930 - DNA, 20 bp, Homo sapiens
cgaggaggctccagagggca

SEQ ID NO: 2870931 - DNA, 13 bp, Homo sapiens
cgaggggagagag

SEQ ID NO: 2870932 - DNA, 14 bp, Homo sapiens
cgaggggagagagg

SEQ ID NO: 2870933 - DNA, 15 bp, Homo sapiens
cgctgccagctctgt

SEQ ID NO: 2870934 - DNA, 20 bp, Homo sapiens
cgctggactctcagtctctg

SEQ ID NO: 2870935 - DNA, 22 bp, Homo sapiens
cgctgggcttcattccggactg

SEQ ID NO: 2870936 - DNA, 22 bp, Homo sapiens
cgcttgtagaactcactctggg

SEQ ID NO: 2870937 - DNA, 16 bp, Homo sapiens
cgctttctagctgttg

SEQ ID NO: 2870938 - DNA, 16 bp, Homo sapiens
cgcttttgttcttccc

SEQ ID NO: 2870939 - DNA, 12 bp, Homo sapiens
cggaagccaaag

SEQ ID NO: 2870940 - DNA, 17 bp, Homo sapiens
cggaagccaaaggcagc

SEQ ID NO: 2870941 - DNA, 15 bp, Homo sapiens
cggactggcagaagc

SEQ ID NO: 2870942 - DNA, 17 bp, Homo sapiens
cggagggattcccctaa

SEQ ID NO: 2870943 - DNA, 17 bp, Homo sapiens
cggaggtccagctgggc

SEQ ID NO: 2870944 - DNA, 21 bp, Homo sapiens
cggaggtccagctgggcctcc

SEQ ID NO: 2870945 - DNA, 24 bp, Homo sapiens
cggcagagcaattccaggctgagc

SEQ ID NO: 2870946 - DNA, 14 bp, Homo sapiens
cggcagatgatgct

SEQ ID NO: 2870947 - DNA, 22 bp, Homo sapiens
cggcagatgatgctttggaaga

SEQ ID NO: 2870948 - DNA, 19 bp, Homo sapiens
cggcccagagaccccttcc

SEQ ID NO: 2870949 - DNA, 12 bp, Homo sapiens
cggcctgagaaa

SEQ ID NO: 2870950 - DNA, 12 bp, Homo sapiens
cgggaaattatt

SEQ ID NO: 2870951 - DNA, 12 bp, Homo sapiens
cgggacagagag

SEQ ID NO: 2870952 - DNA, 18 bp, Homo sapiens
cgggaggagcagcccggg

SEQ ID NO: 2870953 - DNA, 18 bp, Homo sapiens
cggtgcatccacgcacac

SEQ ID NO: 2870954 - DNA, 16 bp, Homo sapiens
cggtgtgcaccagggt

SEQ ID NO: 2870955 - DNA, 13 bp, Homo sapiens
cgtcctcctctgt

SEQ ID NO: 2870956 - DNA, 19 bp, Homo sapiens
cgtcttttttctcttccct

SEQ ID NO: 2870957 - DNA, 21 bp, Homo sapiens
cgtggactctgctagactcct

SEQ ID NO: 2870958 - DNA, 16 bp, Homo sapiens
cgtgtcacctgtgctt

SEQ ID NO: 2870959 - DNA, 21 bp, Homo sapiens
cgttctaaatatgaatgaatg

SEQ ID NO: 2870960 - DNA, 14 bp, Homo sapiens
cgttctgctcatca

SEQ ID NO: 2870961 - DNA, 20 bp, Homo sapiens
ctaaaagttctcaatgtaga

SEQ ID NO: 2870962 - DNA, 18 bp, Homo sapiens
ctaaaattatgttactgt

SEQ ID NO: 2870963 - DNA, 19 bp, Homo sapiens
ctaaaattatgttactgta

SEQ ID NO: 2870964 - DNA, 14 bp, Homo sapiens
ctaaataaaaatat

SEQ ID NO: 2870965 - DNA, 23 bp, Homo sapiens
ctaaatatgaatgaatgggatat

SEQ ID NO: 2870966 - DNA, 15 bp, Homo sapiens
ctaacaaaatgagat

SEQ ID NO: 2870967 - DNA, 15 bp, Homo sapiens
ctaacctcatcttct

SEQ ID NO: 2870968 - DNA, 20 bp, Homo sapiens
ctaactgctacaaatactct

SEQ ID NO: 2870969 - DNA, 18 bp, Homo sapiens
ctaacttaaaaaactgca

SEQ ID NO: 2870970 - DNA, 13 bp, Homo sapiens
ctaagaaaatgta

SEQ ID NO: 2870971 - DNA, 15 bp, Homo sapiens
ctaagaaaatgtagt

SEQ ID NO: 2870972 - DNA, 21 bp, Homo sapiens
ctaagatagaaagctggactg

SEQ ID NO: 2870973 - DNA, 16 bp, Homo sapiens
ctaagtctttccattg

SEQ ID NO: 2870974 - DNA, 18 bp, Homo sapiens
ctaatatttaggcaagag

SEQ ID NO: 2870975 - DNA, 15 bp, Homo sapiens
ctaatgtttgaacaa

SEQ ID NO: 2870976 - DNA, 17 bp, Homo sapiens
ctaattgtaagtgaaat

SEQ ID NO: 2870977 - DNA, 20 bp, Homo sapiens
ctaattgtaagtgaaattaa

SEQ ID NO: 2870978 - DNA, 12 bp, Homo sapiens
ctacaaaatgga

SEQ ID NO: 2870979 - DNA, 17 bp, Homo sapiens
ctacagacctggctctc

SEQ ID NO: 2870980 - DNA, 17 bp, Homo sapiens
ctacagagcttccctga

SEQ ID NO: 2870981 - DNA, 20 bp, Homo sapiens
ctacagagcttccctgactc

SEQ ID NO: 2870982 - DNA, 15 bp, Homo sapiens
ctacagtcaggaaag

SEQ ID NO: 2870983 - DNA, 18 bp, Homo sapiens
ctacagtcaggaaaggaa

SEQ ID NO: 2870984 - DNA, 17 bp, Homo sapiens
ctaccaatacaaaatgt

SEQ ID NO: 2870985 - DNA, 15 bp, Homo sapiens
ctacccggcccagag

SEQ ID NO: 2870986 - DNA, 16 bp, Homo sapiens
ctacccggcccagaga

SEQ ID NO: 2870987 - DNA, 17 bp, Homo sapiens
ctaccctgagctgaggc

SEQ ID NO: 2870988 - DNA, 15 bp, Homo sapiens
ctacctacatatttg

SEQ ID NO: 2870989 - DNA, 20 bp, Homo sapiens
ctacctgacactcccttggg

SEQ ID NO: 2870990 - DNA, 19 bp, Homo sapiens
ctactatttaaatccttgg

SEQ ID NO: 2870991 - DNA, 22 bp, Homo sapiens
ctactgcagcacctccaggcct

SEQ ID NO: 2870992 - DNA, 23 bp, Homo sapiens
ctactgttatcagtaatgctaaa

SEQ ID NO: 2870993 - DNA, 12 bp, Homo sapiens
ctacttgggagg

SEQ ID NO: 2870994 - DNA, 12 bp, Homo sapiens
ctagaaaaataa

SEQ ID NO: 2870995 - DNA, 20 bp, Homo sapiens
ctagaaaaataaaatgtttc

SEQ ID NO: 2870996 - DNA, 16 bp, Homo sapiens
ctagaattcactgagt

SEQ ID NO: 2870997 - DNA, 14 bp, Homo sapiens
ctagagccgagggg

SEQ ID NO: 2870998 - DNA, 16 bp, Homo sapiens
ctagagccgaggggag

SEQ ID NO: 2870999 - DNA, 10 bp, Homo sapiens
ctagagcctg

SEQ ID NO: 2871000 - DNA, 13 bp, Homo sapiens
ctagatctgcagg

SEQ ID NO: 2871001 - DNA, 18 bp, Homo sapiens
ctagatctgcaggctgca

SEQ ID NO: 2871002 - DNA, 21 bp, Homo sapiens
ctagctctctaggcctctcca

SEQ ID NO: 2871003 - DNA, 16 bp, Homo sapiens
ctaggcctctccagtt

SEQ ID NO: 2871004 - DNA, 23 bp, Homo sapiens
ctagggatccctcatctgtccct

SEQ ID NO: 2871005 - DNA, 20 bp, Homo sapiens
ctaggttctgtagagccaat

SEQ ID NO: 2871006 - DNA, 21 bp, Homo sapiens
ctaggttctgtagagccaatt

SEQ ID NO: 2871007 - DNA, 13 bp, Homo sapiens
ctagtgggacagc

SEQ ID NO: 2871008 - DNA, 17 bp, Homo sapiens
ctataaatgccagagcc

SEQ ID NO: 2871009 - DNA, 18 bp, Homo sapiens
ctataaatgccagagcca

SEQ ID NO: 2871010 - DNA, 22 bp, Homo sapiens
ctataaatgccagagccaacct

SEQ ID NO: 2871011 - DNA, 15 bp, Homo sapiens
ctatagcattttgct

SEQ ID NO: 2871012 - DNA, 18 bp, Homo sapiens
ctatcagttgatttttct

SEQ ID NO: 2871013 - DNA, 20 bp, Homo sapiens
ctatcagttgatttttctta

SEQ ID NO: 2871014 - DNA, 13 bp, Homo sapiens
ctatccacactgt

SEQ ID NO: 2871015 - DNA, 20 bp, Homo sapiens
ctatcttttttagtgttaaa

SEQ ID NO: 2871016 - DNA, 21 bp, Homo sapiens
ctatcttttttagtgttaaag

SEQ ID NO: 2871017 - DNA, 15 bp, Homo sapiens
ctatgacaaattcaa

SEQ ID NO: 2871018 - DNA, 17 bp, Homo sapiens
ctatgacaaattcaaga

SEQ ID NO: 2871019 - DNA, 20 bp, Homo sapiens
ctatggcaggataagaaagc

SEQ ID NO: 2871020 - DNA, 22 bp, Homo sapiens
ctatgtaacatgtaggaagtag

SEQ ID NO: 2871021 - DNA, 20 bp, Homo sapiens
ctatttaaatccttggcttc

SEQ ID NO: 2871022 - DNA, 15 bp, Homo sapiens
ctatttctcctccat

SEQ ID NO: 2871023 - DNA, 12 bp, Homo sapiens
ctattttcataa

SEQ ID NO: 2871024 - DNA, 13 bp, Homo sapiens
ctatttttgtgaa

SEQ ID NO: 2871025 - DNA, 15 bp, Homo sapiens
ctatttttgtgaaga

SEQ ID NO: 2871026 - DNA, 22 bp, Homo sapiens
ctcaacccccatttctatttat

SEQ ID NO: 2871027 - DNA, 12 bp, Homo sapiens
ctcaacctaccc

SEQ ID NO: 2871028 - DNA, 18 bp, Homo sapiens
ctgtccccaccctccact

SEQ ID NO: 2871029 - DNA, 19 bp, Homo sapiens
ctgtccccaccctccactc

SEQ ID NO: 2871030 - DNA, 12 bp, Homo sapiens
ctgtccctccgg

SEQ ID NO: 2871031 - DNA, 17 bp, Homo sapiens
ctgtccctccgggacct

SEQ ID NO: 2871032 - DNA, 13 bp, Homo sapiens
ctgtcctgcagca

SEQ ID NO: 2871033 - DNA, 14 bp, Homo sapiens
ctgtccttccctgc

SEQ ID NO: 2871034 - DNA, 17 bp, Homo sapiens
ctgtctcatccatcatc

SEQ ID NO: 2871035 - DNA, 21 bp, Homo sapiens
ctgtctcatccatcatcatgt

SEQ ID NO: 2871036 - DNA, 12 bp, Homo sapiens
ctttcttgtttg

SEQ ID NO: 2871037 - DNA, 15 bp, Homo sapiens
ctttcttgtttgtca

SEQ ID NO: 2871038 - DNA, 22 bp, Homo sapiens
ctttcttgtttgtcagcatctg

SEQ ID NO: 2871039 - DNA, 19 bp, Homo sapiens
ctttgctgttattgacagc

SEQ ID NO: 2871040 - DNA, 17 bp, Homo sapiens
ctttggaagatgcagaa

SEQ ID NO: 2871041 - DNA, 17 bp, Homo sapiens
ctttggacttctgaaga

SEQ ID NO: 2871042 - DNA, 15 bp, Homo sapiens
cttttaatggcattt

SEQ ID NO: 2871043 - DNA, 15 bp, Homo sapiens
cttttagaaatgcat

SEQ ID NO: 2871044 - DNA, 21 bp, Homo sapiens
cttttatacaataattgaagt

SEQ ID NO: 2871045 - DNA, 16 bp, Homo sapiens
cttttgaatgtccaaa

SEQ ID NO: 2871046 - DNA, 15 bp, Homo sapiens
cttttgccctttgat

SEQ ID NO: 2871047 - DNA, 21 bp, Homo sapiens
ctttttaaagaagtgcatgaa

SEQ ID NO: 2871048 - DNA, 22 bp, Homo sapiens
ctttttaaagaagtgcatgaaa

SEQ ID NO: 2871049 - DNA, 22 bp, Homo sapiens
ctttttcccatctggctttttc

SEQ ID NO: 2871050 - DNA, 20 bp, Homo sapiens
gaaaaaaaatgttctttggg

SEQ ID NO: 2871051 - DNA, 12 bp, Homo sapiens
gaaaaatgggag

SEQ ID NO: 2871052 - DNA, 18 bp, Homo sapiens
gaaaaatgggagccagga

SEQ ID NO: 2871053 - DNA, 15 bp, Homo sapiens
gaaaaattaactttt

SEQ ID NO: 2871054 - DNA, 14 bp, Homo sapiens
gaaaacaaggaagt

SEQ ID NO: 2871055 - DNA, 16 bp, Homo sapiens
gaaaattatttgcata

SEQ ID NO: 2871056 - DNA, 19 bp, Homo sapiens
gaaacaaacaaaactctta

SEQ ID NO: 2871057 - DNA, 15 bp, Homo sapiens
gaaacaaataatttg

SEQ ID NO: 2871058 - DNA, 20 bp, Homo sapiens
gaaacaaataatttgaactt

SEQ ID NO: 2871059 - DNA, 20 bp, Homo sapiens
gaaacaactctttgagaaac

SEQ ID NO: 2871060 - DNA, 19 bp, Homo sapiens
gaaacacatcaaataaact

SEQ ID NO: 2871061 - DNA, 17 bp, Homo sapiens
gaaacactatttgtgac

SEQ ID NO: 2871062 - DNA, 12 bp, Homo sapiens
gaaacagccagc

SEQ ID NO: 2871063 - DNA, 21 bp, Homo sapiens
gaaacagttgctgtgaacttt

SEQ ID NO: 2871064 - DNA, 23 bp, Homo sapiens
gaaacatgggctgtgattactgc

SEQ ID NO: 2871065 - DNA, 13 bp, Homo sapiens
gaaacttctcagt

SEQ ID NO: 2871066 - DNA, 18 bp, Homo sapiens
gaaagagtgccagtcagc

SEQ ID NO: 2871067 - DNA, 15 bp, Homo sapiens
gaaagatacttacat

SEQ ID NO: 2871068 - DNA, 15 bp, Homo sapiens
gaaagcctaaaattg

SEQ ID NO: 2871069 - DNA, 14 bp, Homo sapiens
gaaagctaaagttt

SEQ ID NO: 2871070 - DNA, 14 bp, Homo sapiens
gaaagctggactga

SEQ ID NO: 2871071 - DNA, 20 bp, Homo sapiens
gaaagctggactgaccaaag

SEQ ID NO: 2871072 - DNA, 18 bp, Homo sapiens
gaaagtcaaaaaattatt

SEQ ID NO: 2871073 - DNA, 13 bp, Homo sapiens
gaaataataaaaa

SEQ ID NO: 2871074 - DNA, 14 bp, Homo sapiens
gaaatacgtttgtg

SEQ ID NO: 2871075 - DNA, 16 bp, Homo sapiens
gaaatacgtttgtgtt

SEQ ID NO: 2871076 - DNA, 12 bp, Homo sapiens
gaaatgaacttt

SEQ ID NO: 2871077 - DNA, 15 bp, Homo sapiens
gaaatgcatatttgc

SEQ ID NO: 2871078 - DNA, 18 bp, Homo sapiens
gaaattaagcattttgaa

SEQ ID NO: 2871079 - DNA, 15 bp, Homo sapiens
gaacagggacttgtt

SEQ ID NO: 2871080 - DNA, 22 bp, Homo sapiens
gaacccccaggtggcctgcgtc

SEQ ID NO: 2871081 - DNA, 13 bp, Homo sapiens
gaactcactctgg

SEQ ID NO: 2871082 - DNA, 22 bp, Homo sapiens
gaactgctagtcaagtgcgtcc

SEQ ID NO: 2871083 - DNA, 19 bp, Homo sapiens
gaactgttgtttacttgtt

SEQ ID NO: 2871084 - DNA, 20 bp, Homo sapiens
gaacttcagcattgtaatta

SEQ ID NO: 2871085 - DNA, 13 bp, Homo sapiens
gaactttgtcagt

SEQ ID NO: 2871086 - DNA, 15 bp, Homo sapiens
gaactttttaaagaa

SEQ ID NO: 2871087 - DNA, 12 bp, Homo sapiens
gaagaaaatttg

SEQ ID NO: 2871088 - DNA, 19 bp, Homo sapiens
gaagaaaatttgccaatct

SEQ ID NO: 2871089 - DNA, 23 bp, Homo sapiens
gaagaaggaggaatgctggactg

SEQ ID NO: 2871090 - DNA, 18 bp, Homo sapiens
gaagaatcaagagggcag

SEQ ID NO: 2871091 - DNA, 15 bp, Homo sapiens
gaagactgagccaga

SEQ ID NO: 2871092 - DNA, 12 bp, Homo sapiens
gaagagaaacca

SEQ ID NO: 2871093 - DNA, 14 bp, Homo sapiens
gaagagaccactca

SEQ ID NO: 2871094 - DNA, 23 bp, Homo sapiens
gaagagtaagtcaacctgcctga

SEQ ID NO: 2871095 - DNA, 17 bp, Homo sapiens
gaagatctttatatttc

SEQ ID NO: 2871096 - DNA, 17 bp, Homo sapiens
gaagcattgcctggact

SEQ ID NO: 2871097 - DNA, 19 bp, Homo sapiens
gaagcattgcctggactga

SEQ ID NO: 2871098 - DNA, 20 bp, Homo sapiens
gaagccaaaggcagctaaga

SEQ ID NO: 2871099 - DNA, 17 bp, Homo sapiens
gaagccgactctggccc

SEQ ID NO: 2871100 - DNA, 17 bp, Homo sapiens
gaagctgggggaagggt

SEQ ID NO: 2871101 - DNA, 19 bp, Homo sapiens
gaagctgggggaagggtgg

SEQ ID NO: 2871102 - DNA, 14 bp, Homo sapiens
gaagcttgagcctc

SEQ ID NO: 2871103 - DNA, 21 bp, Homo sapiens
gaaggagccccattcctggga

SEQ ID NO: 2871104 - DNA, 17 bp, Homo sapiens
gaaggggccagaggctc

SEQ ID NO: 2871105 - DNA, 13 bp, Homo sapiens
gaaggtgaacttt

SEQ ID NO: 2871106 - DNA, 14 bp, Homo sapiens
gaagtaaaacagtc

SEQ ID NO: 2871107 - DNA, 15 bp, Homo sapiens
gaagtcaaagcaagg

SEQ ID NO: 2871108 - DNA, 16 bp, Homo sapiens
gaagtcaaagcaagga

SEQ ID NO: 2871109 - DNA, 14 bp, Homo sapiens
gaagtcagaatttt

SEQ ID NO: 2871110 - DNA, 17 bp, Homo sapiens
gaagtcagaatttttaa

SEQ ID NO: 2871111 - DNA, 18 bp, Homo sapiens
gaagtcataccaatgaaa

SEQ ID NO: 2871112 - DNA, 18 bp, Homo sapiens
gaagtgatatggtgaagg

SEQ ID NO: 2871113 - DNA, 17 bp, Homo sapiens
gaagttgcagtgagctg

SEQ ID NO: 2871114 - DNA, 22 bp, Homo sapiens
gaagttgccatgggaaacaaat

SEQ ID NO: 2871115 - DNA, 22 bp, Homo sapiens
gaatactgccaaaacatttatg

SEQ ID NO: 2871116 - DNA, 23 bp, Homo sapiens
gaatcacagctcaagcattctgt

SEQ ID NO: 2871117 - DNA, 20 bp, Homo sapiens
gaatctataagtagtaaatc

SEQ ID NO: 2871118 - DNA, 16 bp, Homo sapiens
gaatctcaatgtacat

SEQ ID NO: 2871119 - DNA, 20 bp, Homo sapiens
gaatgggatattttgaaatg

SEQ ID NO: 2871120 - DNA, 18 bp, Homo sapiens
gaatgtccaaaatttata

SEQ ID NO: 2871121 - DNA, 20 bp, Homo sapiens
gaatgtccaaaatttatatt

SEQ ID NO: 2871122 - DNA, 20 bp, Homo sapiens
gaatgttacattgtttgtct

SEQ ID NO: 2871123 - DNA, 14 bp, Homo sapiens
gaattcacacctta

SEQ ID NO: 2871124 - DNA, 22 bp, Homo sapiens
gaatttgtatatgactgcattt

SEQ ID NO: 2871125 - DNA, 14 bp, Homo sapiens
gaatttttaactgt

SEQ ID NO: 2871126 - DNA, 13 bp, Homo sapiens
gacaaaggcaagc

SEQ ID NO: 2871127 - DNA, 13 bp, Homo sapiens
gacaagggattct

SEQ ID NO: 2871128 - DNA, 15 bp, Homo sapiens
gacaagggattctgg

SEQ ID NO: 2871129 - DNA, 18 bp, Homo sapiens
gacaagggattctgggaa

SEQ ID NO: 2871130 - DNA, 20 bp, Homo sapiens
gacaagggattctgggaagc

SEQ ID NO: 2871131 - DNA, 13 bp, Homo sapiens
gacaatgccttgg

SEQ ID NO: 2871132 - DNA, 20 bp, Homo sapiens
gacagagaggagttgccagg

SEQ ID NO: 2871133 - DNA, 11 bp, Homo sapiens
gacagcccaga

SEQ ID NO: 2871134 - DNA, 20 bp, Homo sapiens
gacaggtctagactttctca

SEQ ID NO: 2871135 - DNA, 12 bp, Homo sapiens
gacagtttttga

SEQ ID NO: 2871136 - DNA, 14 bp, Homo sapiens
gacagtttttgaca

SEQ ID NO: 2871137 - DNA, 15 bp, Homo sapiens
gacagtttttgacat

SEQ ID NO: 2871138 - DNA, 19 bp, Homo sapiens
gacagtttttgacatttat

SEQ ID NO: 2871139 - DNA, 15 bp, Homo sapiens
gacataagataaaat

SEQ ID NO: 2871140 - DNA, 15 bp, Homo sapiens
gacatttatattaaa

SEQ ID NO: 2871141 - DNA, 20 bp, Homo sapiens
gacatttatattaaataaca

SEQ ID NO: 2871142 - DNA, 19 bp, Homo sapiens
ctcaagggaaaggcaagct

SEQ ID NO: 2871143 - DNA, 23 bp, Homo sapiens
ctcaagggaaaggcaagcttgag

SEQ ID NO: 2871144 - DNA, 13 bp, Homo sapiens
ctcaataaacagt

SEQ ID NO: 2871145 - DNA, 15 bp, Homo sapiens
ctcacccccttctcc

SEQ ID NO: 2871146 - DNA, 19 bp, Homo sapiens
ctcacccccttctccatcc

SEQ ID NO: 2871147 - DNA, 21 bp, Homo sapiens
ctcacccccttctccatccac

SEQ ID NO: 2871148 - DNA, 12 bp, Homo sapiens
ctcactccccag

SEQ ID NO: 2871149 - DNA, 14 bp, Homo sapiens
ctcactctgggctg

SEQ ID NO: 2871150 - DNA, 18 bp, Homo sapiens
ctcagctgtcctgcagca

SEQ ID NO: 2871151 - DNA, 14 bp, Homo sapiens
ctcagtctctgagc

SEQ ID NO: 2871152 - DNA, 12 bp, Homo sapiens
ctcagttctcaa

SEQ ID NO: 2871153 - DNA, 13 bp, Homo sapiens
ctcagttctcaaa

SEQ ID NO: 2871154 - DNA, 15 bp, Homo sapiens
ctcagttctcaaatg

SEQ ID NO: 2871155 - DNA, 19 bp, Homo sapiens
ctgaccaaagactgcagaa

SEQ ID NO: 2871156 - DNA, 22 bp, Homo sapiens
ctgaccacgctttctagctgtt

SEQ ID NO: 2871157 - DNA, 14 bp, Homo sapiens
ctgaccatctgtga

SEQ ID NO: 2871158 - DNA, 21 bp, Homo sapiens
ctgacccagccccttgagaaa

SEQ ID NO: 2871159 - DNA, 18 bp, Homo sapiens
ctgacctccctctaattt

SEQ ID NO: 2871160 - DNA, 21 bp, Homo sapiens
ctgacctccctctaatttatc

SEQ ID NO: 2871161 - DNA, 13 bp, Homo sapiens
ctgacgacactga

SEQ ID NO: 2871162 - DNA, 16 bp, Homo sapiens
ctgactcagggctcct

SEQ ID NO: 2871163 - DNA, 16 bp, Homo sapiens
ctgactcattctgaag

SEQ ID NO: 2871164 - DNA, 16 bp, Homo sapiens
ctgactttttcccccc

SEQ ID NO: 2871165 - DNA, 14 bp, Homo sapiens
ctgagcaccccctc

SEQ ID NO: 2871166 - DNA, 16 bp, Homo sapiens
ctgagcaccccctcat

SEQ ID NO: 2871167 - DNA, 21 bp, Homo sapiens
ctgagcaccccctcattcccc

SEQ ID NO: 2871168 - DNA, 15 bp, Homo sapiens
ctgagccagattggc

SEQ ID NO: 2871169 - DNA, 16 bp, Homo sapiens
ctgagccatgaggagc

SEQ ID NO: 2871170 - DNA, 22 bp, Homo sapiens
ctgagccatgaggagcgtggac

SEQ ID NO: 2871171 - DNA, 20 bp, Homo sapiens
ctgagcgaggagatgctcct

SEQ ID NO: 2871172 - DNA, 13 bp, Homo sapiens
ctgagctgaggca

SEQ ID NO: 2871173 - DNA, 15 bp, Homo sapiens
ctgagcttctctgtg

SEQ ID NO: 2871174 - DNA, 16 bp, Homo sapiens
ctgagcttctctgtga

SEQ ID NO: 2871175 - DNA, 12 bp, Homo sapiens
ctgaggcaagag

SEQ ID NO: 2871176 - DNA, 15 bp, Homo sapiens
ctgaggcagcagtgt

SEQ ID NO: 2871177 - DNA, 22 bp, Homo sapiens
ctgaggcagcagtgtgaggcca

SEQ ID NO: 2871178 - DNA, 23 bp, Homo sapiens
ctgataaaaccatgtagaaaatt

SEQ ID NO: 2871179 - DNA, 18 bp, Homo sapiens
ctgataccatatgaatga

SEQ ID NO: 2871180 - DNA, 23 bp, Homo sapiens
ctgataccatatgaatgaaacat

SEQ ID NO: 2871181 - DNA, 20 bp, Homo sapiens
ctgatcagagccgtggtcct

SEQ ID NO: 2871182 - DNA, 15 bp, Homo sapiens
ctgatccctctacag

SEQ ID NO: 2871183 - DNA, 17 bp, Homo sapiens
ctgatgaagaagggggt

SEQ ID NO: 2871184 - DNA, 21 bp, Homo sapiens
ctgatgtcagctgctgttgaa

SEQ ID NO: 2871185 - DNA, 18 bp, Homo sapiens
ctgcaaaaggactctcag

SEQ ID NO: 2871186 - DNA, 13 bp, Homo sapiens
ctgcaatcactgt

SEQ ID NO: 2871187 - DNA, 16 bp, Homo sapiens
ctgcaatcactgtgct

SEQ ID NO: 2871188 - DNA, 18 bp, Homo sapiens
ctgcaccatcacacatgc

SEQ ID NO: 2871189 - DNA, 20 bp, Homo sapiens
ctgcagaacccccaggtggc

SEQ ID NO: 2871190 - DNA, 20 bp, Homo sapiens
ctgcagcaaacactccaccc

SEQ ID NO: 2871191 - DNA, 14 bp, Homo sapiens
ctgcagcggcagag

SEQ ID NO: 2871192 - DNA, 15 bp, Homo sapiens
ctgcaggctgcacct

SEQ ID NO: 2871193 - DNA, 21 bp, Homo sapiens
ctgccaatctgtacaaaatgg

SEQ ID NO: 2871194 - DNA, 12 bp, Homo sapiens
ctgccacagaga

SEQ ID NO: 2871195 - DNA, 16 bp, Homo sapiens
ctgccagggcagggcc

SEQ ID NO: 2871196 - DNA, 19 bp, Homo sapiens
ctgccatgcctcaagaaca

SEQ ID NO: 2871197 - DNA, 18 bp, Homo sapiens
ctgcccatcatgtggccc

SEQ ID NO: 2871198 - DNA, 16 bp, Homo sapiens
ctgcctcccactccat

SEQ ID NO: 2871199 - DNA, 14 bp, Homo sapiens
ctgcctcccctccg

SEQ ID NO: 2871200 - DNA, 16 bp, Homo sapiens
ctgcctcccctccgca

SEQ ID NO: 2871201 - DNA, 17 bp, Homo sapiens
ctgcctcttctgggagg

SEQ ID NO: 2871202 - DNA, 18 bp, Homo sapiens
ctgccttcctcctgggcc

SEQ ID NO: 2871203 - DNA, 12 bp, Homo sapiens
ctgcggaagcca

SEQ ID NO: 2871204 - DNA, 13 bp, Homo sapiens
ctgcggaagccaa

SEQ ID NO: 2871205 - DNA, 24 bp, Homo sapiens
ctgcgtcttttttctcttcccttc

SEQ ID NO: 2871206 - DNA, 19 bp, Homo sapiens
ctgcgtgtcacctgtgctt

SEQ ID NO: 2871207 - DNA, 17 bp, Homo sapiens
ctgctcatcattctctg

SEQ ID NO: 2871208 - DNA, 18 bp, Homo sapiens
ctgctcatcattctctgt

SEQ ID NO: 2871209 - DNA, 19 bp, Homo sapiens
ctgctcatggccctcggag

SEQ ID NO: 2871210 - DNA, 16 bp, Homo sapiens
ctgctctagtgggaca

SEQ ID NO: 2871211 - DNA, 12 bp, Homo sapiens
ctgcttgaggaa

SEQ ID NO: 2871212 - DNA, 23 bp, Homo sapiens
ctggacatgaagattctttccca

SEQ ID NO: 2871213 - DNA, 17 bp, Homo sapiens
ctggactctcagtctct

SEQ ID NO: 2871214 - DNA, 20 bp, Homo sapiens
ctggactctcagtctctgag

SEQ ID NO: 2871215 - DNA, 23 bp, Homo sapiens
ctggactctcagtctctgagcag

SEQ ID NO: 2871216 - DNA, 10 bp, Homo sapiens
ctggactgac

SEQ ID NO: 2871217 - DNA, 17 bp, Homo sapiens
ctggactgaccaaagac

SEQ ID NO: 2871218 - DNA, 19 bp, Homo sapiens
ctggactgaccaaagactg

SEQ ID NO: 2871219 - DNA, 14 bp, Homo sapiens
ctggactgaccaca

SEQ ID NO: 2871220 - DNA, 19 bp, Homo sapiens
ctggactggaggcccctgg

SEQ ID NO: 2871221 - DNA, 13 bp, Homo sapiens
ctggacttcctgt

SEQ ID NO: 2871222 - DNA, 13 bp, Homo sapiens
ctggaggcccctg

SEQ ID NO: 2871223 - DNA, 17 bp, Homo sapiens
ctggatccatgggggga

SEQ ID NO: 2871224 - DNA, 23 bp, Homo sapiens
ctggatccatggggggagaagtg

SEQ ID NO: 2871225 - DNA, 17 bp, Homo sapiens
ctggatgccaaggagcc

SEQ ID NO: 2871226 - DNA, 14 bp, Homo sapiens
ctggctagagccga

SEQ ID NO: 2871227 - DNA, 17 bp, Homo sapiens
ctggctagagccgaggg

SEQ ID NO: 2871228 - DNA, 12 bp, Homo sapiens
ctggctctcaga

SEQ ID NO: 2871229 - DNA, 13 bp, Homo sapiens
ctggctctcagag

SEQ ID NO: 2871230 - DNA, 20 bp, Homo sapiens
ctggcttggggtcaagaaac

SEQ ID NO: 2871231 - DNA, 18 bp, Homo sapiens
ctggctttttctgccact

SEQ ID NO: 2871232 - DNA, 21 bp, Homo sapiens
ctggctttttctgccactgag

SEQ ID NO: 2871233 - DNA, 19 bp, Homo sapiens
ctgggaagcttgagcctcc

SEQ ID NO: 2871234 - DNA, 13 bp, Homo sapiens
ctgggagggcagc

SEQ ID NO: 2871235 - DNA, 20 bp, Homo sapiens
ctgggagggcagcagggcta

SEQ ID NO: 2871236 - DNA, 15 bp, Homo sapiens
ctgggcaaagcctag

SEQ ID NO: 2871237 - DNA, 12 bp, Homo sapiens
ctgggcaagaac

SEQ ID NO: 2871238 - DNA, 18 bp, Homo sapiens
ctgggccctctctgctct

SEQ ID NO: 2871239 - DNA, 13 bp, Homo sapiens
ctgggctgaggga

SEQ ID NO: 2871240 - DNA, 22 bp, Homo sapiens
ctgggctgtaacgtggcactgg

SEQ ID NO: 2871241 - DNA, 19 bp, Homo sapiens
ctgggcttggggcttccta

SEQ ID NO: 2871242 - DNA, 14 bp, Homo sapiens
ctgggggtgccagg

SEQ ID NO: 2871243 - DNA, 15 bp, Homo sapiens
ctgggggtgccagga

SEQ ID NO: 2871244 - DNA, 23 bp, Homo sapiens
ctgggtgacagagcaagactctg

SEQ ID NO: 2871245 - DNA, 20 bp, Homo sapiens
ctggtagaattgggaagctg

SEQ ID NO: 2871246 - DNA, 17 bp, Homo sapiens
ctggtaggttgggacac

SEQ ID NO: 2871247 - DNA, 16 bp, Homo sapiens
ctggtgtaatctcaat

SEQ ID NO: 2871248 - DNA, 17 bp, Homo sapiens
ctggttaccactctttt

SEQ ID NO: 2871249 - DNA, 20 bp, Homo sapiens
ctgtaacctcttcagaggcc

SEQ ID NO: 2871250 - DNA, 22 bp, Homo sapiens
ctgtaacctcttcagaggccct

SEQ ID NO: 2871251 - DNA, 23 bp, Homo sapiens
ctgtaacctcttcagaggccctc

SEQ ID NO: 2871252 - DNA, 13 bp, Homo sapiens
ctgtaatcccagc

SEQ ID NO: 2871253 - DNA, 14 bp, Homo sapiens
ctgtacaaaatggt

SEQ ID NO: 2871254 - DNA, 15 bp, Homo sapiens
ctgtagagccaatta

SEQ ID NO: 2871255 - DNA, 16 bp, Homo sapiens
ctgtatatttctttta

SEQ ID NO: 2871256 - DNA, 23 bp, Homo sapiens
ctgtatgggggagattgaacttt

SEQ ID NO: 2871257 - DNA, 13 bp, Homo sapiens
gacatttctctaa

SEQ ID NO: 2871258 - DNA, 19 bp, Homo sapiens
gaccacaccaaccaggcct

SEQ ID NO: 2871259 - DNA, 14 bp, Homo sapiens
gaccacgctttcta

SEQ ID NO: 2871260 - DNA, 15 bp, Homo sapiens
gaccaggaaaggctt

SEQ ID NO: 2871261 - DNA, 18 bp, Homo sapiens
gctgaacataacttctca

SEQ ID NO: 2871262 - DNA, 22 bp, Homo sapiens
gctgacccagccccttgagaaa

SEQ ID NO: 2871263 - DNA, 12 bp, Homo sapiens
gctgagccatga

SEQ ID NO: 2871264 - DNA, 23 bp, Homo sapiens
gctgagcgaggagatgctccttg

SEQ ID NO: 2871265 - DNA, 19 bp, Homo sapiens
gctgaggctgagaaagcta

SEQ ID NO: 2871266 - DNA, 20 bp, Homo sapiens
gctgataccatatgaatgaa

SEQ ID NO: 2871267 - DNA, 15 bp, Homo sapiens
gctgatgaagaaggg

SEQ ID NO: 2871268 - DNA, 13 bp, Homo sapiens
gctgcacctctgg

SEQ ID NO: 2871269 - DNA, 17 bp, Homo sapiens
gctgccagctctgtatc

SEQ ID NO: 2871270 - DNA, 21 bp, Homo sapiens
gctgcccatcatgtggcccca

SEQ ID NO: 2871271 - DNA, 12 bp, Homo sapiens
gctgctgcctgc

SEQ ID NO: 2871272 - DNA, 14 bp, Homo sapiens
gctggactgaccaa

SEQ ID NO: 2871273 - DNA, 23 bp, Homo sapiens
gctggactgaccaaagactgcag

SEQ ID NO: 2871274 - DNA, 13 bp, Homo sapiens
gctgggcctcctg

SEQ ID NO: 2871275 - DNA, 18 bp, Homo sapiens
gctgggcctcctgcctcc

SEQ ID NO: 2871276 - DNA, 22 bp, Homo sapiens
gctgggcctcctgcctccgggc

SEQ ID NO: 2871277 - DNA, 14 bp, Homo sapiens
gctgtatcactgcc

SEQ ID NO: 2871278 - DNA, 17 bp, Homo sapiens
gctgtgagccttgcatg

SEQ ID NO: 2871279 - DNA, 18 bp, Homo sapiens
gctgtgtttgcagcctgc

SEQ ID NO: 2871280 - DNA, 15 bp, Homo sapiens
gctgttattcttgtt

SEQ ID NO: 2871281 - DNA, 18 bp, Homo sapiens
gctgttgttccattgaag

SEQ ID NO: 2871282 - DNA, 12 bp, Homo sapiens
gcttccattcca

SEQ ID NO: 2871283 - DNA, 14 bp, Homo sapiens
gcttccctgactca

SEQ ID NO: 2871284 - DNA, 18 bp, Homo sapiens
gcttccctgactcattct

SEQ ID NO: 2871285 - DNA, 20 bp, Homo sapiens
gcttcgggcccttcccacag

SEQ ID NO: 2871286 - DNA, 18 bp, Homo sapiens
gcttctctagctctctag

SEQ ID NO: 2871287 - DNA, 19 bp, Homo sapiens
gcttctctagctctctagg

SEQ ID NO: 2871288 - DNA, 21 bp, Homo sapiens
gcttctctagctctctaggcc

SEQ ID NO: 2871289 - DNA, 14 bp, Homo sapiens
gcttctctgggctg

SEQ ID NO: 2871290 - DNA, 17 bp, Homo sapiens
gcttctctgggctgaat

SEQ ID NO: 2871291 - DNA, 22 bp, Homo sapiens
gcttctctgtgaacgatttaga

SEQ ID NO: 2871292 - DNA, 13 bp, Homo sapiens
gcttgaacccagg

SEQ ID NO: 2871293 - DNA, 13 bp, Homo sapiens
gcttgagcctccc

SEQ ID NO: 2871294 - DNA, 21 bp, Homo sapiens
gcttgaggccaagatggctgc

SEQ ID NO: 2871295 - DNA, 22 bp, Homo sapiens
gcttgaggccaagatggctgct

SEQ ID NO: 2871296 - DNA, 23 bp, Homo sapiens
gctttgttttgcacactttgcca

SEQ ID NO: 2871297 - DNA, 19 bp, Homo sapiens
ggaaaggcttggctggtgt

SEQ ID NO: 2871298 - DNA, 13 bp, Homo sapiens
ggaagagaaacca

SEQ ID NO: 2871299 - DNA, 21 bp, Homo sapiens
ggaagctcttttctcctgcag

SEQ ID NO: 2871300 - DNA, 16 bp, Homo sapiens
ggaagctgggggaagg

SEQ ID NO: 2871301 - DNA, 22 bp, Homo sapiens
ggaagctgggggaagggtggtc

SEQ ID NO: 2871302 - DNA, 15 bp, Homo sapiens
ggaagcttgagcctc

SEQ ID NO: 2871303 - DNA, 17 bp, Homo sapiens
ggaagcttgagcctccc

SEQ ID NO: 2871304 - DNA, 20 bp, Homo sapiens
ggaagcttgagcctccccca

SEQ ID NO: 2871305 - DNA, 21 bp, Homo sapiens
ggaagtgaacccatattttaa

SEQ ID NO: 2871306 - DNA, 19 bp, Homo sapiens
ggaagttgccatgggaaac

SEQ ID NO: 2871307 - DNA, 20 bp, Homo sapiens
ggaataataggccacagaag

SEQ ID NO: 2871308 - DNA, 11 bp, Homo sapiens
ggacaaaatgg

SEQ ID NO: 2871309 - DNA, 14 bp, Homo sapiens
ggacaagggattct

SEQ ID NO: 2871310 - DNA, 17 bp, Homo sapiens
ggacagtaaacactcca

SEQ ID NO: 2871311 - DNA, 21 bp, Homo sapiens
ggacataagataaaatgatgt

SEQ ID NO: 2871312 - DNA, 22 bp, Homo sapiens
ggacataagataaaatgatgtt

SEQ ID NO: 2871313 - DNA, 14 bp, Homo sapiens
ggactccaggcctg

SEQ ID NO: 2871314 - DNA, 16 bp, Homo sapiens
ggactccaggcctgac

SEQ ID NO: 2871315 - DNA, 13 bp, Homo sapiens
ggactcctcccac

SEQ ID NO: 2871316 - DNA, 21 bp, Homo sapiens
ggactctcagtctctgagcag

SEQ ID NO: 2871317 - DNA, 17 bp, Homo sapiens
ggactggaggcccctgg

SEQ ID NO: 2871318 - DNA, 15 bp, Homo sapiens
ggactggcagaagca

SEQ ID NO: 2871319 - DNA, 18 bp, Homo sapiens
ggacttctgaagagacca

SEQ ID NO: 2871320 - DNA, 19 bp, Homo sapiens
ggacttgtttagagagcct

SEQ ID NO: 2871321 - DNA, 15 bp, Homo sapiens
ggagactgcccagct

SEQ ID NO: 2871322 - DNA, 23 bp, Homo sapiens
ggagactgggctgagggagcctg

SEQ ID NO: 2871323 - DNA, 15 bp, Homo sapiens
ggagagccagctctc

SEQ ID NO: 2871324 - DNA, 17 bp, Homo sapiens
ggagagccagctctctc

SEQ ID NO: 2871325 - DNA, 20 bp, Homo sapiens
ggagccaacagaagcttcca

SEQ ID NO: 2871326 - DNA, 21 bp, Homo sapiens
ggagccactcctctgactcag

SEQ ID NO: 2871327 - DNA, 21 bp, Homo sapiens
ggagccaggagtaagacaagt

SEQ ID NO: 2871328 - DNA, 17 bp, Homo sapiens
ggagccccattcctggg

SEQ ID NO: 2871329 - DNA, 23 bp, Homo sapiens
ggagcgtggactctgctagactc

SEQ ID NO: 2871330 - DNA, 23 bp, Homo sapiens
ggaggacttggttgatgtttaaa

SEQ ID NO: 2871331 - DNA, 15 bp, Homo sapiens
ggaggctccagaggg

SEQ ID NO: 2871332 - DNA, 13 bp, Homo sapiens
ggagggcagcagg

SEQ ID NO: 2871333 - DNA, 23 bp, Homo sapiens
ggagggccacatgggaggctcac

SEQ ID NO: 2871334 - DNA, 15 bp, Homo sapiens
ggaggtccagctggg

SEQ ID NO: 2871335 - DNA, 16 bp, Homo sapiens
ggagtaagacaagtgg

SEQ ID NO: 2871336 - DNA, 23 bp, Homo sapiens
ggagttgatcgcctttcccaggt

SEQ ID NO: 2871337 - DNA, 21 bp, Homo sapiens
ggataagaaagcctaaaattg

SEQ ID NO: 2871338 - DNA, 23 bp, Homo sapiens
ggatagtagttaaataactgtgt

SEQ ID NO: 2871339 - DNA, 15 bp, Homo sapiens
ggatccatgggggga

SEQ ID NO: 2871340 - DNA, 17 bp, Homo sapiens
ggatctcattggaccct

SEQ ID NO: 2871341 - DNA, 20 bp, Homo sapiens
ggatgaattgtcacatctat

SEQ ID NO: 2871342 - DNA, 23 bp, Homo sapiens
ggatgagaatttgagtgctctga

SEQ ID NO: 2871343 - DNA, 18 bp, Homo sapiens
ggatgccaaggagcccct

SEQ ID NO: 2871344 - DNA, 13 bp, Homo sapiens
ggcaaacccatca

SEQ ID NO: 2871345 - DNA, 17 bp, Homo sapiens
ggcaagagggtgacagc

SEQ ID NO: 2871346 - DNA, 14 bp, Homo sapiens
ggcaagcttgaggc

SEQ ID NO: 2871347 - DNA, 17 bp, Homo sapiens
ggcaagcttgaggccaa

SEQ ID NO: 2871348 - DNA, 19 bp, Homo sapiens
ggcaagcttgaggccaaga

SEQ ID NO: 2871349 - DNA, 21 bp, Homo sapiens
ggcaagcttgaggccaagatg

SEQ ID NO: 2871350 - DNA, 14 bp, Homo sapiens
ggcacattaactgt

SEQ ID NO: 2871351 - DNA, 22 bp, Homo sapiens
ggcagaagcattgcctggactg

SEQ ID NO: 2871352 - DNA, 13 bp, Homo sapiens
ggcagcagggcta

SEQ ID NO: 2871353 - DNA, 12 bp, Homo sapiens
ggcagctaagat

SEQ ID NO: 2871354 - DNA, 17 bp, Homo sapiens
ggcaggggtgggagagc

SEQ ID NO: 2871355 - DNA, 19 bp, Homo sapiens
ggcagtcgatagagctgta

SEQ ID NO: 2871356 - DNA, 20 bp, Homo sapiens
ggcattctttgcaatactgc

SEQ ID NO: 2871357 - DNA, 16 bp, Homo sapiens
ggccaagatggctgct

SEQ ID NO: 2871358 - DNA, 19 bp, Homo sapiens
ggccacagaaggtgaactt

SEQ ID NO: 2871359 - DNA, 19 bp, Homo sapiens
ggccacatgggaggctcac

SEQ ID NO: 2871360 - DNA, 14 bp, Homo sapiens
ggccatcagggtgg

SEQ ID NO: 2871361 - DNA, 17 bp, Homo sapiens
ggcccagagaccccttc

SEQ ID NO: 2871362 - DNA, 22 bp, Homo sapiens
ggcccagagaccccttcctttc

SEQ ID NO: 2871363 - DNA, 22 bp, Homo sapiens
ggccccaggcattgccaagggc

SEQ ID NO: 2871364 - DNA, 21 bp, Homo sapiens
ggcccgagatgtgacccacca

SEQ ID NO: 2871365 - DNA, 15 bp, Homo sapiens
ggccctcgctgccag

SEQ ID NO: 2871366 - DNA, 19 bp, Homo sapiens
ggccctcgctgccagctct

SEQ ID NO: 2871367 - DNA, 12 bp, Homo sapiens
ggccctggccct

SEQ ID NO: 2871368 - DNA, 23 bp, Homo sapiens
ggcctgagaaacactatttgtga

SEQ ID NO: 2871369 - DNA, 17 bp, Homo sapiens
ggccttcatcctcctcc

SEQ ID NO: 2871370 - DNA, 19 bp, Homo sapiens
ggctaccctgagctgaggc

SEQ ID NO: 2871371 - DNA, 19 bp, Homo sapiens
ggctagagccgaggggaga

SEQ ID NO: 2871372 - DNA, 22 bp, Homo sapiens
ggctcacccccttctccatcca

SEQ ID NO: 2871373 - DNA, 13 bp, Homo sapiens
ggctccagagggc

SEQ ID NO: 2871374 - DNA, 13 bp, Homo sapiens
ttgttgctgctgt

SEQ ID NO: 2871375 - DNA, 16 bp, Homo sapiens
ttgttgctgctgtttg

SEQ ID NO: 2871376 - DNA, 16 bp, Homo sapiens
ttgtttgtcagcatct

SEQ ID NO: 2871377 - DNA, 23 bp, Homo sapiens
ttgtttgtcagcatctgaccatc

SEQ ID NO: 2871378 - DNA, 13 bp, Homo sapiens
ttgttttgcactg

SEQ ID NO: 2871379 - DNA, 15 bp, Homo sapiens
tttaaaatctgtcac

SEQ ID NO: 2871380 - DNA, 11 bp, Homo sapiens
tttaaagcctt

SEQ ID NO: 2871381 - DNA, 18 bp, Homo sapiens
tttaacatacaagaaaat

SEQ ID NO: 2871382 - DNA, 19 bp, Homo sapiens
tttaacatacaagaaaatg

SEQ ID NO: 2871383 - DNA, 12 bp, Homo sapiens
tttaactgtgat

SEQ ID NO: 2871384 - DNA, 12 bp, Homo sapiens
tttaagctgttt

SEQ ID NO: 2871385 - DNA, 13 bp, Homo sapiens
tttaagctgtttc

SEQ ID NO: 2871386 - DNA, 18 bp, Homo sapiens
tttaagctgtttccatag

SEQ ID NO: 2871387 - DNA, 18 bp, Homo sapiens
tttaatagtcaccttcat

SEQ ID NO: 2871388 - DNA, 14 bp, Homo sapiens
tttactaactaaat

SEQ ID NO: 2871389 - DNA, 18 bp, Homo sapiens
tttactagggatccctca

SEQ ID NO: 2871390 - DNA, 18 bp, Homo sapiens
tttactgagcttctctgt

SEQ ID NO: 2871391 - DNA, 23 bp, Homo sapiens
tttagaagcctgacaactcattt

SEQ ID NO: 2871392 - DNA, 18 bp, Homo sapiens
tttatattaaataacatg

SEQ ID NO: 2871393 - DNA, 18 bp, Homo sapiens
tttatgatgacaatcaaa

SEQ ID NO: 2871394 - DNA, 17 bp, Homo sapiens
tttattattttcacctg

SEQ ID NO: 2871395 - DNA, 16 bp, Homo sapiens
tttattgcaatgcaga

SEQ ID NO: 2871396 - DNA, 21 bp, Homo sapiens
tttcacaatcttggggctgat

SEQ ID NO: 2871397 - DNA, 18 bp, Homo sapiens
tttcataagtatttcaaa

SEQ ID NO: 2871398 - DNA, 14 bp, Homo sapiens
tttcataatcagta

SEQ ID NO: 2871399 - DNA, 14 bp, Homo sapiens
tttccaaattaaaa

SEQ ID NO: 2871400 - DNA, 17 bp, Homo sapiens
tttccaaattaaaacaa

SEQ ID NO: 2871401 - DNA, 19 bp, Homo sapiens
tttccatagtgttaactgt

SEQ ID NO: 2871402 - DNA, 19 bp, Homo sapiens
tttcccaccaccttggact

SEQ ID NO: 2871403 - DNA, 23 bp, Homo sapiens
tttcccatctggctttttctgcc

SEQ ID NO: 2871404 - DNA, 17 bp, Homo sapiens
tttccctccagagaaag

SEQ ID NO: 2871405 - DNA, 21 bp, Homo sapiens
tttcctaataaagttctgtac

SEQ ID NO: 2871406 - DNA, 15 bp, Homo sapiens
tttcctacaaaatgg

SEQ ID NO: 2871407 - DNA, 17 bp, Homo sapiens
tttcctccccaccttcc

SEQ ID NO: 2871408 - DNA, 22 bp, Homo sapiens
tttccttttggcctcctgcaaa

SEQ ID NO: 2871409 - DNA, 14 bp, Homo sapiens
tttctaaactccct

SEQ ID NO: 2871410 - DNA, 22 bp, Homo sapiens
tttctaattgtaagtgaaatta

SEQ ID NO: 2871411 - DNA, 22 bp, Homo sapiens
tttctactttgaagtcatacca

SEQ ID NO: 2871412 - DNA, 14 bp, Homo sapiens
tttctatgacaaat

SEQ ID NO: 2871413 - DNA, 15 bp, Homo sapiens
tttctatgacaaatt

SEQ ID NO: 2871414 - DNA, 22 bp, Homo sapiens
tttctatttttatgatgacaat

SEQ ID NO: 2871415 - DNA, 12 bp, Homo sapiens
tttcttgtttgt

SEQ ID NO: 2871416 - DNA, 20 bp, Homo sapiens
tttgaaacaaagtactcttt

SEQ ID NO: 2871417 - DNA, 17 bp, Homo sapiens
tttgaaactcgagacca

SEQ ID NO: 2871418 - DNA, 18 bp, Homo sapiens
tttgaaattaacctctca

SEQ ID NO: 2871419 - DNA, 14 bp, Homo sapiens
tttgaactttggaa

SEQ ID NO: 2871420 - DNA, 21 bp, Homo sapiens
tttgagaaacaacaatttcta

SEQ ID NO: 2871421 - DNA, 13 bp, Homo sapiens
tttgagtgctctg

SEQ ID NO: 2871422 - DNA, 16 bp, Homo sapiens
tttgatttctaattgt

SEQ ID NO: 2871423 - DNA, 20 bp, Homo sapiens
tttgcaagggaaaagtctct

SEQ ID NO: 2871424 - DNA, 17 bp, Homo sapiens
tttgcataacaattcct

SEQ ID NO: 2871425 - DNA, 18 bp, Homo sapiens
tttgcataacaattcctc

SEQ ID NO: 2871426 - DNA, 20 bp, Homo sapiens
tttgcataacaattcctcta

SEQ ID NO: 2871427 - DNA, 12 bp, Homo sapiens
tttgccctttga

SEQ ID NO: 2871428 - DNA, 18 bp, Homo sapiens
tttggacttctgaagaga

SEQ ID NO: 2871429 - DNA, 20 bp, Homo sapiens
tttgtaagtgtaaaaaatgt

SEQ ID NO: 2871430 - DNA, 23 bp, Homo sapiens
tttgtcagcatctgaccatctgt

SEQ ID NO: 2871431 - DNA, 13 bp, Homo sapiens
tttgtccacttca

SEQ ID NO: 2871432 - DNA, 17 bp, Homo sapiens
tttgtctgtcttcatag

SEQ ID NO: 2871433 - DNA, 15 bp, Homo sapiens
tttgttcttcagatt

SEQ ID NO: 2871434 - DNA, 14 bp, Homo sapiens
ttttaaagccttct

SEQ ID NO: 2871435 - DNA, 19 bp, Homo sapiens
ttttaaagccttctggatc

SEQ ID NO: 2871436 - DNA, 22 bp, Homo sapiens
ttttaagataaattataagtta

SEQ ID NO: 2871437 - DNA, 12 bp, Homo sapiens
ttttaagctgtt

SEQ ID NO: 2871438 - DNA, 13 bp, Homo sapiens
ttttaatggcatt

SEQ ID NO: 2871439 - DNA, 14 bp, Homo sapiens
ttttcaatatttat

SEQ ID NO: 2871440 - DNA, 16 bp, Homo sapiens
ttttcaatatttatta

SEQ ID NO: 2871441 - DNA, 22 bp, Homo sapiens
ttttcggaaacactgacttagg

SEQ ID NO: 2871442 - DNA, 17 bp, Homo sapiens
ttttctaaataaaaata

SEQ ID NO: 2871443 - DNA, 15 bp, Homo sapiens
tgttgcctcttgcaa

SEQ ID NO: 2871444 - DNA, 18 bp, Homo sapiens
tgttgcctcttgcaatgc

SEQ ID NO: 2871445 - DNA, 15 bp, Homo sapiens
tgttggtgctttgca

SEQ ID NO: 2871446 - DNA, 15 bp, Homo sapiens
tgttgttgctgctgt

SEQ ID NO: 2871447 - DNA, 13 bp, Homo sapiens
tgtttactaggga

SEQ ID NO: 2871448 - DNA, 13 bp, Homo sapiens
tgtttagagagcc

SEQ ID NO: 2871449 - DNA, 20 bp, Homo sapiens
tgtttagagagcctgtcacc

SEQ ID NO: 2871450 - DNA, 23 bp, Homo sapiens
tgtttagagagcctgtcaccaga

SEQ ID NO: 2871451 - DNA, 23 bp, Homo sapiens
tgtttagattgtattaactatct

SEQ ID NO: 2871452 - DNA, 12 bp, Homo sapiens
tgtttcattatg

SEQ ID NO: 2871453 - DNA, 24 bp, Homo sapiens
tgtttctctataaagtatggtaat

SEQ ID NO: 2871454 - DNA, 16 bp, Homo sapiens
tgtttgtcagcatctg

SEQ ID NO: 2871455 - DNA, 18 bp, Homo sapiens
tgtttgtcagcatctgac

SEQ ID NO: 2871456 - DNA, 17 bp, Homo sapiens
tgtttgtctgtcttcat

SEQ ID NO: 2871457 - DNA, 15 bp, Homo sapiens
tgtttgtgctgtggt

SEQ ID NO: 2871458 - DNA, 21 bp, Homo sapiens
tgttttgcactgacaagatgg

SEQ ID NO: 2871459 - DNA, 20 bp, Homo sapiens
tgtttttaagctgtttccat

SEQ ID NO: 2871460 - DNA, 12 bp, Homo sapiens
ttaaaaaacaat

SEQ ID NO: 2871461 - DNA, 22 bp, Homo sapiens
ttaaaaaacaattaactgccct

SEQ ID NO: 2871462 - DNA, 17 bp, Homo sapiens
ttaaaacaaatatacat

SEQ ID NO: 2871463 - DNA, 13 bp, Homo sapiens
ttaaaagaaatat

SEQ ID NO: 2871464 - DNA, 19 bp, Homo sapiens
ttaaaaggtactggtacta

SEQ ID NO: 2871465 - DNA, 13 bp, Homo sapiens
ttaaaatcctcaa

SEQ ID NO: 2871466 - DNA, 13 bp, Homo sapiens
ttaaaatgttcac

SEQ ID NO: 2871467 - DNA, 21 bp, Homo sapiens
ttaaactatgttcctaacaaa

SEQ ID NO: 2871468 - DNA, 13 bp, Homo sapiens
ttaaagagataaa

SEQ ID NO: 2871469 - DNA, 14 bp, Homo sapiens
ttaaagagataaag

SEQ ID NO: 2871470 - DNA, 11 bp, Homo sapiens
ttaaagccttc

SEQ ID NO: 2871471 - DNA, 14 bp, Homo sapiens
ttaaataactgtgt

SEQ ID NO: 2871472 - DNA, 13 bp, Homo sapiens
ttaaatacagtct

SEQ ID NO: 2871473 - DNA, 16 bp, Homo sapiens
ttaaccctctcttccc

SEQ ID NO: 2871474 - DNA, 14 bp, Homo sapiens
ttaactagaattta

SEQ ID NO: 2871475 - DNA, 15 bp, Homo sapiens
ttaactagaatttat

SEQ ID NO: 2871476 - DNA, 21 bp, Homo sapiens
ttaactagaatttattcaatt

SEQ ID NO: 2871477 - DNA, 19 bp, Homo sapiens
ttaactatcttctttggac

SEQ ID NO: 2871478 - DNA, 12 bp, Homo sapiens
ttaactgtactg

SEQ ID NO: 2871479 - DNA, 14 bp, Homo sapiens
ttaagctgtttcca

SEQ ID NO: 2871480 - DNA, 14 bp, Homo sapiens
ttaatagatttggg

SEQ ID NO: 2871481 - DNA, 14 bp, Homo sapiens
ttaatgaagaaagt

SEQ ID NO: 2871482 - DNA, 22 bp, Homo sapiens
ttaatgccatctagctagcaat

SEQ ID NO: 2871483 - DNA, 19 bp, Homo sapiens
ttaatgctgtttctaagaa

SEQ ID NO: 2871484 - DNA, 22 bp, Homo sapiens
ttaatgctgtttctaagaaaat

SEQ ID NO: 2871485 - DNA, 24 bp, Homo sapiens
ttaatgctgtttctaagaaaatgt

SEQ ID NO: 2871486 - DNA, 16 bp, Homo sapiens
ttaatgggcacaaaat

SEQ ID NO: 2871487 - DNA, 18 bp, Homo sapiens
ttacactgcggaagccaa

SEQ ID NO: 2871488 - DNA, 19 bp, Homo sapiens
ttacagtaggagcccagct

SEQ ID NO: 2871489 - DNA, 17 bp, Homo sapiens
ttacattgtttgtctgt

SEQ ID NO: 2871490 - DNA, 17 bp, Homo sapiens
ttaccccaaagagaaag

SEQ ID NO: 2871491 - DNA, 11 bp, Homo sapiens
ttacctctgat

SEQ ID NO: 2871492 - DNA, 21 bp, Homo sapiens
ttacctctgatacctcaaccc

SEQ ID NO: 2871493 - DNA, 18 bp, Homo sapiens
ttactaactaaataccat

SEQ ID NO: 2871494 - DNA, 20 bp, Homo sapiens
ttactagggatccctcatct

SEQ ID NO: 2871495 - DNA, 16 bp, Homo sapiens
ttactgagcttctctg

SEQ ID NO: 2871496 - DNA, 16 bp, Homo sapiens
ttactgcaatcactgt

SEQ ID NO: 2871497 - DNA, 15 bp, Homo sapiens
ttacttgcttctcta

SEQ ID NO: 2871498 - DNA, 14 bp, Homo sapiens
ttactttttcccat

SEQ ID NO: 2871499 - DNA, 17 bp, Homo sapiens
ttactttttcccatctg

SEQ ID NO: 2871500 - DNA, 21 bp, Homo sapiens
ttagaaacaaacaaaactctt

SEQ ID NO: 2871501 - DNA, 22 bp, Homo sapiens
ttagaaagaagcccaatattat

SEQ ID NO: 2871502 - DNA, 23 bp, Homo sapiens
ttagaaataataaaaagaaagat

SEQ ID NO: 2871503 - DNA, 15 bp, Homo sapiens
ttagagagcctgtca

SEQ ID NO: 2871504 - DNA, 21 bp, Homo sapiens
ttagagggatgagacagacat

SEQ ID NO: 2871505 - DNA, 16 bp, Homo sapiens
ttagagtgtctttcca

SEQ ID NO: 2871506 - DNA, 20 bp, Homo sapiens
ttagatgggaggatgaattg

SEQ ID NO: 2871507 - DNA, 17 bp, Homo sapiens
ttaggccagcaacgctt

SEQ ID NO: 2871508 - DNA, 15 bp, Homo sapiens
ttagggcactgggct

SEQ ID NO: 2871509 - DNA, 21 bp, Homo sapiens
ttaggggaagtaaaacagtca

SEQ ID NO: 2871510 - DNA, 16 bp, Homo sapiens
ttaggtttcaggaagt

SEQ ID NO: 2871511 - DNA, 19 bp, Homo sapiens
ttagtggtcataaaataga

SEQ ID NO: 2871512 - DNA, 18 bp, Homo sapiens
ttataaataaaatcatgt

SEQ ID NO: 2871513 - DNA, 21 bp, Homo sapiens
ttataatactactactgttat

SEQ ID NO: 2871514 - DNA, 16 bp, Homo sapiens
ttataattttcctaat

SEQ ID NO: 2871515 - DNA, 19 bp, Homo sapiens
ttatacatcaatatgtata

SEQ ID NO: 2871516 - DNA, 17 bp, Homo sapiens
ttatagcaactaatgtt

SEQ ID NO: 2871517 - DNA, 19 bp, Homo sapiens
tgggattgagtctgtgcca

SEQ ID NO: 2871518 - DNA, 13 bp, Homo sapiens
tgggcagagccca

SEQ ID NO: 2871519 - DNA, 14 bp, Homo sapiens
tgggccactctccc

SEQ ID NO: 2871520 - DNA, 16 bp, Homo sapiens
tgggccctctctgctc

SEQ ID NO: 2871521 - DNA, 15 bp, Homo sapiens
tgggctccctgactg

SEQ ID NO: 2871522 - DNA, 11 bp, Homo sapiens
tgggctgaggg

SEQ ID NO: 2871523 - DNA, 12 bp, Homo sapiens
tgggctgaggga

SEQ ID NO: 2871524 - DNA, 22 bp, Homo sapiens
tggggagccaacagaagcttcc

SEQ ID NO: 2871525 - DNA, 15 bp, Homo sapiens
tggggagggacaagg

SEQ ID NO: 2871526 - DNA, 13 bp, Homo sapiens
tggggcctcaaga

SEQ ID NO: 2871527 - DNA, 20 bp, Homo sapiens
tggggctgatgaagaagggg

SEQ ID NO: 2871528 - DNA, 18 bp, Homo sapiens
tgggggagattgaacttt

SEQ ID NO: 2871529 - DNA, 21 bp, Homo sapiens
tggggtcaagaaacagccagc

SEQ ID NO: 2871530 - DNA, 17 bp, Homo sapiens
tgggtcatttagaagcc

SEQ ID NO: 2871531 - DNA, 17 bp, Homo sapiens
tgggtccatgggcagag

SEQ ID NO: 2871532 - DNA, 17 bp, Homo sapiens
tgggtgacagagcaaga

SEQ ID NO: 2871533 - DNA, 19 bp, Homo sapiens
tgggttttgtattctctga

SEQ ID NO: 2871534 - DNA, 14 bp, Homo sapiens
tggtaggttgggac

SEQ ID NO: 2871535 - DNA, 14 bp, Homo sapiens
tggtatgagggggt

SEQ ID NO: 2871536 - DNA, 17 bp, Homo sapiens
tggtatgagggggtggt

SEQ ID NO: 2871537 - DNA, 19 bp, Homo sapiens
tggtcagccctagggtgga

SEQ ID NO: 2871538 - DNA, 15 bp, Homo sapiens
tggtcataaaataga

SEQ ID NO: 2871539 - DNA, 21 bp, Homo sapiens
tggtcataaaatagaataatt

SEQ ID NO: 2871540 - DNA, 16 bp, Homo sapiens
tggtctgagcaccccc

SEQ ID NO: 2871541 - DNA, 19 bp, Homo sapiens
tggtctgccaatctgtaca

SEQ ID NO: 2871542 - DNA, 20 bp, Homo sapiens
tggtctgccaatctgtacaa

SEQ ID NO: 2871543 - DNA, 21 bp, Homo sapiens
tggtctgtgtaacatccaagc

SEQ ID NO: 2871544 - DNA, 18 bp, Homo sapiens
tggtgaagggaagtgggg

SEQ ID NO: 2871545 - DNA, 17 bp, Homo sapiens
tggtgggtccatgggca

SEQ ID NO: 2871546 - DNA, 18 bp, Homo sapiens
tggtgggtccatgggcag

SEQ ID NO: 2871547 - DNA, 17 bp, Homo sapiens
tggttctaactgctgtt

SEQ ID NO: 2871548 - DNA, 15 bp, Homo sapiens
tggttgatgtttaaa

SEQ ID NO: 2871549 - DNA, 17 bp, Homo sapiens
tgtaaatgaagatcttt

SEQ ID NO: 2871550 - DNA, 19 bp, Homo sapiens
tgtaaatgaagatctttat

SEQ ID NO: 2871551 - DNA, 15 bp, Homo sapiens
tgtaagtgaaattaa

SEQ ID NO: 2871552 - DNA, 22 bp, Homo sapiens
tgtaataatgtaacatgatttc

SEQ ID NO: 2871553 - DNA, 16 bp, Homo sapiens
tgtaatccgaatctct

SEQ ID NO: 2871554 - DNA, 15 bp, Homo sapiens
tgtaatcttgaattg

SEQ ID NO: 2871555 - DNA, 19 bp, Homo sapiens
tgtaattatgtaaataact

SEQ ID NO: 2871556 - DNA, 18 bp, Homo sapiens
tgtaatttcaaaatacat

SEQ ID NO: 2871557 - DNA, 23 bp, Homo sapiens
tgtagaaaatttgttattttgca

SEQ ID NO: 2871558 - DNA, 20 bp, Homo sapiens
tgtagaactcactctgggct

SEQ ID NO: 2871559 - DNA, 17 bp, Homo sapiens
tgtagaggcataaacct

SEQ ID NO: 2871560 - DNA, 23 bp, Homo sapiens
tgtatgggggagattgaactttc

SEQ ID NO: 2871561 - DNA, 22 bp, Homo sapiens
tgtatgtcaataaacaacagct

SEQ ID NO: 2871562 - DNA, 19 bp, Homo sapiens
tgtattctctgagctgtgc

SEQ ID NO: 2871563 - DNA, 13 bp, Homo sapiens
tgtatttttcaga

SEQ ID NO: 2871564 - DNA, 14 bp, Homo sapiens
tgtcaccagagctt

SEQ ID NO: 2871565 - DNA, 14 bp, Homo sapiens
tgtcacctgtgctt

SEQ ID NO: 2871566 - DNA, 15 bp, Homo sapiens
tgtcagcatctgacc

SEQ ID NO: 2871567 - DNA, 22 bp, Homo sapiens
tgtcagtgctataaatgccaga

SEQ ID NO: 2871568 - DNA, 11 bp, Homo sapiens
tgtcagtgttg

SEQ ID NO: 2871569 - DNA, 17 bp, Homo sapiens
tgtccattgtccaatcc

SEQ ID NO: 2871570 - DNA, 20 bp, Homo sapiens
tgtcccacccccttccccca

SEQ ID NO: 2871571 - DNA, 19 bp, Homo sapiens
tgtccccaccctccactca

SEQ ID NO: 2871572 - DNA, 18 bp, Homo sapiens
tgtccccctctgtccagg

SEQ ID NO: 2871573 - DNA, 16 bp, Homo sapiens
tgtcccttaaacaaaa

SEQ ID NO: 2871574 - DNA, 18 bp, Homo sapiens
tgtcctgcagcaaacact

SEQ ID NO: 2871575 - DNA, 15 bp, Homo sapiens
tgtccttccctgcca

SEQ ID NO: 2871576 - DNA, 17 bp, Homo sapiens
tgtctcatccatcatca

SEQ ID NO: 2871577 - DNA, 14 bp, Homo sapiens
tgtctgccacagag

SEQ ID NO: 2871578 - DNA, 16 bp, Homo sapiens
tgtcttatgtgaaaaa

SEQ ID NO: 2871579 - DNA, 22 bp, Homo sapiens
tgtcttatgtgaaaaattaact

SEQ ID NO: 2871580 - DNA, 22 bp, Homo sapiens
tgtcttgatgcatgcactgttc

SEQ ID NO: 2871581 - DNA, 12 bp, Homo sapiens
tgtgaaaaatta

SEQ ID NO: 2871582 - DNA, 14 bp, Homo sapiens
tgtgaaaaattaac

SEQ ID NO: 2871583 - DNA, 15 bp, Homo sapiens
tgtgaaaaattaact

SEQ ID NO: 2871584 - DNA, 18 bp, Homo sapiens
tgtgaaaatggtccagga

SEQ ID NO: 2871585 - DNA, 23 bp, Homo sapiens
tgtgaagagggacataagataaa

SEQ ID NO: 2871586 - DNA, 16 bp, Homo sapiens
tgtgaagtttggagat

SEQ ID NO: 2871587 - DNA, 19 bp, Homo sapiens
tgtgaagtttggagataga

SEQ ID NO: 2871588 - DNA, 17 bp, Homo sapiens
tgtgacagtttccaaat

SEQ ID NO: 2871589 - DNA, 16 bp, Homo sapiens
tgtgaccaatgtcttg

SEQ ID NO: 2871590 - DNA, 19 bp, Homo sapiens
tgtgacccaccagtgcctt

SEQ ID NO: 2871591 - DNA, 18 bp, Homo sapiens
tgtgactataaagctgtt

SEQ ID NO: 2871592 - DNA, 19 bp, Homo sapiens
tgtgactataaagctgtta

SEQ ID NO: 2871593 - DNA, 16 bp, Homo sapiens
aaaaatgggagccagg

SEQ ID NO: 2871594 - DNA, 14 bp, Homo sapiens
aaaaattaactttt

SEQ ID NO: 2871595 - DNA, 20 bp, Homo sapiens
aaaaattacctttaatttta

SEQ ID NO: 2871596 - DNA, 17 bp, Homo sapiens
aaaacaaatatacattt

SEQ ID NO: 2871597 - DNA, 22 bp, Homo sapiens
aaaacaatggtgtggtgaatgt

SEQ ID NO: 2871598 - DNA, 13 bp, Homo sapiens
aaaacactgtgca

SEQ ID NO: 2871599 - DNA, 20 bp, Homo sapiens
aaaacattttaagttttact

SEQ ID NO: 2871600 - DNA, 14 bp, Homo sapiens
aaaaccttttgaaa

SEQ ID NO: 2871601 - DNA, 11 bp, Homo sapiens
aaaagaaatat

SEQ ID NO: 2871602 - DNA, 21 bp, Homo sapiens
aaaagactggatttgcagaag

SEQ ID NO: 2871603 - DNA, 17 bp, Homo sapiens
aaaagggtcagaaggat

SEQ ID NO: 2871604 - DNA, 13 bp, Homo sapiens
aaaagtaaagatg

SEQ ID NO: 2871605 - DNA, 20 bp, Homo sapiens
aaaagtactaatagaacttg

SEQ ID NO: 2871606 - DNA, 22 bp, Homo sapiens
aaaagtagtgttgtccaggaag

SEQ ID NO: 2871607 - DNA, 12 bp, Homo sapiens
aaaataaaatgt

SEQ ID NO: 2871608 - DNA, 15 bp, Homo sapiens
aaaatatgtaatttc

SEQ ID NO: 2871609 - DNA, 21 bp, Homo sapiens
aaaatccccttcgctgaaatt

SEQ ID NO: 2871610 - DNA, 19 bp, Homo sapiens
aaaatgagagctgtaactg

SEQ ID NO: 2871611 - DNA, 16 bp, Homo sapiens
aaaatgatgttataca

SEQ ID NO: 2871612 - DNA, 23 bp, Homo sapiens
aaaatggtcctatttttgtgaag

SEQ ID NO: 2871613 - DNA, 22 bp, Homo sapiens
aaaatgtggtctgccaatctgt

SEQ ID NO: 2871614 - DNA, 22 bp, Homo sapiens
aaaatgtttcattatgcacttt

SEQ ID NO: 2871615 - DNA, 12 bp, Homo sapiens
aaaattaacttt

SEQ ID NO: 2871616 - DNA, 22 bp, Homo sapiens
aaaattatgttactgtattttt

SEQ ID NO: 2871617 - DNA, 17 bp, Homo sapiens
aaaattatttgctatgg

SEQ ID NO: 2871618 - DNA, 19 bp, Homo sapiens
aaacaaaaattaaaatcct

SEQ ID NO: 2871619 - DNA, 16 bp, Homo sapiens
aaacaacaatttctac

SEQ ID NO: 2871620 - DNA, 15 bp, Homo sapiens
aaacaacagctgaag

SEQ ID NO: 2871621 - DNA, 19 bp, Homo sapiens
aaacactatttgtgacttt

SEQ ID NO: 2871622 - DNA, 18 bp, Homo sapiens
aaacactccacattcttc

SEQ ID NO: 2871623 - DNA, 23 bp, Homo sapiens
aaacagttgctgtgaactttcat

SEQ ID NO: 2871624 - DNA, 19 bp, Homo sapiens
aaacatgaccctaaatctt

SEQ ID NO: 2871625 - DNA, 15 bp, Homo sapiens
aaacatgggctgtga

SEQ ID NO: 2871626 - DNA, 22 bp, Homo sapiens
aaacatgggctgtgattactgc

SEQ ID NO: 2871627 - DNA, 22 bp, Homo sapiens
aaacatttatgacaagctgtat

SEQ ID NO: 2871628 - DNA, 14 bp, Homo sapiens
aaaccaagatagat

SEQ ID NO: 2871629 - DNA, 19 bp, Homo sapiens
aaaccactttattgcaatg

SEQ ID NO: 2871630 - DNA, 12 bp, Homo sapiens
aaaccagggagc

SEQ ID NO: 2871631 - DNA, 17 bp, Homo sapiens
aaaccttattgtacctc

SEQ ID NO: 2871632 - DNA, 14 bp, Homo sapiens
aaactatgttccta

SEQ ID NO: 2871633 - DNA, 22 bp, Homo sapiens
aaactcgagaccataaagatat

SEQ ID NO: 2871634 - DNA, 18 bp, Homo sapiens
aaagaaatatattttttg

SEQ ID NO: 2871635 - DNA, 19 bp, Homo sapiens
aaagactggatttgcagaa

SEQ ID NO: 2871636 - DNA, 15 bp, Homo sapiens
aaagagaaagagttt

SEQ ID NO: 2871637 - DNA, 21 bp, Homo sapiens
aaagaggtggattcctgggca

SEQ ID NO: 2871638 - DNA, 14 bp, Homo sapiens
aaagagtttgaaac

SEQ ID NO: 2871639 - DNA, 14 bp, Homo sapiens
aaagcaatatgcat

SEQ ID NO: 2871640 - DNA, 21 bp, Homo sapiens
aaagccagcgtcctcctctgt

SEQ ID NO: 2871641 - DNA, 17 bp, Homo sapiens
aaagcctccgctgggct

SEQ ID NO: 2871642 - DNA, 17 bp, Homo sapiens
aaagctcttctttttta

SEQ ID NO: 2871643 - DNA, 12 bp, Homo sapiens
aaagctggactg

SEQ ID NO: 2871644 - DNA, 16 bp, Homo sapiens
aaagctggactgacca

SEQ ID NO: 2871645 - DNA, 21 bp, Homo sapiens
aaagctgttattcttgttata

SEQ ID NO: 2871646 - DNA, 14 bp, Homo sapiens
aaaggcaagcactt

SEQ ID NO: 2871647 - DNA, 14 bp, Homo sapiens
aaaggcaagcttga

SEQ ID NO: 2871648 - DNA, 14 bp, Homo sapiens
aaaggcagctaaga

SEQ ID NO: 2871649 - DNA, 20 bp, Homo sapiens
aaaggcagctaagatagaaa

SEQ ID NO: 2871650 - DNA, 17 bp, Homo sapiens
aaaggcttggctggtgt

SEQ ID NO: 2871651 - DNA, 14 bp, Homo sapiens
aaagtaacaatcta

SEQ ID NO: 2871652 - DNA, 16 bp, Homo sapiens
aaagtactctttaaca

SEQ ID NO: 2871653 - DNA, 13 bp, Homo sapiens
aaagtacttgact

SEQ ID NO: 2871654 - DNA, 23 bp, Homo sapiens
aaagtcaaaaaattatttgctat

SEQ ID NO: 2871655 - DNA, 12 bp, Homo sapiens
aaagtctcttgt

SEQ ID NO: 2871656 - DNA, 23 bp, Homo sapiens
aaagtggggagggacaagggatt

SEQ ID NO: 2871657 - DNA, 14 bp, Homo sapiens
aaataaaatgtttc

SEQ ID NO: 2871658 - DNA, 15 bp, Homo sapiens
aaataatttgaactt

SEQ ID NO: 2871659 - DNA, 19 bp, Homo sapiens
aaatacgtttgtgtttcta

SEQ ID NO: 2871660 - DNA, 15 bp, Homo sapiens
aaatatacattttct

SEQ ID NO: 2871661 - DNA, 17 bp, Homo sapiens
aaatatgtaatttcaaa

SEQ ID NO: 2871662 - DNA, 17 bp, Homo sapiens
aaatccagtttcccacc

SEQ ID NO: 2871663 - DNA, 15 bp, Homo sapiens
aaatgaaaatgtctt

SEQ ID NO: 2871664 - DNA, 16 bp, Homo sapiens
aaatgaaaatgtcttg

SEQ ID NO: 2871665 - DNA, 17 bp, Homo sapiens
aaatgaaaatgtcttgt

SEQ ID NO: 2871666 - DNA, 17 bp, Homo sapiens
aaatgacagatcttttt

SEQ ID NO: 2871667 - DNA, 12 bp, Homo sapiens
aaatgcatattt

SEQ ID NO: 2871668 - DNA, 14 bp, Homo sapiens
aaatgccagagcca

SEQ ID NO: 2871669 - DNA, 19 bp, Homo sapiens
aaatgccagagccaacctg

SEQ ID NO: 2871670 - DNA, 14 bp, Homo sapiens
aaatgggagccagg

SEQ ID NO: 2871671 - DNA, 16 bp, Homo sapiens
aaatgggagccaggag

SEQ ID NO: 2871672 - DNA, 22 bp, Homo sapiens
aaatggtcctatttttgtgaag

SEQ ID NO: 2871673 - DNA, 21 bp, Homo sapiens
aaatgtatccaaggaaacatt

SEQ ID NO: 2871674 - DNA, 13 bp, Homo sapiens
aaatgtcttgtgt

SEQ ID NO: 2871675 - DNA, 23 bp, Homo sapiens
aaatgtttcattatgcactttta

SEQ ID NO: 2871676 - DNA, 12 bp, Homo sapiens
aaattaaaacaa

SEQ ID NO: 2871677 - DNA, 23 bp, Homo sapiens
aaattaacttttttgtggcaatt

SEQ ID NO: 2871678 - DNA, 13 bp, Homo sapiens
aaattacctttaa

SEQ ID NO: 2871679 - DNA, 18 bp, Homo sapiens
aaattcaagagctagaaa

SEQ ID NO: 2871680 - DNA, 21 bp, Homo sapiens
aaattcaagagctagaaaaat

SEQ ID NO: 2871681 - DNA, 18 bp, Homo sapiens
aaattgccctatgctgtg

SEQ ID NO: 2871682 - DNA, 17 bp, Homo sapiens
aaatttgccaatctttc

SEQ ID NO: 2871683 - DNA, 16 bp, Homo sapiens
aaatttggttctaata

SEQ ID NO: 2871684 - DNA, 19 bp, Homo sapiens
aaatttgttattttgcaac

SEQ ID NO: 2871685 - DNA, 14 bp, Homo sapiens
aacaaaactcttaa

SEQ ID NO: 2871686 - DNA, 16 bp, Homo sapiens
aacaaacaaaactctt

SEQ ID NO: 2871687 - DNA, 12 bp, Homo sapiens
aacaaagtaaaa

SEQ ID NO: 2871688 - DNA, 19 bp, Homo sapiens
aacaaataatttgaacttt

SEQ ID NO: 2871689 - DNA, 16 bp, Homo sapiens
aacaatggtgtggtga

SEQ ID NO: 2871690 - DNA, 22 bp, Homo sapiens
aacaatggtgtggtgaatgtgt

SEQ ID NO: 2871691 - DNA, 21 bp, Homo sapiens
aacacagagctggcgactgca

SEQ ID NO: 2871692 - DNA, 16 bp, Homo sapiens
aacactatttgtgact

SEQ ID NO: 2871693 - DNA, 22 bp, Homo sapiens
aacactatttgtgactttttaa

SEQ ID NO: 2871694 - DNA, 20 bp, Homo sapiens
aacactgtgcacatctgtgt

SEQ ID NO: 2871695 - DNA, 16 bp, Homo sapiens
aacagaagcttccatt

SEQ ID NO: 2871696 - DNA, 15 bp, Homo sapiens
aacagggttggcatt

SEQ ID NO: 2871697 - DNA, 19 bp, Homo sapiens
aacagtcatctagaattca

SEQ ID NO: 2871698 - DNA, 20 bp, Homo sapiens
aacatgaccctaaatcttga

SEQ ID NO: 2871699 - DNA, 15 bp, Homo sapiens
aacatgggctgtgat

SEQ ID NO: 2871700 - DNA, 19 bp, Homo sapiens
aacatgggctgtgattact

SEQ ID NO: 2871701 - DNA, 21 bp, Homo sapiens
aacatgggctgtgattactgc

SEQ ID NO: 2871702 - DNA, 22 bp, Homo sapiens
aacatgggctgtgattactgca

SEQ ID NO: 2871703 - DNA, 18 bp, Homo sapiens
atttctactttgaagtca

SEQ ID NO: 2871704 - DNA, 12 bp, Homo sapiens
atttctatttat

SEQ ID NO: 2871705 - DNA, 19 bp, Homo sapiens
atttctctttaaactatgt

SEQ ID NO: 2871706 - DNA, 19 bp, Homo sapiens
atttggcaatgccatcatc

SEQ ID NO: 2871707 - DNA, 15 bp, Homo sapiens
atttggttctaatag

SEQ ID NO: 2871708 - DNA, 21 bp, Homo sapiens
atttgtgtgtgtgtgtgtgtt

SEQ ID NO: 2871709 - DNA, 17 bp, Homo sapiens
atttgttattttgcaac

SEQ ID NO: 2871710 - DNA, 13 bp, Homo sapiens
attttaaattctc

SEQ ID NO: 2871711 - DNA, 21 bp, Homo sapiens
attttaatgctgtttctaaga

SEQ ID NO: 2871712 - DNA, 12 bp, Homo sapiens
attttatcatta

SEQ ID NO: 2871713 - DNA, 17 bp, Homo sapiens
attttatcattaaaaat

SEQ ID NO: 2871714 - DNA, 15 bp, Homo sapiens
attttattacatatg

SEQ ID NO: 2871715 - DNA, 17 bp, Homo sapiens
attttcataatcagtaa

SEQ ID NO: 2871716 - DNA, 21 bp, Homo sapiens
attttcataatcagtaaatag

SEQ ID NO: 2871717 - DNA, 12 bp, Homo sapiens
attttctaaata

SEQ ID NO: 2871718 - DNA, 20 bp, Homo sapiens
attttgaaatgaactttgtc

SEQ ID NO: 2871719 - DNA, 13 bp, Homo sapiens
atttttcagaaat

SEQ ID NO: 2871720 - DNA, 21 bp, Homo sapiens
atttttgaaacccattaggca

SEQ ID NO: 2871721 - DNA, 13 bp, Homo sapiens
atttttgtgaaga

SEQ ID NO: 2871722 - DNA, 11 bp, Homo sapiens
attttttgaat

SEQ ID NO: 2871723 - DNA, 17 bp, Homo sapiens
atttttttaactgtgat

SEQ ID NO: 2871724 - DNA, 15 bp, Homo sapiens
atttttttcaatatt

SEQ ID NO: 2871725 - DNA, 17 bp, Homo sapiens
caaaaattagccgggca

SEQ ID NO: 2871726 - DNA, 14 bp, Homo sapiens
caaaacaatggtgt

SEQ ID NO: 2871727 - DNA, 18 bp, Homo sapiens
caaaatttatattttaga

SEQ ID NO: 2871728 - DNA, 15 bp, Homo sapiens
caaagcaaggaaact

SEQ ID NO: 2871729 - DNA, 16 bp, Homo sapiens
caaagcaatcttttat

SEQ ID NO: 2871730 - DNA, 21 bp, Homo sapiens
caaagccagcgtcctcctctg

SEQ ID NO: 2871731 - DNA, 22 bp, Homo sapiens
caaagccagcgtcctcctctgt

SEQ ID NO: 2871732 - DNA, 16 bp, Homo sapiens
caaagccggcctgaga

SEQ ID NO: 2871733 - DNA, 23 bp, Homo sapiens
caaagccggcctgagaaacacta

SEQ ID NO: 2871734 - DNA, 21 bp, Homo sapiens
caaaggcagctaagatagaaa

SEQ ID NO: 2871735 - DNA, 20 bp, Homo sapiens
caaagtactctttaacatac

SEQ ID NO: 2871736 - DNA, 16 bp, Homo sapiens
caaataaaatatcata

SEQ ID NO: 2871737 - DNA, 20 bp, Homo sapiens
caaataaactgactttttcc

SEQ ID NO: 2871738 - DNA, 20 bp, Homo sapiens
caaataatttgaactttgga

SEQ ID NO: 2871739 - DNA, 17 bp, Homo sapiens
caaatatacattttcta

SEQ ID NO: 2871740 - DNA, 22 bp, Homo sapiens
caaatgaagaaagtcaaaaaat

SEQ ID NO: 2871741 - DNA, 18 bp, Homo sapiens
caaatgacagatcttttt

SEQ ID NO: 2871742 - DNA, 14 bp, Homo sapiens
caaattaaaacaaa

SEQ ID NO: 2871743 - DNA, 15 bp, Homo sapiens
caaattaaaacaaat

SEQ ID NO: 2871744 - DNA, 21 bp, Homo sapiens
caaattaaaacaaatatacat

SEQ ID NO: 2871745 - DNA, 21 bp, Homo sapiens
caaattcaagagctagaaaaa

SEQ ID NO: 2871746 - DNA, 22 bp, Homo sapiens
caacactgtccttccctgccac

SEQ ID NO: 2871747 - DNA, 23 bp, Homo sapiens
caacactgtccttccctgccact

SEQ ID NO: 2871748 - DNA, 22 bp, Homo sapiens
caaccaggccttcatcctcctc

SEQ ID NO: 2871749 - DNA, 13 bp, Homo sapiens
caacctggacttc

SEQ ID NO: 2871750 - DNA, 16 bp, Homo sapiens
caacctggacttcctg

SEQ ID NO: 2871751 - DNA, 20 bp, Homo sapiens
caacctggacttcctgtcat

SEQ ID NO: 2871752 - DNA, 18 bp, Homo sapiens
caaccttagatgttctaa

SEQ ID NO: 2871753 - DNA, 14 bp, Homo sapiens
caactctttgagaa

SEQ ID NO: 2871754 - DNA, 16 bp, Homo sapiens
caactctttgagaaac

SEQ ID NO: 2871755 - DNA, 14 bp, Homo sapiens
caagaaacagaagt

SEQ ID NO: 2871756 - DNA, 15 bp, Homo sapiens
caagaaacagaagta

SEQ ID NO: 2871757 - DNA, 20 bp, Homo sapiens
caagaaatatactctcccag

SEQ ID NO: 2871758 - DNA, 14 bp, Homo sapiens
caagaatgaaaaat

SEQ ID NO: 2871759 - DNA, 23 bp, Homo sapiens
caagatattttaaaatctgtcac

SEQ ID NO: 2871760 - DNA, 21 bp, Homo sapiens
caagatggaaaataaattata

SEQ ID NO: 2871761 - DNA, 15 bp, Homo sapiens
caagatggctgctgc

SEQ ID NO: 2871762 - DNA, 15 bp, Homo sapiens
caagcttgaggccaa

SEQ ID NO: 2871763 - DNA, 15 bp, Homo sapiens
caaggaaacatttta

SEQ ID NO: 2871764 - DNA, 22 bp, Homo sapiens
caaggaaaggcatgtacaaaaa

SEQ ID NO: 2871765 - DNA, 17 bp, Homo sapiens
caagggaaaggcaagct

SEQ ID NO: 2871766 - DNA, 18 bp, Homo sapiens
caagggaaaggcaagctt

SEQ ID NO: 2871767 - DNA, 17 bp, Homo sapiens
caaggtttacactgcgg

SEQ ID NO: 2871768 - DNA, 14 bp, Homo sapiens
caataaacagtcac

SEQ ID NO: 2871769 - DNA, 13 bp, Homo sapiens
caatacaaaatgt

SEQ ID NO: 2871770 - DNA, 12 bp, Homo sapiens
caatatgtatat

SEQ ID NO: 2871771 - DNA, 19 bp, Homo sapiens
caatatttattattttcac

SEQ ID NO: 2871772 - DNA, 14 bp, Homo sapiens
caatcctatgtttt

SEQ ID NO: 2871773 - DNA, 11 bp, Homo sapiens
caatcctggac

SEQ ID NO: 2871774 - DNA, 19 bp, Homo sapiens
caatctatggcttatttct

SEQ ID NO: 2871775 - DNA, 20 bp, Homo sapiens
caatctatggcttatttcta

SEQ ID NO: 2871776 - DNA, 15 bp, Homo sapiens
caatctgggactttc

SEQ ID NO: 2871777 - DNA, 15 bp, Homo sapiens
caatctgtacaaaat

SEQ ID NO: 2871778 - DNA, 20 bp, Homo sapiens
caatctttcctactttctat

SEQ ID NO: 2871779 - DNA, 13 bp, Homo sapiens
caatgccatcatc

SEQ ID NO: 2871780 - DNA, 15 bp, Homo sapiens
caatgcctcagtagc

SEQ ID NO: 2871781 - DNA, 22 bp, Homo sapiens
caatgtagaggcataaacctgt

SEQ ID NO: 2871782 - DNA, 23 bp, Homo sapiens
caatgtcttgatgcatgcactgt

SEQ ID NO: 2871783 - DNA, 21 bp, Homo sapiens
caattaaaaacgaaaacctga

SEQ ID NO: 2871784 - DNA, 11 bp, Homo sapiens
caattaactgc

SEQ ID NO: 2871785 - DNA, 19 bp, Homo sapiens
caattagtggtcataaaat

SEQ ID NO: 2871786 - DNA, 23 bp, Homo sapiens
caattagtgtgacagtttccaaa

SEQ ID NO: 2871787 - DNA, 13 bp, Homo sapiens
caattcagtgttc

SEQ ID NO: 2871788 - DNA, 12 bp, Homo sapiens
caattccaggct

SEQ ID NO: 2871789 - DNA, 19 bp, Homo sapiens
caattccaggctgagccat

SEQ ID NO: 2871790 - DNA, 15 bp, Homo sapiens
caattcctctgggaa

SEQ ID NO: 2871791 - DNA, 23 bp, Homo sapiens
caattgcgaccttaatttaactt

SEQ ID NO: 2871792 - DNA, 13 bp, Homo sapiens
caatttaaaacaa

SEQ ID NO: 2871793 - DNA, 16 bp, Homo sapiens
caatttctactttgaa

SEQ ID NO: 2871794 - DNA, 22 bp, Homo sapiens
cacaaaataaccaatcctggac

SEQ ID NO: 2871795 - DNA, 22 bp, Homo sapiens
cacagagctggcgactgcagct

SEQ ID NO: 2871796 - DNA, 11 bp, Homo sapiens
cacagccatag

SEQ ID NO: 2871797 - DNA, 17 bp, Homo sapiens
cacagcctcccctgcca

SEQ ID NO: 2871798 - DNA, 20 bp, Homo sapiens
cacagcctcccctgccaggg

SEQ ID NO: 2871799 - DNA, 21 bp, Homo sapiens
cacagcctcccctgccagggc

SEQ ID NO: 2871800 - DNA, 15 bp, Homo sapiens
cacaggacatttctc

SEQ ID NO: 2871801 - DNA, 22 bp, Homo sapiens
cacatcctccacgttctgctca

SEQ ID NO: 2871802 - DNA, 12 bp, Homo sapiens
cacatctgtgtc

SEQ ID NO: 2871803 - DNA, 23 bp, Homo sapiens
cacatctgtgtcttgtttggaat

SEQ ID NO: 2871804 - DNA, 18 bp, Homo sapiens
cacatgcatcatcagcct

SEQ ID NO: 2871805 - DNA, 16 bp, Homo sapiens
cacatggggcctggcc

SEQ ID NO: 2871806 - DNA, 14 bp, Homo sapiens
cacattaactgttg

SEQ ID NO: 2871807 - DNA, 13 bp, Homo sapiens
caccaaccaggcc

SEQ ID NO: 2871808 - DNA, 14 bp, Homo sapiens
caccaaccaggcct

SEQ ID NO: 2871809 - DNA, 19 bp, Homo sapiens
caccaccttggactcctcc

SEQ ID NO: 2871810 - DNA, 23 bp, Homo sapiens
caccaccttggactcctcccaca

SEQ ID NO: 2871811 - DNA, 16 bp, Homo sapiens
caccagagcttctctg

SEQ ID NO: 2871812 - DNA, 22 bp, Homo sapiens
caccagagcttctctgggctga

SEQ ID NO: 2871813 - DNA, 14 bp, Homo sapiens
cccgaacagggact

SEQ ID NO: 2871814 - DNA, 22 bp, Homo sapiens
cccgcttttgttcttccccaca

SEQ ID NO: 2871815 - DNA, 22 bp, Homo sapiens
cccggcccagagaccccttcct

SEQ ID NO: 2871816 - DNA, 17 bp, Homo sapiens
ccctaagtgcccaaagt

SEQ ID NO: 2871817 - DNA, 17 bp, Homo sapiens
ccctagaaacttccaaa

SEQ ID NO: 2871818 - DNA, 13 bp, Homo sapiens
ccctatcagttga

SEQ ID NO: 2871819 - DNA, 12 bp, Homo sapiens
ccctccaccttc

SEQ ID NO: 2871820 - DNA, 18 bp, Homo sapiens
ccctcctccagcccctgt

SEQ ID NO: 2871821 - DNA, 21 bp, Homo sapiens
ccctcctccagcccctgtccc

SEQ ID NO: 2871822 - DNA, 19 bp, Homo sapiens
ccctcggaggtccagctgg

SEQ ID NO: 2871823 - DNA, 20 bp, Homo sapiens
ccctcggaggtccagctggg

SEQ ID NO: 2871824 - DNA, 18 bp, Homo sapiens
ccctctacagagcttccc

SEQ ID NO: 2871825 - DNA, 14 bp, Homo sapiens
ccctctctgctctg

SEQ ID NO: 2871826 - DNA, 13 bp, Homo sapiens
ccctctcttccct

SEQ ID NO: 2871827 - DNA, 15 bp, Homo sapiens
ccctctcttccctat

SEQ ID NO: 2871828 - DNA, 14 bp, Homo sapiens
ccctcttccttccc

SEQ ID NO: 2871829 - DNA, 16 bp, Homo sapiens
ccctcttccttccccc

SEQ ID NO: 2871830 - DNA, 17 bp, Homo sapiens
ccctcttccttccccca

SEQ ID NO: 2871831 - DNA, 20 bp, Homo sapiens
ccctctttcttgtttgtcag

SEQ ID NO: 2871832 - DNA, 14 bp, Homo sapiens
ccctgagctgaggc

SEQ ID NO: 2871833 - DNA, 21 bp, Homo sapiens
ccctgagctgaggcagcagtg

SEQ ID NO: 2871834 - DNA, 20 bp, Homo sapiens
ccctgcaaaaggactctcag

SEQ ID NO: 2871835 - DNA, 22 bp, Homo sapiens
ccctgtcccacccccttccccc

SEQ ID NO: 2871836 - DNA, 23 bp, Homo sapiens
cccttcccacaggacatttctct

SEQ ID NO: 2871837 - DNA, 18 bp, Homo sapiens
cccttcccagaccaggaa

SEQ ID NO: 2871838 - DNA, 21 bp, Homo sapiens
cccttcccccagcccatccat

SEQ ID NO: 2871839 - DNA, 14 bp, Homo sapiens
cccttcctttcctc

SEQ ID NO: 2871840 - DNA, 15 bp, Homo sapiens
cccttcctttcctct

SEQ ID NO: 2871841 - DNA, 23 bp, Homo sapiens
cccttctccatccacatgggagc

SEQ ID NO: 2871842 - DNA, 13 bp, Homo sapiens
ccctttcctcccc

SEQ ID NO: 2871843 - DNA, 13 bp, Homo sapiens
ccgactctggccc

SEQ ID NO: 2871844 - DNA, 14 bp, Homo sapiens
ccgactctggccct

SEQ ID NO: 2871845 - DNA, 14 bp, Homo sapiens
ccgcagcagggaag

SEQ ID NO: 2871846 - DNA, 23 bp, Homo sapiens
ccgctgggcttcattccggactg

SEQ ID NO: 2871847 - DNA, 18 bp, Homo sapiens
ccgcttggagcagagggg

SEQ ID NO: 2871848 - DNA, 19 bp, Homo sapiens
ccggatgaaacttctcagt

SEQ ID NO: 2871849 - DNA, 19 bp, Homo sapiens
ccggcccagagaccccttc

SEQ ID NO: 2871850 - DNA, 20 bp, Homo sapiens
ccggcccagagaccccttcc

SEQ ID NO: 2871851 - DNA, 20 bp, Homo sapiens
ccgggtggaaaagaatccct

SEQ ID NO: 2871852 - DNA, 14 bp, Homo sapiens
ccgtggtcctttgg

SEQ ID NO: 2871853 - DNA, 21 bp, Homo sapiens
cctaataaagttctgtactca

SEQ ID NO: 2871854 - DNA, 13 bp, Homo sapiens
cctacaaaatgga

SEQ ID NO: 2871855 - DNA, 15 bp, Homo sapiens
cctacatatttgtat

SEQ ID NO: 2871856 - DNA, 17 bp, Homo sapiens
cctactttctattttta

SEQ ID NO: 2871857 - DNA, 22 bp, Homo sapiens
cctagatctgcaggctgcacct

SEQ ID NO: 2871858 - DNA, 21 bp, Homo sapiens
cctagtgaaggcttctctctg

SEQ ID NO: 2871859 - DNA, 23 bp, Homo sapiens
cctagtgaaggcttctctctgtg

SEQ ID NO: 2871860 - DNA, 22 bp, Homo sapiens
cctatacgcagcgtgctttaaa

SEQ ID NO: 2871861 - DNA, 19 bp, Homo sapiens
cctattatttccgggtgga

SEQ ID NO: 2871862 - DNA, 13 bp, Homo sapiens
cctcaggagagac

SEQ ID NO: 2871863 - DNA, 20 bp, Homo sapiens
cctcagtagcatctcagtgg

SEQ ID NO: 2871864 - DNA, 15 bp, Homo sapiens
cctcatctgtccctc

SEQ ID NO: 2871865 - DNA, 17 bp, Homo sapiens
cctcatcttcttcacca

SEQ ID NO: 2871866 - DNA, 14 bp, Homo sapiens
cctccacatcctcc

SEQ ID NO: 2871867 - DNA, 18 bp, Homo sapiens
cctccacgttctgctcat

SEQ ID NO: 2871868 - DNA, 21 bp, Homo sapiens
cctccactcagctgtcctgca

SEQ ID NO: 2871869 - DNA, 14 bp, Homo sapiens
cctccagcccctgt

SEQ ID NO: 2871870 - DNA, 17 bp, Homo sapiens
cctccagcccctgtccc

SEQ ID NO: 2871871 - DNA, 18 bp, Homo sapiens
cctccagcccctgtccca

SEQ ID NO: 2871872 - DNA, 21 bp, Homo sapiens
cctcccacccacagccataga

SEQ ID NO: 2871873 - DNA, 18 bp, Homo sapiens
cctccccaccttccccag

SEQ ID NO: 2871874 - DNA, 19 bp, Homo sapiens
cctccccaccttccccaga

SEQ ID NO: 2871875 - DNA, 23 bp, Homo sapiens
cctccccaccttccccagactca

SEQ ID NO: 2871876 - DNA, 13 bp, Homo sapiens
cctcccccaaagc

SEQ ID NO: 2871877 - DNA, 15 bp, Homo sapiens
cctcccctccgcagc

SEQ ID NO: 2871878 - DNA, 18 bp, Homo sapiens
cctcccctccgcagcagg

SEQ ID NO: 2871879 - DNA, 18 bp, Homo sapiens
cctcccctgccagggcag

SEQ ID NO: 2871880 - DNA, 13 bp, Homo sapiens
cctccctctaatt

SEQ ID NO: 2871881 - DNA, 19 bp, Homo sapiens
cctccctctcccaggcccg

SEQ ID NO: 2871882 - DNA, 17 bp, Homo sapiens
cctccctcttccttccc

SEQ ID NO: 2871883 - DNA, 18 bp, Homo sapiens
cctccgcagcagggaagc

SEQ ID NO: 2871884 - DNA, 20 bp, Homo sapiens
cctcctccagcccctgtccc

SEQ ID NO: 2871885 - DNA, 15 bp, Homo sapiens
cctcctccccagctc

SEQ ID NO: 2871886 - DNA, 20 bp, Homo sapiens
cctcgctgccagctctgtat

SEQ ID NO: 2871887 - DNA, 20 bp, Homo sapiens
cctcggaggtccagctgggc

SEQ ID NO: 2871888 - DNA, 20 bp, Homo sapiens
cctctccagtttgcacctgt

SEQ ID NO: 2871889 - DNA, 14 bp, Homo sapiens
cctctcccaggccc

SEQ ID NO: 2871890 - DNA, 18 bp, Homo sapiens
cctctcccaggcccgaga

SEQ ID NO: 2871891 - DNA, 15 bp, Homo sapiens
cctctctgctctgcg

SEQ ID NO: 2871892 - DNA, 12 bp, Homo sapiens
cctctgactcag

SEQ ID NO: 2871893 - DNA, 22 bp, Homo sapiens
cctctgactcagggctcctggg

SEQ ID NO: 2871894 - DNA, 15 bp, Homo sapiens
cctctggctagagcc

SEQ ID NO: 2871895 - DNA, 15 bp, Homo sapiens
cctctgtccaggcac

SEQ ID NO: 2871896 - DNA, 19 bp, Homo sapiens
cctctgtccaggcactgag

SEQ ID NO: 2871897 - DNA, 14 bp, Homo sapiens
cctcttcagaggcc

SEQ ID NO: 2871898 - DNA, 14 bp, Homo sapiens
cctcttccttcccc

SEQ ID NO: 2871899 - DNA, 13 bp, Homo sapiens
cctcttctgggag

SEQ ID NO: 2871900 - DNA, 21 bp, Homo sapiens
cctctttcttgtttgtcagca

SEQ ID NO: 2871901 - DNA, 22 bp, Homo sapiens
cctgacaactcattttcatatt

SEQ ID NO: 2871902 - DNA, 23 bp, Homo sapiens
cctgaccagggggcccgaacagg

SEQ ID NO: 2871903 - DNA, 15 bp, Homo sapiens
cctgagctgaggcag

SEQ ID NO: 2871904 - DNA, 18 bp, Homo sapiens
cctgaggaacccttacag

SEQ ID NO: 2871905 - DNA, 13 bp, Homo sapiens
cctgatcagagcc

SEQ ID NO: 2871906 - DNA, 24 bp, Homo sapiens
cctgcagcaaacactccaccctcc

SEQ ID NO: 2871907 - DNA, 12 bp, Homo sapiens
cctgccacagcc

SEQ ID NO: 2871908 - DNA, 19 bp, Homo sapiens
cctgccagggcagggcccc

SEQ ID NO: 2871909 - DNA, 17 bp, Homo sapiens
cctgctctagtgggaca

SEQ ID NO: 2871910 - DNA, 21 bp, Homo sapiens
cctggacatgaagattctttc

SEQ ID NO: 2871911 - DNA, 24 bp, Homo sapiens
cctggacatgaagattctttccca

SEQ ID NO: 2871912 - DNA, 14 bp, Homo sapiens
cctggacttcctgt

SEQ ID NO: 2871913 - DNA, 12 bp, Homo sapiens
cctggagccaga

SEQ ID NO: 2871914 - DNA, 21 bp, Homo sapiens
cctggatgccaaggagcccct

SEQ ID NO: 2871915 - DNA, 12 bp, Homo sapiens
cctggctgccca

SEQ ID NO: 2871916 - DNA, 18 bp, Homo sapiens
cctgggaaatattcccta

SEQ ID NO: 2871917 - DNA, 13 bp, Homo sapiens
cctgggcaaagcc

SEQ ID NO: 2871918 - DNA, 18 bp, Homo sapiens
cctgggccctctctgctc

SEQ ID NO: 2871919 - DNA, 14 bp, Homo sapiens
cctgggggtgccag

SEQ ID NO: 2871920 - DNA, 16 bp, Homo sapiens
cctgggggtgccagga

SEQ ID NO: 2871921 - DNA, 23 bp, Homo sapiens
cctgggttttgtattctctgagc

SEQ ID NO: 2871922 - DNA, 20 bp, Homo sapiens
cctgtattactgaataatat

SEQ ID NO: 2871923 - DNA, 15 bp, Homo sapiens
ctgtaacctcttcag

SEQ ID NO: 2871924 - DNA, 24 bp, Homo sapiens
ctgtagggtaattagtaacatgtg

SEQ ID NO: 2871925 - DNA, 16 bp, Homo sapiens
ctgtatcaggacccag

SEQ ID NO: 2871926 - DNA, 22 bp, Homo sapiens
ctgtatgggggagattgaactt

SEQ ID NO: 2871927 - DNA, 21 bp, Homo sapiens
ctgtattactgaataatatca

SEQ ID NO: 2871928 - DNA, 23 bp, Homo sapiens
ctgtattactgaataatatcaaa

SEQ ID NO: 2871929 - DNA, 13 bp, Homo sapiens
ctgtatttttcag

SEQ ID NO: 2871930 - DNA, 21 bp, Homo sapiens
ctgtcaccagagcttctctgg

SEQ ID NO: 2871931 - DNA, 16 bp, Homo sapiens
ctgtccaggcactgag

SEQ ID NO: 2871932 - DNA, 12 bp, Homo sapiens
ctgtccccaccc

SEQ ID NO: 2871933 - DNA, 23 bp, Homo sapiens
ctgtcctgcagcaaacactccac

SEQ ID NO: 2871934 - DNA, 16 bp, Homo sapiens
ctgtccttccctgcca

SEQ ID NO: 2871935 - DNA, 18 bp, Homo sapiens
ctgtccttccctgccact

SEQ ID NO: 2871936 - DNA, 12 bp, Homo sapiens
ctgtctcatcca

SEQ ID NO: 2871937 - DNA, 15 bp, Homo sapiens
ctgtctcatccatca

SEQ ID NO: 2871938 - DNA, 17 bp, Homo sapiens
ctgtgaccaatgtcttg

SEQ ID NO: 2871939 - DNA, 17 bp, Homo sapiens
ctgtgactataaagctg

SEQ ID NO: 2871940 - DNA, 16 bp, Homo sapiens
ctgtgattactgcaat

SEQ ID NO: 2871941 - DNA, 18 bp, Homo sapiens
ctgtgcacatctgtgtct

SEQ ID NO: 2871942 - DNA, 19 bp, Homo sapiens
ctgtgcacatctgtgtctt

SEQ ID NO: 2871943 - DNA, 21 bp, Homo sapiens
ctgtgcacatctgtgtcttgt

SEQ ID NO: 2871944 - DNA, 16 bp, Homo sapiens
ctgtgcagccgctgag

SEQ ID NO: 2871945 - DNA, 19 bp, Homo sapiens
ctgtgcagccgctgagcga

SEQ ID NO: 2871946 - DNA, 23 bp, Homo sapiens
ctgtgctccatatttgatttcta

SEQ ID NO: 2871947 - DNA, 15 bp, Homo sapiens
ctgtggtgtgtcccc

SEQ ID NO: 2871948 - DNA, 19 bp, Homo sapiens
ctgtgtaacatccaagcca

SEQ ID NO: 2871949 - DNA, 20 bp, Homo sapiens
ctgtgtaacatccaagccag

SEQ ID NO: 2871950 - DNA, 21 bp, Homo sapiens
ctgtgtaaccagctcagtgtt

SEQ ID NO: 2871951 - DNA, 15 bp, Homo sapiens
ctgtgtttgcagcct

SEQ ID NO: 2871952 - DNA, 13 bp, Homo sapiens
ctgttattcttgt

SEQ ID NO: 2871953 - DNA, 12 bp, Homo sapiens
ctgttccccctg

SEQ ID NO: 2871954 - DNA, 22 bp, Homo sapiens
ctgttctgatcggccagttttc

SEQ ID NO: 2871955 - DNA, 12 bp, Homo sapiens
ctgttgcacttt

SEQ ID NO: 2871956 - DNA, 19 bp, Homo sapiens
ctgttgcacttttgaatgt

SEQ ID NO: 2871957 - DNA, 18 bp, Homo sapiens
ctgttgctatagagccta

SEQ ID NO: 2871958 - DNA, 12 bp, Homo sapiens
ctgtttctaaga

SEQ ID NO: 2871959 - DNA, 21 bp, Homo sapiens
ctgtttgggttgttggtctgt

SEQ ID NO: 2871960 - DNA, 23 bp, Homo sapiens
ctgtttgggttgttggtctgtgt

SEQ ID NO: 2871961 - DNA, 18 bp, Homo sapiens
ctgtttttaagctgtttc

SEQ ID NO: 2871962 - DNA, 20 bp, Homo sapiens
cttaaaaggtactggtacta

SEQ ID NO: 2871963 - DNA, 23 bp, Homo sapiens
cttaagtcctaaaagttctcaat

SEQ ID NO: 2871964 - DNA, 16 bp, Homo sapiens
cttacagtaggagccc

SEQ ID NO: 2871965 - DNA, 18 bp, Homo sapiens
cttagatgttctaagtct

SEQ ID NO: 2871966 - DNA, 19 bp, Homo sapiens
cttagctgaggctgagaaa

SEQ ID NO: 2871967 - DNA, 21 bp, Homo sapiens
cttagctgaggctgagaaagc

SEQ ID NO: 2871968 - DNA, 17 bp, Homo sapiens
cttaggaagagaaacca

SEQ ID NO: 2871969 - DNA, 22 bp, Homo sapiens
cttaggaagagaaaccagggag

SEQ ID NO: 2871970 - DNA, 20 bp, Homo sapiens
cttatagaatatttattacc

SEQ ID NO: 2871971 - DNA, 15 bp, Homo sapiens
cttatgaaaagtact

SEQ ID NO: 2871972 - DNA, 16 bp, Homo sapiens
cttatgtgaaaaatta

SEQ ID NO: 2871973 - DNA, 19 bp, Homo sapiens
cttatgtgaaaaattaact

SEQ ID NO: 2871974 - DNA, 14 bp, Homo sapiens
cttattgtacctct

SEQ ID NO: 2871975 - DNA, 16 bp, Homo sapiens
cttcaacccccagcta

SEQ ID NO: 2871976 - DNA, 16 bp, Homo sapiens
cttcagcattgtaatt

SEQ ID NO: 2871977 - DNA, 16 bp, Homo sapiens
cttcagtttttcactt

SEQ ID NO: 2871978 - DNA, 13 bp, Homo sapiens
cttcatcctcctc

SEQ ID NO: 2871979 - DNA, 14 bp, Homo sapiens
cttcatgcctgatg

SEQ ID NO: 2871980 - DNA, 15 bp, Homo sapiens
cttcatggcagaagg

SEQ ID NO: 2871981 - DNA, 17 bp, Homo sapiens
cttcattattcaagaat

SEQ ID NO: 2871982 - DNA, 21 bp, Homo sapiens
cttcattattcaagaatgaaa

SEQ ID NO: 2871983 - DNA, 21 bp, Homo sapiens
cttcattcttgaaagctgtgg

SEQ ID NO: 2871984 - DNA, 13 bp, Homo sapiens
cttcattttgtat

SEQ ID NO: 2871985 - DNA, 19 bp, Homo sapiens
cttccaaatcccctaagca

SEQ ID NO: 2871986 - DNA, 13 bp, Homo sapiens
cttccatttgcaa

SEQ ID NO: 2871987 - DNA, 19 bp, Homo sapiens
cttccattttcccccacta

SEQ ID NO: 2871988 - DNA, 23 bp, Homo sapiens
cttccattttcccccactactgc

SEQ ID NO: 2871989 - DNA, 22 bp, Homo sapiens
cttcccagaccaggaaaggctt

SEQ ID NO: 2871990 - DNA, 23 bp, Homo sapiens
cttccccagactcagctccagaa

SEQ ID NO: 2871991 - DNA, 13 bp, Homo sapiens
cttccctgactca

SEQ ID NO: 2871992 - DNA, 14 bp, Homo sapiens
cttccctgactcat

SEQ ID NO: 2871993 - DNA, 21 bp, Homo sapiens
cttccctgccacttcaacccc

SEQ ID NO: 2871994 - DNA, 15 bp, Homo sapiens
cttcccttcccagac

SEQ ID NO: 2871995 - DNA, 16 bp, Homo sapiens
cttcccttcccagacc

SEQ ID NO: 2871996 - DNA, 16 bp, Homo sapiens
cttcctagatctgcag

SEQ ID NO: 2871997 - DNA, 12 bp, Homo sapiens
cttcctttcctc

SEQ ID NO: 2871998 - DNA, 13 bp, Homo sapiens
cttcctttcctct

SEQ ID NO: 2871999 - DNA, 20 bp, Homo sapiens
cttcgctgctagagaagggg

SEQ ID NO: 2872000 - DNA, 17 bp, Homo sapiens
cttcgggcccttcccac

SEQ ID NO: 2872001 - DNA, 16 bp, Homo sapiens
cttctccatccacatg

SEQ ID NO: 2872002 - DNA, 16 bp, Homo sapiens
cttctctctgtgggat

SEQ ID NO: 2872003 - DNA, 21 bp, Homo sapiens
cttctctgtgaacgatttaga

SEQ ID NO: 2872004 - DNA, 18 bp, Homo sapiens
cttctcttcctagatctg

SEQ ID NO: 2872005 - DNA, 14 bp, Homo sapiens
cttctggatccatg

SEQ ID NO: 2872006 - DNA, 23 bp, Homo sapiens
cttctgggagggcagcagggcta

SEQ ID NO: 2872007 - DNA, 19 bp, Homo sapiens
cttctttggacttctgaag

SEQ ID NO: 2872008 - DNA, 13 bp, Homo sapiens
cttgaaacctgat

SEQ ID NO: 2872009 - DNA, 14 bp, Homo sapiens
cttgaaacctgatg

SEQ ID NO: 2872010 - DNA, 17 bp, Homo sapiens
cttgaattgtaactgtt

SEQ ID NO: 2872011 - DNA, 20 bp, Homo sapiens
cttgaattgtaactgttctt

SEQ ID NO: 2872012 - DNA, 21 bp, Homo sapiens
cttgactacctactggtgtaa

SEQ ID NO: 2872013 - DNA, 19 bp, Homo sapiens
cttgagcctcccccaaagc

SEQ ID NO: 2872014 - DNA, 18 bp, Homo sapiens
cttgccttattagagtgt

SEQ ID NO: 2872015 - DNA, 21 bp, Homo sapiens
cttgccttattagagtgtctt

SEQ ID NO: 2872016 - DNA, 16 bp, Homo sapiens
cttggactcctcccac

SEQ ID NO: 2872017 - DNA, 18 bp, Homo sapiens
cttggactcctcccacaa

SEQ ID NO: 2872018 - DNA, 19 bp, Homo sapiens
cttgggccctttgagtgca

SEQ ID NO: 2872019 - DNA, 13 bp, Homo sapiens
cttggttccccca

SEQ ID NO: 2872020 - DNA, 15 bp, Homo sapiens
cttggttgaggaaac

SEQ ID NO: 2872021 - DNA, 18 bp, Homo sapiens
cttgtagaactcactctg

SEQ ID NO: 2872022 - DNA, 14 bp, Homo sapiens
cttgtctctgggct

SEQ ID NO: 2872023 - DNA, 18 bp, Homo sapiens
cttgtttagagagcctgt

SEQ ID NO: 2872024 - DNA, 12 bp, Homo sapiens
cttgtttgtcag

SEQ ID NO: 2872025 - DNA, 17 bp, Homo sapiens
ctttcatgtaaactgtg

SEQ ID NO: 2872026 - DNA, 19 bp, Homo sapiens
ctttcatgtaaactgtgca

SEQ ID NO: 2872027 - DNA, 13 bp, Homo sapiens
ctttccaaattaa

SEQ ID NO: 2872028 - DNA, 22 bp, Homo sapiens
ctttccaaattaaaacaaatat

SEQ ID NO: 2872029 - DNA, 18 bp, Homo sapiens
ctttccattggatctcat

SEQ ID NO: 2872030 - DNA, 16 bp, Homo sapiens
ctttcctacaaaatgg

SEQ ID NO: 2872031 - DNA, 15 bp, Homo sapiens
ctttcctactttcta

SEQ ID NO: 2872032 - DNA, 12 bp, Homo sapiens
ctttcctcccca

SEQ ID NO: 2872033 - DNA, 19 bp, Homo sapiens
gggccactctcccctccct

SEQ ID NO: 2872034 - DNA, 18 bp, Homo sapiens
gggcccgaacagggactt

SEQ ID NO: 2872035 - DNA, 14 bp, Homo sapiens
gggcctcctgcctc

SEQ ID NO: 2872036 - DNA, 13 bp, Homo sapiens
gggctaccctgag

SEQ ID NO: 2872037 - DNA, 19 bp, Homo sapiens
gggctaccctgagctgagg

SEQ ID NO: 2872038 - DNA, 21 bp, Homo sapiens
gggctaccctgagctgaggca

SEQ ID NO: 2872039 - DNA, 14 bp, Homo sapiens
gggctccctgactg

SEQ ID NO: 2872040 - DNA, 18 bp, Homo sapiens
gggctccctgactgggag

SEQ ID NO: 2872041 - DNA, 12 bp, Homo sapiens
gggctgagggag

SEQ ID NO: 2872042 - DNA, 19 bp, Homo sapiens
gggctgtaacgtggcactg

SEQ ID NO: 2872043 - DNA, 20 bp, Homo sapiens
gggcttcattccggactggc

SEQ ID NO: 2872044 - DNA, 21 bp, Homo sapiens
gggcttcattccggactggca

SEQ ID NO: 2872045 - DNA, 14 bp, Homo sapiens
ggggaagggtggtc

SEQ ID NO: 2872046 - DNA, 18 bp, Homo sapiens
ggggagactgggctgagg

SEQ ID NO: 2872047 - DNA, 13 bp, Homo sapiens
ggggccagaggct

SEQ ID NO: 2872048 - DNA, 22 bp, Homo sapiens
ggggtggttattggactccagg

SEQ ID NO: 2872049 - DNA, 13 bp, Homo sapiens
gggtggggggagt

SEQ ID NO: 2872050 - DNA, 21 bp, Homo sapiens
gggttctgcagcggcagagca

SEQ ID NO: 2872051 - DNA, 18 bp, Homo sapiens
gggttttgtattctctga

SEQ ID NO: 2872052 - DNA, 18 bp, Homo sapiens
ggtcaagaaacagccagc

SEQ ID NO: 2872053 - DNA, 13 bp, Homo sapiens
ggtcataaaatag

SEQ ID NO: 2872054 - DNA, 17 bp, Homo sapiens
ggtccagctgggcctcc

SEQ ID NO: 2872055 - DNA, 14 bp, Homo sapiens
ggtccatgggcaga

SEQ ID NO: 2872056 - DNA, 17 bp, Homo sapiens
ggtccatgggcagagcc

SEQ ID NO: 2872057 - DNA, 18 bp, Homo sapiens
ggtccatgggcagagccc

SEQ ID NO: 2872058 - DNA, 16 bp, Homo sapiens
ggtcctatttttgtga

SEQ ID NO: 2872059 - DNA, 15 bp, Homo sapiens
ggtcctttggggtga

SEQ ID NO: 2872060 - DNA, 15 bp, Homo sapiens
ggtctaccaatacaa

SEQ ID NO: 2872061 - DNA, 16 bp, Homo sapiens
ggtctgagcaccccct

SEQ ID NO: 2872062 - DNA, 11 bp, Homo sapiens
ggtctgccaat

SEQ ID NO: 2872063 - DNA, 23 bp, Homo sapiens
ggtctgtgtaacatccaagccag

SEQ ID NO: 2872064 - DNA, 17 bp, Homo sapiens
ggtgctttgcattttga

SEQ ID NO: 2872065 - DNA, 21 bp, Homo sapiens
ggtggcgactctatagactct

SEQ ID NO: 2872066 - DNA, 15 bp, Homo sapiens
ggtgggccactctcc

SEQ ID NO: 2872067 - DNA, 14 bp, Homo sapiens
ggtgggtccatggg

SEQ ID NO: 2872068 - DNA, 17 bp, Homo sapiens
ggtggttattggactcc

SEQ ID NO: 2872069 - DNA, 20 bp, Homo sapiens
ggtggttattggactccagg

SEQ ID NO: 2872070 - DNA, 17 bp, Homo sapiens
ggtgtaatctcaatgca

SEQ ID NO: 2872071 - DNA, 22 bp, Homo sapiens
ggtgtatgcacagggtgtggta

SEQ ID NO: 2872072 - DNA, 18 bp, Homo sapiens
ggtgtgatcgtctgactg

SEQ ID NO: 2872073 - DNA, 17 bp, Homo sapiens
ggtgtgcaccagggttg

SEQ ID NO: 2872074 - DNA, 14 bp, Homo sapiens
ggtgtgtgaagttt

SEQ ID NO: 2872075 - DNA, 22 bp, Homo sapiens
ggttaccactcttttgctgtgc

SEQ ID NO: 2872076 - DNA, 13 bp, Homo sapiens
ggttattggactc

SEQ ID NO: 2872077 - DNA, 11 bp, Homo sapiens
ggttgaggaaa

SEQ ID NO: 2872078 - DNA, 23 bp, Homo sapiens
ggtttacactgcggaagccaaag

SEQ ID NO: 2872079 - DNA, 13 bp, Homo sapiens
ggtttcaggaagt

SEQ ID NO: 2872080 - DNA, 18 bp, Homo sapiens
ggttttgtattctctgag

SEQ ID NO: 2872081 - DNA, 22 bp, Homo sapiens
gtaaaaaatgtctcatgtcaat

SEQ ID NO: 2872082 - DNA, 20 bp, Homo sapiens
gtaaacactccacattcttc

SEQ ID NO: 2872083 - DNA, 23 bp, Homo sapiens
gtaaatagtgtcatataaactca

SEQ ID NO: 2872084 - DNA, 21 bp, Homo sapiens
gtaaatgaagatctttatatt

SEQ ID NO: 2872085 - DNA, 14 bp, Homo sapiens
gtaacatccaagcc

SEQ ID NO: 2872086 - DNA, 18 bp, Homo sapiens
gtaacatccaagccagag

SEQ ID NO: 2872087 - DNA, 15 bp, Homo sapiens
gtaagacaagtggga

SEQ ID NO: 2872088 - DNA, 17 bp, Homo sapiens
gtaataatgtaacatga

SEQ ID NO: 2872089 - DNA, 15 bp, Homo sapiens
gtaatctatgtttat

SEQ ID NO: 2872090 - DNA, 22 bp, Homo sapiens
gtaatctatgtttataatacta

SEQ ID NO: 2872091 - DNA, 20 bp, Homo sapiens
gtaattatgtaaataactct

SEQ ID NO: 2872092 - DNA, 17 bp, Homo sapiens
gtacaaatgaagaaagt

SEQ ID NO: 2872093 - DNA, 15 bp, Homo sapiens
gtactaatagaactt

SEQ ID NO: 2872094 - DNA, 11 bp, Homo sapiens
gtactctttaa

SEQ ID NO: 2872095 - DNA, 17 bp, Homo sapiens
gtagaactcactctggg

SEQ ID NO: 2872096 - DNA, 18 bp, Homo sapiens
gtagaactcactctgggc

SEQ ID NO: 2872097 - DNA, 20 bp, Homo sapiens
gtagagccaattagacttga

SEQ ID NO: 2872098 - DNA, 15 bp, Homo sapiens
gtaggaagtaggaag

SEQ ID NO: 2872099 - DNA, 18 bp, Homo sapiens
gtaggagcccagctctga

SEQ ID NO: 2872100 - DNA, 22 bp, Homo sapiens
gtataacagccttttccttctg

SEQ ID NO: 2872101 - DNA, 19 bp, Homo sapiens
gtatatgactgcatttgtg

SEQ ID NO: 2872102 - DNA, 14 bp, Homo sapiens
gtatcaggacccag

SEQ ID NO: 2872103 - DNA, 22 bp, Homo sapiens
gtatcaggacccagaggaaggg

SEQ ID NO: 2872104 - DNA, 22 bp, Homo sapiens
gtatgcacagggtgtggtatga

SEQ ID NO: 2872105 - DNA, 21 bp, Homo sapiens
gtattaaaaaacaattaactg

SEQ ID NO: 2872106 - DNA, 11 bp, Homo sapiens
gtattctctga

SEQ ID NO: 2872107 - DNA, 19 bp, Homo sapiens
gtattctctgagctgtgca

SEQ ID NO: 2872108 - DNA, 17 bp, Homo sapiens
gtcaagtgcgtccacga

SEQ ID NO: 2872109 - DNA, 17 bp, Homo sapiens
gtcaataaacaacagct

SEQ ID NO: 2872110 - DNA, 20 bp, Homo sapiens
gtcaataaacaacagctgaa

SEQ ID NO: 2872111 - DNA, 19 bp, Homo sapiens
gtcacatggggcctggccc

SEQ ID NO: 2872112 - DNA, 16 bp, Homo sapiens
gtcaccagagcttctc

SEQ ID NO: 2872113 - DNA, 22 bp, Homo sapiens
gtcaccagagcttctctgggct

SEQ ID NO: 2872114 - DNA, 17 bp, Homo sapiens
gtcagaatttttaactg

SEQ ID NO: 2872115 - DNA, 19 bp, Homo sapiens
gtcagaatttttaactgta

SEQ ID NO: 2872116 - DNA, 10 bp, Homo sapiens
gtcagcatct

SEQ ID NO: 2872117 - DNA, 15 bp, Homo sapiens
gtcagcatctgacca

SEQ ID NO: 2872118 - DNA, 16 bp, Homo sapiens
gtcagcatctgaccat

SEQ ID NO: 2872119 - DNA, 18 bp, Homo sapiens
gtcagcatctgaccatct

SEQ ID NO: 2872120 - DNA, 21 bp, Homo sapiens
gtcagcatctgaccatctgtg

SEQ ID NO: 2872121 - DNA, 23 bp, Homo sapiens
gtcagcatctgaccatctgtgac

SEQ ID NO: 2872122 - DNA, 19 bp, Homo sapiens
gtcagctgctgttgaactt

SEQ ID NO: 2872123 - DNA, 22 bp, Homo sapiens
gtcagtgctataaatgccagag

SEQ ID NO: 2872124 - DNA, 17 bp, Homo sapiens
gtccaatcctatgtttt

SEQ ID NO: 2872125 - DNA, 18 bp, Homo sapiens
gtccacgactgtctccat

SEQ ID NO: 2872126 - DNA, 20 bp, Homo sapiens
gtccagctgggcctcctgcc

SEQ ID NO: 2872127 - DNA, 13 bp, Homo sapiens
gtccatgggcaga

SEQ ID NO: 2872128 - DNA, 14 bp, Homo sapiens
gtccatgggcagag

SEQ ID NO: 2872129 - DNA, 16 bp, Homo sapiens
gtccattgtccaatcc

SEQ ID NO: 2872130 - DNA, 13 bp, Homo sapiens
gtcccagagcccg

SEQ ID NO: 2872131 - DNA, 21 bp, Homo sapiens
gtccccctctgtccaggcact

SEQ ID NO: 2872132 - DNA, 17 bp, Homo sapiens
gtccttccctgccactt

SEQ ID NO: 2872133 - DNA, 16 bp, Homo sapiens
gtctcatccatcatca

SEQ ID NO: 2872134 - DNA, 17 bp, Homo sapiens
gtctccagaagaaaatt

SEQ ID NO: 2872135 - DNA, 15 bp, Homo sapiens
gtctgccacagagag

SEQ ID NO: 2872136 - DNA, 21 bp, Homo sapiens
gtctgtgtaacatccaagcca

SEQ ID NO: 2872137 - DNA, 23 bp, Homo sapiens
gtctgtgtaacatccaagccaga

SEQ ID NO: 2872138 - DNA, 19 bp, Homo sapiens
gtcttatgtgaaaaattaa

SEQ ID NO: 2872139 - DNA, 17 bp, Homo sapiens
gtcttcactgccatgcc

SEQ ID NO: 2872140 - DNA, 18 bp, Homo sapiens
gtctttccacggagccac

SEQ ID NO: 2872141 - DNA, 17 bp, Homo sapiens
gtcttttttctcttccc

SEQ ID NO: 2872142 - DNA, 18 bp, Homo sapiens
gtcttttttctcttccct

SEQ ID NO: 2872143 - DNA, 12 bp, Homo sapiens
tattctctgagc

SEQ ID NO: 2872144 - DNA, 18 bp, Homo sapiens
tattctctgagctgtgca

SEQ ID NO: 2872145 - DNA, 23 bp, Homo sapiens
tattgctgtgagccttgcatgac

SEQ ID NO: 2872146 - DNA, 13 bp, Homo sapiens
tattgtacctctc

SEQ ID NO: 2872147 - DNA, 17 bp, Homo sapiens
tattgtccattgtccaa

SEQ ID NO: 2872148 - DNA, 17 bp, Homo sapiens
tatttactaactaaata

SEQ ID NO: 2872149 - DNA, 14 bp, Homo sapiens
tatttactgagctt

SEQ ID NO: 2872150 - DNA, 19 bp, Homo sapiens
tatttattattttcacctg

SEQ ID NO: 2872151 - DNA, 19 bp, Homo sapiens
tatttctatatagacttgg

SEQ ID NO: 2872152 - DNA, 16 bp, Homo sapiens
tatttctatgacaaat

SEQ ID NO: 2872153 - DNA, 16 bp, Homo sapiens
tatttgatttctaatt

SEQ ID NO: 2872154 - DNA, 18 bp, Homo sapiens
tatttgtatgtttttctg

SEQ ID NO: 2872155 - DNA, 14 bp, Homo sapiens
tattttaaattctc

SEQ ID NO: 2872156 - DNA, 14 bp, Homo sapiens
tatttttcagaaat

SEQ ID NO: 2872157 - DNA, 15 bp, Homo sapiens
tcaaaaccttttgaa

SEQ ID NO: 2872158 - DNA, 20 bp, Homo sapiens
tcaaagcaaggaaactatgt

SEQ ID NO: 2872159 - DNA, 18 bp, Homo sapiens
tcaaagtatgcaatgctt

SEQ ID NO: 2872160 - DNA, 17 bp, Homo sapiens
tcaaatgtgtgtggcag

SEQ ID NO: 2872161 - DNA, 15 bp, Homo sapiens
tcaacaaaaattgtc

SEQ ID NO: 2872162 - DNA, 18 bp, Homo sapiens
tcaacaaaaattgtccct

SEQ ID NO: 2872163 - DNA, 13 bp, Homo sapiens
tcaacccccagct

SEQ ID NO: 2872164 - DNA, 14 bp, Homo sapiens
tcaacccccagcta

SEQ ID NO: 2872165 - DNA, 13 bp, Homo sapiens
tcaacctaccctg

SEQ ID NO: 2872166 - DNA, 17 bp, Homo sapiens
tcaacctgggcaaagcc

SEQ ID NO: 2872167 - DNA, 15 bp, Homo sapiens
tcaacttaataagat

SEQ ID NO: 2872168 - DNA, 13 bp, Homo sapiens
tcaagaaacagcc

SEQ ID NO: 2872169 - DNA, 20 bp, Homo sapiens
tcaagagctagaaaaataaa

SEQ ID NO: 2872170 - DNA, 16 bp, Homo sapiens
tcaagcattctgttta

SEQ ID NO: 2872171 - DNA, 21 bp, Homo sapiens
tcaagggaaaggcaagcttga

SEQ ID NO: 2872172 - DNA, 16 bp, Homo sapiens
tcaataaacaacagct

SEQ ID NO: 2872173 - DNA, 13 bp, Homo sapiens
tcaataaacagtc

SEQ ID NO: 2872174 - DNA, 17 bp, Homo sapiens
tcaatatgaatctataa

SEQ ID NO: 2872175 - DNA, 13 bp, Homo sapiens
tcaatatgtatat

SEQ ID NO: 2872176 - DNA, 19 bp, Homo sapiens
tcaatatgtatatatgtat

SEQ ID NO: 2872177 - DNA, 10 bp, Homo sapiens
tcaatattta

SEQ ID NO: 2872178 - DNA, 11 bp, Homo sapiens
tcaatatttat

SEQ ID NO: 2872179 - DNA, 21 bp, Homo sapiens
tcaatgcaagccccaactttc

SEQ ID NO: 2872180 - DNA, 20 bp, Homo sapiens
tcaattagtggtcataaaat

SEQ ID NO: 2872181 - DNA, 15 bp, Homo sapiens
tcaattcctctggga

SEQ ID NO: 2872182 - DNA, 21 bp, Homo sapiens
tcacaatcttggggctgatga

SEQ ID NO: 2872183 - DNA, 23 bp, Homo sapiens
tcacaatcttggggctgatgaag

SEQ ID NO: 2872184 - DNA, 17 bp, Homo sapiens
tcaccatttgattatgt

SEQ ID NO: 2872185 - DNA, 18 bp, Homo sapiens
tcacccccttctccatcc

SEQ ID NO: 2872186 - DNA, 22 bp, Homo sapiens
tcacccccttctccatccacat

SEQ ID NO: 2872187 - DNA, 15 bp, Homo sapiens
tcaccgtgggctccc

SEQ ID NO: 2872188 - DNA, 22 bp, Homo sapiens
tcacctacatatgctgatcttt

SEQ ID NO: 2872189 - DNA, 22 bp, Homo sapiens
tcacctgtttttaagctgtttc

SEQ ID NO: 2872190 - DNA, 14 bp, Homo sapiens
tcactccccagccc

SEQ ID NO: 2872191 - DNA, 20 bp, Homo sapiens
tcactgagttttgtttcact

SEQ ID NO: 2872192 - DNA, 14 bp, Homo sapiens
tcactgccttcgtt

SEQ ID NO: 2872193 - DNA, 16 bp, Homo sapiens
tcagaaatcaaactgc

SEQ ID NO: 2872194 - DNA, 18 bp, Homo sapiens
tcagaatttttaactgta

SEQ ID NO: 2872195 - DNA, 18 bp, Homo sapiens
tcagaggccctcgctgcc

SEQ ID NO: 2872196 - DNA, 22 bp, Homo sapiens
tcagaggccctcgctgccagct

SEQ ID NO: 2872197 - DNA, 16 bp, Homo sapiens
tcagcatctgaccatc

SEQ ID NO: 2872198 - DNA, 17 bp, Homo sapiens
tcagcatctgaccatct

SEQ ID NO: 2872199 - DNA, 18 bp, Homo sapiens
tcagcatctgaccatctg

SEQ ID NO: 2872200 - DNA, 23 bp, Homo sapiens
tcagcatctgaccatctgtgact

SEQ ID NO: 2872201 - DNA, 14 bp, Homo sapiens
tcagcattgtaatt

SEQ ID NO: 2872202 - DNA, 23 bp, Homo sapiens
tcagccctagggtggagagccac

SEQ ID NO: 2872203 - DNA, 14 bp, Homo sapiens
tcagctccttcctg

SEQ ID NO: 2872204 - DNA, 15 bp, Homo sapiens
tcagctctttccaaa

SEQ ID NO: 2872205 - DNA, 18 bp, Homo sapiens
tcagctgctgttgaactt

SEQ ID NO: 2872206 - DNA, 22 bp, Homo sapiens
tcagctgctgttgaacttttta

SEQ ID NO: 2872207 - DNA, 23 bp, Homo sapiens
tcagctgctgttgaactttttaa

SEQ ID NO: 2872208 - DNA, 16 bp, Homo sapiens
tcaggacccagaggaa

SEQ ID NO: 2872209 - DNA, 12 bp, Homo sapiens
tcaggagttcct

SEQ ID NO: 2872210 - DNA, 21 bp, Homo sapiens
tcagtaatgctaaatgtgtaa

SEQ ID NO: 2872211 - DNA, 18 bp, Homo sapiens
tcagtccagcagtttcca

SEQ ID NO: 2872212 - DNA, 17 bp, Homo sapiens
tcagtctctgagcagtg

SEQ ID NO: 2872213 - DNA, 20 bp, Homo sapiens
tcagtctctgagcagtgaat

SEQ ID NO: 2872214 - DNA, 19 bp, Homo sapiens
tcagtgctataaatgccag

SEQ ID NO: 2872215 - DNA, 20 bp, Homo sapiens
tcagtgctataaatgccaga

SEQ ID NO: 2872216 - DNA, 12 bp, Homo sapiens
tcagtgctccct

SEQ ID NO: 2872217 - DNA, 20 bp, Homo sapiens
tcagttgatttttcttattt

SEQ ID NO: 2872218 - DNA, 15 bp, Homo sapiens
tcagtttttcacttc

SEQ ID NO: 2872219 - DNA, 15 bp, Homo sapiens
tcataagtatttcaa

SEQ ID NO: 2872220 - DNA, 15 bp, Homo sapiens
tcataccaatgaaaa

SEQ ID NO: 2872221 - DNA, 14 bp, Homo sapiens
tcatattgtaatct

SEQ ID NO: 2872222 - DNA, 19 bp, Homo sapiens
tcatcattctctgtctcat

SEQ ID NO: 2872223 - DNA, 14 bp, Homo sapiens
tcatccatcatcat

SEQ ID NO: 2872224 - DNA, 16 bp, Homo sapiens
tcatccatcatcatgt

SEQ ID NO: 2872225 - DNA, 23 bp, Homo sapiens
tcatcccgagcacctccacatcc

SEQ ID NO: 2872226 - DNA, 17 bp, Homo sapiens
tcatcctcctccccagc

SEQ ID NO: 2872227 - DNA, 23 bp, Homo sapiens
tcatcctcctccccagctcttct

SEQ ID NO: 2872228 - DNA, 23 bp, Homo sapiens
tcatctcctgccttcctcctggg

SEQ ID NO: 2872229 - DNA, 16 bp, Homo sapiens
tcatcttcttcaccat

SEQ ID NO: 2872230 - DNA, 15 bp, Homo sapiens
tcatgcctgatgaaa

SEQ ID NO: 2872231 - DNA, 17 bp, Homo sapiens
tcatgtaataaacaggt

SEQ ID NO: 2872232 - DNA, 18 bp, Homo sapiens
tcatgtcacctacatatg

SEQ ID NO: 2872233 - DNA, 21 bp, Homo sapiens
tcatgtgtgtccacgactgtc

SEQ ID NO: 2872234 - DNA, 23 bp, Homo sapiens
tcatgtgtgtccacgactgtctc

SEQ ID NO: 2872235 - DNA, 13 bp, Homo sapiens
tcattaaaaatta

SEQ ID NO: 2872236 - DNA, 16 bp, Homo sapiens
tcattattcaagaatg

SEQ ID NO: 2872237 - DNA, 16 bp, Homo sapiens
tcattctctgtctcat

SEQ ID NO: 2872238 - DNA, 18 bp, Homo sapiens
tcattcttgaaagctgtg

SEQ ID NO: 2872239 - DNA, 17 bp, Homo sapiens
tcatttctatttctcct

SEQ ID NO: 2872240 - DNA, 18 bp, Homo sapiens
tccaaattaaaacaaata

SEQ ID NO: 2872241 - DNA, 18 bp, Homo sapiens
tccaccctccaccttcca

SEQ ID NO: 2872242 - DNA, 16 bp, Homo sapiens
tccacgactgtctcca

SEQ ID NO: 2872243 - DNA, 17 bp, Homo sapiens
tccacgactgtctccat

SEQ ID NO: 2872244 - DNA, 19 bp, Homo sapiens
tccacgactgtctccatgg

SEQ ID NO: 2872245 - DNA, 22 bp, Homo sapiens
tccacgagctgtttactaggga

SEQ ID NO: 2872246 - DNA, 21 bp, Homo sapiens
tccacggagccactcctctga

SEQ ID NO: 2872247 - DNA, 20 bp, Homo sapiens
tccacgttctgctcatcatt

SEQ ID NO: 2872248 - DNA, 15 bp, Homo sapiens
tccactgagggcagt

SEQ ID NO: 2872249 - DNA, 15 bp, Homo sapiens
tccacttcattttgt

SEQ ID NO: 2872250 - DNA, 12 bp, Homo sapiens
tccagagggcac

SEQ ID NO: 2872251 - DNA, 12 bp, Homo sapiens
tccagcccctgt

SEQ ID NO: 2872252 - DNA, 14 bp, Homo sapiens
tccagcccctgtcc

SEQ ID NO: 2872253 - DNA, 21 bp, Homo sapiens
tctttcaaaaccttttgaaat

SEQ ID NO: 2872254 - DNA, 11 bp, Homo sapiens
tctttccaaat

SEQ ID NO: 2872255 - DNA, 22 bp, Homo sapiens
tctttccacggagccactcctc

SEQ ID NO: 2872256 - DNA, 13 bp, Homo sapiens
tcttttgctgtgc

SEQ ID NO: 2872257 - DNA, 15 bp, Homo sapiens
tcttttttttttccc

SEQ ID NO: 2872258 - DNA, 22 bp, Homo sapiens
tgaaaaaatagagcctgaggga

SEQ ID NO: 2872259 - DNA, 18 bp, Homo sapiens
tgaaaacactgtgcacat

SEQ ID NO: 2872260 - DNA, 18 bp, Homo sapiens
tgaaacaaagtactcttt

SEQ ID NO: 2872261 - DNA, 20 bp, Homo sapiens
tgaaacaaagtactctttaa

SEQ ID NO: 2872262 - DNA, 18 bp, Homo sapiens
tgaaacagttgctgtgaa

SEQ ID NO: 2872263 - DNA, 13 bp, Homo sapiens
tgaaacctgatgt

SEQ ID NO: 2872264 - DNA, 15 bp, Homo sapiens
tgaaacctgatgtca

SEQ ID NO: 2872265 - DNA, 22 bp, Homo sapiens
tgaaacctgatgtcagctgctg

SEQ ID NO: 2872266 - DNA, 20 bp, Homo sapiens
tgaacaaagctcaaagtatg

SEQ ID NO: 2872267 - DNA, 15 bp, Homo sapiens
tgaacataacttctc

SEQ ID NO: 2872268 - DNA, 16 bp, Homo sapiens
tgaacataacttctca

SEQ ID NO: 2872269 - DNA, 21 bp, Homo sapiens
tgaacctgaaaagggtcagaa

SEQ ID NO: 2872270 - DNA, 20 bp, Homo sapiens
tgaagaaagtcaaaaaatta

SEQ ID NO: 2872271 - DNA, 15 bp, Homo sapiens
tgaagaagggggtgg

SEQ ID NO: 2872272 - DNA, 20 bp, Homo sapiens
tgaagagggacataagataa

SEQ ID NO: 2872273 - DNA, 16 bp, Homo sapiens
tgaagattctttccca

SEQ ID NO: 2872274 - DNA, 17 bp, Homo sapiens
tgaagccgactctggcc

SEQ ID NO: 2872275 - DNA, 19 bp, Homo sapiens
tgaagccgactctggccct

SEQ ID NO: 2872276 - DNA, 15 bp, Homo sapiens
tgaaggcttctctct

SEQ ID NO: 2872277 - DNA, 19 bp, Homo sapiens
tgaaggcttctctctgtgg

SEQ ID NO: 2872278 - DNA, 13 bp, Homo sapiens
tgaagggaagtgg

SEQ ID NO: 2872279 - DNA, 17 bp, Homo sapiens
tgaagggaagtggggag

SEQ ID NO: 2872280 - DNA, 16 bp, Homo sapiens
tgaagtatgaagtctg

SEQ ID NO: 2872281 - DNA, 13 bp, Homo sapiens
tgaagtttggaga

SEQ ID NO: 2872282 - DNA, 16 bp, Homo sapiens
tgaatactgtattttg

SEQ ID NO: 2872283 - DNA, 22 bp, Homo sapiens
tgaatctataagtagtaaatca

SEQ ID NO: 2872284 - DNA, 17 bp, Homo sapiens
tgaatgataagcaggaa

SEQ ID NO: 2872285 - DNA, 14 bp, Homo sapiens
tgaatgtccaaaat

SEQ ID NO: 2872286 - DNA, 14 bp, Homo sapiens
tgaatgtgtgagaa

SEQ ID NO: 2872287 - DNA, 16 bp, Homo sapiens
tgaatgtgtgagaaaa

SEQ ID NO: 2872288 - DNA, 17 bp, Homo sapiens
tgaatgtgtgagaaaaa

SEQ ID NO: 2872289 - DNA, 19 bp, Homo sapiens
tgaattgtaactgttcttg

SEQ ID NO: 2872290 - DNA, 22 bp, Homo sapiens
tgacaactcattttcatattgt

SEQ ID NO: 2872291 - DNA, 22 bp, Homo sapiens
tgacaagctgtatcactgcctt

SEQ ID NO: 2872292 - DNA, 23 bp, Homo sapiens
tgacactcaataaacagtcactg

SEQ ID NO: 2872293 - DNA, 22 bp, Homo sapiens
tgacactcccttgggctccctg

SEQ ID NO: 2872294 - DNA, 21 bp, Homo sapiens
tgacagagcaagactctgtct

SEQ ID NO: 2872295 - DNA, 22 bp, Homo sapiens
tgacagatcttttttttttccc

SEQ ID NO: 2872296 - DNA, 17 bp, Homo sapiens
tgacagtttccaaattg

SEQ ID NO: 2872297 - DNA, 17 bp, Homo sapiens
tgacagtttttgacatt

SEQ ID NO: 2872298 - DNA, 16 bp, Homo sapiens
tgacatttaatgccat

SEQ ID NO: 2872299 - DNA, 21 bp, Homo sapiens
tgacatttggagtgttcccct

SEQ ID NO: 2872300 - DNA, 15 bp, Homo sapiens
tgacccaccagtgcc

SEQ ID NO: 2872301 - DNA, 16 bp, Homo sapiens
tgactacagtcaggaa

SEQ ID NO: 2872302 - DNA, 22 bp, Homo sapiens
tgactacctactggtgtaatct

SEQ ID NO: 2872303 - DNA, 14 bp, Homo sapiens
tgactataaagctg

SEQ ID NO: 2872304 - DNA, 16 bp, Homo sapiens
tgactataaagctgtt

SEQ ID NO: 2872305 - DNA, 15 bp, Homo sapiens
tgactcagggctcct

SEQ ID NO: 2872306 - DNA, 17 bp, Homo sapiens
tgactcagggctcctgg

SEQ ID NO: 2872307 - DNA, 13 bp, Homo sapiens
tgactggaggcct

SEQ ID NO: 2872308 - DNA, 23 bp, Homo sapiens
tgactggtgttatcaccgtgggc

SEQ ID NO: 2872309 - DNA, 20 bp, Homo sapiens
tgagaaacaacaatttctac

SEQ ID NO: 2872310 - DNA, 20 bp, Homo sapiens
tgagaaacactatttgtgac

SEQ ID NO: 2872311 - DNA, 15 bp, Homo sapiens
tgagacagacattca

SEQ ID NO: 2872312 - DNA, 22 bp, Homo sapiens
tgagcatagagaacaaagtaaa

SEQ ID NO: 2872313 - DNA, 15 bp, Homo sapiens
tgagccatgaggagc

SEQ ID NO: 2872314 - DNA, 20 bp, Homo sapiens
tgagccatgaggagcgtgga

SEQ ID NO: 2872315 - DNA, 17 bp, Homo sapiens
tgagcctcccccaaagc

SEQ ID NO: 2872316 - DNA, 23 bp, Homo sapiens
tgagcgaggagatgctccttggg

SEQ ID NO: 2872317 - DNA, 13 bp, Homo sapiens
tgaggagacagaa

SEQ ID NO: 2872318 - DNA, 16 bp, Homo sapiens
tgaggagacagaaagc

SEQ ID NO: 2872319 - DNA, 20 bp, Homo sapiens
tgaggagacagaaagcctcc

SEQ ID NO: 2872320 - DNA, 20 bp, Homo sapiens
tgaggatagtagttaaataa

SEQ ID NO: 2872321 - DNA, 21 bp, Homo sapiens
tgaggccaagatggctgctgc

SEQ ID NO: 2872322 - DNA, 13 bp, Homo sapiens
tgaggccagggca

SEQ ID NO: 2872323 - DNA, 14 bp, Homo sapiens
tgaggccagggcag

SEQ ID NO: 2872324 - DNA, 16 bp, Homo sapiens
tgaggccagggcagag

SEQ ID NO: 2872325 - DNA, 15 bp, Homo sapiens
tgagtgcagtcctga

SEQ ID NO: 2872326 - DNA, 12 bp, Homo sapiens
tgagtgctctga

SEQ ID NO: 2872327 - DNA, 13 bp, Homo sapiens
tgagtgctctgat

SEQ ID NO: 2872328 - DNA, 19 bp, Homo sapiens
tgagtgctctgatccctct

SEQ ID NO: 2872329 - DNA, 16 bp, Homo sapiens
tgataaaaccatgtag

SEQ ID NO: 2872330 - DNA, 18 bp, Homo sapiens
tgataccatatgaatgaa

SEQ ID NO: 2872331 - DNA, 22 bp, Homo sapiens
tgatagggagttttaaagaaat

SEQ ID NO: 2872332 - DNA, 23 bp, Homo sapiens
tgatagggtctaccaatacaaaa

SEQ ID NO: 2872333 - DNA, 20 bp, Homo sapiens
tgatcggccagttttcggaa

SEQ ID NO: 2872334 - DNA, 21 bp, Homo sapiens
tgatcggccagttttcggaaa

SEQ ID NO: 2872335 - DNA, 14 bp, Homo sapiens
tgatgaatactgta

SEQ ID NO: 2872336 - DNA, 13 bp, Homo sapiens
tgatgacaatcaa

SEQ ID NO: 2872337 - DNA, 18 bp, Homo sapiens
tgatgcatgcactgttcc

SEQ ID NO: 2872338 - DNA, 19 bp, Homo sapiens
tgattactgcaatcactgt

SEQ ID NO: 2872339 - DNA, 18 bp, Homo sapiens
tgatttccctccagagaa

SEQ ID NO: 2872340 - DNA, 22 bp, Homo sapiens
tgatttctaattgtaagtgaaa

SEQ ID NO: 2872341 - DNA, 16 bp, Homo sapiens
tgcaagtgagaagctg

SEQ ID NO: 2872342 - DNA, 13 bp, Homo sapiens
tgcaatcactgtg

SEQ ID NO: 2872343 - DNA, 14 bp, Homo sapiens
tgcaattcagtgtt

SEQ ID NO: 2872344 - DNA, 22 bp, Homo sapiens
tgcaccaagcaggaaatgaaaa

SEQ ID NO: 2872345 - DNA, 16 bp, Homo sapiens
tgcacctgtccccacc

SEQ ID NO: 2872346 - DNA, 10 bp, Homo sapiens
tgcactgaca

SEQ ID NO: 2872347 - DNA, 13 bp, Homo sapiens
tgcactgacaaga

SEQ ID NO: 2872348 - DNA, 18 bp, Homo sapiens
tgcactgacaagatggaa

SEQ ID NO: 2872349 - DNA, 13 bp, Homo sapiens
tgcactgttcccc

SEQ ID NO: 2872350 - DNA, 20 bp, Homo sapiens
tgcactgttccccctgtgca

SEQ ID NO: 2872351 - DNA, 21 bp, Homo sapiens
tgcactgttccccctgtgcag

SEQ ID NO: 2872352 - DNA, 19 bp, Homo sapiens
tgcacttttagaaatgcat

SEQ ID NO: 2872353 - DNA, 14 bp, Homo sapiens
tgcacttttgaatg

SEQ ID NO: 2872354 - DNA, 19 bp, Homo sapiens
tgcacttttgaatgtccaa

SEQ ID NO: 2872355 - DNA, 19 bp, Homo sapiens
tgcagaacccccaggtggc

SEQ ID NO: 2872356 - DNA, 22 bp, Homo sapiens
tgcagaacccccaggtggcctg

SEQ ID NO: 2872357 - DNA, 23 bp, Homo sapiens
tgcagaacccccaggtggcctgc

SEQ ID NO: 2872358 - DNA, 18 bp, Homo sapiens
tgcagaagcaataataaa

SEQ ID NO: 2872359 - DNA, 18 bp, Homo sapiens
tgcagcaaacactccacc

SEQ ID NO: 2872360 - DNA, 19 bp, Homo sapiens
tgcagcaaacactccaccc

SEQ ID NO: 2872361 - DNA, 14 bp, Homo sapiens
tgcagcacctccag

SEQ ID NO: 2872362 - DNA, 19 bp, Homo sapiens
ttgctgattcaagaaacag

SEQ ID NO: 2872363 - DNA, 13 bp, Homo sapiens
ttggactccaggc

SEQ ID NO: 2872364 - DNA, 16 bp, Homo sapiens
ttggactccaggcctg

SEQ ID NO: 2872365 - DNA, 15 bp, Homo sapiens
ttggacttctgaaga

SEQ ID NO: 2872366 - DNA, 14 bp, Homo sapiens
ttggagaatactgc

SEQ ID NO: 2872367 - DNA, 17 bp, Homo sapiens
ttggcaatgccatcatc

SEQ ID NO: 2872368 - DNA, 23 bp, Homo sapiens
ttggcattcaaccacgcaggaag

SEQ ID NO: 2872369 - DNA, 18 bp, Homo sapiens
ttggcctcctgcaaagtc

SEQ ID NO: 2872370 - DNA, 16 bp, Homo sapiens
ttggtgctttgcattt

SEQ ID NO: 2872371 - DNA, 18 bp, Homo sapiens
ttggttcccccactgatc

SEQ ID NO: 2872372 - DNA, 15 bp, Homo sapiens
ttggttctaatagaa

SEQ ID NO: 2872373 - DNA, 12 bp, Homo sapiens
ttggttttgaca

SEQ ID NO: 2872374 - DNA, 14 bp, Homo sapiens
ttgtacagccttat

SEQ ID NO: 2872375 - DNA, 17 bp, Homo sapiens
ttgtagaactcactctg

SEQ ID NO: 2872376 - DNA, 19 bp, Homo sapiens
ttgtagaactcactctggg

SEQ ID NO: 2872377 - DNA, 22 bp, Homo sapiens
ttgtagaactcactctgggctg

SEQ ID NO: 2872378 - DNA, 19 bp, Homo sapiens
ttgtatatgactgcatttg

SEQ ID NO: 2872379 - DNA, 20 bp, Homo sapiens
ttgtatgtttttctgtataa

SEQ ID NO: 2872380 - DNA, 22 bp, Homo sapiens
ttgtattctctgagctgtgcag

SEQ ID NO: 2872381 - DNA, 14 bp, Homo sapiens
ttgtcagcatctga

SEQ ID NO: 2872382 - DNA, 16 bp, Homo sapiens
ttgtcagcatctgacc

SEQ ID NO: 2872383 - DNA, 17 bp, Homo sapiens
ttgtcagcatctgacca

SEQ ID NO: 2872384 - DNA, 19 bp, Homo sapiens
ttgtcagcatctgaccatc

SEQ ID NO: 2872385 - DNA, 21 bp, Homo sapiens
ttgtcagcatctgaccatctg

SEQ ID NO: 2872386 - DNA, 23 bp, Homo sapiens
ttgtcagcatctgaccatctgtg

SEQ ID NO: 2872387 - DNA, 20 bp, Homo sapiens
ttgtccacttcattttgtat

SEQ ID NO: 2872388 - DNA, 20 bp, Homo sapiens
ttgtctagaggtgagaccaa

SEQ ID NO: 2872389 - DNA, 21 bp, Homo sapiens
ttgtcttatgtgaaaaattaa

SEQ ID NO: 2872390 - DNA, 22 bp, Homo sapiens
ttgtgttcagctctttccaaat

SEQ ID NO: 2872391 - DNA, 21 bp, Homo sapiens
ttgttattattagataatatt

SEQ ID NO: 2872392 - DNA, 22 bp, Homo sapiens
ttgttattttgcaacctcgctg

SEQ ID NO: 2872393 - DNA, 14 bp, Homo sapiens
ttgttgttgctgct

SEQ ID NO: 2872394 - DNA, 19 bp, Homo sapiens
ttgtttttcattcagtctt

SEQ ID NO: 2872395 - DNA, 12 bp, Homo sapiens
tttaaaagaaat

SEQ ID NO: 2872396 - DNA, 15 bp, Homo sapiens
tttaaagccttctgg

SEQ ID NO: 2872397 - DNA, 21 bp, Homo sapiens
tttaacatacaagaaaatgta

SEQ ID NO: 2872398 - DNA, 15 bp, Homo sapiens
tttaactagaattta

SEQ ID NO: 2872399 - DNA, 17 bp, Homo sapiens
tttaactagaatttatt

SEQ ID NO: 2872400 - DNA, 13 bp, Homo sapiens
tttaactgtgata

SEQ ID NO: 2872401 - DNA, 15 bp, Homo sapiens
tttaagataaattat

SEQ ID NO: 2872402 - DNA, 23 bp, Homo sapiens
tttagaaaaaatggatgcccaga

SEQ ID NO: 2872403 - DNA, 23 bp, Homo sapiens
tttagaaagaagcccaatattat

SEQ ID NO: 2872404 - DNA, 14 bp, Homo sapiens
tttagagagcctgt

SEQ ID NO: 2872405 - DNA, 15 bp, Homo sapiens
tttagtgaattaaat

SEQ ID NO: 2872406 - DNA, 15 bp, Homo sapiens
tttataatactacta

SEQ ID NO: 2872407 - DNA, 18 bp, Homo sapiens
tttatatttcaataaatg

SEQ ID NO: 2872408 - DNA, 20 bp, Homo sapiens
tttatattttagaaataata

SEQ ID NO: 2872409 - DNA, 13 bp, Homo sapiens
tttattacctctg

SEQ ID NO: 2872410 - DNA, 17 bp, Homo sapiens
tttattcaattcctctg

SEQ ID NO: 2872411 - DNA, 12 bp, Homo sapiens
tttattgcaatg

SEQ ID NO: 2872412 - DNA, 12 bp, Homo sapiens
tttatttttcat

SEQ ID NO: 2872413 - DNA, 17 bp, Homo sapiens
tttatttttcatttagt

SEQ ID NO: 2872414 - DNA, 15 bp, Homo sapiens
tttcaaaatacattt

SEQ ID NO: 2872415 - DNA, 19 bp, Homo sapiens
tttcaaaatacatttgtaa

SEQ ID NO: 2872416 - DNA, 21 bp, Homo sapiens
tttcaaattggagcttcatgg

SEQ ID NO: 2872417 - DNA, 18 bp, Homo sapiens
tttcaattgcatctccca

SEQ ID NO: 2872418 - DNA, 17 bp, Homo sapiens
tttcataagtatttcaa

SEQ ID NO: 2872419 - DNA, 19 bp, Homo sapiens
tttcataagtatttcaaat

SEQ ID NO: 2872420 - DNA, 13 bp, Homo sapiens
tttcatattgtaa

SEQ ID NO: 2872421 - DNA, 19 bp, Homo sapiens
tttcatgtaaactgtgcac

SEQ ID NO: 2872422 - DNA, 13 bp, Homo sapiens
tttccaaattaaa

SEQ ID NO: 2872423 - DNA, 20 bp, Homo sapiens
tttccaaattaaaacaaata

SEQ ID NO: 2872424 - DNA, 12 bp, Homo sapiens
tttcccaattca

SEQ ID NO: 2872425 - DNA, 15 bp, Homo sapiens
tttcccaattcacat

SEQ ID NO: 2872426 - DNA, 14 bp, Homo sapiens
tttcctacaaaatg

SEQ ID NO: 2872427 - DNA, 12 bp, Homo sapiens
tttcctccccac

SEQ ID NO: 2872428 - DNA, 14 bp, Homo sapiens
tttcctccccacct

SEQ ID NO: 2872429 - DNA, 14 bp, Homo sapiens
tttcctctgcagca

SEQ ID NO: 2872430 - DNA, 19 bp, Homo sapiens
tttccttctggttctaact

SEQ ID NO: 2872431 - DNA, 20 bp, Homo sapiens
tttctaaataaaaatatgta

SEQ ID NO: 2872432 - DNA, 21 bp, Homo sapiens
tttctaaataaaaatatgtaa

SEQ ID NO: 2872433 - DNA, 16 bp, Homo sapiens
tttctaagaaaatgta

SEQ ID NO: 2872434 - DNA, 13 bp, Homo sapiens
tttctaattgtaa

SEQ ID NO: 2872435 - DNA, 18 bp, Homo sapiens
tttctactttgaagtcat

SEQ ID NO: 2872436 - DNA, 21 bp, Homo sapiens
tttctagctgttgagctgttt

SEQ ID NO: 2872437 - DNA, 12 bp, Homo sapiens
tttctcctgcag

SEQ ID NO: 2872438 - DNA, 17 bp, Homo sapiens
tttcttatccaactttt

SEQ ID NO: 2872439 - DNA, 20 bp, Homo sapiens
tttcttcatgcctgatgaaa

SEQ ID NO: 2872440 - DNA, 15 bp, Homo sapiens
tttgaactttggaac

SEQ ID NO: 2872441 - DNA, 22 bp, Homo sapiens
tttgaagtcataccaatgaaaa

SEQ ID NO: 2872442 - DNA, 17 bp, Homo sapiens
tttgacaggttttccaa

SEQ ID NO: 2872443 - DNA, 15 bp, Homo sapiens
tttgacatttatatt

SEQ ID NO: 2872444 - DNA, 14 bp, Homo sapiens
tttgagtgctctga

SEQ ID NO: 2872445 - DNA, 14 bp, Homo sapiens
tttgagtgttttaa

SEQ ID NO: 2872446 - DNA, 14 bp, Homo sapiens
tttgatttctaatt

SEQ ID NO: 2872447 - DNA, 13 bp, Homo sapiens
tttgcaatactgc

SEQ ID NO: 2872448 - DNA, 15 bp, Homo sapiens
tttgcaatactgctt

SEQ ID NO: 2872449 - DNA, 13 bp, Homo sapiens
tttgcacctgtcc

SEQ ID NO: 2872450 - DNA, 16 bp, Homo sapiens
tttgcataacaattcc

SEQ ID NO: 2872451 - DNA, 13 bp, Homo sapiens
tttggacaaaatg

SEQ ID NO: 2872452 - DNA, 18 bp, Homo sapiens
tttgtatatgactgcatt

SEQ ID NO: 2872453 - DNA, 16 bp, Homo sapiens
tttgtattctctgagc

SEQ ID NO: 2872454 - DNA, 17 bp, Homo sapiens
tttgtatttctctattt

SEQ ID NO: 2872455 - DNA, 15 bp, Homo sapiens
tttgtcagcatctga

SEQ ID NO: 2872456 - DNA, 15 bp, Homo sapiens
tttgtgactttttaa

SEQ ID NO: 2872457 - DNA, 15 bp, Homo sapiens
tttgttattttgcaa

SEQ ID NO: 2872458 - DNA, 13 bp, Homo sapiens
tttgtttcacttt

SEQ ID NO: 2872459 - DNA, 23 bp, Homo sapiens
tttgttttaaaacgtgtaaatga

SEQ ID NO: 2872460 - DNA, 14 bp, Homo sapiens
ttttaaaacgtgta

SEQ ID NO: 2872461 - DNA, 12 bp, Homo sapiens
ttttaactagaa

SEQ ID NO: 2872462 - DNA, 12 bp, Homo sapiens
ttttaactgtga

SEQ ID NO: 2872463 - DNA, 21 bp, Homo sapiens
ttttaatgctgtttctaagaa

SEQ ID NO: 2872464 - DNA, 14 bp, Homo sapiens
ttttagaaatgcat

SEQ ID NO: 2872465 - DNA, 22 bp, Homo sapiens
ttttagaaatgcatatttgcca

SEQ ID NO: 2872466 - DNA, 19 bp, Homo sapiens
ttttatcattaaaaattac

SEQ ID NO: 2872467 - DNA, 21 bp, Homo sapiens
ttttcacaatcttggggctga

SEQ ID NO: 2872468 - DNA, 23 bp, Homo sapiens
ttttcatagtaagtgcgaagact

SEQ ID NO: 2872469 - DNA, 20 bp, Homo sapiens
ttttccagctggatgagaat

SEQ ID NO: 2872470 - DNA, 23 bp, Homo sapiens
ttttctgaggatagtagttaaat

SEQ ID NO: 2872471 - DNA, 17 bp, Homo sapiens
ttttgaaatgaactttg

SEQ ID NO: 2872472 - DNA, 21 bp, Homo sapiens
aatgatatataatttaaagtt

SEQ ID NO: 2872473 - DNA, 13 bp, Homo sapiens
aatgattcagtgt

SEQ ID NO: 2872474 - DNA, 14 bp, Homo sapiens
aatgattcagtgtt

SEQ ID NO: 2872475 - DNA, 12 bp, Homo sapiens
aatgccagagcc

SEQ ID NO: 2872476 - DNA, 15 bp, Homo sapiens
aatgcccctgttcat

SEQ ID NO: 2872477 - DNA, 17 bp, Homo sapiens
aatgccttgggagagat

SEQ ID NO: 2872478 - DNA, 15 bp, Homo sapiens
aatgctaaatgtgta

SEQ ID NO: 2872479 - DNA, 17 bp, Homo sapiens
aatgctcccacctgaat

SEQ ID NO: 2872480 - DNA, 23 bp, Homo sapiens
aatgctggactggaggcccctgg

SEQ ID NO: 2872481 - DNA, 19 bp, Homo sapiens
aatgctgtttctaagaaaa

SEQ ID NO: 2872482 - DNA, 13 bp, Homo sapiens
aatgcttcattat

SEQ ID NO: 2872483 - DNA, 14 bp, Homo sapiens
aatggagggagcca

SEQ ID NO: 2872484 - DNA, 15 bp, Homo sapiens
aatgggagccaggag

SEQ ID NO: 2872485 - DNA, 19 bp, Homo sapiens
aatgggatattttgaaatg

SEQ ID NO: 2872486 - DNA, 14 bp, Homo sapiens
aatggtccaggaga

SEQ ID NO: 2872487 - DNA, 19 bp, Homo sapiens
aatggtccaggagaaggcc

SEQ ID NO: 2872488 - DNA, 18 bp, Homo sapiens
aatggtgtggtgaatgtg

SEQ ID NO: 2872489 - DNA, 14 bp, Homo sapiens
aatgtatatgcact

SEQ ID NO: 2872490 - DNA, 16 bp, Homo sapiens
aatgtatcttattcac

SEQ ID NO: 2872491 - DNA, 20 bp, Homo sapiens
aatgtccaaaatttatattt

SEQ ID NO: 2872492 - DNA, 20 bp, Homo sapiens
aatgtcttgatgcatgcact

SEQ ID NO: 2872493 - DNA, 20 bp, Homo sapiens
aatgtgatgaatactgtatt

SEQ ID NO: 2872494 - DNA, 16 bp, Homo sapiens
aatgtggtctgccaat

SEQ ID NO: 2872495 - DNA, 15 bp, Homo sapiens
aatgtgtgagaaaaa

SEQ ID NO: 2872496 - DNA, 15 bp, Homo sapiens
aatgttacattgttt

SEQ ID NO: 2872497 - DNA, 18 bp, Homo sapiens
aattaaaaacgaaaacct

SEQ ID NO: 2872498 - DNA, 16 bp, Homo sapiens
aattaagcattttgaa

SEQ ID NO: 2872499 - DNA, 16 bp, Homo sapiens
aattacctttaatttt

SEQ ID NO: 2872500 - DNA, 17 bp, Homo sapiens
aattacctttaatttta

SEQ ID NO: 2872501 - DNA, 17 bp, Homo sapiens
aattagtaacatgtgtt

SEQ ID NO: 2872502 - DNA, 19 bp, Homo sapiens
aattagtggtcataaaata

SEQ ID NO: 2872503 - DNA, 21 bp, Homo sapiens
aattagtggtcataaaataga

SEQ ID NO: 2872504 - DNA, 22 bp, Homo sapiens
aattatagtgatgtaatcttga

SEQ ID NO: 2872505 - DNA, 16 bp, Homo sapiens
aattatgtaaataact

SEQ ID NO: 2872506 - DNA, 22 bp, Homo sapiens
aattcacatctaacctcatctt

SEQ ID NO: 2872507 - DNA, 14 bp, Homo sapiens
aattccagatttgt

SEQ ID NO: 2872508 - DNA, 19 bp, Homo sapiens
aattccaggctgagccatg

SEQ ID NO: 2872509 - DNA, 20 bp, Homo sapiens
aattccaggctgagccatga

SEQ ID NO: 2872510 - DNA, 13 bp, Homo sapiens
aattcctctggga

SEQ ID NO: 2872511 - DNA, 18 bp, Homo sapiens
aattctcgggaaattatt

SEQ ID NO: 2872512 - DNA, 19 bp, Homo sapiens
aattcttggttgaggaaac

SEQ ID NO: 2872513 - DNA, 13 bp, Homo sapiens
aattcttttctga

SEQ ID NO: 2872514 - DNA, 14 bp, Homo sapiens
aattcttttctgag

SEQ ID NO: 2872515 - DNA, 23 bp, Homo sapiens
aattgctgataccatatgaatga

SEQ ID NO: 2872516 - DNA, 10 bp, Homo sapiens
aattgtaagt

SEQ ID NO: 2872517 - DNA, 15 bp, Homo sapiens
aattgtaagtgaaat

SEQ ID NO: 2872518 - DNA, 11 bp, Homo sapiens
aattgtccctt

SEQ ID NO: 2872519 - DNA, 18 bp, Homo sapiens
aatttagtaaataaacaa

SEQ ID NO: 2872520 - DNA, 15 bp, Homo sapiens
aatttcaaaatacat

SEQ ID NO: 2872521 - DNA, 22 bp, Homo sapiens
aatttcaaaatacatttgtaag

SEQ ID NO: 2872522 - DNA, 15 bp, Homo sapiens
aatttctactttgaa

SEQ ID NO: 2872523 - DNA, 12 bp, Homo sapiens
aatttgaacttt

SEQ ID NO: 2872524 - DNA, 15 bp, Homo sapiens
aatttgaactttgga

SEQ ID NO: 2872525 - DNA, 16 bp, Homo sapiens
aatttggttctaatag

SEQ ID NO: 2872526 - DNA, 17 bp, Homo sapiens
aatttggttctaggccg

SEQ ID NO: 2872527 - DNA, 14 bp, Homo sapiens
aatttgtatatgac

SEQ ID NO: 2872528 - DNA, 21 bp, Homo sapiens
aatttgtatatgactgcattt

SEQ ID NO: 2872529 - DNA, 18 bp, Homo sapiens
aatttgttattttgcaac

SEQ ID NO: 2872530 - DNA, 20 bp, Homo sapiens
aattttaatgctgtttctaa

SEQ ID NO: 2872531 - DNA, 21 bp, Homo sapiens
aattttaatgctgtttctaag

SEQ ID NO: 2872532 - DNA, 19 bp, Homo sapiens
aattttcctaataaagttc

SEQ ID NO: 2872533 - DNA, 13 bp, Homo sapiens
aatttttaactgt

SEQ ID NO: 2872534 - DNA, 16 bp, Homo sapiens
acaaaatggtcctatt

SEQ ID NO: 2872535 - DNA, 15 bp, Homo sapiens
acaaacaaaactctt

SEQ ID NO: 2872536 - DNA, 14 bp, Homo sapiens
acaaacatgaccct

SEQ ID NO: 2872537 - DNA, 19 bp, Homo sapiens
acaaactcatcctctttta

SEQ ID NO: 2872538 - DNA, 16 bp, Homo sapiens
acaaagtactctttaa

SEQ ID NO: 2872539 - DNA, 17 bp, Homo sapiens
acaaataatttgaactt

SEQ ID NO: 2872540 - DNA, 15 bp, Homo sapiens
acaaatactcttagg

SEQ ID NO: 2872541 - DNA, 21 bp, Homo sapiens
acaaatgaagaaagtcaaaaa

SEQ ID NO: 2872542 - DNA, 17 bp, Homo sapiens
acaaatgacagatcttt

SEQ ID NO: 2872543 - DNA, 23 bp, Homo sapiens
acaaatgctcccacctgaatttg

SEQ ID NO: 2872544 - DNA, 13 bp, Homo sapiens
acaagctgtatca

SEQ ID NO: 2872545 - DNA, 17 bp, Homo sapiens
acaatctatggcttatt

SEQ ID NO: 2872546 - DNA, 22 bp, Homo sapiens
acaatctatggcttatttctat

SEQ ID NO: 2872547 - DNA, 22 bp, Homo sapiens
acaattcctctactaacaatca

SEQ ID NO: 2872548 - DNA, 16 bp, Homo sapiens
acaatttatactgcga

SEQ ID NO: 2872549 - DNA, 16 bp, Homo sapiens
acacatcaaataaact

SEQ ID NO: 2872550 - DNA, 15 bp, Homo sapiens
acacatggacacaga

SEQ ID NO: 2872551 - DNA, 18 bp, Homo sapiens
acactatggtatttgagt

SEQ ID NO: 2872552 - DNA, 19 bp, Homo sapiens
acactatggtatttgagtg

SEQ ID NO: 2872553 - DNA, 15 bp, Homo sapiens
acactcaataaacag

SEQ ID NO: 2872554 - DNA, 20 bp, Homo sapiens
acactcaataaacagtcact

SEQ ID NO: 2872555 - DNA, 18 bp, Homo sapiens
acactccaccctccacct

SEQ ID NO: 2872556 - DNA, 15 bp, Homo sapiens
acactgcggaagcca

SEQ ID NO: 2872557 - DNA, 23 bp, Homo sapiens
acactgcggaagccaaaggcagc

SEQ ID NO: 2872558 - DNA, 19 bp, Homo sapiens
acactgtccttccctgcca

SEQ ID NO: 2872559 - DNA, 20 bp, Homo sapiens
acactgtgcacatctgtgtc

SEQ ID NO: 2872560 - DNA, 13 bp, Homo sapiens
acagacctggctc

SEQ ID NO: 2872561 - DNA, 15 bp, Homo sapiens
acagcctcccctgcc

SEQ ID NO: 2872562 - DNA, 17 bp, Homo sapiens
acagcctcccctgccag

SEQ ID NO: 2872563 - DNA, 22 bp, Homo sapiens
acagcctcccctgccagggcag

SEQ ID NO: 2872564 - DNA, 23 bp, Homo sapiens
acagccttattttgttggtgctt

SEQ ID NO: 2872565 - DNA, 18 bp, Homo sapiens
acagcttcctttcctgtg

SEQ ID NO: 2872566 - DNA, 17 bp, Homo sapiens
acaggaggggcccacaa

SEQ ID NO: 2872567 - DNA, 19 bp, Homo sapiens
acaggaggggcccacaatg

SEQ ID NO: 2872568 - DNA, 17 bp, Homo sapiens
acaggcacattaactgt

SEQ ID NO: 2872569 - DNA, 20 bp, Homo sapiens
acagggacttgtttagagag

SEQ ID NO: 2872570 - DNA, 23 bp, Homo sapiens
acagggacttgtttagagagcct

SEQ ID NO: 2872571 - DNA, 15 bp, Homo sapiens
acaggtctagacttt

SEQ ID NO: 2872572 - DNA, 21 bp, Homo sapiens
acaggttttccaaaagtaaag

SEQ ID NO: 2872573 - DNA, 23 bp, Homo sapiens
acagtaaacactccacattcttc

SEQ ID NO: 2872574 - DNA, 19 bp, Homo sapiens
acagtcttccatttgcaag

SEQ ID NO: 2872575 - DNA, 13 bp, Homo sapiens
acatacaagaaaa

SEQ ID NO: 2872576 - DNA, 14 bp, Homo sapiens
acatacaagaaaat

SEQ ID NO: 2872577 - DNA, 18 bp, Homo sapiens
acatacaagaaaatgtat

SEQ ID NO: 2872578 - DNA, 22 bp, Homo sapiens
acatagaccctctttcttgttt

SEQ ID NO: 2872579 - DNA, 23 bp, Homo sapiens
acatatttgtatgtttttctgta

SEQ ID NO: 2872580 - DNA, 14 bp, Homo sapiens
acatcaaataaact

SEQ ID NO: 2872581 - DNA, 14 bp, Homo sapiens
acatccaagccaga

SEQ ID NO: 2872582 - DNA, 18 bp, Homo sapiens
agctctctaggcctctcc

SEQ ID NO: 2872583 - DNA, 19 bp, Homo sapiens
agctctctaggcctctcca

SEQ ID NO: 2872584 - DNA, 12 bp, Homo sapiens
agctctgtatca

SEQ ID NO: 2872585 - DNA, 22 bp, Homo sapiens
agctctgtatcaggacccagag

SEQ ID NO: 2872586 - DNA, 12 bp, Homo sapiens
agctcttctctt

SEQ ID NO: 2872587 - DNA, 15 bp, Homo sapiens
agctctttccaaatt

SEQ ID NO: 2872588 - DNA, 18 bp, Homo sapiens
agctcttttctcctgcag

SEQ ID NO: 2872589 - DNA, 17 bp, Homo sapiens
agctgcaccatcacaca

SEQ ID NO: 2872590 - DNA, 13 bp, Homo sapiens
agctgctgttgaa

SEQ ID NO: 2872591 - DNA, 15 bp, Homo sapiens
agctgctgttgaact

SEQ ID NO: 2872592 - DNA, 11 bp, Homo sapiens
agctggactga

SEQ ID NO: 2872593 - DNA, 12 bp, Homo sapiens
agctggactgac

SEQ ID NO: 2872594 - DNA, 13 bp, Homo sapiens
agctggactgacc

SEQ ID NO: 2872595 - DNA, 14 bp, Homo sapiens
agctggactgacca

SEQ ID NO: 2872596 - DNA, 16 bp, Homo sapiens
agctggcgactgcagc

SEQ ID NO: 2872597 - DNA, 20 bp, Homo sapiens
agctggcgactgcagctgca

SEQ ID NO: 2872598 - DNA, 14 bp, Homo sapiens
agctgggcctcctg

SEQ ID NO: 2872599 - DNA, 18 bp, Homo sapiens
agctgggggaagggtggt

SEQ ID NO: 2872600 - DNA, 14 bp, Homo sapiens
agctgtcctgcagc

SEQ ID NO: 2872601 - DNA, 15 bp, Homo sapiens
agctgtcctgcagca

SEQ ID NO: 2872602 - DNA, 17 bp, Homo sapiens
agctgttattcttgtta

SEQ ID NO: 2872603 - DNA, 14 bp, Homo sapiens
agctgttgagctgt

SEQ ID NO: 2872604 - DNA, 18 bp, Homo sapiens
agctgttttccctgacct

SEQ ID NO: 2872605 - DNA, 15 bp, Homo sapiens
agcttctctgggctg

SEQ ID NO: 2872606 - DNA, 13 bp, Homo sapiens
agcttgagcctcc

SEQ ID NO: 2872607 - DNA, 21 bp, Homo sapiens
agcttgagcctcccccaaagc

SEQ ID NO: 2872608 - DNA, 20 bp, Homo sapiens
agcttgaggccaagatggct

SEQ ID NO: 2872609 - DNA, 21 bp, Homo sapiens
agctttagtgaattaaattta

SEQ ID NO: 2872610 - DNA, 22 bp, Homo sapiens
aggaaaaatgggagccaggagt

SEQ ID NO: 2872611 - DNA, 13 bp, Homo sapiens
aggaaacatttta

SEQ ID NO: 2872612 - DNA, 14 bp, Homo sapiens
aggaagtaggaagt

SEQ ID NO: 2872613 - DNA, 15 bp, Homo sapiens
aggaatgctggactg

SEQ ID NO: 2872614 - DNA, 17 bp, Homo sapiens
aggaatgctggactgga

SEQ ID NO: 2872615 - DNA, 20 bp, Homo sapiens
aggacataaattagaggtct

SEQ ID NO: 2872616 - DNA, 20 bp, Homo sapiens
aggaccagtcaacctgggca

SEQ ID NO: 2872617 - DNA, 19 bp, Homo sapiens
aggactcccaaccctggct

SEQ ID NO: 2872618 - DNA, 18 bp, Homo sapiens
aggacttggttgatgttt

SEQ ID NO: 2872619 - DNA, 12 bp, Homo sapiens
aggagacagaaa

SEQ ID NO: 2872620 - DNA, 14 bp, Homo sapiens
aggagacagaaagc

SEQ ID NO: 2872621 - DNA, 16 bp, Homo sapiens
aggagacagaaagcct

SEQ ID NO: 2872622 - DNA, 22 bp, Homo sapiens
aggagatgctccttgggccctt

SEQ ID NO: 2872623 - DNA, 16 bp, Homo sapiens
aggagccccattcctg

SEQ ID NO: 2872624 - DNA, 19 bp, Homo sapiens
aggagccccattcctggga

SEQ ID NO: 2872625 - DNA, 21 bp, Homo sapiens
aggagccccattcctgggaaa

SEQ ID NO: 2872626 - DNA, 21 bp, Homo sapiens
aggagcgtggactctgctaga

SEQ ID NO: 2872627 - DNA, 17 bp, Homo sapiens
aggaggaatgctggact

SEQ ID NO: 2872628 - DNA, 19 bp, Homo sapiens
aggaggaatgctggactgg

SEQ ID NO: 2872629 - DNA, 22 bp, Homo sapiens
aggaggaatgctggactggagg

SEQ ID NO: 2872630 - DNA, 19 bp, Homo sapiens
aggagttcctaaccagcct

SEQ ID NO: 2872631 - DNA, 12 bp, Homo sapiens
aggcaagagaaa

SEQ ID NO: 2872632 - DNA, 12 bp, Homo sapiens
aggcaagagaat

SEQ ID NO: 2872633 - DNA, 12 bp, Homo sapiens
aggcaagcttga

SEQ ID NO: 2872634 - DNA, 18 bp, Homo sapiens
aggcaagcttgaggccaa

SEQ ID NO: 2872635 - DNA, 19 bp, Homo sapiens
aggcagcagtgtgaggcca

SEQ ID NO: 2872636 - DNA, 20 bp, Homo sapiens
aggcagcagtgtgaggccag

SEQ ID NO: 2872637 - DNA, 22 bp, Homo sapiens
aggcagcagtgtgaggccaggg

SEQ ID NO: 2872638 - DNA, 23 bp, Homo sapiens
aggcagcagtgtgaggccagggc

SEQ ID NO: 2872639 - DNA, 20 bp, Homo sapiens
aggcagctaagatagaaagc

SEQ ID NO: 2872640 - DNA, 22 bp, Homo sapiens
aggcaggggtgggagagccagc

SEQ ID NO: 2872641 - DNA, 23 bp, Homo sapiens
aggcaggggtgggagagccagct

SEQ ID NO: 2872642 - DNA, 18 bp, Homo sapiens
aggcataaacctgtgctg

SEQ ID NO: 2872643 - DNA, 16 bp, Homo sapiens
aggcatgtacaaaaat

SEQ ID NO: 2872644 - DNA, 18 bp, Homo sapiens
aggcatgtacaaaaatta

SEQ ID NO: 2872645 - DNA, 13 bp, Homo sapiens
aggcattgccaag

SEQ ID NO: 2872646 - DNA, 14 bp, Homo sapiens
aggcattgccaagg

SEQ ID NO: 2872647 - DNA, 20 bp, Homo sapiens
aggcattgccaagggctttg

SEQ ID NO: 2872648 - DNA, 17 bp, Homo sapiens
aggccaagatggctgct

SEQ ID NO: 2872649 - DNA, 19 bp, Homo sapiens
aggccaagatggctgctgc

SEQ ID NO: 2872650 - DNA, 21 bp, Homo sapiens
aggccaagatggctgctgcct

SEQ ID NO: 2872651 - DNA, 23 bp, Homo sapiens
aggccacagaaggtgaactttgt

SEQ ID NO: 2872652 - DNA, 13 bp, Homo sapiens
aggcctgaccagg

SEQ ID NO: 2872653 - DNA, 17 bp, Homo sapiens
aggccttcatcctcctc

SEQ ID NO: 2872654 - DNA, 18 bp, Homo sapiens
aggccttcatcctcctcc

SEQ ID NO: 2872655 - DNA, 13 bp, Homo sapiens
aggctgagaaagc

SEQ ID NO: 2872656 - DNA, 11 bp, Homo sapiens
aggctgagcca

SEQ ID NO: 2872657 - DNA, 18 bp, Homo sapiens
aggctgagccatgaggag

SEQ ID NO: 2872658 - DNA, 21 bp, Homo sapiens
aggctgcacctctggctagag

SEQ ID NO: 2872659 - DNA, 22 bp, Homo sapiens
aggctggatgtgcattagcctg

SEQ ID NO: 2872660 - DNA, 18 bp, Homo sapiens
agggaagaaggaggaatg

SEQ ID NO: 2872661 - DNA, 13 bp, Homo sapiens
agggaagtgggga

SEQ ID NO: 2872662 - DNA, 18 bp, Homo sapiens
agggacaagggattctgg

SEQ ID NO: 2872663 - DNA, 16 bp, Homo sapiens
agggacataagataaa

SEQ ID NO: 2872664 - DNA, 15 bp, Homo sapiens
agggacgcctggggg

SEQ ID NO: 2872665 - DNA, 22 bp, Homo sapiens
agggacttgtttagagagcctg

SEQ ID NO: 2872666 - DNA, 17 bp, Homo sapiens
agggagcccctttgatg

SEQ ID NO: 2872667 - DNA, 19 bp, Homo sapiens
agggatccctcatctgtcc

SEQ ID NO: 2872668 - DNA, 16 bp, Homo sapiens
agggatgccacccagc

SEQ ID NO: 2872669 - DNA, 18 bp, Homo sapiens
agggcactgggctgttgt

SEQ ID NO: 2872670 - DNA, 17 bp, Homo sapiens
agggcagggccccaggc

SEQ ID NO: 2872671 - DNA, 20 bp, Homo sapiens
agggcagtcgatagagctgt

SEQ ID NO: 2872672 - DNA, 21 bp, Homo sapiens
agggccacatgggaggctcac

SEQ ID NO: 2872673 - DNA, 15 bp, Homo sapiens
agggctaccctgagc

SEQ ID NO: 2872674 - DNA, 17 bp, Homo sapiens
agggctaccctgagctg

SEQ ID NO: 2872675 - DNA, 21 bp, Homo sapiens
agggctaccctgagctgaggc

SEQ ID NO: 2872676 - DNA, 15 bp, Homo sapiens
aggggagagagggac

SEQ ID NO: 2872677 - DNA, 17 bp, Homo sapiens
aggggccagaggctcgt

SEQ ID NO: 2872678 - DNA, 17 bp, Homo sapiens
aggggccttagggcact

SEQ ID NO: 2872679 - DNA, 21 bp, Homo sapiens
agggggtggttattggactcc

SEQ ID NO: 2872680 - DNA, 20 bp, Homo sapiens
agggtctaccaatacaaaat

SEQ ID NO: 2872681 - DNA, 22 bp, Homo sapiens
agggtgggccactctcccctcc

SEQ ID NO: 2872682 - DNA, 23 bp, Homo sapiens
agggtgggccactctcccctccc

SEQ ID NO: 2872683 - DNA, 23 bp, Homo sapiens
agggtgtggtatgagggggtggt

SEQ ID NO: 2872684 - DNA, 16 bp, Homo sapiens
aggtcaggagttccta

SEQ ID NO: 2872685 - DNA, 15 bp, Homo sapiens
aggtccagctgggcc

SEQ ID NO: 2872686 - DNA, 18 bp, Homo sapiens
aggtccagctgggcctcc

SEQ ID NO: 2872687 - DNA, 23 bp, Homo sapiens
aggtccagctgggcctcctgcct

SEQ ID NO: 2872688 - DNA, 17 bp, Homo sapiens
aggtctagactttctca

SEQ ID NO: 2872689 - DNA, 20 bp, Homo sapiens
aggtctagactttctcagtg

SEQ ID NO: 2872690 - DNA, 23 bp, Homo sapiens
aggtgagaccaaaggatccagag

SEQ ID NO: 2872691 - DNA, 20 bp, Homo sapiens
aggtgctacacccttttcca

SEQ ID NO: 2872692 - DNA, 19 bp, Homo sapiens
caacactgtccttccctgc

SEQ ID NO: 2872693 - DNA, 21 bp, Homo sapiens
caacagacacaatttatactg

SEQ ID NO: 2872694 - DNA, 18 bp, Homo sapiens
caacatggtgaaaccccg

SEQ ID NO: 2872695 - DNA, 16 bp, Homo sapiens
caaccacgcaggaagc

SEQ ID NO: 2872696 - DNA, 16 bp, Homo sapiens
caacccccatttctat

SEQ ID NO: 2872697 - DNA, 17 bp, Homo sapiens
caaccttagatgttcta

SEQ ID NO: 2872698 - DNA, 13 bp, Homo sapiens
caaccttgtttaa

SEQ ID NO: 2872699 - DNA, 14 bp, Homo sapiens
caacttcagtccaa

SEQ ID NO: 2872700 - DNA, 15 bp, Homo sapiens
caagaaacagccagc

SEQ ID NO: 2872701 - DNA, 22 bp, Homo sapiens
caagaaatccagtttcccacca

SEQ ID NO: 2872702 - DNA, 19 bp, Homo sapiens
caagaatgaaaaatataat

SEQ ID NO: 2872703 - DNA, 21 bp, Homo sapiens
caagaatgaaaaatataatgt

SEQ ID NO: 2872704 - DNA, 15 bp, Homo sapiens
caagactctgtctca

SEQ ID NO: 2872705 - DNA, 13 bp, Homo sapiens
caagagaaaataa

SEQ ID NO: 2872706 - DNA, 21 bp, Homo sapiens
caagagggtgacagcttcctt

SEQ ID NO: 2872707 - DNA, 15 bp, Homo sapiens
caagatggaaaataa

SEQ ID NO: 2872708 - DNA, 19 bp, Homo sapiens
caagatggctgctgcctgc

SEQ ID NO: 2872709 - DNA, 20 bp, Homo sapiens
caagatggctgctgcctgct

SEQ ID NO: 2872710 - DNA, 22 bp, Homo sapiens
caagatggctgctgcctgctca

SEQ ID NO: 2872711 - DNA, 11 bp, Homo sapiens
caagccagagt

SEQ ID NO: 2872712 - DNA, 18 bp, Homo sapiens
caagccccaactttctta

SEQ ID NO: 2872713 - DNA, 16 bp, Homo sapiens
caagctgtatcactgc

SEQ ID NO: 2872714 - DNA, 22 bp, Homo sapiens
caagcttgaggccaagatggct

SEQ ID NO: 2872715 - DNA, 12 bp, Homo sapiens
caaggaacaaga

SEQ ID NO: 2872716 - DNA, 22 bp, Homo sapiens
caaggctgtgtttagattgtat

SEQ ID NO: 2872717 - DNA, 20 bp, Homo sapiens
caagggctttgttttgcaca

SEQ ID NO: 2872718 - DNA, 16 bp, Homo sapiens
caataaacaacagctg

SEQ ID NO: 2872719 - DNA, 21 bp, Homo sapiens
caataaacaacagctgaagca

SEQ ID NO: 2872720 - DNA, 15 bp, Homo sapiens
caataaacagtcact

SEQ ID NO: 2872721 - DNA, 18 bp, Homo sapiens
caataaacagtcactgga

SEQ ID NO: 2872722 - DNA, 13 bp, Homo sapiens
caataataaagta

SEQ ID NO: 2872723 - DNA, 23 bp, Homo sapiens
caataataaagtacttgactacc

SEQ ID NO: 2872724 - DNA, 12 bp, Homo sapiens
caatacaaaatg

SEQ ID NO: 2872725 - DNA, 14 bp, Homo sapiens
caatacaaaatgta

SEQ ID NO: 2872726 - DNA, 11 bp, Homo sapiens
caatactgctt

SEQ ID NO: 2872727 - DNA, 16 bp, Homo sapiens
caatatgaatctataa

SEQ ID NO: 2872728 - DNA, 19 bp, Homo sapiens
caatatgaatctataagta

SEQ ID NO: 2872729 - DNA, 15 bp, Homo sapiens
caatcagctccttcc

SEQ ID NO: 2872730 - DNA, 16 bp, Homo sapiens
caatcagctccttcct

SEQ ID NO: 2872731 - DNA, 21 bp, Homo sapiens
caatccatcgtattaaaaaac

SEQ ID NO: 2872732 - DNA, 20 bp, Homo sapiens
caatcctatgtttttgttca

SEQ ID NO: 2872733 - DNA, 18 bp, Homo sapiens
caatctgggactttcact

SEQ ID NO: 2872734 - DNA, 16 bp, Homo sapiens
caatctgtacaaaatg

SEQ ID NO: 2872735 - DNA, 15 bp, Homo sapiens
caatgaaaaaatgta

SEQ ID NO: 2872736 - DNA, 14 bp, Homo sapiens
caatgccatcatct

SEQ ID NO: 2872737 - DNA, 12 bp, Homo sapiens
caatgcctcagt

SEQ ID NO: 2872738 - DNA, 17 bp, Homo sapiens
caatgccttgggagaga

SEQ ID NO: 2872739 - DNA, 16 bp, Homo sapiens
caatggaaaatataat

SEQ ID NO: 2872740 - DNA, 21 bp, Homo sapiens
caatggtgtggtgaatgtgtg

SEQ ID NO: 2872741 - DNA, 11 bp, Homo sapiens
caatgtcttga

SEQ ID NO: 2872742 - DNA, 21 bp, Homo sapiens
caatgtcttgatgcatgcact

SEQ ID NO: 2872743 - DNA, 18 bp, Homo sapiens
caatgtgagtcccagagc

SEQ ID NO: 2872744 - DNA, 19 bp, Homo sapiens
caatgtgagtcccagagcc

SEQ ID NO: 2872745 - DNA, 21 bp, Homo sapiens
caatgtgagtcccagagcccg

SEQ ID NO: 2872746 - DNA, 18 bp, Homo sapiens
caattagtggtcataaaa

SEQ ID NO: 2872747 - DNA, 21 bp, Homo sapiens
caattagtggtcataaaatag

SEQ ID NO: 2872748 - DNA, 15 bp, Homo sapiens
caattccaggctgag

SEQ ID NO: 2872749 - DNA, 21 bp, Homo sapiens
caattccaggctgagccatga

SEQ ID NO: 2872750 - DNA, 23 bp, Homo sapiens
caattccaggctgagccatgagg

SEQ ID NO: 2872751 - DNA, 14 bp, Homo sapiens
caattcctctggga

SEQ ID NO: 2872752 - DNA, 14 bp, Homo sapiens
caattgcatctccc

SEQ ID NO: 2872753 - DNA, 17 bp, Homo sapiens
caattgcatctcccaga

SEQ ID NO: 2872754 - DNA, 18 bp, Homo sapiens
caattgcgaccttaattt

SEQ ID NO: 2872755 - DNA, 14 bp, Homo sapiens
caatttaaaacaat

SEQ ID NO: 2872756 - DNA, 12 bp, Homo sapiens
cacaacttgttt

SEQ ID NO: 2872757 - DNA, 20 bp, Homo sapiens
cacaacttgtttttggtttt

SEQ ID NO: 2872758 - DNA, 23 bp, Homo sapiens
cacaatcttggggctgatgaaga

SEQ ID NO: 2872759 - DNA, 22 bp, Homo sapiens
cacaatggagtgggagatcagc

SEQ ID NO: 2872760 - DNA, 16 bp, Homo sapiens
cacacatggacacaga

SEQ ID NO: 2872761 - DNA, 18 bp, Homo sapiens
cacaccaaccaggccttc

SEQ ID NO: 2872762 - DNA, 17 bp, Homo sapiens
cacagaaggtgaacttt

SEQ ID NO: 2872763 - DNA, 14 bp, Homo sapiens
cacagacccacaca

SEQ ID NO: 2872764 - DNA, 20 bp, Homo sapiens
cacagagctggcgactgcag

SEQ ID NO: 2872765 - DNA, 19 bp, Homo sapiens
cacagcctcccctgccagg

SEQ ID NO: 2872766 - DNA, 20 bp, Homo sapiens
cacaggcacattaactgttg

SEQ ID NO: 2872767 - DNA, 23 bp, Homo sapiens
cacagttgtgttcctgacactca

SEQ ID NO: 2872768 - DNA, 17 bp, Homo sapiens
cacatctaacctcatct

SEQ ID NO: 2872769 - DNA, 16 bp, Homo sapiens
cacatctgtgtcttgt

SEQ ID NO: 2872770 - DNA, 18 bp, Homo sapiens
cacatctgtgtcttgttt

SEQ ID NO: 2872771 - DNA, 19 bp, Homo sapiens
cacatgcatcatcagccta

SEQ ID NO: 2872772 - DNA, 20 bp, Homo sapiens
cacatggggcctggcccacg

SEQ ID NO: 2872773 - DNA, 16 bp, Homo sapiens
cacatgtttacagaac

SEQ ID NO: 2872774 - DNA, 14 bp, Homo sapiens
caccagagcttctc

SEQ ID NO: 2872775 - DNA, 14 bp, Homo sapiens
caccatcacacatg

SEQ ID NO: 2872776 - DNA, 17 bp, Homo sapiens
cacccagcaacacagag

SEQ ID NO: 2872777 - DNA, 23 bp, Homo sapiens
cacccatgatactccactcccag

SEQ ID NO: 2872778 - DNA, 12 bp, Homo sapiens
caccccctcatt

SEQ ID NO: 2872779 - DNA, 16 bp, Homo sapiens
cacccctaagtgccca

SEQ ID NO: 2872780 - DNA, 20 bp, Homo sapiens
cacccctaagtgcccaaagt

SEQ ID NO: 2872781 - DNA, 17 bp, Homo sapiens
caccctccaccttccat

SEQ ID NO: 2872782 - DNA, 21 bp, Homo sapiens
cacccttttccagctggatga

SEQ ID NO: 2872783 - DNA, 13 bp, Homo sapiens
caccgtgggctcc

SEQ ID NO: 2872784 - DNA, 17 bp, Homo sapiens
caccgtgggctccctga

SEQ ID NO: 2872785 - DNA, 16 bp, Homo sapiens
cacctccacatcctcc

SEQ ID NO: 2872786 - DNA, 18 bp, Homo sapiens
cacctctggctagagccg

SEQ ID NO: 2872787 - DNA, 19 bp, Homo sapiens
cacctctggctagagccga

SEQ ID NO: 2872788 - DNA, 21 bp, Homo sapiens
cacctgtccccaccctccact

SEQ ID NO: 2872789 - DNA, 18 bp, Homo sapiens
caccttccattttccccc

SEQ ID NO: 2872790 - DNA, 14 bp, Homo sapiens
caccttccccagac

SEQ ID NO: 2872791 - DNA, 15 bp, Homo sapiens
caccttccccagact

SEQ ID NO: 2872792 - DNA, 20 bp, Homo sapiens
caccttccccagactcagct

SEQ ID NO: 2872793 - DNA, 21 bp, Homo sapiens
caccttccccagactcagctc

SEQ ID NO: 2872794 - DNA, 17 bp, Homo sapiens
caccttggactcctccc

SEQ ID NO: 2872795 - DNA, 22 bp, Homo sapiens
caccttggactcctcccacaat

SEQ ID NO: 2872796 - DNA, 21 bp, Homo sapiens
cacggagccactcctctgact

SEQ ID NO: 2872797 - DNA, 13 bp, Homo sapiens
cactactgcagca

SEQ ID NO: 2872798 - DNA, 16 bp, Homo sapiens
cactactgcagcacct

SEQ ID NO: 2872799 - DNA, 16 bp, Homo sapiens
cactcccagcagctca

SEQ ID NO: 2872800 - DNA, 20 bp, Homo sapiens
cactcccttgggctccctgt

SEQ ID NO: 2872801 - DNA, 13 bp, Homo sapiens
cactcctctgact

SEQ ID NO: 2872802 - DNA, 22 bp, Homo sapiens
ccctggtccagtcgggaggagc

SEQ ID NO: 2872803 - DNA, 21 bp, Homo sapiens
ccctggtgtcacatggggcct

SEQ ID NO: 2872804 - DNA, 22 bp, Homo sapiens
ccctgtgcagccgctgagcgag

SEQ ID NO: 2872805 - DNA, 16 bp, Homo sapiens
ccctgttcatgttttt

SEQ ID NO: 2872806 - DNA, 14 bp, Homo sapiens
cccttcccagacca

SEQ ID NO: 2872807 - DNA, 16 bp, Homo sapiens
cccttcccccagccca

SEQ ID NO: 2872808 - DNA, 16 bp, Homo sapiens
cccttcctttcctctg

SEQ ID NO: 2872809 - DNA, 19 bp, Homo sapiens
cccttcctttcctctgcag

SEQ ID NO: 2872810 - DNA, 14 bp, Homo sapiens
ccctttgagtgcag

SEQ ID NO: 2872811 - DNA, 11 bp, Homo sapiens
ccctttttcat

SEQ ID NO: 2872812 - DNA, 12 bp, Homo sapiens
ccgaacagggac

SEQ ID NO: 2872813 - DNA, 14 bp, Homo sapiens
ccgaacagggactt

SEQ ID NO: 2872814 - DNA, 20 bp, Homo sapiens
ccgaggggagagagggactc

SEQ ID NO: 2872815 - DNA, 16 bp, Homo sapiens
ccgcagcagggaagct

SEQ ID NO: 2872816 - DNA, 23 bp, Homo sapiens
ccgctgagcgaggagatgctcct

SEQ ID NO: 2872817 - DNA, 17 bp, Homo sapiens
ccgcttggagcagaggg

SEQ ID NO: 2872818 - DNA, 17 bp, Homo sapiens
ccggatgaaacttctca

SEQ ID NO: 2872819 - DNA, 18 bp, Homo sapiens
cctaagtgcccaaagtgg

SEQ ID NO: 2872820 - DNA, 16 bp, Homo sapiens
cctaataaagttctgt

SEQ ID NO: 2872821 - DNA, 21 bp, Homo sapiens
cctacatatgctgatctttta

SEQ ID NO: 2872822 - DNA, 16 bp, Homo sapiens
cctactggtgtaatct

SEQ ID NO: 2872823 - DNA, 14 bp, Homo sapiens
cctactttctattt

SEQ ID NO: 2872824 - DNA, 18 bp, Homo sapiens
cctagatctgcaggctgc

SEQ ID NO: 2872825 - DNA, 19 bp, Homo sapiens
cctagatctgcaggctgca

SEQ ID NO: 2872826 - DNA, 16 bp, Homo sapiens
cctcaagaacaccttt

SEQ ID NO: 2872827 - DNA, 18 bp, Homo sapiens
cctcaatccagctatgtt

SEQ ID NO: 2872828 - DNA, 15 bp, Homo sapiens
cctcaggagagaccc

SEQ ID NO: 2872829 - DNA, 13 bp, Homo sapiens
cctcattcccctc

SEQ ID NO: 2872830 - DNA, 15 bp, Homo sapiens
cctccacatcctcca

SEQ ID NO: 2872831 - DNA, 16 bp, Homo sapiens
cctccacatcctccac

SEQ ID NO: 2872832 - DNA, 21 bp, Homo sapiens
cctccaccttccattttcccc

SEQ ID NO: 2872833 - DNA, 12 bp, Homo sapiens
cctccaggcctg

SEQ ID NO: 2872834 - DNA, 13 bp, Homo sapiens
cctccaggcctgt

SEQ ID NO: 2872835 - DNA, 11 bp, Homo sapiens
cctccatggga

SEQ ID NO: 2872836 - DNA, 15 bp, Homo sapiens
cctccccaccttccc

SEQ ID NO: 2872837 - DNA, 14 bp, Homo sapiens
cctcccctccgcag

SEQ ID NO: 2872838 - DNA, 16 bp, Homo sapiens
cctcccctgccagggc

SEQ ID NO: 2872839 - DNA, 19 bp, Homo sapiens
cctccgcagcagggaagct

SEQ ID NO: 2872840 - DNA, 21 bp, Homo sapiens
cctccgctgggcttcattccg

SEQ ID NO: 2872841 - DNA, 16 bp, Homo sapiens
cctccgggcaggcaag

SEQ ID NO: 2872842 - DNA, 12 bp, Homo sapiens
cctcctccagcc

SEQ ID NO: 2872843 - DNA, 16 bp, Homo sapiens
cctcctccagcccctg

SEQ ID NO: 2872844 - DNA, 16 bp, Homo sapiens
cctcctccccagctct

SEQ ID NO: 2872845 - DNA, 18 bp, Homo sapiens
cctcctccccagctcttc

SEQ ID NO: 2872846 - DNA, 12 bp, Homo sapiens
cctcctctgtga

SEQ ID NO: 2872847 - DNA, 14 bp, Homo sapiens
cctcgctgccagct

SEQ ID NO: 2872848 - DNA, 19 bp, Homo sapiens
cctcgctgccagctctgta

SEQ ID NO: 2872849 - DNA, 18 bp, Homo sapiens
cctcggaggtccagctgg

SEQ ID NO: 2872850 - DNA, 19 bp, Homo sapiens
cctcggaggtccagctggg

SEQ ID NO: 2872851 - DNA, 22 bp, Homo sapiens
cctcggaggtccagctgggcct

SEQ ID NO: 2872852 - DNA, 20 bp, Homo sapiens
cctctcactccccagcccca

SEQ ID NO: 2872853 - DNA, 18 bp, Homo sapiens
cctctccagtttgcacct

SEQ ID NO: 2872854 - DNA, 16 bp, Homo sapiens
cctctcccaggcccga

SEQ ID NO: 2872855 - DNA, 12 bp, Homo sapiens
cctctctgctct

SEQ ID NO: 2872856 - DNA, 16 bp, Homo sapiens
cctctctgctctgcgt

SEQ ID NO: 2872857 - DNA, 11 bp, Homo sapiens
cctctcttccc

SEQ ID NO: 2872858 - DNA, 12 bp, Homo sapiens
cctctcttccct

SEQ ID NO: 2872859 - DNA, 14 bp, Homo sapiens
cctctgatacctca

SEQ ID NO: 2872860 - DNA, 20 bp, Homo sapiens
cctctgtccaggcactgaga

SEQ ID NO: 2872861 - DNA, 18 bp, Homo sapiens
cctctgtgaccaatgtct

SEQ ID NO: 2872862 - DNA, 19 bp, Homo sapiens
cctctgtgaccaatgtctt

SEQ ID NO: 2872863 - DNA, 14 bp, Homo sapiens
cctctttcttgttt

SEQ ID NO: 2872864 - DNA, 17 bp, Homo sapiens
cctgaaaacactgtgca

SEQ ID NO: 2872865 - DNA, 14 bp, Homo sapiens
cctgaatttgtata

SEQ ID NO: 2872866 - DNA, 13 bp, Homo sapiens
cctgacactccct

SEQ ID NO: 2872867 - DNA, 13 bp, Homo sapiens
cctgactcattct

SEQ ID NO: 2872868 - DNA, 21 bp, Homo sapiens
cctgagaaacactatttgtga

SEQ ID NO: 2872869 - DNA, 17 bp, Homo sapiens
cctgatgtcagctgctg

SEQ ID NO: 2872870 - DNA, 23 bp, Homo sapiens
cctgccacttcaacccccagcta

SEQ ID NO: 2872871 - DNA, 17 bp, Homo sapiens
cctgccagggcagggcc

SEQ ID NO: 2872872 - DNA, 18 bp, Homo sapiens
cctgcctcccctccgcag

SEQ ID NO: 2872873 - DNA, 13 bp, Homo sapiens
cctgcctccgggc

SEQ ID NO: 2872874 - DNA, 16 bp, Homo sapiens
cctgccttcctcctgg

SEQ ID NO: 2872875 - DNA, 13 bp, Homo sapiens
cctggactgacca

SEQ ID NO: 2872876 - DNA, 13 bp, Homo sapiens
cctggacttcctg

SEQ ID NO: 2872877 - DNA, 18 bp, Homo sapiens
cctggagactgcccagct

SEQ ID NO: 2872878 - DNA, 18 bp, Homo sapiens
cctggcccacgccctccc

SEQ ID NO: 2872879 - DNA, 12 bp, Homo sapiens
cctggcccttac

SEQ ID NO: 2872880 - DNA, 17 bp, Homo sapiens
cctggctctcagaggaa

SEQ ID NO: 2872881 - DNA, 15 bp, Homo sapiens
cctgggccctctctg

SEQ ID NO: 2872882 - DNA, 21 bp, Homo sapiens
cctgggttttgtattctctga

SEQ ID NO: 2872883 - DNA, 22 bp, Homo sapiens
cctgggttttgtattctctgag

SEQ ID NO: 2872884 - DNA, 15 bp, Homo sapiens
cctggtgctgcctct

SEQ ID NO: 2872885 - DNA, 17 bp, Homo sapiens
cctgtccacctcaccag

SEQ ID NO: 2872886 - DNA, 13 bp, Homo sapiens
cctgtccccaccc

SEQ ID NO: 2872887 - DNA, 23 bp, Homo sapiens
cctgtgctgaacataacttctca

SEQ ID NO: 2872888 - DNA, 22 bp, Homo sapiens
cctgtgcttcgggcccttccca

SEQ ID NO: 2872889 - DNA, 19 bp, Homo sapiens
cctgtgtgtactctgtcca

SEQ ID NO: 2872890 - DNA, 20 bp, Homo sapiens
cctgtgtgtactctgtccag

SEQ ID NO: 2872891 - DNA, 14 bp, Homo sapiens
ccttaatttaactt

SEQ ID NO: 2872892 - DNA, 20 bp, Homo sapiens
ccttaatttaactttccagt

SEQ ID NO: 2872893 - DNA, 21 bp, Homo sapiens
ccttacagtaggagcccagct

SEQ ID NO: 2872894 - DNA, 20 bp, Homo sapiens
ccttacttgcttctctagct

SEQ ID NO: 2872895 - DNA, 16 bp, Homo sapiens
ccttagggcactgggc

SEQ ID NO: 2872896 - DNA, 15 bp, Homo sapiens
ccttattgtacctct

SEQ ID NO: 2872897 - DNA, 19 bp, Homo sapiens
ccttcacgattaactgtga

SEQ ID NO: 2872898 - DNA, 23 bp, Homo sapiens
ccttccatggtgtgatcgtctga

SEQ ID NO: 2872899 - DNA, 13 bp, Homo sapiens
ccttcccagacca

SEQ ID NO: 2872900 - DNA, 13 bp, Homo sapiens
ccttccccagact

SEQ ID NO: 2872901 - DNA, 14 bp, Homo sapiens
ccttccccagactc

SEQ ID NO: 2872902 - DNA, 15 bp, Homo sapiens
ccttcccccagccca

SEQ ID NO: 2872903 - DNA, 20 bp, Homo sapiens
ccttcccccatcccctttcc

SEQ ID NO: 2872904 - DNA, 14 bp, Homo sapiens
ccttccctgccact

SEQ ID NO: 2872905 - DNA, 12 bp, Homo sapiens
ccttcctttcct

SEQ ID NO: 2872906 - DNA, 14 bp, Homo sapiens
ccttcctttcctct

SEQ ID NO: 2872907 - DNA, 14 bp, Homo sapiens
ccttcgtttatatt

SEQ ID NO: 2872908 - DNA, 16 bp, Homo sapiens
ccttctccatccacat

SEQ ID NO: 2872909 - DNA, 15 bp, Homo sapiens
ccttctggatccatg

SEQ ID NO: 2872910 - DNA, 17 bp, Homo sapiens
ccttctggatccatggg

SEQ ID NO: 2872911 - DNA, 13 bp, Homo sapiens
ccttcttcgctgc

SEQ ID NO: 2872912 - DNA, 14 bp, Homo sapiens
ccttcttcgctgct

SEQ ID NO: 2872913 - DNA, 21 bp, Homo sapiens
ctgacttaggtttcaggaagt

SEQ ID NO: 2872914 - DNA, 21 bp, Homo sapiens
ctgagaaacactatttgtgac

SEQ ID NO: 2872915 - DNA, 18 bp, Homo sapiens
ctgagaaagctaaagttt

SEQ ID NO: 2872916 - DNA, 21 bp, Homo sapiens
ctgagccagattggccaatta

SEQ ID NO: 2872917 - DNA, 12 bp, Homo sapiens
ctgagctgaggc

SEQ ID NO: 2872918 - DNA, 15 bp, Homo sapiens
ctgagctgtgcaggt

SEQ ID NO: 2872919 - DNA, 19 bp, Homo sapiens
ctgataccatatgaatgaa

SEQ ID NO: 2872920 - DNA, 20 bp, Homo sapiens
ctgataccatatgaatgaaa

SEQ ID NO: 2872921 - DNA, 15 bp, Homo sapiens
ctgcacctctggcta

SEQ ID NO: 2872922 - DNA, 16 bp, Homo sapiens
ctgcagaacccccagg

SEQ ID NO: 2872923 - DNA, 18 bp, Homo sapiens
ctgcagaacccccaggtg

SEQ ID NO: 2872924 - DNA, 12 bp, Homo sapiens
ctgcagcacctc

SEQ ID NO: 2872925 - DNA, 14 bp, Homo sapiens
ctgcagcacctcca

SEQ ID NO: 2872926 - DNA, 15 bp, Homo sapiens
ctgcagcacctccag

SEQ ID NO: 2872927 - DNA, 18 bp, Homo sapiens
ctgcagcacctccaggcc

SEQ ID NO: 2872928 - DNA, 19 bp, Homo sapiens
ctgcagcacctccaggcct

SEQ ID NO: 2872929 - DNA, 12 bp, Homo sapiens
ctgcagcacttt

SEQ ID NO: 2872930 - DNA, 19 bp, Homo sapiens
ctgcagcactttaaccctc

SEQ ID NO: 2872931 - DNA, 16 bp, Homo sapiens
ctgcagcggcagagca

SEQ ID NO: 2872932 - DNA, 17 bp, Homo sapiens
ctgcagcggcagagcaa

SEQ ID NO: 2872933 - DNA, 13 bp, Homo sapiens
ctgcaggctgcac

SEQ ID NO: 2872934 - DNA, 13 bp, Homo sapiens
ctgccacagagag

SEQ ID NO: 2872935 - DNA, 16 bp, Homo sapiens
ctgccactgaggagac

SEQ ID NO: 2872936 - DNA, 23 bp, Homo sapiens
ctgccactgaggagacagaaagc

SEQ ID NO: 2872937 - DNA, 23 bp, Homo sapiens
ctgccacttcaacccccagctaa

SEQ ID NO: 2872938 - DNA, 13 bp, Homo sapiens
ctgccagggcagg

SEQ ID NO: 2872939 - DNA, 13 bp, Homo sapiens
ctgccatgcctca

SEQ ID NO: 2872940 - DNA, 20 bp, Homo sapiens
ctgcctccgggcaggcaagg

SEQ ID NO: 2872941 - DNA, 22 bp, Homo sapiens
ctgcctcttctgggagggcagc

SEQ ID NO: 2872942 - DNA, 15 bp, Homo sapiens
ctgcctgctcatggc

SEQ ID NO: 2872943 - DNA, 15 bp, Homo sapiens
ctgccttcctcctgg

SEQ ID NO: 2872944 - DNA, 23 bp, Homo sapiens
ctgccttgtccctctcactcccc

SEQ ID NO: 2872945 - DNA, 14 bp, Homo sapiens
ctgcggaagccaaa

SEQ ID NO: 2872946 - DNA, 15 bp, Homo sapiens
ctgcggaagccaaag

SEQ ID NO: 2872947 - DNA, 16 bp, Homo sapiens
ctgcggaagccaaagg

SEQ ID NO: 2872948 - DNA, 21 bp, Homo sapiens
ctgcggaagccaaaggcagct

SEQ ID NO: 2872949 - DNA, 23 bp, Homo sapiens
ctgctacaaatactcttaggaag

SEQ ID NO: 2872950 - DNA, 16 bp, Homo sapiens
ctgctagactcctcag

SEQ ID NO: 2872951 - DNA, 22 bp, Homo sapiens
ctgctcatcattctctgtctca

SEQ ID NO: 2872952 - DNA, 18 bp, Homo sapiens
ctgctcatggccctcgga

SEQ ID NO: 2872953 - DNA, 23 bp, Homo sapiens
ctgctctagtgggacagcccaga

SEQ ID NO: 2872954 - DNA, 20 bp, Homo sapiens
ctgctctgcgtgtcacctgt

SEQ ID NO: 2872955 - DNA, 21 bp, Homo sapiens
ctgctctgcgtgtcacctgtg

SEQ ID NO: 2872956 - DNA, 22 bp, Homo sapiens
ctgctctgcgtgtcacctgtgc

SEQ ID NO: 2872957 - DNA, 14 bp, Homo sapiens
ctgctgcctgctca

SEQ ID NO: 2872958 - DNA, 15 bp, Homo sapiens
ctgctgcctgctcat

SEQ ID NO: 2872959 - DNA, 18 bp, Homo sapiens
ctgctgcctgctcatggc

SEQ ID NO: 2872960 - DNA, 14 bp, Homo sapiens
ctgctgttgaactt

SEQ ID NO: 2872961 - DNA, 16 bp, Homo sapiens
ctgctgttgaactttt

SEQ ID NO: 2872962 - DNA, 18 bp, Homo sapiens
ctggactctcagtctctg

SEQ ID NO: 2872963 - DNA, 12 bp, Homo sapiens
ctggactgacca

SEQ ID NO: 2872964 - DNA, 14 bp, Homo sapiens
ctggactgaccaaa

SEQ ID NO: 2872965 - DNA, 14 bp, Homo sapiens
ctggacttcctgtc

SEQ ID NO: 2872966 - DNA, 23 bp, Homo sapiens
ctggacttcctgtcattttcaca

SEQ ID NO: 2872967 - DNA, 14 bp, Homo sapiens
ctggatccatgggg

SEQ ID NO: 2872968 - DNA, 18 bp, Homo sapiens
ctggatccatggggggag

SEQ ID NO: 2872969 - DNA, 23 bp, Homo sapiens
ctggatcccgttcagaaaaccac

SEQ ID NO: 2872970 - DNA, 20 bp, Homo sapiens
ctggatgccaaggagcccct

SEQ ID NO: 2872971 - DNA, 15 bp, Homo sapiens
ctggatttgcagaag

SEQ ID NO: 2872972 - DNA, 12 bp, Homo sapiens
ctggcagaagca

SEQ ID NO: 2872973 - DNA, 14 bp, Homo sapiens
ctggcccacgccct

SEQ ID NO: 2872974 - DNA, 17 bp, Homo sapiens
ctggcccacgccctccc

SEQ ID NO: 2872975 - DNA, 17 bp, Homo sapiens
ctggccccatggtcagc

SEQ ID NO: 2872976 - DNA, 13 bp, Homo sapiens
ctggctagagccg

SEQ ID NO: 2872977 - DNA, 16 bp, Homo sapiens
ctggctagagccgagg

SEQ ID NO: 2872978 - DNA, 14 bp, Homo sapiens
ctggctgttctgat

SEQ ID NO: 2872979 - DNA, 15 bp, Homo sapiens
ctggctttttctgcc

SEQ ID NO: 2872980 - DNA, 16 bp, Homo sapiens
ctggctttttctgcca

SEQ ID NO: 2872981 - DNA, 17 bp, Homo sapiens
ctggctttttctgccac

SEQ ID NO: 2872982 - DNA, 16 bp, Homo sapiens
ctgggaaatattccct

SEQ ID NO: 2872983 - DNA, 18 bp, Homo sapiens
ctgggaaatattccctag

SEQ ID NO: 2872984 - DNA, 18 bp, Homo sapiens
ctgggaagcttgagcctc

SEQ ID NO: 2872985 - DNA, 22 bp, Homo sapiens
ctgggaagcttgagcctccccc

SEQ ID NO: 2872986 - DNA, 19 bp, Homo sapiens
ctgggagggcagcagggct

SEQ ID NO: 2872987 - DNA, 15 bp, Homo sapiens
ctgggcctcctgcct

SEQ ID NO: 2872988 - DNA, 16 bp, Homo sapiens
ctgggctgagggagcc

SEQ ID NO: 2872989 - DNA, 14 bp, Homo sapiens
ctgggctgttgttc

SEQ ID NO: 2872990 - DNA, 15 bp, Homo sapiens
ctggggctctgggat

SEQ ID NO: 2872991 - DNA, 13 bp, Homo sapiens
ctgggggaagggt

SEQ ID NO: 2872992 - DNA, 22 bp, Homo sapiens
ctgggtgacagagcaagactct

SEQ ID NO: 2872993 - DNA, 16 bp, Homo sapiens
ctgggtgactggaggc

SEQ ID NO: 2872994 - DNA, 20 bp, Homo sapiens
ctgggttttgtattctctga

SEQ ID NO: 2872995 - DNA, 22 bp, Homo sapiens
ctgggttttgtattctctgagc

SEQ ID NO: 2872996 - DNA, 18 bp, Homo sapiens
ctggtagaattgggaagc

SEQ ID NO: 2872997 - DNA, 14 bp, Homo sapiens
ctggtgctgcctct

SEQ ID NO: 2872998 - DNA, 20 bp, Homo sapiens
ctggtgtaatctcaatgcaa

SEQ ID NO: 2872999 - DNA, 20 bp, Homo sapiens
ctgtaatcccagcactttgg

SEQ ID NO: 2873000 - DNA, 15 bp, Homo sapiens
ctgtactgaataggt

SEQ ID NO: 2873001 - DNA, 16 bp, Homo sapiens
ctgtagagccaattag

SEQ ID NO: 2873002 - DNA, 13 bp, Homo sapiens
ctgtatatttctt

SEQ ID NO: 2873003 - DNA, 14 bp, Homo sapiens
ctgtatatttcttt

SEQ ID NO: 2873004 - DNA, 15 bp, Homo sapiens
ctgtatatttctttt

SEQ ID NO: 2873005 - DNA, 22 bp, Homo sapiens
ctgtatcaggacccagaggaag

SEQ ID NO: 2873006 - DNA, 23 bp, Homo sapiens
ctgtatcaggacccagaggaagg

SEQ ID NO: 2873007 - DNA, 15 bp, Homo sapiens
ctgtatttttctaaa

SEQ ID NO: 2873008 - DNA, 12 bp, Homo sapiens
ctgtcaccagag

SEQ ID NO: 2873009 - DNA, 13 bp, Homo sapiens
ctgtcaccagagc

SEQ ID NO: 2873010 - DNA, 14 bp, Homo sapiens
ctgtcaccagagct

SEQ ID NO: 2873011 - DNA, 15 bp, Homo sapiens
ctgtcaccagagctt

SEQ ID NO: 2873012 - DNA, 19 bp, Homo sapiens
ctgtcaccagagcttctct

SEQ ID NO: 2873013 - DNA, 19 bp, Homo sapiens
ctgtccaggcactgagata

SEQ ID NO: 2873014 - DNA, 20 bp, Homo sapiens
ctgtccagttcctttagaaa

SEQ ID NO: 2873015 - DNA, 16 bp, Homo sapiens
ctgtcctgcagcaaac

SEQ ID NO: 2873016 - DNA, 12 bp, Homo sapiens
ctgtccttccct

SEQ ID NO: 2873017 - DNA, 16 bp, Homo sapiens
ctgtctcatccatcat

SEQ ID NO: 2873018 - DNA, 20 bp, Homo sapiens
ctgtctcatccatcatcatg

SEQ ID NO: 2873019 - DNA, 15 bp, Homo sapiens
ctgtgactataaagc

SEQ ID NO: 2873020 - DNA, 18 bp, Homo sapiens
ctgtgactataaagctgt

SEQ ID NO: 2873021 - DNA, 19 bp, Homo sapiens
ctgtgactataaagctgtt

SEQ ID NO: 2873022 - DNA, 13 bp, Homo sapiens
ctgtgagccttgc

SEQ ID NO: 2873023 - DNA, 14 bp, Homo sapiens
gatggctgctgcct

SEQ ID NO: 2873024 - DNA, 20 bp, Homo sapiens
gatgggatggtggagggcca

SEQ ID NO: 2873025 - DNA, 18 bp, Homo sapiens
gatgtgacccaccagtgc

SEQ ID NO: 2873026 - DNA, 14 bp, Homo sapiens
gattactgcaatca

SEQ ID NO: 2873027 - DNA, 13 bp, Homo sapiens
gattattcagtgt

SEQ ID NO: 2873028 - DNA, 14 bp, Homo sapiens
gattattcagtgtc

SEQ ID NO: 2873029 - DNA, 20 bp, Homo sapiens
gattcagtgttaaatgtgat

SEQ ID NO: 2873030 - DNA, 21 bp, Homo sapiens
gattgctgccccatcagtgct

SEQ ID NO: 2873031 - DNA, 23 bp, Homo sapiens
gatttccctccagagaaagcaca

SEQ ID NO: 2873032 - DNA, 22 bp, Homo sapiens
gatttctaattgtaagtgaaat

SEQ ID NO: 2873033 - DNA, 18 bp, Homo sapiens
gatttggggcctcaagaa

SEQ ID NO: 2873034 - DNA, 20 bp, Homo sapiens
gatttggggcctcaagaaat

SEQ ID NO: 2873035 - DNA, 14 bp, Homo sapiens
gatttttcttattt

SEQ ID NO: 2873036 - DNA, 19 bp, Homo sapiens
gcaaacccatcaacaaaaa

SEQ ID NO: 2873037 - DNA, 21 bp, Homo sapiens
gcaaagtctccagaagaaaat

SEQ ID NO: 2873038 - DNA, 18 bp, Homo sapiens
gcaagaacctaaagtagc

SEQ ID NO: 2873039 - DNA, 15 bp, Homo sapiens
gcaagagaaaataaa

SEQ ID NO: 2873040 - DNA, 22 bp, Homo sapiens
gcaaggtttacactgcggaagc

SEQ ID NO: 2873041 - DNA, 15 bp, Homo sapiens
gcaatgccatcatct

SEQ ID NO: 2873042 - DNA, 18 bp, Homo sapiens
gcaatgccatcatctcct

SEQ ID NO: 2873043 - DNA, 14 bp, Homo sapiens
gcaattccaggctg

SEQ ID NO: 2873044 - DNA, 20 bp, Homo sapiens
gcaattccaggctgagccat

SEQ ID NO: 2873045 - DNA, 21 bp, Homo sapiens
gcacattaactgttgcacttt

SEQ ID NO: 2873046 - DNA, 18 bp, Homo sapiens
gcacctccacatcctcca

SEQ ID NO: 2873047 - DNA, 20 bp, Homo sapiens
gcacctccaggcctgttgct

SEQ ID NO: 2873048 - DNA, 19 bp, Homo sapiens
gcacctctggctagagccg

SEQ ID NO: 2873049 - DNA, 22 bp, Homo sapiens
gcactggtaggttgggacacca

SEQ ID NO: 2873050 - DNA, 20 bp, Homo sapiens
gcactttaaccctctcttcc

SEQ ID NO: 2873051 - DNA, 23 bp, Homo sapiens
gcactttaaccctctcttcccta

SEQ ID NO: 2873052 - DNA, 19 bp, Homo sapiens
gcagaacccccaggtggcc

SEQ ID NO: 2873053 - DNA, 20 bp, Homo sapiens
gcagaacccccaggtggcct

SEQ ID NO: 2873054 - DNA, 17 bp, Homo sapiens
gcagaagcaataataaa

SEQ ID NO: 2873055 - DNA, 17 bp, Homo sapiens
gcagagcaattccaggc

SEQ ID NO: 2873056 - DNA, 19 bp, Homo sapiens
gcagagcaattccaggctg

SEQ ID NO: 2873057 - DNA, 21 bp, Homo sapiens
gcagagcaattccaggctgag

SEQ ID NO: 2873058 - DNA, 18 bp, Homo sapiens
gcagatgatgctttggaa

SEQ ID NO: 2873059 - DNA, 16 bp, Homo sapiens
gcagcaaacactccac

SEQ ID NO: 2873060 - DNA, 15 bp, Homo sapiens
gcagcacctccaggc

SEQ ID NO: 2873061 - DNA, 11 bp, Homo sapiens
gcagcacttta

SEQ ID NO: 2873062 - DNA, 12 bp, Homo sapiens
gcagcagggcta

SEQ ID NO: 2873063 - DNA, 21 bp, Homo sapiens
gcagcagtgtgaggccagggc

SEQ ID NO: 2873064 - DNA, 23 bp, Homo sapiens
gcagccaggatgactagatcctg

SEQ ID NO: 2873065 - DNA, 15 bp, Homo sapiens
gcagcccggggagga

SEQ ID NO: 2873066 - DNA, 13 bp, Homo sapiens
gcagcggcagagc

SEQ ID NO: 2873067 - DNA, 21 bp, Homo sapiens
gcagctaagatagaaagctgg

SEQ ID NO: 2873068 - DNA, 23 bp, Homo sapiens
gcagctaagatagaaagctggac

SEQ ID NO: 2873069 - DNA, 16 bp, Homo sapiens
gcagctcaacctaccc

SEQ ID NO: 2873070 - DNA, 17 bp, Homo sapiens
gcagctcaacctaccct

SEQ ID NO: 2873071 - DNA, 16 bp, Homo sapiens
gcagctgcaccatcac

SEQ ID NO: 2873072 - DNA, 17 bp, Homo sapiens
gcaggaaggatggcaag

SEQ ID NO: 2873073 - DNA, 19 bp, Homo sapiens
gcaggctgcacctctggct

SEQ ID NO: 2873074 - DNA, 20 bp, Homo sapiens
gcagggctaccctgagctga

SEQ ID NO: 2873075 - DNA, 15 bp, Homo sapiens
gcaggggtgggagag

SEQ ID NO: 2873076 - DNA, 17 bp, Homo sapiens
gcaggggtgggagagcc

SEQ ID NO: 2873077 - DNA, 17 bp, Homo sapiens
gcaggtggggagactgg

SEQ ID NO: 2873078 - DNA, 15 bp, Homo sapiens
gcagtgtgaggccag

SEQ ID NO: 2873079 - DNA, 22 bp, Homo sapiens
gcagtttccagtcctaacaaat

SEQ ID NO: 2873080 - DNA, 16 bp, Homo sapiens
gcataacaattcctct

SEQ ID NO: 2873081 - DNA, 17 bp, Homo sapiens
gcataacaattcctcta

SEQ ID NO: 2873082 - DNA, 18 bp, Homo sapiens
gcatccacgcacacatgg

SEQ ID NO: 2873083 - DNA, 23 bp, Homo sapiens
gcatcccacgttctgttaattta

SEQ ID NO: 2873084 - DNA, 12 bp, Homo sapiens
gcatctcccaga

SEQ ID NO: 2873085 - DNA, 15 bp, Homo sapiens
gcatctgaccatctg

SEQ ID NO: 2873086 - DNA, 17 bp, Homo sapiens
gcatgcactgttccccc

SEQ ID NO: 2873087 - DNA, 21 bp, Homo sapiens
gcatgcactgttccccctgtg

SEQ ID NO: 2873088 - DNA, 23 bp, Homo sapiens
gcatgcactgttccccctgtgca

SEQ ID NO: 2873089 - DNA, 21 bp, Homo sapiens
gcattcaaccacgcaggaagc

SEQ ID NO: 2873090 - DNA, 21 bp, Homo sapiens
gcattcatgtaataaacaggt

SEQ ID NO: 2873091 - DNA, 16 bp, Homo sapiens
gcattgcctggactga

SEQ ID NO: 2873092 - DNA, 21 bp, Homo sapiens
gcattgtaattatgtaaataa

SEQ ID NO: 2873093 - DNA, 15 bp, Homo sapiens
gcattttgaaacaaa

SEQ ID NO: 2873094 - DNA, 19 bp, Homo sapiens
gccaacagaagcttccatt

SEQ ID NO: 2873095 - DNA, 21 bp, Homo sapiens
gccaagatggctgctgcctgc

SEQ ID NO: 2873096 - DNA, 22 bp, Homo sapiens
gccaagatggctgctgcctgct

SEQ ID NO: 2873097 - DNA, 14 bp, Homo sapiens
gccaattagacttg

SEQ ID NO: 2873098 - DNA, 19 bp, Homo sapiens
gccaccaagagggacgcct

SEQ ID NO: 2873099 - DNA, 13 bp, Homo sapiens
gccactcctctga

SEQ ID NO: 2873100 - DNA, 21 bp, Homo sapiens
gccactcctctgactcagggc

SEQ ID NO: 2873101 - DNA, 15 bp, Homo sapiens
gccactctcccctcc

SEQ ID NO: 2873102 - DNA, 12 bp, Homo sapiens
gccactgaggag

SEQ ID NO: 2873103 - DNA, 14 bp, Homo sapiens
gccactgaggagac

SEQ ID NO: 2873104 - DNA, 22 bp, Homo sapiens
gccactgaggagacagaaagcc

SEQ ID NO: 2873105 - DNA, 19 bp, Homo sapiens
gccacttcaacccccagct

SEQ ID NO: 2873106 - DNA, 13 bp, Homo sapiens
gccagagccaacc

SEQ ID NO: 2873107 - DNA, 17 bp, Homo sapiens
gccagagccaacctgga

SEQ ID NO: 2873108 - DNA, 15 bp, Homo sapiens
gccagagtttttaaa

SEQ ID NO: 2873109 - DNA, 19 bp, Homo sapiens
gccagattggccaattaaa

SEQ ID NO: 2873110 - DNA, 14 bp, Homo sapiens
gccagcaacgcttg

SEQ ID NO: 2873111 - DNA, 18 bp, Homo sapiens
gccagcaacgcttgtaga

SEQ ID NO: 2873112 - DNA, 13 bp, Homo sapiens
gccagctctgtat

SEQ ID NO: 2873113 - DNA, 13 bp, Homo sapiens
gccaggagtaaga

SEQ ID NO: 2873114 - DNA, 18 bp, Homo sapiens
gccatagacctacagacc

SEQ ID NO: 2873115 - DNA, 21 bp, Homo sapiens
gccatagacctacagacctgg

SEQ ID NO: 2873116 - DNA, 22 bp, Homo sapiens
gccatcagggtgggccactctc

SEQ ID NO: 2873117 - DNA, 18 bp, Homo sapiens
gcccacgccctccctctc

SEQ ID NO: 2873118 - DNA, 21 bp, Homo sapiens
gcccactgcctgcctcccctc

SEQ ID NO: 2873119 - DNA, 17 bp, Homo sapiens
gcccagagaccccttcc

SEQ ID NO: 2873120 - DNA, 23 bp, Homo sapiens
gcccagagaccccttcctttcct

SEQ ID NO: 2873121 - DNA, 20 bp, Homo sapiens
gcccagaggactcccaaccc

SEQ ID NO: 2873122 - DNA, 22 bp, Homo sapiens
gcccatccattaggccagcaac

SEQ ID NO: 2873123 - DNA, 14 bp, Homo sapiens
gccccaacactgtc

SEQ ID NO: 2873124 - DNA, 19 bp, Homo sapiens
gccccacccctaagtgccc

SEQ ID NO: 2873125 - DNA, 22 bp, Homo sapiens
gccccacccctaagtgcccaaa

SEQ ID NO: 2873126 - DNA, 15 bp, Homo sapiens
gcccctcctccagcc

SEQ ID NO: 2873127 - DNA, 21 bp, Homo sapiens
gcccctcctccagcccctgtc

SEQ ID NO: 2873128 - DNA, 15 bp, Homo sapiens
gcccctgtcccaccc

SEQ ID NO: 2873129 - DNA, 15 bp, Homo sapiens
gcccgaacagggact

SEQ ID NO: 2873130 - DNA, 12 bp, Homo sapiens
gccctcatcccg

SEQ ID NO: 2873131 - DNA, 21 bp, Homo sapiens
gccctccctctcccaggcccg

SEQ ID NO: 2873132 - DNA, 20 bp, Homo sapiens
taagttttactgataatttg

SEQ ID NO: 2873133 - DNA, 16 bp, Homo sapiens
taataaaaagaaagat

SEQ ID NO: 2873134 - DNA, 12 bp, Homo sapiens
taataaagtact

SEQ ID NO: 2873135 - DNA, 14 bp, Homo sapiens
taatagaacttgtt

SEQ ID NO: 2873136 - DNA, 20 bp, Homo sapiens
taatagctttagtgaattaa

SEQ ID NO: 2873137 - DNA, 20 bp, Homo sapiens
taatatgtctgccacagaga

SEQ ID NO: 2873138 - DNA, 16 bp, Homo sapiens
taatatttaggcaaga

SEQ ID NO: 2873139 - DNA, 22 bp, Homo sapiens
taatcttgaattgtaactgttc

SEQ ID NO: 2873140 - DNA, 15 bp, Homo sapiens
taatgctaaatgtgt

SEQ ID NO: 2873141 - DNA, 15 bp, Homo sapiens
taatgctgtttctaa

SEQ ID NO: 2873142 - DNA, 17 bp, Homo sapiens
taatgctgtttctaaga

SEQ ID NO: 2873143 - DNA, 14 bp, Homo sapiens
taatggcatttctc

SEQ ID NO: 2873144 - DNA, 15 bp, Homo sapiens
taatggcatttctct

SEQ ID NO: 2873145 - DNA, 17 bp, Homo sapiens
taatgggattagaaaca

SEQ ID NO: 2873146 - DNA, 13 bp, Homo sapiens
taatgtaacatga

SEQ ID NO: 2873147 - DNA, 21 bp, Homo sapiens
taatgtgaaaatggtccagga

SEQ ID NO: 2873148 - DNA, 13 bp, Homo sapiens
taattatgtaaat

SEQ ID NO: 2873149 - DNA, 15 bp, Homo sapiens
taattatgtaaataa

SEQ ID NO: 2873150 - DNA, 18 bp, Homo sapiens
taattatgtaaataactc

SEQ ID NO: 2873151 - DNA, 19 bp, Homo sapiens
taatttcaaaatacatttg

SEQ ID NO: 2873152 - DNA, 12 bp, Homo sapiens
taatttgaactt

SEQ ID NO: 2873153 - DNA, 16 bp, Homo sapiens
taattttaatgctgtt

SEQ ID NO: 2873154 - DNA, 22 bp, Homo sapiens
taatttttgaaacccattaggc

SEQ ID NO: 2873155 - DNA, 12 bp, Homo sapiens
tacaaaatggag

SEQ ID NO: 2873156 - DNA, 15 bp, Homo sapiens
tacaagaaaatgtat

SEQ ID NO: 2873157 - DNA, 22 bp, Homo sapiens
tacactgcggaagccaaaggca

SEQ ID NO: 2873158 - DNA, 21 bp, Homo sapiens
tacagaatgcggcctctgaga

SEQ ID NO: 2873159 - DNA, 20 bp, Homo sapiens
tacagacctggctctcagag

SEQ ID NO: 2873160 - DNA, 15 bp, Homo sapiens
tacagagcttccctg

SEQ ID NO: 2873161 - DNA, 15 bp, Homo sapiens
tacagataacttctt

SEQ ID NO: 2873162 - DNA, 19 bp, Homo sapiens
tacagtcttccatttgcaa

SEQ ID NO: 2873163 - DNA, 15 bp, Homo sapiens
tacatgttcccaaaa

SEQ ID NO: 2873164 - DNA, 13 bp, Homo sapiens
tacattttctaaa

SEQ ID NO: 2873165 - DNA, 15 bp, Homo sapiens
tacattttctaaata

SEQ ID NO: 2873166 - DNA, 23 bp, Homo sapiens
tacattttctaaataaaaatatg

SEQ ID NO: 2873167 - DNA, 18 bp, Homo sapiens
taccaatacaaaatgtat

SEQ ID NO: 2873168 - DNA, 19 bp, Homo sapiens
taccatatgaatgaaacat

SEQ ID NO: 2873169 - DNA, 16 bp, Homo sapiens
taccctgagctgaggc

SEQ ID NO: 2873170 - DNA, 17 bp, Homo sapiens
taccctgagctgaggca

SEQ ID NO: 2873171 - DNA, 14 bp, Homo sapiens
tacctacatatttg

SEQ ID NO: 2873172 - DNA, 21 bp, Homo sapiens
tacctacatatttgtatgttt

SEQ ID NO: 2873173 - DNA, 18 bp, Homo sapiens
tacctactggtgtaatct

SEQ ID NO: 2873174 - DNA, 14 bp, Homo sapiens
tacctcctgagaaa

SEQ ID NO: 2873175 - DNA, 21 bp, Homo sapiens
tacctctcttatagaatattt

SEQ ID NO: 2873176 - DNA, 23 bp, Homo sapiens
tacctctcttatagaatatttat

SEQ ID NO: 2873177 - DNA, 17 bp, Homo sapiens
tacctctgatacctcaa

SEQ ID NO: 2873178 - DNA, 20 bp, Homo sapiens
tacctgaaaacactgtgcac

SEQ ID NO: 2873179 - DNA, 14 bp, Homo sapiens
tacgaatacttttg

SEQ ID NO: 2873180 - DNA, 14 bp, Homo sapiens
tacgtttgtgtttc

SEQ ID NO: 2873181 - DNA, 16 bp, Homo sapiens
tactaactaaatacca

SEQ ID NO: 2873182 - DNA, 13 bp, Homo sapiens
tactcatgcgtga

SEQ ID NO: 2873183 - DNA, 21 bp, Homo sapiens
tactccactcccagcagctca

SEQ ID NO: 2873184 - DNA, 14 bp, Homo sapiens
tactgagcttctct

SEQ ID NO: 2873185 - DNA, 15 bp, Homo sapiens
tactgcaatcactgt

SEQ ID NO: 2873186 - DNA, 17 bp, Homo sapiens
tactgccaaaacattta

SEQ ID NO: 2873187 - DNA, 18 bp, Homo sapiens
tactgccaaaacatttat

SEQ ID NO: 2873188 - DNA, 17 bp, Homo sapiens
tactgcttaattgctga

SEQ ID NO: 2873189 - DNA, 20 bp, Homo sapiens
tactggtgtaatctcaatgc

SEQ ID NO: 2873190 - DNA, 17 bp, Homo sapiens
tactgtattttgtattg

SEQ ID NO: 2873191 - DNA, 18 bp, Homo sapiens
tactgtatttttcagaaa

SEQ ID NO: 2873192 - DNA, 15 bp, Homo sapiens
tacttcccactgtat

SEQ ID NO: 2873193 - DNA, 16 bp, Homo sapiens
tacttccctcttgaaa

SEQ ID NO: 2873194 - DNA, 16 bp, Homo sapiens
tagaaaaataaaatgt

SEQ ID NO: 2873195 - DNA, 15 bp, Homo sapiens
tagaaacttccaaat

SEQ ID NO: 2873196 - DNA, 12 bp, Homo sapiens
tagaaagctgga

SEQ ID NO: 2873197 - DNA, 15 bp, Homo sapiens
tagaaagctggactg

SEQ ID NO: 2873198 - DNA, 16 bp, Homo sapiens
tagaaagctggactga

SEQ ID NO: 2873199 - DNA, 14 bp, Homo sapiens
tagaaatgcatatt

SEQ ID NO: 2873200 - DNA, 19 bp, Homo sapiens
tagaactcagttttaacta

SEQ ID NO: 2873201 - DNA, 18 bp, Homo sapiens
tagaagcctgacaactca

SEQ ID NO: 2873202 - DNA, 13 bp, Homo sapiens
tagaataattctt

SEQ ID NO: 2873203 - DNA, 20 bp, Homo sapiens
tagaatatttattacctctg

SEQ ID NO: 2873204 - DNA, 20 bp, Homo sapiens
tagaatttattcaattcctc

SEQ ID NO: 2873205 - DNA, 18 bp, Homo sapiens
tagaccctctttcttgtt

SEQ ID NO: 2873206 - DNA, 18 bp, Homo sapiens
tagacctacagacctggc

SEQ ID NO: 2873207 - DNA, 18 bp, Homo sapiens
tagacttggagaatactg

SEQ ID NO: 2873208 - DNA, 20 bp, Homo sapiens
tagacttggagaatactgcc

SEQ ID NO: 2873209 - DNA, 22 bp, Homo sapiens
tagagaacaaagtaaaagtagt

SEQ ID NO: 2873210 - DNA, 22 bp, Homo sapiens
tagagagcctgtcaccagagct

SEQ ID NO: 2873211 - DNA, 23 bp, Homo sapiens
tagagagcctgtcaccagagctt

SEQ ID NO: 2873212 - DNA, 22 bp, Homo sapiens
tagagccgaggggagagaggga

SEQ ID NO: 2873213 - DNA, 23 bp, Homo sapiens
tagatccatttggacaaaatgga

SEQ ID NO: 2873214 - DNA, 14 bp, Homo sapiens
tagatctgcaggct

SEQ ID NO: 2873215 - DNA, 20 bp, Homo sapiens
tagcattcatgtaataaaca

SEQ ID NO: 2873216 - DNA, 15 bp, Homo sapiens
tagctctctaggcct

SEQ ID NO: 2873217 - DNA, 21 bp, Homo sapiens
tagctttaatcaatcatgccc

SEQ ID NO: 2873218 - DNA, 15 bp, Homo sapiens
taggaagagaaacca

SEQ ID NO: 2873219 - DNA, 19 bp, Homo sapiens
taggaagagaaaccaggga

SEQ ID NO: 2873220 - DNA, 16 bp, Homo sapiens
taggaagtaaattata

SEQ ID NO: 2873221 - DNA, 12 bp, Homo sapiens
taggcaagagaa

SEQ ID NO: 2873222 - DNA, 22 bp, Homo sapiens
taggccacagaaggtgaacttt

SEQ ID NO: 2873223 - DNA, 14 bp, Homo sapiens
tagggaagggcctg

SEQ ID NO: 2873224 - DNA, 16 bp, Homo sapiens
tagggcactgggctgt

SEQ ID NO: 2873225 - DNA, 19 bp, Homo sapiens
taggggaagtaaaacagtc

SEQ ID NO: 2873226 - DNA, 13 bp, Homo sapiens
tagggtctaccaa

SEQ ID NO: 2873227 - DNA, 21 bp, Homo sapiens
taggttctgtagagccaatta

SEQ ID NO: 2873228 - DNA, 14 bp, Homo sapiens
tagtaaataaacaa

SEQ ID NO: 2873229 - DNA, 17 bp, Homo sapiens
tagtgacatttaatgcc

SEQ ID NO: 2873230 - DNA, 19 bp, Homo sapiens
tagtgacatttaatgccat

SEQ ID NO: 2873231 - DNA, 14 bp, Homo sapiens
tagtgttgtccagg

SEQ ID NO: 2873232 - DNA, 16 bp, Homo sapiens
tagttaaataactgtg

SEQ ID NO: 2873233 - DNA, 14 bp, Homo sapiens
tagtttgttcttca

SEQ ID NO: 2873234 - DNA, 18 bp, Homo sapiens
tataaagctgttattctt

SEQ ID NO: 2873235 - DNA, 20 bp, Homo sapiens
tataaagctgttattcttgt

SEQ ID NO: 2873236 - DNA, 15 bp, Homo sapiens
tataaatgccagagc

SEQ ID NO: 2873237 - DNA, 16 bp, Homo sapiens
tataagtagtaaatca

SEQ ID NO: 2873238 - DNA, 20 bp, Homo sapiens
tataatactactactgttat

SEQ ID NO: 2873239 - DNA, 21 bp, Homo sapiens
tataatttttttcaatattta

SEQ ID NO: 2873240 - DNA, 18 bp, Homo sapiens
tatacatcaatatgtata

SEQ ID NO: 2873241 - DNA, 19 bp, Homo sapiens
tatacattttctaaataaa

SEQ ID NO: 2873242 - DNA, 21 bp, Homo sapiens
tctgctagactcctcaggaga

SEQ ID NO: 2873243 - DNA, 14 bp, Homo sapiens
tctgctcatcattc

SEQ ID NO: 2873244 - DNA, 15 bp, Homo sapiens
tctgctcatcattct

SEQ ID NO: 2873245 - DNA, 16 bp, Homo sapiens
tctgctctgcgtgtca

SEQ ID NO: 2873246 - DNA, 21 bp, Homo sapiens
tctgctctgcgtgtcacctgt

SEQ ID NO: 2873247 - DNA, 21 bp, Homo sapiens
tctggatcccgttcagaaaac

SEQ ID NO: 2873248 - DNA, 15 bp, Homo sapiens
tctggccctggccct

SEQ ID NO: 2873249 - DNA, 22 bp, Homo sapiens
tctggctagagccgaggggaga

SEQ ID NO: 2873250 - DNA, 13 bp, Homo sapiens
tctgggagggcag

SEQ ID NO: 2873251 - DNA, 21 bp, Homo sapiens
tctgggagggcagcagggcta

SEQ ID NO: 2873252 - DNA, 23 bp, Homo sapiens
tctgggctgtaacgtggcactgg

SEQ ID NO: 2873253 - DNA, 15 bp, Homo sapiens
tctggggctctggga

SEQ ID NO: 2873254 - DNA, 20 bp, Homo sapiens
tctgtatcaggacccagagg

SEQ ID NO: 2873255 - DNA, 13 bp, Homo sapiens
tctgtctcatcca

SEQ ID NO: 2873256 - DNA, 18 bp, Homo sapiens
tctgtgaccaatgtcttg

SEQ ID NO: 2873257 - DNA, 19 bp, Homo sapiens
tctgtgaccaatgtcttga

SEQ ID NO: 2873258 - DNA, 19 bp, Homo sapiens
tctgtgactataaagctgt

SEQ ID NO: 2873259 - DNA, 23 bp, Homo sapiens
tctgtgtaaatctaactacaagg

SEQ ID NO: 2873260 - DNA, 20 bp, Homo sapiens
tctgtgtaacatccaagcca

SEQ ID NO: 2873261 - DNA, 23 bp, Homo sapiens
tctgtgtaaccagctcagtgttt

SEQ ID NO: 2873262 - DNA, 19 bp, Homo sapiens
tcttatagaatatttatta

SEQ ID NO: 2873263 - DNA, 20 bp, Homo sapiens
tcttatagaatatttattac

SEQ ID NO: 2873264 - DNA, 21 bp, Homo sapiens
tcttcactgccatgcctcaag

SEQ ID NO: 2873265 - DNA, 22 bp, Homo sapiens
tcttcatggcatcttcaatatg

SEQ ID NO: 2873266 - DNA, 11 bp, Homo sapiens
tcttccccaca

SEQ ID NO: 2873267 - DNA, 18 bp, Homo sapiens
tcttcccttcccagacca

SEQ ID NO: 2873268 - DNA, 21 bp, Homo sapiens
tcttcctagatctgcaggctg

SEQ ID NO: 2873269 - DNA, 14 bp, Homo sapiens
tcttccttccccca

SEQ ID NO: 2873270 - DNA, 15 bp, Homo sapiens
tcttccttcccccat

SEQ ID NO: 2873271 - DNA, 20 bp, Homo sapiens
tcttcgctgctagagaaggg

SEQ ID NO: 2873272 - DNA, 14 bp, Homo sapiens
tcttctcttcctag

SEQ ID NO: 2873273 - DNA, 17 bp, Homo sapiens
tcttctgggagggcagc

SEQ ID NO: 2873274 - DNA, 23 bp, Homo sapiens
tcttctgggagggcagcagggct

SEQ ID NO: 2873275 - DNA, 13 bp, Homo sapiens
tcttcttcaccat

SEQ ID NO: 2873276 - DNA, 21 bp, Homo sapiens
tcttgaatttaataatctgta

SEQ ID NO: 2873277 - DNA, 12 bp, Homo sapiens
tcttgtctctgg

SEQ ID NO: 2873278 - DNA, 13 bp, Homo sapiens
tcttgtctctggg

SEQ ID NO: 2873279 - DNA, 13 bp, Homo sapiens
tcttgtttgtcag

SEQ ID NO: 2873280 - DNA, 15 bp, Homo sapiens
tcttgtttgtcagca

SEQ ID NO: 2873281 - DNA, 16 bp, Homo sapiens
tcttgtttgtcagcat

SEQ ID NO: 2873282 - DNA, 17 bp, Homo sapiens
tcttgtttgtcagcatc

SEQ ID NO: 2873283 - DNA, 23 bp, Homo sapiens
tcttgtttgtcagcatctgacca

SEQ ID NO: 2873284 - DNA, 22 bp, Homo sapiens
tctttaacatacaagaaaatgt

SEQ ID NO: 2873285 - DNA, 15 bp, Homo sapiens
tctttccaaattaaa

SEQ ID NO: 2873286 - DNA, 20 bp, Homo sapiens
tctttccattggatctcatt

SEQ ID NO: 2873287 - DNA, 15 bp, Homo sapiens
tctttcttgtttgtc

SEQ ID NO: 2873288 - DNA, 21 bp, Homo sapiens
tctttcttgtttgtcagcatc

SEQ ID NO: 2873289 - DNA, 15 bp, Homo sapiens
tctttgcaatactgc

SEQ ID NO: 2873290 - DNA, 12 bp, Homo sapiens
tctttgctgtta

SEQ ID NO: 2873291 - DNA, 18 bp, Homo sapiens
tcttttaatggcatttct

SEQ ID NO: 2873292 - DNA, 11 bp, Homo sapiens
tgaaaaatata

SEQ ID NO: 2873293 - DNA, 12 bp, Homo sapiens
tgaaaaattaac

SEQ ID NO: 2873294 - DNA, 17 bp, Homo sapiens
tgaaaaattaacttttt

SEQ ID NO: 2873295 - DNA, 14 bp, Homo sapiens
tgaaaatgtcttgt

SEQ ID NO: 2873296 - DNA, 15 bp, Homo sapiens
tgaaaatgtcttgtg

SEQ ID NO: 2873297 - DNA, 17 bp, Homo sapiens
tgaaacaaagtactctt

SEQ ID NO: 2873298 - DNA, 22 bp, Homo sapiens
tgaaacaaagtactctttaaca

SEQ ID NO: 2873299 - DNA, 17 bp, Homo sapiens
tgaaacagttgctgtga

SEQ ID NO: 2873300 - DNA, 18 bp, Homo sapiens
tgaaacatgggctgtgat

SEQ ID NO: 2873301 - DNA, 20 bp, Homo sapiens
tgaaacatgggctgtgatta

SEQ ID NO: 2873302 - DNA, 23 bp, Homo sapiens
tgaaacccattaggcatgcctaa

SEQ ID NO: 2873303 - DNA, 14 bp, Homo sapiens
tgaaacttctcagt

SEQ ID NO: 2873304 - DNA, 15 bp, Homo sapiens
tgaaacttctcagtc

SEQ ID NO: 2873305 - DNA, 15 bp, Homo sapiens
tgaaatgaactttgt

SEQ ID NO: 2873306 - DNA, 22 bp, Homo sapiens
tgaaatgtacgtcatttgtgca

SEQ ID NO: 2873307 - DNA, 24 bp, Homo sapiens
tgaaattaagcattttgaaacaaa

SEQ ID NO: 2873308 - DNA, 20 bp, Homo sapiens
tgaacataacttctcatgta

SEQ ID NO: 2873309 - DNA, 23 bp, Homo sapiens
tgaacataacttctcatgtatat

SEQ ID NO: 2873310 - DNA, 14 bp, Homo sapiens
tgaacccatatttt

SEQ ID NO: 2873311 - DNA, 23 bp, Homo sapiens
tgaacctgaaaagggtcagaagg

SEQ ID NO: 2873312 - DNA, 19 bp, Homo sapiens
tgaaccttaaaaggtactg

SEQ ID NO: 2873313 - DNA, 19 bp, Homo sapiens
tgaactttttaaagaagtg

SEQ ID NO: 2873314 - DNA, 14 bp, Homo sapiens
tgaagaagggggtg

SEQ ID NO: 2873315 - DNA, 19 bp, Homo sapiens
tgaagaagggggtgggggg

SEQ ID NO: 2873316 - DNA, 21 bp, Homo sapiens
tgaagaagggggtggggggag

SEQ ID NO: 2873317 - DNA, 16 bp, Homo sapiens
tgaagagggacataag

SEQ ID NO: 2873318 - DNA, 22 bp, Homo sapiens
tgaagagggacataagataaaa

SEQ ID NO: 2873319 - DNA, 23 bp, Homo sapiens
tgaagagtaagtcaacctgcctg

SEQ ID NO: 2873320 - DNA, 13 bp, Homo sapiens
tgaagccacagga

SEQ ID NO: 2873321 - DNA, 15 bp, Homo sapiens
tgaagccgactctgg

SEQ ID NO: 2873322 - DNA, 18 bp, Homo sapiens
tgaagccgactctggccc

SEQ ID NO: 2873323 - DNA, 20 bp, Homo sapiens
tgaagccgactctggccctg

SEQ ID NO: 2873324 - DNA, 11 bp, Homo sapiens
tgaaggagccc

SEQ ID NO: 2873325 - DNA, 15 bp, Homo sapiens
tgaagggaagtgggg

SEQ ID NO: 2873326 - DNA, 22 bp, Homo sapiens
tgaagtgttccctttttcataa

SEQ ID NO: 2873327 - DNA, 16 bp, Homo sapiens
tgaagtttggagatag

SEQ ID NO: 2873328 - DNA, 18 bp, Homo sapiens
tgaagtttggagatagat

SEQ ID NO: 2873329 - DNA, 16 bp, Homo sapiens
tgaataaataaatgta

SEQ ID NO: 2873330 - DNA, 13 bp, Homo sapiens
tgaataggttccc

SEQ ID NO: 2873331 - DNA, 13 bp, Homo sapiens
tgaatgaatggga

SEQ ID NO: 2873332 - DNA, 16 bp, Homo sapiens
tgaatgattcagtgtt

SEQ ID NO: 2873333 - DNA, 19 bp, Homo sapiens
tgaatgtatgtcagtgcta

SEQ ID NO: 2873334 - DNA, 20 bp, Homo sapiens
tgaattcttggttgaggaaa

SEQ ID NO: 2873335 - DNA, 22 bp, Homo sapiens
tgaattcttggttgaggaaaca

SEQ ID NO: 2873336 - DNA, 18 bp, Homo sapiens
tgaattgtaactgttctt

SEQ ID NO: 2873337 - DNA, 17 bp, Homo sapiens
tgacaaaggcaagcact

SEQ ID NO: 2873338 - DNA, 21 bp, Homo sapiens
tgacaagctgtatcactgcct

SEQ ID NO: 2873339 - DNA, 12 bp, Homo sapiens
tgacaatcaaag

SEQ ID NO: 2873340 - DNA, 19 bp, Homo sapiens
tgacactcaataaacagtc

SEQ ID NO: 2873341 - DNA, 14 bp, Homo sapiens
tgacactcccttgg

SEQ ID NO: 2873342 - DNA, 18 bp, Homo sapiens
tgacagagcaagactctg

SEQ ID NO: 2873343 - DNA, 14 bp, Homo sapiens
tgacaggttttcca

SEQ ID NO: 2873344 - DNA, 14 bp, Homo sapiens
tgacagtttccaaa

SEQ ID NO: 2873345 - DNA, 13 bp, Homo sapiens
tgacatttatatt

SEQ ID NO: 2873346 - DNA, 17 bp, Homo sapiens
tgaccaaagactgcaga

SEQ ID NO: 2873347 - DNA, 21 bp, Homo sapiens
tgaccaaagactgcagaaccc

SEQ ID NO: 2873348 - DNA, 22 bp, Homo sapiens
tgaccacgctttctagctgttg

SEQ ID NO: 2873349 - DNA, 14 bp, Homo sapiens
tgaccatctgtgac

SEQ ID NO: 2873350 - DNA, 17 bp, Homo sapiens
tgaccattcaattagtg

SEQ ID NO: 2873351 - DNA, 17 bp, Homo sapiens
tgacccaccagtgcctt

SEQ ID NO: 2873352 - DNA, 18 bp, Homo sapiens
ttagagagcctgtcacca

SEQ ID NO: 2873353 - DNA, 22 bp, Homo sapiens
ttagagagcctgtcaccagagc

SEQ ID NO: 2873354 - DNA, 13 bp, Homo sapiens
ttagatgttctaa

SEQ ID NO: 2873355 - DNA, 22 bp, Homo sapiens
ttagatgttctaagtctttcca

SEQ ID NO: 2873356 - DNA, 18 bp, Homo sapiens
ttagctccataaagtaca

SEQ ID NO: 2873357 - DNA, 15 bp, Homo sapiens
ttaggaagagaaacc

SEQ ID NO: 2873358 - DNA, 15 bp, Homo sapiens
ttaggcatgcctaat

SEQ ID NO: 2873359 - DNA, 10 bp, Homo sapiens
ttaggccagc

SEQ ID NO: 2873360 - DNA, 14 bp, Homo sapiens
ttagggaagggcct

SEQ ID NO: 2873361 - DNA, 20 bp, Homo sapiens
ttaggggaagtaaaacagtc

SEQ ID NO: 2873362 - DNA, 19 bp, Homo sapiens
ttagtgaattaaatttagt

SEQ ID NO: 2873363 - DNA, 23 bp, Homo sapiens
ttagtgatgtccttaaaatgtgg

SEQ ID NO: 2873364 - DNA, 19 bp, Homo sapiens
ttagtgtgacagtttccaa

SEQ ID NO: 2873365 - DNA, 22 bp, Homo sapiens
ttagtgtgacagtttccaaatt

SEQ ID NO: 2873366 - DNA, 16 bp, Homo sapiens
ttataatttttttcaa

SEQ ID NO: 2873367 - DNA, 15 bp, Homo sapiens
ttatatttcaataaa

SEQ ID NO: 2873368 - DNA, 18 bp, Homo sapiens
ttatattttagaaataat

SEQ ID NO: 2873369 - DNA, 18 bp, Homo sapiens
ttatatttttttaactgt

SEQ ID NO: 2873370 - DNA, 18 bp, Homo sapiens
ttatcaccgtgggctccc

SEQ ID NO: 2873371 - DNA, 21 bp, Homo sapiens
ttatcagtaatgctaaatgtg

SEQ ID NO: 2873372 - DNA, 21 bp, Homo sapiens
ttatgcaattcagtgttccaa

SEQ ID NO: 2873373 - DNA, 21 bp, Homo sapiens
ttatgcacttttagaaatgca

SEQ ID NO: 2873374 - DNA, 16 bp, Homo sapiens
ttatgtaaataactct

SEQ ID NO: 2873375 - DNA, 12 bp, Homo sapiens
ttatgtgaaaaa

SEQ ID NO: 2873376 - DNA, 13 bp, Homo sapiens
ttatgtgaaaaat

SEQ ID NO: 2873377 - DNA, 16 bp, Homo sapiens
ttatgtgaaaaattaa

SEQ ID NO: 2873378 - DNA, 18 bp, Homo sapiens
ttatgtgaaaaattaact

SEQ ID NO: 2873379 - DNA, 19 bp, Homo sapiens
ttatgtttaaaagaaatat

SEQ ID NO: 2873380 - DNA, 14 bp, Homo sapiens
ttattaagtaaaat

SEQ ID NO: 2873381 - DNA, 13 bp, Homo sapiens
ttattacctctga

SEQ ID NO: 2873382 - DNA, 16 bp, Homo sapiens
ttattattttcacctg

SEQ ID NO: 2873383 - DNA, 12 bp, Homo sapiens
ttattcttgtta

SEQ ID NO: 2873384 - DNA, 23 bp, Homo sapiens
ttattggactccaggcctgacca

SEQ ID NO: 2873385 - DNA, 14 bp, Homo sapiens
ttattgtacctctc

SEQ ID NO: 2873386 - DNA, 17 bp, Homo sapiens
ttattgtacctctctta

SEQ ID NO: 2873387 - DNA, 22 bp, Homo sapiens
ttatttacagataacttcttta

SEQ ID NO: 2873388 - DNA, 12 bp, Homo sapiens
ttatttctatga

SEQ ID NO: 2873389 - DNA, 21 bp, Homo sapiens
ttcaaagccagcgtcctcctc

SEQ ID NO: 2873390 - DNA, 18 bp, Homo sapiens
ttcaaccacgcaggaagc

SEQ ID NO: 2873391 - DNA, 19 bp, Homo sapiens
ttcaagaagtaatcagtat

SEQ ID NO: 2873392 - DNA, 21 bp, Homo sapiens
ttcaagaatgaaaaatataat

SEQ ID NO: 2873393 - DNA, 16 bp, Homo sapiens
ttcaatatgaatctat

SEQ ID NO: 2873394 - DNA, 12 bp, Homo sapiens
ttcaattcctct

SEQ ID NO: 2873395 - DNA, 21 bp, Homo sapiens
ttcacctgtttttaagctgtt

SEQ ID NO: 2873396 - DNA, 14 bp, Homo sapiens
ttcactgccatgcc

SEQ ID NO: 2873397 - DNA, 22 bp, Homo sapiens
ttcagaggccctcgctgccagc

SEQ ID NO: 2873398 - DNA, 14 bp, Homo sapiens
ttcagctctttcca

SEQ ID NO: 2873399 - DNA, 16 bp, Homo sapiens
ttcagctctttccaaa

SEQ ID NO: 2873400 - DNA, 17 bp, Homo sapiens
ttcagctctttccaaat

SEQ ID NO: 2873401 - DNA, 20 bp, Homo sapiens
ttcagctctttccaaattaa

SEQ ID NO: 2873402 - DNA, 22 bp, Homo sapiens
ttcagtgttaaatgtgatgaat

SEQ ID NO: 2873403 - DNA, 13 bp, Homo sapiens
ttcagtttttcac

SEQ ID NO: 2873404 - DNA, 23 bp, Homo sapiens
ttcatgattatagcaactaatgt

SEQ ID NO: 2873405 - DNA, 17 bp, Homo sapiens
ttcatggcagaaggcaa

SEQ ID NO: 2873406 - DNA, 21 bp, Homo sapiens
ttcatggcatcttcaatatga

SEQ ID NO: 2873407 - DNA, 14 bp, Homo sapiens
ttcatgtaaactgt

SEQ ID NO: 2873408 - DNA, 17 bp, Homo sapiens
ttcatgtaaactgtgca

SEQ ID NO: 2873409 - DNA, 22 bp, Homo sapiens
ttcattccggactggcagaagc

SEQ ID NO: 2873410 - DNA, 14 bp, Homo sapiens
ttcattttgtataa

SEQ ID NO: 2873411 - DNA, 24 bp, Homo sapiens
ttccacggagccactcctctgact

SEQ ID NO: 2873412 - DNA, 12 bp, Homo sapiens
ttccacttctgg

SEQ ID NO: 2873413 - DNA, 14 bp, Homo sapiens
ttccaggctgagcc

SEQ ID NO: 2873414 - DNA, 14 bp, Homo sapiens
ttccagtcctaaca

SEQ ID NO: 2873415 - DNA, 17 bp, Homo sapiens
ttccagtcctaacaaat

SEQ ID NO: 2873416 - DNA, 21 bp, Homo sapiens
ttccatagtgttaactgtcag

SEQ ID NO: 2873417 - DNA, 21 bp, Homo sapiens
ttccatggtgtgatcgtctga

SEQ ID NO: 2873418 - DNA, 14 bp, Homo sapiens
ttcccatctggctt

SEQ ID NO: 2873419 - DNA, 18 bp, Homo sapiens
ttcccatctggctttttc

SEQ ID NO: 2873420 - DNA, 19 bp, Homo sapiens
ttccccagactcagctcca

SEQ ID NO: 2873421 - DNA, 15 bp, Homo sapiens
ttcccccactgatca

SEQ ID NO: 2873422 - DNA, 20 bp, Homo sapiens
ttcccccatcccctttcctc

SEQ ID NO: 2873423 - DNA, 21 bp, Homo sapiens
ttcccccatcccctttcctcc

SEQ ID NO: 2873424 - DNA, 23 bp, Homo sapiens
ttcccccatcccctttcctcccc

SEQ ID NO: 2873425 - DNA, 21 bp, Homo sapiens
ttccctattatttccgggtgg

SEQ ID NO: 2873426 - DNA, 16 bp, Homo sapiens
ttcctaacaaaatgag

SEQ ID NO: 2873427 - DNA, 14 bp, Homo sapiens
ttcctactttctat

SEQ ID NO: 2873428 - DNA, 16 bp, Homo sapiens
ttcctctgcagcactt

SEQ ID NO: 2873429 - DNA, 12 bp, Homo sapiens
ttcctctgggaa

SEQ ID NO: 2873430 - DNA, 17 bp, Homo sapiens
ttcctgtgtgtactctg

SEQ ID NO: 2873431 - DNA, 21 bp, Homo sapiens
ttcctttcctctgcagcactt

SEQ ID NO: 2873432 - DNA, 17 bp, Homo sapiens
ttccttttggcctcctg

SEQ ID NO: 2873433 - DNA, 15 bp, Homo sapiens
ttcgctgaaattgct

SEQ ID NO: 2873434 - DNA, 14 bp, Homo sapiens
ttcggaaacactga

SEQ ID NO: 2873435 - DNA, 13 bp, Homo sapiens
ttcggtgtgcacc

SEQ ID NO: 2873436 - DNA, 23 bp, Homo sapiens
ttcgtttatatttttttaactgt

SEQ ID NO: 2873437 - DNA, 23 bp, Homo sapiens
ttctaaccttcacgattaactgt

SEQ ID NO: 2873438 - DNA, 14 bp, Homo sapiens
ttctaagaaaatgt

SEQ ID NO: 2873439 - DNA, 17 bp, Homo sapiens
ttctaagtctttccatt

SEQ ID NO: 2873440 - DNA, 18 bp, Homo sapiens
ttctaatagaactcagtt

SEQ ID NO: 2873441 - DNA, 19 bp, Homo sapiens
ttctatgacaaattcaaga

SEQ ID NO: 2873442 - DNA, 23 bp, Homo sapiens
ttctcctccatgggagaaaatag

SEQ ID NO: 2873443 - DNA, 20 bp, Homo sapiens
ttctctagctctctaggcct

SEQ ID NO: 2873444 - DNA, 17 bp, Homo sapiens
ttctctgggctgaatgt

SEQ ID NO: 2873445 - DNA, 13 bp, Homo sapiens
ttctctgtctcat

SEQ ID NO: 2873446 - DNA, 16 bp, Homo sapiens
ttctcttcctagatct

SEQ ID NO: 2873447 - DNA, 22 bp, Homo sapiens
ttctcttcctagatctgcaggc

SEQ ID NO: 2873448 - DNA, 18 bp, Homo sapiens
ttctgcagcggcagagca

SEQ ID NO: 2873449 - DNA, 20 bp, Homo sapiens
ttctgccactgaggagacag

SEQ ID NO: 2873450 - DNA, 14 bp, Homo sapiens
ttctgctcatcatt

SEQ ID NO: 2873451 - DNA, 13 bp, Homo sapiens
ttctggatccatg

SEQ ID NO: 2873452 - DNA, 23 bp, Homo sapiens
ttctggatccatggggggagaag

SEQ ID NO: 2873453 - DNA, 14 bp, Homo sapiens
ttctgggagggcag

SEQ ID NO: 2873454 - DNA, 17 bp, Homo sapiens
ttctggtcttcactgcc

SEQ ID NO: 2873455 - DNA, 18 bp, Homo sapiens
ttctggtcttcactgcca

SEQ ID NO: 2873456 - DNA, 13 bp, Homo sapiens
ttcttccccacaa

SEQ ID NO: 2873457 - DNA, 18 bp, Homo sapiens
ttcttgtttgtcagcatc

SEQ ID NO: 2873458 - DNA, 12 bp, Homo sapiens
ttgaaacaaagt

SEQ ID NO: 2873459 - DNA, 23 bp, Homo sapiens
ttgaaatgaactttgtcagtgtt

SEQ ID NO: 2873460 - DNA, 13 bp, Homo sapiens
ttgaacacagttg

SEQ ID NO: 2873461 - DNA, 17 bp, Homo sapiens
ttgaaccttaaaaggta

SEQ ID NO: 2873462 - DNA, 12 bp, Homo sapiens
aaacttttttat

SEQ ID NO: 2873463 - DNA, 17 bp, Homo sapiens
aaacttttttatttaaa

SEQ ID NO: 2873464 - DNA, 15 bp, Homo sapiens
aaagaagtaaatttg

SEQ ID NO: 2873465 - DNA, 18 bp, Homo sapiens
aaagaagtaaatttgtcc

SEQ ID NO: 2873466 - DNA, 14 bp, Homo sapiens
aaagagttcaagaa

SEQ ID NO: 2873467 - DNA, 14 bp, Homo sapiens
aaagattttttaat

SEQ ID NO: 2873468 - DNA, 22 bp, Homo sapiens
aaagattttttaataatttaga

SEQ ID NO: 2873469 - DNA, 22 bp, Homo sapiens
aaagcaagcattcagaagaaaa

SEQ ID NO: 2873470 - DNA, 16 bp, Homo sapiens
aaagcacaaaaagaaa

SEQ ID NO: 2873471 - DNA, 15 bp, Homo sapiens
aaagctggtttaatg

SEQ ID NO: 2873472 - DNA, 16 bp, Homo sapiens
aaagctggtttaatgt

SEQ ID NO: 2873473 - DNA, 18 bp, Homo sapiens
aaagctgtgtgtttggaa

SEQ ID NO: 2873474 - DNA, 14 bp, Homo sapiens
aaagcttaaaactt

SEQ ID NO: 2873475 - DNA, 15 bp, Homo sapiens
aaagcttaaaacttt

SEQ ID NO: 2873476 - DNA, 18 bp, Homo sapiens
aaaggtttatgaaaaaga

SEQ ID NO: 2873477 - DNA, 22 bp, Homo sapiens
aaaggtttatgaaaaagaagaa

SEQ ID NO: 2873478 - DNA, 18 bp, Homo sapiens
aaagttcaacatgttatt

SEQ ID NO: 2873479 - DNA, 18 bp, Homo sapiens
aaagttgataaagatttt

SEQ ID NO: 2873480 - DNA, 20 bp, Homo sapiens
aaagttgataaagatttttt

SEQ ID NO: 2873481 - DNA, 23 bp, Homo sapiens
aaagttgataaagattttttaat

SEQ ID NO: 2873482 - DNA, 16 bp, Homo sapiens
aaataaatttttataa

SEQ ID NO: 2873483 - DNA, 14 bp, Homo sapiens
aaataagaagaatg

SEQ ID NO: 2873484 - DNA, 16 bp, Homo sapiens
aaataagtttttgttt

SEQ ID NO: 2873485 - DNA, 18 bp, Homo sapiens
aaatacatgctaagagaa

SEQ ID NO: 2873486 - DNA, 21 bp, Homo sapiens
aaatagtttggatatgtaaaa

SEQ ID NO: 2873487 - DNA, 18 bp, Homo sapiens
aaatattttaaagaattg

SEQ ID NO: 2873488 - DNA, 19 bp, Homo sapiens
aaatattttaaagaattgt

SEQ ID NO: 2873489 - DNA, 17 bp, Homo sapiens
aaatcacgctttttgaa

SEQ ID NO: 2873490 - DNA, 22 bp, Homo sapiens
aaatcttggttgatgccaaaaa

SEQ ID NO: 2873491 - DNA, 16 bp, Homo sapiens
aaatgccttttcccaa

SEQ ID NO: 2873492 - DNA, 21 bp, Homo sapiens
aaatggaaaggagaggaaaga

SEQ ID NO: 2873493 - DNA, 13 bp, Homo sapiens
aaatggtgaaaga

SEQ ID NO: 2873494 - DNA, 22 bp, Homo sapiens
aaatgtccagccacccccaggc

SEQ ID NO: 2873495 - DNA, 13 bp, Homo sapiens
aaattatttaaac

SEQ ID NO: 2873496 - DNA, 22 bp, Homo sapiens
aaatttaatgtttttctggaag

SEQ ID NO: 2873497 - DNA, 21 bp, Homo sapiens
aaatttatgattattcaagaa

SEQ ID NO: 2873498 - DNA, 22 bp, Homo sapiens
aaatttgtccaatggctgtaaa

SEQ ID NO: 2873499 - DNA, 14 bp, Homo sapiens
aacaattctaaaat

SEQ ID NO: 2873500 - DNA, 22 bp, Homo sapiens
aacaattctaaaatgattgtag

SEQ ID NO: 2873501 - DNA, 14 bp, Homo sapiens
aacataaaaatgat

SEQ ID NO: 2873502 - DNA, 15 bp, Homo sapiens
aacatagacagaaga

SEQ ID NO: 2873503 - DNA, 20 bp, Homo sapiens
aacatgttatttgtaataga

SEQ ID NO: 2873504 - DNA, 15 bp, Homo sapiens
aacatttattttgac

SEQ ID NO: 2873505 - DNA, 17 bp, Homo sapiens
aacatttattttgacat

SEQ ID NO: 2873506 - DNA, 15 bp, Homo sapiens
aaccataaaataaat

SEQ ID NO: 2873507 - DNA, 22 bp, Homo sapiens
aaccatagcacaggctaatttt

SEQ ID NO: 2873508 - DNA, 23 bp, Homo sapiens
aacccctcccctccatccctggc

SEQ ID NO: 2873509 - DNA, 22 bp, Homo sapiens
aacctactttcatactgaagat

SEQ ID NO: 2873510 - DNA, 14 bp, Homo sapiens
aacctatccttcca

SEQ ID NO: 2873511 - DNA, 15 bp, Homo sapiens
aacctttccctcacc

SEQ ID NO: 2873512 - DNA, 17 bp, Homo sapiens
aacctttccctcacccc

SEQ ID NO: 2873513 - DNA, 19 bp, Homo sapiens
aacctttccctcaccccct

SEQ ID NO: 2873514 - DNA, 20 bp, Homo sapiens
aacgtttaagccaaaacaat

SEQ ID NO: 2873515 - DNA, 22 bp, Homo sapiens
aactccagccacccagccagga

SEQ ID NO: 2873516 - DNA, 18 bp, Homo sapiens
aactccagtctcctgaca

SEQ ID NO: 2873517 - DNA, 20 bp, Homo sapiens
aactgagccaaacacactgt

SEQ ID NO: 2873518 - DNA, 21 bp, Homo sapiens
aactgagccaaacacactgta

SEQ ID NO: 2873519 - DNA, 22 bp, Homo sapiens
aactggctgtttgatagcagaa

SEQ ID NO: 2873520 - DNA, 21 bp, Homo sapiens
aacttaccaggcaccaaaaga

SEQ ID NO: 2873521 - DNA, 19 bp, Homo sapiens
aactttaaagcgtttgcac

SEQ ID NO: 2873522 - DNA, 15 bp, Homo sapiens
aagaaaaagaagcaa

SEQ ID NO: 2873523 - DNA, 20 bp, Homo sapiens
aagaaagccgtactgtctat

SEQ ID NO: 2873524 - DNA, 15 bp, Homo sapiens
aagaaataagttttt

SEQ ID NO: 2873525 - DNA, 21 bp, Homo sapiens
aagaagcaacctcagtaattt

SEQ ID NO: 2873526 - DNA, 14 bp, Homo sapiens
aagaagtaaaagca

SEQ ID NO: 2873527 - DNA, 15 bp, Homo sapiens
aagaagtttcatcat

SEQ ID NO: 2873528 - DNA, 18 bp, Homo sapiens
aagaagtttcatcatttt

SEQ ID NO: 2873529 - DNA, 22 bp, Homo sapiens
aagaatacttctcattttttaa

SEQ ID NO: 2873530 - DNA, 13 bp, Homo sapiens
aagaatgcttaat

SEQ ID NO: 2873531 - DNA, 22 bp, Homo sapiens
aagacacacctctggatccctg

SEQ ID NO: 2873532 - DNA, 18 bp, Homo sapiens
aagagctacgtatttaat

SEQ ID NO: 2873533 - DNA, 15 bp, Homo sapiens
aagaggaagcaagaa

SEQ ID NO: 2873534 - DNA, 22 bp, Homo sapiens
aagaggtctgagccctggtgtg

SEQ ID NO: 2873535 - DNA, 16 bp, Homo sapiens
acagtgcactcagagc

SEQ ID NO: 2873536 - DNA, 12 bp, Homo sapiens
acataaagttga

SEQ ID NO: 2873537 - DNA, 15 bp, Homo sapiens
acataaagttgataa

SEQ ID NO: 2873538 - DNA, 17 bp, Homo sapiens
acataattatccaggaa

SEQ ID NO: 2873539 - DNA, 14 bp, Homo sapiens
acatactcattttt

SEQ ID NO: 2873540 - DNA, 18 bp, Homo sapiens
acatagacagaagaaaca

SEQ ID NO: 2873541 - DNA, 12 bp, Homo sapiens
acatagcctttg

SEQ ID NO: 2873542 - DNA, 15 bp, Homo sapiens
acatcattcattttt

SEQ ID NO: 2873543 - DNA, 15 bp, Homo sapiens
acatgccagcttcct

SEQ ID NO: 2873544 - DNA, 23 bp, Homo sapiens
acatgtgctattgaactgagcca

SEQ ID NO: 2873545 - DNA, 14 bp, Homo sapiens
acatgttatttgta

SEQ ID NO: 2873546 - DNA, 22 bp, Homo sapiens
acattaaagaagggttgagctg

SEQ ID NO: 2873547 - DNA, 20 bp, Homo sapiens
acatttctatagccaaaaat

SEQ ID NO: 2873548 - DNA, 14 bp, Homo sapiens
acatttctctgagc

SEQ ID NO: 2873549 - DNA, 15 bp, Homo sapiens
accaacataaaaatg

SEQ ID NO: 2873550 - DNA, 15 bp, Homo sapiens
accaagatacttaag

SEQ ID NO: 2873551 - DNA, 21 bp, Homo sapiens
accaagatacttaagtgctgc

SEQ ID NO: 2873552 - DNA, 15 bp, Homo sapiens
accaatgtcataaca

SEQ ID NO: 2873553 - DNA, 17 bp, Homo sapiens
accaccgaagaggaagc

SEQ ID NO: 2873554 - DNA, 20 bp, Homo sapiens
accaggcaccaaaagaagta

SEQ ID NO: 2873555 - DNA, 13 bp, Homo sapiens
accagggctctgt

SEQ ID NO: 2873556 - DNA, 11 bp, Homo sapiens
accataaaata

SEQ ID NO: 2873557 - DNA, 19 bp, Homo sapiens
acccagagtggagtctgag

SEQ ID NO: 2873558 - DNA, 20 bp, Homo sapiens
acccagagtggagtctgagt

SEQ ID NO: 2873559 - DNA, 14 bp, Homo sapiens
acccagccaggagg

SEQ ID NO: 2873560 - DNA, 23 bp, Homo sapiens
accccaggacgccactcatttca

SEQ ID NO: 2873561 - DNA, 13 bp, Homo sapiens
acccccagccccg

SEQ ID NO: 2873562 - DNA, 12 bp, Homo sapiens
acccctcccctc

SEQ ID NO: 2873563 - DNA, 13 bp, Homo sapiens
acccctcccctcc

SEQ ID NO: 2873564 - DNA, 19 bp, Homo sapiens
acccctcccctccatccct

SEQ ID NO: 2873565 - DNA, 20 bp, Homo sapiens
acccctcccctccatccctg

SEQ ID NO: 2873566 - DNA, 21 bp, Homo sapiens
accctctgggcagctgtcatg

SEQ ID NO: 2873567 - DNA, 16 bp, Homo sapiens
accctgttttccacac

SEQ ID NO: 2873568 - DNA, 13 bp, Homo sapiens
accgctaaaagaa

SEQ ID NO: 2873569 - DNA, 16 bp, Homo sapiens
accgctaaaagaaact

SEQ ID NO: 2873570 - DNA, 13 bp, Homo sapiens
acctaaagaaaaa

SEQ ID NO: 2873571 - DNA, 17 bp, Homo sapiens
acctaaataattagaat

SEQ ID NO: 2873572 - DNA, 21 bp, Homo sapiens
acctcaatcagtctcagaatg

SEQ ID NO: 2873573 - DNA, 18 bp, Homo sapiens
acctcagacaatccactc

SEQ ID NO: 2873574 - DNA, 21 bp, Homo sapiens
acctcagacaatccactctca

SEQ ID NO: 2873575 - DNA, 17 bp, Homo sapiens
acctcagtaatttagaa

SEQ ID NO: 2873576 - DNA, 14 bp, Homo sapiens
acctccctactccc

SEQ ID NO: 2873577 - DNA, 17 bp, Homo sapiens
acctctggatccctgga

SEQ ID NO: 2873578 - DNA, 17 bp, Homo sapiens
accttgttgatgccagc

SEQ ID NO: 2873579 - DNA, 22 bp, Homo sapiens
acctttccctcaccccctccca

SEQ ID NO: 2873580 - DNA, 17 bp, Homo sapiens
acgccactcatttcatc

SEQ ID NO: 2873581 - DNA, 20 bp, Homo sapiens
acgccactcatttcatctca

SEQ ID NO: 2873582 - DNA, 21 bp, Homo sapiens
acgccactcatttcatctcat

SEQ ID NO: 2873583 - DNA, 21 bp, Homo sapiens
acgtatttaatagcaaagaat

SEQ ID NO: 2873584 - DNA, 20 bp, Homo sapiens
acgtcctgctggcacctcag

SEQ ID NO: 2873585 - DNA, 21 bp, Homo sapiens
acgtcctgctggcacctcaga

SEQ ID NO: 2873586 - DNA, 14 bp, Homo sapiens
actactgtaattaa

SEQ ID NO: 2873587 - DNA, 21 bp, Homo sapiens
actactgtaattaagtgcaat

SEQ ID NO: 2873588 - DNA, 14 bp, Homo sapiens
actagaggtgagaa

SEQ ID NO: 2873589 - DNA, 18 bp, Homo sapiens
actagttttactttgaac

SEQ ID NO: 2873590 - DNA, 16 bp, Homo sapiens
actcattctatgaaca

SEQ ID NO: 2873591 - DNA, 13 bp, Homo sapiens
actcatttcatct

SEQ ID NO: 2873592 - DNA, 13 bp, Homo sapiens
actccagccagcg

SEQ ID NO: 2873593 - DNA, 19 bp, Homo sapiens
actccagccagcgcctccc

SEQ ID NO: 2873594 - DNA, 16 bp, Homo sapiens
actccagtctcctgac

SEQ ID NO: 2873595 - DNA, 16 bp, Homo sapiens
actcccccagccctca

SEQ ID NO: 2873596 - DNA, 16 bp, Homo sapiens
actccctaagaaaccc

SEQ ID NO: 2873597 - DNA, 21 bp, Homo sapiens
actcctgtctgtcctggaggt

SEQ ID NO: 2873598 - DNA, 20 bp, Homo sapiens
actccttcaacaattctaaa

SEQ ID NO: 2873599 - DNA, 15 bp, Homo sapiens
actctcaggaggcgc

SEQ ID NO: 2873600 - DNA, 17 bp, Homo sapiens
actctcaggaggcgcag

SEQ ID NO: 2873601 - DNA, 22 bp, Homo sapiens
actctcaggaggcgcagcccga

SEQ ID NO: 2873602 - DNA, 23 bp, Homo sapiens
actctctataagtgttcagtgtt

SEQ ID NO: 2873603 - DNA, 24 bp, Homo sapiens
actctctataagtgttcagtgttg

SEQ ID NO: 2873604 - DNA, 15 bp, Homo sapiens
actctctttcttcca

SEQ ID NO: 2873605 - DNA, 19 bp, Homo sapiens
actgagccaaacacactgt

SEQ ID NO: 2873606 - DNA, 21 bp, Homo sapiens
actgagccaaacacactgtaa

SEQ ID NO: 2873607 - DNA, 22 bp, Homo sapiens
actgagccaaacacactgtaaa

SEQ ID NO: 2873608 - DNA, 22 bp, Homo sapiens
actgatgcgaaaacttgaatct

SEQ ID NO: 2873609 - DNA, 23 bp, Homo sapiens
actgatgcgaaaacttgaatctg

SEQ ID NO: 2873610 - DNA, 19 bp, Homo sapiens
actgctggtaaaataatgt

SEQ ID NO: 2873611 - DNA, 18 bp, Homo sapiens
actgctgtccctcctgag

SEQ ID NO: 2873612 - DNA, 20 bp, Homo sapiens
actgggtaatgaaacaaaga

SEQ ID NO: 2873613 - DNA, 18 bp, Homo sapiens
actggttaaatcaattct

SEQ ID NO: 2873614 - DNA, 19 bp, Homo sapiens
actgtaaatatccacagac

SEQ ID NO: 2873615 - DNA, 19 bp, Homo sapiens
actgtaattaagtgcaatt

SEQ ID NO: 2873616 - DNA, 16 bp, Homo sapiens
actgtaatttctttga

SEQ ID NO: 2873617 - DNA, 22 bp, Homo sapiens
acttaccaggcaccaaaagaag

SEQ ID NO: 2873618 - DNA, 13 bp, Homo sapiens
acttagcccaaga

SEQ ID NO: 2873619 - DNA, 13 bp, Homo sapiens
acttcctcctcct

SEQ ID NO: 2873620 - DNA, 16 bp, Homo sapiens
acttgaatctgttact

SEQ ID NO: 2873621 - DNA, 20 bp, Homo sapiens
acttgaatctgttactgaaa

SEQ ID NO: 2873622 - DNA, 14 bp, Homo sapiens
actttgaagttagc

SEQ ID NO: 2873623 - DNA, 15 bp, Homo sapiens
acttttttatttaaa

SEQ ID NO: 2873624 - DNA, 23 bp, Homo sapiens
acttttttatttaaaaaactaaa

SEQ ID NO: 2873625 - DNA, 23 bp, Homo sapiens
agaaaaacaaactcgttttttac

SEQ ID NO: 2873626 - DNA, 21 bp, Homo sapiens
agaaaaagttgcagtctcaga

SEQ ID NO: 2873627 - DNA, 17 bp, Homo sapiens
agaaacataaataaaat

SEQ ID NO: 2873628 - DNA, 13 bp, Homo sapiens
agaaaccccaggg

SEQ ID NO: 2873629 - DNA, 15 bp, Homo sapiens
agaaacttttttatt

SEQ ID NO: 2873630 - DNA, 19 bp, Homo sapiens
agaaacttttttatttaaa

SEQ ID NO: 2873631 - DNA, 16 bp, Homo sapiens
agaaagaatgcaagag

SEQ ID NO: 2873632 - DNA, 17 bp, Homo sapiens
agaaatcattttgcaat

SEQ ID NO: 2873633 - DNA, 16 bp, Homo sapiens
agaaatttaaactata

SEQ ID NO: 2873634 - DNA, 20 bp, Homo sapiens
agaaatttaaactataagca

SEQ ID NO: 2873635 - DNA, 23 bp, Homo sapiens
agaagaaaaagttgcagtctcag

SEQ ID NO: 2873636 - DNA, 22 bp, Homo sapiens
agaagaagtttcatcatttttt

SEQ ID NO: 2873637 - DNA, 19 bp, Homo sapiens
agaagaatgcttaatcaga

SEQ ID NO: 2873638 - DNA, 15 bp, Homo sapiens
agaagagagatcaaa

SEQ ID NO: 2873639 - DNA, 21 bp, Homo sapiens
agaagcaacctcagtaattta

SEQ ID NO: 2873640 - DNA, 21 bp, Homo sapiens
agaagtttcatcattttttac

SEQ ID NO: 2873641 - DNA, 15 bp, Homo sapiens
agaatacttctcatt

SEQ ID NO: 2873642 - DNA, 14 bp, Homo sapiens
agaatgcttaatca

SEQ ID NO: 2873643 - DNA, 20 bp, Homo sapiens
agaatgcttaatcagataga

SEQ ID NO: 2873644 - DNA, 23 bp, Homo sapiens
agaattgtgtcagactgtttagt

SEQ ID NO: 2873645 - DNA, 23 bp, Homo sapiens
agacaaatctatgccactcagaa

SEQ ID NO: 2873646 - DNA, 20 bp, Homo sapiens
agacaaccttgtcccaagga

SEQ ID NO: 2873647 - DNA, 13 bp, Homo sapiens
agacaaggaacca

SEQ ID NO: 2873648 - DNA, 16 bp, Homo sapiens
agacacatactcattt

SEQ ID NO: 2873649 - DNA, 14 bp, Homo sapiens
agaccttttttagg

SEQ ID NO: 2873650 - DNA, 21 bp, Homo sapiens
agagagatcaaatggaaagga

SEQ ID NO: 2873651 - DNA, 16 bp, Homo sapiens
agagccctgctgtggg

SEQ ID NO: 2873652 - DNA, 11 bp, Homo sapiens
agagctacata

SEQ ID NO: 2873653 - DNA, 14 bp, Homo sapiens
agagctacgtattt

SEQ ID NO: 2873654 - DNA, 16 bp, Homo sapiens
agaggaaaatgaataa

SEQ ID NO: 2873655 - DNA, 14 bp, Homo sapiens
agagggctagggag

SEQ ID NO: 2873656 - DNA, 14 bp, Homo sapiens
agaggtctgagccc

SEQ ID NO: 2873657 - DNA, 16 bp, Homo sapiens
agaggtgagaaattta

SEQ ID NO: 2873658 - DNA, 17 bp, Homo sapiens
agaggtgagaaatttaa

SEQ ID NO: 2873659 - DNA, 19 bp, Homo sapiens
agagtaacatgccagcttc

SEQ ID NO: 2873660 - DNA, 20 bp, Homo sapiens
agagtggactgaatgtgcct

SEQ ID NO: 2873661 - DNA, 16 bp, Homo sapiens
agagtggagtctgagt

SEQ ID NO: 2873662 - DNA, 15 bp, Homo sapiens
agagttcaagaaata

SEQ ID NO: 2873663 - DNA, 18 bp, Homo sapiens
agagttcaagaaataagt

SEQ ID NO: 2873664 - DNA, 15 bp, Homo sapiens
agataactgaaaatt

SEQ ID NO: 2873665 - DNA, 18 bp, Homo sapiens
agataactgaaaattatt

SEQ ID NO: 2873666 - DNA, 22 bp, Homo sapiens
agataactgaaaattatttaaa

SEQ ID NO: 2873667 - DNA, 22 bp, Homo sapiens
agataccatgtataattttcta

SEQ ID NO: 2873668 - DNA, 16 bp, Homo sapiens
agatacttaagtgctg

SEQ ID NO: 2873669 - DNA, 16 bp, Homo sapiens
agatgagaagccaaag

SEQ ID NO: 2873670 - DNA, 14 bp, Homo sapiens
agatgcagcaaaat

SEQ ID NO: 2873671 - DNA, 21 bp, Homo sapiens
agatgcagcaaaatgtgaatg

SEQ ID NO: 2873672 - DNA, 19 bp, Homo sapiens
agatggcctgagaagagag

SEQ ID NO: 2873673 - DNA, 19 bp, Homo sapiens
agatgtttgatagattttc

SEQ ID NO: 2873674 - DNA, 18 bp, Homo sapiens
agatttctataaaagcaa

SEQ ID NO: 2873675 - DNA, 13 bp, Homo sapiens
agatttcttttaa

SEQ ID NO: 2873676 - DNA, 12 bp, Homo sapiens
agcaaaaaagaa

SEQ ID NO: 2873677 - DNA, 12 bp, Homo sapiens
agcaagaaagcc

SEQ ID NO: 2873678 - DNA, 16 bp, Homo sapiens
agcaagagatgagaaa

SEQ ID NO: 2873679 - DNA, 17 bp, Homo sapiens
agcaagattttgtcaaa

SEQ ID NO: 2873680 - DNA, 21 bp, Homo sapiens
agcaagattttgtcaaaaact

SEQ ID NO: 2873681 - DNA, 15 bp, Homo sapiens
agcaagcattcagaa

SEQ ID NO: 2873682 - DNA, 18 bp, Homo sapiens
agcaagcattcagaagaa

SEQ ID NO: 2873683 - DNA, 16 bp, Homo sapiens
agcacaaaaagaaact

SEQ ID NO: 2873684 - DNA, 17 bp, Homo sapiens
agcacaggctaattttt

SEQ ID NO: 2873685 - DNA, 15 bp, Homo sapiens
agcagagtctgtctc

SEQ ID NO: 2873686 - DNA, 12 bp, Homo sapiens
agcagctgggca

SEQ ID NO: 2873687 - DNA, 18 bp, Homo sapiens
agcagtcagggtgggaag

SEQ ID NO: 2873688 - DNA, 18 bp, Homo sapiens
agcataccttggactgac

SEQ ID NO: 2873689 - DNA, 21 bp, Homo sapiens
agcattcagaagaaaaagaag

SEQ ID NO: 2873690 - DNA, 18 bp, Homo sapiens
agccaaaaatagctaaat

SEQ ID NO: 2873691 - DNA, 20 bp, Homo sapiens
agccaaacacactgtaaata

SEQ ID NO: 2873692 - DNA, 14 bp, Homo sapiens
agccacccccaggc

SEQ ID NO: 2873693 - DNA, 22 bp, Homo sapiens
agccacccccaggcatctgtta

SEQ ID NO: 2873694 - DNA, 22 bp, Homo sapiens
agccagagggtgggagcctaag

SEQ ID NO: 2873695 - DNA, 12 bp, Homo sapiens
agccagcgcctc

SEQ ID NO: 2873696 - DNA, 16 bp, Homo sapiens
agccagcgcctccctc

SEQ ID NO: 2873697 - DNA, 22 bp, Homo sapiens
agccagcgcctccctccacccc

SEQ ID NO: 2873698 - DNA, 18 bp, Homo sapiens
agccaggagcctcctgac

SEQ ID NO: 2873699 - DNA, 15 bp, Homo sapiens
agccatgccaataaa

SEQ ID NO: 2873700 - DNA, 14 bp, Homo sapiens
agcccaagaggact

SEQ ID NO: 2873701 - DNA, 15 bp, Homo sapiens
agccccgactccagc

SEQ ID NO: 2873702 - DNA, 20 bp, Homo sapiens
agccccgactccagccagcg

SEQ ID NO: 2873703 - DNA, 18 bp, Homo sapiens
agccccttgtcctctccc

SEQ ID NO: 2873704 - DNA, 19 bp, Homo sapiens
agccccttgtcctctcccg

SEQ ID NO: 2873705 - DNA, 13 bp, Homo sapiens
agcccgaagccca

SEQ ID NO: 2873706 - DNA, 13 bp, Homo sapiens
agccctaaacatc

SEQ ID NO: 2873707 - DNA, 14 bp, Homo sapiens
agccctaaacatca

SEQ ID NO: 2873708 - DNA, 15 bp, Homo sapiens
agccctaaacatcat

SEQ ID NO: 2873709 - DNA, 15 bp, Homo sapiens
agccgtactgtctat

SEQ ID NO: 2873710 - DNA, 22 bp, Homo sapiens
agccgtggccgagggcttccct

SEQ ID NO: 2873711 - DNA, 16 bp, Homo sapiens
cgcctctgagccagga

SEQ ID NO: 2873712 - DNA, 18 bp, Homo sapiens
cgcctctgagccaggagc

SEQ ID NO: 2873713 - DNA, 13 bp, Homo sapiens
cgctaaaagaaac

SEQ ID NO: 2873714 - DNA, 11 bp, Homo sapiens
cgctttttgaa

SEQ ID NO: 2873715 - DNA, 16 bp, Homo sapiens
cgctttttgaaaaagc

SEQ ID NO: 2873716 - DNA, 16 bp, Homo sapiens
cggacgtcctgctggc

SEQ ID NO: 2873717 - DNA, 21 bp, Homo sapiens
cggacgtcctgctggcacctc

SEQ ID NO: 2873718 - DNA, 18 bp, Homo sapiens
cggagtgagttttttagt

SEQ ID NO: 2873719 - DNA, 18 bp, Homo sapiens
cggcccagaagtttccct

SEQ ID NO: 2873720 - DNA, 23 bp, Homo sapiens
cgggaccctgctcacaggcaggc

SEQ ID NO: 2873721 - DNA, 17 bp, Homo sapiens
cgtccccccccaacctt

SEQ ID NO: 2873722 - DNA, 18 bp, Homo sapiens
cgtttaagccaaaacaat

SEQ ID NO: 2873723 - DNA, 22 bp, Homo sapiens
cgtttaagccaaaacaatgttt

SEQ ID NO: 2873724 - DNA, 13 bp, Homo sapiens
ctaaagaaaaaca

SEQ ID NO: 2873725 - DNA, 17 bp, Homo sapiens
ctaaagctggtttaatg

SEQ ID NO: 2873726 - DNA, 21 bp, Homo sapiens
ctaaaggactggttaaatcaa

SEQ ID NO: 2873727 - DNA, 19 bp, Homo sapiens
ctaaatacctcaatcagtc

SEQ ID NO: 2873728 - DNA, 13 bp, Homo sapiens
ctaagagaagtag

SEQ ID NO: 2873729 - DNA, 19 bp, Homo sapiens
ctaagagaagtagaaatca

SEQ ID NO: 2873730 - DNA, 17 bp, Homo sapiens
ctaagtgggaagtgaag

SEQ ID NO: 2873731 - DNA, 16 bp, Homo sapiens
ctaatcagagtggcca

SEQ ID NO: 2873732 - DNA, 16 bp, Homo sapiens
ctaatttttttgtatt

SEQ ID NO: 2873733 - DNA, 20 bp, Homo sapiens
ctaatttttttgtattttag

SEQ ID NO: 2873734 - DNA, 15 bp, Homo sapiens
ctacataatttagtt

SEQ ID NO: 2873735 - DNA, 17 bp, Homo sapiens
ctaccagctaactccag

SEQ ID NO: 2873736 - DNA, 15 bp, Homo sapiens
ctacccctgtcctgg

SEQ ID NO: 2873737 - DNA, 14 bp, Homo sapiens
ctactcccctgggc

SEQ ID NO: 2873738 - DNA, 16 bp, Homo sapiens
ctactcctgtgctctg

SEQ ID NO: 2873739 - DNA, 15 bp, Homo sapiens
ctagaggtgagaaat

SEQ ID NO: 2873740 - DNA, 15 bp, Homo sapiens
ctagatggttccctt

SEQ ID NO: 2873741 - DNA, 22 bp, Homo sapiens
ctagttttactttgaactttca

SEQ ID NO: 2873742 - DNA, 15 bp, Homo sapiens
ctataaactactgta

SEQ ID NO: 2873743 - DNA, 17 bp, Homo sapiens
ctataaactactgtaat

SEQ ID NO: 2873744 - DNA, 16 bp, Homo sapiens
ctataagtgttcagtg

SEQ ID NO: 2873745 - DNA, 13 bp, Homo sapiens
ctatagaggagga

SEQ ID NO: 2873746 - DNA, 13 bp, Homo sapiens
ctatagccaaaaa

SEQ ID NO: 2873747 - DNA, 14 bp, Homo sapiens
ctatagccaaaaat

SEQ ID NO: 2873748 - DNA, 18 bp, Homo sapiens
ctatgcagtattgccaca

SEQ ID NO: 2873749 - DNA, 23 bp, Homo sapiens
ctatgcagtattgccacaatgcc

SEQ ID NO: 2873750 - DNA, 13 bp, Homo sapiens
ctatgtcccagcc

SEQ ID NO: 2873751 - DNA, 20 bp, Homo sapiens
ctatgtcccagcccctggta

SEQ ID NO: 2873752 - DNA, 16 bp, Homo sapiens
ctatgttgtgatcctt

SEQ ID NO: 2873753 - DNA, 15 bp, Homo sapiens
ctatgtttttaatgt

SEQ ID NO: 2873754 - DNA, 13 bp, Homo sapiens
caaacacactgta

SEQ ID NO: 2873755 - DNA, 15 bp, Homo sapiens
caaacacactgtaaa

SEQ ID NO: 2873756 - DNA, 17 bp, Homo sapiens
caaacacactgtaaata

SEQ ID NO: 2873757 - DNA, 21 bp, Homo sapiens
caaactgatgcgaaaacttga

SEQ ID NO: 2873758 - DNA, 21 bp, Homo sapiens
caaagagttcaagaaataagt

SEQ ID NO: 2873759 - DNA, 22 bp, Homo sapiens
caaagcaagcattcagaagaaa

SEQ ID NO: 2873760 - DNA, 13 bp, Homo sapiens
caaagtttaataa

SEQ ID NO: 2873761 - DNA, 15 bp, Homo sapiens
caacaacaaggaccc

SEQ ID NO: 2873762 - DNA, 13 bp, Homo sapiens
caacaaggaccct

SEQ ID NO: 2873763 - DNA, 16 bp, Homo sapiens
caacaaggaccctgtt

SEQ ID NO: 2873764 - DNA, 20 bp, Homo sapiens
caacaaggaccctgttttcc

SEQ ID NO: 2873765 - DNA, 10 bp, Homo sapiens
caacagaaac

SEQ ID NO: 2873766 - DNA, 22 bp, Homo sapiens
caacagcctgtttgggaggctg

SEQ ID NO: 2873767 - DNA, 23 bp, Homo sapiens
caacatttgtgcagaaatttgaa

SEQ ID NO: 2873768 - DNA, 15 bp, Homo sapiens
caacctcagtaattt

SEQ ID NO: 2873769 - DNA, 19 bp, Homo sapiens
caacctgtggcgctgcagc

SEQ ID NO: 2873770 - DNA, 15 bp, Homo sapiens
caactacagtctaaa

SEQ ID NO: 2873771 - DNA, 22 bp, Homo sapiens
caactccagccacccagccagg

SEQ ID NO: 2873772 - DNA, 23 bp, Homo sapiens
caactccagccacccagccagga

SEQ ID NO: 2873773 - DNA, 21 bp, Homo sapiens
caagaaagccgtactgtctat

SEQ ID NO: 2873774 - DNA, 23 bp, Homo sapiens
caagaagcattttgtaagttgaa

SEQ ID NO: 2873775 - DNA, 22 bp, Homo sapiens
caagagatgagaaacaacagaa

SEQ ID NO: 2873776 - DNA, 15 bp, Homo sapiens
caagaggtctgagcc

SEQ ID NO: 2873777 - DNA, 18 bp, Homo sapiens
caagaggtctgagccctg

SEQ ID NO: 2873778 - DNA, 22 bp, Homo sapiens
caagagtggactgaatgtgcct

SEQ ID NO: 2873779 - DNA, 21 bp, Homo sapiens
caagcatggctattttatatt

SEQ ID NO: 2873780 - DNA, 18 bp, Homo sapiens
caagccacagaaatgtgt

SEQ ID NO: 2873781 - DNA, 13 bp, Homo sapiens
caagcctgtggga

SEQ ID NO: 2873782 - DNA, 19 bp, Homo sapiens
caaggaccctgttttccac

SEQ ID NO: 2873783 - DNA, 12 bp, Homo sapiens
caaggactcctg

SEQ ID NO: 2873784 - DNA, 19 bp, Homo sapiens
caagtatttgttaatttag

SEQ ID NO: 2873785 - DNA, 20 bp, Homo sapiens
caagttccgtctcctctcca

SEQ ID NO: 2873786 - DNA, 14 bp, Homo sapiens
caataaagtgatct

SEQ ID NO: 2873787 - DNA, 22 bp, Homo sapiens
caataaagtgatctgtgttcaa

SEQ ID NO: 2873788 - DNA, 22 bp, Homo sapiens
caataatttaaatattttttaa

SEQ ID NO: 2873789 - DNA, 14 bp, Homo sapiens
caatccactctcag

SEQ ID NO: 2873790 - DNA, 12 bp, Homo sapiens
caatgcaacatt

SEQ ID NO: 2873791 - DNA, 17 bp, Homo sapiens
caatgcacctaaagaaa

SEQ ID NO: 2873792 - DNA, 13 bp, Homo sapiens
caatgcctctccc

SEQ ID NO: 2873793 - DNA, 14 bp, Homo sapiens
caatgcctctccca

SEQ ID NO: 2873794 - DNA, 15 bp, Homo sapiens
caatgcctctcccac

SEQ ID NO: 2873795 - DNA, 23 bp, Homo sapiens
caattgcacgcggagtgagtttt

SEQ ID NO: 2873796 - DNA, 22 bp, Homo sapiens
caatttcccctctgtgtcctct

SEQ ID NO: 2873797 - DNA, 21 bp, Homo sapiens
cacactgtaaatatccacaga

SEQ ID NO: 2873798 - DNA, 19 bp, Homo sapiens
cacagactccctcccctgc

SEQ ID NO: 2873799 - DNA, 21 bp, Homo sapiens
cacagcatgaggcaaaaatgt

SEQ ID NO: 2873800 - DNA, 23 bp, Homo sapiens
cacagcccaagaggactgagact

SEQ ID NO: 2873801 - DNA, 17 bp, Homo sapiens
cacagtgttatgctctg

SEQ ID NO: 2873802 - DNA, 18 bp, Homo sapiens
cacataggaaacttttga

SEQ ID NO: 2873803 - DNA, 16 bp, Homo sapiens
cacattccctctcatc

SEQ ID NO: 2873804 - DNA, 20 bp, Homo sapiens
caccatcaccctctgggcag

SEQ ID NO: 2873805 - DNA, 13 bp, Homo sapiens
caccatctgcttg

SEQ ID NO: 2873806 - DNA, 16 bp, Homo sapiens
cacccagccaggaggg

SEQ ID NO: 2873807 - DNA, 13 bp, Homo sapiens
agtctgagtcctg

SEQ ID NO: 2873808 - DNA, 16 bp, Homo sapiens
agtctgagtcctgtct

SEQ ID NO: 2873809 - DNA, 17 bp, Homo sapiens
agtctgagtctgagtcc

SEQ ID NO: 2873810 - DNA, 12 bp, Homo sapiens
agtgaagaatac

SEQ ID NO: 2873811 - DNA, 14 bp, Homo sapiens
agtgaagaatactt

SEQ ID NO: 2873812 - DNA, 22 bp, Homo sapiens
agtgaagaatacttctcatttt

SEQ ID NO: 2873813 - DNA, 18 bp, Homo sapiens
agtgaagccccttgtcct

SEQ ID NO: 2873814 - DNA, 15 bp, Homo sapiens
agtgagttttttagt

SEQ ID NO: 2873815 - DNA, 15 bp, Homo sapiens
agtgattgtcttaat

SEQ ID NO: 2873816 - DNA, 14 bp, Homo sapiens
agtggagtctgagt

SEQ ID NO: 2873817 - DNA, 18 bp, Homo sapiens
agtggagtctgagtctga

SEQ ID NO: 2873818 - DNA, 15 bp, Homo sapiens
agtgggaagtgaagc

SEQ ID NO: 2873819 - DNA, 17 bp, Homo sapiens
agtgggaagtgaagccc

SEQ ID NO: 2873820 - DNA, 18 bp, Homo sapiens
agtggggaggggcctggc

SEQ ID NO: 2873821 - DNA, 19 bp, Homo sapiens
agtggggaggggcctggcc

SEQ ID NO: 2873822 - DNA, 20 bp, Homo sapiens
agtgtagaacctaattcaat

SEQ ID NO: 2873823 - DNA, 14 bp, Homo sapiens
agtgttaataaaat

SEQ ID NO: 2873824 - DNA, 20 bp, Homo sapiens
agtgttcagtgttgacatag

SEQ ID NO: 2873825 - DNA, 22 bp, Homo sapiens
agtgttcagtgttgacatagcc

SEQ ID NO: 2873826 - DNA, 12 bp, Homo sapiens
agtgttgacata

SEQ ID NO: 2873827 - DNA, 13 bp, Homo sapiens
agtgttgacatag

SEQ ID NO: 2873828 - DNA, 20 bp, Homo sapiens
agtgttgacatagcctttgt

SEQ ID NO: 2873829 - DNA, 22 bp, Homo sapiens
agtgttgacatagcctttgtgc

SEQ ID NO: 2873830 - DNA, 21 bp, Homo sapiens
agttagctttaacttaaatag

SEQ ID NO: 2873831 - DNA, 13 bp, Homo sapiens
agttctcatccac

SEQ ID NO: 2873832 - DNA, 18 bp, Homo sapiens
agttctcatccacagagg

SEQ ID NO: 2873833 - DNA, 23 bp, Homo sapiens
agttctcatccacagaggccagg

SEQ ID NO: 2873834 - DNA, 23 bp, Homo sapiens
agttgataaagattttttaataa

SEQ ID NO: 2873835 - DNA, 20 bp, Homo sapiens
agttggccatgatgtctttt

SEQ ID NO: 2873836 - DNA, 15 bp, Homo sapiens
agtttatatttaact

SEQ ID NO: 2873837 - DNA, 17 bp, Homo sapiens
ataaaaatgatctaaac

SEQ ID NO: 2873838 - DNA, 15 bp, Homo sapiens
ataaaatgaccagta

SEQ ID NO: 2873839 - DNA, 18 bp, Homo sapiens
ataaagattttttaataa

SEQ ID NO: 2873840 - DNA, 20 bp, Homo sapiens
ataaagttgataaagatttt

SEQ ID NO: 2873841 - DNA, 14 bp, Homo sapiens
ataaataaaatgac

SEQ ID NO: 2873842 - DNA, 21 bp, Homo sapiens
ataagaaacttttttatttaa

SEQ ID NO: 2873843 - DNA, 11 bp, Homo sapiens
ataagaagaat

SEQ ID NO: 2873844 - DNA, 14 bp, Homo sapiens
ataagtgttcagtg

SEQ ID NO: 2873845 - DNA, 18 bp, Homo sapiens
ataagtgttcagtgttga

SEQ ID NO: 2873846 - DNA, 21 bp, Homo sapiens
ataagtgttcagtgttgacat

SEQ ID NO: 2873847 - DNA, 19 bp, Homo sapiens
ataatactaaagtgtctat

SEQ ID NO: 2873848 - DNA, 13 bp, Homo sapiens
ataatgaacagaa

SEQ ID NO: 2873849 - DNA, 13 bp, Homo sapiens
ataatgaagaatg

SEQ ID NO: 2873850 - DNA, 18 bp, Homo sapiens
ataatgaagaatggccat

SEQ ID NO: 2873851 - DNA, 21 bp, Homo sapiens
ataattgttttatctgaattt

SEQ ID NO: 2873852 - DNA, 20 bp, Homo sapiens
ataatttagtttcatataaa

SEQ ID NO: 2873853 - DNA, 18 bp, Homo sapiens
atacatgctaagagaagt

SEQ ID NO: 2873854 - DNA, 17 bp, Homo sapiens
atacattgaattagaaa

SEQ ID NO: 2873855 - DNA, 18 bp, Homo sapiens
atagacagaagaaacaag

SEQ ID NO: 2873856 - DNA, 19 bp, Homo sapiens
atagacagaagaaacaagg

SEQ ID NO: 2873857 - DNA, 17 bp, Homo sapiens
atagcaaaagaagaagt

SEQ ID NO: 2873858 - DNA, 15 bp, Homo sapiens
atagcaaagaattga

SEQ ID NO: 2873859 - DNA, 14 bp, Homo sapiens
atagcacaggctaa

SEQ ID NO: 2873860 - DNA, 17 bp, Homo sapiens
atagcacaggctaattt

SEQ ID NO: 2873861 - DNA, 18 bp, Homo sapiens
atagccaaaaatagctaa

SEQ ID NO: 2873862 - DNA, 20 bp, Homo sapiens
atagccactattaacatttc

SEQ ID NO: 2873863 - DNA, 17 bp, Homo sapiens
atagctgagctggaaag

SEQ ID NO: 2873864 - DNA, 18 bp, Homo sapiens
atagtttggatatgtaaa

SEQ ID NO: 2873865 - DNA, 14 bp, Homo sapiens
atataaacacataa

SEQ ID NO: 2873866 - DNA, 21 bp, Homo sapiens
atatatatctatctatttgag

SEQ ID NO: 2873867 - DNA, 20 bp, Homo sapiens
atatatctatctatttgagg

SEQ ID NO: 2873868 - DNA, 17 bp, Homo sapiens
atatccctatgtcccag

SEQ ID NO: 2873869 - DNA, 16 bp, Homo sapiens
atatctatctatttga

SEQ ID NO: 2873870 - DNA, 15 bp, Homo sapiens
atatctcctgaaaag

SEQ ID NO: 2873871 - DNA, 21 bp, Homo sapiens
atatgatgttaaaaaaataag

SEQ ID NO: 2873872 - DNA, 18 bp, Homo sapiens
atatgtaaaacatttatt

SEQ ID NO: 2873873 - DNA, 23 bp, Homo sapiens
atattcctattgtgcaatgtaaa

SEQ ID NO: 2873874 - DNA, 21 bp, Homo sapiens
atattgtgggtgttaattttt

SEQ ID NO: 2873875 - DNA, 19 bp, Homo sapiens
atatttaactctctttatg

SEQ ID NO: 2873876 - DNA, 14 bp, Homo sapiens
atattttaaagaat

SEQ ID NO: 2873877 - DNA, 21 bp, Homo sapiens
atcaacttaccaggcaccaaa

SEQ ID NO: 2873878 - DNA, 18 bp, Homo sapiens
atcactgctgtccctcct

SEQ ID NO: 2873879 - DNA, 15 bp, Homo sapiens
atcattcatttttgt

SEQ ID NO: 2873880 - DNA, 18 bp, Homo sapiens
atccacagaggccaggca

SEQ ID NO: 2873881 - DNA, 21 bp, Homo sapiens
atccaggtcctttccttctcg

SEQ ID NO: 2873882 - DNA, 20 bp, Homo sapiens
atccctatgtcccagcccct

SEQ ID NO: 2873883 - DNA, 20 bp, Homo sapiens
atcccttaatatcctaaaca

SEQ ID NO: 2873884 - DNA, 14 bp, Homo sapiens
atccgcctctgagc

SEQ ID NO: 2873885 - DNA, 16 bp, Homo sapiens
atccgcctctgagcca

SEQ ID NO: 2873886 - DNA, 18 bp, Homo sapiens
atccgcctctgagccagg

SEQ ID NO: 2873887 - DNA, 16 bp, Homo sapiens
atcctggattcactca

SEQ ID NO: 2873888 - DNA, 20 bp, Homo sapiens
atcctggattcactcactca

SEQ ID NO: 2873889 - DNA, 13 bp, Homo sapiens
atcgaatgaaatt

SEQ ID NO: 2873890 - DNA, 16 bp, Homo sapiens
atctatctatttgagg

SEQ ID NO: 2873891 - DNA, 15 bp, Homo sapiens
atctcagtgaagaat

SEQ ID NO: 2873892 - DNA, 20 bp, Homo sapiens
atctcagtgaagaatacttc

SEQ ID NO: 2873893 - DNA, 19 bp, Homo sapiens
atctcatctcagtgaagaa

SEQ ID NO: 2873894 - DNA, 17 bp, Homo sapiens
atctcatttaagggaaa

SEQ ID NO: 2873895 - DNA, 12 bp, Homo sapiens
atctcctgaaaa

SEQ ID NO: 2873896 - DNA, 17 bp, Homo sapiens
atctgtcccctctcccc

SEQ ID NO: 2873897 - DNA, 16 bp, Homo sapiens
atctgttactgaaatg

SEQ ID NO: 2873898 - DNA, 14 bp, Homo sapiens
atctgttagcagag

SEQ ID NO: 2873899 - DNA, 23 bp, Homo sapiens
atctgttagcagagtctgtctct

SEQ ID NO: 2873900 - DNA, 12 bp, Homo sapiens
atcttctggctt

SEQ ID NO: 2873901 - DNA, 18 bp, Homo sapiens
atctttttaggccacctc

SEQ ID NO: 2873902 - DNA, 12 bp, Homo sapiens
atgataatgaac

SEQ ID NO: 2873903 - DNA, 15 bp, Homo sapiens
atgataatgaacaga

SEQ ID NO: 2873904 - DNA, 23 bp, Homo sapiens
atgcaacatttgtgcagaaattt

SEQ ID NO: 2873905 - DNA, 18 bp, Homo sapiens
atgcaagagtggactgaa

SEQ ID NO: 2873906 - DNA, 14 bp, Homo sapiens
atgcacctaaagaa

SEQ ID NO: 2873907 - DNA, 16 bp, Homo sapiens
atgcacctaaagaaaa

SEQ ID NO: 2873908 - DNA, 18 bp, Homo sapiens
atgccaaaaaaaaataca

SEQ ID NO: 2873909 - DNA, 18 bp, Homo sapiens
atgccaataaagtgatct

SEQ ID NO: 2873910 - DNA, 15 bp, Homo sapiens
atgccagcttcctgt

SEQ ID NO: 2873911 - DNA, 20 bp, Homo sapiens
atgccagcttcctgtgggcc

SEQ ID NO: 2873912 - DNA, 14 bp, Homo sapiens
atgcgaaaacttga

SEQ ID NO: 2873913 - DNA, 20 bp, Homo sapiens
atgcgaaaacttgaatctgt

SEQ ID NO: 2873914 - DNA, 22 bp, Homo sapiens
atgcgaatgagctgggccctgg

SEQ ID NO: 2873915 - DNA, 15 bp, Homo sapiens
atgctaagagaagta

SEQ ID NO: 2873916 - DNA, 17 bp, Homo sapiens
atgctaagagaagtaga

SEQ ID NO: 2873917 - DNA, 22 bp, Homo sapiens
atgctaagagaagtagaaatca

SEQ ID NO: 2873918 - DNA, 16 bp, Homo sapiens
atgctctctatagagg

SEQ ID NO: 2873919 - DNA, 13 bp, Homo sapiens
atgcttctgctca

SEQ ID NO: 2873920 - DNA, 15 bp, Homo sapiens
atgcttctgctcaca

SEQ ID NO: 2873921 - DNA, 17 bp, Homo sapiens
atgcttctgctcacatt

SEQ ID NO: 2873922 - DNA, 19 bp, Homo sapiens
atggaaaggagaggaaaga

SEQ ID NO: 2873923 - DNA, 22 bp, Homo sapiens
atggaaaggagaggaaagaact

SEQ ID NO: 2873924 - DNA, 14 bp, Homo sapiens
atggagagtggcat

SEQ ID NO: 2873925 - DNA, 11 bp, Homo sapiens
tggccccctcc

SEQ ID NO: 2873926 - DNA, 20 bp, Homo sapiens
tggcctggtccaggcttggg

SEQ ID NO: 2873927 - DNA, 13 bp, Homo sapiens
tggctatgttttt

SEQ ID NO: 2873928 - DNA, 23 bp, Homo sapiens
tggctcgctccctgtagctctgc

SEQ ID NO: 2873929 - DNA, 23 bp, Homo sapiens
tggctggcagctgagagccctgc

SEQ ID NO: 2873930 - DNA, 12 bp, Homo sapiens
tggctgtaaact

SEQ ID NO: 2873931 - DNA, 20 bp, Homo sapiens
tggctttgtcacttttcctt

SEQ ID NO: 2873932 - DNA, 23 bp, Homo sapiens
tgggaagaaagaatgcaagagtg

SEQ ID NO: 2873933 - DNA, 16 bp, Homo sapiens
tgggagcctaaggaag

SEQ ID NO: 2873934 - DNA, 23 bp, Homo sapiens
tgggcactgggccggcagcctgg

SEQ ID NO: 2873935 - DNA, 21 bp, Homo sapiens
tgggcagctgtcatggaaaag

SEQ ID NO: 2873936 - DNA, 21 bp, Homo sapiens
tgggcatactaataaagtatg

SEQ ID NO: 2873937 - DNA, 14 bp, Homo sapiens
tgggccggcagcct

SEQ ID NO: 2873938 - DNA, 16 bp, Homo sapiens
tgggccggcagcctgg

SEQ ID NO: 2873939 - DNA, 17 bp, Homo sapiens
tggggaggggcctggcc

SEQ ID NO: 2873940 - DNA, 22 bp, Homo sapiens
tggggaggggcctggcctgggt

SEQ ID NO: 2873941 - DNA, 14 bp, Homo sapiens
tggggcagggcctg

SEQ ID NO: 2873942 - DNA, 19 bp, Homo sapiens
tggggcagggcctggcctg

SEQ ID NO: 2873943 - DNA, 14 bp, Homo sapiens
tgggtaacactgat

SEQ ID NO: 2873944 - DNA, 20 bp, Homo sapiens
tgggtgtgtttcaggacagc

SEQ ID NO: 2873945 - DNA, 11 bp, Homo sapiens
tggtgtgtttc

SEQ ID NO: 2873946 - DNA, 12 bp, Homo sapiens
tggttccctctt

SEQ ID NO: 2873947 - DNA, 14 bp, Homo sapiens
tggttgatgccaaa

SEQ ID NO: 2873948 - DNA, 18 bp, Homo sapiens
tggtttcccaagagctac

SEQ ID NO: 2873949 - DNA, 23 bp, Homo sapiens
tgtaaactataaactactgtaat

SEQ ID NO: 2873950 - DNA, 13 bp, Homo sapiens
tgtaaaggtcaga

SEQ ID NO: 2873951 - DNA, 15 bp, Homo sapiens
tgtaaatatccacag

SEQ ID NO: 2873952 - DNA, 16 bp, Homo sapiens
tgtaagttgaagcaaa

SEQ ID NO: 2873953 - DNA, 20 bp, Homo sapiens
tgtaattaagtgcaatttcc

SEQ ID NO: 2873954 - DNA, 17 bp, Homo sapiens
tgtagaacctaattcaa

SEQ ID NO: 2873955 - DNA, 14 bp, Homo sapiens
tgtagctctgcctc

SEQ ID NO: 2873956 - DNA, 17 bp, Homo sapiens
tgtcacttttccttttc

SEQ ID NO: 2873957 - DNA, 18 bp, Homo sapiens
tgtcacttttccttttct

SEQ ID NO: 2873958 - DNA, 18 bp, Homo sapiens
tgtcatggaaaagcccag

SEQ ID NO: 2873959 - DNA, 13 bp, Homo sapiens
tgtcattttggta

SEQ ID NO: 2873960 - DNA, 16 bp, Homo sapiens
tgtccaatcacattca

SEQ ID NO: 2873961 - DNA, 14 bp, Homo sapiens
tgtccagccacccc

SEQ ID NO: 2873962 - DNA, 22 bp, Homo sapiens
tgtccagccacccccaggcatc

SEQ ID NO: 2873963 - DNA, 13 bp, Homo sapiens
tgtccctcctgag

SEQ ID NO: 2873964 - DNA, 16 bp, Homo sapiens
tgtcctctcccctctg

SEQ ID NO: 2873965 - DNA, 21 bp, Homo sapiens
tgtcctctcccctctgccctg

SEQ ID NO: 2873966 - DNA, 22 bp, Homo sapiens
tgtcctctcccctctgccctgt

SEQ ID NO: 2873967 - DNA, 14 bp, Homo sapiens
tgtcgttcccttgt

SEQ ID NO: 2873968 - DNA, 13 bp, Homo sapiens
tgtctgcctgcct

SEQ ID NO: 2873969 - DNA, 21 bp, Homo sapiens
tgtgattcctttgaagaggaa

SEQ ID NO: 2873970 - DNA, 22 bp, Homo sapiens
tgtgcatttgtgtctgcctgcc

SEQ ID NO: 2873971 - DNA, 17 bp, Homo sapiens
tgtgccaggactctctt

SEQ ID NO: 2873972 - DNA, 12 bp, Homo sapiens
tgtgcccttggg

SEQ ID NO: 2873973 - DNA, 16 bp, Homo sapiens
tgtgctattgaactga

SEQ ID NO: 2873974 - DNA, 16 bp, Homo sapiens
tgtgctctggaggctg

SEQ ID NO: 2873975 - DNA, 12 bp, Homo sapiens
tgtgtcctctcc

SEQ ID NO: 2873976 - DNA, 13 bp, Homo sapiens
tgtgtcctctccc

SEQ ID NO: 2873977 - DNA, 14 bp, Homo sapiens
tgtgtcctctcccc

SEQ ID NO: 2873978 - DNA, 15 bp, Homo sapiens
tgtgtctgcctgcct

SEQ ID NO: 2873979 - DNA, 13 bp, Homo sapiens
tgtgtgtttggaa

SEQ ID NO: 2873980 - DNA, 11 bp, Homo sapiens
tgtgtttcagg

SEQ ID NO: 2873981 - DNA, 16 bp, Homo sapiens
tgtgtttcaggacagc

SEQ ID NO: 2873982 - DNA, 24 bp, Homo sapiens
tgtgtttcaggacagctgcttctg

SEQ ID NO: 2873983 - DNA, 17 bp, Homo sapiens
tgtgtttggaagactat

SEQ ID NO: 2873984 - DNA, 15 bp, Homo sapiens
tgttaatttagaaaa

SEQ ID NO: 2873985 - DNA, 20 bp, Homo sapiens
tgttaatttagaaaacttta

SEQ ID NO: 2873986 - DNA, 22 bp, Homo sapiens
tgttaatttagaaaactttaaa

SEQ ID NO: 2873987 - DNA, 13 bp, Homo sapiens
tgttaatttttga

SEQ ID NO: 2873988 - DNA, 17 bp, Homo sapiens
tgttagactagtttctt

SEQ ID NO: 2873989 - DNA, 21 bp, Homo sapiens
tgttagcagagtctgtctctt

SEQ ID NO: 2873990 - DNA, 22 bp, Homo sapiens
tgttatcaaacaccaacataaa

SEQ ID NO: 2873991 - DNA, 17 bp, Homo sapiens
tgttcagtgttgacata

SEQ ID NO: 2873992 - DNA, 19 bp, Homo sapiens
tgttcagtgttgacatagc

SEQ ID NO: 2873993 - DNA, 20 bp, Homo sapiens
tgttcagtgttgacatagcc

SEQ ID NO: 2873994 - DNA, 15 bp, Homo sapiens
tgttcctgccttctc

SEQ ID NO: 2873995 - DNA, 16 bp, Homo sapiens
tgttgacatagccttt

SEQ ID NO: 2873996 - DNA, 19 bp, Homo sapiens
tgttgacatagcctttgtg

SEQ ID NO: 2873997 - DNA, 17 bp, Homo sapiens
tgttgcaccatctgctt

SEQ ID NO: 2873998 - DNA, 17 bp, Homo sapiens
tgttgtttcttaaataa

SEQ ID NO: 2873999 - DNA, 13 bp, Homo sapiens
tgtttaaagttca

SEQ ID NO: 2874000 - DNA, 21 bp, Homo sapiens
ttaaaaaagcttaaaactttg

SEQ ID NO: 2874001 - DNA, 15 bp, Homo sapiens
ttaaaactttgaagt

SEQ ID NO: 2874002 - DNA, 15 bp, Homo sapiens
ttaactctctttatg

SEQ ID NO: 2874003 - DNA, 21 bp, Homo sapiens
ttaactgggtaatgaaacaaa

SEQ ID NO: 2874004 - DNA, 15 bp, Homo sapiens
ttaagggaaaaatat

SEQ ID NO: 2874005 - DNA, 20 bp, Homo sapiens
ttaatagcaaagaattgact

SEQ ID NO: 2874006 - DNA, 16 bp, Homo sapiens
ttaatttagaaaactt

SEQ ID NO: 2874007 - DNA, 18 bp, Homo sapiens
ttacaaagcccttttata

SEQ ID NO: 2874008 - DNA, 14 bp, Homo sapiens
ttacaatacaatag

SEQ ID NO: 2874009 - DNA, 16 bp, Homo sapiens
ttacacagcccaagag

SEQ ID NO: 2874010 - DNA, 20 bp, Homo sapiens
ttacctgacggacgtcctgc

SEQ ID NO: 2874011 - DNA, 18 bp, Homo sapiens
ttactttaatttccttga

SEQ ID NO: 2874012 - DNA, 14 bp, Homo sapiens
ttagaaaactttaa

SEQ ID NO: 2874013 - DNA, 16 bp, Homo sapiens
ttagaaaactttaaag

SEQ ID NO: 2874014 - DNA, 13 bp, Homo sapiens
ttagaaacataaa

SEQ ID NO: 2874015 - DNA, 16 bp, Homo sapiens
ttagaaacataaataa

SEQ ID NO: 2874016 - DNA, 12 bp, Homo sapiens
ttagcagagtct

SEQ ID NO: 2874017 - DNA, 18 bp, Homo sapiens
ttaggaagcaagcttaat

SEQ ID NO: 2874018 - DNA, 14 bp, Homo sapiens
ttagttttctttgt

SEQ ID NO: 2874019 - DNA, 21 bp, Homo sapiens
ttagttttctttgtaaaggtc

SEQ ID NO: 2874020 - DNA, 24 bp, Homo sapiens
ttataggatttatttaaaatagca

SEQ ID NO: 2874021 - DNA, 17 bp, Homo sapiens
ttatctgaatttttaaa

SEQ ID NO: 2874022 - DNA, 16 bp, Homo sapiens
ttatcttgttcaatga

SEQ ID NO: 2874023 - DNA, 17 bp, Homo sapiens
ttatgtctgtggatttt

SEQ ID NO: 2874024 - DNA, 18 bp, Homo sapiens
ttatttgtaatagatgtt

SEQ ID NO: 2874025 - DNA, 13 bp, Homo sapiens
ttcaaaagcaatc

SEQ ID NO: 2874026 - DNA, 19 bp, Homo sapiens
ttcaaagtttaataaattt

SEQ ID NO: 2874027 - DNA, 18 bp, Homo sapiens
ttcaacaattctaaaatg

SEQ ID NO: 2874028 - DNA, 14 bp, Homo sapiens
ttcaagcctgtggg

SEQ ID NO: 2874029 - DNA, 15 bp, Homo sapiens
ttcaagcctgtggga

SEQ ID NO: 2874030 - DNA, 22 bp, Homo sapiens
ttcacaacagcctgacaacatt

SEQ ID NO: 2874031 - DNA, 14 bp, Homo sapiens
ttcaccaaatcttg

SEQ ID NO: 2874032 - DNA, 21 bp, Homo sapiens
ttcagtgttgacatagccttt

SEQ ID NO: 2874033 - DNA, 18 bp, Homo sapiens
ttcatacatttgacttct

SEQ ID NO: 2874034 - DNA, 14 bp, Homo sapiens
ttcatataaagtat

SEQ ID NO: 2874035 - DNA, 16 bp, Homo sapiens
ttcatataaagtatca

SEQ ID NO: 2874036 - DNA, 18 bp, Homo sapiens
ttcatgataatgaacaga

SEQ ID NO: 2874037 - DNA, 18 bp, Homo sapiens
ttcccctctgtgtcctct

SEQ ID NO: 2874038 - DNA, 22 bp, Homo sapiens
ttcccctctgtgtcctctcccc

SEQ ID NO: 2874039 - DNA, 16 bp, Homo sapiens
ttccctagatggttcc

SEQ ID NO: 2874040 - DNA, 13 bp, Homo sapiens
ttccctcaccccc

SEQ ID NO: 2874041 - DNA, 18 bp, Homo sapiens
ttccctcaccccctccca

SEQ ID NO: 2874042 - DNA, 14 bp, Homo sapiens
ttccctctcatcca

SEQ ID NO: 2874043 - DNA, 11 bp, Homo sapiens
ttccctggaga

SEQ ID NO: 2874044 - DNA, 13 bp, Homo sapiens
ttccgtctcctct

SEQ ID NO: 2874045 - DNA, 21 bp, Homo sapiens
tctcattcccagagtcagagg

SEQ ID NO: 2874046 - DNA, 16 bp, Homo sapiens
tctcccctctgccctg

SEQ ID NO: 2874047 - DNA, 18 bp, Homo sapiens
tctcccctctgccctgta

SEQ ID NO: 2874048 - DNA, 17 bp, Homo sapiens
tctcccgaatcctgagg

SEQ ID NO: 2874049 - DNA, 14 bp, Homo sapiens
tctcctctccagcc

SEQ ID NO: 2874050 - DNA, 19 bp, Homo sapiens
tctctataagtgttcagtg

SEQ ID NO: 2874051 - DNA, 20 bp, Homo sapiens
tctctataagtgttcagtgt

SEQ ID NO: 2874052 - DNA, 16 bp, Homo sapiens
tctgaatttttaaaca

SEQ ID NO: 2874053 - DNA, 14 bp, Homo sapiens
tctgacttcctctg

SEQ ID NO: 2874054 - DNA, 15 bp, Homo sapiens
tctgagccaggagcc

SEQ ID NO: 2874055 - DNA, 11 bp, Homo sapiens
tctgagccctg

SEQ ID NO: 2874056 - DNA, 21 bp, Homo sapiens
tctgagtcctgtctctgcctg

SEQ ID NO: 2874057 - DNA, 13 bp, Homo sapiens
tctgagtctgagt

SEQ ID NO: 2874058 - DNA, 15 bp, Homo sapiens
tctgcaacagcctgt

SEQ ID NO: 2874059 - DNA, 13 bp, Homo sapiens
tctgcctccctct

SEQ ID NO: 2874060 - DNA, 21 bp, Homo sapiens
tctgcctgcctcatgctctct

SEQ ID NO: 2874061 - DNA, 15 bp, Homo sapiens
tctgcctgcggccca

SEQ ID NO: 2874062 - DNA, 20 bp, Homo sapiens
tctgctcacattccctctca

SEQ ID NO: 2874063 - DNA, 22 bp, Homo sapiens
tctgtattctgcaacagcctgt

SEQ ID NO: 2874064 - DNA, 17 bp, Homo sapiens
tctgtcccctctcccct

SEQ ID NO: 2874065 - DNA, 18 bp, Homo sapiens
tctgtgcatttgtgtctg

SEQ ID NO: 2874066 - DNA, 15 bp, Homo sapiens
tctgttactgaaatg

SEQ ID NO: 2874067 - DNA, 20 bp, Homo sapiens
tctgttagcagagtctgtct

SEQ ID NO: 2874068 - DNA, 16 bp, Homo sapiens
tcttcaccaaatcttg

SEQ ID NO: 2874069 - DNA, 16 bp, Homo sapiens
tcttcctctctctcac

SEQ ID NO: 2874070 - DNA, 11 bp, Homo sapiens
tcttctggctt

SEQ ID NO: 2874071 - DNA, 15 bp, Homo sapiens
tctttcctgtgccag

SEQ ID NO: 2874072 - DNA, 17 bp, Homo sapiens
tctttgtaaaggtcaga

SEQ ID NO: 2874073 - DNA, 19 bp, Homo sapiens
tctttgtaaaggtcagagt

SEQ ID NO: 2874074 - DNA, 22 bp, Homo sapiens
tcttttaaagaagtaaatttgt

SEQ ID NO: 2874075 - DNA, 14 bp, Homo sapiens
tcttttataggatt

SEQ ID NO: 2874076 - DNA, 19 bp, Homo sapiens
tgaaaaggtttatgaaaaa

SEQ ID NO: 2874077 - DNA, 22 bp, Homo sapiens
tgaaaaggtttatgaaaaagaa

SEQ ID NO: 2874078 - DNA, 16 bp, Homo sapiens
tgaaatatgatgttaa

SEQ ID NO: 2874079 - DNA, 17 bp, Homo sapiens
tgaactgtggtgccaca

SEQ ID NO: 2874080 - DNA, 22 bp, Homo sapiens
tgaagaggaaaatgaataatac

SEQ ID NO: 2874081 - DNA, 21 bp, Homo sapiens
tgaagccccttgtcctctccc

SEQ ID NO: 2874082 - DNA, 18 bp, Homo sapiens
tgaatctgttactgaaat

SEQ ID NO: 2874083 - DNA, 19 bp, Homo sapiens
tgaatctgttactgaaatg

SEQ ID NO: 2874084 - DNA, 15 bp, Homo sapiens
tgaatgcaaaccata

SEQ ID NO: 2874085 - DNA, 23 bp, Homo sapiens
tgaattagaaacataaataaaat

SEQ ID NO: 2874086 - DNA, 21 bp, Homo sapiens
tgaatttttaaacaagtattt

SEQ ID NO: 2874087 - DNA, 16 bp, Homo sapiens
tgacaacatttctata

SEQ ID NO: 2874088 - DNA, 23 bp, Homo sapiens
tgacaacatttctatagccaaaa

SEQ ID NO: 2874089 - DNA, 16 bp, Homo sapiens
tgacataaagttgata

SEQ ID NO: 2874090 - DNA, 12 bp, Homo sapiens
tgacatagcctt

SEQ ID NO: 2874091 - DNA, 21 bp, Homo sapiens
tgacattaagacacacctctg

SEQ ID NO: 2874092 - DNA, 18 bp, Homo sapiens
tgacccagagtggagtct

SEQ ID NO: 2874093 - DNA, 16 bp, Homo sapiens
tgacggacgtcctgct

SEQ ID NO: 2874094 - DNA, 17 bp, Homo sapiens
tgagagccctgctgtgg

SEQ ID NO: 2874095 - DNA, 14 bp, Homo sapiens
tgagatttctttta

SEQ ID NO: 2874096 - DNA, 15 bp, Homo sapiens
tgagatttcttttaa

SEQ ID NO: 2874097 - DNA, 20 bp, Homo sapiens
tgagccaggagcctcctgac

SEQ ID NO: 2874098 - DNA, 22 bp, Homo sapiens
tgagctggaaaggatgcttctg

SEQ ID NO: 2874099 - DNA, 16 bp, Homo sapiens
tgagctgggccctggg

SEQ ID NO: 2874100 - DNA, 17 bp, Homo sapiens
tgagctgggccctgggt

SEQ ID NO: 2874101 - DNA, 18 bp, Homo sapiens
tgagggatggggagcagc

SEQ ID NO: 2874102 - DNA, 21 bp, Homo sapiens
tgagggatggggagcagctgg

SEQ ID NO: 2874103 - DNA, 21 bp, Homo sapiens
tgaggtgggggtctggcctag

SEQ ID NO: 2874104 - DNA, 16 bp, Homo sapiens
tgagtcctgtctctgc

SEQ ID NO: 2874105 - DNA, 15 bp, Homo sapiens
tgagtctgagtcctg

SEQ ID NO: 2874106 - DNA, 18 bp, Homo sapiens
tgagtctgagtcctgtct

SEQ ID NO: 2874107 - DNA, 21 bp, Homo sapiens
tgagtctgagtcctgtctctg

SEQ ID NO: 2874108 - DNA, 19 bp, Homo sapiens
tgataaagattttttaata

SEQ ID NO: 2874109 - DNA, 15 bp, Homo sapiens
tgataatgaacagaa

SEQ ID NO: 2874110 - DNA, 16 bp, Homo sapiens
tgatactaagcattga

SEQ ID NO: 2874111 - DNA, 24 bp, Homo sapiens
tgatagcagaagaaaaagttgcag

SEQ ID NO: 2874112 - DNA, 14 bp, Homo sapiens
tgatgccaaaaaaa

SEQ ID NO: 2874113 - DNA, 21 bp, Homo sapiens
tgatgccagctgtactgagtt

SEQ ID NO: 2874114 - DNA, 21 bp, Homo sapiens
tgatgcctgacacaggggaca

SEQ ID NO: 2874115 - DNA, 16 bp, Homo sapiens
tgatgcgaaaacttga

SEQ ID NO: 2874116 - DNA, 12 bp, Homo sapiens
tgatgttaaaaa

SEQ ID NO: 2874117 - DNA, 13 bp, Homo sapiens
tgattttggcatg

SEQ ID NO: 2874118 - DNA, 19 bp, Homo sapiens
tgcaagtccatagctgagc

SEQ ID NO: 2874119 - DNA, 18 bp, Homo sapiens
tgcaatgggggagggagg

SEQ ID NO: 2874120 - DNA, 19 bp, Homo sapiens
tgcaatgggggagggaggg

SEQ ID NO: 2874121 - DNA, 15 bp, Homo sapiens
tgcaatttctcccga

SEQ ID NO: 2874122 - DNA, 15 bp, Homo sapiens
tgcaccatctgcttg

SEQ ID NO: 2874123 - DNA, 16 bp, Homo sapiens
tgcacctaaagaaaaa

SEQ ID NO: 2874124 - DNA, 19 bp, Homo sapiens
tgcacctaaagaaaaacaa

SEQ ID NO: 2874125 - DNA, 14 bp, Homo sapiens
tgcatttgtgtctg

SEQ ID NO: 2874126 - DNA, 15 bp, Homo sapiens
tgcatttgtgtctgc

SEQ ID NO: 2874127 - DNA, 19 bp, Homo sapiens
tgccacaatgcctctccca

SEQ ID NO: 2874128 - DNA, 21 bp, Homo sapiens
tgccagcttcctgtgggccag

SEQ ID NO: 2874129 - DNA, 22 bp, Homo sapiens
tgcccttggggtaagccagagc

SEQ ID NO: 2874130 - DNA, 15 bp, Homo sapiens
tgcctaatggagaag

SEQ ID NO: 2874131 - DNA, 15 bp, Homo sapiens
tgcctagtggcttcc

SEQ ID NO: 2874132 - DNA, 13 bp, Homo sapiens
tgcctcatgctct

SEQ ID NO: 2874133 - DNA, 16 bp, Homo sapiens
tgcctcatgctctcta

SEQ ID NO: 2874134 - DNA, 17 bp, Homo sapiens
tgcctgacacaggggac

SEQ ID NO: 2874135 - DNA, 22 bp, Homo sapiens
tgcctgcaactttttgccttct

SEQ ID NO: 2874136 - DNA, 19 bp, Homo sapiens
tgcgaaaacttgaatctgt

SEQ ID NO: 2874137 - DNA, 21 bp, Homo sapiens
tgcgagaggtccctgcttacc

SEQ ID NO: 2874138 - DNA, 19 bp, Homo sapiens
tgctaggggatgaggggct

SEQ ID NO: 2874139 - DNA, 17 bp, Homo sapiens
tgctatggttttctcca

SEQ ID NO: 2874140 - DNA, 15 bp, Homo sapiens
tgctattgaactgag

SEQ ID NO: 2874141 - DNA, 17 bp, Homo sapiens
tgctattgaactgagcc

SEQ ID NO: 2874142 - DNA, 12 bp, Homo sapiens
tgctcacaggca

SEQ ID NO: 2874143 - DNA, 14 bp, Homo sapiens
tgctcacattccct

SEQ ID NO: 2874144 - DNA, 23 bp, Homo sapiens
tgctcctacccctgtcctggggc

SEQ ID NO: 2874145 - DNA, 15 bp, Homo sapiens
tgctctggaggctgc

SEQ ID NO: 2874146 - DNA, 18 bp, Homo sapiens
tgctgagttccggggtgc

SEQ ID NO: 2874147 - DNA, 16 bp, Homo sapiens
tgctggtaaaataatg

SEQ ID NO: 2874148 - DNA, 13 bp, Homo sapiens
tgctgtccctcct

SEQ ID NO: 2874149 - DNA, 13 bp, Homo sapiens
tgcttctgctcac

SEQ ID NO: 2874150 - DNA, 14 bp, Homo sapiens
tggaaaagcccagt

SEQ ID NO: 2874151 - DNA, 23 bp, Homo sapiens
tggaaaggatgcttctgctcaca

SEQ ID NO: 2874152 - DNA, 22 bp, Homo sapiens
tggaatataattgttttatctg

SEQ ID NO: 2874153 - DNA, 23 bp, Homo sapiens
tggaggtgggagacaaggaacca

SEQ ID NO: 2874154 - DNA, 21 bp, Homo sapiens
tggagtctgagtctgagtcct

SEQ ID NO: 2874155 - DNA, 14 bp, Homo sapiens
tggatgacattaaa

SEQ ID NO: 2874156 - DNA, 15 bp, Homo sapiens
tggatggaaggagac

SEQ ID NO: 2874157 - DNA, 14 bp, Homo sapiens
tggcacctcagaca

SEQ ID NO: 2874158 - DNA, 20 bp, Homo sapiens
tggcacttagcccaagaggt

SEQ ID NO: 2874159 - DNA, 17 bp, Homo sapiens
tggcagctgagagccct

SEQ ID NO: 2874160 - DNA, 18 bp, Homo sapiens
tggcagctgagagccctg

SEQ ID NO: 2874161 - DNA, 23 bp, Homo sapiens
tcagtcaagttccgtctcctctc

SEQ ID NO: 2874162 - DNA, 11 bp, Homo sapiens
tcagtgttgac

SEQ ID NO: 2874163 - DNA, 18 bp, Homo sapiens
tcagtgttgacatagcct

SEQ ID NO: 2874164 - DNA, 20 bp, Homo sapiens
tcagtgttgacatagccttt

SEQ ID NO: 2874165 - DNA, 22 bp, Homo sapiens
tcagtgttgacatagcctttgt

SEQ ID NO: 2874166 - DNA, 15 bp, Homo sapiens
tcatactgaagatgc

SEQ ID NO: 2874167 - DNA, 13 bp, Homo sapiens
tcatataaagtat

SEQ ID NO: 2874168 - DNA, 16 bp, Homo sapiens
tcatataaagtatcat

SEQ ID NO: 2874169 - DNA, 18 bp, Homo sapiens
tcatataaagtatcatca

SEQ ID NO: 2874170 - DNA, 15 bp, Homo sapiens
tcatccacagaggcc

SEQ ID NO: 2874171 - DNA, 18 bp, Homo sapiens
tcatccaggtcctttcct

SEQ ID NO: 2874172 - DNA, 16 bp, Homo sapiens
tcatctcatttaaggg

SEQ ID NO: 2874173 - DNA, 20 bp, Homo sapiens
tcattccttcactcatccag

SEQ ID NO: 2874174 - DNA, 16 bp, Homo sapiens
tcatttaagggaaaaa

SEQ ID NO: 2874175 - DNA, 20 bp, Homo sapiens
tcatttcatctcatttaagg

SEQ ID NO: 2874176 - DNA, 15 bp, Homo sapiens
tccacagaggccagg

SEQ ID NO: 2874177 - DNA, 12 bp, Homo sapiens
tccactctcagg

SEQ ID NO: 2874178 - DNA, 13 bp, Homo sapiens
tccagccagcgcc

SEQ ID NO: 2874179 - DNA, 20 bp, Homo sapiens
tccaggtcctttccttctcg

SEQ ID NO: 2874180 - DNA, 15 bp, Homo sapiens
tccagtctcctgaca

SEQ ID NO: 2874181 - DNA, 13 bp, Homo sapiens
tccatccctggcc

SEQ ID NO: 2874182 - DNA, 20 bp, Homo sapiens
tccatccctggccccctccc

SEQ ID NO: 2874183 - DNA, 24 bp, Homo sapiens
tccatccctggccccctccctgga

SEQ ID NO: 2874184 - DNA, 17 bp, Homo sapiens
tccatgtgaaaataaaa

SEQ ID NO: 2874185 - DNA, 18 bp, Homo sapiens
tccattaaaacaatttat

SEQ ID NO: 2874186 - DNA, 20 bp, Homo sapiens
tcccaaaatgttgaaatatg

SEQ ID NO: 2874187 - DNA, 13 bp, Homo sapiens
tcccaaagtgctg

SEQ ID NO: 2874188 - DNA, 12 bp, Homo sapiens
tcccacccccag

SEQ ID NO: 2874189 - DNA, 14 bp, Homo sapiens
tcccacccccagcc

SEQ ID NO: 2874190 - DNA, 15 bp, Homo sapiens
tcccacccccagccc

SEQ ID NO: 2874191 - DNA, 16 bp, Homo sapiens
tcccacgatgtcaagg

SEQ ID NO: 2874192 - DNA, 15 bp, Homo sapiens
tcccagcccctggta

SEQ ID NO: 2874193 - DNA, 19 bp, Homo sapiens
tcccagcccctggtactcc

SEQ ID NO: 2874194 - DNA, 23 bp, Homo sapiens
tcccagcccctggtactccccca

SEQ ID NO: 2874195 - DNA, 21 bp, Homo sapiens
tcccatgactgcccagctctg

SEQ ID NO: 2874196 - DNA, 17 bp, Homo sapiens
tcccatttgtgtttcag

SEQ ID NO: 2874197 - DNA, 19 bp, Homo sapiens
tccccccccaacctttccc

SEQ ID NO: 2874198 - DNA, 14 bp, Homo sapiens
tcccctccatccct

SEQ ID NO: 2874199 - DNA, 15 bp, Homo sapiens
tcccctccatccctg

SEQ ID NO: 2874200 - DNA, 18 bp, Homo sapiens
tcccctccatccctggcc

SEQ ID NO: 2874201 - DNA, 16 bp, Homo sapiens
tcccctctgccctgta

SEQ ID NO: 2874202 - DNA, 19 bp, Homo sapiens
tcccctctgccctgtatat

SEQ ID NO: 2874203 - DNA, 22 bp, Homo sapiens
tcccctgggcatcttctggctt

SEQ ID NO: 2874204 - DNA, 15 bp, Homo sapiens
tcccgaatcctgagg

SEQ ID NO: 2874205 - DNA, 19 bp, Homo sapiens
tccctaagaaaccccaggg

SEQ ID NO: 2874206 - DNA, 16 bp, Homo sapiens
tccctaccccatttgt

SEQ ID NO: 2874207 - DNA, 17 bp, Homo sapiens
tccctactcccctgggc

SEQ ID NO: 2874208 - DNA, 21 bp, Homo sapiens
tccctagatggttccctttgt

SEQ ID NO: 2874209 - DNA, 20 bp, Homo sapiens
tccctcaaatgcgcgtgtgc

SEQ ID NO: 2874210 - DNA, 10 bp, Homo sapiens
tccctcaccc

SEQ ID NO: 2874211 - DNA, 12 bp, Homo sapiens
tccctcaccccc

SEQ ID NO: 2874212 - DNA, 15 bp, Homo sapiens
tccctcaccccctcc

SEQ ID NO: 2874213 - DNA, 11 bp, Homo sapiens
tccctccaccc

SEQ ID NO: 2874214 - DNA, 15 bp, Homo sapiens
tccctccaccccagg

SEQ ID NO: 2874215 - DNA, 16 bp, Homo sapiens
tccctccaccccagga

SEQ ID NO: 2874216 - DNA, 17 bp, Homo sapiens
tccctccaccccaggac

SEQ ID NO: 2874217 - DNA, 13 bp, Homo sapiens
tccctctcatcca

SEQ ID NO: 2874218 - DNA, 14 bp, Homo sapiens
tccctctttcctgt

SEQ ID NO: 2874219 - DNA, 16 bp, Homo sapiens
tccctctttcctgtgc

SEQ ID NO: 2874220 - DNA, 14 bp, Homo sapiens
tccctgtagctctg

SEQ ID NO: 2874221 - DNA, 14 bp, Homo sapiens
tcccttaatatcct

SEQ ID NO: 2874222 - DNA, 14 bp, Homo sapiens
tcccttctatgcag

SEQ ID NO: 2874223 - DNA, 18 bp, Homo sapiens
tcccttgtgtctgttgct

SEQ ID NO: 2874224 - DNA, 13 bp, Homo sapiens
tccctttctcttc

SEQ ID NO: 2874225 - DNA, 17 bp, Homo sapiens
tccctttctcttcttcc

SEQ ID NO: 2874226 - DNA, 14 bp, Homo sapiens
tccctttgttgctg

SEQ ID NO: 2874227 - DNA, 15 bp, Homo sapiens
tccctttgttgctgt

SEQ ID NO: 2874228 - DNA, 13 bp, Homo sapiens
tccgcctctgagc

SEQ ID NO: 2874229 - DNA, 15 bp, Homo sapiens
tccgcctctgagcca

SEQ ID NO: 2874230 - DNA, 16 bp, Homo sapiens
tccgcctctgagccag

SEQ ID NO: 2874231 - DNA, 21 bp, Homo sapiens
tccgcctctgagccaggagcc

SEQ ID NO: 2874232 - DNA, 17 bp, Homo sapiens
tccgtctcctctccagc

SEQ ID NO: 2874233 - DNA, 21 bp, Homo sapiens
tccgtctcctctccagcccta

SEQ ID NO: 2874234 - DNA, 22 bp, Homo sapiens
tcctaagtgggaagtgaagccc

SEQ ID NO: 2874235 - DNA, 15 bp, Homo sapiens
tcctacccctgtcct

SEQ ID NO: 2874236 - DNA, 19 bp, Homo sapiens
tcctcaacccctcccctcc

SEQ ID NO: 2874237 - DNA, 16 bp, Homo sapiens
tcctcctcctcctcct

SEQ ID NO: 2874238 - DNA, 15 bp, Homo sapiens
tcctcctcctcctgt

SEQ ID NO: 2874239 - DNA, 16 bp, Homo sapiens
tcctcctcctgttcct

SEQ ID NO: 2874240 - DNA, 18 bp, Homo sapiens
tcctcctgttcctgcctt

SEQ ID NO: 2874241 - DNA, 19 bp, Homo sapiens
tcctcctgttcctgccttc

SEQ ID NO: 2874242 - DNA, 13 bp, Homo sapiens
tcctctccagccc

SEQ ID NO: 2874243 - DNA, 21 bp, Homo sapiens
tcctgaaaaggtttatgaaaa

SEQ ID NO: 2874244 - DNA, 14 bp, Homo sapiens
tcctgacattaaga

SEQ ID NO: 2874245 - DNA, 16 bp, Homo sapiens
tcctgaggtctggatt

SEQ ID NO: 2874246 - DNA, 21 bp, Homo sapiens
tcctgccttctcttctatcct

SEQ ID NO: 2874247 - DNA, 12 bp, Homo sapiens
tcctgctggcac

SEQ ID NO: 2874248 - DNA, 15 bp, Homo sapiens
tcctgctggcacctc

SEQ ID NO: 2874249 - DNA, 18 bp, Homo sapiens
tcctgtctgtcctggagg

SEQ ID NO: 2874250 - DNA, 13 bp, Homo sapiens
tcctgtgccagga

SEQ ID NO: 2874251 - DNA, 21 bp, Homo sapiens
tcctgtgccaggactctcttt

SEQ ID NO: 2874252 - DNA, 14 bp, Homo sapiens
tcctgttcctgcct

SEQ ID NO: 2874253 - DNA, 15 bp, Homo sapiens
tcctgttcctgcctt

SEQ ID NO: 2874254 - DNA, 19 bp, Homo sapiens
tcctgttcctgccttctct

SEQ ID NO: 2874255 - DNA, 18 bp, Homo sapiens
tccttcaacaattctaaa

SEQ ID NO: 2874256 - DNA, 21 bp, Homo sapiens
tccttcatcgaacaaactgat

SEQ ID NO: 2874257 - DNA, 17 bp, Homo sapiens
tccttctcgtcttcctc

SEQ ID NO: 2874258 - DNA, 19 bp, Homo sapiens
tccttctcgtcttcctctc

SEQ ID NO: 2874259 - DNA, 24 bp, Homo sapiens
tccttctcgtcttcctctctctca

SEQ ID NO: 2874260 - DNA, 20 bp, Homo sapiens
tcctttgaagaggaaaatga

SEQ ID NO: 2874261 - DNA, 16 bp, Homo sapiens
tccttttagtgataaa

SEQ ID NO: 2874262 - DNA, 12 bp, Homo sapiens
tcgaatgaaatt

SEQ ID NO: 2874263 - DNA, 19 bp, Homo sapiens
tcgatcctggattcactca

SEQ ID NO: 2874264 - DNA, 21 bp, Homo sapiens
tcgctccctgtagctctgcct

SEQ ID NO: 2874265 - DNA, 22 bp, Homo sapiens
tcgctccctgtagctctgcctc

SEQ ID NO: 2874266 - DNA, 18 bp, Homo sapiens
tcgctcctcaacccctcc

SEQ ID NO: 2874267 - DNA, 22 bp, Homo sapiens
tcgctcctcaacccctcccctc

SEQ ID NO: 2874268 - DNA, 19 bp, Homo sapiens
tcggcctcccaaagtgctg

SEQ ID NO: 2874269 - DNA, 18 bp, Homo sapiens
tcgtcttcctctctctca

SEQ ID NO: 2874270 - DNA, 19 bp, Homo sapiens
tcgtgcgcaacaacaagga

SEQ ID NO: 2874271 - DNA, 14 bp, Homo sapiens
tctaaaggactggt

SEQ ID NO: 2874272 - DNA, 24 bp, Homo sapiens
tctataagtgttcagtgttgacat

SEQ ID NO: 2874273 - DNA, 14 bp, Homo sapiens
tctattacactgga

SEQ ID NO: 2874274 - DNA, 14 bp, Homo sapiens
aaaaactaaaaact

SEQ ID NO: 2874275 - DNA, 18 bp, Homo sapiens
aaaaagaagcaacctcag

SEQ ID NO: 2874276 - DNA, 16 bp, Homo sapiens
aaaaaggcaagccaca

SEQ ID NO: 2874277 - DNA, 20 bp, Homo sapiens
aaaaagttgcagtctcagaa

SEQ ID NO: 2874278 - DNA, 16 bp, Homo sapiens
aaaaataagaagaatg

SEQ ID NO: 2874279 - DNA, 21 bp, Homo sapiens
aaaaatagctaaatacctcaa

SEQ ID NO: 2874280 - DNA, 23 bp, Homo sapiens
aaaaatagtttggatatgtaaaa

SEQ ID NO: 2874281 - DNA, 16 bp, Homo sapiens
aaaacatttattttga

SEQ ID NO: 2874282 - DNA, 18 bp, Homo sapiens
aaaaccataaaataaatt

SEQ ID NO: 2874283 - DNA, 19 bp, Homo sapiens
aaaaccataaaataaattt

SEQ ID NO: 2874284 - DNA, 13 bp, Homo sapiens
aaaactaaattta

SEQ ID NO: 2874285 - DNA, 22 bp, Homo sapiens
aaaacttgaatctgttactgaa

SEQ ID NO: 2874286 - DNA, 12 bp, Homo sapiens
aaaagaagaagt

SEQ ID NO: 2874287 - DNA, 14 bp, Homo sapiens
aaaagaagaagttt

SEQ ID NO: 2874288 - DNA, 19 bp, Homo sapiens
aaaagagatggcctgagaa

SEQ ID NO: 2874289 - DNA, 11 bp, Homo sapiens
aaaagcccagt

SEQ ID NO: 2874290 - DNA, 16 bp, Homo sapiens
aaaagcccagtgacct

SEQ ID NO: 2874291 - DNA, 20 bp, Homo sapiens
aaaagcccagtgacctgacc

SEQ ID NO: 2874292 - DNA, 21 bp, Homo sapiens
aaaagcccagtgacctgaccg

SEQ ID NO: 2874293 - DNA, 14 bp, Homo sapiens
aaaagctagaattg

SEQ ID NO: 2874294 - DNA, 23 bp, Homo sapiens
aaaagggggctattccctggaga

SEQ ID NO: 2874295 - DNA, 14 bp, Homo sapiens
aaaaggtttatgaa

SEQ ID NO: 2874296 - DNA, 19 bp, Homo sapiens
aaaaggtttatgaaaaaga

SEQ ID NO: 2874297 - DNA, 20 bp, Homo sapiens
aaaaggtttatgaaaaagaa

SEQ ID NO: 2874298 - DNA, 21 bp, Homo sapiens
aaaagtgatctgtcccctctc

SEQ ID NO: 2874299 - DNA, 18 bp, Homo sapiens
aaaagttgcagtctcaga

SEQ ID NO: 2874300 - DNA, 14 bp, Homo sapiens
aaaatatatatcta

SEQ ID NO: 2874301 - DNA, 21 bp, Homo sapiens
aaaatcaggtggcttttgcgg

SEQ ID NO: 2874302 - DNA, 20 bp, Homo sapiens
aaaatgtccagccaccccca

SEQ ID NO: 2874303 - DNA, 21 bp, Homo sapiens
aaaattgaatgcaaaccatag

SEQ ID NO: 2874304 - DNA, 16 bp, Homo sapiens
aaaatttcaaaagtga

SEQ ID NO: 2874305 - DNA, 13 bp, Homo sapiens
aaacacactgtaa

SEQ ID NO: 2874306 - DNA, 22 bp, Homo sapiens
aaacacactgtaaatatccaca

SEQ ID NO: 2874307 - DNA, 15 bp, Homo sapiens
aaacaccaacataaa

SEQ ID NO: 2874308 - DNA, 19 bp, Homo sapiens
aaacaccaacataaaaatg

SEQ ID NO: 2874309 - DNA, 14 bp, Homo sapiens
aaacataaataaaa

SEQ ID NO: 2874310 - DNA, 19 bp, Homo sapiens
aaacatgaatcctgtgata

SEQ ID NO: 2874311 - DNA, 16 bp, Homo sapiens
aaacatttactgacca

SEQ ID NO: 2874312 - DNA, 17 bp, Homo sapiens
aaaccataaaataaatt

SEQ ID NO: 2874313 - DNA, 13 bp, Homo sapiens
aaactactgtaat

SEQ ID NO: 2874314 - DNA, 21 bp, Homo sapiens
aaactgatgcgaaaacttgaa

SEQ ID NO: 2874315 - DNA, 22 bp, Homo sapiens
aaactgatgcgaaaacttgaat

SEQ ID NO: 2874316 - DNA, 13 bp, Homo sapiens
aaacttgaatctg

SEQ ID NO: 2874317 - DNA, 19 bp, Homo sapiens
aaacttttttatttaaaaa

SEQ ID NO: 2874318 - DNA, 15 bp, Homo sapiens
aaagaagtaaaagca

SEQ ID NO: 2874319 - DNA, 16 bp, Homo sapiens
aaagagttcaagaaat

SEQ ID NO: 2874320 - DNA, 22 bp, Homo sapiens
aaagataccatgtataattttc

SEQ ID NO: 2874321 - DNA, 19 bp, Homo sapiens
aaagattttttaataattt

SEQ ID NO: 2874322 - DNA, 20 bp, Homo sapiens
aaagattttttaataattta

SEQ ID NO: 2874323 - DNA, 16 bp, Homo sapiens
aaagcaaaaaagaaaa

SEQ ID NO: 2874324 - DNA, 18 bp, Homo sapiens
aaagccatgccaataaag

SEQ ID NO: 2874325 - DNA, 13 bp, Homo sapiens
aaagctagaattg

SEQ ID NO: 2874326 - DNA, 14 bp, Homo sapiens
aaagctagaattga

SEQ ID NO: 2874327 - DNA, 16 bp, Homo sapiens
aaagcttaaaactttg

SEQ ID NO: 2874328 - DNA, 19 bp, Homo sapiens
aaagtatggtattgaaact

SEQ ID NO: 2874329 - DNA, 17 bp, Homo sapiens
aaagttgataaagattt

SEQ ID NO: 2874330 - DNA, 21 bp, Homo sapiens
aaagtttaacctaaataatta

SEQ ID NO: 2874331 - DNA, 12 bp, Homo sapiens
aaagtttaataa

SEQ ID NO: 2874332 - DNA, 15 bp, Homo sapiens
aaataaaatgaccag

SEQ ID NO: 2874333 - DNA, 15 bp, Homo sapiens
aaataagaagaatgc

SEQ ID NO: 2874334 - DNA, 20 bp, Homo sapiens
aaataagaagaatgcttaat

SEQ ID NO: 2874335 - DNA, 16 bp, Homo sapiens
aaatagcaaaagaaga

SEQ ID NO: 2874336 - DNA, 14 bp, Homo sapiens
aaatagtttggata

SEQ ID NO: 2874337 - DNA, 15 bp, Homo sapiens
aaatatgatgttaaa

SEQ ID NO: 2874338 - DNA, 21 bp, Homo sapiens
aaatatgatgttaaaaaaata

SEQ ID NO: 2874339 - DNA, 16 bp, Homo sapiens
aaatattttaaagaat

SEQ ID NO: 2874340 - DNA, 17 bp, Homo sapiens
aaatattttaaagaatt

SEQ ID NO: 2874341 - DNA, 20 bp, Homo sapiens
aaatcacgctttttgaaaaa

SEQ ID NO: 2874342 - DNA, 13 bp, Homo sapiens
aaatcgaatgaaa

SEQ ID NO: 2874343 - DNA, 20 bp, Homo sapiens
aaatcttggttgatgccaaa

SEQ ID NO: 2874344 - DNA, 19 bp, Homo sapiens
aaatgaccagtaattgtga

SEQ ID NO: 2874345 - DNA, 21 bp, Homo sapiens
aaatgaccagtaattgtgaaa

SEQ ID NO: 2874346 - DNA, 16 bp, Homo sapiens
aaatgatggaaccaaa

SEQ ID NO: 2874347 - DNA, 20 bp, Homo sapiens
aaatgatggaaccaaaaatc

SEQ ID NO: 2874348 - DNA, 21 bp, Homo sapiens
aaatgccttttcccaaaatgt

SEQ ID NO: 2874349 - DNA, 17 bp, Homo sapiens
aaatgtttatacaataa

SEQ ID NO: 2874350 - DNA, 21 bp, Homo sapiens
aaattaactgggtaatgaaac

SEQ ID NO: 2874351 - DNA, 12 bp, Homo sapiens
aaattatttaaa

SEQ ID NO: 2874352 - DNA, 21 bp, Homo sapiens
aaatttaatgtttttctggaa

SEQ ID NO: 2874353 - DNA, 16 bp, Homo sapiens
aacaaactcgtttttt

SEQ ID NO: 2874354 - DNA, 17 bp, Homo sapiens
aacaaagagttcaagaa

SEQ ID NO: 2874355 - DNA, 19 bp, Homo sapiens
aacaaagagttcaagaaat

SEQ ID NO: 2874356 - DNA, 14 bp, Homo sapiens
aacaacaaggaccc

SEQ ID NO: 2874357 - DNA, 22 bp, Homo sapiens
aacaaggaccctgttttccaca

SEQ ID NO: 2874358 - DNA, 20 bp, Homo sapiens
aacaagtatttgttaattta

SEQ ID NO: 2874359 - DNA, 23 bp, Homo sapiens
aacaagtatttgttaatttagaa

SEQ ID NO: 2874360 - DNA, 15 bp, Homo sapiens
aacaccaacataaaa

SEQ ID NO: 2874361 - DNA, 21 bp, Homo sapiens
aacactatctgtactaaaaac

SEQ ID NO: 2874362 - DNA, 18 bp, Homo sapiens
aacagaacatagacagaa

SEQ ID NO: 2874363 - DNA, 22 bp, Homo sapiens
aacagcctgtttgggaggctgg

SEQ ID NO: 2874364 - DNA, 13 bp, Homo sapiens
aacataaaaatga

SEQ ID NO: 2874365 - DNA, 14 bp, Homo sapiens
aacataaataaaat

SEQ ID NO: 2874366 - DNA, 16 bp, Homo sapiens
aacatagacagaagaa

SEQ ID NO: 2874367 - DNA, 22 bp, Homo sapiens
aacatttctatagccaaaaata

SEQ ID NO: 2874368 - DNA, 14 bp, Homo sapiens
aaccaaaaatcact

SEQ ID NO: 2874369 - DNA, 16 bp, Homo sapiens
aaccgctaaaagaaac

SEQ ID NO: 2874370 - DNA, 20 bp, Homo sapiens
aacctactttcatactgaag

SEQ ID NO: 2874371 - DNA, 20 bp, Homo sapiens
aactactgtaattaagtgca

SEQ ID NO: 2874372 - DNA, 21 bp, Homo sapiens
aactagaggtgagaaatttaa

SEQ ID NO: 2874373 - DNA, 22 bp, Homo sapiens
aactagaggtgagaaatttaaa

SEQ ID NO: 2874374 - DNA, 18 bp, Homo sapiens
aactataaactactgtaa

SEQ ID NO: 2874375 - DNA, 15 bp, Homo sapiens
atgagctgggccctg

SEQ ID NO: 2874376 - DNA, 21 bp, Homo sapiens
atgaggggcttcctgggtcct

SEQ ID NO: 2874377 - DNA, 22 bp, Homo sapiens
atgatcttgagatttcttttaa

SEQ ID NO: 2874378 - DNA, 21 bp, Homo sapiens
atgatgttaaaaaaataagaa

SEQ ID NO: 2874379 - DNA, 22 bp, Homo sapiens
atgatgttaaaaaaataagaag

SEQ ID NO: 2874380 - DNA, 14 bp, Homo sapiens
atgcaaaccatagc

SEQ ID NO: 2874381 - DNA, 18 bp, Homo sapiens
atgcacctaaagaaaaac

SEQ ID NO: 2874382 - DNA, 23 bp, Homo sapiens
atgcacctaaagaaaaacaaact

SEQ ID NO: 2874383 - DNA, 17 bp, Homo sapiens
atgcagtattgccacaa

SEQ ID NO: 2874384 - DNA, 20 bp, Homo sapiens
atgcagtattgccacaatgc

SEQ ID NO: 2874385 - DNA, 18 bp, Homo sapiens
atgcctgacacaggggac

SEQ ID NO: 2874386 - DNA, 21 bp, Homo sapiens
atgccttttcccaaaatgttg

SEQ ID NO: 2874387 - DNA, 19 bp, Homo sapiens
atgcttctgctcacattcc

SEQ ID NO: 2874388 - DNA, 23 bp, Homo sapiens
atgcttctgctcacattccctct

SEQ ID NO: 2874389 - DNA, 15 bp, Homo sapiens
atggaaaggagagga

SEQ ID NO: 2874390 - DNA, 20 bp, Homo sapiens
atggacatgtgtcccagcca

SEQ ID NO: 2874391 - DNA, 17 bp, Homo sapiens
atggagtaatggtcacg

SEQ ID NO: 2874392 - DNA, 13 bp, Homo sapiens
atggctattttat

SEQ ID NO: 2874393 - DNA, 15 bp, Homo sapiens
atgggtaacactgat

SEQ ID NO: 2874394 - DNA, 15 bp, Homo sapiens
atgtaaaacatttat

SEQ ID NO: 2874395 - DNA, 21 bp, Homo sapiens
atgtaaaacatttattttgac

SEQ ID NO: 2874396 - DNA, 20 bp, Homo sapiens
atgtaccaagtaaccatttc

SEQ ID NO: 2874397 - DNA, 12 bp, Homo sapiens
atgtatagtaaa

SEQ ID NO: 2874398 - DNA, 20 bp, Homo sapiens
atgtccagccacccccaggc

SEQ ID NO: 2874399 - DNA, 15 bp, Homo sapiens
atgtctggctgaagc

SEQ ID NO: 2874400 - DNA, 23 bp, Homo sapiens
atgtgattcctttgaagaggaaa

SEQ ID NO: 2874401 - DNA, 19 bp, Homo sapiens
atgtgcctaatggagaaga

SEQ ID NO: 2874402 - DNA, 15 bp, Homo sapiens
atgtgctattgaact

SEQ ID NO: 2874403 - DNA, 15 bp, Homo sapiens
atgttaaaaaaataa

SEQ ID NO: 2874404 - DNA, 15 bp, Homo sapiens
atgttatttgtaata

SEQ ID NO: 2874405 - DNA, 22 bp, Homo sapiens
atgttgaaatatgatgttaaaa

SEQ ID NO: 2874406 - DNA, 14 bp, Homo sapiens
atgtttaaaccttt

SEQ ID NO: 2874407 - DNA, 16 bp, Homo sapiens
atgtttttaatgtata

SEQ ID NO: 2874408 - DNA, 21 bp, Homo sapiens
attaaagaagggttgagctgg

SEQ ID NO: 2874409 - DNA, 19 bp, Homo sapiens
attaactgggtaatgaaac

SEQ ID NO: 2874410 - DNA, 20 bp, Homo sapiens
attagttttctttgtaaagg

SEQ ID NO: 2874411 - DNA, 15 bp, Homo sapiens
attatacaccatttt

SEQ ID NO: 2874412 - DNA, 16 bp, Homo sapiens
attcaattcaaagctg

SEQ ID NO: 2874413 - DNA, 22 bp, Homo sapiens
attcactcactcactcattcct

SEQ ID NO: 2874414 - DNA, 14 bp, Homo sapiens
attcagaagaaaaa

SEQ ID NO: 2874415 - DNA, 16 bp, Homo sapiens
attcagaagaaaaaga

SEQ ID NO: 2874416 - DNA, 22 bp, Homo sapiens
attccaccacaggaatgtatca

SEQ ID NO: 2874417 - DNA, 20 bp, Homo sapiens
attccatgtgaaaataaaat

SEQ ID NO: 2874418 - DNA, 15 bp, Homo sapiens
attcccagagtcaga

SEQ ID NO: 2874419 - DNA, 20 bp, Homo sapiens
attccctctcatccaggtcc

SEQ ID NO: 2874420 - DNA, 13 bp, Homo sapiens
attccctggagac

SEQ ID NO: 2874421 - DNA, 14 bp, Homo sapiens
attctaaaatgatt

SEQ ID NO: 2874422 - DNA, 15 bp, Homo sapiens
attctaaaatgcctt

SEQ ID NO: 2874423 - DNA, 16 bp, Homo sapiens
attctgatacagcctt

SEQ ID NO: 2874424 - DNA, 14 bp, Homo sapiens
attgaactgagcca

SEQ ID NO: 2874425 - DNA, 19 bp, Homo sapiens
attgccacaatgcctctcc

SEQ ID NO: 2874426 - DNA, 20 bp, Homo sapiens
attgccacaatgcctctccc

SEQ ID NO: 2874427 - DNA, 13 bp, Homo sapiens
attgggagtagga

SEQ ID NO: 2874428 - DNA, 13 bp, Homo sapiens
attgtagtaatct

SEQ ID NO: 2874429 - DNA, 16 bp, Homo sapiens
attgtgggtgttaatt

SEQ ID NO: 2874430 - DNA, 19 bp, Homo sapiens
attgttttatctgaatttt

SEQ ID NO: 2874431 - DNA, 22 bp, Homo sapiens
atttaaaaaactaaaaactaga

SEQ ID NO: 2874432 - DNA, 13 bp, Homo sapiens
atttaaaatagca

SEQ ID NO: 2874433 - DNA, 15 bp, Homo sapiens
atttaaaatagcaaa

SEQ ID NO: 2874434 - DNA, 21 bp, Homo sapiens
atttaaaatagcaaaagaaga

SEQ ID NO: 2874435 - DNA, 19 bp, Homo sapiens
atttaaaccgctaaaagaa

SEQ ID NO: 2874436 - DNA, 13 bp, Homo sapiens
atttaactctctt

SEQ ID NO: 2874437 - DNA, 18 bp, Homo sapiens
atttaagggaaaaatata

SEQ ID NO: 2874438 - DNA, 14 bp, Homo sapiens
atttagaaaacttt

SEQ ID NO: 2874439 - DNA, 17 bp, Homo sapiens
atttatcgcagaccttt

SEQ ID NO: 2874440 - DNA, 14 bp, Homo sapiens
atttcatctcattt

SEQ ID NO: 2874441 - DNA, 15 bp, Homo sapiens
atttcatctcattta

SEQ ID NO: 2874442 - DNA, 22 bp, Homo sapiens
atttcccctctgtgtcctctcc

SEQ ID NO: 2874443 - DNA, 23 bp, Homo sapiens
atttcccctctgtgtcctctccc

SEQ ID NO: 2874444 - DNA, 17 bp, Homo sapiens
atttctatagccaaaaa

SEQ ID NO: 2874445 - DNA, 13 bp, Homo sapiens
atttctctgagca

SEQ ID NO: 2874446 - DNA, 22 bp, Homo sapiens
atttcttttaaagaagtaaatt

SEQ ID NO: 2874447 - DNA, 17 bp, Homo sapiens
atttgtgtctgcctgcc

SEQ ID NO: 2874448 - DNA, 12 bp, Homo sapiens
attttaaagaat

SEQ ID NO: 2874449 - DNA, 13 bp, Homo sapiens
attttaaagaatt

SEQ ID NO: 2874450 - DNA, 15 bp, Homo sapiens
attttctgctacttt

SEQ ID NO: 2874451 - DNA, 24 bp, Homo sapiens
attttgacataaagttgataaaga

SEQ ID NO: 2874452 - DNA, 15 bp, Homo sapiens
atttttaaacaagta

SEQ ID NO: 2874453 - DNA, 18 bp, Homo sapiens
atttttcatgataatgaa

SEQ ID NO: 2874454 - DNA, 19 bp, Homo sapiens
atttttgatactaagcatt

SEQ ID NO: 2874455 - DNA, 20 bp, Homo sapiens
attttttaaaaaagcttaaa

SEQ ID NO: 2874456 - DNA, 14 bp, Homo sapiens
caaaacaatgttta

SEQ ID NO: 2874457 - DNA, 14 bp, Homo sapiens
caaaagaagaagtt

SEQ ID NO: 2874458 - DNA, 12 bp, Homo sapiens
caaaagaagtaa

SEQ ID NO: 2874459 - DNA, 18 bp, Homo sapiens
caaaagaagtaaaagcaa

SEQ ID NO: 2874460 - DNA, 20 bp, Homo sapiens
caaaagtgatctgtcccctc

SEQ ID NO: 2874461 - DNA, 21 bp, Homo sapiens
caaaagtgatctgtcccctct

SEQ ID NO: 2874462 - DNA, 22 bp, Homo sapiens
caaaatgttgaaatatgatgtt

SEQ ID NO: 2874463 - DNA, 20 bp, Homo sapiens
cctaagtgggaagtgaagcc

SEQ ID NO: 2874464 - DNA, 22 bp, Homo sapiens
cctaagtgggaagtgaagcccc

SEQ ID NO: 2874465 - DNA, 16 bp, Homo sapiens
cctaattcaattcaaa

SEQ ID NO: 2874466 - DNA, 18 bp, Homo sapiens
cctagatggttccctttg

SEQ ID NO: 2874467 - DNA, 14 bp, Homo sapiens
cctagtggggaggg

SEQ ID NO: 2874468 - DNA, 22 bp, Homo sapiens
cctataaggagagttcaagcct

SEQ ID NO: 2874469 - DNA, 23 bp, Homo sapiens
cctataaggagagttcaagcctg

SEQ ID NO: 2874470 - DNA, 17 bp, Homo sapiens
cctatccttccagtggc

SEQ ID NO: 2874471 - DNA, 23 bp, Homo sapiens
cctcaacccctcccctccatccc

SEQ ID NO: 2874472 - DNA, 23 bp, Homo sapiens
cctcagacaatccactctcagga

SEQ ID NO: 2874473 - DNA, 13 bp, Homo sapiens
cctccaccccagg

SEQ ID NO: 2874474 - DNA, 17 bp, Homo sapiens
cctccatccctggcccc

SEQ ID NO: 2874475 - DNA, 15 bp, Homo sapiens
cctcccacccccagc

SEQ ID NO: 2874476 - DNA, 18 bp, Homo sapiens
cctccccacacctcccta

SEQ ID NO: 2874477 - DNA, 17 bp, Homo sapiens
cctccctccaccccagg

SEQ ID NO: 2874478 - DNA, 14 bp, Homo sapiens
cctccctctccata

SEQ ID NO: 2874479 - DNA, 13 bp, Homo sapiens
cctcctcctcctg

SEQ ID NO: 2874480 - DNA, 13 bp, Homo sapiens
cctcctgaccctg

SEQ ID NO: 2874481 - DNA, 19 bp, Homo sapiens
cctcctgttcctgccttct

SEQ ID NO: 2874482 - DNA, 20 bp, Homo sapiens
cctcgcatccgcctctgagc

SEQ ID NO: 2874483 - DNA, 17 bp, Homo sapiens
cctctccatatctcctt

SEQ ID NO: 2874484 - DNA, 16 bp, Homo sapiens
cctctcccacgatgtc

SEQ ID NO: 2874485 - DNA, 19 bp, Homo sapiens
cctctcccctctgccctgt

SEQ ID NO: 2874486 - DNA, 21 bp, Homo sapiens
cctctcccgcgggcctggaca

SEQ ID NO: 2874487 - DNA, 11 bp, Homo sapiens
cctctgagcca

SEQ ID NO: 2874488 - DNA, 14 bp, Homo sapiens
cctctgagccagga

SEQ ID NO: 2874489 - DNA, 16 bp, Homo sapiens
cctctgagccaggagc

SEQ ID NO: 2874490 - DNA, 18 bp, Homo sapiens
cctctggatccctggagg

SEQ ID NO: 2874491 - DNA, 21 bp, Homo sapiens
cctctttcctgtgccaggact

SEQ ID NO: 2874492 - DNA, 21 bp, Homo sapiens
cctgacattaagacacacctc

SEQ ID NO: 2874493 - DNA, 19 bp, Homo sapiens
cctgaccggcacctgcgag

SEQ ID NO: 2874494 - DNA, 19 bp, Homo sapiens
cctgacggacgtcctgctg

SEQ ID NO: 2874495 - DNA, 12 bp, Homo sapiens
cctgagaagaga

SEQ ID NO: 2874496 - DNA, 21 bp, Homo sapiens
cctgaggggatatccctatgt

SEQ ID NO: 2874497 - DNA, 21 bp, Homo sapiens
cctgcaagtccatagctgagc

SEQ ID NO: 2874498 - DNA, 22 bp, Homo sapiens
cctgccagcaggccagggactc

SEQ ID NO: 2874499 - DNA, 12 bp, Homo sapiens
cctgctggcacc

SEQ ID NO: 2874500 - DNA, 12 bp, Homo sapiens
cctgctgtggga

SEQ ID NO: 2874501 - DNA, 14 bp, Homo sapiens
cctgcttacctgac

SEQ ID NO: 2874502 - DNA, 15 bp, Homo sapiens
cctggaggtgggaga

SEQ ID NO: 2874503 - DNA, 20 bp, Homo sapiens
cctgggcatcttctggcttg

SEQ ID NO: 2874504 - DNA, 19 bp, Homo sapiens
cctgggtggggcagggcct

SEQ ID NO: 2874505 - DNA, 21 bp, Homo sapiens
cctgggtggggcagggcctgg

SEQ ID NO: 2874506 - DNA, 22 bp, Homo sapiens
cctgtatataatactaaagtgt

SEQ ID NO: 2874507 - DNA, 13 bp, Homo sapiens
cctgtctctgcct

SEQ ID NO: 2874508 - DNA, 15 bp, Homo sapiens
cctgtctctgcctgc

SEQ ID NO: 2874509 - DNA, 14 bp, Homo sapiens
cctgtgatgcctga

SEQ ID NO: 2874510 - DNA, 17 bp, Homo sapiens
cctgttcctgccttctc

SEQ ID NO: 2874511 - DNA, 18 bp, Homo sapiens
cctgttcctgccttctct

SEQ ID NO: 2874512 - DNA, 21 bp, Homo sapiens
cctgttcctgccttctcttct

SEQ ID NO: 2874513 - DNA, 15 bp, Homo sapiens
ccttctatgcagtat

SEQ ID NO: 2874514 - DNA, 22 bp, Homo sapiens
ccttctcgtcttcctctctctc

SEQ ID NO: 2874515 - DNA, 18 bp, Homo sapiens
ccttctcttctatcctgc

SEQ ID NO: 2874516 - DNA, 23 bp, Homo sapiens
ccttggggtaagccagagcctgg

SEQ ID NO: 2874517 - DNA, 15 bp, Homo sapiens
ccttgttgatgccag

SEQ ID NO: 2874518 - DNA, 15 bp, Homo sapiens
cctttaggtctggtt

SEQ ID NO: 2874519 - DNA, 21 bp, Homo sapiens
cctttccctcaccccctccca

SEQ ID NO: 2874520 - DNA, 12 bp, Homo sapiens
cctttccttctc

SEQ ID NO: 2874521 - DNA, 14 bp, Homo sapiens
cctttccttctcgt

SEQ ID NO: 2874522 - DNA, 13 bp, Homo sapiens
cctttgaagagga

SEQ ID NO: 2874523 - DNA, 12 bp, Homo sapiens
ccttttcttaaa

SEQ ID NO: 2874524 - DNA, 10 bp, Homo sapiens
cgaagcccag

SEQ ID NO: 2874525 - DNA, 20 bp, Homo sapiens
cgaatgagctgggccctggg

SEQ ID NO: 2874526 - DNA, 14 bp, Homo sapiens
cgactccagccagc

SEQ ID NO: 2874527 - DNA, 18 bp, Homo sapiens
cgagaggtccctgcttac

SEQ ID NO: 2874528 - DNA, 23 bp, Homo sapiens
cgatctccactgttgggtgggtg

SEQ ID NO: 2874529 - DNA, 22 bp, Homo sapiens
cgcatccgcctctgagccagga

SEQ ID NO: 2874530 - DNA, 12 bp, Homo sapiens
cgccactcattt

SEQ ID NO: 2874531 - DNA, 18 bp, Homo sapiens
cgctgcagcagggcagga

SEQ ID NO: 2874532 - DNA, 13 bp, Homo sapiens
cggcagcctggtt

SEQ ID NO: 2874533 - DNA, 17 bp, Homo sapiens
cggcagcctggttccct

SEQ ID NO: 2874534 - DNA, 20 bp, Homo sapiens
cggcagcctggttccctctt

SEQ ID NO: 2874535 - DNA, 20 bp, Homo sapiens
cggttcaggaaaattgaatg

SEQ ID NO: 2874536 - DNA, 21 bp, Homo sapiens
cgtatttaatagcaaagaatt

SEQ ID NO: 2874537 - DNA, 23 bp, Homo sapiens
cgtatttaatagcaaagaattga

SEQ ID NO: 2874538 - DNA, 13 bp, Homo sapiens
cgtcccctgctac

SEQ ID NO: 2874539 - DNA, 12 bp, Homo sapiens
cgtcctgctggc

SEQ ID NO: 2874540 - DNA, 22 bp, Homo sapiens
cgtcctgctggcacctcagaca

SEQ ID NO: 2874541 - DNA, 17 bp, Homo sapiens
cgtcttcctctctctca

SEQ ID NO: 2874542 - DNA, 16 bp, Homo sapiens
cgtgccagctctagtt

SEQ ID NO: 2874543 - DNA, 21 bp, Homo sapiens
cgttcccttgtgtctgttgct

SEQ ID NO: 2874544 - DNA, 20 bp, Homo sapiens
ctaaaaacatttactgacca

SEQ ID NO: 2874545 - DNA, 18 bp, Homo sapiens
ctaaagctggtttaatgt

SEQ ID NO: 2874546 - DNA, 22 bp, Homo sapiens
ctaaagtgtctattagttttct

SEQ ID NO: 2874547 - DNA, 20 bp, Homo sapiens
ctaaatcttttataggattt

SEQ ID NO: 2874548 - DNA, 20 bp, Homo sapiens
ctaactccagtctcctgaca

SEQ ID NO: 2874549 - DNA, 17 bp, Homo sapiens
ctaagagaagtagaaat

SEQ ID NO: 2874550 - DNA, 15 bp, Homo sapiens
ctaattcaattcaaa

SEQ ID NO: 2874551 - DNA, 21 bp, Homo sapiens
ctaatttttttgtattttagc

SEQ ID NO: 2874552 - DNA, 14 bp, Homo sapiens
ctacccctgtcctg

SEQ ID NO: 2874553 - DNA, 13 bp, Homo sapiens
ctactcccctggg

SEQ ID NO: 2874554 - DNA, 17 bp, Homo sapiens
ctactgacctttgtcct

SEQ ID NO: 2874555 - DNA, 15 bp, Homo sapiens
ctactgtaattaagt

SEQ ID NO: 2874556 - DNA, 14 bp, Homo sapiens
ctacttcctcctcc

SEQ ID NO: 2874557 - DNA, 16 bp, Homo sapiens
ctacttcctcctcctc

SEQ ID NO: 2874558 - DNA, 16 bp, Homo sapiens
ctactttctattcttt

SEQ ID NO: 2874559 - DNA, 16 bp, Homo sapiens
ctagaattgagtgttt

SEQ ID NO: 2874560 - DNA, 19 bp, Homo sapiens
ctagaattgagtgtttaaa

SEQ ID NO: 2874561 - DNA, 21 bp, Homo sapiens
ctagaattgagtgtttaaagt

SEQ ID NO: 2874562 - DNA, 19 bp, Homo sapiens
ctagtatccaaaatattta

SEQ ID NO: 2874563 - DNA, 21 bp, Homo sapiens
ctagtggggaggggcctggcc

SEQ ID NO: 2874564 - DNA, 15 bp, Homo sapiens
ctagttttcagcctt

SEQ ID NO: 2874565 - DNA, 19 bp, Homo sapiens
ctagttttcagccttggga

SEQ ID NO: 2874566 - DNA, 21 bp, Homo sapiens
ctataaggagagttcaagcct

SEQ ID NO: 2874567 - DNA, 18 bp, Homo sapiens
ctataagtgttcagtgtt

SEQ ID NO: 2874568 - DNA, 20 bp, Homo sapiens
ctataagtgttcagtgttga

SEQ ID NO: 2874569 - DNA, 19 bp, Homo sapiens
ctatccttccagtggctcg

SEQ ID NO: 2874570 - DNA, 16 bp, Homo sapiens
ctatgtttttaatgta

SEQ ID NO: 2874571 - DNA, 13 bp, Homo sapiens
ctattgaactgag

SEQ ID NO: 2874572 - DNA, 15 bp, Homo sapiens
ctattgaactgagcc

SEQ ID NO: 2874573 - DNA, 17 bp, Homo sapiens
ctcaagctagccagagg

SEQ ID NO: 2874574 - DNA, 19 bp, Homo sapiens
ctcacattccctctcatcc

SEQ ID NO: 2874575 - DNA, 23 bp, Homo sapiens
ctcacattccctctcatccaggt

SEQ ID NO: 2874576 - DNA, 20 bp, Homo sapiens
ctcaccactacatcacttga

SEQ ID NO: 2874577 - DNA, 17 bp, Homo sapiens
ctcacctacttcctcct

SEQ ID NO: 2874578 - DNA, 18 bp, Homo sapiens
ctcatccacagaggccag

SEQ ID NO: 2874579 - DNA, 19 bp, Homo sapiens
ctcatccaggtcctttcct

SEQ ID NO: 2874580 - DNA, 18 bp, Homo sapiens
ctcatttcatctcattta

SEQ ID NO: 2874581 - DNA, 14 bp, Homo sapiens
ctccaccccaggac

SEQ ID NO: 2874582 - DNA, 23 bp, Homo sapiens
ctccacgattacgtgaataaaat

SEQ ID NO: 2874583 - DNA, 18 bp, Homo sapiens
ctccagccacccagccag

SEQ ID NO: 2874584 - DNA, 20 bp, Homo sapiens
ctccagccacccagccagga

SEQ ID NO: 2874585 - DNA, 14 bp, Homo sapiens
caatggctgtaaac

SEQ ID NO: 2874586 - DNA, 18 bp, Homo sapiens
caattctgatacagcctt

SEQ ID NO: 2874587 - DNA, 23 bp, Homo sapiens
cacaacagcctgacaacatttct

SEQ ID NO: 2874588 - DNA, 14 bp, Homo sapiens
cacaccatcaccct

SEQ ID NO: 2874589 - DNA, 22 bp, Homo sapiens
cacacctctggatccctggagg

SEQ ID NO: 2874590 - DNA, 13 bp, Homo sapiens
cacactgtaaata

SEQ ID NO: 2874591 - DNA, 9 bp, Homo sapiens
cacagaaat

SEQ ID NO: 2874592 - DNA, 12 bp, Homo sapiens
cacagactccct

SEQ ID NO: 2874593 - DNA, 15 bp, Homo sapiens
cacagactccctccc

SEQ ID NO: 2874594 - DNA, 18 bp, Homo sapiens
cacagactccctcccctg

SEQ ID NO: 2874595 - DNA, 14 bp, Homo sapiens
cacagctaatattc

SEQ ID NO: 2874596 - DNA, 15 bp, Homo sapiens
cacaggggacactga

SEQ ID NO: 2874597 - DNA, 17 bp, Homo sapiens
cacaggggacactgaac

SEQ ID NO: 2874598 - DNA, 20 bp, Homo sapiens
cacagtgcactcagagctgc

SEQ ID NO: 2874599 - DNA, 15 bp, Homo sapiens
caccaaaagaagtaa

SEQ ID NO: 2874600 - DNA, 17 bp, Homo sapiens
caccatcaccctctggg

SEQ ID NO: 2874601 - DNA, 11 bp, Homo sapiens
caccccaggac

SEQ ID NO: 2874602 - DNA, 20 bp, Homo sapiens
caccccaggacgccactcat

SEQ ID NO: 2874603 - DNA, 13 bp, Homo sapiens
cacccccagcccc

SEQ ID NO: 2874604 - DNA, 15 bp, Homo sapiens
caccccctcccaccc

SEQ ID NO: 2874605 - DNA, 16 bp, Homo sapiens
caccgaagaggaagca

SEQ ID NO: 2874606 - DNA, 13 bp, Homo sapiens
cacctaaagaaaa

SEQ ID NO: 2874607 - DNA, 17 bp, Homo sapiens
cacctaaagaaaaacaa

SEQ ID NO: 2874608 - DNA, 16 bp, Homo sapiens
cacctacttcctcctc

SEQ ID NO: 2874609 - DNA, 13 bp, Homo sapiens
cacctcagacaat

SEQ ID NO: 2874610 - DNA, 21 bp, Homo sapiens
cacctccctactcccctgggc

SEQ ID NO: 2874611 - DNA, 14 bp, Homo sapiens
cactcagagctgct

SEQ ID NO: 2874612 - DNA, 20 bp, Homo sapiens
cactcattccttcactcatc

SEQ ID NO: 2874613 - DNA, 18 bp, Homo sapiens
cactcatttcatctcatt

SEQ ID NO: 2874614 - DNA, 19 bp, Homo sapiens
cactcatttcatctcattt

SEQ ID NO: 2874615 - DNA, 17 bp, Homo sapiens
cactccctaagaaaccc

SEQ ID NO: 2874616 - DNA, 21 bp, Homo sapiens
cactccctaagaaaccccagg

SEQ ID NO: 2874617 - DNA, 12 bp, Homo sapiens
cactctcaggag

SEQ ID NO: 2874618 - DNA, 23 bp, Homo sapiens
cactgaaccttgttgatgccagc

SEQ ID NO: 2874619 - DNA, 23 bp, Homo sapiens
cactgttgggtgggtgggccctg

SEQ ID NO: 2874620 - DNA, 15 bp, Homo sapiens
cacttagcccaagag

SEQ ID NO: 2874621 - DNA, 14 bp, Homo sapiens
cacttttccttttc

SEQ ID NO: 2874622 - DNA, 17 bp, Homo sapiens
cagaaagccttccatta

SEQ ID NO: 2874623 - DNA, 19 bp, Homo sapiens
cagaacatagacagaagaa

SEQ ID NO: 2874624 - DNA, 14 bp, Homo sapiens
cagaagaaacaagg

SEQ ID NO: 2874625 - DNA, 18 bp, Homo sapiens
cagacaatccactctcag

SEQ ID NO: 2874626 - DNA, 16 bp, Homo sapiens
cagaccatatttttaa

SEQ ID NO: 2874627 - DNA, 23 bp, Homo sapiens
cagacccactcccaaagctcaga

SEQ ID NO: 2874628 - DNA, 23 bp, Homo sapiens
cagactccttcaacaattctaaa

SEQ ID NO: 2874629 - DNA, 19 bp, Homo sapiens
cagagcctggggtgttctc

SEQ ID NO: 2874630 - DNA, 12 bp, Homo sapiens
cagagctgaccc

SEQ ID NO: 2874631 - DNA, 23 bp, Homo sapiens
cagagtcgcttttgccttttcaa

SEQ ID NO: 2874632 - DNA, 13 bp, Homo sapiens
cagagtctgtctc

SEQ ID NO: 2874633 - DNA, 14 bp, Homo sapiens
cagagtctgtctct

SEQ ID NO: 2874634 - DNA, 17 bp, Homo sapiens
cagagtggagtctgagt

SEQ ID NO: 2874635 - DNA, 19 bp, Homo sapiens
cagagtggagtctgagtct

SEQ ID NO: 2874636 - DNA, 12 bp, Homo sapiens
cagatgcccacg

SEQ ID NO: 2874637 - DNA, 22 bp, Homo sapiens
cagcaaaatgtgaatgggaaaa

SEQ ID NO: 2874638 - DNA, 14 bp, Homo sapiens
cagcagcagctcaa

SEQ ID NO: 2874639 - DNA, 15 bp, Homo sapiens
cagccacccagccag

SEQ ID NO: 2874640 - DNA, 17 bp, Homo sapiens
cagccacccagccagga

SEQ ID NO: 2874641 - DNA, 19 bp, Homo sapiens
cagccacccagccaggagg

SEQ ID NO: 2874642 - DNA, 17 bp, Homo sapiens
cagccacctaaaaacat

SEQ ID NO: 2874643 - DNA, 18 bp, Homo sapiens
cagccagcgcctccctcc

SEQ ID NO: 2874644 - DNA, 19 bp, Homo sapiens
cagccagcgcctccctcca

SEQ ID NO: 2874645 - DNA, 21 bp, Homo sapiens
cagcccaagaggactgagact

SEQ ID NO: 2874646 - DNA, 16 bp, Homo sapiens
cagccccgactccagc

SEQ ID NO: 2874647 - DNA, 17 bp, Homo sapiens
cagccccgactccagcc

SEQ ID NO: 2874648 - DNA, 14 bp, Homo sapiens
cagcccgaagccca

SEQ ID NO: 2874649 - DNA, 14 bp, Homo sapiens
cagcctggttccct

SEQ ID NO: 2874650 - DNA, 19 bp, Homo sapiens
cagcctgtttgggaggctg

SEQ ID NO: 2874651 - DNA, 20 bp, Homo sapiens
cagcctgtttgggaggctgg

SEQ ID NO: 2874652 - DNA, 12 bp, Homo sapiens
cagcgcctccct

SEQ ID NO: 2874653 - DNA, 14 bp, Homo sapiens
cagcgcctccctcc

SEQ ID NO: 2874654 - DNA, 16 bp, Homo sapiens
cagcgcctccctccac

SEQ ID NO: 2874655 - DNA, 16 bp, Homo sapiens
cagctgagagccctgc

SEQ ID NO: 2874656 - DNA, 15 bp, Homo sapiens
cagctgcttctgtgc

SEQ ID NO: 2874657 - DNA, 22 bp, Homo sapiens
cagctgtactgagttctcatcc

SEQ ID NO: 2874658 - DNA, 22 bp, Homo sapiens
cagcttcctgtgggccaggagc

SEQ ID NO: 2874659 - DNA, 18 bp, Homo sapiens
caggacgccactcatttc

SEQ ID NO: 2874660 - DNA, 20 bp, Homo sapiens
caggacgccactcatttcat

SEQ ID NO: 2874661 - DNA, 13 bp, Homo sapiens
caggactctcttt

SEQ ID NO: 2874662 - DNA, 14 bp, Homo sapiens
caggactctctttc

SEQ ID NO: 2874663 - DNA, 16 bp, Homo sapiens
caggactctctttctt

SEQ ID NO: 2874664 - DNA, 15 bp, Homo sapiens
caggaggcgcagccc

SEQ ID NO: 2874665 - DNA, 17 bp, Homo sapiens
caggaggcgcagcccga

SEQ ID NO: 2874666 - DNA, 18 bp, Homo sapiens
caggaggcgcagcccgaa

SEQ ID NO: 2874667 - DNA, 19 bp, Homo sapiens
caggcagacaaccttgtcc

SEQ ID NO: 2874668 - DNA, 13 bp, Homo sapiens
ctgtccctcctga

SEQ ID NO: 2874669 - DNA, 14 bp, Homo sapiens
ctgtccctcctgag

SEQ ID NO: 2874670 - DNA, 15 bp, Homo sapiens
ctgtccctcctgagg

SEQ ID NO: 2874671 - DNA, 19 bp, Homo sapiens
ctgtctatgttgtgatcct

SEQ ID NO: 2874672 - DNA, 12 bp, Homo sapiens
ctgtctctgcct

SEQ ID NO: 2874673 - DNA, 13 bp, Homo sapiens
ctgtctgtcctgg

SEQ ID NO: 2874674 - DNA, 17 bp, Homo sapiens
ctgtgatgcctgacaca

SEQ ID NO: 2874675 - DNA, 18 bp, Homo sapiens
ctgtgcatttgtgtctgc

SEQ ID NO: 2874676 - DNA, 19 bp, Homo sapiens
ctgtggcgctgcagcaggg

SEQ ID NO: 2874677 - DNA, 13 bp, Homo sapiens
ctgtgggccagga

SEQ ID NO: 2874678 - DNA, 14 bp, Homo sapiens
ctgtgggccaggag

SEQ ID NO: 2874679 - DNA, 14 bp, Homo sapiens
ctgttagcagagtc

SEQ ID NO: 2874680 - DNA, 23 bp, Homo sapiens
ctgttagcagagtctgtctcttg

SEQ ID NO: 2874681 - DNA, 12 bp, Homo sapiens
ctgttcctgcct

SEQ ID NO: 2874682 - DNA, 17 bp, Homo sapiens
ctgttcctgccttctct

SEQ ID NO: 2874683 - DNA, 19 bp, Homo sapiens
ctgtttgggaggctggagt

SEQ ID NO: 2874684 - DNA, 13 bp, Homo sapiens
cttaaataagaaa

SEQ ID NO: 2874685 - DNA, 16 bp, Homo sapiens
cttaaataagaaactt

SEQ ID NO: 2874686 - DNA, 23 bp, Homo sapiens
cttaaatggtgtaattttgtcct

SEQ ID NO: 2874687 - DNA, 16 bp, Homo sapiens
cttaagtgctgcaatt

SEQ ID NO: 2874688 - DNA, 12 bp, Homo sapiens
cttagcccaaga

SEQ ID NO: 2874689 - DNA, 15 bp, Homo sapiens
cttagcccaagaggt

SEQ ID NO: 2874690 - DNA, 21 bp, Homo sapiens
cttagcccaagaggtctgagc

SEQ ID NO: 2874691 - DNA, 20 bp, Homo sapiens
cttcaacaattctaaaatga

SEQ ID NO: 2874692 - DNA, 19 bp, Homo sapiens
cttcatcgaacaaactgat

SEQ ID NO: 2874693 - DNA, 20 bp, Homo sapiens
cttcatcgaacaaactgatg

SEQ ID NO: 2874694 - DNA, 22 bp, Homo sapiens
cttccagtggctcgctccctgt

SEQ ID NO: 2874695 - DNA, 18 bp, Homo sapiens
cttcccctacacctccct

SEQ ID NO: 2874696 - DNA, 22 bp, Homo sapiens
cttcctctcaagctagccagag

SEQ ID NO: 2874697 - DNA, 18 bp, Homo sapiens
cttcctgtgggccaggag

SEQ ID NO: 2874698 - DNA, 21 bp, Homo sapiens
cttctatgcagtattgccaca

SEQ ID NO: 2874699 - DNA, 20 bp, Homo sapiens
cttctcattttttaaaaaag

SEQ ID NO: 2874700 - DNA, 16 bp, Homo sapiens
cttctcgtcttcctct

SEQ ID NO: 2874701 - DNA, 22 bp, Homo sapiens
cttctcgtcttcctctctctca

SEQ ID NO: 2874702 - DNA, 13 bp, Homo sapiens
cttctgctcacat

SEQ ID NO: 2874703 - DNA, 16 bp, Homo sapiens
cttctgctcacattcc

SEQ ID NO: 2874704 - DNA, 23 bp, Homo sapiens
cttctgtggaagtagctttgaac

SEQ ID NO: 2874705 - DNA, 18 bp, Homo sapiens
cttgaatctgttactgaa

SEQ ID NO: 2874706 - DNA, 22 bp, Homo sapiens
cttgaccatcgtccttcctctc

SEQ ID NO: 2874707 - DNA, 22 bp, Homo sapiens
cttgggctccattcccatcact

SEQ ID NO: 2874708 - DNA, 16 bp, Homo sapiens
cttggttggctggcag

SEQ ID NO: 2874709 - DNA, 13 bp, Homo sapiens
cttgtcctctccc

SEQ ID NO: 2874710 - DNA, 14 bp, Homo sapiens
cttgtcctctcccg

SEQ ID NO: 2874711 - DNA, 14 bp, Homo sapiens
cttgtgtctgttgc

SEQ ID NO: 2874712 - DNA, 17 bp, Homo sapiens
ctttcctgtgccaggac

SEQ ID NO: 2874713 - DNA, 14 bp, Homo sapiens
ctttccttctcgtc

SEQ ID NO: 2874714 - DNA, 22 bp, Homo sapiens
ctttcgaaagcaatgcttctat

SEQ ID NO: 2874715 - DNA, 21 bp, Homo sapiens
ctttcttccactaccctccct

SEQ ID NO: 2874716 - DNA, 14 bp, Homo sapiens
ctttgaagaggaaa

SEQ ID NO: 2874717 - DNA, 22 bp, Homo sapiens
ctttgaagaggaaaatgaataa

SEQ ID NO: 2874718 - DNA, 19 bp, Homo sapiens
ctttggtgttacacagccc

SEQ ID NO: 2874719 - DNA, 14 bp, Homo sapiens
ctttgtaaaggtca

SEQ ID NO: 2874720 - DNA, 15 bp, Homo sapiens
ctttgtaaaggtcag

SEQ ID NO: 2874721 - DNA, 17 bp, Homo sapiens
cttttaaagaagtaaat

SEQ ID NO: 2874722 - DNA, 16 bp, Homo sapiens
cttttccttttcttaa

SEQ ID NO: 2874723 - DNA, 21 bp, Homo sapiens
gaaaaacaaactcgtttttta

SEQ ID NO: 2874724 - DNA, 12 bp, Homo sapiens
gaaaaagaagca

SEQ ID NO: 2874725 - DNA, 16 bp, Homo sapiens
gaaaaagttgcagtct

SEQ ID NO: 2874726 - DNA, 16 bp, Homo sapiens
gaaaactttaaagcgt

SEQ ID NO: 2874727 - DNA, 11 bp, Homo sapiens
gaaaagcccag

SEQ ID NO: 2874728 - DNA, 19 bp, Homo sapiens
gctgataattttaaattct

SEQ ID NO: 2874729 - DNA, 16 bp, Homo sapiens
gctgcagcagggcagg

SEQ ID NO: 2874730 - DNA, 11 bp, Homo sapiens
gctgcttctgt

SEQ ID NO: 2874731 - DNA, 14 bp, Homo sapiens
gctgcttctgtgca

SEQ ID NO: 2874732 - DNA, 11 bp, Homo sapiens
gctggcacctc

SEQ ID NO: 2874733 - DNA, 12 bp, Homo sapiens
gctggcacctca

SEQ ID NO: 2874734 - DNA, 16 bp, Homo sapiens
gctggcagctgagagc

SEQ ID NO: 2874735 - DNA, 20 bp, Homo sapiens
gctggcagctgagagccctg

SEQ ID NO: 2874736 - DNA, 21 bp, Homo sapiens
gctgtaaactataaactactg

SEQ ID NO: 2874737 - DNA, 21 bp, Homo sapiens
gctgtccctcctgaggtctgg

SEQ ID NO: 2874738 - DNA, 19 bp, Homo sapiens
gcttcctgtgggccaggag

SEQ ID NO: 2874739 - DNA, 22 bp, Homo sapiens
gcttctgctcacattccctctc

SEQ ID NO: 2874740 - DNA, 21 bp, Homo sapiens
gcttgactggatggaaggaga

SEQ ID NO: 2874741 - DNA, 15 bp, Homo sapiens
gcttgggctccattc

SEQ ID NO: 2874742 - DNA, 15 bp, Homo sapiens
gcttggttggctggc

SEQ ID NO: 2874743 - DNA, 23 bp, Homo sapiens
gcttttgcggttcaggaaaattg

SEQ ID NO: 2874744 - DNA, 21 bp, Homo sapiens
ggaaaagagatggcctgagaa

SEQ ID NO: 2874745 - DNA, 13 bp, Homo sapiens
ggaaaagcccagt

SEQ ID NO: 2874746 - DNA, 14 bp, Homo sapiens
ggaaaatgaataat

SEQ ID NO: 2874747 - DNA, 15 bp, Homo sapiens
ggaaaggagaggaaa

SEQ ID NO: 2874748 - DNA, 14 bp, Homo sapiens
ggaagtgaagcccc

SEQ ID NO: 2874749 - DNA, 19 bp, Homo sapiens
ggacgccactcatttcatc

SEQ ID NO: 2874750 - DNA, 14 bp, Homo sapiens
ggacgtcctgctgg

SEQ ID NO: 2874751 - DNA, 13 bp, Homo sapiens
ggactctctttct

SEQ ID NO: 2874752 - DNA, 12 bp, Homo sapiens
ggagcagctggg

SEQ ID NO: 2874753 - DNA, 13 bp, Homo sapiens
ggaggcgcagccc

SEQ ID NO: 2874754 - DNA, 20 bp, Homo sapiens
ggaggctgcagagctgaccc

SEQ ID NO: 2874755 - DNA, 13 bp, Homo sapiens
ggaggggcctggc

SEQ ID NO: 2874756 - DNA, 14 bp, Homo sapiens
ggaggggcctggcc

SEQ ID NO: 2874757 - DNA, 16 bp, Homo sapiens
ggaggggcctggcctg

SEQ ID NO: 2874758 - DNA, 12 bp, Homo sapiens
ggagtctgagtc

SEQ ID NO: 2874759 - DNA, 19 bp, Homo sapiens
ggagtctgagtctgagtcc

SEQ ID NO: 2874760 - DNA, 21 bp, Homo sapiens
ggatggggtatggattctaaa

SEQ ID NO: 2874761 - DNA, 23 bp, Homo sapiens
ggcaaaaatgtccagccaccccc

SEQ ID NO: 2874762 - DNA, 14 bp, Homo sapiens
ggcaagccacagaa

SEQ ID NO: 2874763 - DNA, 17 bp, Homo sapiens
ggcacctcagacaatcc

SEQ ID NO: 2874764 - DNA, 21 bp, Homo sapiens
ggcactgggccggcagcctgg

SEQ ID NO: 2874765 - DNA, 15 bp, Homo sapiens
ggcagacaaccttgt

SEQ ID NO: 2874766 - DNA, 16 bp, Homo sapiens
ggcagacaaccttgtc

SEQ ID NO: 2874767 - DNA, 11 bp, Homo sapiens
ggcagcctggt

SEQ ID NO: 2874768 - DNA, 18 bp, Homo sapiens
ggcagctgagagccctgc

SEQ ID NO: 2874769 - DNA, 21 bp, Homo sapiens
ggcagctgtcatggaaaagcc

SEQ ID NO: 2874770 - DNA, 23 bp, Homo sapiens
ggcagctgtcatggaaaagccca

SEQ ID NO: 2874771 - DNA, 14 bp, Homo sapiens
ggcagggaaactgg

SEQ ID NO: 2874772 - DNA, 13 bp, Homo sapiens
ggcagggcctggc

SEQ ID NO: 2874773 - DNA, 14 bp, Homo sapiens
ggcatactaataaa

SEQ ID NO: 2874774 - DNA, 13 bp, Homo sapiens
ggcatcaaagatg

SEQ ID NO: 2874775 - DNA, 17 bp, Homo sapiens
ggcatggcccagcctgg

SEQ ID NO: 2874776 - DNA, 22 bp, Homo sapiens
ggcatggcccagcctggagccg

SEQ ID NO: 2874777 - DNA, 18 bp, Homo sapiens
tagggttgccagtcctgc

SEQ ID NO: 2874778 - DNA, 22 bp, Homo sapiens
tagtaaatcacgctttttgaaa

SEQ ID NO: 2874779 - DNA, 14 bp, Homo sapiens
tagtaatctgcatt

SEQ ID NO: 2874780 - DNA, 20 bp, Homo sapiens
tagtagcagtgattgtctta

SEQ ID NO: 2874781 - DNA, 20 bp, Homo sapiens
tagtggggaggggcctggcc

SEQ ID NO: 2874782 - DNA, 23 bp, Homo sapiens
tagtggggaggggcctggcctgg

SEQ ID NO: 2874783 - DNA, 11 bp, Homo sapiens
tagtttggata

SEQ ID NO: 2874784 - DNA, 16 bp, Homo sapiens
tagttttactttgaac

SEQ ID NO: 2874785 - DNA, 16 bp, Homo sapiens
tataaccagacacata

SEQ ID NO: 2874786 - DNA, 23 bp, Homo sapiens
tataaggagagttcaagcctgtg

SEQ ID NO: 2874787 - DNA, 22 bp, Homo sapiens
tataagtgttcagtgttgacat

SEQ ID NO: 2874788 - DNA, 15 bp, Homo sapiens
tataatactaaagtg

SEQ ID NO: 2874789 - DNA, 16 bp, Homo sapiens
tataatactaaagtgt

SEQ ID NO: 2874790 - DNA, 19 bp, Homo sapiens
tatagccaaaaatagctaa

SEQ ID NO: 2874791 - DNA, 22 bp, Homo sapiens
tatagccaaaaatagctaaata

SEQ ID NO: 2874792 - DNA, 15 bp, Homo sapiens
tatataatactaaag

SEQ ID NO: 2874793 - DNA, 13 bp, Homo sapiens
tatatcatcttta

SEQ ID NO: 2874794 - DNA, 17 bp, Homo sapiens
tatatctatctatttga

SEQ ID NO: 2874795 - DNA, 23 bp, Homo sapiens
tatcaaacaccaacataaaaatg

SEQ ID NO: 2874796 - DNA, 23 bp, Homo sapiens
tatcatcagtgtagaacctaatt

SEQ ID NO: 2874797 - DNA, 21 bp, Homo sapiens
tatccaaaatatttaaattta

SEQ ID NO: 2874798 - DNA, 22 bp, Homo sapiens
tatccacagactccctcccctg

SEQ ID NO: 2874799 - DNA, 16 bp, Homo sapiens
tatctatctatttgag

SEQ ID NO: 2874800 - DNA, 17 bp, Homo sapiens
tatctatctatttgagg

SEQ ID NO: 2874801 - DNA, 23 bp, Homo sapiens
tatctccttcccctacacctccc

SEQ ID NO: 2874802 - DNA, 14 bp, Homo sapiens
tatgaaaaagaaga

SEQ ID NO: 2874803 - DNA, 15 bp, Homo sapiens
tatgaaaaagaagaa

SEQ ID NO: 2874804 - DNA, 15 bp, Homo sapiens
tatggattctaaaat

SEQ ID NO: 2874805 - DNA, 16 bp, Homo sapiens
tatggattctaaaatg

SEQ ID NO: 2874806 - DNA, 15 bp, Homo sapiens
tatgtaaaacattta

SEQ ID NO: 2874807 - DNA, 16 bp, Homo sapiens
tattatgtgcaacatt

SEQ ID NO: 2874808 - DNA, 14 bp, Homo sapiens
tattcctattgtgc

SEQ ID NO: 2874809 - DNA, 16 bp, Homo sapiens
tattctgacttcctct

SEQ ID NO: 2874810 - DNA, 15 bp, Homo sapiens
tattgaactgagcca

SEQ ID NO: 2874811 - DNA, 16 bp, Homo sapiens
tattggaatataattg

SEQ ID NO: 2874812 - DNA, 23 bp, Homo sapiens
tattgggagtaggagttgctcct

SEQ ID NO: 2874813 - DNA, 23 bp, Homo sapiens
tccctcgcatccgcctctgagcc

SEQ ID NO: 2874814 - DNA, 15 bp, Homo sapiens
tccctctttcctgtg

SEQ ID NO: 2874815 - DNA, 17 bp, Homo sapiens
tccctctttcctgtgcc

SEQ ID NO: 2874816 - DNA, 17 bp, Homo sapiens
tccctgtagctctgcct

SEQ ID NO: 2874817 - DNA, 18 bp, Homo sapiens
tccctgtagctctgcctc

SEQ ID NO: 2874818 - DNA, 21 bp, Homo sapiens
tccctttgttgctgtctggct

SEQ ID NO: 2874819 - DNA, 14 bp, Homo sapiens
tcctcctcctcctg

SEQ ID NO: 2874820 - DNA, 20 bp, Homo sapiens
tcctcctgttcctgccttct

SEQ ID NO: 2874821 - DNA, 21 bp, Homo sapiens
tcctcctgttcctgccttctc

SEQ ID NO: 2874822 - DNA, 22 bp, Homo sapiens
tcctctcaagctagccagaggg

SEQ ID NO: 2874823 - DNA, 18 bp, Homo sapiens
tcctctcccctctgccct

SEQ ID NO: 2874824 - DNA, 21 bp, Homo sapiens
tcctctctctcacctacttcc

SEQ ID NO: 2874825 - DNA, 22 bp, Homo sapiens
tcctgacattaagacacacctc

SEQ ID NO: 2874826 - DNA, 14 bp, Homo sapiens
tcctgccttctctt

SEQ ID NO: 2874827 - DNA, 15 bp, Homo sapiens
tcctgccttctcttc

SEQ ID NO: 2874828 - DNA, 20 bp, Homo sapiens
tcctggaggtgggagacaag

SEQ ID NO: 2874829 - DNA, 21 bp, Homo sapiens
tcctggggctgggtgtgtttc

SEQ ID NO: 2874830 - DNA, 19 bp, Homo sapiens
tcctgtgctctggaggctg

SEQ ID NO: 2874831 - DNA, 13 bp, Homo sapiens
tcctgttccctac

SEQ ID NO: 2874832 - DNA, 13 bp, Homo sapiens
tcctgttcctgcc

SEQ ID NO: 2874833 - DNA, 21 bp, Homo sapiens
tcctgttcctgccttctcttc

SEQ ID NO: 2874834 - DNA, 23 bp, Homo sapiens
tccttctcgtcttcctctctctc

SEQ ID NO: 2874835 - DNA, 15 bp, Homo sapiens
tcctttccttctcgt

SEQ ID NO: 2874836 - DNA, 22 bp, Homo sapiens
tcctttccttctcgtcttcctc

SEQ ID NO: 2874837 - DNA, 15 bp, Homo sapiens
tcctttgaagaggaa

SEQ ID NO: 2874838 - DNA, 12 bp, Homo sapiens
tcgaacaaactg

SEQ ID NO: 2874839 - DNA, 16 bp, Homo sapiens
tcgaacaaactgatgc

SEQ ID NO: 2874840 - DNA, 17 bp, Homo sapiens
tcgaatgaaattaactg

SEQ ID NO: 2874841 - DNA, 16 bp, Homo sapiens
tcgctccctgtagctc

SEQ ID NO: 2874842 - DNA, 23 bp, Homo sapiens
tcgctccctgtagctctgcctcc

SEQ ID NO: 2874843 - DNA, 19 bp, Homo sapiens
tcgctcctcaacccctccc

SEQ ID NO: 2874844 - DNA, 18 bp, Homo sapiens
tcgttcccttgtgtctgt

SEQ ID NO: 2874845 - DNA, 23 bp, Homo sapiens
tctacagaccatatttttaaaga

SEQ ID NO: 2874846 - DNA, 20 bp, Homo sapiens
tctataagtgttcagtgttg

SEQ ID NO: 2874847 - DNA, 21 bp, Homo sapiens
tctataagtgttcagtgttga

SEQ ID NO: 2874848 - DNA, 15 bp, Homo sapiens
tctatctatttgagg

SEQ ID NO: 2874849 - DNA, 20 bp, Homo sapiens
tctattagttttctttgtaa

SEQ ID NO: 2874850 - DNA, 18 bp, Homo sapiens
tctcacctacttcctcct

SEQ ID NO: 2874851 - DNA, 14 bp, Homo sapiens
tctcactggcatct

SEQ ID NO: 2874852 - DNA, 19 bp, Homo sapiens
tctcaggaggcgcagcccg

SEQ ID NO: 2874853 - DNA, 15 bp, Homo sapiens
tctcatttaagggaa

SEQ ID NO: 2874854 - DNA, 23 bp, Homo sapiens
tctcatttaagggaaaaatatat

SEQ ID NO: 2874855 - DNA, 20 bp, Homo sapiens
tctcattttttaaaaaagct

SEQ ID NO: 2874856 - DNA, 16 bp, Homo sapiens
tctccatatctccttc

SEQ ID NO: 2874857 - DNA, 13 bp, Homo sapiens
tctcccctctgcc

SEQ ID NO: 2874858 - DNA, 15 bp, Homo sapiens
tctcccgcgggcctg

SEQ ID NO: 2874859 - DNA, 14 bp, Homo sapiens
tctccttcccctac

SEQ ID NO: 2874860 - DNA, 23 bp, Homo sapiens
tctctataagtgttcagtgttga

SEQ ID NO: 2874861 - DNA, 13 bp, Homo sapiens
tctctcacctact

SEQ ID NO: 2874862 - DNA, 22 bp, Homo sapiens
tctctcacctacttcctcctcc

SEQ ID NO: 2874863 - DNA, 11 bp, Homo sapiens
tctctctcacc

SEQ ID NO: 2874864 - DNA, 17 bp, Homo sapiens
tctcttctatcctgcaa

SEQ ID NO: 2874865 - DNA, 16 bp, Homo sapiens
tctcttggctttgtca

SEQ ID NO: 2874866 - DNA, 12 bp, Homo sapiens
tctgagtcctgt

SEQ ID NO: 2874867 - DNA, 18 bp, Homo sapiens
tctgagtcctgtctctgc

SEQ ID NO: 2874868 - DNA, 22 bp, Homo sapiens
tctgattatacaccatttttga

SEQ ID NO: 2874869 - DNA, 14 bp, Homo sapiens
tctgcaacagcctg

SEQ ID NO: 2874870 - DNA, 17 bp, Homo sapiens
tctgcctgcctcatgct

SEQ ID NO: 2874871 - DNA, 21 bp, Homo sapiens
tctgctcacattccctctcat

SEQ ID NO: 2874872 - DNA, 22 bp, Homo sapiens
tctgctcacattccctctcatc

SEQ ID NO: 2874873 - DNA, 24 bp, Homo sapiens
tctggaggctgcagagctgaccca

SEQ ID NO: 2874874 - DNA, 21 bp, Homo sapiens
tctggttgttgcaccatctgc

SEQ ID NO: 2874875 - DNA, 22 bp, Homo sapiens
tctgtctcttggctttgtcact

SEQ ID NO: 2874876 - DNA, 12 bp, Homo sapiens
tctgttactgaa

SEQ ID NO: 2874877 - DNA, 13 bp, Homo sapiens
tctgttactgaaa

SEQ ID NO: 2874878 - DNA, 14 bp, Homo sapiens
tctgttagcagagt

SEQ ID NO: 2874879 - DNA, 16 bp, Homo sapiens
tctgttagcagagtct

SEQ ID NO: 2874880 - DNA, 15 bp, Homo sapiens
tcttaaaacaaagcc

SEQ ID NO: 2874881 - DNA, 18 bp, Homo sapiens
tcttaaataagaaacttt

SEQ ID NO: 2874882 - DNA, 22 bp, Homo sapiens
tcttcaggtgaaaaaggcaagc

SEQ ID NO: 2874883 - DNA, 15 bp, Homo sapiens
tcttctatcctgcaa

SEQ ID NO: 2874884 - DNA, 23 bp, Homo sapiens
tcttgcaggaaggactatgaaaa

SEQ ID NO: 2874885 - DNA, 22 bp, Homo sapiens
tctttcttccactaccctccct

SEQ ID NO: 2874886 - DNA, 19 bp, Homo sapiens
tcttttaaagaagtaaatt

SEQ ID NO: 2874887 - DNA, 23 bp, Homo sapiens
tcttttaaagaagtaaatttgtc

SEQ ID NO: 2874888 - DNA, 13 bp, Homo sapiens
tgaaaaagaagaa

SEQ ID NO: 2874889 - DNA, 13 bp, Homo sapiens
tgaaaaagcgaaa

SEQ ID NO: 2874890 - DNA, 20 bp, Homo sapiens
tgaaatatgatgttaaaaaa

SEQ ID NO: 2874891 - DNA, 22 bp, Homo sapiens
tgaaattaactgggtaatgaaa

SEQ ID NO: 2874892 - DNA, 12 bp, Homo sapiens
tgaactgagcca

SEQ ID NO: 2874893 - DNA, 20 bp, Homo sapiens
tgaagaggaaaatgaataat

SEQ ID NO: 2874894 - DNA, 21 bp, Homo sapiens
tgaagatgcagcaaaatgtga

SEQ ID NO: 2874895 - DNA, 20 bp, Homo sapiens
tgaagcaaatcgaatgaaat

SEQ ID NO: 2874896 - DNA, 21 bp, Homo sapiens
tgaagcacagagggctaggga

SEQ ID NO: 2874897 - DNA, 18 bp, Homo sapiens
tgaatgggaaaagagatg

SEQ ID NO: 2874898 - DNA, 19 bp, Homo sapiens
tgaatttttaaacaagtat

SEQ ID NO: 2874899 - DNA, 17 bp, Homo sapiens
tgacatagcctttgtgc

SEQ ID NO: 2874900 - DNA, 22 bp, Homo sapiens
tgacccagagtggagtctgagt

SEQ ID NO: 2874901 - DNA, 18 bp, Homo sapiens
tgaccctgtgatgcctga

SEQ ID NO: 2874902 - DNA, 13 bp, Homo sapiens
tgaccggcacctg

SEQ ID NO: 2874903 - DNA, 15 bp, Homo sapiens
tgaccggcacctgcg

SEQ ID NO: 2874904 - DNA, 16 bp, Homo sapiens
tgaccggcacctgcga

SEQ ID NO: 2874905 - DNA, 20 bp, Homo sapiens
tgactgtgtgttgtgaaata

SEQ ID NO: 2874906 - DNA, 14 bp, Homo sapiens
tgagaaatttaaac

SEQ ID NO: 2874907 - DNA, 17 bp, Homo sapiens
tgagaaatttaaactat

SEQ ID NO: 2874908 - DNA, 19 bp, Homo sapiens
tgagagccctgctgtggga

SEQ ID NO: 2874909 - DNA, 20 bp, Homo sapiens
tgagagccctgctgtgggag

SEQ ID NO: 2874910 - DNA, 22 bp, Homo sapiens
tgagagccctgctgtgggagag

SEQ ID NO: 2874911 - DNA, 18 bp, Homo sapiens
tgagcatgggtgtgccct

SEQ ID NO: 2874912 - DNA, 20 bp, Homo sapiens
tgagccaaacacactgtaaa

SEQ ID NO: 2874913 - DNA, 21 bp, Homo sapiens
tgagccaaacacactgtaaat

SEQ ID NO: 2874914 - DNA, 22 bp, Homo sapiens
tgagccaaacacactgtaaata

SEQ ID NO: 2874915 - DNA, 14 bp, Homo sapiens
tgagccaggagcct

SEQ ID NO: 2874916 - DNA, 15 bp, Homo sapiens
tgaggacaggagagg

SEQ ID NO: 2874917 - DNA, 14 bp, Homo sapiens
tgaggagagaagga

SEQ ID NO: 2874918 - DNA, 17 bp, Homo sapiens
tgaggggcttcctgggt

SEQ ID NO: 2874919 - DNA, 18 bp, Homo sapiens
tgataatgaacagaacat

SEQ ID NO: 2874920 - DNA, 20 bp, Homo sapiens
tgataatgaacagaacatag

SEQ ID NO: 2874921 - DNA, 14 bp, Homo sapiens
tgatagattttctg

SEQ ID NO: 2874922 - DNA, 19 bp, Homo sapiens
tgatctgtcccctctcccc

SEQ ID NO: 2874923 - DNA, 18 bp, Homo sapiens
tgatcttgagatttcttt

SEQ ID NO: 2874924 - DNA, 21 bp, Homo sapiens
tgatgccaaaaaaaaatacat

SEQ ID NO: 2874925 - DNA, 20 bp, Homo sapiens
tgattgtagtaatctgcatt

SEQ ID NO: 2874926 - DNA, 16 bp, Homo sapiens
tgattttcagacaggg

SEQ ID NO: 2874927 - DNA, 15 bp, Homo sapiens
tgcaatcccttaata

SEQ ID NO: 2874928 - DNA, 22 bp, Homo sapiens
tgcaatgtaaatattttaaaga

SEQ ID NO: 2874929 - DNA, 19 bp, Homo sapiens
tgcaatttcccctctgtgt

SEQ ID NO: 2874930 - DNA, 14 bp, Homo sapiens
tgcaccatctgctt

SEQ ID NO: 2874931 - DNA, 14 bp, Homo sapiens
tgcacctaaagaaa

SEQ ID NO: 2874932 - DNA, 15 bp, Homo sapiens
tgcacctaaagaaaa

SEQ ID NO: 2874933 - DNA, 22 bp, Homo sapiens
tgcagtattgccacaatgcctc

SEQ ID NO: 2874934 - DNA, 23 bp, Homo sapiens
tttgttaatttagaaaactttaa

SEQ ID NO: 2874935 - DNA, 14 bp, Homo sapiens
ttttaaaaaagctt

SEQ ID NO: 2874936 - DNA, 12 bp, Homo sapiens
ttttacaaagcc

SEQ ID NO: 2874937 - DNA, 13 bp, Homo sapiens
ttttactttgaac

SEQ ID NO: 2874938 - DNA, 17 bp, Homo sapiens
ttttcaaatcaagaaaa

SEQ ID NO: 2874939 - DNA, 14 bp, Homo sapiens
ttttccttttctta

SEQ ID NO: 2874940 - DNA, 15 bp, Homo sapiens
ttttccttttcttaa

SEQ ID NO: 2874941 - DNA, 16 bp, Homo sapiens
ttttccttttcttaaa

SEQ ID NO: 2874942 - DNA, 16 bp, Homo sapiens
ttttctttgtaaaggt

SEQ ID NO: 2874943 - DNA, 21 bp, Homo sapiens
ttttgcggttcaggaaaattg

SEQ ID NO: 2874944 - DNA, 22 bp, Homo sapiens
tttttaaaaaagcttaaaactt

SEQ ID NO: 2874945 - DNA, 23 bp, Homo sapiens
tttttaaaaaagcttaaaacttt

SEQ ID NO: 2874946 - DNA, 14 bp, Homo sapiens
tttttaataattta

SEQ ID NO: 2874947 - DNA, 15 bp, Homo sapiens
tttttacaaagccct

SEQ ID NO: 2874948 - DNA, 13 bp, Homo sapiens
tttttatttaaaa

SEQ ID NO: 2874949 - DNA, 17 bp, Homo sapiens
tttttgaaaaagcgaaa

SEQ ID NO: 2874950 - DNA, 15 bp, Homo sapiens
acatcattcttgaga

SEQ ID NO: 2874951 - DNA, 19 bp, Homo sapiens
acatgctaagagaagtaga

SEQ ID NO: 2874952 - DNA, 19 bp, Homo sapiens
acatgtgtcccagccacag

SEQ ID NO: 2874953 - DNA, 18 bp, Homo sapiens
acattgaattagaaacat

SEQ ID NO: 2874954 - DNA, 15 bp, Homo sapiens
acatttctctgagca

SEQ ID NO: 2874955 - DNA, 14 bp, Homo sapiens
accaaaagaagtaa

SEQ ID NO: 2874956 - DNA, 21 bp, Homo sapiens
accaaaagaagtaaaagcaaa

SEQ ID NO: 2874957 - DNA, 14 bp, Homo sapiens
accacttacttcgt

SEQ ID NO: 2874958 - DNA, 19 bp, Homo sapiens
accaggcaccaaaagaagt

SEQ ID NO: 2874959 - DNA, 16 bp, Homo sapiens
accagttggccatgat

SEQ ID NO: 2874960 - DNA, 14 bp, Homo sapiens
accatcaccctctg

SEQ ID NO: 2874961 - DNA, 17 bp, Homo sapiens
accccaggacgccactc

SEQ ID NO: 2874962 - DNA, 14 bp, Homo sapiens
acccccagccccga

SEQ ID NO: 2874963 - DNA, 13 bp, Homo sapiens
accccctcccacc

SEQ ID NO: 2874964 - DNA, 14 bp, Homo sapiens
accccctcccaccc

SEQ ID NO: 2874965 - DNA, 16 bp, Homo sapiens
accctctgggcagctg

SEQ ID NO: 2874966 - DNA, 14 bp, Homo sapiens
accctgctcacagg

SEQ ID NO: 2874967 - DNA, 18 bp, Homo sapiens
accctgctcacaggcagg

SEQ ID NO: 2874968 - DNA, 21 bp, Homo sapiens
accctgttttccacaccatca

SEQ ID NO: 2874969 - DNA, 19 bp, Homo sapiens
accgggatgaacctatcct

SEQ ID NO: 2874970 - DNA, 19 bp, Homo sapiens
acctcaatcagtctcagaa

SEQ ID NO: 2874971 - DNA, 15 bp, Homo sapiens
acctcagtaatttag

SEQ ID NO: 2874972 - DNA, 11 bp, Homo sapiens
acctccctact

SEQ ID NO: 2874973 - DNA, 15 bp, Homo sapiens
acctgaccggcacct

SEQ ID NO: 2874974 - DNA, 21 bp, Homo sapiens
acctgggcatactaataaagt

SEQ ID NO: 2874975 - DNA, 13 bp, Homo sapiens
acctttccctcac

SEQ ID NO: 2874976 - DNA, 14 bp, Homo sapiens
acctttccctcacc

SEQ ID NO: 2874977 - DNA, 19 bp, Homo sapiens
acctttccctcaccccctc

SEQ ID NO: 2874978 - DNA, 15 bp, Homo sapiens
acgatgtcaaggact

SEQ ID NO: 2874979 - DNA, 22 bp, Homo sapiens
acgcaccaccatgccaggctaa

SEQ ID NO: 2874980 - DNA, 15 bp, Homo sapiens
acgccactcatttca

SEQ ID NO: 2874981 - DNA, 22 bp, Homo sapiens
acggacgtcctgctggcacctc

SEQ ID NO: 2874982 - DNA, 16 bp, Homo sapiens
acgtatttaatagcaa

SEQ ID NO: 2874983 - DNA, 15 bp, Homo sapiens
acgtcctgctggcac

SEQ ID NO: 2874984 - DNA, 17 bp, Homo sapiens
acgtttaagccaaaaca

SEQ ID NO: 2874985 - DNA, 13 bp, Homo sapiens
actaaatctttta

SEQ ID NO: 2874986 - DNA, 22 bp, Homo sapiens
actacacactgtgtactgcagt

SEQ ID NO: 2874987 - DNA, 14 bp, Homo sapiens
actacgtgccagct

SEQ ID NO: 2874988 - DNA, 20 bp, Homo sapiens
actagttgtgtctggcagtt

SEQ ID NO: 2874989 - DNA, 15 bp, Homo sapiens
actataaactactgt

SEQ ID NO: 2874990 - DNA, 18 bp, Homo sapiens
actataaactactgtaat

SEQ ID NO: 2874991 - DNA, 20 bp, Homo sapiens
actataaactactgtaatta

SEQ ID NO: 2874992 - DNA, 20 bp, Homo sapiens
actatcttactatttcacaa

SEQ ID NO: 2874993 - DNA, 19 bp, Homo sapiens
actatgaaaagctagaatt

SEQ ID NO: 2874994 - DNA, 12 bp, Homo sapiens
actcatttcatc

SEQ ID NO: 2874995 - DNA, 14 bp, Homo sapiens
actcatttcatctc

SEQ ID NO: 2874996 - DNA, 15 bp, Homo sapiens
actcatttcatctca

SEQ ID NO: 2874997 - DNA, 19 bp, Homo sapiens
actcatttttcatgataat

SEQ ID NO: 2874998 - DNA, 20 bp, Homo sapiens
actccagccacccagccagg

SEQ ID NO: 2874999 - DNA, 21 bp, Homo sapiens
actccagccacccagccagga

SEQ ID NO: 2875000 - DNA, 14 bp, Homo sapiens
actccagccagcgc

SEQ ID NO: 2875001 - DNA, 15 bp, Homo sapiens
actccagccagcgcc

SEQ ID NO: 2875002 - DNA, 17 bp, Homo sapiens
actccagccagcgcctc

SEQ ID NO: 2875003 - DNA, 13 bp, Homo sapiens
actcccccagccc

SEQ ID NO: 2875004 - DNA, 19 bp, Homo sapiens
actccctaagaaaccccag

SEQ ID NO: 2875005 - DNA, 14 bp, Homo sapiens
actccctcccctgc

SEQ ID NO: 2875006 - DNA, 15 bp, Homo sapiens
actccctcccctgcc

SEQ ID NO: 2875007 - DNA, 16 bp, Homo sapiens
actcctgtgctctgga

SEQ ID NO: 2875008 - DNA, 20 bp, Homo sapiens
actcctgtgctctggaggct

SEQ ID NO: 2875009 - DNA, 22 bp, Homo sapiens
actccttcaacaattctaaaat

SEQ ID NO: 2875010 - DNA, 13 bp, Homo sapiens
actctcaggaggc

SEQ ID NO: 2875011 - DNA, 21 bp, Homo sapiens
actctctataagtgttcagtg

SEQ ID NO: 2875012 - DNA, 17 bp, Homo sapiens
actgaaaattatttaaa

SEQ ID NO: 2875013 - DNA, 21 bp, Homo sapiens
actgaaccttgttgatgccag

SEQ ID NO: 2875014 - DNA, 23 bp, Homo sapiens
actgagccaaacacactgtaaat

SEQ ID NO: 2875015 - DNA, 20 bp, Homo sapiens
actgatgcgaaaacttgaat

SEQ ID NO: 2875016 - DNA, 17 bp, Homo sapiens
actggcctcaaagcaag

SEQ ID NO: 2875017 - DNA, 19 bp, Homo sapiens
actgggccggcagcctggt

SEQ ID NO: 2875018 - DNA, 17 bp, Homo sapiens
actgtaattaagtgcaa

SEQ ID NO: 2875019 - DNA, 18 bp, Homo sapiens
actgtgtgttgtgaaata

SEQ ID NO: 2875020 - DNA, 21 bp, Homo sapiens
actgttgggtgggtgggccct

SEQ ID NO: 2875021 - DNA, 21 bp, Homo sapiens
acttaccaggcaccaaaagaa

SEQ ID NO: 2875022 - DNA, 21 bp, Homo sapiens
acttagcccaagaggtctgag

SEQ ID NO: 2875023 - DNA, 23 bp, Homo sapiens
acttagcccaagaggtctgagcc

SEQ ID NO: 2875024 - DNA, 23 bp, Homo sapiens
acttcaagcatggctattttata

SEQ ID NO: 2875025 - DNA, 23 bp, Homo sapiens
acttcgtgcgcaacaacaaggac

SEQ ID NO: 2875026 - DNA, 20 bp, Homo sapiens
acttctcattttttaaaaaa

SEQ ID NO: 2875027 - DNA, 21 bp, Homo sapiens
acttgaatctgttactgaaat

SEQ ID NO: 2875028 - DNA, 23 bp, Homo sapiens
acttgaatctgttactgaaatga

SEQ ID NO: 2875029 - DNA, 14 bp, Homo sapiens
acttggttttgcta

SEQ ID NO: 2875030 - DNA, 17 bp, Homo sapiens
actttgaagttagcttt

SEQ ID NO: 2875031 - DNA, 13 bp, Homo sapiens
acttttccttttc

SEQ ID NO: 2875032 - DNA, 14 bp, Homo sapiens
acttttccttttct

SEQ ID NO: 2875033 - DNA, 13 bp, Homo sapiens
acttttttctcta

SEQ ID NO: 2875034 - DNA, 14 bp, Homo sapiens
agaaaaagaagcaa

SEQ ID NO: 2875035 - DNA, 16 bp, Homo sapiens
agaaaacctttcttca

SEQ ID NO: 2875036 - DNA, 14 bp, Homo sapiens
agaaacaacagaaa

SEQ ID NO: 2875037 - DNA, 16 bp, Homo sapiens
agaaacataaataaaa

SEQ ID NO: 2875038 - DNA, 23 bp, Homo sapiens
agaaacataaataaaatgaccag

SEQ ID NO: 2875039 - DNA, 21 bp, Homo sapiens
agaaatgtttatacaataatt

SEQ ID NO: 2875040 - DNA, 24 bp, Homo sapiens
agaaatttaaactataagcaagaa

SEQ ID NO: 2875041 - DNA, 13 bp, Homo sapiens
agaagaaacaagg

SEQ ID NO: 2875042 - DNA, 21 bp, Homo sapiens
agaagaaacaaggttttcagt

SEQ ID NO: 2875043 - DNA, 19 bp, Homo sapiens
agaagcattttgtaagttg

SEQ ID NO: 2875044 - DNA, 16 bp, Homo sapiens
agaaggcaaaaatagt

SEQ ID NO: 2875045 - DNA, 19 bp, Homo sapiens
agaaggcaaaaatagtttg

SEQ ID NO: 2875046 - DNA, 15 bp, Homo sapiens
agaagtaaatttgtc

SEQ ID NO: 2875047 - DNA, 16 bp, Homo sapiens
agaagtaaatttgtcc

SEQ ID NO: 2875048 - DNA, 17 bp, Homo sapiens
agaagtaaatttgtcca

SEQ ID NO: 2875049 - DNA, 19 bp, Homo sapiens
agaagtttcatcatttttt

SEQ ID NO: 2875050 - DNA, 23 bp, Homo sapiens
agaagtttcatcattttttactt

SEQ ID NO: 2875051 - DNA, 13 bp, Homo sapiens
agaataaatgggt

SEQ ID NO: 2875052 - DNA, 19 bp, Homo sapiens
agaatacttctcatttttt

SEQ ID NO: 2875053 - DNA, 16 bp, Homo sapiens
agaatgtcattttggt

SEQ ID NO: 2875054 - DNA, 20 bp, Homo sapiens
agaatgtcattttggtactt

SEQ ID NO: 2875055 - DNA, 23 bp, Homo sapiens
agaatgtcattttggtactttgg

SEQ ID NO: 2875056 - DNA, 14 bp, Homo sapiens
agaattgagtgttt

SEQ ID NO: 2875057 - DNA, 17 bp, Homo sapiens
agaattgagtgtttaaa

SEQ ID NO: 2875058 - DNA, 14 bp, Homo sapiens
agacaaccttgtcc

SEQ ID NO: 2875059 - DNA, 20 bp, Homo sapiens
agacaatccactctcaggag

SEQ ID NO: 2875060 - DNA, 20 bp, Homo sapiens
agacactcctataaggagag

SEQ ID NO: 2875061 - DNA, 14 bp, Homo sapiens
agacagaagaaaca

SEQ ID NO: 2875062 - DNA, 15 bp, Homo sapiens
agacagaagaaacaa

SEQ ID NO: 2875063 - DNA, 16 bp, Homo sapiens
agacagaagaaacaag

SEQ ID NO: 2875064 - DNA, 17 bp, Homo sapiens
agacagaagaaacaagg

SEQ ID NO: 2875065 - DNA, 16 bp, Homo sapiens
agaccttttttaggaa

SEQ ID NO: 2875066 - DNA, 17 bp, Homo sapiens
agactcaagcctcccca

SEQ ID NO: 2875067 - DNA, 17 bp, Homo sapiens
agactccttcaacaatt

SEQ ID NO: 2875068 - DNA, 19 bp, Homo sapiens
agacttcaagcatggctat

SEQ ID NO: 2875069 - DNA, 20 bp, Homo sapiens
agagatggcctgagaagaga

SEQ ID NO: 2875070 - DNA, 18 bp, Homo sapiens
cacctctggatccctgga

SEQ ID NO: 2875071 - DNA, 14 bp, Homo sapiens
cactcatttcatct

SEQ ID NO: 2875072 - DNA, 16 bp, Homo sapiens
cactcatttcatctca

SEQ ID NO: 2875073 - DNA, 22 bp, Homo sapiens
cactcatttcatctcatttaag

SEQ ID NO: 2875074 - DNA, 20 bp, Homo sapiens
cactgcaatctccacctccc

SEQ ID NO: 2875075 - DNA, 18 bp, Homo sapiens
cactgctgtccctcctga

SEQ ID NO: 2875076 - DNA, 19 bp, Homo sapiens
cactgctgtccctcctgag

SEQ ID NO: 2875077 - DNA, 13 bp, Homo sapiens
cactgggccggca

SEQ ID NO: 2875078 - DNA, 18 bp, Homo sapiens
cactgtaaatatccacag

SEQ ID NO: 2875079 - DNA, 19 bp, Homo sapiens
cactgtaaatatccacaga

SEQ ID NO: 2875080 - DNA, 16 bp, Homo sapiens
cactgttgggtgggtg

SEQ ID NO: 2875081 - DNA, 23 bp, Homo sapiens
cacttagcccaagaggtctgagc

SEQ ID NO: 2875082 - DNA, 23 bp, Homo sapiens
cagaaacttttttctctaaagga

SEQ ID NO: 2875083 - DNA, 21 bp, Homo sapiens
cagaacatagacagaagaaac

SEQ ID NO: 2875084 - DNA, 14 bp, Homo sapiens
cagacaatccactc

SEQ ID NO: 2875085 - DNA, 15 bp, Homo sapiens
cagaccttttttagg

SEQ ID NO: 2875086 - DNA, 17 bp, Homo sapiens
cagactccctcccctgc

SEQ ID NO: 2875087 - DNA, 18 bp, Homo sapiens
cagactccctcccctgcc

SEQ ID NO: 2875088 - DNA, 20 bp, Homo sapiens
cagacttgccaggctccctt

SEQ ID NO: 2875089 - DNA, 13 bp, Homo sapiens
cagagctgaccca

SEQ ID NO: 2875090 - DNA, 12 bp, Homo sapiens
cagaggagaaga

SEQ ID NO: 2875091 - DNA, 13 bp, Homo sapiens
cagagggctaggg

SEQ ID NO: 2875092 - DNA, 23 bp, Homo sapiens
cagagtcagaggagaagagacat

SEQ ID NO: 2875093 - DNA, 14 bp, Homo sapiens
cagagtctaggcaa

SEQ ID NO: 2875094 - DNA, 13 bp, Homo sapiens
cagagtggagtct

SEQ ID NO: 2875095 - DNA, 19 bp, Homo sapiens
cagataactgaaaattatt

SEQ ID NO: 2875096 - DNA, 15 bp, Homo sapiens
cagccacccccaggc

SEQ ID NO: 2875097 - DNA, 23 bp, Homo sapiens
cagccagcgcctccctccacccc

SEQ ID NO: 2875098 - DNA, 15 bp, Homo sapiens
cagccccgactccag

SEQ ID NO: 2875099 - DNA, 19 bp, Homo sapiens
cagccccgactccagccag

SEQ ID NO: 2875100 - DNA, 16 bp, Homo sapiens
cagcccgaagcccagt

SEQ ID NO: 2875101 - DNA, 14 bp, Homo sapiens
cagccctaaacatc

SEQ ID NO: 2875102 - DNA, 15 bp, Homo sapiens
cagccgtgcactccc

SEQ ID NO: 2875103 - DNA, 11 bp, Homo sapiens
cagcctggagc

SEQ ID NO: 2875104 - DNA, 13 bp, Homo sapiens
cagcctggagccg

SEQ ID NO: 2875105 - DNA, 14 bp, Homo sapiens
cagcctggagccgt

SEQ ID NO: 2875106 - DNA, 15 bp, Homo sapiens
cagcctggttccctc

SEQ ID NO: 2875107 - DNA, 16 bp, Homo sapiens
cagcctggttccctct

SEQ ID NO: 2875108 - DNA, 18 bp, Homo sapiens
cagcctggttccctcttt

SEQ ID NO: 2875109 - DNA, 15 bp, Homo sapiens
cagcgcctccctcca

SEQ ID NO: 2875110 - DNA, 20 bp, Homo sapiens
cagcgcctccctccacccca

SEQ ID NO: 2875111 - DNA, 12 bp, Homo sapiens
cagctcaagtta

SEQ ID NO: 2875112 - DNA, 12 bp, Homo sapiens
cagctctgaggc

SEQ ID NO: 2875113 - DNA, 20 bp, Homo sapiens
cagctgagagccctgctgtg

SEQ ID NO: 2875114 - DNA, 21 bp, Homo sapiens
cagctgagagccctgctgtgg

SEQ ID NO: 2875115 - DNA, 12 bp, Homo sapiens
caggacagctgc

SEQ ID NO: 2875116 - DNA, 12 bp, Homo sapiens
caggacgccact

SEQ ID NO: 2875117 - DNA, 16 bp, Homo sapiens
caggacgccactcatt

SEQ ID NO: 2875118 - DNA, 17 bp, Homo sapiens
caggacgccactcattt

SEQ ID NO: 2875119 - DNA, 19 bp, Homo sapiens
caggacgccactcatttca

SEQ ID NO: 2875120 - DNA, 21 bp, Homo sapiens
caggacgccactcatttcatc

SEQ ID NO: 2875121 - DNA, 14 bp, Homo sapiens
caggatccccctct

SEQ ID NO: 2875122 - DNA, 15 bp, Homo sapiens
caggatccccctctt

SEQ ID NO: 2875123 - DNA, 16 bp, Homo sapiens
caggcaccaaaagaag

SEQ ID NO: 2875124 - DNA, 19 bp, Homo sapiens
caggcaccaaaagaagtaa

SEQ ID NO: 2875125 - DNA, 19 bp, Homo sapiens
caggcatctgttagcagag

SEQ ID NO: 2875126 - DNA, 20 bp, Homo sapiens
caggcatctgttagcagagt

SEQ ID NO: 2875127 - DNA, 23 bp, Homo sapiens
caggcatctgttagcagagtctg

SEQ ID NO: 2875128 - DNA, 24 bp, Homo sapiens
caggcatctgttagcagagtctgt

SEQ ID NO: 2875129 - DNA, 19 bp, Homo sapiens
caggcatggcccagcctgg

SEQ ID NO: 2875130 - DNA, 20 bp, Homo sapiens
caggctccctttctcttctt

SEQ ID NO: 2875131 - DNA, 23 bp, Homo sapiens
caggcttgggctccattcccatc

SEQ ID NO: 2875132 - DNA, 17 bp, Homo sapiens
cagggcaggaaggggaa

SEQ ID NO: 2875133 - DNA, 17 bp, Homo sapiens
cagggtgggaagaaaga

SEQ ID NO: 2875134 - DNA, 14 bp, Homo sapiens
caggtcctttcctt

SEQ ID NO: 2875135 - DNA, 13 bp, Homo sapiens
cagtattgccaca

SEQ ID NO: 2875136 - DNA, 19 bp, Homo sapiens
cagtattgccacaatgcct

SEQ ID NO: 2875137 - DNA, 19 bp, Homo sapiens
cagtcaagttccgtctcct

SEQ ID NO: 2875138 - DNA, 22 bp, Homo sapiens
cagtctaaagctggtttaatgt

SEQ ID NO: 2875139 - DNA, 11 bp, Homo sapiens
cagtctcagaa

SEQ ID NO: 2875140 - DNA, 17 bp, Homo sapiens
cagtctcctgacattaa

SEQ ID NO: 2875141 - DNA, 15 bp, Homo sapiens
cagtgacctgaccgg

SEQ ID NO: 2875142 - DNA, 15 bp, Homo sapiens
cagtgcactcagagc

SEQ ID NO: 2875143 - DNA, 20 bp, Homo sapiens
cagtggctcgctccctgtag

SEQ ID NO: 2875144 - DNA, 12 bp, Homo sapiens
cagtgttgacat

SEQ ID NO: 2875145 - DNA, 17 bp, Homo sapiens
cagtgttgacatagcct

SEQ ID NO: 2875146 - DNA, 18 bp, Homo sapiens
cagtgttgacatagcctt

SEQ ID NO: 2875147 - DNA, 20 bp, Homo sapiens
cagtgttgacatagcctttg

SEQ ID NO: 2875148 - DNA, 21 bp, Homo sapiens
cagttaatcctcacacctact

SEQ ID NO: 2875149 - DNA, 17 bp, Homo sapiens
cagtttatatttaactc

SEQ ID NO: 2875150 - DNA, 19 bp, Homo sapiens
cagtttcccttctatgcag

SEQ ID NO: 2875151 - DNA, 15 bp, Homo sapiens
cataaaaatgatcta

SEQ ID NO: 2875152 - DNA, 22 bp, Homo sapiens
cataccttggactgactaccag

SEQ ID NO: 2875153 - DNA, 15 bp, Homo sapiens
catagacagaagaaa

SEQ ID NO: 2875154 - DNA, 19 bp, Homo sapiens
catagacagaagaaacaag

SEQ ID NO: 2875155 - DNA, 11 bp, Homo sapiens
catagcctttg

SEQ ID NO: 2875156 - DNA, 15 bp, Homo sapiens
catagctgagctgga

SEQ ID NO: 2875157 - DNA, 12 bp, Homo sapiens
catataaagtat

SEQ ID NO: 2875158 - DNA, 20 bp, Homo sapiens
catcaaagatgagaagccaa

SEQ ID NO: 2875159 - DNA, 15 bp, Homo sapiens
catcactgctgtccc

SEQ ID NO: 2875160 - DNA, 18 bp, Homo sapiens
catcactgctgtccctcc

SEQ ID NO: 2875161 - DNA, 19 bp, Homo sapiens
catcactgctgtccctcct

SEQ ID NO: 2875162 - DNA, 14 bp, Homo sapiens
catcattttttact

SEQ ID NO: 2875163 - DNA, 16 bp, Homo sapiens
catccaggtcctttcc

SEQ ID NO: 2875164 - DNA, 20 bp, Homo sapiens
catccaggtcctttccttct

SEQ ID NO: 2875165 - DNA, 20 bp, Homo sapiens
catccctggccccctccctg

SEQ ID NO: 2875166 - DNA, 22 bp, Homo sapiens
catccctggccccctccctgga

SEQ ID NO: 2875167 - DNA, 23 bp, Homo sapiens
catccctggccccctccctggat

SEQ ID NO: 2875168 - DNA, 13 bp, Homo sapiens
catccgcctctga

SEQ ID NO: 2875169 - DNA, 20 bp, Homo sapiens
catccgcctctgagccagga

SEQ ID NO: 2875170 - DNA, 23 bp, Homo sapiens
catcctaagtgggaagtgaagcc

SEQ ID NO: 2875171 - DNA, 22 bp, Homo sapiens
catctcagtgaagaatacttct

SEQ ID NO: 2875172 - DNA, 20 bp, Homo sapiens
catctcatttaagggaaaaa

SEQ ID NO: 2875173 - DNA, 22 bp, Homo sapiens
catctcatttaagggaaaaata

SEQ ID NO: 2875174 - DNA, 15 bp, Homo sapiens
catctgttagcagag

SEQ ID NO: 2875175 - DNA, 16 bp, Homo sapiens
catctgttagcagagt

SEQ ID NO: 2875176 - DNA, 19 bp, Homo sapiens
catctgttagcagagtctg

SEQ ID NO: 2875177 - DNA, 12 bp, Homo sapiens
catcttctggct

SEQ ID NO: 2875178 - DNA, 14 bp, Homo sapiens
catcttctggcttg

SEQ ID NO: 2875179 - DNA, 17 bp, Homo sapiens
catcttctggcttgact

SEQ ID NO: 2875180 - DNA, 18 bp, Homo sapiens
catgccagcttcctgtgg

SEQ ID NO: 2875181 - DNA, 16 bp, Homo sapiens
catgccaggctaattt

SEQ ID NO: 2875182 - DNA, 19 bp, Homo sapiens
catgcgaatgagctgggcc

SEQ ID NO: 2875183 - DNA, 13 bp, Homo sapiens
catgctaagagaa

SEQ ID NO: 2875184 - DNA, 17 bp, Homo sapiens
catgctaagagaagtag

SEQ ID NO: 2875185 - DNA, 19 bp, Homo sapiens
catgctaagagaagtagaa

SEQ ID NO: 2875186 - DNA, 21 bp, Homo sapiens
catgctaagagaagtagaaat

SEQ ID NO: 2875187 - DNA, 16 bp, Homo sapiens
catggaaaagcccagt

SEQ ID NO: 2875188 - DNA, 14 bp, Homo sapiens
catggcccagcctg

SEQ ID NO: 2875189 - DNA, 16 bp, Homo sapiens
catggcccagcctgga

SEQ ID NO: 2875190 - DNA, 21 bp, Homo sapiens
gaagccccttgtcctctcccg

SEQ ID NO: 2875191 - DNA, 21 bp, Homo sapiens
gaaggactatgaaaagctaga

SEQ ID NO: 2875192 - DNA, 22 bp, Homo sapiens
gaagggaataaggtacaagaag

SEQ ID NO: 2875193 - DNA, 12 bp, Homo sapiens
gaagtgaagccc

SEQ ID NO: 2875194 - DNA, 17 bp, Homo sapiens
gaagttagctttaactt

SEQ ID NO: 2875195 - DNA, 16 bp, Homo sapiens
gaataatacattgaat

SEQ ID NO: 2875196 - DNA, 18 bp, Homo sapiens
gaatttttaaacaagtat

SEQ ID NO: 2875197 - DNA, 22 bp, Homo sapiens
gacaacatttctatagccaaaa

SEQ ID NO: 2875198 - DNA, 16 bp, Homo sapiens
gacacaggggacactg

SEQ ID NO: 2875199 - DNA, 15 bp, Homo sapiens
gacagaggttttgaa

SEQ ID NO: 2875200 - DNA, 19 bp, Homo sapiens
gacataaagttgataaaga

SEQ ID NO: 2875201 - DNA, 13 bp, Homo sapiens
gacatagcctttg

SEQ ID NO: 2875202 - DNA, 15 bp, Homo sapiens
gaccagtaattgtga

SEQ ID NO: 2875203 - DNA, 15 bp, Homo sapiens
gaccatatttttaaa

SEQ ID NO: 2875204 - DNA, 18 bp, Homo sapiens
gaccatatttttaaagaa

SEQ ID NO: 2875205 - DNA, 18 bp, Homo sapiens
gaccatcgtccttcctct

SEQ ID NO: 2875206 - DNA, 18 bp, Homo sapiens
gacccagagtggagtctg

SEQ ID NO: 2875207 - DNA, 19 bp, Homo sapiens
gacccagagtggagtctga

SEQ ID NO: 2875208 - DNA, 13 bp, Homo sapiens
gaccctgctcaca

SEQ ID NO: 2875209 - DNA, 17 bp, Homo sapiens
gaccctgttttccacac

SEQ ID NO: 2875210 - DNA, 17 bp, Homo sapiens
gacctgaccggcacctg

SEQ ID NO: 2875211 - DNA, 14 bp, Homo sapiens
gacgccactcattt

SEQ ID NO: 2875212 - DNA, 18 bp, Homo sapiens
gacgccactcatttcatc

SEQ ID NO: 2875213 - DNA, 17 bp, Homo sapiens
gacggggtttcaccatg

SEQ ID NO: 2875214 - DNA, 22 bp, Homo sapiens
gactccagccagcgcctccctc

SEQ ID NO: 2875215 - DNA, 23 bp, Homo sapiens
gactccagccagcgcctccctcc

SEQ ID NO: 2875216 - DNA, 12 bp, Homo sapiens
gactctctttct

SEQ ID NO: 2875217 - DNA, 15 bp, Homo sapiens
gactgaatgtgccta

SEQ ID NO: 2875218 - DNA, 16 bp, Homo sapiens
gactggcacttagccc

SEQ ID NO: 2875219 - DNA, 20 bp, Homo sapiens
gactggcacttagcccaaga

SEQ ID NO: 2875220 - DNA, 18 bp, Homo sapiens
gagacaaatctatgccac

SEQ ID NO: 2875221 - DNA, 12 bp, Homo sapiens
gagagaaggaca

SEQ ID NO: 2875222 - DNA, 12 bp, Homo sapiens
gagagccctgct

SEQ ID NO: 2875223 - DNA, 14 bp, Homo sapiens
gagagccctgctgt

SEQ ID NO: 2875224 - DNA, 23 bp, Homo sapiens
gagaggtccctgcttacctgacg

SEQ ID NO: 2875225 - DNA, 20 bp, Homo sapiens
gagagttcaagcctgtggga

SEQ ID NO: 2875226 - DNA, 23 bp, Homo sapiens
gagatcaaatggaaaggagagga

SEQ ID NO: 2875227 - DNA, 13 bp, Homo sapiens
gagcatgggtgtg

SEQ ID NO: 2875228 - DNA, 12 bp, Homo sapiens
gagccaggagcc

SEQ ID NO: 2875229 - DNA, 11 bp, Homo sapiens
gaggactgaga

SEQ ID NO: 2875230 - DNA, 13 bp, Homo sapiens
gaggactgagact

SEQ ID NO: 2875231 - DNA, 12 bp, Homo sapiens
gaggagagaagg

SEQ ID NO: 2875232 - DNA, 23 bp, Homo sapiens
gaggatggtcatcgtgacagcag

SEQ ID NO: 2875233 - DNA, 14 bp, Homo sapiens
gaggcaaaaatgtc

SEQ ID NO: 2875234 - DNA, 19 bp, Homo sapiens
gaggccaggcatggcccag

SEQ ID NO: 2875235 - DNA, 13 bp, Homo sapiens
gaggtccagaccc

SEQ ID NO: 2875236 - DNA, 20 bp, Homo sapiens
gaggtccctgcttacctgac

SEQ ID NO: 2875237 - DNA, 13 bp, Homo sapiens
gaggtctgagccc

SEQ ID NO: 2875238 - DNA, 16 bp, Homo sapiens
gaggtctgagccctgg

SEQ ID NO: 2875239 - DNA, 15 bp, Homo sapiens
gaggtgggagacaag

SEQ ID NO: 2875240 - DNA, 14 bp, Homo sapiens
gaggtgggggtctg

SEQ ID NO: 2875241 - DNA, 23 bp, Homo sapiens
gaggttttattctgacttcctct

SEQ ID NO: 2875242 - DNA, 14 bp, Homo sapiens
gagtcagaggagaa

SEQ ID NO: 2875243 - DNA, 13 bp, Homo sapiens
gagtcctgtctct

SEQ ID NO: 2875244 - DNA, 15 bp, Homo sapiens
gagtcctgtctctgc

SEQ ID NO: 2875245 - DNA, 14 bp, Homo sapiens
gagtctgagtcctg

SEQ ID NO: 2875246 - DNA, 15 bp, Homo sapiens
gagtctgagtcctgt

SEQ ID NO: 2875247 - DNA, 14 bp, Homo sapiens
gagtctgagtctga

SEQ ID NO: 2875248 - DNA, 15 bp, Homo sapiens
gagtggagtctgagt

SEQ ID NO: 2875249 - DNA, 21 bp, Homo sapiens
gataactgaaaattatttaaa

SEQ ID NO: 2875250 - DNA, 17 bp, Homo sapiens
gataccatgtataattt

SEQ ID NO: 2875251 - DNA, 16 bp, Homo sapiens
gatatgtaaaacattt

SEQ ID NO: 2875252 - DNA, 17 bp, Homo sapiens
gatctgtcccctctccc

SEQ ID NO: 2875253 - DNA, 18 bp, Homo sapiens
gatctgtcccctctcccc

SEQ ID NO: 2875254 - DNA, 20 bp, Homo sapiens
gatctgtcccctctcccctc

SEQ ID NO: 2875255 - DNA, 19 bp, Homo sapiens
gatcttgagatttctttta

SEQ ID NO: 2875256 - DNA, 12 bp, Homo sapiens
gatgccagctgt

SEQ ID NO: 2875257 - DNA, 16 bp, Homo sapiens
gatgcgaaaacttgaa

SEQ ID NO: 2875258 - DNA, 21 bp, Homo sapiens
gatgcgaaaacttgaatctgt

SEQ ID NO: 2875259 - DNA, 21 bp, Homo sapiens
gattccatgtgaaaataaaat

SEQ ID NO: 2875260 - DNA, 17 bp, Homo sapiens
gattcctttgaagagga

SEQ ID NO: 2875261 - DNA, 15 bp, Homo sapiens
gattgtcttaatatt

SEQ ID NO: 2875262 - DNA, 12 bp, Homo sapiens
gatttatttaaa

SEQ ID NO: 2875263 - DNA, 20 bp, Homo sapiens
gattttctgctactttgctg

SEQ ID NO: 2875264 - DNA, 21 bp, Homo sapiens
gattttttccttcaaagttta

SEQ ID NO: 2875265 - DNA, 11 bp, Homo sapiens
gcaaaagaaga

SEQ ID NO: 2875266 - DNA, 15 bp, Homo sapiens
gcaaaagaagaagtt

SEQ ID NO: 2875267 - DNA, 13 bp, Homo sapiens
gcaaaatgtgaat

SEQ ID NO: 2875268 - DNA, 12 bp, Homo sapiens
gcaacagcctgt

SEQ ID NO: 2875269 - DNA, 13 bp, Homo sapiens
gcaagagatgaga

SEQ ID NO: 2875270 - DNA, 15 bp, Homo sapiens
gcaagattttgtcaa

SEQ ID NO: 2875271 - DNA, 17 bp, Homo sapiens
gcaagcattcagaagaa

SEQ ID NO: 2875272 - DNA, 13 bp, Homo sapiens
gcaagccacagaa

SEQ ID NO: 2875273 - DNA, 15 bp, Homo sapiens
gcaagccacagaaat

SEQ ID NO: 2875274 - DNA, 18 bp, Homo sapiens
gcaagtccatagctgagc

SEQ ID NO: 2875275 - DNA, 21 bp, Homo sapiens
gcaataacgtttaagccaaaa

SEQ ID NO: 2875276 - DNA, 13 bp, Homo sapiens
gcaatgtaaatat

SEQ ID NO: 2875277 - DNA, 18 bp, Homo sapiens
gcaatgtaaatattttaa

SEQ ID NO: 2875278 - DNA, 19 bp, Homo sapiens
gcacagagggctagggagg

SEQ ID NO: 2875279 - DNA, 15 bp, Homo sapiens
gcacaggctaatttt

SEQ ID NO: 2875280 - DNA, 21 bp, Homo sapiens
gcacctcagacaatccactct

SEQ ID NO: 2875281 - DNA, 21 bp, Homo sapiens
gcacctgcgagaggtccctgc

SEQ ID NO: 2875282 - DNA, 23 bp, Homo sapiens
gcacctgcgagaggtccctgctt

SEQ ID NO: 2875283 - DNA, 21 bp, Homo sapiens
gcactccctaagaaaccccag

SEQ ID NO: 2875284 - DNA, 21 bp, Homo sapiens
gcacttagcccaagaggtctg

SEQ ID NO: 2875285 - DNA, 16 bp, Homo sapiens
gcagagtctgtctctt

SEQ ID NO: 2875286 - DNA, 18 bp, Homo sapiens
gcagcctggttccctctt

SEQ ID NO: 2875287 - DNA, 23 bp, Homo sapiens
gcagcctggttccctctttcctg

SEQ ID NO: 2875288 - DNA, 15 bp, Homo sapiens
gcagctgagagccct

SEQ ID NO: 2875289 - DNA, 22 bp, Homo sapiens
gcagctgggcactgggccggca

SEQ ID NO: 2875290 - DNA, 20 bp, Homo sapiens
gcagctgtcatggaaaagcc

SEQ ID NO: 2875291 - DNA, 22 bp, Homo sapiens
gcagctgtcatggaaaagccca

SEQ ID NO: 2875292 - DNA, 18 bp, Homo sapiens
gcagggcaggaaggggaa

SEQ ID NO: 2875293 - DNA, 12 bp, Homo sapiens
gcagtctcagaa

SEQ ID NO: 2875294 - DNA, 19 bp, Homo sapiens
gcagtctcagaaagccttc

SEQ ID NO: 2875295 - DNA, 21 bp, Homo sapiens
gcagtctcagaaagccttcca

SEQ ID NO: 2875296 - DNA, 16 bp, Homo sapiens
gcatactaataaagta

SEQ ID NO: 2875297 - DNA, 21 bp, Homo sapiens
gcatccgcctctgagccagga

SEQ ID NO: 2875298 - DNA, 17 bp, Homo sapiens
gcatggagagtggcatc

SEQ ID NO: 2875299 - DNA, 14 bp, Homo sapiens
gcatggcccagcct

SEQ ID NO: 2875300 - DNA, 16 bp, Homo sapiens
gcatggcccagcctgg

SEQ ID NO: 2875301 - DNA, 15 bp, Homo sapiens
gcatgggtgtgccct

SEQ ID NO: 2875302 - DNA, 22 bp, Homo sapiens
gcattattggaatataattgtt

SEQ ID NO: 2875303 - DNA, 18 bp, Homo sapiens
gcattcagaagaaaaaga

SEQ ID NO: 2875304 - DNA, 21 bp, Homo sapiens
gcattgaatggctatgttttt

SEQ ID NO: 2875305 - DNA, 21 bp, Homo sapiens
gccaatgcacctaaagaaaaa

SEQ ID NO: 2875306 - DNA, 18 bp, Homo sapiens
gccacaatgcctctccca

SEQ ID NO: 2875307 - DNA, 21 bp, Homo sapiens
gccacagtgttatgctctgtg

SEQ ID NO: 2875308 - DNA, 15 bp, Homo sapiens
gccacccagccagga

SEQ ID NO: 2875309 - DNA, 13 bp, Homo sapiens
gccacccccaggc

SEQ ID NO: 2875310 - DNA, 13 bp, Homo sapiens
gccagagcctggg

SEQ ID NO: 2875311 - DNA, 17 bp, Homo sapiens
tcagaagaaaaagaagc

SEQ ID NO: 2875312 - DNA, 18 bp, Homo sapiens
tcagaagaaaaagaagca

SEQ ID NO: 2875313 - DNA, 22 bp, Homo sapiens
tcagacaatccactctcaggag

SEQ ID NO: 2875314 - DNA, 14 bp, Homo sapiens
tcagactgtttagt

SEQ ID NO: 2875315 - DNA, 13 bp, Homo sapiens
tcagaggagaaga

SEQ ID NO: 2875316 - DNA, 21 bp, Homo sapiens
tcagagtggccaatccctgtg

SEQ ID NO: 2875317 - DNA, 22 bp, Homo sapiens
tcagagtggccaatccctgtgt

SEQ ID NO: 2875318 - DNA, 10 bp, Homo sapiens
tcagccgtgc

SEQ ID NO: 2875319 - DNA, 18 bp, Homo sapiens
tcagctgttaaccatttg

SEQ ID NO: 2875320 - DNA, 12 bp, Homo sapiens
tcaggacagctg

SEQ ID NO: 2875321 - DNA, 19 bp, Homo sapiens
tcaggacagctgcttctgt

SEQ ID NO: 2875322 - DNA, 19 bp, Homo sapiens
tcagtcaagttccgtctcc

SEQ ID NO: 2875323 - DNA, 22 bp, Homo sapiens
tcagtcaagttccgtctcctct

SEQ ID NO: 2875324 - DNA, 18 bp, Homo sapiens
tcagtctcagaatgtcat

SEQ ID NO: 2875325 - DNA, 12 bp, Homo sapiens
tcagtgttgaca

SEQ ID NO: 2875326 - DNA, 14 bp, Homo sapiens
tcagtgttgacata

SEQ ID NO: 2875327 - DNA, 17 bp, Homo sapiens
tcagtgttgacatagcc

SEQ ID NO: 2875328 - DNA, 16 bp, Homo sapiens
tcatccacagaggcca

SEQ ID NO: 2875329 - DNA, 18 bp, Homo sapiens
tcatccacagaggccagg

SEQ ID NO: 2875330 - DNA, 19 bp, Homo sapiens
tcatccaggtcctttcctt

SEQ ID NO: 2875331 - DNA, 20 bp, Homo sapiens
tcatctcatttaagggaaaa

SEQ ID NO: 2875332 - DNA, 21 bp, Homo sapiens
tcatctcatttaagggaaaaa

SEQ ID NO: 2875333 - DNA, 21 bp, Homo sapiens
tcatgataatgaacagaacat

SEQ ID NO: 2875334 - DNA, 16 bp, Homo sapiens
tcatggaaaagcccag

SEQ ID NO: 2875335 - DNA, 14 bp, Homo sapiens
tcattcatttttgt

SEQ ID NO: 2875336 - DNA, 23 bp, Homo sapiens
tcatttaagggaaaaatatatat

SEQ ID NO: 2875337 - DNA, 21 bp, Homo sapiens
tccaagagctacataatttag

SEQ ID NO: 2875338 - DNA, 17 bp, Homo sapiens
tccaatggctgtaaact

SEQ ID NO: 2875339 - DNA, 23 bp, Homo sapiens
tccacaccatcaccctctgggca

SEQ ID NO: 2875340 - DNA, 12 bp, Homo sapiens
tccaccccagga

SEQ ID NO: 2875341 - DNA, 14 bp, Homo sapiens
tccactaccctccc

SEQ ID NO: 2875342 - DNA, 15 bp, Homo sapiens
tccactctcaggagg

SEQ ID NO: 2875343 - DNA, 23 bp, Homo sapiens
tccactgttgggtgggtgggccc

SEQ ID NO: 2875344 - DNA, 18 bp, Homo sapiens
tccagccacccagccagg

SEQ ID NO: 2875345 - DNA, 19 bp, Homo sapiens
tccagccacccagccagga

SEQ ID NO: 2875346 - DNA, 12 bp, Homo sapiens
tccagccagcgc

SEQ ID NO: 2875347 - DNA, 14 bp, Homo sapiens
tccagccagcgcct

SEQ ID NO: 2875348 - DNA, 18 bp, Homo sapiens
tccagccagcgcctccct

SEQ ID NO: 2875349 - DNA, 20 bp, Homo sapiens
tccagccagcgcctccctcc

SEQ ID NO: 2875350 - DNA, 23 bp, Homo sapiens
tccagccagcgcctccctccacc

SEQ ID NO: 2875351 - DNA, 18 bp, Homo sapiens
tccaggtcctttccttct

SEQ ID NO: 2875352 - DNA, 16 bp, Homo sapiens
tccagtctcctgacat

SEQ ID NO: 2875353 - DNA, 24 bp, Homo sapiens
tccatatctccttcccctacacct

SEQ ID NO: 2875354 - DNA, 23 bp, Homo sapiens
tccatccctggccccctccctgg

SEQ ID NO: 2875355 - DNA, 16 bp, Homo sapiens
tccatgtgaaaataaa

SEQ ID NO: 2875356 - DNA, 13 bp, Homo sapiens
tcccacccccagc

SEQ ID NO: 2875357 - DNA, 23 bp, Homo sapiens
tcccacccccagccccgactcca

SEQ ID NO: 2875358 - DNA, 21 bp, Homo sapiens
tcccagagtcagaggagaaga

SEQ ID NO: 2875359 - DNA, 16 bp, Homo sapiens
tcccatcactgctgtc

SEQ ID NO: 2875360 - DNA, 22 bp, Homo sapiens
tcccatcactgctgtccctcct

SEQ ID NO: 2875361 - DNA, 16 bp, Homo sapiens
tcccatttatcgcaga

SEQ ID NO: 2875362 - DNA, 16 bp, Homo sapiens
tcccccagccctcagt

SEQ ID NO: 2875363 - DNA, 13 bp, Homo sapiens
tcccctctcccct

SEQ ID NO: 2875364 - DNA, 18 bp, Homo sapiens
tcccctgcccccatccca

SEQ ID NO: 2875365 - DNA, 21 bp, Homo sapiens
tcccgcgggcctggacactta

SEQ ID NO: 2875366 - DNA, 18 bp, Homo sapiens
tccctactcccctgggca

SEQ ID NO: 2875367 - DNA, 21 bp, Homo sapiens
tccctcaaatgcgcgtgtgca

SEQ ID NO: 2875368 - DNA, 17 bp, Homo sapiens
tccctcaccccctccca

SEQ ID NO: 2875369 - DNA, 20 bp, Homo sapiens
tccctcaccccctcccaccc

SEQ ID NO: 2875370 - DNA, 23 bp, Homo sapiens
tccctcaccccctcccaccccca

SEQ ID NO: 2875371 - DNA, 14 bp, Homo sapiens
tccctctcatccag

SEQ ID NO: 2875372 - DNA, 17 bp, Homo sapiens
tccctgcttacctgacg

SEQ ID NO: 2875373 - DNA, 11 bp, Homo sapiens
tccctggagac

SEQ ID NO: 2875374 - DNA, 20 bp, Homo sapiens
tccctggccccctccctgga

SEQ ID NO: 2875375 - DNA, 16 bp, Homo sapiens
tccctgtagctctgcc

SEQ ID NO: 2875376 - DNA, 17 bp, Homo sapiens
tcccttgtgtctgttgc

SEQ ID NO: 2875377 - DNA, 18 bp, Homo sapiens
tccgcctctgagccagga

SEQ ID NO: 2875378 - DNA, 20 bp, Homo sapiens
tccgtctcctctccagccct

SEQ ID NO: 2875379 - DNA, 21 bp, Homo sapiens
tcctaaacatcattcattttt

SEQ ID NO: 2875380 - DNA, 23 bp, Homo sapiens
tcctaagtgggaagtgaagcccc

SEQ ID NO: 2875381 - DNA, 14 bp, Homo sapiens
tcctataaggagag

SEQ ID NO: 2875382 - DNA, 21 bp, Homo sapiens
tcctattgtgcaatgtaaata

SEQ ID NO: 2875383 - DNA, 22 bp, Homo sapiens
tcctcaacccctcccctccatc

SEQ ID NO: 2875384 - DNA, 15 bp, Homo sapiens
tcctcctgttcctgc

SEQ ID NO: 2875385 - DNA, 19 bp, Homo sapiens
tcctctcccctctgccctg

SEQ ID NO: 2875386 - DNA, 20 bp, Homo sapiens
tcctctctctcacctacttc

SEQ ID NO: 2875387 - DNA, 23 bp, Homo sapiens
tcctgaaaaggtttatgaaaaag

SEQ ID NO: 2875388 - DNA, 13 bp, Homo sapiens
tcctgagtagctg

SEQ ID NO: 2875389 - DNA, 16 bp, Homo sapiens
tcctgcaatttctccc

SEQ ID NO: 2875390 - DNA, 17 bp, Homo sapiens
tcctgctggcacctcag

SEQ ID NO: 2875391 - DNA, 18 bp, Homo sapiens
tcctgctggcacctcaga

SEQ ID NO: 2875392 - DNA, 20 bp, Homo sapiens
tcctgctggcacctcagaca

SEQ ID NO: 2875393 - DNA, 23 bp, Homo sapiens
tcctggggctgggtgtgtttcag

SEQ ID NO: 2875394 - DNA, 13 bp, Homo sapiens
tcctgtctctgcc

SEQ ID NO: 2875395 - DNA, 22 bp, Homo sapiens
tcctgtgccaggactctctttc

SEQ ID NO: 2875396 - DNA, 13 bp, Homo sapiens
tcctgtgctctgg

SEQ ID NO: 2875397 - DNA, 22 bp, Homo sapiens
tcctgtgggccaggagctcagc

SEQ ID NO: 2875398 - DNA, 16 bp, Homo sapiens
tcctgttcctgccttc

SEQ ID NO: 2875399 - DNA, 17 bp, Homo sapiens
tcctgttcctgccttct

SEQ ID NO: 2875400 - DNA, 20 bp, Homo sapiens
tccttcaacaattctaaaat

SEQ ID NO: 2875401 - DNA, 16 bp, Homo sapiens
tccttcactcatccag

SEQ ID NO: 2875402 - DNA, 18 bp, Homo sapiens
tccttcactcatccagcc

SEQ ID NO: 2875403 - DNA, 13 bp, Homo sapiens
tccttccagtggc

SEQ ID NO: 2875404 - DNA, 14 bp, Homo sapiens
tccttcctctcaag

SEQ ID NO: 2875405 - DNA, 16 bp, Homo sapiens
tccttctcgtcttcct

SEQ ID NO: 2875406 - DNA, 20 bp, Homo sapiens
tccttctcgtcttcctctct

SEQ ID NO: 2875407 - DNA, 13 bp, Homo sapiens
tcctttccttctc

SEQ ID NO: 2875408 - DNA, 14 bp, Homo sapiens
tcgaacaaactgat

SEQ ID NO: 2875409 - DNA, 23 bp, Homo sapiens
tcgcatccgcctctgagccagga

SEQ ID NO: 2875410 - DNA, 19 bp, Homo sapiens
tcgctccctgtagctctgc

SEQ ID NO: 2875411 - DNA, 21 bp, Homo sapiens
tcgcttttgccttttcaaatc

SEQ ID NO: 2875412 - DNA, 12 bp, Homo sapiens
tcgtcttcctct

SEQ ID NO: 2875413 - DNA, 15 bp, Homo sapiens
tcgtcttcctctctc

SEQ ID NO: 2875414 - DNA, 21 bp, Homo sapiens
tctaaagctggtttaatgttt

SEQ ID NO: 2875415 - DNA, 22 bp, Homo sapiens
tctataagtgttcagtgttgac

SEQ ID NO: 2875416 - DNA, 23 bp, Homo sapiens
tctataagtgttcagtgttgaca

SEQ ID NO: 2875417 - DNA, 17 bp, Homo sapiens
tctatagccaaaaatag

SEQ ID NO: 2875418 - DNA, 19 bp, Homo sapiens
tctatagccaaaaatagct

SEQ ID NO: 2875419 - DNA, 21 bp, Homo sapiens
tctcacctacttcctcctcct

SEQ ID NO: 2875420 - DNA, 18 bp, Homo sapiens
tctcagaatgtcattttg

SEQ ID NO: 2875421 - DNA, 23 bp, Homo sapiens
tctcatccaggtcctttccttct

SEQ ID NO: 2875422 - DNA, 18 bp, Homo sapiens
tctcatttaagggaaaaa

SEQ ID NO: 2875423 - DNA, 13 bp, Homo sapiens
tctccagccctat

SEQ ID NO: 2875424 - DNA, 17 bp, Homo sapiens
tctcccctctgccctgt

SEQ ID NO: 2875425 - DNA, 19 bp, Homo sapiens
tctcccgcgggcctggaca

SEQ ID NO: 2875426 - DNA, 16 bp, Homo sapiens
tctcctctccagccct

SEQ ID NO: 2875427 - DNA, 17 bp, Homo sapiens
tctcctctccagcccta

SEQ ID NO: 2875428 - DNA, 13 bp, Homo sapiens
tctcgatctcctg

SEQ ID NO: 2875429 - DNA, 18 bp, Homo sapiens
tctctataagtgttcagt

SEQ ID NO: 2875430 - DNA, 20 bp, Homo sapiens
agaggactgagactggcact

SEQ ID NO: 2875431 - DNA, 14 bp, Homo sapiens
agaggccaggcatg

SEQ ID NO: 2875432 - DNA, 22 bp, Homo sapiens
agagggtgggagcctaaggaag

SEQ ID NO: 2875433 - DNA, 12 bp, Homo sapiens
agaggtccctgc

SEQ ID NO: 2875434 - DNA, 13 bp, Homo sapiens
agaggtccctgct

SEQ ID NO: 2875435 - DNA, 15 bp, Homo sapiens
agaggtccctgctta

SEQ ID NO: 2875436 - DNA, 18 bp, Homo sapiens
agaggtccctgcttacct

SEQ ID NO: 2875437 - DNA, 22 bp, Homo sapiens
agaggtccctgcttacctgacg

SEQ ID NO: 2875438 - DNA, 12 bp, Homo sapiens
agaggtctgagc

SEQ ID NO: 2875439 - DNA, 13 bp, Homo sapiens
agaggtctgagcc

SEQ ID NO: 2875440 - DNA, 21 bp, Homo sapiens
agaggtctgagccctggtgtg

SEQ ID NO: 2875441 - DNA, 13 bp, Homo sapiens
agagtcagaggag

SEQ ID NO: 2875442 - DNA, 14 bp, Homo sapiens
agagtctgtctctt

SEQ ID NO: 2875443 - DNA, 17 bp, Homo sapiens
agagtggagtctgagtc

SEQ ID NO: 2875444 - DNA, 18 bp, Homo sapiens
agagtggagtctgagtct

SEQ ID NO: 2875445 - DNA, 14 bp, Homo sapiens
agagttcaagaaat

SEQ ID NO: 2875446 - DNA, 21 bp, Homo sapiens
agagttcaagaaataagtttt

SEQ ID NO: 2875447 - DNA, 16 bp, Homo sapiens
agagttcaagcctgtg

SEQ ID NO: 2875448 - DNA, 18 bp, Homo sapiens
agatattcctattgtgca

SEQ ID NO: 2875449 - DNA, 19 bp, Homo sapiens
agatgcagcaaaatgtgaa

SEQ ID NO: 2875450 - DNA, 16 bp, Homo sapiens
agattttctgctactt

SEQ ID NO: 2875451 - DNA, 14 bp, Homo sapiens
agattttttaataa

SEQ ID NO: 2875452 - DNA, 14 bp, Homo sapiens
agcaaaaaagaaaa

SEQ ID NO: 2875453 - DNA, 23 bp, Homo sapiens
agcaaaatgtgaatgggaaaaga

SEQ ID NO: 2875454 - DNA, 15 bp, Homo sapiens
agcaaatcgaatgaa

SEQ ID NO: 2875455 - DNA, 21 bp, Homo sapiens
agcaactacagtctaaagctg

SEQ ID NO: 2875456 - DNA, 14 bp, Homo sapiens
agcaagagatgaga

SEQ ID NO: 2875457 - DNA, 21 bp, Homo sapiens
agcaagcattcagaagaaaaa

SEQ ID NO: 2875458 - DNA, 22 bp, Homo sapiens
agcaagcattcagaagaaaaag

SEQ ID NO: 2875459 - DNA, 12 bp, Homo sapiens
agcacaggctaa

SEQ ID NO: 2875460 - DNA, 16 bp, Homo sapiens
agcacaggctaatttt

SEQ ID NO: 2875461 - DNA, 21 bp, Homo sapiens
agcagaagaaaaagttgcagt

SEQ ID NO: 2875462 - DNA, 14 bp, Homo sapiens
agcagagtctgtct

SEQ ID NO: 2875463 - DNA, 15 bp, Homo sapiens
agcagctgggcactg

SEQ ID NO: 2875464 - DNA, 16 bp, Homo sapiens
agcagctgggcactgg

SEQ ID NO: 2875465 - DNA, 19 bp, Homo sapiens
agcagtgattgtcttaata

SEQ ID NO: 2875466 - DNA, 14 bp, Homo sapiens
agcattcagaagaa

SEQ ID NO: 2875467 - DNA, 15 bp, Homo sapiens
agccaaacacactgt

SEQ ID NO: 2875468 - DNA, 18 bp, Homo sapiens
agccaaacacactgtaaa

SEQ ID NO: 2875469 - DNA, 13 bp, Homo sapiens
agccacccagcca

SEQ ID NO: 2875470 - DNA, 14 bp, Homo sapiens
agccacccagccag

SEQ ID NO: 2875471 - DNA, 19 bp, Homo sapiens
agccacccagccaggaggg

SEQ ID NO: 2875472 - DNA, 15 bp, Homo sapiens
agccacccccaggca

SEQ ID NO: 2875473 - DNA, 19 bp, Homo sapiens
agccagagggtgggagcct

SEQ ID NO: 2875474 - DNA, 17 bp, Homo sapiens
agccagcgcctccctcc

SEQ ID NO: 2875475 - DNA, 21 bp, Homo sapiens
agccagcgcctccctccaccc

SEQ ID NO: 2875476 - DNA, 23 bp, Homo sapiens
agccagcgcctccctccacccca

SEQ ID NO: 2875477 - DNA, 20 bp, Homo sapiens
agccaggagcctcctgaccc

SEQ ID NO: 2875478 - DNA, 16 bp, Homo sapiens
agccatgccaataaag

SEQ ID NO: 2875479 - DNA, 20 bp, Homo sapiens
agccatgccaataaagtgat

SEQ ID NO: 2875480 - DNA, 18 bp, Homo sapiens
agcccaagaggtctgagc

SEQ ID NO: 2875481 - DNA, 19 bp, Homo sapiens
agcccaagaggtctgagcc

SEQ ID NO: 2875482 - DNA, 20 bp, Homo sapiens
agcccaagaggtctgagccc

SEQ ID NO: 2875483 - DNA, 21 bp, Homo sapiens
agcccaagaggtctgagccct

SEQ ID NO: 2875484 - DNA, 16 bp, Homo sapiens
agcccagtttcccttc

SEQ ID NO: 2875485 - DNA, 19 bp, Homo sapiens
agccccgactccagccagc

SEQ ID NO: 2875486 - DNA, 22 bp, Homo sapiens
agccccgactccagccagcgcc

SEQ ID NO: 2875487 - DNA, 15 bp, Homo sapiens
agccccttgtcctct

SEQ ID NO: 2875488 - DNA, 14 bp, Homo sapiens
agcccgaagcccag

SEQ ID NO: 2875489 - DNA, 15 bp, Homo sapiens
agccctgctgtggga

SEQ ID NO: 2875490 - DNA, 16 bp, Homo sapiens
agccctggtgtgtttc

SEQ ID NO: 2875491 - DNA, 14 bp, Homo sapiens
agccgtactgtcta

SEQ ID NO: 2875492 - DNA, 21 bp, Homo sapiens
agcctggttccctctttcctg

SEQ ID NO: 2875493 - DNA, 20 bp, Homo sapiens
agcctgtttgggaggctgga

SEQ ID NO: 2875494 - DNA, 23 bp, Homo sapiens
agcgaaaaaatcaggtggctttt

SEQ ID NO: 2875495 - DNA, 19 bp, Homo sapiens
agcgcctccctccacccca

SEQ ID NO: 2875496 - DNA, 22 bp, Homo sapiens
agcgtcccctgctactcctgtg

SEQ ID NO: 2875497 - DNA, 20 bp, Homo sapiens
agctaaatacctcaatcagt

SEQ ID NO: 2875498 - DNA, 23 bp, Homo sapiens
agctaactccagtctcctgacat

SEQ ID NO: 2875499 - DNA, 16 bp, Homo sapiens
agctacgtatttaata

SEQ ID NO: 2875500 - DNA, 17 bp, Homo sapiens
agctgacccagagtgga

SEQ ID NO: 2875501 - DNA, 22 bp, Homo sapiens
agctgacccagagtggagtctg

SEQ ID NO: 2875502 - DNA, 18 bp, Homo sapiens
agctgagagccctgctgt

SEQ ID NO: 2875503 - DNA, 17 bp, Homo sapiens
agctgggcactgggccg

SEQ ID NO: 2875504 - DNA, 16 bp, Homo sapiens
agctgtactgagttct

SEQ ID NO: 2875505 - DNA, 10 bp, Homo sapiens
agctgtcatg

SEQ ID NO: 2875506 - DNA, 21 bp, Homo sapiens
agctgtcatggaaaagcccag

SEQ ID NO: 2875507 - DNA, 23 bp, Homo sapiens
agctgtcatggaaaagcccagtg

SEQ ID NO: 2875508 - DNA, 14 bp, Homo sapiens
agcttaaaactttg

SEQ ID NO: 2875509 - DNA, 16 bp, Homo sapiens
agcttaaaactttgaa

SEQ ID NO: 2875510 - DNA, 14 bp, Homo sapiens
aggaaaatgaataa

SEQ ID NO: 2875511 - DNA, 23 bp, Homo sapiens
aggaaccacaccaatgcaacatt

SEQ ID NO: 2875512 - DNA, 16 bp, Homo sapiens
aggaagcaagaaagcc

SEQ ID NO: 2875513 - DNA, 16 bp, Homo sapiens
aggaaggactatgaaa

SEQ ID NO: 2875514 - DNA, 19 bp, Homo sapiens
aggactctctttcttccac

SEQ ID NO: 2875515 - DNA, 15 bp, Homo sapiens
aggactgagactggc

SEQ ID NO: 2875516 - DNA, 13 bp, Homo sapiens
aggagaagagaca

SEQ ID NO: 2875517 - DNA, 14 bp, Homo sapiens
aggagcctcctgac

SEQ ID NO: 2875518 - DNA, 16 bp, Homo sapiens
aggaggcgcagcccga

SEQ ID NO: 2875519 - DNA, 13 bp, Homo sapiens
aggagttgctcct

SEQ ID NO: 2875520 - DNA, 16 bp, Homo sapiens
aggatccccctctttg

SEQ ID NO: 2875521 - DNA, 22 bp, Homo sapiens
aggatccccctctttgcacagc

SEQ ID NO: 2875522 - DNA, 15 bp, Homo sapiens
aggatgtgtgggcca

SEQ ID NO: 2875523 - DNA, 12 bp, Homo sapiens
aggcaaaaatgt

SEQ ID NO: 2875524 - DNA, 16 bp, Homo sapiens
aggcaagccacagaaa

SEQ ID NO: 2875525 - DNA, 20 bp, Homo sapiens
aggcgcagcccgaagcccag

SEQ ID NO: 2875526 - DNA, 12 bp, Homo sapiens
aggctaattttt

SEQ ID NO: 2875527 - DNA, 22 bp, Homo sapiens
aggctaatttttttgtatttta

SEQ ID NO: 2875528 - DNA, 18 bp, Homo sapiens
aggctgcagagctgaccc

SEQ ID NO: 2875529 - DNA, 14 bp, Homo sapiens
agggaaaaatatat

SEQ ID NO: 2875530 - DNA, 14 bp, Homo sapiens
agggcaggaagggg

SEQ ID NO: 2875531 - DNA, 12 bp, Homo sapiens
aggggcctggcc

SEQ ID NO: 2875532 - DNA, 13 bp, Homo sapiens
aggggcttcctgg

SEQ ID NO: 2875533 - DNA, 18 bp, Homo sapiens
agggggctattccctgga

SEQ ID NO: 2875534 - DNA, 20 bp, Homo sapiens
agggggctattccctggaga

SEQ ID NO: 2875535 - DNA, 17 bp, Homo sapiens
agggtgggaagaaagaa

SEQ ID NO: 2875536 - DNA, 16 bp, Homo sapiens
aggtacaagaagcatt

SEQ ID NO: 2875537 - DNA, 13 bp, Homo sapiens
aggtcctttcctt

SEQ ID NO: 2875538 - DNA, 16 bp, Homo sapiens
aggtcctttccttctc

SEQ ID NO: 2875539 - DNA, 12 bp, Homo sapiens
aggtctgagccc

SEQ ID NO: 2875540 - DNA, 16 bp, Homo sapiens
aggtttatgaaaaaga

SEQ ID NO: 2875541 - DNA, 16 bp, Homo sapiens
agtaaatttgtccaat

SEQ ID NO: 2875542 - DNA, 13 bp, Homo sapiens
agtaatctgcatt

SEQ ID NO: 2875543 - DNA, 14 bp, Homo sapiens
agtaatttagaaat

SEQ ID NO: 2875544 - DNA, 17 bp, Homo sapiens
agtaatttagaaatcat

SEQ ID NO: 2875545 - DNA, 15 bp, Homo sapiens
agtagttaattctgt

SEQ ID NO: 2875546 - DNA, 21 bp, Homo sapiens
agtatttattttttcaaaaac

SEQ ID NO: 2875547 - DNA, 13 bp, Homo sapiens
agtatttgttaat

SEQ ID NO: 2875548 - DNA, 14 bp, Homo sapiens
agtatttgttaatt

SEQ ID NO: 2875549 - DNA, 13 bp, Homo sapiens
agtcagaggagaa

SEQ ID NO: 2875550 - DNA, 19 bp, Homo sapiens
agtccatagctgagctgga

SEQ ID NO: 2875551 - DNA, 11 bp, Homo sapiens
atctgcaaagc

SEQ ID NO: 2875552 - DNA, 21 bp, Homo sapiens
atctgcttggttggctggcag

SEQ ID NO: 2875553 - DNA, 18 bp, Homo sapiens
atctgtcccctctcccct

SEQ ID NO: 2875554 - DNA, 14 bp, Homo sapiens
atctgttactgaaa

SEQ ID NO: 2875555 - DNA, 21 bp, Homo sapiens
atctgttagcagagtctgtct

SEQ ID NO: 2875556 - DNA, 16 bp, Homo sapiens
atcttactatttcaca

SEQ ID NO: 2875557 - DNA, 20 bp, Homo sapiens
atcttggttgatgccaaaaa

SEQ ID NO: 2875558 - DNA, 14 bp, Homo sapiens
atctttctgttact

SEQ ID NO: 2875559 - DNA, 14 bp, Homo sapiens
atgaaaaagaagaa

SEQ ID NO: 2875560 - DNA, 17 bp, Homo sapiens
atgaaaaagaagaatct

SEQ ID NO: 2875561 - DNA, 13 bp, Homo sapiens
atgaaaagctaga

SEQ ID NO: 2875562 - DNA, 22 bp, Homo sapiens
atgacattaaagaagggttgag

SEQ ID NO: 2875563 - DNA, 17 bp, Homo sapiens
atgagctgggccctggg

SEQ ID NO: 2875564 - DNA, 18 bp, Homo sapiens
atgagctgggccctgggt

SEQ ID NO: 2875565 - DNA, 14 bp, Homo sapiens
atgaggagagaagg

SEQ ID NO: 2875566 - DNA, 15 bp, Homo sapiens
atgaggcaaaaatgt

SEQ ID NO: 2875567 - DNA, 14 bp, Homo sapiens
atgatgttaaaaaa

SEQ ID NO: 2875568 - DNA, 15 bp, Homo sapiens
atgcacctaaagaaa

SEQ ID NO: 2875569 - DNA, 16 bp, Homo sapiens
atgcagcaaaatgtga

SEQ ID NO: 2875570 - DNA, 19 bp, Homo sapiens
atgccaaaaaaaaatacat

SEQ ID NO: 2875571 - DNA, 22 bp, Homo sapiens
atgccagcttcctgtgggccag

SEQ ID NO: 2875572 - DNA, 11 bp, Homo sapiens
atgcctctccc

SEQ ID NO: 2875573 - DNA, 18 bp, Homo sapiens
atgcgaaaacttgaatct

SEQ ID NO: 2875574 - DNA, 15 bp, Homo sapiens
atgcgaatgagctgg

SEQ ID NO: 2875575 - DNA, 16 bp, Homo sapiens
atgcgaatgagctggg

SEQ ID NO: 2875576 - DNA, 16 bp, Homo sapiens
atgctaagagaagtag

SEQ ID NO: 2875577 - DNA, 20 bp, Homo sapiens
atgctctctatagaggagga

SEQ ID NO: 2875578 - DNA, 21 bp, Homo sapiens
atgctctgtggctggctcacc

SEQ ID NO: 2875579 - DNA, 14 bp, Homo sapiens
atgcttctgctcac

SEQ ID NO: 2875580 - DNA, 22 bp, Homo sapiens
atgcttctgctcacattccctc

SEQ ID NO: 2875581 - DNA, 13 bp, Homo sapiens
atggaaaagccca

SEQ ID NO: 2875582 - DNA, 14 bp, Homo sapiens
atggaaaagcccag

SEQ ID NO: 2875583 - DNA, 15 bp, Homo sapiens
atggaaaagcccagt

SEQ ID NO: 2875584 - DNA, 19 bp, Homo sapiens
atggaaaagcccagtgacc

SEQ ID NO: 2875585 - DNA, 20 bp, Homo sapiens
atggagaaacatcctaagtg

SEQ ID NO: 2875586 - DNA, 14 bp, Homo sapiens
atggcccagcctgg

SEQ ID NO: 2875587 - DNA, 17 bp, Homo sapiens
atggcccagcctggagc

SEQ ID NO: 2875588 - DNA, 20 bp, Homo sapiens
atggctgataattttaaatt

SEQ ID NO: 2875589 - DNA, 14 bp, Homo sapiens
atggctgtaaacta

SEQ ID NO: 2875590 - DNA, 16 bp, Homo sapiens
atggggagcagctggg

SEQ ID NO: 2875591 - DNA, 14 bp, Homo sapiens
atggttttctccaa

SEQ ID NO: 2875592 - DNA, 14 bp, Homo sapiens
atgtaaaacattta

SEQ ID NO: 2875593 - DNA, 20 bp, Homo sapiens
atgtaaaacatttattttga

SEQ ID NO: 2875594 - DNA, 15 bp, Homo sapiens
atgtaaatattttaa

SEQ ID NO: 2875595 - DNA, 19 bp, Homo sapiens
atgtaaatattttaaagaa

SEQ ID NO: 2875596 - DNA, 20 bp, Homo sapiens
atgtaaatattttaaagaat

SEQ ID NO: 2875597 - DNA, 15 bp, Homo sapiens
atgtaccttgaccat

SEQ ID NO: 2875598 - DNA, 16 bp, Homo sapiens
atgtatagtaaatcac

SEQ ID NO: 2875599 - DNA, 18 bp, Homo sapiens
atgtcaaggactcctgtc

SEQ ID NO: 2875600 - DNA, 19 bp, Homo sapiens
atgtccagccacccccagg

SEQ ID NO: 2875601 - DNA, 14 bp, Homo sapiens
atgtctgtggattt

SEQ ID NO: 2875602 - DNA, 17 bp, Homo sapiens
atgtgctattgaactga

SEQ ID NO: 2875603 - DNA, 22 bp, Homo sapiens
atgttaaaaaaataagaagaat

SEQ ID NO: 2875604 - DNA, 21 bp, Homo sapiens
atgtttgatagattttctgct

SEQ ID NO: 2875605 - DNA, 14 bp, Homo sapiens
atgtttttaatgta

SEQ ID NO: 2875606 - DNA, 18 bp, Homo sapiens
attaactgggtaatgaaa

SEQ ID NO: 2875607 - DNA, 14 bp, Homo sapiens
attaatgttgatga

SEQ ID NO: 2875608 - DNA, 15 bp, Homo sapiens
attatgtgcaacatt

SEQ ID NO: 2875609 - DNA, 19 bp, Homo sapiens
attattcaagaaagtgaaa

SEQ ID NO: 2875610 - DNA, 14 bp, Homo sapiens
attattcactagta

SEQ ID NO: 2875611 - DNA, 18 bp, Homo sapiens
attcaaaataaacaataa

SEQ ID NO: 2875612 - DNA, 18 bp, Homo sapiens
attcagaagaaaaagaag

SEQ ID NO: 2875613 - DNA, 20 bp, Homo sapiens
attcccatcactgctgtccc

SEQ ID NO: 2875614 - DNA, 16 bp, Homo sapiens
attctaaaatgattgt

SEQ ID NO: 2875615 - DNA, 14 bp, Homo sapiens
attctaaaatgcct

SEQ ID NO: 2875616 - DNA, 14 bp, Homo sapiens
attctgacttcctc

SEQ ID NO: 2875617 - DNA, 15 bp, Homo sapiens
attgaactgagccaa

SEQ ID NO: 2875618 - DNA, 21 bp, Homo sapiens
attgaatggctatgtttttaa

SEQ ID NO: 2875619 - DNA, 23 bp, Homo sapiens
attgaatggctatgtttttaatg

SEQ ID NO: 2875620 - DNA, 15 bp, Homo sapiens
attgtgcaatgtaaa

SEQ ID NO: 2875621 - DNA, 17 bp, Homo sapiens
attgtgcaatgtaaata

SEQ ID NO: 2875622 - DNA, 17 bp, Homo sapiens
attgtgtcagactgttt

SEQ ID NO: 2875623 - DNA, 13 bp, Homo sapiens
atttaaaaaacta

SEQ ID NO: 2875624 - DNA, 22 bp, Homo sapiens
atttaaaccgctaaaagaaact

SEQ ID NO: 2875625 - DNA, 24 bp, Homo sapiens
atttaaaccgctaaaagaaacttt

SEQ ID NO: 2875626 - DNA, 15 bp, Homo sapiens
atttaagggaaaaat

SEQ ID NO: 2875627 - DNA, 17 bp, Homo sapiens
atttagaaaactttaaa

SEQ ID NO: 2875628 - DNA, 18 bp, Homo sapiens
atttagaaaactttaaag

SEQ ID NO: 2875629 - DNA, 13 bp, Homo sapiens
atttattttgaca

SEQ ID NO: 2875630 - DNA, 14 bp, Homo sapiens
atttattttgacat

SEQ ID NO: 2875631 - DNA, 21 bp, Homo sapiens
atttattttgacataaagttg

SEQ ID NO: 2875632 - DNA, 21 bp, Homo sapiens
atttcatctcatttaagggaa

SEQ ID NO: 2875633 - DNA, 22 bp, Homo sapiens
atttcatctcatttaagggaaa

SEQ ID NO: 2875634 - DNA, 18 bp, Homo sapiens
atttcccctctgtgtcct

SEQ ID NO: 2875635 - DNA, 23 bp, Homo sapiens
atttctatagccaaaaatagcta

SEQ ID NO: 2875636 - DNA, 18 bp, Homo sapiens
atttctctgagcagtcag

SEQ ID NO: 2875637 - DNA, 16 bp, Homo sapiens
atttcttttaaagaag

SEQ ID NO: 2875638 - DNA, 18 bp, Homo sapiens
atttgggggtgcaatgat

SEQ ID NO: 2875639 - DNA, 22 bp, Homo sapiens
atttgtaatagatgtttgatag

SEQ ID NO: 2875640 - DNA, 19 bp, Homo sapiens
atttgtgtctgcctgcctc

SEQ ID NO: 2875641 - DNA, 21 bp, Homo sapiens
attttgcaatcccttaatatc

SEQ ID NO: 2875642 - DNA, 14 bp, Homo sapiens
attttttaaaaaag

SEQ ID NO: 2875643 - DNA, 19 bp, Homo sapiens
attttttaaaaaagcttaa

SEQ ID NO: 2875644 - DNA, 14 bp, Homo sapiens
caaaaaaaaataca

SEQ ID NO: 2875645 - DNA, 15 bp, Homo sapiens
caaaaagaaactttc

SEQ ID NO: 2875646 - DNA, 19 bp, Homo sapiens
caaaagaagtaaaagcaaa

SEQ ID NO: 2875647 - DNA, 22 bp, Homo sapiens
caaaagtgatctgtcccctctc

SEQ ID NO: 2875648 - DNA, 18 bp, Homo sapiens
caaacaccaacataaaaa

SEQ ID NO: 2875649 - DNA, 14 bp, Homo sapiens
caaagaaatagcaa

SEQ ID NO: 2875650 - DNA, 16 bp, Homo sapiens
caaagagttcaagaaa

SEQ ID NO: 2875651 - DNA, 17 bp, Homo sapiens
caaagagttcaagaaat

SEQ ID NO: 2875652 - DNA, 16 bp, Homo sapiens
caaagatgagaagcca

SEQ ID NO: 2875653 - DNA, 14 bp, Homo sapiens
caaatcgaatgaaa

SEQ ID NO: 2875654 - DNA, 22 bp, Homo sapiens
caaatcttggttgatgccaaaa

SEQ ID NO: 2875655 - DNA, 17 bp, Homo sapiens
caaatgcgcgtgtgcac

SEQ ID NO: 2875656 - DNA, 13 bp, Homo sapiens
caaatggaaagga

SEQ ID NO: 2875657 - DNA, 21 bp, Homo sapiens
caaatggaaaggagaggaaag

SEQ ID NO: 2875658 - DNA, 15 bp, Homo sapiens
caacatgttatttgt

SEQ ID NO: 2875659 - DNA, 22 bp, Homo sapiens
caacatgttatttgtaatagat

SEQ ID NO: 2875660 - DNA, 19 bp, Homo sapiens
caacctttccctcaccccc

SEQ ID NO: 2875661 - DNA, 19 bp, Homo sapiens
caactacagtctaaagctg

SEQ ID NO: 2875662 - DNA, 18 bp, Homo sapiens
caagaaataagtttttgt

SEQ ID NO: 2875663 - DNA, 18 bp, Homo sapiens
caagcatggctattttat

SEQ ID NO: 2875664 - DNA, 17 bp, Homo sapiens
caagcattcagaagaaa

SEQ ID NO: 2875665 - DNA, 12 bp, Homo sapiens
caagccacagaa

SEQ ID NO: 2875666 - DNA, 12 bp, Homo sapiens
caagcctgtggg

SEQ ID NO: 2875667 - DNA, 14 bp, Homo sapiens
caagcctgtgggag

SEQ ID NO: 2875668 - DNA, 15 bp, Homo sapiens
caagctagccagagg

SEQ ID NO: 2875669 - DNA, 21 bp, Homo sapiens
caagtccatagctgagctgga

SEQ ID NO: 2875670 - DNA, 16 bp, Homo sapiens
caagttccgtctcctc

SEQ ID NO: 2875671 - DNA, 21 bp, Homo sapiens
ctatacctgggcatactaata

SEQ ID NO: 2875672 - DNA, 19 bp, Homo sapiens
ctatagccaaaaatagcta

SEQ ID NO: 2875673 - DNA, 20 bp, Homo sapiens
ctatcctgcaatttctcccg

SEQ ID NO: 2875674 - DNA, 16 bp, Homo sapiens
ctatccttccagtggc

SEQ ID NO: 2875675 - DNA, 13 bp, Homo sapiens
ctatctatttgag

SEQ ID NO: 2875676 - DNA, 16 bp, Homo sapiens
ctatgaaaagctagaa

SEQ ID NO: 2875677 - DNA, 21 bp, Homo sapiens
ctatgaaaagctagaattgag

SEQ ID NO: 2875678 - DNA, 19 bp, Homo sapiens
ctatgtcccagcccctggt

SEQ ID NO: 2875679 - DNA, 18 bp, Homo sapiens
ctattgaactgagccaaa

SEQ ID NO: 2875680 - DNA, 22 bp, Homo sapiens
ctattgtgcaatgtaaatattt

SEQ ID NO: 2875681 - DNA, 23 bp, Homo sapiens
ctcaacccctcccctccatccct

SEQ ID NO: 2875682 - DNA, 16 bp, Homo sapiens
ctcaatcagtctcaga

SEQ ID NO: 2875683 - DNA, 18 bp, Homo sapiens
ctcaccccctcccacccc

SEQ ID NO: 2875684 - DNA, 16 bp, Homo sapiens
ctcactcactcattcc

SEQ ID NO: 2875685 - DNA, 18 bp, Homo sapiens
ctcagtaatttagaaatc

SEQ ID NO: 2875686 - DNA, 13 bp, Homo sapiens
ctcatccacagag

SEQ ID NO: 2875687 - DNA, 15 bp, Homo sapiens
ctcatccacagaggc

SEQ ID NO: 2875688 - DNA, 17 bp, Homo sapiens
ctcatccacagaggcca

SEQ ID NO: 2875689 - DNA, 20 bp, Homo sapiens
ctcatccacagaggccaggc

SEQ ID NO: 2875690 - DNA, 15 bp, Homo sapiens
ctcatccaggtcctt

SEQ ID NO: 2875691 - DNA, 18 bp, Homo sapiens
ctcatccaggtcctttcc

SEQ ID NO: 2875692 - DNA, 18 bp, Homo sapiens
ctcatggagaaacatcct

SEQ ID NO: 2875693 - DNA, 18 bp, Homo sapiens
ctcatttaagggaaaaat

SEQ ID NO: 2875694 - DNA, 14 bp, Homo sapiens
ctccaagagctaca

SEQ ID NO: 2875695 - DNA, 20 bp, Homo sapiens
ctccaagagctacataattt

SEQ ID NO: 2875696 - DNA, 12 bp, Homo sapiens
ctccaccccagg

SEQ ID NO: 2875697 - DNA, 19 bp, Homo sapiens
ctccagccagcgcctccct

SEQ ID NO: 2875698 - DNA, 20 bp, Homo sapiens
ctccagccagcgcctccctc

SEQ ID NO: 2875699 - DNA, 15 bp, Homo sapiens
ctccagtctcctgac

SEQ ID NO: 2875700 - DNA, 16 bp, Homo sapiens
ctccagtctcctgaca

SEQ ID NO: 2875701 - DNA, 18 bp, Homo sapiens
ctccagtctcctgacatt

SEQ ID NO: 2875702 - DNA, 14 bp, Homo sapiens
ctccatatctcctt

SEQ ID NO: 2875703 - DNA, 17 bp, Homo sapiens
ctccatatctccttccc

SEQ ID NO: 2875704 - DNA, 12 bp, Homo sapiens
ctccatccctgg

SEQ ID NO: 2875705 - DNA, 14 bp, Homo sapiens
ctccatccctggcc

SEQ ID NO: 2875706 - DNA, 18 bp, Homo sapiens
ctccattcccatcactgc

SEQ ID NO: 2875707 - DNA, 22 bp, Homo sapiens
ctccattcccatcactgctgtc

SEQ ID NO: 2875708 - DNA, 13 bp, Homo sapiens
ctcccacccccag

SEQ ID NO: 2875709 - DNA, 14 bp, Homo sapiens
ctcccacccccagc

SEQ ID NO: 2875710 - DNA, 16 bp, Homo sapiens
ctcccacccccagccc

SEQ ID NO: 2875711 - DNA, 23 bp, Homo sapiens
ctcccacgatgtcaaggactcct

SEQ ID NO: 2875712 - DNA, 14 bp, Homo sapiens
ctcccctccatccc

SEQ ID NO: 2875713 - DNA, 16 bp, Homo sapiens
ctcccctccatccctg

SEQ ID NO: 2875714 - DNA, 22 bp, Homo sapiens
ctcccctgcccccatcccacat

SEQ ID NO: 2875715 - DNA, 23 bp, Homo sapiens
ctcccctgggcatcttctggctt

SEQ ID NO: 2875716 - DNA, 14 bp, Homo sapiens
ctcccgaatcctga

SEQ ID NO: 2875717 - DNA, 16 bp, Homo sapiens
ctcccgaatcctgagg

SEQ ID NO: 2875718 - DNA, 18 bp, Homo sapiens
ctccctaagaaaccccag

SEQ ID NO: 2875719 - DNA, 19 bp, Homo sapiens
ctccctaagaaaccccagg

SEQ ID NO: 2875720 - DNA, 14 bp, Homo sapiens
ctccctactcccct

SEQ ID NO: 2875721 - DNA, 12 bp, Homo sapiens
ctccctccaccc

SEQ ID NO: 2875722 - DNA, 16 bp, Homo sapiens
ctccctccaccccagg

SEQ ID NO: 2875723 - DNA, 17 bp, Homo sapiens
ctccctccaccccagga

SEQ ID NO: 2875724 - DNA, 19 bp, Homo sapiens
ctccctccaccccaggacg

SEQ ID NO: 2875725 - DNA, 13 bp, Homo sapiens
ctccctcgcatcc

SEQ ID NO: 2875726 - DNA, 16 bp, Homo sapiens
ctccctttctcttctt

SEQ ID NO: 2875727 - DNA, 21 bp, Homo sapiens
ctcctacccctgtcctggggc

SEQ ID NO: 2875728 - DNA, 20 bp, Homo sapiens
ctcctcaacccctcccctcc

SEQ ID NO: 2875729 - DNA, 21 bp, Homo sapiens
ctcctcaacccctcccctcca

SEQ ID NO: 2875730 - DNA, 16 bp, Homo sapiens
ctcctcctcctcctgt

SEQ ID NO: 2875731 - DNA, 13 bp, Homo sapiens
ctcctcctcctgt

SEQ ID NO: 2875732 - DNA, 15 bp, Homo sapiens
ctcctcctgttcctg

SEQ ID NO: 2875733 - DNA, 13 bp, Homo sapiens
ctcctgaccctgt

SEQ ID NO: 2875734 - DNA, 14 bp, Homo sapiens
ctcctgaccctgtg

SEQ ID NO: 2875735 - DNA, 18 bp, Homo sapiens
ctcgcatccgcctctgag

SEQ ID NO: 2875736 - DNA, 15 bp, Homo sapiens
ctcgctccctgtagc

SEQ ID NO: 2875737 - DNA, 21 bp, Homo sapiens
ctcgctccctgtagctctgcc

SEQ ID NO: 2875738 - DNA, 22 bp, Homo sapiens
ctctaaaagggggctattccct

SEQ ID NO: 2875739 - DNA, 20 bp, Homo sapiens
ctctagttttcagccttggg

SEQ ID NO: 2875740 - DNA, 23 bp, Homo sapiens
ctctataagtgttcagtgttgac

SEQ ID NO: 2875741 - DNA, 20 bp, Homo sapiens
ctctcaagctagccagaggg

SEQ ID NO: 2875742 - DNA, 18 bp, Homo sapiens
ctctcacctacttcctcc

SEQ ID NO: 2875743 - DNA, 20 bp, Homo sapiens
ctctcaggaggcgcagcccg

SEQ ID NO: 2875744 - DNA, 14 bp, Homo sapiens
ctctccagccctat

SEQ ID NO: 2875745 - DNA, 20 bp, Homo sapiens
ctctctataagtgttcagtg

SEQ ID NO: 2875746 - DNA, 22 bp, Homo sapiens
ctctctataagtgttcagtgtt

SEQ ID NO: 2875747 - DNA, 19 bp, Homo sapiens
ctctctcacctacttcctc

SEQ ID NO: 2875748 - DNA, 13 bp, Homo sapiens
ctctgcctccctc

SEQ ID NO: 2875749 - DNA, 17 bp, Homo sapiens
ctctggaggctgcagag

SEQ ID NO: 2875750 - DNA, 19 bp, Homo sapiens
ctctggaggctgcagagct

SEQ ID NO: 2875751 - DNA, 12 bp, Homo sapiens
ctctgggcagct

SEQ ID NO: 2875752 - DNA, 18 bp, Homo sapiens
ctctgggcagctgtcatg

SEQ ID NO: 2875753 - DNA, 10 bp, Homo sapiens
ctctttcctg

SEQ ID NO: 2875754 - DNA, 12 bp, Homo sapiens
ctctttcctgtg

SEQ ID NO: 2875755 - DNA, 13 bp, Homo sapiens
ctgaatgtgccta

SEQ ID NO: 2875756 - DNA, 22 bp, Homo sapiens
ctgacaacatttctatagccaa

SEQ ID NO: 2875757 - DNA, 21 bp, Homo sapiens
ctgacaggcactataatttct

SEQ ID NO: 2875758 - DNA, 18 bp, Homo sapiens
ctgaccctgtgatgcctg

SEQ ID NO: 2875759 - DNA, 20 bp, Homo sapiens
ctgacggacgtcctgctggc

SEQ ID NO: 2875760 - DNA, 16 bp, Homo sapiens
ctgacttcctctgatt

SEQ ID NO: 2875761 - DNA, 22 bp, Homo sapiens
ctgagaagagagatcaaatgga

SEQ ID NO: 2875762 - DNA, 13 bp, Homo sapiens
ctgagccaggagc

SEQ ID NO: 2875763 - DNA, 14 bp, Homo sapiens
ctgagccaggagcc

SEQ ID NO: 2875764 - DNA, 22 bp, Homo sapiens
ctgagccaggagcctcctgacc

SEQ ID NO: 2875765 - DNA, 13 bp, Homo sapiens
ctgagccctggtg

SEQ ID NO: 2875766 - DNA, 23 bp, Homo sapiens
ctgagctggaaaggatgcttctg

SEQ ID NO: 2875767 - DNA, 16 bp, Homo sapiens
ctgagtctgagtcctg

SEQ ID NO: 2875768 - DNA, 22 bp, Homo sapiens
ctgagttctcatccacagaggc

SEQ ID NO: 2875769 - DNA, 17 bp, Homo sapiens
ctgataattttaaattc

SEQ ID NO: 2875770 - DNA, 13 bp, Homo sapiens
ctgatacagcctt

SEQ ID NO: 2875771 - DNA, 14 bp, Homo sapiens
ctgatacagcctta

SEQ ID NO: 2875772 - DNA, 21 bp, Homo sapiens
ctgatgcgaaaacttgaatct

SEQ ID NO: 2875773 - DNA, 17 bp, Homo sapiens
ctgattatacaccattt

SEQ ID NO: 2875774 - DNA, 16 bp, Homo sapiens
ctgcagagctgaccca

SEQ ID NO: 2875775 - DNA, 17 bp, Homo sapiens
ctgcagagctgacccag

SEQ ID NO: 2875776 - DNA, 22 bp, Homo sapiens
ctgcagcagggcaggaagggga

SEQ ID NO: 2875777 - DNA, 20 bp, Homo sapiens
ctgcccccatcccacatgat

SEQ ID NO: 2875778 - DNA, 18 bp, Homo sapiens
ctgcctccctctccatat

SEQ ID NO: 2875779 - DNA, 23 bp, Homo sapiens
ctgcctccctctccatatctcct

SEQ ID NO: 2875780 - DNA, 14 bp, Homo sapiens
ctgcctgcggccca

SEQ ID NO: 2875781 - DNA, 19 bp, Homo sapiens
ctgcgagaggtccctgctt

SEQ ID NO: 2875782 - DNA, 17 bp, Homo sapiens
ctgctactcctgtgctc

SEQ ID NO: 2875783 - DNA, 19 bp, Homo sapiens
ctgctactcctgtgctctg

SEQ ID NO: 2875784 - DNA, 13 bp, Homo sapiens
ctgctcacattcc

SEQ ID NO: 2875785 - DNA, 15 bp, Homo sapiens
ctgctcacattccct

SEQ ID NO: 2875786 - DNA, 20 bp, Homo sapiens
ctgctggcacctcagacaat

SEQ ID NO: 2875787 - DNA, 23 bp, Homo sapiens
ctgctggcacctcagacaatcca

SEQ ID NO: 2875788 - DNA, 17 bp, Homo sapiens
ctgctggtaaaataatg

SEQ ID NO: 2875789 - DNA, 14 bp, Homo sapiens
ctgctgtccctcct

SEQ ID NO: 2875790 - DNA, 15 bp, Homo sapiens
ctgctgtccctcctg

SEQ ID NO: 2875791 - DNA, 17 bp, Homo sapiens
gtactcccccagccctc

SEQ ID NO: 2875792 - DNA, 21 bp, Homo sapiens
gtactgagttctcatccacag

SEQ ID NO: 2875793 - DNA, 18 bp, Homo sapiens
gtagctctgcctccctct

SEQ ID NO: 2875794 - DNA, 19 bp, Homo sapiens
gtatataatactaaagtgt

SEQ ID NO: 2875795 - DNA, 17 bp, Homo sapiens
gtatttattttttcaaa

SEQ ID NO: 2875796 - DNA, 18 bp, Homo sapiens
gtatttattttttcaaaa

SEQ ID NO: 2875797 - DNA, 14 bp, Homo sapiens
gtcacttttccttt

SEQ ID NO: 2875798 - DNA, 13 bp, Homo sapiens
gtcagaggagaag

SEQ ID NO: 2875799 - DNA, 23 bp, Homo sapiens
gtcagagtaacatgccagcttcc

SEQ ID NO: 2875800 - DNA, 18 bp, Homo sapiens
gtcatggaaaagcccagt

SEQ ID NO: 2875801 - DNA, 20 bp, Homo sapiens
gtccaatggctgtaaactat

SEQ ID NO: 2875802 - DNA, 13 bp, Homo sapiens
gtcccctctcccc

SEQ ID NO: 2875803 - DNA, 17 bp, Homo sapiens
gtcccctctcccctcat

SEQ ID NO: 2875804 - DNA, 13 bp, Homo sapiens
gtcctctcccctc

SEQ ID NO: 2875805 - DNA, 21 bp, Homo sapiens
gtcctgcaagtccatagctga

SEQ ID NO: 2875806 - DNA, 16 bp, Homo sapiens
gtcctgctggcacctc

SEQ ID NO: 2875807 - DNA, 17 bp, Homo sapiens
gtcctgctggcacctca

SEQ ID NO: 2875808 - DNA, 23 bp, Homo sapiens
gtccttcctttaggtctggttgt

SEQ ID NO: 2875809 - DNA, 13 bp, Homo sapiens
gtcgcaactgaga

SEQ ID NO: 2875810 - DNA, 19 bp, Homo sapiens
gtctattagttttctttgt

SEQ ID NO: 2875811 - DNA, 16 bp, Homo sapiens
gtctcctctccagccc

SEQ ID NO: 2875812 - DNA, 18 bp, Homo sapiens
gtctcctctccagcccta

SEQ ID NO: 2875813 - DNA, 12 bp, Homo sapiens
gtctcctgacat

SEQ ID NO: 2875814 - DNA, 17 bp, Homo sapiens
gtctgagtcctgtctct

SEQ ID NO: 2875815 - DNA, 14 bp, Homo sapiens
gtctgtcctggagg

SEQ ID NO: 2875816 - DNA, 15 bp, Homo sapiens
gtctgtctcttggct

SEQ ID NO: 2875817 - DNA, 17 bp, Homo sapiens
gtcttcctctctctcac

SEQ ID NO: 2875818 - DNA, 14 bp, Homo sapiens
gtgaagaatacttc

SEQ ID NO: 2875819 - DNA, 22 bp, Homo sapiens
gtgaagccccttgtcctctccc

SEQ ID NO: 2875820 - DNA, 15 bp, Homo sapiens
gtgaatgggaaaaga

SEQ ID NO: 2875821 - DNA, 19 bp, Homo sapiens
gtgacctgaccggcacctg

SEQ ID NO: 2875822 - DNA, 20 bp, Homo sapiens
gtgatctgtcccctctcccc

SEQ ID NO: 2875823 - DNA, 21 bp, Homo sapiens
gtgattcctttgaagaggaaa

SEQ ID NO: 2875824 - DNA, 16 bp, Homo sapiens
gtgcaatttcccctct

SEQ ID NO: 2875825 - DNA, 22 bp, Homo sapiens
gtgcaatttcccctctgtgtcc

SEQ ID NO: 2875826 - DNA, 23 bp, Homo sapiens
gtgcaatttcccctctgtgtcct

SEQ ID NO: 2875827 - DNA, 13 bp, Homo sapiens
gtgccaggactct

SEQ ID NO: 2875828 - DNA, 19 bp, Homo sapiens
gtgccaggactctctttct

SEQ ID NO: 2875829 - DNA, 13 bp, Homo sapiens
gtggagtctgagt

SEQ ID NO: 2875830 - DNA, 16 bp, Homo sapiens
gtgggaagtgaagccc

SEQ ID NO: 2875831 - DNA, 22 bp, Homo sapiens
gtggggtacatttctctgagca

SEQ ID NO: 2875832 - DNA, 14 bp, Homo sapiens
gtgtgcccttgggg

SEQ ID NO: 2875833 - DNA, 23 bp, Homo sapiens
gtgtgtttccagatcgatcctgg

SEQ ID NO: 2875834 - DNA, 21 bp, Homo sapiens
gtgttacacagcccaagagga

SEQ ID NO: 2875835 - DNA, 21 bp, Homo sapiens
gtgttcagtgttgacatagcc

SEQ ID NO: 2875836 - DNA, 22 bp, Homo sapiens
gtgttcagtgttgacatagcct

SEQ ID NO: 2875837 - DNA, 17 bp, Homo sapiens
gtgttgacatagccttt

SEQ ID NO: 2875838 - DNA, 17 bp, Homo sapiens
gtgtttcaggacagctg

SEQ ID NO: 2875839 - DNA, 16 bp, Homo sapiens
gtgtttgtgagcatgg

SEQ ID NO: 2875840 - DNA, 12 bp, Homo sapiens
gttaatttttga

SEQ ID NO: 2875841 - DNA, 13 bp, Homo sapiens
gttagcagagtct

SEQ ID NO: 2875842 - DNA, 18 bp, Homo sapiens
gttagcagagtctgtctc

SEQ ID NO: 2875843 - DNA, 22 bp, Homo sapiens
gttagtatctttattaattttt

SEQ ID NO: 2875844 - DNA, 14 bp, Homo sapiens
gttcaagcctgtgg

SEQ ID NO: 2875845 - DNA, 16 bp, Homo sapiens
gttcaagcctgtggga

SEQ ID NO: 2875846 - DNA, 11 bp, Homo sapiens
gttcagtgttg

SEQ ID NO: 2875847 - DNA, 12 bp, Homo sapiens
gttcagtgttga

SEQ ID NO: 2875848 - DNA, 13 bp, Homo sapiens
gttcagtgttgac

SEQ ID NO: 2875849 - DNA, 14 bp, Homo sapiens
gttcagtgttgaca

SEQ ID NO: 2875850 - DNA, 15 bp, Homo sapiens
gttcagtgttgacat

SEQ ID NO: 2875851 - DNA, 16 bp, Homo sapiens
gttcagtgttgacata

SEQ ID NO: 2875852 - DNA, 17 bp, Homo sapiens
gttcagtgttgacatag

SEQ ID NO: 2875853 - DNA, 23 bp, Homo sapiens
gttcagtgttgacatagcctttg

SEQ ID NO: 2875854 - DNA, 19 bp, Homo sapiens
gttcattgtaaaaattttt

SEQ ID NO: 2875855 - DNA, 12 bp, Homo sapiens
gttcccttgtgt

SEQ ID NO: 2875856 - DNA, 16 bp, Homo sapiens
gttcctgccttctctt

SEQ ID NO: 2875857 - DNA, 18 bp, Homo sapiens
gttgaagcaaatcgaatg

SEQ ID NO: 2875858 - DNA, 12 bp, Homo sapiens
gttgacatagcc

SEQ ID NO: 2875859 - DNA, 16 bp, Homo sapiens
gttgacatagcctttg

SEQ ID NO: 2875860 - DNA, 12 bp, Homo sapiens
gttgagacagag

SEQ ID NO: 2875861 - DNA, 19 bp, Homo sapiens
gttgggtgggtgggccctg

SEQ ID NO: 2875862 - DNA, 20 bp, Homo sapiens
gtttaagccaaaacaatgtt

SEQ ID NO: 2875863 - DNA, 23 bp, Homo sapiens
gtttccctcaaatgcgcgtgtgc

SEQ ID NO: 2875864 - DNA, 21 bp, Homo sapiens
gtttcttaaataagaaacttt

SEQ ID NO: 2875865 - DNA, 16 bp, Homo sapiens
gtttgatagattttct

SEQ ID NO: 2875866 - DNA, 20 bp, Homo sapiens
gttttattctgacttcctct

SEQ ID NO: 2875867 - DNA, 18 bp, Homo sapiens
gttttctccaagagctac

SEQ ID NO: 2875868 - DNA, 15 bp, Homo sapiens
gttttctttgtaaag

SEQ ID NO: 2875869 - DNA, 18 bp, Homo sapiens
gttttctttgtaaaggtc

SEQ ID NO: 2875870 - DNA, 17 bp, Homo sapiens
gttttgctacataatta

SEQ ID NO: 2875871 - DNA, 12 bp, Homo sapiens
gtttttaatgta

SEQ ID NO: 2875872 - DNA, 13 bp, Homo sapiens
gtttttaatgtat

SEQ ID NO: 2875873 - DNA, 22 bp, Homo sapiens
taaaaaaataagaagaatgctt

SEQ ID NO: 2875874 - DNA, 20 bp, Homo sapiens
taaaaaagcttaaaactttg

SEQ ID NO: 2875875 - DNA, 20 bp, Homo sapiens
taaaaactagaggtgagaaa

SEQ ID NO: 2875876 - DNA, 23 bp, Homo sapiens
taaaacaaagccatgccaataaa

SEQ ID NO: 2875877 - DNA, 14 bp, Homo sapiens
taaaacatttattt

SEQ ID NO: 2875878 - DNA, 14 bp, Homo sapiens
taaaactttgaagt

SEQ ID NO: 2875879 - DNA, 14 bp, Homo sapiens
taaaagaaactttc

SEQ ID NO: 2875880 - DNA, 17 bp, Homo sapiens
taaaagaaactttcttt

SEQ ID NO: 2875881 - DNA, 23 bp, Homo sapiens
taaaagcaaaaaagaaaaccttt

SEQ ID NO: 2875882 - DNA, 21 bp, Homo sapiens
taaaagcaagattttgtcaaa

SEQ ID NO: 2875883 - DNA, 21 bp, Homo sapiens
taaaatgaccagtaattgtga

SEQ ID NO: 2875884 - DNA, 16 bp, Homo sapiens
taaaatgattgtagta

SEQ ID NO: 2875885 - DNA, 18 bp, Homo sapiens
taaacaagtatttgttaa

SEQ ID NO: 2875886 - DNA, 13 bp, Homo sapiens
taaaccttttttg

SEQ ID NO: 2875887 - DNA, 13 bp, Homo sapiens
taaactactgtaa

SEQ ID NO: 2875888 - DNA, 15 bp, Homo sapiens
taaactactgtaatt

SEQ ID NO: 2875889 - DNA, 16 bp, Homo sapiens
taaactactgtaatta

SEQ ID NO: 2875890 - DNA, 15 bp, Homo sapiens
taaactataagcaag

SEQ ID NO: 2875891 - DNA, 14 bp, Homo sapiens
taaagaaaaacaaa

SEQ ID NO: 2875892 - DNA, 15 bp, Homo sapiens
taaagaaaaacaaac

SEQ ID NO: 2875893 - DNA, 16 bp, Homo sapiens
taaagaagtaaatttg

SEQ ID NO: 2875894 - DNA, 17 bp, Homo sapiens
taaagattttttaataa

SEQ ID NO: 2875895 - DNA, 20 bp, Homo sapiens
taaagattttttaataattt

SEQ ID NO: 2875896 - DNA, 19 bp, Homo sapiens
taaagctggtttaatgttt

SEQ ID NO: 2875897 - DNA, 19 bp, Homo sapiens
taaagtatggtattgaaac

SEQ ID NO: 2875898 - DNA, 18 bp, Homo sapiens
taaagttcaacatgttat

SEQ ID NO: 2875899 - DNA, 20 bp, Homo sapiens
taaagttgataaagattttt

SEQ ID NO: 2875900 - DNA, 13 bp, Homo sapiens
taaataaaatgac

SEQ ID NO: 2875901 - DNA, 14 bp, Homo sapiens
taaatatccacaga

SEQ ID NO: 2875902 - DNA, 17 bp, Homo sapiens
taacatgccagcttcct

SEQ ID NO: 2875903 - DNA, 22 bp, Homo sapiens
taaccagacacatactcatttt

SEQ ID NO: 2875904 - DNA, 15 bp, Homo sapiens
taacctaaataatta

SEQ ID NO: 2875905 - DNA, 20 bp, Homo sapiens
taactgaaaattatttaaac

SEQ ID NO: 2875906 - DNA, 17 bp, Homo sapiens
taacttaaatagtattt

SEQ ID NO: 2875907 - DNA, 21 bp, Homo sapiens
taagaaacttttttatttaaa

SEQ ID NO: 2875908 - DNA, 21 bp, Homo sapiens
taagaagaatgcttaatcaga

SEQ ID NO: 2875909 - DNA, 20 bp, Homo sapiens
taagagaagtagaaatcata

SEQ ID NO: 2875910 - DNA, 13 bp, Homo sapiens
taagccagagcct

SEQ ID NO: 2875911 - DNA, 18 bp, Homo sapiens
tcaggaaaattgaatgca

SEQ ID NO: 2875912 - DNA, 13 bp, Homo sapiens
tcaggacagctgc

SEQ ID NO: 2875913 - DNA, 16 bp, Homo sapiens
tcaggaggcgcagccc

SEQ ID NO: 2875914 - DNA, 22 bp, Homo sapiens
tcaggcatgcgaatgagctggg

SEQ ID NO: 2875915 - DNA, 15 bp, Homo sapiens
tcagggtgggaagaa

SEQ ID NO: 2875916 - DNA, 19 bp, Homo sapiens
tcagtaatttagaaatcat

SEQ ID NO: 2875917 - DNA, 18 bp, Homo sapiens
tcagtccccacagataac

SEQ ID NO: 2875918 - DNA, 19 bp, Homo sapiens
tcagtctcagaatgtcatt

SEQ ID NO: 2875919 - DNA, 13 bp, Homo sapiens
tcagtgttgacat

SEQ ID NO: 2875920 - DNA, 15 bp, Homo sapiens
tcagtgttgacatag

SEQ ID NO: 2875921 - DNA, 13 bp, Homo sapiens
tcatactgaagat

SEQ ID NO: 2875922 - DNA, 17 bp, Homo sapiens
tcatcgaacaaactgat

SEQ ID NO: 2875923 - DNA, 18 bp, Homo sapiens
tcatcgaacaaactgatg

SEQ ID NO: 2875924 - DNA, 19 bp, Homo sapiens
tcatcgaacaaactgatgc

SEQ ID NO: 2875925 - DNA, 14 bp, Homo sapiens
tcatctcatttaag

SEQ ID NO: 2875926 - DNA, 23 bp, Homo sapiens
tcatctcatttaagggaaaaata

SEQ ID NO: 2875927 - DNA, 17 bp, Homo sapiens
tcatggaaaagcccagt

SEQ ID NO: 2875928 - DNA, 22 bp, Homo sapiens
tcatggaaaagcccagtgacct

SEQ ID NO: 2875929 - DNA, 11 bp, Homo sapiens
tcatggagaaa

SEQ ID NO: 2875930 - DNA, 18 bp, Homo sapiens
tcattctatgaacagtga

SEQ ID NO: 2875931 - DNA, 14 bp, Homo sapiens
tcatttaagggaaa

SEQ ID NO: 2875932 - DNA, 15 bp, Homo sapiens
tcatttaagggaaaa

SEQ ID NO: 2875933 - DNA, 11 bp, Homo sapiens
tcatttcatct

SEQ ID NO: 2875934 - DNA, 15 bp, Homo sapiens
tcatttcatctcatt

SEQ ID NO: 2875935 - DNA, 16 bp, Homo sapiens
tcatttcatctcattt

SEQ ID NO: 2875936 - DNA, 17 bp, Homo sapiens
tcatttcatctcattta

SEQ ID NO: 2875937 - DNA, 16 bp, Homo sapiens
tcattttttaaaaaag

SEQ ID NO: 2875938 - DNA, 16 bp, Homo sapiens
tccaatggctgtaaac

SEQ ID NO: 2875939 - DNA, 20 bp, Homo sapiens
tccaatggctgtaaactata

SEQ ID NO: 2875940 - DNA, 13 bp, Homo sapiens
tccaccccaggac

SEQ ID NO: 2875941 - DNA, 17 bp, Homo sapiens
tccactaccctccctcg

SEQ ID NO: 2875942 - DNA, 19 bp, Homo sapiens
tccactaccctccctcgca

SEQ ID NO: 2875943 - DNA, 21 bp, Homo sapiens
tccactaccctccctcgcatc

SEQ ID NO: 2875944 - DNA, 17 bp, Homo sapiens
tccagccacccagccag

SEQ ID NO: 2875945 - DNA, 10 bp, Homo sapiens
tccagccagc

SEQ ID NO: 2875946 - DNA, 16 bp, Homo sapiens
tccaggtcctttcctt

SEQ ID NO: 2875947 - DNA, 19 bp, Homo sapiens
tccaggtcctttccttctc

SEQ ID NO: 2875948 - DNA, 23 bp, Homo sapiens
tccagtggctcgctccctgtagc

SEQ ID NO: 2875949 - DNA, 17 bp, Homo sapiens
tccatagctgagctgga

SEQ ID NO: 2875950 - DNA, 15 bp, Homo sapiens
tccatccctggcccc

SEQ ID NO: 2875951 - DNA, 22 bp, Homo sapiens
tccatccctggccccctccctg

SEQ ID NO: 2875952 - DNA, 22 bp, Homo sapiens
tccatgactgtgtgttgtgaaa

SEQ ID NO: 2875953 - DNA, 13 bp, Homo sapiens
tcccaagagctac

SEQ ID NO: 2875954 - DNA, 18 bp, Homo sapiens
tcccacaggttcaggcga

SEQ ID NO: 2875955 - DNA, 17 bp, Homo sapiens
tcccagagtcagaggag

SEQ ID NO: 2875956 - DNA, 19 bp, Homo sapiens
tcccagagtcagaggagaa

SEQ ID NO: 2875957 - DNA, 22 bp, Homo sapiens
tcccagagtcagaggagaagag

SEQ ID NO: 2875958 - DNA, 14 bp, Homo sapiens
tcccagcccctggt

SEQ ID NO: 2875959 - DNA, 15 bp, Homo sapiens
tcccatttgtgtttc

SEQ ID NO: 2875960 - DNA, 18 bp, Homo sapiens
tccccccccaacctttcc

SEQ ID NO: 2875961 - DNA, 22 bp, Homo sapiens
tcccctcatggagaaacatcct

SEQ ID NO: 2875962 - DNA, 20 bp, Homo sapiens
tcccctccatccctggcccc

SEQ ID NO: 2875963 - DNA, 22 bp, Homo sapiens
tcccctgcccccatcccacatg

SEQ ID NO: 2875964 - DNA, 19 bp, Homo sapiens
tcccctgctactcctgtgc

SEQ ID NO: 2875965 - DNA, 23 bp, Homo sapiens
tcccctgctactcctgtgctctg

SEQ ID NO: 2875966 - DNA, 21 bp, Homo sapiens
tcccctgggcatcttctggct

SEQ ID NO: 2875967 - DNA, 18 bp, Homo sapiens
tcccgcgggcctggacac

SEQ ID NO: 2875968 - DNA, 16 bp, Homo sapiens
tccctatgtcccagcc

SEQ ID NO: 2875969 - DNA, 22 bp, Homo sapiens
tccctatgtcccagcccctggt

SEQ ID NO: 2875970 - DNA, 13 bp, Homo sapiens
tccctccacccca

SEQ ID NO: 2875971 - DNA, 14 bp, Homo sapiens
tccctccaccccag

SEQ ID NO: 2875972 - DNA, 17 bp, Homo sapiens
tccctcgcatccgcctc

SEQ ID NO: 2875973 - DNA, 21 bp, Homo sapiens
tccctcgcatccgcctctgag

SEQ ID NO: 2875974 - DNA, 12 bp, Homo sapiens
tccctctttcct

SEQ ID NO: 2875975 - DNA, 13 bp, Homo sapiens
tccctctttcctg

SEQ ID NO: 2875976 - DNA, 18 bp, Homo sapiens
tccctggatgacattaaa

SEQ ID NO: 2875977 - DNA, 20 bp, Homo sapiens
tccctggatgacattaaaga

SEQ ID NO: 2875978 - DNA, 18 bp, Homo sapiens
tccctggccccctccctg

SEQ ID NO: 2875979 - DNA, 22 bp, Homo sapiens
tccctgtgtgtcgttcccttgt

SEQ ID NO: 2875980 - DNA, 17 bp, Homo sapiens
tcccttaatatcctaaa

SEQ ID NO: 2875981 - DNA, 21 bp, Homo sapiens
tcccttaatatcctaaacatc

SEQ ID NO: 2875982 - DNA, 13 bp, Homo sapiens
tcccttgtgtctg

SEQ ID NO: 2875983 - DNA, 17 bp, Homo sapiens
tccctttgttgctgtct

SEQ ID NO: 2875984 - DNA, 13 bp, Homo sapiens
tccgtctcctctc

SEQ ID NO: 2875985 - DNA, 16 bp, Homo sapiens
tcctacccctgtcctg

SEQ ID NO: 2875986 - DNA, 20 bp, Homo sapiens
tcctacccctgtcctggggc

SEQ ID NO: 2875987 - DNA, 16 bp, Homo sapiens
tcctcatctgcaaagc

SEQ ID NO: 2875988 - DNA, 14 bp, Homo sapiens
tcctcctcctcctc

SEQ ID NO: 2875989 - DNA, 17 bp, Homo sapiens
tcctcctgttcctgcct

SEQ ID NO: 2875990 - DNA, 22 bp, Homo sapiens
tcctcctgttcctgccttctct

SEQ ID NO: 2875991 - DNA, 20 bp, Homo sapiens
tcctctcccctctgccctgt

SEQ ID NO: 2875992 - DNA, 21 bp, Homo sapiens
tcctgaggggatatccctatg

SEQ ID NO: 2875993 - DNA, 16 bp, Homo sapiens
tcctgctggcacctca

SEQ ID NO: 2875994 - DNA, 14 bp, Homo sapiens
tcctgtctctgcct

SEQ ID NO: 2875995 - DNA, 15 bp, Homo sapiens
tcctgtctctgcctg

SEQ ID NO: 2875996 - DNA, 16 bp, Homo sapiens
tcctgtgggccaggag

SEQ ID NO: 2875997 - DNA, 18 bp, Homo sapiens
tcctgtgggccaggagct

SEQ ID NO: 2875998 - DNA, 21 bp, Homo sapiens
tcctgtgggccaggagctcag

SEQ ID NO: 2875999 - DNA, 21 bp, Homo sapiens
tccttcaaagtttaataaatt

SEQ ID NO: 2876000 - DNA, 14 bp, Homo sapiens
tccttctcgtcttc

SEQ ID NO: 2876001 - DNA, 18 bp, Homo sapiens
tccttctcgtcttcctct

SEQ ID NO: 2876002 - DNA, 14 bp, Homo sapiens
tcctttgaagagga

SEQ ID NO: 2876003 - DNA, 13 bp, Homo sapiens
tcgatcctggatt

SEQ ID NO: 2876004 - DNA, 18 bp, Homo sapiens
tcgcatccgcctctgagc

SEQ ID NO: 2876005 - DNA, 16 bp, Homo sapiens
tcgctcctcaacccct

SEQ ID NO: 2876006 - DNA, 14 bp, Homo sapiens
tcgtccttcctctc

SEQ ID NO: 2876007 - DNA, 22 bp, Homo sapiens
tcgtgcgcaacaacaaggaccc

SEQ ID NO: 2876008 - DNA, 14 bp, Homo sapiens
tcgttcccttgtgt

SEQ ID NO: 2876009 - DNA, 14 bp, Homo sapiens
tcgttttttacaaa

SEQ ID NO: 2876010 - DNA, 19 bp, Homo sapiens
tctaaagctggtttaatgt

SEQ ID NO: 2876011 - DNA, 16 bp, Homo sapiens
tctataagtgttcagt

SEQ ID NO: 2876012 - DNA, 18 bp, Homo sapiens
tctataagtgttcagtgt

SEQ ID NO: 2876013 - DNA, 19 bp, Homo sapiens
tctataagtgttcagtgtt

SEQ ID NO: 2876014 - DNA, 20 bp, Homo sapiens
tctatagccaaaaatagcta

SEQ ID NO: 2876015 - DNA, 14 bp, Homo sapiens
tctatctatttgag

SEQ ID NO: 2876016 - DNA, 19 bp, Homo sapiens
tctatgcagtattgccaca

SEQ ID NO: 2876017 - DNA, 20 bp, Homo sapiens
tctatgcagtattgccacaa

SEQ ID NO: 2876018 - DNA, 19 bp, Homo sapiens
tctattagttttctttgta

SEQ ID NO: 2876019 - DNA, 19 bp, Homo sapiens
tctcatctcagtgaagaat

SEQ ID NO: 2876020 - DNA, 16 bp, Homo sapiens
tctcatttaagggaaa

SEQ ID NO: 2876021 - DNA, 17 bp, Homo sapiens
tctcatttaagggaaaa

SEQ ID NO: 2876022 - DNA, 19 bp, Homo sapiens
tctcatttaagggaaaaat

SEQ ID NO: 2876023 - DNA, 15 bp, Homo sapiens
tctccatatctcctt

SEQ ID NO: 2876024 - DNA, 16 bp, Homo sapiens
tctcccgaatcctgag

SEQ ID NO: 2876025 - DNA, 18 bp, Homo sapiens
tctccttcccctacacct

SEQ ID NO: 2876026 - DNA, 19 bp, Homo sapiens
tctctttatgtctgtggat

SEQ ID NO: 2876027 - DNA, 21 bp, Homo sapiens
tctctttcttccactaccctc

SEQ ID NO: 2876028 - DNA, 19 bp, Homo sapiens
tctgaatttttaaacaagt

SEQ ID NO: 2876029 - DNA, 15 bp, Homo sapiens
tctgacttcctctga

SEQ ID NO: 2876030 - DNA, 14 bp, Homo sapiens
tctgagccaggagc

SEQ ID NO: 2876031 - DNA, 21 bp, Homo sapiens
ttttaaaaaagcttaaaactt

SEQ ID NO: 2876032 - DNA, 23 bp, Homo sapiens
ttttaaaaaagcttaaaactttg

SEQ ID NO: 2876033 - DNA, 21 bp, Homo sapiens
ttttaaagaagtaaatttgtc

SEQ ID NO: 2876034 - DNA, 12 bp, Homo sapiens
ttttaaagaatt

SEQ ID NO: 2876035 - DNA, 13 bp, Homo sapiens
ttttaaagaattg

SEQ ID NO: 2876036 - DNA, 23 bp, Homo sapiens
ttttatctgaatttttaaacaag

SEQ ID NO: 2876037 - DNA, 14 bp, Homo sapiens
ttttattctgactt

SEQ ID NO: 2876038 - DNA, 13 bp, Homo sapiens
ttttatttaaaaa

SEQ ID NO: 2876039 - DNA, 15 bp, Homo sapiens
ttttctttgtaaagg

SEQ ID NO: 2876040 - DNA, 18 bp, Homo sapiens
ttttctttgtaaaggtca

SEQ ID NO: 2876041 - DNA, 18 bp, Homo sapiens
ttttgcaatcccttaata

SEQ ID NO: 2876042 - DNA, 19 bp, Homo sapiens
ttttgtaagttgaagcaaa

SEQ ID NO: 2876043 - DNA, 21 bp, Homo sapiens
ttttgttgtttcttaaataag

SEQ ID NO: 2876044 - DNA, 12 bp, Homo sapiens
tttttaggccac

SEQ ID NO: 2876045 - DNA, 16 bp, Homo sapiens
tttttcatgataatga

SEQ ID NO: 2876046 - DNA, 19 bp, Homo sapiens
tttttccttcaaagtttaa

SEQ ID NO: 2876047 - DNA, 22 bp, Homo sapiens
tttttccttcaaagtttaataa

SEQ ID NO: 2876048 - DNA, 13 bp, Homo sapiens
tttttgatactaa

SEQ ID NO: 2876049 - DNA, 14 bp, Homo sapiens
aagatacttaagtg

SEQ ID NO: 2876050 - DNA, 16 bp, Homo sapiens
aagatgagaagccaaa

SEQ ID NO: 2876051 - DNA, 17 bp, Homo sapiens
aagatgagaagccaaag

SEQ ID NO: 2876052 - DNA, 18 bp, Homo sapiens
aagatggcagatacagga

SEQ ID NO: 2876053 - DNA, 16 bp, Homo sapiens
aagattttttaataat

SEQ ID NO: 2876054 - DNA, 15 bp, Homo sapiens
aagcaaaaaagaaaa

SEQ ID NO: 2876055 - DNA, 17 bp, Homo sapiens
aagcaaatcgaatgaaa

SEQ ID NO: 2876056 - DNA, 18 bp, Homo sapiens
aagcaaatcgaatgaaat

SEQ ID NO: 2876057 - DNA, 15 bp, Homo sapiens
aagcaacctcagtaa

SEQ ID NO: 2876058 - DNA, 18 bp, Homo sapiens
aagcaacctcagtaattt

SEQ ID NO: 2876059 - DNA, 20 bp, Homo sapiens
aagcaacctcagtaatttag

SEQ ID NO: 2876060 - DNA, 22 bp, Homo sapiens
aagcaacctcagtaatttagaa

SEQ ID NO: 2876061 - DNA, 22 bp, Homo sapiens
aagcagtccagagtctaggcaa

SEQ ID NO: 2876062 - DNA, 12 bp, Homo sapiens
aagccaaaacaa

SEQ ID NO: 2876063 - DNA, 14 bp, Homo sapiens
aagcccagtttccc

SEQ ID NO: 2876064 - DNA, 17 bp, Homo sapiens
aagcccagtttcccttc

SEQ ID NO: 2876065 - DNA, 20 bp, Homo sapiens
aagccccttgtcctctcccg

SEQ ID NO: 2876066 - DNA, 19 bp, Homo sapiens
aagctagaattgagtgttt

SEQ ID NO: 2876067 - DNA, 16 bp, Homo sapiens
aagctggtttaatgtt

SEQ ID NO: 2876068 - DNA, 13 bp, Homo sapiens
aagcttaaaactt

SEQ ID NO: 2876069 - DNA, 15 bp, Homo sapiens
aaggacatgtgctat

SEQ ID NO: 2876070 - DNA, 17 bp, Homo sapiens
aaggagaggaaagaact

SEQ ID NO: 2876071 - DNA, 23 bp, Homo sapiens
aaggatgcttctgctcacattcc

SEQ ID NO: 2876072 - DNA, 16 bp, Homo sapiens
aaggcaagccacagaa

SEQ ID NO: 2876073 - DNA, 15 bp, Homo sapiens
aagggaaaaatatat

SEQ ID NO: 2876074 - DNA, 18 bp, Homo sapiens
aagggggtcaaaggaaga

SEQ ID NO: 2876075 - DNA, 23 bp, Homo sapiens
aagggtgggcatcaaagatgaga

SEQ ID NO: 2876076 - DNA, 18 bp, Homo sapiens
aaggtacaagaagcattt

SEQ ID NO: 2876077 - DNA, 19 bp, Homo sapiens
aaggtacaagaagcatttt

SEQ ID NO: 2876078 - DNA, 17 bp, Homo sapiens
aaggtttatgaaaaaga

SEQ ID NO: 2876079 - DNA, 18 bp, Homo sapiens
aagtaaaagcaaaaaaga

SEQ ID NO: 2876080 - DNA, 15 bp, Homo sapiens
aagtagaaatcatag

SEQ ID NO: 2876081 - DNA, 13 bp, Homo sapiens
aagtagctttgaa

SEQ ID NO: 2876082 - DNA, 19 bp, Homo sapiens
aagtatcatcagtgtagaa

SEQ ID NO: 2876083 - DNA, 19 bp, Homo sapiens
aagtccatagctgagctgg

SEQ ID NO: 2876084 - DNA, 16 bp, Homo sapiens
aagtgatctgtgttca

SEQ ID NO: 2876085 - DNA, 13 bp, Homo sapiens
aagtgttcagtgt

SEQ ID NO: 2876086 - DNA, 17 bp, Homo sapiens
aagtgttcagtgttgac

SEQ ID NO: 2876087 - DNA, 22 bp, Homo sapiens
aagtgttcagtgttgacatagc

SEQ ID NO: 2876088 - DNA, 23 bp, Homo sapiens
aagtgttcagtgttgacatagcc

SEQ ID NO: 2876089 - DNA, 18 bp, Homo sapiens
aagtttaacctaaataat

SEQ ID NO: 2876090 - DNA, 15 bp, Homo sapiens
aagtttcatcatttt

SEQ ID NO: 2876091 - DNA, 11 bp, Homo sapiens
aataaagtgat

SEQ ID NO: 2876092 - DNA, 15 bp, Homo sapiens
aataaagtgatctgt

SEQ ID NO: 2876093 - DNA, 22 bp, Homo sapiens
aataacgtttaagccaaaacaa

SEQ ID NO: 2876094 - DNA, 20 bp, Homo sapiens
aataagtttttgtttcacag

SEQ ID NO: 2876095 - DNA, 21 bp, Homo sapiens
aataatttagacttcaagcat

SEQ ID NO: 2876096 - DNA, 18 bp, Homo sapiens
aatacattgaattagaaa

SEQ ID NO: 2876097 - DNA, 11 bp, Homo sapiens
aatagatgttt

SEQ ID NO: 2876098 - DNA, 19 bp, Homo sapiens
aatagatgtttgatagatt

SEQ ID NO: 2876099 - DNA, 22 bp, Homo sapiens
aatagatgtttgatagattttc

SEQ ID NO: 2876100 - DNA, 18 bp, Homo sapiens
aatagcaaagaattgact

SEQ ID NO: 2876101 - DNA, 20 bp, Homo sapiens
aatatatatctatctatttg

SEQ ID NO: 2876102 - DNA, 18 bp, Homo sapiens
aatcacgctttttgaaaa

SEQ ID NO: 2876103 - DNA, 20 bp, Homo sapiens
aatcacgctttttgaaaaag

SEQ ID NO: 2876104 - DNA, 23 bp, Homo sapiens
aatcagagtggccaatccctgtg

SEQ ID NO: 2876105 - DNA, 21 bp, Homo sapiens
aatcagatagatattcctatt

SEQ ID NO: 2876106 - DNA, 16 bp, Homo sapiens
aatcaggtggcttttg

SEQ ID NO: 2876107 - DNA, 17 bp, Homo sapiens
aatcagtctcagaatgt

SEQ ID NO: 2876108 - DNA, 15 bp, Homo sapiens
aatccactctcagga

SEQ ID NO: 2876109 - DNA, 23 bp, Homo sapiens
aatctggtctgaataacactgga

SEQ ID NO: 2876110 - DNA, 16 bp, Homo sapiens
aatcttttataggatt

SEQ ID NO: 2876111 - DNA, 16 bp, Homo sapiens
aatgaaacaaagagtt

SEQ ID NO: 2876112 - DNA, 18 bp, Homo sapiens
aatgaccagtaattgtga

SEQ ID NO: 2876113 - DNA, 21 bp, Homo sapiens
aatgaccagtaattgtgaaaa

SEQ ID NO: 2876114 - DNA, 14 bp, Homo sapiens
aatgagctgggccc

SEQ ID NO: 2876115 - DNA, 13 bp, Homo sapiens
aatgcctctccca

SEQ ID NO: 2876116 - DNA, 15 bp, Homo sapiens
aatggaaaggagagg

SEQ ID NO: 2876117 - DNA, 17 bp, Homo sapiens
aatggctgataatttta

SEQ ID NO: 2876118 - DNA, 16 bp, Homo sapiens
aatggctgtaaactat

SEQ ID NO: 2876119 - DNA, 19 bp, Homo sapiens
aatgtaaatattttaaaga

SEQ ID NO: 2876120 - DNA, 22 bp, Homo sapiens
aattcaaagctgtgtgtttgga

SEQ ID NO: 2876121 - DNA, 12 bp, Homo sapiens
aattctaaaatg

SEQ ID NO: 2876122 - DNA, 18 bp, Homo sapiens
aattgaatgcaaaccata

SEQ ID NO: 2876123 - DNA, 21 bp, Homo sapiens
aatttagaaatcattttgcaa

SEQ ID NO: 2876124 - DNA, 17 bp, Homo sapiens
aatttagacttcaagca

SEQ ID NO: 2876125 - DNA, 14 bp, Homo sapiens
aatttagtttcata

SEQ ID NO: 2876126 - DNA, 22 bp, Homo sapiens
aatttgtccaatggctgtaaac

SEQ ID NO: 2876127 - DNA, 13 bp, Homo sapiens
aatttttaaacaa

SEQ ID NO: 2876128 - DNA, 13 bp, Homo sapiens
aatttttgatact

SEQ ID NO: 2876129 - DNA, 20 bp, Homo sapiens
acaaactcgttttttacaaa

SEQ ID NO: 2876130 - DNA, 20 bp, Homo sapiens
acaaactgatgcgaaaactt

SEQ ID NO: 2876131 - DNA, 21 bp, Homo sapiens
acaaactgatgcgaaaacttg

SEQ ID NO: 2876132 - DNA, 22 bp, Homo sapiens
acaaactgatgcgaaaacttga

SEQ ID NO: 2876133 - DNA, 18 bp, Homo sapiens
acaaagagttcaagaaat

SEQ ID NO: 2876134 - DNA, 15 bp, Homo sapiens
acaaagcccttttat

SEQ ID NO: 2876135 - DNA, 14 bp, Homo sapiens
acaaatctatgcca

SEQ ID NO: 2876136 - DNA, 12 bp, Homo sapiens
acaacaaggacc

SEQ ID NO: 2876137 - DNA, 22 bp, Homo sapiens
acaactccagccacccagccag

SEQ ID NO: 2876138 - DNA, 12 bp, Homo sapiens
acaaggaaccac

SEQ ID NO: 2876139 - DNA, 19 bp, Homo sapiens
acaaggaccctgttttcca

SEQ ID NO: 2876140 - DNA, 17 bp, Homo sapiens
acaagtatttgttaatt

SEQ ID NO: 2876141 - DNA, 20 bp, Homo sapiens
acaagtatttgttaatttag

SEQ ID NO: 2876142 - DNA, 22 bp, Homo sapiens
acaagtatttgttaatttagaa

SEQ ID NO: 2876143 - DNA, 14 bp, Homo sapiens
acaatccactctca

SEQ ID NO: 2876144 - DNA, 15 bp, Homo sapiens
acaatccactctcag

SEQ ID NO: 2876145 - DNA, 17 bp, Homo sapiens
acaatccactctcagga

SEQ ID NO: 2876146 - DNA, 18 bp, Homo sapiens
acaatccactctcaggag

SEQ ID NO: 2876147 - DNA, 14 bp, Homo sapiens
acaatgcctctccc

SEQ ID NO: 2876148 - DNA, 20 bp, Homo sapiens
acaatgcctctcccacgatg

SEQ ID NO: 2876149 - DNA, 12 bp, Homo sapiens
acaattctaaaa

SEQ ID NO: 2876150 - DNA, 17 bp, Homo sapiens
acaattctaaaatgatt

SEQ ID NO: 2876151 - DNA, 12 bp, Homo sapiens
acacactgtaaa

SEQ ID NO: 2876152 - DNA, 17 bp, Homo sapiens
acaccaacataaaaatg

SEQ ID NO: 2876153 - DNA, 18 bp, Homo sapiens
acaccaacataaaaatga

SEQ ID NO: 2876154 - DNA, 19 bp, Homo sapiens
acaccatcaccctctgggc

SEQ ID NO: 2876155 - DNA, 22 bp, Homo sapiens
acacctccctactcccctgggc

SEQ ID NO: 2876156 - DNA, 17 bp, Homo sapiens
acacctctggatccctg

SEQ ID NO: 2876157 - DNA, 19 bp, Homo sapiens
acacctctggatccctgga

SEQ ID NO: 2876158 - DNA, 23 bp, Homo sapiens
acactgattacttttgggagggg

SEQ ID NO: 2876159 - DNA, 23 bp, Homo sapiens
acagactccctcccctgccccca

SEQ ID NO: 2876160 - DNA, 20 bp, Homo sapiens
acagagggctagggaggtgg

SEQ ID NO: 2876161 - DNA, 14 bp, Homo sapiens
acagataactgaaa

SEQ ID NO: 2876162 - DNA, 21 bp, Homo sapiens
acagcctgtttgggaggctgg

SEQ ID NO: 2876163 - DNA, 22 bp, Homo sapiens
acagcctgtttgggaggctgga

SEQ ID NO: 2876164 - DNA, 22 bp, Homo sapiens
acagtatttattttttcaaaaa

SEQ ID NO: 2876165 - DNA, 12 bp, Homo sapiens
acagtctaaagc

SEQ ID NO: 2876166 - DNA, 12 bp, Homo sapiens
aaaaagcttaaa

SEQ ID NO: 2876167 - DNA, 15 bp, Homo sapiens
aaaaagcttaaaact

SEQ ID NO: 2876168 - DNA, 14 bp, Homo sapiens
aaaaataagaagaa

SEQ ID NO: 2876169 - DNA, 22 bp, Homo sapiens
aaaaataagaagaatgcttaat

SEQ ID NO: 2876170 - DNA, 14 bp, Homo sapiens
aaaaatagtttgga

SEQ ID NO: 2876171 - DNA, 18 bp, Homo sapiens
aaaaatgtccagccaccc

SEQ ID NO: 2876172 - DNA, 22 bp, Homo sapiens
aaaacacagtgcactcagagct

SEQ ID NO: 2876173 - DNA, 17 bp, Homo sapiens
aaaacatttactgacca

SEQ ID NO: 2876174 - DNA, 20 bp, Homo sapiens
aaaaccataaaataaatttt

SEQ ID NO: 2876175 - DNA, 16 bp, Homo sapiens
aaaactaaaaactaga

SEQ ID NO: 2876176 - DNA, 14 bp, Homo sapiens
aaaagttgcagtct

SEQ ID NO: 2876177 - DNA, 17 bp, Homo sapiens
aaaagttgcagtctcag

SEQ ID NO: 2876178 - DNA, 21 bp, Homo sapiens
aaaagtttaacctaaataatt

SEQ ID NO: 2876179 - DNA, 14 bp, Homo sapiens
aaaattgaatgcaa

SEQ ID NO: 2876180 - DNA, 20 bp, Homo sapiens
aaacaaactcgttttttaca

SEQ ID NO: 2876181 - DNA, 16 bp, Homo sapiens
aaacaaggttttcagt

SEQ ID NO: 2876182 - DNA, 12 bp, Homo sapiens
aaacaagtattt

SEQ ID NO: 2876183 - DNA, 22 bp, Homo sapiens
aaacaagtatttgttaatttag

SEQ ID NO: 2876184 - DNA, 16 bp, Homo sapiens
aaacatgctagtgata

SEQ ID NO: 2876185 - DNA, 21 bp, Homo sapiens
aaacatttattttgacataaa

SEQ ID NO: 2876186 - DNA, 17 bp, Homo sapiens
aaacctttcttcaccaa

SEQ ID NO: 2876187 - DNA, 12 bp, Homo sapiens
aaactactgtaa

SEQ ID NO: 2876188 - DNA, 19 bp, Homo sapiens
aaactactgtaattaagtg

SEQ ID NO: 2876189 - DNA, 17 bp, Homo sapiens
aaactataaactactgt

SEQ ID NO: 2876190 - DNA, 18 bp, Homo sapiens
aaactataaactactgta

SEQ ID NO: 2876191 - DNA, 19 bp, Homo sapiens
aaactataaactactgtaa

SEQ ID NO: 2876192 - DNA, 16 bp, Homo sapiens
aaactcgttttttaca

SEQ ID NO: 2876193 - DNA, 20 bp, Homo sapiens
aaactgatgcgaaaacttga

SEQ ID NO: 2876194 - DNA, 14 bp, Homo sapiens
aaacttgaatctgt

SEQ ID NO: 2876195 - DNA, 22 bp, Homo sapiens
aaactttaaagcgtttgcacag

SEQ ID NO: 2876196 - DNA, 13 bp, Homo sapiens
cagcttcctgtgg

SEQ ID NO: 2876197 - DNA, 19 bp, Homo sapiens
caggacagctgcttctgtg

SEQ ID NO: 2876198 - DNA, 14 bp, Homo sapiens
caggacgccactca

SEQ ID NO: 2876199 - DNA, 13 bp, Homo sapiens
caggagctcagcc

SEQ ID NO: 2876200 - DNA, 16 bp, Homo sapiens
caggaggcgcagcccg

SEQ ID NO: 2876201 - DNA, 23 bp, Homo sapiens
caggatggggtatggattctaaa

SEQ ID NO: 2876202 - DNA, 15 bp, Homo sapiens
caggcaccaaaagaa

SEQ ID NO: 2876203 - DNA, 18 bp, Homo sapiens
caggcatggcccagcctg

SEQ ID NO: 2876204 - DNA, 22 bp, Homo sapiens
caggcatggcccagcctggagc

SEQ ID NO: 2876205 - DNA, 17 bp, Homo sapiens
caggcttgggctccatt

SEQ ID NO: 2876206 - DNA, 21 bp, Homo sapiens
caggcttgggctccattccca

SEQ ID NO: 2876207 - DNA, 12 bp, Homo sapiens
cagggcctggcc

SEQ ID NO: 2876208 - DNA, 13 bp, Homo sapiens
cagggcctggcct

SEQ ID NO: 2876209 - DNA, 18 bp, Homo sapiens
caggtcctttccttctcg

SEQ ID NO: 2876210 - DNA, 16 bp, Homo sapiens
cagtaattgtgaaaat

SEQ ID NO: 2876211 - DNA, 18 bp, Homo sapiens
cagtaggttgaggacagg

SEQ ID NO: 2876212 - DNA, 20 bp, Homo sapiens
cagtattgccacaatgcctc

SEQ ID NO: 2876213 - DNA, 23 bp, Homo sapiens
cagtcaagttccgtctcctctcc

SEQ ID NO: 2876214 - DNA, 11 bp, Homo sapiens
cagtcctgcaa

SEQ ID NO: 2876215 - DNA, 21 bp, Homo sapiens
cagtctcagaatgtcattttg

SEQ ID NO: 2876216 - DNA, 14 bp, Homo sapiens
cagtgacctgaccg

SEQ ID NO: 2876217 - DNA, 20 bp, Homo sapiens
cagtgacctgaccggcacct

SEQ ID NO: 2876218 - DNA, 21 bp, Homo sapiens
cagtgacctgaccggcacctg

SEQ ID NO: 2876219 - DNA, 20 bp, Homo sapiens
cagtgattgtcttaatattg

SEQ ID NO: 2876220 - DNA, 13 bp, Homo sapiens
cagtgttgacata

SEQ ID NO: 2876221 - DNA, 14 bp, Homo sapiens
cagtgttgacatag

SEQ ID NO: 2876222 - DNA, 15 bp, Homo sapiens
cagtgttgacatagc

SEQ ID NO: 2876223 - DNA, 19 bp, Homo sapiens
cagtgttgacatagccttt

SEQ ID NO: 2876224 - DNA, 21 bp, Homo sapiens
cataaagttgataaagatttt

SEQ ID NO: 2876225 - DNA, 18 bp, Homo sapiens
cataaataaaatgaccag

SEQ ID NO: 2876226 - DNA, 22 bp, Homo sapiens
cataatttagtttcatataaag

SEQ ID NO: 2876227 - DNA, 15 bp, Homo sapiens
cataccttggactga

SEQ ID NO: 2876228 - DNA, 12 bp, Homo sapiens
catagcctttgt

SEQ ID NO: 2876229 - DNA, 14 bp, Homo sapiens
catagcctttgtgc

SEQ ID NO: 2876230 - DNA, 14 bp, Homo sapiens
catatctccttccc

SEQ ID NO: 2876231 - DNA, 17 bp, Homo sapiens
catcaccctctgggcag

SEQ ID NO: 2876232 - DNA, 17 bp, Homo sapiens
catcactgctgtccctc

SEQ ID NO: 2876233 - DNA, 20 bp, Homo sapiens
catcactgctgtccctcctg

SEQ ID NO: 2876234 - DNA, 13 bp, Homo sapiens
catccctggcccc

SEQ ID NO: 2876235 - DNA, 21 bp, Homo sapiens
catccctggccccctccctgg

SEQ ID NO: 2876236 - DNA, 15 bp, Homo sapiens
catcgaacaaactga

SEQ ID NO: 2876237 - DNA, 15 bp, Homo sapiens
catcgtccttcctct

SEQ ID NO: 2876238 - DNA, 21 bp, Homo sapiens
catctcagtgaagaatacttc

SEQ ID NO: 2876239 - DNA, 21 bp, Homo sapiens
catctcatttaagggaaaaat

SEQ ID NO: 2876240 - DNA, 13 bp, Homo sapiens
catcttctggctt

SEQ ID NO: 2876241 - DNA, 22 bp, Homo sapiens
catgactgtgtgttgtgaaata

SEQ ID NO: 2876242 - DNA, 22 bp, Homo sapiens
catgatcttgagatttctttta

SEQ ID NO: 2876243 - DNA, 21 bp, Homo sapiens
catgccaataaagtgatctgt

SEQ ID NO: 2876244 - DNA, 18 bp, Homo sapiens
catgccaggctaattttt

SEQ ID NO: 2876245 - DNA, 12 bp, Homo sapiens
agcctcctgacc

SEQ ID NO: 2876246 - DNA, 19 bp, Homo sapiens
agcctggttccctctttcc

SEQ ID NO: 2876247 - DNA, 18 bp, Homo sapiens
agcctgtgggagtagaaa

SEQ ID NO: 2876248 - DNA, 18 bp, Homo sapiens
agcctgtttgggaggctg

SEQ ID NO: 2876249 - DNA, 20 bp, Homo sapiens
agcgaagggggtcaaaggaa

SEQ ID NO: 2876250 - DNA, 13 bp, Homo sapiens
agcgcctccctcc

SEQ ID NO: 2876251 - DNA, 20 bp, Homo sapiens
agcgcctccctccaccccag

SEQ ID NO: 2876252 - DNA, 21 bp, Homo sapiens
agcgcctccctccaccccagg

SEQ ID NO: 2876253 - DNA, 20 bp, Homo sapiens
agctagaattgagtgtttaa

SEQ ID NO: 2876254 - DNA, 23 bp, Homo sapiens
agctcagacttgccaggctccct

SEQ ID NO: 2876255 - DNA, 19 bp, Homo sapiens
agctgtcatggaaaagccc

SEQ ID NO: 2876256 - DNA, 22 bp, Homo sapiens
agctgtcatggaaaagcccagt

SEQ ID NO: 2876257 - DNA, 22 bp, Homo sapiens
agctgtgtgtttggaagactat

SEQ ID NO: 2876258 - DNA, 22 bp, Homo sapiens
agcttcctgtgggccaggagct

SEQ ID NO: 2876259 - DNA, 16 bp, Homo sapiens
aggaaaattgaatgca

SEQ ID NO: 2876260 - DNA, 15 bp, Homo sapiens
aggaagcaagcttaa

SEQ ID NO: 2876261 - DNA, 16 bp, Homo sapiens
aggacgccactcattt

SEQ ID NO: 2876262 - DNA, 17 bp, Homo sapiens
aggacgccactcatttc

SEQ ID NO: 2876263 - DNA, 18 bp, Homo sapiens
aggacgccactcatttca

SEQ ID NO: 2876264 - DNA, 20 bp, Homo sapiens
aggacgccactcatttcatc

SEQ ID NO: 2876265 - DNA, 15 bp, Homo sapiens
aggactctctttctt

SEQ ID NO: 2876266 - DNA, 17 bp, Homo sapiens
aggaggcgcagcccgaa

SEQ ID NO: 2876267 - DNA, 22 bp, Homo sapiens
aggaggcgcagcccgaagccca

SEQ ID NO: 2876268 - DNA, 23 bp, Homo sapiens
aggagtagaatataaacacataa

SEQ ID NO: 2876269 - DNA, 22 bp, Homo sapiens
aggcaaaaatgtccagccaccc

SEQ ID NO: 2876270 - DNA, 15 bp, Homo sapiens
aggcaagccacagaa

SEQ ID NO: 2876271 - DNA, 18 bp, Homo sapiens
aggcaccaaaagaagtaa

SEQ ID NO: 2876272 - DNA, 21 bp, Homo sapiens
aggcagacaaccttgtcccaa

SEQ ID NO: 2876273 - DNA, 20 bp, Homo sapiens
aggcatctgttagcagagtc

SEQ ID NO: 2876274 - DNA, 19 bp, Homo sapiens
aggcatgcgaatgagctgg

SEQ ID NO: 2876275 - DNA, 20 bp, Homo sapiens
aggcatgcgaatgagctggg

SEQ ID NO: 2876276 - DNA, 19 bp, Homo sapiens
aggcatggcccagcctgga

SEQ ID NO: 2876277 - DNA, 20 bp, Homo sapiens
aggccacctccaaggactct

SEQ ID NO: 2876278 - DNA, 23 bp, Homo sapiens
aggctaatttttttgtattttag

SEQ ID NO: 2876279 - DNA, 12 bp, Homo sapiens
agggcctggcct

SEQ ID NO: 2876280 - DNA, 15 bp, Homo sapiens
agggcctggcctggt

SEQ ID NO: 2876281 - DNA, 20 bp, Homo sapiens
agggctagggaggtggggta

SEQ ID NO: 2876282 - DNA, 17 bp, Homo sapiens
agggctccagggccagg

SEQ ID NO: 2876283 - DNA, 15 bp, Homo sapiens
aggggcctggcctgg

SEQ ID NO: 2876284 - DNA, 20 bp, Homo sapiens
aggggctgtccaatcacatt

SEQ ID NO: 2876285 - DNA, 15 bp, Homo sapiens
aggggcttcctgggt

SEQ ID NO: 2876286 - DNA, 14 bp, Homo sapiens
agggtgggagccta

SEQ ID NO: 2876287 - DNA, 18 bp, Homo sapiens
aggtcacagctaataagt

SEQ ID NO: 2876288 - DNA, 16 bp, Homo sapiens
aggtccctgcttacct

SEQ ID NO: 2876289 - DNA, 14 bp, Homo sapiens
aggtctgagccctg

SEQ ID NO: 2876290 - DNA, 15 bp, Homo sapiens
aggtctgagccctgg

SEQ ID NO: 2876291 - DNA, 13 bp, Homo sapiens
aggtgagaaattt

SEQ ID NO: 2876292 - DNA, 16 bp, Homo sapiens
aggtgggggtctggcc

SEQ ID NO: 2876293 - DNA, 10 bp, Homo sapiens
aggttttcag

SEQ ID NO: 2876294 - DNA, 23 bp, Homo sapiens
agtaatttagaaatcattttgca

SEQ ID NO: 2876295 - DNA, 19 bp, Homo sapiens
agtagaaaaatctcattcc

SEQ ID NO: 2876296 - DNA, 12 bp, Homo sapiens
agtagaaatcat

SEQ ID NO: 2876297 - DNA, 16 bp, Homo sapiens
agtagggttgccagtc

SEQ ID NO: 2876298 - DNA, 22 bp, Homo sapiens
agtattgccacaatgcctctcc

SEQ ID NO: 2876299 - DNA, 18 bp, Homo sapiens
agtatttgttaatttaga

SEQ ID NO: 2876300 - DNA, 20 bp, Homo sapiens
agtcaagttccgtctcctct

SEQ ID NO: 2876301 - DNA, 21 bp, Homo sapiens
agtcagggtgggaagaaagaa

SEQ ID NO: 2876302 - DNA, 16 bp, Homo sapiens
agtcctgtctctgcct

SEQ ID NO: 2876303 - DNA, 18 bp, Homo sapiens
agtctcagaaagccttcc

SEQ ID NO: 2876304 - DNA, 19 bp, Homo sapiens
agtctcagaaagccttcca

SEQ ID NO: 2876305 - DNA, 14 bp, Homo sapiens
agtctcctgacatt

SEQ ID NO: 2876306 - DNA, 13 bp, Homo sapiens
atggattctaaaa

SEQ ID NO: 2876307 - DNA, 14 bp, Homo sapiens
atggattctaaaat

SEQ ID NO: 2876308 - DNA, 17 bp, Homo sapiens
atggcctgagaagagag

SEQ ID NO: 2876309 - DNA, 13 bp, Homo sapiens
atgggtgtgccct

SEQ ID NO: 2876310 - DNA, 20 bp, Homo sapiens
atgggtgtgcccttggggta

SEQ ID NO: 2876311 - DNA, 23 bp, Homo sapiens
atggtcacgaggtccagacccac

SEQ ID NO: 2876312 - DNA, 13 bp, Homo sapiens
atgtaaatatttt

SEQ ID NO: 2876313 - DNA, 23 bp, Homo sapiens
atgtaaatattttaaagaattgt

SEQ ID NO: 2876314 - DNA, 17 bp, Homo sapiens
atgtatctggttaatga

SEQ ID NO: 2876315 - DNA, 16 bp, Homo sapiens
atgtcaaggactcctg

SEQ ID NO: 2876316 - DNA, 14 bp, Homo sapiens
atgtccagccaccc

SEQ ID NO: 2876317 - DNA, 21 bp, Homo sapiens
atgtgctattgaactgagcca

SEQ ID NO: 2876318 - DNA, 19 bp, Homo sapiens
atgttaaaaaaataagaag

SEQ ID NO: 2876319 - DNA, 19 bp, Homo sapiens
atgttatttgtaatagatg

SEQ ID NO: 2876320 - DNA, 16 bp, Homo sapiens
atgtttatacaataat

SEQ ID NO: 2876321 - DNA, 20 bp, Homo sapiens
attaaagaagggttgagctg

SEQ ID NO: 2876322 - DNA, 22 bp, Homo sapiens
attaactgggtaatgaaacaaa

SEQ ID NO: 2876323 - DNA, 17 bp, Homo sapiens
attagaaacataaataa

SEQ ID NO: 2876324 - DNA, 22 bp, Homo sapiens
attatttaaaccgctaaaagaa

SEQ ID NO: 2876325 - DNA, 16 bp, Homo sapiens
attcaagaaagtgaaa

SEQ ID NO: 2876326 - DNA, 17 bp, Homo sapiens
attcagaagaaaaagaa

SEQ ID NO: 2876327 - DNA, 16 bp, Homo sapiens
attcccatcactgctg

SEQ ID NO: 2876328 - DNA, 12 bp, Homo sapiens
attccctggaga

SEQ ID NO: 2876329 - DNA, 22 bp, Homo sapiens
attcctattgtgcaatgtaaat

SEQ ID NO: 2876330 - DNA, 13 bp, Homo sapiens
attccttcactca

SEQ ID NO: 2876331 - DNA, 17 bp, Homo sapiens
attccttcactcatcca

SEQ ID NO: 2876332 - DNA, 16 bp, Homo sapiens
attcctttgaagagga

SEQ ID NO: 2876333 - DNA, 18 bp, Homo sapiens
attcctttgaagaggaaa

SEQ ID NO: 2876334 - DNA, 20 bp, Homo sapiens
attcctttgaagaggaaaat

SEQ ID NO: 2876335 - DNA, 17 bp, Homo sapiens
attctgatacagcctta

SEQ ID NO: 2876336 - DNA, 17 bp, Homo sapiens
attctgcaacagcctgt

SEQ ID NO: 2876337 - DNA, 14 bp, Homo sapiens
attgaagtcctcca

SEQ ID NO: 2876338 - DNA, 20 bp, Homo sapiens
attgtgcaatgtaaatattt

SEQ ID NO: 2876339 - DNA, 17 bp, Homo sapiens
atttaaaaaactaaaaa

SEQ ID NO: 2876340 - DNA, 18 bp, Homo sapiens
atttaaaatagcaaaaga

SEQ ID NO: 2876341 - DNA, 22 bp, Homo sapiens
atttaaaatagcaaaagaagaa

SEQ ID NO: 2876342 - DNA, 20 bp, Homo sapiens
atttaaaccgctaaaagaaa

SEQ ID NO: 2876343 - DNA, 21 bp, Homo sapiens
atttaaaccgctaaaagaaac

SEQ ID NO: 2876344 - DNA, 17 bp, Homo sapiens
atttaatagcaaagaat

SEQ ID NO: 2876345 - DNA, 18 bp, Homo sapiens
atttaatagcaaagaatt

SEQ ID NO: 2876346 - DNA, 18 bp, Homo sapiens
atttatgattattcaaga

SEQ ID NO: 2876347 - DNA, 14 bp, Homo sapiens
atttatttaaaata

SEQ ID NO: 2876348 - DNA, 12 bp, Homo sapiens
atttattttgac

SEQ ID NO: 2876349 - DNA, 19 bp, Homo sapiens
atttcacaacagcctgaca

SEQ ID NO: 2876350 - DNA, 23 bp, Homo sapiens
atttcatctcatttaagggaaaa

SEQ ID NO: 2876351 - DNA, 17 bp, Homo sapiens
atttcttttaaagaagt

SEQ ID NO: 2876352 - DNA, 18 bp, Homo sapiens
atttcttttaaagaagta

SEQ ID NO: 2876353 - DNA, 21 bp, Homo sapiens
atttcttttaaagaagtaaat

SEQ ID NO: 2876354 - DNA, 21 bp, Homo sapiens
atttgtccaatggctgtaaac

SEQ ID NO: 2876355 - DNA, 13 bp, Homo sapiens
atttgtggtcaca

SEQ ID NO: 2876356 - DNA, 23 bp, Homo sapiens
atttgttaatttagaaaacttta

SEQ ID NO: 2876357 - DNA, 13 bp, Homo sapiens
attttagcagaga

SEQ ID NO: 2876358 - DNA, 15 bp, Homo sapiens
attttatattacact

SEQ ID NO: 2876359 - DNA, 17 bp, Homo sapiens
attttgacataaagttg

SEQ ID NO: 2876360 - DNA, 13 bp, Homo sapiens
atttttaaacaag

SEQ ID NO: 2876361 - DNA, 14 bp, Homo sapiens
atttttaaacaagt

SEQ ID NO: 2876362 - DNA, 21 bp, Homo sapiens
atttttgatactaagcattga

SEQ ID NO: 2876363 - DNA, 14 bp, Homo sapiens
attttttaataatt

SEQ ID NO: 2876364 - DNA, 23 bp, Homo sapiens
attttttccttcaaagtttaata

SEQ ID NO: 2876365 - DNA, 12 bp, Homo sapiens
caaaaaagaaaa

SEQ ID NO: 2876366 - DNA, 14 bp, Homo sapiens
caaaaaagaaaacc

SEQ ID NO: 2876367 - DNA, 14 bp, Homo sapiens
caaaaatagctaaa

SEQ ID NO: 2876368 - DNA, 20 bp, Homo sapiens
caaaagaagaagtttcatca

SEQ ID NO: 2876369 - DNA, 17 bp, Homo sapiens
caaaagaagtaaaagca

SEQ ID NO: 2876370 - DNA, 14 bp, Homo sapiens
caaaagtgatctgt

SEQ ID NO: 2876371 - DNA, 21 bp, Homo sapiens
caaaatttcaaaagtgatctg

SEQ ID NO: 2876372 - DNA, 22 bp, Homo sapiens
cccaagaggtctgagccctggt

SEQ ID NO: 2876373 - DNA, 13 bp, Homo sapiens
cccagagtcagag

SEQ ID NO: 2876374 - DNA, 20 bp, Homo sapiens
cccagccccgactccagcca

SEQ ID NO: 2876375 - DNA, 13 bp, Homo sapiens
cccaggacgccac

SEQ ID NO: 2876376 - DNA, 22 bp, Homo sapiens
cccaggcatctgttagcagagt

SEQ ID NO: 2876377 - DNA, 13 bp, Homo sapiens
cccaggtccttcc

SEQ ID NO: 2876378 - DNA, 17 bp, Homo sapiens
cccagtaaagataccat

SEQ ID NO: 2876379 - DNA, 15 bp, Homo sapiens
cccagtgacctgacc

SEQ ID NO: 2876380 - DNA, 17 bp, Homo sapiens
ccccacacctccctact

SEQ ID NO: 2876381 - DNA, 17 bp, Homo sapiens
ccccagccccgactcca

SEQ ID NO: 2876382 - DNA, 18 bp, Homo sapiens
ccccagccccgactccag

SEQ ID NO: 2876383 - DNA, 12 bp, Homo sapiens
ccccaggacgcc

SEQ ID NO: 2876384 - DNA, 23 bp, Homo sapiens
ccccaggcatctgttagcagagt

SEQ ID NO: 2876385 - DNA, 16 bp, Homo sapiens
ccccctcccaccccca

SEQ ID NO: 2876386 - DNA, 13 bp, Homo sapiens
ccccctccctgga

SEQ ID NO: 2876387 - DNA, 13 bp, Homo sapiens
ccccgactccagc

SEQ ID NO: 2876388 - DNA, 16 bp, Homo sapiens
ccccgactccagccag

SEQ ID NO: 2876389 - DNA, 17 bp, Homo sapiens
cccctacaactccagcc

SEQ ID NO: 2876390 - DNA, 13 bp, Homo sapiens
cccctctgccctg

SEQ ID NO: 2876391 - DNA, 17 bp, Homo sapiens
cccctctgccctgtata

SEQ ID NO: 2876392 - DNA, 16 bp, Homo sapiens
cccctctgtgtcctct

SEQ ID NO: 2876393 - DNA, 21 bp, Homo sapiens
cccctctttgcacagcatgag

SEQ ID NO: 2876394 - DNA, 17 bp, Homo sapiens
cccgactccagccagcg

SEQ ID NO: 2876395 - DNA, 16 bp, Homo sapiens
cccgcgggcctggaca

SEQ ID NO: 2876396 - DNA, 19 bp, Homo sapiens
ccctagatggttccctttg

SEQ ID NO: 2876397 - DNA, 14 bp, Homo sapiens
ccctatgtcccagc

SEQ ID NO: 2876398 - DNA, 15 bp, Homo sapiens
ccctatgtcccagcc

SEQ ID NO: 2876399 - DNA, 12 bp, Homo sapiens
ccctccatccct

SEQ ID NO: 2876400 - DNA, 17 bp, Homo sapiens
ccctccatccctggccc

SEQ ID NO: 2876401 - DNA, 16 bp, Homo sapiens
ccctcccacccccagc

SEQ ID NO: 2876402 - DNA, 21 bp, Homo sapiens
ccctccccacacctccctact

SEQ ID NO: 2876403 - DNA, 13 bp, Homo sapiens
ccctctgccctgt

SEQ ID NO: 2876404 - DNA, 14 bp, Homo sapiens
ccctctgccctgta

SEQ ID NO: 2876405 - DNA, 17 bp, Homo sapiens
ccctctgccctgtatat

SEQ ID NO: 2876406 - DNA, 13 bp, Homo sapiens
ccctctttcctgt

SEQ ID NO: 2876407 - DNA, 19 bp, Homo sapiens
ccctctttgcacagcatga

SEQ ID NO: 2876408 - DNA, 20 bp, Homo sapiens
ccctctttgcacagcatgag

SEQ ID NO: 2876409 - DNA, 17 bp, Homo sapiens
ccctgctactcctgtgc

SEQ ID NO: 2876410 - DNA, 21 bp, Homo sapiens
ccctgctactcctgtgctctg

SEQ ID NO: 2876411 - DNA, 16 bp, Homo sapiens
ccctgcttacctgacg

SEQ ID NO: 2876412 - DNA, 12 bp, Homo sapiens
ccctggaggggc

SEQ ID NO: 2876413 - DNA, 19 bp, Homo sapiens
ccctgggcatcttctggct

SEQ ID NO: 2876414 - DNA, 13 bp, Homo sapiens
ccctgtagctctg

SEQ ID NO: 2876415 - DNA, 18 bp, Homo sapiens
ccctgtagctctgcctcc

SEQ ID NO: 2876416 - DNA, 20 bp, Homo sapiens
ccctgtgtgtcgttcccttg

SEQ ID NO: 2876417 - DNA, 13 bp, Homo sapiens
cccttaacctaaa

SEQ ID NO: 2876418 - DNA, 21 bp, Homo sapiens
cacccccagccccgactccag

SEQ ID NO: 2876419 - DNA, 23 bp, Homo sapiens
cacccccagccccgactccagcc

SEQ ID NO: 2876420 - DNA, 14 bp, Homo sapiens
caccctctgggcag

SEQ ID NO: 2876421 - DNA, 24 bp, Homo sapiens
caccgtgcccagccctaaacatca

SEQ ID NO: 2876422 - DNA, 15 bp, Homo sapiens
cacctacttcctcct

SEQ ID NO: 2876423 - DNA, 17 bp, Homo sapiens
cacctctggatccctgg

SEQ ID NO: 2876424 - DNA, 22 bp, Homo sapiens
cacctgcgagaggtccctgctt

SEQ ID NO: 2876425 - DNA, 21 bp, Homo sapiens
cacgatgtcaaggactcctgt

SEQ ID NO: 2876426 - DNA, 15 bp, Homo sapiens
cactcactcactcat

SEQ ID NO: 2876427 - DNA, 12 bp, Homo sapiens
cactcatttcat

SEQ ID NO: 2876428 - DNA, 17 bp, Homo sapiens
cactcatttcatctcat

SEQ ID NO: 2876429 - DNA, 20 bp, Homo sapiens
cactccctaagaaaccccag

SEQ ID NO: 2876430 - DNA, 22 bp, Homo sapiens
cactgaaccttgttgatgccag

SEQ ID NO: 2876431 - DNA, 21 bp, Homo sapiens
cactgattacttttgggaggg

SEQ ID NO: 2876432 - DNA, 18 bp, Homo sapiens
cactgggccggcagcctg

SEQ ID NO: 2876433 - DNA, 19 bp, Homo sapiens
cactgggccggcagcctgg

SEQ ID NO: 2876434 - DNA, 20 bp, Homo sapiens
cactgggccggcagcctggt

SEQ ID NO: 2876435 - DNA, 21 bp, Homo sapiens
cactgggccggcagcctggtt

SEQ ID NO: 2876436 - DNA, 17 bp, Homo sapiens
cactgttgggtgggtgg

SEQ ID NO: 2876437 - DNA, 16 bp, Homo sapiens
cacttagcccaagagg

SEQ ID NO: 2876438 - DNA, 16 bp, Homo sapiens
cacttcccatttgtgt

SEQ ID NO: 2876439 - DNA, 13 bp, Homo sapiens
cagaaagccttcc

SEQ ID NO: 2876440 - DNA, 16 bp, Homo sapiens
cagaacatagacagaa

SEQ ID NO: 2876441 - DNA, 22 bp, Homo sapiens
cagaagaaaaagttgcagtctc

SEQ ID NO: 2876442 - DNA, 22 bp, Homo sapiens
cagaataaatgggtaacactga

SEQ ID NO: 2876443 - DNA, 21 bp, Homo sapiens
cagaatgtcattttggtactt

SEQ ID NO: 2876444 - DNA, 17 bp, Homo sapiens
cagacaaccttgtccca

SEQ ID NO: 2876445 - DNA, 18 bp, Homo sapiens
cagacaaccttgtcccaa

SEQ ID NO: 2876446 - DNA, 21 bp, Homo sapiens
cagacaaccttgtcccaagga

SEQ ID NO: 2876447 - DNA, 13 bp, Homo sapiens
cagacaatccact

SEQ ID NO: 2876448 - DNA, 19 bp, Homo sapiens
cagacaatccactctcagg

SEQ ID NO: 2876449 - DNA, 20 bp, Homo sapiens
cagacaatccactctcagga

SEQ ID NO: 2876450 - DNA, 22 bp, Homo sapiens
cagacaatccactctcaggagg

SEQ ID NO: 2876451 - DNA, 18 bp, Homo sapiens
cagactccttcaacaatt

SEQ ID NO: 2876452 - DNA, 20 bp, Homo sapiens
cagagcctggggtgttctct

SEQ ID NO: 2876453 - DNA, 14 bp, Homo sapiens
cagagggctaggga

SEQ ID NO: 2876454 - DNA, 17 bp, Homo sapiens
cagagtcagaggagaag

SEQ ID NO: 2876455 - DNA, 19 bp, Homo sapiens
cagagtcagaggagaagag

SEQ ID NO: 2876456 - DNA, 15 bp, Homo sapiens
cagagtctgtctctt

SEQ ID NO: 2876457 - DNA, 20 bp, Homo sapiens
cagagtggccaatccctgtg

SEQ ID NO: 2876458 - DNA, 19 bp, Homo sapiens
cagcaggccagggactcag

SEQ ID NO: 2876459 - DNA, 18 bp, Homo sapiens
cagcagggcaggaagggg

SEQ ID NO: 2876460 - DNA, 14 bp, Homo sapiens
cagcataccttgga

SEQ ID NO: 2876461 - DNA, 21 bp, Homo sapiens
cagccacagtgttatgctctg

SEQ ID NO: 2876462 - DNA, 16 bp, Homo sapiens
cagccagcgcctccct

SEQ ID NO: 2876463 - DNA, 21 bp, Homo sapiens
cagccagcgcctccctccacc

SEQ ID NO: 2876464 - DNA, 11 bp, Homo sapiens
cagccaggagg

SEQ ID NO: 2876465 - DNA, 13 bp, Homo sapiens
cagccaggagggg

SEQ ID NO: 2876466 - DNA, 16 bp, Homo sapiens
cagccatgaagtcacc

SEQ ID NO: 2876467 - DNA, 20 bp, Homo sapiens
cagccccgactccagccagc

SEQ ID NO: 2876468 - DNA, 21 bp, Homo sapiens
cagccccgactccagccagcg

SEQ ID NO: 2876469 - DNA, 13 bp, Homo sapiens
cagcccgaagccc

SEQ ID NO: 2876470 - DNA, 17 bp, Homo sapiens
cagcctggttccctctt

SEQ ID NO: 2876471 - DNA, 19 bp, Homo sapiens
cagcctggttccctctttc

SEQ ID NO: 2876472 - DNA, 18 bp, Homo sapiens
cagcgcctccctccaccc

SEQ ID NO: 2876473 - DNA, 21 bp, Homo sapiens
cagcgcctccctccaccccag

SEQ ID NO: 2876474 - DNA, 22 bp, Homo sapiens
cagcgcctccctccaccccagg

SEQ ID NO: 2876475 - DNA, 23 bp, Homo sapiens
cagcgcctccctccaccccagga

SEQ ID NO: 2876476 - DNA, 22 bp, Homo sapiens
cagcgtcccctgctactcctgt

SEQ ID NO: 2876477 - DNA, 18 bp, Homo sapiens
cagctaactccagtctcc

SEQ ID NO: 2876478 - DNA, 23 bp, Homo sapiens
cagctaactccagtctcctgaca

SEQ ID NO: 2876479 - DNA, 20 bp, Homo sapiens
cagctctagttttcagcctt

SEQ ID NO: 2876480 - DNA, 15 bp, Homo sapiens
cagctgagagccctg

SEQ ID NO: 2876481 - DNA, 13 bp, Homo sapiens
cagctgcttctgt

SEQ ID NO: 2876482 - DNA, 15 bp, Homo sapiens
cagctgtactgagtt

SEQ ID NO: 2876483 - DNA, 15 bp, Homo sapiens
cagctgtcatggaaa

SEQ ID NO: 2876484 - DNA, 22 bp, Homo sapiens
cagctgtcatggaaaagcccag

SEQ ID NO: 2876485 - DNA, 23 bp, Homo sapiens
cagctgtcatggaaaagcccagt

SEQ ID NO: 2876486 - DNA, 13 bp, Homo sapiens
tggcatgtggaga

SEQ ID NO: 2876487 - DNA, 22 bp, Homo sapiens
tggccaatgcacctaaagaaaa

SEQ ID NO: 2876488 - DNA, 13 bp, Homo sapiens
tggcccagcctgg

SEQ ID NO: 2876489 - DNA, 16 bp, Homo sapiens
tggcccagcctggagc

SEQ ID NO: 2876490 - DNA, 17 bp, Homo sapiens
tctcaagctagccagag

SEQ ID NO: 2876491 - DNA, 14 bp, Homo sapiens
tctcactaaatctt

SEQ ID NO: 2876492 - DNA, 16 bp, Homo sapiens
tctcactggcatcttg

SEQ ID NO: 2876493 - DNA, 16 bp, Homo sapiens
tctcagtgaagaatac

SEQ ID NO: 2876494 - DNA, 20 bp, Homo sapiens
tctcatccaggtcctttcct

SEQ ID NO: 2876495 - DNA, 20 bp, Homo sapiens
tctcatctcagtgaagaata

SEQ ID NO: 2876496 - DNA, 10 bp, Homo sapiens
tctcattccc

SEQ ID NO: 2876497 - DNA, 20 bp, Homo sapiens
ctgaaccttgttgatgccag

SEQ ID NO: 2876498 - DNA, 22 bp, Homo sapiens
ctgaatgtgcctaatggagaag

SEQ ID NO: 2876499 - DNA, 23 bp, Homo sapiens
ctgaatgtgcctaatggagaaga

SEQ ID NO: 2876500 - DNA, 11 bp, Homo sapiens
ctgaattttta

SEQ ID NO: 2876501 - DNA, 12 bp, Homo sapiens
ctgaatttttaa

SEQ ID NO: 2876502 - DNA, 14 bp, Homo sapiens
ctgacacaggggac

SEQ ID NO: 2876503 - DNA, 18 bp, Homo sapiens
ctgacacaggggacactg

SEQ ID NO: 2876504 - DNA, 19 bp, Homo sapiens
ctgacacaggggacactga

SEQ ID NO: 2876505 - DNA, 16 bp, Homo sapiens
ctgacccagagtggag

SEQ ID NO: 2876506 - DNA, 14 bp, Homo sapiens
ctgaccggcacctg

SEQ ID NO: 2876507 - DNA, 21 bp, Homo sapiens
ctgactaccagctaactccag

SEQ ID NO: 2876508 - DNA, 16 bp, Homo sapiens
ctgagagccctgctgt

SEQ ID NO: 2876509 - DNA, 19 bp, Homo sapiens
ctgagagccctgctgtggg

SEQ ID NO: 2876510 - DNA, 20 bp, Homo sapiens
ctgagagccctgctgtggga

SEQ ID NO: 2876511 - DNA, 23 bp, Homo sapiens
ctgagccaaacacactgtaaata

SEQ ID NO: 2876512 - DNA, 21 bp, Homo sapiens
ctgagccaggagcctcctgac

SEQ ID NO: 2876513 - DNA, 18 bp, Homo sapiens
ctgagccctggtgtgttt

SEQ ID NO: 2876514 - DNA, 22 bp, Homo sapiens
ctgaggacaatgtctggctgaa

SEQ ID NO: 2876515 - DNA, 18 bp, Homo sapiens
ctgagtctgagtcctgtc

SEQ ID NO: 2876516 - DNA, 21 bp, Homo sapiens
ctgagttctcatccacagagg

SEQ ID NO: 2876517 - DNA, 18 bp, Homo sapiens
ctgataattttaaattct

SEQ ID NO: 2876518 - DNA, 21 bp, Homo sapiens
ctgatacagccttacaataca

SEQ ID NO: 2876519 - DNA, 15 bp, Homo sapiens
ctgcaacagcctgtt

SEQ ID NO: 2876520 - DNA, 22 bp, Homo sapiens
ctgcaagtccatagctgagctg

SEQ ID NO: 2876521 - DNA, 23 bp, Homo sapiens
ctgcagcagggcaggaaggggaa

SEQ ID NO: 2876522 - DNA, 12 bp, Homo sapiens
ctgcccagctct

SEQ ID NO: 2876523 - DNA, 17 bp, Homo sapiens
ctgcccagctctgaggc

SEQ ID NO: 2876524 - DNA, 11 bp, Homo sapiens
ctgccctgtat

SEQ ID NO: 2876525 - DNA, 21 bp, Homo sapiens
ctgcctctcgctcctcaaccc

SEQ ID NO: 2876526 - DNA, 18 bp, Homo sapiens
ttcctctcaagctagcca

SEQ ID NO: 2876527 - DNA, 14 bp, Homo sapiens
ttcctctctctcac

SEQ ID NO: 2876528 - DNA, 13 bp, Homo sapiens
ttcctgccttctc

SEQ ID NO: 2876529 - DNA, 18 bp, Homo sapiens
ttcctgccttctcttcta

SEQ ID NO: 2876530 - DNA, 21 bp, Homo sapiens
ttcctgtgccaggactctctt

SEQ ID NO: 2876531 - DNA, 17 bp, Homo sapiens
ttcctgtgggccaggag

SEQ ID NO: 2876532 - DNA, 23 bp, Homo sapiens
ttcctgtgggccaggagctcagc

SEQ ID NO: 2876533 - DNA, 14 bp, Homo sapiens
ttctaaaatgcctt

SEQ ID NO: 2876534 - DNA, 22 bp, Homo sapiens
ttctattcattcattttgaaat

SEQ ID NO: 2876535 - DNA, 21 bp, Homo sapiens
ttctcgtcttcctctctctca

SEQ ID NO: 2876536 - DNA, 17 bp, Homo sapiens
ttctcttctatcctgca

SEQ ID NO: 2876537 - DNA, 21 bp, Homo sapiens
ttctgctactttgctgctatg

SEQ ID NO: 2876538 - DNA, 15 bp, Homo sapiens
ttctgctcacattcc

SEQ ID NO: 2876539 - DNA, 21 bp, Homo sapiens
ttctgctcacattccctctca

SEQ ID NO: 2876540 - DNA, 21 bp, Homo sapiens
ttctgtgcatttgtgtctgcc

SEQ ID NO: 2876541 - DNA, 22 bp, Homo sapiens
ttctgtgcatttgtgtctgcct

SEQ ID NO: 2876542 - DNA, 22 bp, Homo sapiens
ttctttggtttcccaagagcta

SEQ ID NO: 2876543 - DNA, 20 bp, Homo sapiens
ttgaagcaaatcgaatgaaa

SEQ ID NO: 2876544 - DNA, 18 bp, Homo sapiens
ttgaatctgttactgaaa

SEQ ID NO: 2876545 - DNA, 16 bp, Homo sapiens
ttgaatgcaaaccata

SEQ ID NO: 2876546 - DNA, 15 bp, Homo sapiens
ttgacataaagttga

SEQ ID NO: 2876547 - DNA, 13 bp, Homo sapiens
ttgacatagcctt

SEQ ID NO: 2876548 - DNA, 16 bp, Homo sapiens
ttgacatagcctttgt

SEQ ID NO: 2876549 - DNA, 15 bp, Homo sapiens
ttgaggacaggagag

SEQ ID NO: 2876550 - DNA, 13 bp, Homo sapiens
ttgagtgtttaaa

SEQ ID NO: 2876551 - DNA, 17 bp, Homo sapiens
ttgataaagatttttta

SEQ ID NO: 2876552 - DNA, 20 bp, Homo sapiens
ttgataaagattttttaata

SEQ ID NO: 2876553 - DNA, 22 bp, Homo sapiens
ttgataaagattttttaataat

SEQ ID NO: 2876554 - DNA, 14 bp, Homo sapiens
ttgatgccaaaaaa

SEQ ID NO: 2876555 - DNA, 21 bp, Homo sapiens
ttgatgccagctgtactgagt

SEQ ID NO: 2876556 - DNA, 14 bp, Homo sapiens
ttgcggttcaggaa

SEQ ID NO: 2876557 - DNA, 16 bp, Homo sapiens
ttgctacataattatc

SEQ ID NO: 2876558 - DNA, 20 bp, Homo sapiens
ttgctcctacccctgtcctg

SEQ ID NO: 2876559 - DNA, 22 bp, Homo sapiens
ttggccaatgcacctaaagaaa

SEQ ID NO: 2876560 - DNA, 14 bp, Homo sapiens
ttggtggccacata

SEQ ID NO: 2876561 - DNA, 21 bp, Homo sapiens
ttggtgttacacagcccaaga

SEQ ID NO: 2876562 - DNA, 16 bp, Homo sapiens
ttgtcacttttccttt

SEQ ID NO: 2876563 - DNA, 20 bp, Homo sapiens
ttgttaatttagaaaacttt

SEQ ID NO: 2876564 - DNA, 14 bp, Homo sapiens
ttgtttcttaaata

SEQ ID NO: 2876565 - DNA, 21 bp, Homo sapiens
tttaaaaaagcttaaaacttt

SEQ ID NO: 2876566 - DNA, 11 bp, Homo sapiens
tttaaaccttt

SEQ ID NO: 2876567 - DNA, 15 bp, Homo sapiens
tttaaactataagca

SEQ ID NO: 2876568 - DNA, 13 bp, Homo sapiens
tttaaagaattgt

SEQ ID NO: 2876569 - DNA, 14 bp, Homo sapiens
tttaacttaaatag

SEQ ID NO: 2876570 - DNA, 17 bp, Homo sapiens
tttaatagcaaagaatt

SEQ ID NO: 2876571 - DNA, 16 bp, Homo sapiens
tttagaaaactttaaa

SEQ ID NO: 2876572 - DNA, 13 bp, Homo sapiens
tttagaaatcatt

SEQ ID NO: 2876573 - DNA, 16 bp, Homo sapiens
tttatcgcagaccttt

SEQ ID NO: 2876574 - DNA, 16 bp, Homo sapiens
tttatctgaattttta

SEQ ID NO: 2876575 - DNA, 19 bp, Homo sapiens
tttatgagtgttaataaaa

SEQ ID NO: 2876576 - DNA, 17 bp, Homo sapiens
tttcaaaagtgatctgt

SEQ ID NO: 2876577 - DNA, 19 bp, Homo sapiens
tttcaaatcaagaaaataa

SEQ ID NO: 2876578 - DNA, 18 bp, Homo sapiens
tttcagtccccacagata

SEQ ID NO: 2876579 - DNA, 13 bp, Homo sapiens
tttcatataaagt

SEQ ID NO: 2876580 - DNA, 12 bp, Homo sapiens
tttcatctcatt

SEQ ID NO: 2876581 - DNA, 23 bp, Homo sapiens
tttcatctcatttaagggaaaaa

SEQ ID NO: 2876582 - DNA, 22 bp, Homo sapiens
tttcatgataatgaacagaaca

SEQ ID NO: 2876583 - DNA, 23 bp, Homo sapiens
tttccctcaaatgcgcgtgtgca

SEQ ID NO: 2876584 - DNA, 19 bp, Homo sapiens
tttccctcaccccctccca

SEQ ID NO: 2876585 - DNA, 16 bp, Homo sapiens
tttccttttcttaaaa

SEQ ID NO: 2876586 - DNA, 22 bp, Homo sapiens
tttctatagccaaaaatagcta

SEQ ID NO: 2876587 - DNA, 13 bp, Homo sapiens
tttcttaaataag

SEQ ID NO: 2876588 - DNA, 21 bp, Homo sapiens
tttcttaaataagaaactttt

SEQ ID NO: 2876589 - DNA, 13 bp, Homo sapiens
tttctttgtaaag

SEQ ID NO: 2876590 - DNA, 15 bp, Homo sapiens
tttgaagaggaaaat

SEQ ID NO: 2876591 - DNA, 16 bp, Homo sapiens
tttgaagttagcttta

SEQ ID NO: 2876592 - DNA, 21 bp, Homo sapiens
tttgatactaagcattgaatg

SEQ ID NO: 2876593 - DNA, 17 bp, Homo sapiens
tttgccttttcaaatca

SEQ ID NO: 2876594 - DNA, 19 bp, Homo sapiens
tttggatatgtaaaacatt

SEQ ID NO: 2876595 - DNA, 13 bp, Homo sapiens
tttgtaaaggtca

SEQ ID NO: 2876596 - DNA, 15 bp, Homo sapiens
tttgtcacttttcct

SEQ ID NO: 2876597 - DNA, 12 bp, Homo sapiens
tttgttaattta

SEQ ID NO: 2876598 - DNA, 15 bp, Homo sapiens
ttttaaaaaagctta

SEQ ID NO: 2876599 - DNA, 16 bp, Homo sapiens
ttttaaaaccataaaa

SEQ ID NO: 2876600 - DNA, 15 bp, Homo sapiens
ttttgacataaagtt

SEQ ID NO: 2876601 - DNA, 15 bp, Homo sapiens
tttttaaaaaagctt

SEQ ID NO: 2876602 - DNA, 20 bp, Homo sapiens
tttttaggaagcaagcttaa

SEQ ID NO: 2876603 - DNA, 18 bp, Homo sapiens
tttttccttcaaagttta

SEQ ID NO: 2876604 - DNA, 23 bp, Homo sapiens
tttttgaaaaagcgaaaaaatca

SEQ ID NO: 2876605 - DNA, 15 bp, Homo sapiens
tttttgatactaagc

SEQ ID NO: 2876606 - DNA, 13 bp, Homo sapiens
ttttttaaaaaag

SEQ ID NO: 2876607 - DNA, 16 bp, Homo sapiens
aagagctacataattt

SEQ ID NO: 2876608 - DNA, 17 bp, Homo sapiens
aagattttgtcaaaaac

SEQ ID NO: 2876609 - DNA, 14 bp, Homo sapiens
aagattttttaata

SEQ ID NO: 2876610 - DNA, 17 bp, Homo sapiens
aagattttttaataatt

SEQ ID NO: 2876611 - DNA, 19 bp, Homo sapiens
aagcaagaaagccgtactg

SEQ ID NO: 2876612 - DNA, 21 bp, Homo sapiens
aagcaagcattcagaagaaaa

SEQ ID NO: 2876613 - DNA, 13 bp, Homo sapiens
aagcaagcttaat

SEQ ID NO: 2876614 - DNA, 13 bp, Homo sapiens
aagcattgaatgg

SEQ ID NO: 2876615 - DNA, 13 bp, Homo sapiens
aagcattttgtaa

SEQ ID NO: 2876616 - DNA, 19 bp, Homo sapiens
aagcattttgtaagttgaa

SEQ ID NO: 2876617 - DNA, 23 bp, Homo sapiens
aagcattttgtaagttgaagcaa

SEQ ID NO: 2876618 - DNA, 18 bp, Homo sapiens
aagccccttgtcctctcc

SEQ ID NO: 2876619 - DNA, 16 bp, Homo sapiens
aagccgtactgtctat

SEQ ID NO: 2876620 - DNA, 18 bp, Homo sapiens
aagctagccagagggtgg

SEQ ID NO: 2876621 - DNA, 22 bp, Homo sapiens
aaggaccctgttttccacacca

SEQ ID NO: 2876622 - DNA, 22 bp, Homo sapiens
aagggggctattccctggagac

SEQ ID NO: 2876623 - DNA, 23 bp, Homo sapiens
aagggggctattccctggagacc

SEQ ID NO: 2876624 - DNA, 17 bp, Homo sapiens
aagggggtcaaaggaag

SEQ ID NO: 2876625 - DNA, 14 bp, Homo sapiens
aagggttgagctgg

SEQ ID NO: 2876626 - DNA, 14 bp, Homo sapiens
aagtagtaattgca

SEQ ID NO: 2876627 - DNA, 21 bp, Homo sapiens
aagtatttgttaatttagaaa

SEQ ID NO: 2876628 - DNA, 12 bp, Homo sapiens
aagtgaagcccc

SEQ ID NO: 2876629 - DNA, 18 bp, Homo sapiens
aagtgatctgtcccctct

SEQ ID NO: 2876630 - DNA, 19 bp, Homo sapiens
aagtgatctgtcccctctc

SEQ ID NO: 2876631 - DNA, 17 bp, Homo sapiens
aagtgatctgtgttcaa

SEQ ID NO: 2876632 - DNA, 22 bp, Homo sapiens
aagtgatttgggggtgcaatga

SEQ ID NO: 2876633 - DNA, 17 bp, Homo sapiens
aagtgcaatttcccctc

SEQ ID NO: 2876634 - DNA, 18 bp, Homo sapiens
aagtgggaagtgaagccc

SEQ ID NO: 2876635 - DNA, 12 bp, Homo sapiens
aagtgttcagtg

SEQ ID NO: 2876636 - DNA, 16 bp, Homo sapiens
aagtgttcagtgttga

SEQ ID NO: 2876637 - DNA, 19 bp, Homo sapiens
aagtgttcagtgttgacat

SEQ ID NO: 2876638 - DNA, 12 bp, Homo sapiens
aataaaatttat

SEQ ID NO: 2876639 - DNA, 20 bp, Homo sapiens
aataatacattgaattagaa

SEQ ID NO: 2876640 - DNA, 12 bp, Homo sapiens
aataatttagac

SEQ ID NO: 2876641 - DNA, 23 bp, Homo sapiens
aatacatgctaagagaagtagaa

SEQ ID NO: 2876642 - DNA, 16 bp, Homo sapiens
aatacttctcattttt

SEQ ID NO: 2876643 - DNA, 22 bp, Homo sapiens
aatacttctcattttttaaaaa

SEQ ID NO: 2876644 - DNA, 13 bp, Homo sapiens
aatagcaaaagaa

SEQ ID NO: 2876645 - DNA, 16 bp, Homo sapiens
aatagcaaaagaagaa

SEQ ID NO: 2876646 - DNA, 19 bp, Homo sapiens
aatagcaaaagaagaagtt

SEQ ID NO: 2876647 - DNA, 15 bp, Homo sapiens
aatagcaaagaattg

SEQ ID NO: 2876648 - DNA, 21 bp, Homo sapiens
aatagctaaatacctcaatca

SEQ ID NO: 2876649 - DNA, 14 bp, Homo sapiens
aatagtttggatat

SEQ ID NO: 2876650 - DNA, 18 bp, Homo sapiens
aatatcctaaacatcatt

SEQ ID NO: 2876651 - DNA, 15 bp, Homo sapiens
aatatttaaatttat

SEQ ID NO: 2876652 - DNA, 11 bp, Homo sapiens
aatattttaaa

SEQ ID NO: 2876653 - DNA, 21 bp, Homo sapiens
aatcaattctgatacagcctt

SEQ ID NO: 2876654 - DNA, 17 bp, Homo sapiens
aatcacattcaggcatg

SEQ ID NO: 2876655 - DNA, 17 bp, Homo sapiens
aatcacgctttttgaaa

SEQ ID NO: 2876656 - DNA, 16 bp, Homo sapiens
aatcagagtggccaat

SEQ ID NO: 2876657 - DNA, 21 bp, Homo sapiens
aatcctgaggggatatcccta

SEQ ID NO: 2876658 - DNA, 18 bp, Homo sapiens
aatctgcattattggaat

SEQ ID NO: 2876659 - DNA, 19 bp, Homo sapiens
aatcttggttgatgccaaa

SEQ ID NO: 2876660 - DNA, 23 bp, Homo sapiens
aatgaaacaaagagttcaagaaa

SEQ ID NO: 2876661 - DNA, 12 bp, Homo sapiens
aatgaacagaac

SEQ ID NO: 2876662 - DNA, 15 bp, Homo sapiens
aatgaacagaacata

SEQ ID NO: 2876663 - DNA, 13 bp, Homo sapiens
aatgagctgggcc

SEQ ID NO: 2876664 - DNA, 15 bp, Homo sapiens
aatgattgtagtaat

SEQ ID NO: 2876665 - DNA, 15 bp, Homo sapiens
aatgcacctaaagaa

SEQ ID NO: 2876666 - DNA, 22 bp, Homo sapiens
aatgcttaatcagatagatatt

SEQ ID NO: 2876667 - DNA, 13 bp, Homo sapiens
aatggaaaggaga

SEQ ID NO: 2876668 - DNA, 16 bp, Homo sapiens
aatggctatgttttta

SEQ ID NO: 2876669 - DNA, 14 bp, Homo sapiens
aatgggaaaagaga

SEQ ID NO: 2876670 - DNA, 15 bp, Homo sapiens
aatgggggagggagg

SEQ ID NO: 2876671 - DNA, 16 bp, Homo sapiens
aatgtaaatattttaa

SEQ ID NO: 2876672 - DNA, 21 bp, Homo sapiens
aatgtaaatattttaaagaat

SEQ ID NO: 2876673 - DNA, 15 bp, Homo sapiens
aatgtcataacaggc

SEQ ID NO: 2876674 - DNA, 19 bp, Homo sapiens
aatgtcattttggtacttt

SEQ ID NO: 2876675 - DNA, 22 bp, Homo sapiens
aatgttgaaatatgatgttaaa

SEQ ID NO: 2876676 - DNA, 18 bp, Homo sapiens
aattaactgggtaatgaa

SEQ ID NO: 2876677 - DNA, 21 bp, Homo sapiens
aattaactgggtaatgaaaca

SEQ ID NO: 2876678 - DNA, 14 bp, Homo sapiens
aattaagtgcaatt

SEQ ID NO: 2876679 - DNA, 19 bp, Homo sapiens
aattctgtcactcaccact

SEQ ID NO: 2876680 - DNA, 19 bp, Homo sapiens
aattgttttatctgaattt

SEQ ID NO: 2876681 - DNA, 22 bp, Homo sapiens
aattgttttatctgaattttta

SEQ ID NO: 2876682 - DNA, 22 bp, Homo sapiens
aatttaaactataagcaagaag

SEQ ID NO: 2876683 - DNA, 15 bp, Homo sapiens
aatttagaaaacttt

SEQ ID NO: 2876684 - DNA, 16 bp, Homo sapiens
aatttagaaaacttta

SEQ ID NO: 2876685 - DNA, 20 bp, Homo sapiens
aatttagaaatcattttgca

SEQ ID NO: 2876686 - DNA, 22 bp, Homo sapiens
aatttagtttcatataaagtat

SEQ ID NO: 2876687 - DNA, 19 bp, Homo sapiens
acaaagagttcaagaaata

SEQ ID NO: 2876688 - DNA, 16 bp, Homo sapiens
acaaagcccttttata

SEQ ID NO: 2876689 - DNA, 15 bp, Homo sapiens
acaaatctatgccac

SEQ ID NO: 2876690 - DNA, 22 bp, Homo sapiens
acaacatttctatagccaaaaa

SEQ ID NO: 2876691 - DNA, 20 bp, Homo sapiens
acaacctgagttcaagtcaa

SEQ ID NO: 2876692 - DNA, 12 bp, Homo sapiens
acaactccagcc

SEQ ID NO: 2876693 - DNA, 14 bp, Homo sapiens
acaactccagccac

SEQ ID NO: 2876694 - DNA, 17 bp, Homo sapiens
acaagaagcattttgta

SEQ ID NO: 2876695 - DNA, 24 bp, Homo sapiens
acaaggaaccaccgaagaggaagc

SEQ ID NO: 2876696 - DNA, 21 bp, Homo sapiens
acaaggaccctgttttccaca

SEQ ID NO: 2876697 - DNA, 22 bp, Homo sapiens
acaaggaccctgttttccacac

SEQ ID NO: 2876698 - DNA, 15 bp, Homo sapiens
acaatgcctctccca

SEQ ID NO: 2876699 - DNA, 21 bp, Homo sapiens
acacactgtaaatatccacag

SEQ ID NO: 2876700 - DNA, 19 bp, Homo sapiens
acacatactcatttttcat

SEQ ID NO: 2876701 - DNA, 14 bp, Homo sapiens
acacctccctactc

SEQ ID NO: 2876702 - DNA, 19 bp, Homo sapiens
acactgtaaatatccacag

SEQ ID NO: 2876703 - DNA, 19 bp, Homo sapiens
acacttatggggacagcat

SEQ ID NO: 2876704 - DNA, 14 bp, Homo sapiens
acagaagaaacaag

SEQ ID NO: 2876705 - DNA, 16 bp, Homo sapiens
acagactccctcccct

SEQ ID NO: 2876706 - DNA, 19 bp, Homo sapiens
acagactccctcccctgcc

SEQ ID NO: 2876707 - DNA, 15 bp, Homo sapiens
acagaggccaggcat

SEQ ID NO: 2876708 - DNA, 18 bp, Homo sapiens
acagataactgaaaatta

SEQ ID NO: 2876709 - DNA, 13 bp, Homo sapiens
acagatgcccacg

SEQ ID NO: 2876710 - DNA, 13 bp, Homo sapiens
acagcagcagctc

SEQ ID NO: 2876711 - DNA, 21 bp, Homo sapiens
acagcataccttggactgact

SEQ ID NO: 2876712 - DNA, 13 bp, Homo sapiens
acagcccaagagg

SEQ ID NO: 2876713 - DNA, 19 bp, Homo sapiens
acagcccaagaggactgag

SEQ ID NO: 2876714 - DNA, 18 bp, Homo sapiens
acaggggacactgaacct

SEQ ID NO: 2876715 - DNA, 20 bp, Homo sapiens
acagtatttattttttcaaa

SEQ ID NO: 2876716 - DNA, 14 bp, Homo sapiens
acagtctaaagctg

SEQ ID NO: 2876717 - DNA, 15 bp, Homo sapiens
acataaataaaatga

SEQ ID NO: 2876718 - DNA, 15 bp, Homo sapiens
acataagccattatt

SEQ ID NO: 2876719 - DNA, 23 bp, Homo sapiens
acataattatccaggaagggaat

SEQ ID NO: 2876720 - DNA, 13 bp, Homo sapiens
acatactcatttt

SEQ ID NO: 2876721 - DNA, 16 bp, Homo sapiens
acatactcatttttca

SEQ ID NO: 2876722 - DNA, 17 bp, Homo sapiens
acatagacagaagaaac

SEQ ID NO: 2876723 - DNA, 23 bp, Homo sapiens
acatgccagcttcctgtgggcca

SEQ ID NO: 2876724 - DNA, 24 bp, Homo sapiens
acatgctaagagaagtagaaatca

SEQ ID NO: 2876725 - DNA, 11 bp, Homo sapiens
acatgtgctat

SEQ ID NO: 2876726 - DNA, 20 bp, Homo sapiens
acatgtgtcccagccacagt

SEQ ID NO: 2876727 - DNA, 22 bp, Homo sapiens
agtccccacagataactgaaaa

SEQ ID NO: 2876728 - DNA, 17 bp, Homo sapiens
agtcctgtctctgcctg

SEQ ID NO: 2876729 - DNA, 21 bp, Homo sapiens
agtcctgtctctgcctgcggc

SEQ ID NO: 2876730 - DNA, 21 bp, Homo sapiens
agtctaaagctggtttaatgt

SEQ ID NO: 2876731 - DNA, 13 bp, Homo sapiens
agtctcctgacat

SEQ ID NO: 2876732 - DNA, 19 bp, Homo sapiens
agtctgagtcctgtctctg

SEQ ID NO: 2876733 - DNA, 23 bp, Homo sapiens
agtctgtctcttggctttgtcac

SEQ ID NO: 2876734 - DNA, 23 bp, Homo sapiens
agtgaagccccttgtcctctccc

SEQ ID NO: 2876735 - DNA, 22 bp, Homo sapiens
agtgacctgaccggcacctgcg

SEQ ID NO: 2876736 - DNA, 19 bp, Homo sapiens
agtgagttttttagtgcgt

SEQ ID NO: 2876737 - DNA, 18 bp, Homo sapiens
agtgatatctagaaaggg

SEQ ID NO: 2876738 - DNA, 19 bp, Homo sapiens
agtgatctgtcccctctcc

SEQ ID NO: 2876739 - DNA, 20 bp, Homo sapiens
agtgatctgtcccctctccc

SEQ ID NO: 2876740 - DNA, 15 bp, Homo sapiens
agtgcaatttcccct

SEQ ID NO: 2876741 - DNA, 16 bp, Homo sapiens
agtgcaatttcccctc

SEQ ID NO: 2876742 - DNA, 21 bp, Homo sapiens
agtgcaatttcccctctgtgt

SEQ ID NO: 2876743 - DNA, 15 bp, Homo sapiens
agtgcactcagagct

SEQ ID NO: 2876744 - DNA, 20 bp, Homo sapiens
agtgctgggattacaggtgt

SEQ ID NO: 2876745 - DNA, 16 bp, Homo sapiens
agtggctcgctccctg

SEQ ID NO: 2876746 - DNA, 20 bp, Homo sapiens
agtggggaggggcctggcct

SEQ ID NO: 2876747 - DNA, 22 bp, Homo sapiens
agtgtgcttctgttatcaaaca

SEQ ID NO: 2876748 - DNA, 13 bp, Homo sapiens
agtgtgtcagagt

SEQ ID NO: 2876749 - DNA, 15 bp, Homo sapiens
agtgttcagtgttga

SEQ ID NO: 2876750 - DNA, 16 bp, Homo sapiens
agtgttcagtgttgac

SEQ ID NO: 2876751 - DNA, 14 bp, Homo sapiens
agtgttgacatagc

SEQ ID NO: 2876752 - DNA, 16 bp, Homo sapiens
agtgttgacatagcct

SEQ ID NO: 2876753 - DNA, 17 bp, Homo sapiens
agtgttgacatagcctt

SEQ ID NO: 2876754 - DNA, 15 bp, Homo sapiens
agttagctttaactt

SEQ ID NO: 2876755 - DNA, 22 bp, Homo sapiens
agttcaagcctgtgggagtaga

SEQ ID NO: 2876756 - DNA, 13 bp, Homo sapiens
agttccgtctcct

SEQ ID NO: 2876757 - DNA, 12 bp, Homo sapiens
agttctcatcca

SEQ ID NO: 2876758 - DNA, 22 bp, Homo sapiens
agttctcatccacagaggccag

SEQ ID NO: 2876759 - DNA, 14 bp, Homo sapiens
agttgaagcaaatc

SEQ ID NO: 2876760 - DNA, 17 bp, Homo sapiens
agttgataaagattttt

SEQ ID NO: 2876761 - DNA, 21 bp, Homo sapiens
agttgataaagattttttaat

SEQ ID NO: 2876762 - DNA, 21 bp, Homo sapiens
agttgctcctacccctgtcct

SEQ ID NO: 2876763 - DNA, 16 bp, Homo sapiens
agtttatatttaactc

SEQ ID NO: 2876764 - DNA, 14 bp, Homo sapiens
agtttggatatgta

SEQ ID NO: 2876765 - DNA, 13 bp, Homo sapiens
ataaactactgta

SEQ ID NO: 2876766 - DNA, 21 bp, Homo sapiens
ataaactactgtaattaagtg

SEQ ID NO: 2876767 - DNA, 16 bp, Homo sapiens
ataaagattttttaat

SEQ ID NO: 2876768 - DNA, 17 bp, Homo sapiens
ataaagattttttaata

SEQ ID NO: 2876769 - DNA, 21 bp, Homo sapiens
ataaagattttttaataattt

SEQ ID NO: 2876770 - DNA, 14 bp, Homo sapiens
ataaagtatcatca

SEQ ID NO: 2876771 - DNA, 19 bp, Homo sapiens
ataaagtatggtattgaaa

SEQ ID NO: 2876772 - DNA, 17 bp, Homo sapiens
ataaagtgatctgtgtt

SEQ ID NO: 2876773 - DNA, 20 bp, Homo sapiens
ataaagtgatctgtgttcaa

SEQ ID NO: 2876774 - DNA, 17 bp, Homo sapiens
ataaagttgataaagat

SEQ ID NO: 2876775 - DNA, 21 bp, Homo sapiens
ataaagttgataaagattttt

SEQ ID NO: 2876776 - DNA, 20 bp, Homo sapiens
ataaatgggtaacactgatt

SEQ ID NO: 2876777 - DNA, 18 bp, Homo sapiens
ataacgtttaagccaaaa

SEQ ID NO: 2876778 - DNA, 17 bp, Homo sapiens
ataactgaaaattattt

SEQ ID NO: 2876779 - DNA, 13 bp, Homo sapiens
ataagaaactttt

SEQ ID NO: 2876780 - DNA, 22 bp, Homo sapiens
ataagaaacttttttatttaaa

SEQ ID NO: 2876781 - DNA, 13 bp, Homo sapiens
ataagtgttcagt

SEQ ID NO: 2876782 - DNA, 17 bp, Homo sapiens
ataagtgttcagtgttg

SEQ ID NO: 2876783 - DNA, 20 bp, Homo sapiens
ataagtgttcagtgttgaca

SEQ ID NO: 2876784 - DNA, 22 bp, Homo sapiens
atacatgctaagagaagtagaa

SEQ ID NO: 2876785 - DNA, 18 bp, Homo sapiens
atactaaagtgtctatta

SEQ ID NO: 2876786 - DNA, 13 bp, Homo sapiens
atactgaagatgc

SEQ ID NO: 2876787 - DNA, 13 bp, Homo sapiens
atagcaagagatg

SEQ ID NO: 2876788 - DNA, 14 bp, Homo sapiens
atagccaaaaatag

SEQ ID NO: 2876789 - DNA, 13 bp, Homo sapiens
atagctaaatacc

SEQ ID NO: 2876790 - DNA, 23 bp, Homo sapiens
atagtttggatatgtaaaacatt

SEQ ID NO: 2876791 - DNA, 13 bp, Homo sapiens
atataaacacata

SEQ ID NO: 2876792 - DNA, 14 bp, Homo sapiens
atataatactaaag

SEQ ID NO: 2876793 - DNA, 16 bp, Homo sapiens
atataatactaaagtg

SEQ ID NO: 2876794 - DNA, 22 bp, Homo sapiens
atataatactaaagtgtctatt

SEQ ID NO: 2876795 - DNA, 15 bp, Homo sapiens
atatatctatctatt

SEQ ID NO: 2876796 - DNA, 14 bp, Homo sapiens
atatatttttctga

SEQ ID NO: 2876797 - DNA, 22 bp, Homo sapiens
atatccacagactccctcccct

SEQ ID NO: 2876798 - DNA, 20 bp, Homo sapiens
atatccctatgtcccagccc

SEQ ID NO: 2876799 - DNA, 13 bp, Homo sapiens
atatcctaaacat

SEQ ID NO: 2876800 - DNA, 14 bp, Homo sapiens
atatctatctattt

SEQ ID NO: 2876801 - DNA, 17 bp, Homo sapiens
atatctatctatttgag

SEQ ID NO: 2876802 - DNA, 22 bp, Homo sapiens
atatctcctgaaaaggtttatg

SEQ ID NO: 2876803 - DNA, 15 bp, Homo sapiens
atatgatgttaaaaa

SEQ ID NO: 2876804 - DNA, 15 bp, Homo sapiens
atatgtaaaacattt

SEQ ID NO: 2876805 - DNA, 16 bp, Homo sapiens
atatgtaaaacattta

SEQ ID NO: 2876806 - DNA, 15 bp, Homo sapiens
atattacactacaca

SEQ ID NO: 2876807 - DNA, 17 bp, Homo sapiens
atattcctattgtgcaa

SEQ ID NO: 2876808 - DNA, 19 bp, Homo sapiens
atattgtgggtgttaattt

SEQ ID NO: 2876809 - DNA, 23 bp, Homo sapiens
atatttaaatttatgagtgttaa

SEQ ID NO: 2876810 - DNA, 15 bp, Homo sapiens
atattttaaagaatt

SEQ ID NO: 2876811 - DNA, 20 bp, Homo sapiens
atattttaaagaattgtgtc

SEQ ID NO: 2876812 - DNA, 19 bp, Homo sapiens
atcaattctgatacagcct

SEQ ID NO: 2876813 - DNA, 21 bp, Homo sapiens
atcaattctgatacagcctta

SEQ ID NO: 2876814 - DNA, 24 bp, Homo sapiens
atcacattcaggcatgcgaatgag

SEQ ID NO: 2876815 - DNA, 16 bp, Homo sapiens
atcaccctctgggcag

SEQ ID NO: 2876816 - DNA, 18 bp, Homo sapiens
atcacgctttttgaaaaa

SEQ ID NO: 2876817 - DNA, 19 bp, Homo sapiens
atcactgctgtccctcctg

SEQ ID NO: 2876818 - DNA, 20 bp, Homo sapiens
atcagcaggatgtgtgggcc

SEQ ID NO: 2876819 - DNA, 16 bp, Homo sapiens
atcagtctcagaatgt

SEQ ID NO: 2876820 - DNA, 15 bp, Homo sapiens
atcatcagtgtagaa

SEQ ID NO: 2876821 - DNA, 16 bp, Homo sapiens
atcatcagtgtagaac

SEQ ID NO: 2876822 - DNA, 14 bp, Homo sapiens
atcattttttactt

SEQ ID NO: 2876823 - DNA, 13 bp, Homo sapiens
atccacagactcc

SEQ ID NO: 2876824 - DNA, 16 bp, Homo sapiens
atccaggtcctttcct

SEQ ID NO: 2876825 - DNA, 16 bp, Homo sapiens
atccctggaggggctg

SEQ ID NO: 2876826 - DNA, 12 bp, Homo sapiens
atccctggcccc

SEQ ID NO: 2876827 - DNA, 22 bp, Homo sapiens
atccctggccccctccctggat

SEQ ID NO: 2876828 - DNA, 21 bp, Homo sapiens
atccgcctctgagccaggagc

SEQ ID NO: 2876829 - DNA, 23 bp, Homo sapiens
atcctaagtgggaagtgaagccc

SEQ ID NO: 2876830 - DNA, 22 bp, Homo sapiens
atcctgaggggatatccctatg

SEQ ID NO: 2876831 - DNA, 14 bp, Homo sapiens
atccttccagtggc

SEQ ID NO: 2876832 - DNA, 17 bp, Homo sapiens
atccttccagtggctcg

SEQ ID NO: 2876833 - DNA, 13 bp, Homo sapiens
atcgaacaaactg

SEQ ID NO: 2876834 - DNA, 16 bp, Homo sapiens
atcgaacaaactgatg

SEQ ID NO: 2876835 - DNA, 17 bp, Homo sapiens
atcgaacaaactgatgc

SEQ ID NO: 2876836 - DNA, 18 bp, Homo sapiens
atcgaacaaactgatgcg

SEQ ID NO: 2876837 - DNA, 20 bp, Homo sapiens
atcgcagaccttttttagga

SEQ ID NO: 2876838 - DNA, 13 bp, Homo sapiens
atcgtccttcctc

SEQ ID NO: 2876839 - DNA, 16 bp, Homo sapiens
atcgtccttcctctca

SEQ ID NO: 2876840 - DNA, 14 bp, Homo sapiens
atcgtgacagcagc

SEQ ID NO: 2876841 - DNA, 14 bp, Homo sapiens
atctatctatttga

SEQ ID NO: 2876842 - DNA, 12 bp, Homo sapiens
atctatttgagg

SEQ ID NO: 2876843 - DNA, 17 bp, Homo sapiens
atctcagtgaagaatac

SEQ ID NO: 2876844 - DNA, 16 bp, Homo sapiens
atctcatttaagggaa

SEQ ID NO: 2876845 - DNA, 18 bp, Homo sapiens
atctcatttaagggaaaa

SEQ ID NO: 2876846 - DNA, 12 bp, Homo sapiens
atctgaattttt

SEQ ID NO: 2876847 - DNA, 21 bp, Homo sapiens
cctaaaaacatttactgacca

SEQ ID NO: 2876848 - DNA, 23 bp, Homo sapiens
cctaagtgggaagtgaagcccct

SEQ ID NO: 2876849 - DNA, 19 bp, Homo sapiens
cctaatggagaagacccac

SEQ ID NO: 2876850 - DNA, 20 bp, Homo sapiens
cctaattcaattcaaagctg

SEQ ID NO: 2876851 - DNA, 14 bp, Homo sapiens
cctactcccctggg

SEQ ID NO: 2876852 - DNA, 14 bp, Homo sapiens
cctacttcctcctc

SEQ ID NO: 2876853 - DNA, 15 bp, Homo sapiens
cctagatggttccct

SEQ ID NO: 2876854 - DNA, 17 bp, Homo sapiens
cctagtggggaggggcc

SEQ ID NO: 2876855 - DNA, 22 bp, Homo sapiens
cctagtggggaggggcctggcc

SEQ ID NO: 2876856 - DNA, 23 bp, Homo sapiens
cctagtggggaggggcctggcct

SEQ ID NO: 2876857 - DNA, 16 bp, Homo sapiens
cctcaccccctcccac

SEQ ID NO: 2876858 - DNA, 17 bp, Homo sapiens
cctcaccccctcccacc

SEQ ID NO: 2876859 - DNA, 20 bp, Homo sapiens
cctcaccccctcccaccccc

SEQ ID NO: 2876860 - DNA, 22 bp, Homo sapiens
cctcagacaatccactctcagg

SEQ ID NO: 2876861 - DNA, 12 bp, Homo sapiens
cctccatccctg

SEQ ID NO: 2876862 - DNA, 16 bp, Homo sapiens
cctccatccctggccc

SEQ ID NO: 2876863 - DNA, 16 bp, Homo sapiens
cctcccacccccagcc

SEQ ID NO: 2876864 - DNA, 14 bp, Homo sapiens
cctcccctccatcc

SEQ ID NO: 2876865 - DNA, 20 bp, Homo sapiens
cctcccctccatccctggcc

SEQ ID NO: 2876866 - DNA, 20 bp, Homo sapiens
cctcccctgcccccatccca

SEQ ID NO: 2876867 - DNA, 15 bp, Homo sapiens
cctccctccacccca

SEQ ID NO: 2876868 - DNA, 16 bp, Homo sapiens
cctccctccaccccag

SEQ ID NO: 2876869 - DNA, 12 bp, Homo sapiens
cctccctggatg

SEQ ID NO: 2876870 - DNA, 13 bp, Homo sapiens
cctcctcctcctc

SEQ ID NO: 2876871 - DNA, 14 bp, Homo sapiens
cctcctcctcctgt

SEQ ID NO: 2876872 - DNA, 14 bp, Homo sapiens
cctcctcctgttcc

SEQ ID NO: 2876873 - DNA, 20 bp, Homo sapiens
cctcctgaccctgtgatgcc

SEQ ID NO: 2876874 - DNA, 15 bp, Homo sapiens
cctcctgttcctgcc

SEQ ID NO: 2876875 - DNA, 18 bp, Homo sapiens
cctcctgttcctgccttc

SEQ ID NO: 2876876 - DNA, 20 bp, Homo sapiens
cctctccatatctccttccc

SEQ ID NO: 2876877 - DNA, 16 bp, Homo sapiens
cctctcccctcatgga

SEQ ID NO: 2876878 - DNA, 22 bp, Homo sapiens
cctctcccgcgggcctggacac

SEQ ID NO: 2876879 - DNA, 12 bp, Homo sapiens
cctctctctcac

SEQ ID NO: 2876880 - DNA, 18 bp, Homo sapiens
cctctgagccaggagcct

SEQ ID NO: 2876881 - DNA, 21 bp, Homo sapiens
cctctgagccaggagcctcct

SEQ ID NO: 2876882 - DNA, 13 bp, Homo sapiens
cctctgccctgta

SEQ ID NO: 2876883 - DNA, 21 bp, Homo sapiens
cctctggatccctggaggggc

SEQ ID NO: 2876884 - DNA, 14 bp, Homo sapiens
cctctgggcagctg

SEQ ID NO: 2876885 - DNA, 22 bp, Homo sapiens
cctctgggcagctgtcatggaa

SEQ ID NO: 2876886 - DNA, 14 bp, Homo sapiens
cctctttgcacagc

SEQ ID NO: 2876887 - DNA, 22 bp, Homo sapiens
cctgaaaaggtttatgaaaaag

SEQ ID NO: 2876888 - DNA, 23 bp, Homo sapiens
cctgacattaagacacacctctg

SEQ ID NO: 2876889 - DNA, 13 bp, Homo sapiens
cctgaccggcacc

SEQ ID NO: 2876890 - DNA, 15 bp, Homo sapiens
cctgctactcctgtg

SEQ ID NO: 2876891 - DNA, 13 bp, Homo sapiens
cctgctggcacct

SEQ ID NO: 2876892 - DNA, 16 bp, Homo sapiens
cctgctggcacctcag

SEQ ID NO: 2876893 - DNA, 21 bp, Homo sapiens
cctgctggcacctcagacaat

SEQ ID NO: 2876894 - DNA, 13 bp, Homo sapiens
cctgctgtgggag

SEQ ID NO: 2876895 - DNA, 15 bp, Homo sapiens
cctgcttacctgacg

SEQ ID NO: 2876896 - DNA, 20 bp, Homo sapiens
cctggccccctccctggatg

SEQ ID NO: 2876897 - DNA, 13 bp, Homo sapiens
cctggcctggtcc

SEQ ID NO: 2876898 - DNA, 18 bp, Homo sapiens
cctgggcatcttctggct

SEQ ID NO: 2876899 - DNA, 20 bp, Homo sapiens
cctggtactcccccagccct

SEQ ID NO: 2876900 - DNA, 13 bp, Homo sapiens
cctggttccctct

SEQ ID NO: 2876901 - DNA, 18 bp, Homo sapiens
cctggttccctctttcct

SEQ ID NO: 2876902 - DNA, 17 bp, Homo sapiens
cctgtatataatactaa

SEQ ID NO: 2876903 - DNA, 22 bp, Homo sapiens
cctgtgactgctggtaaaataa

SEQ ID NO: 2876904 - DNA, 17 bp, Homo sapiens
cctgtgccaggactctc

SEQ ID NO: 2876905 - DNA, 18 bp, Homo sapiens
cctgtgctctggaggctg

SEQ ID NO: 2876906 - DNA, 20 bp, Homo sapiens
cctgtgtgtcgttcccttgt

SEQ ID NO: 2876907 - DNA, 22 bp, Homo sapiens
cctgtgtgtcgttcccttgtgt

SEQ ID NO: 2876908 - DNA, 14 bp, Homo sapiens
cctgttcctgcctt

SEQ ID NO: 2876909 - DNA, 13 bp, Homo sapiens
cctgtttgggagg

SEQ ID NO: 2876910 - DNA, 20 bp, Homo sapiens
ccttcatcgaacaaactgat

SEQ ID NO: 2876911 - DNA, 15 bp, Homo sapiens
ccttccagtggctcg

SEQ ID NO: 2876912 - DNA, 17 bp, Homo sapiens
ccttcctctcaagctag

SEQ ID NO: 2876913 - DNA, 16 bp, Homo sapiens
ccttctcgtcttcctc

SEQ ID NO: 2876914 - DNA, 18 bp, Homo sapiens
ccttctcgtcttcctctc

SEQ ID NO: 2876915 - DNA, 23 bp, Homo sapiens
ccttctcgtcttcctctctctca

SEQ ID NO: 2876916 - DNA, 21 bp, Homo sapiens
ccttggggtaagccagagcct

SEQ ID NO: 2876917 - DNA, 16 bp, Homo sapiens
cctttaggtctggttg

SEQ ID NO: 2876918 - DNA, 16 bp, Homo sapiens
cctttcgaaagcaatg

SEQ ID NO: 2876919 - DNA, 23 bp, Homo sapiens
cctttgaagaggaaaatgaataa

SEQ ID NO: 2876920 - DNA, 13 bp, Homo sapiens
cgactccagccag

SEQ ID NO: 2876921 - DNA, 17 bp, Homo sapiens
cgactccagccagcgcc

SEQ ID NO: 2876922 - DNA, 18 bp, Homo sapiens
cgactccagccagcgcct

SEQ ID NO: 2876923 - DNA, 20 bp, Homo sapiens
cgactccagccagcgcctcc

SEQ ID NO: 2876924 - DNA, 14 bp, Homo sapiens
cgagaggtccctgc

SEQ ID NO: 2876925 - DNA, 17 bp, Homo sapiens
cgagaggtccctgctta

SEQ ID NO: 2876926 - DNA, 18 bp, Homo sapiens
cgcaacaacaaggaccct

SEQ ID NO: 2876927 - DNA, 16 bp, Homo sapiens
cgcagcccgaagccca

SEQ ID NO: 2876928 - DNA, 17 bp, Homo sapiens
cgcagcccgaagcccag

SEQ ID NO: 2876929 - DNA, 18 bp, Homo sapiens
cgcagcccgaagcccagt

SEQ ID NO: 2876930 - DNA, 20 bp, Homo sapiens
cgcatccgcctctgagccag

SEQ ID NO: 2876931 - DNA, 14 bp, Homo sapiens
cgccactcatttca

SEQ ID NO: 2876932 - DNA, 16 bp, Homo sapiens
cgccactcatttcatc

SEQ ID NO: 2876933 - DNA, 17 bp, Homo sapiens
cgccactcatttcatct

SEQ ID NO: 2876934 - DNA, 21 bp, Homo sapiens
cgccactcatttcatctcatt

SEQ ID NO: 2876935 - DNA, 18 bp, Homo sapiens
cgcctccctccaccccag

SEQ ID NO: 2876936 - DNA, 20 bp, Homo sapiens
cgcctccctccaccccagga

SEQ ID NO: 2876937 - DNA, 13 bp, Homo sapiens
cgcctctgagcca

SEQ ID NO: 2876938 - DNA, 20 bp, Homo sapiens
cgctccctgtagctctgcct

SEQ ID NO: 2876939 - DNA, 15 bp, Homo sapiens
cggacgtcctgctgg

SEQ ID NO: 2876940 - DNA, 20 bp, Homo sapiens
cggacgtcctgctggcacct

SEQ ID NO: 2876941 - DNA, 20 bp, Homo sapiens
cgggaccctgctcacaggca

SEQ ID NO: 2876942 - DNA, 16 bp, Homo sapiens
cgtctcctctccagcc

SEQ ID NO: 2876943 - DNA, 22 bp, Homo sapiens
cgtgcgcaacaacaaggaccct

SEQ ID NO: 2876944 - DNA, 20 bp, Homo sapiens
cgttcccttgtgtctgttgc

SEQ ID NO: 2876945 - DNA, 14 bp, Homo sapiens
ctaaaagaaacttt

SEQ ID NO: 2876946 - DNA, 20 bp, Homo sapiens
ctaaagaaaaacaaactcgt

SEQ ID NO: 2876947 - DNA, 23 bp, Homo sapiens
ctaaggagtgtagcaactacagt

SEQ ID NO: 2876948 - DNA, 22 bp, Homo sapiens
ctaagtgggaagtgaagcccct

SEQ ID NO: 2876949 - DNA, 16 bp, Homo sapiens
ctaattttttgttgtt

SEQ ID NO: 2876950 - DNA, 14 bp, Homo sapiens
ctacacctccctcc

SEQ ID NO: 2876951 - DNA, 21 bp, Homo sapiens
ctacagaccatatttttaaag

SEQ ID NO: 2876952 - DNA, 16 bp, Homo sapiens
ctacccctgtcctggg

SEQ ID NO: 2876953 - DNA, 12 bp, Homo sapiens
ctactgtaatta

SEQ ID NO: 2876954 - DNA, 22 bp, Homo sapiens
ctactgtaattaagtgcaattt

SEQ ID NO: 2876955 - DNA, 15 bp, Homo sapiens
ctacttcctcctcct

SEQ ID NO: 2876956 - DNA, 17 bp, Homo sapiens
ctagaggtgagaaattt

SEQ ID NO: 2876957 - DNA, 19 bp, Homo sapiens
ctagaggtgagaaatttaa

SEQ ID NO: 2876958 - DNA, 18 bp, Homo sapiens
ctagtggggaggggcctg

SEQ ID NO: 2876959 - DNA, 16 bp, Homo sapiens
ctagttttactttgaa

SEQ ID NO: 2876960 - DNA, 16 bp, Homo sapiens
ctataaactactgtaa

SEQ ID NO: 2876961 - DNA, 19 bp, Homo sapiens
ctataaactactgtaatta

SEQ ID NO: 2876962 - DNA, 16 bp, Homo sapiens
ctataaccagacacat

SEQ ID NO: 2876963 - DNA, 14 bp, Homo sapiens
ctataagtgttcag

SEQ ID NO: 2876964 - DNA, 17 bp, Homo sapiens
ctataagtgttcagtgt

SEQ ID NO: 2876965 - DNA, 22 bp, Homo sapiens
ctataagtgttcagtgttgaca

SEQ ID NO: 2876966 - DNA, 23 bp, Homo sapiens
ctataagtgttcagtgttgacat

SEQ ID NO: 2876967 - DNA, 17 bp, Homo sapiens
ctgctgtccctcctgag

SEQ ID NO: 2876968 - DNA, 18 bp, Homo sapiens
ctgctgtccctcctgagg

SEQ ID NO: 2876969 - DNA, 12 bp, Homo sapiens
ctgcttacctga

SEQ ID NO: 2876970 - DNA, 20 bp, Homo sapiens
ctggaaaggatgcttctgct

SEQ ID NO: 2876971 - DNA, 22 bp, Homo sapiens
ctggacacttatggggacagca

SEQ ID NO: 2876972 - DNA, 15 bp, Homo sapiens
ctggatgacattaaa

SEQ ID NO: 2876973 - DNA, 15 bp, Homo sapiens
ctggcagctgagagc

SEQ ID NO: 2876974 - DNA, 19 bp, Homo sapiens
ctggcagctgagagccctg

SEQ ID NO: 2876975 - DNA, 21 bp, Homo sapiens
ctggcagctgagagccctgct

SEQ ID NO: 2876976 - DNA, 20 bp, Homo sapiens
ctggcagtttatatttaact

SEQ ID NO: 2876977 - DNA, 22 bp, Homo sapiens
ctggcagtttatatttaactct

SEQ ID NO: 2876978 - DNA, 21 bp, Homo sapiens
ctggcctagtggggaggggcc

SEQ ID NO: 2876979 - DNA, 20 bp, Homo sapiens
ctggcctgggtggggcaggg

SEQ ID NO: 2876980 - DNA, 22 bp, Homo sapiens
ctggcctgggtggggcagggcc

SEQ ID NO: 2876981 - DNA, 18 bp, Homo sapiens
ctgggccggcagcctggt

SEQ ID NO: 2876982 - DNA, 18 bp, Homo sapiens
ctgggtaatgaaacaaag

SEQ ID NO: 2876983 - DNA, 14 bp, Homo sapiens
ctggtccaggcttg

SEQ ID NO: 2876984 - DNA, 20 bp, Homo sapiens
ctggttccctctttcctgtg

SEQ ID NO: 2876985 - DNA, 22 bp, Homo sapiens
ctggttgttgcaccatctgctt

SEQ ID NO: 2876986 - DNA, 15 bp, Homo sapiens
ctgtaaatatccaca

SEQ ID NO: 2876987 - DNA, 16 bp, Homo sapiens
ctgtaaatatccacag

SEQ ID NO: 2876988 - DNA, 13 bp, Homo sapiens
ctgtaattaagtg

SEQ ID NO: 2876989 - DNA, 15 bp, Homo sapiens
ctgtaattaagtgca

SEQ ID NO: 2876990 - DNA, 18 bp, Homo sapiens
ctgtaattaagtgcaatt

SEQ ID NO: 2876991 - DNA, 15 bp, Homo sapiens
ctgtagctctgcctc

SEQ ID NO: 2876992 - DNA, 21 bp, Homo sapiens
ctgtattctgcaacagcctgt

SEQ ID NO: 2876993 - DNA, 17 bp, Homo sapiens
ctgtccaatcacattca

SEQ ID NO: 2876994 - DNA, 14 bp, Homo sapiens
ctgtctctgcctgc

SEQ ID NO: 2876995 - DNA, 14 bp, Homo sapiens
ctgtctcttggctt

SEQ ID NO: 2876996 - DNA, 17 bp, Homo sapiens
ctgtctgtcctggaggt

SEQ ID NO: 2876997 - DNA, 15 bp, Homo sapiens
ctgtgatgcctgaca

SEQ ID NO: 2876998 - DNA, 16 bp, Homo sapiens
ctgtgctctggaggct

SEQ ID NO: 2876999 - DNA, 20 bp, Homo sapiens
ctgtgctctggaggctgcag

SEQ ID NO: 2877000 - DNA, 23 bp, Homo sapiens
ctgtggattttttccttcaaagt

SEQ ID NO: 2877001 - DNA, 19 bp, Homo sapiens
ctgtgggccaggagctcag

SEQ ID NO: 2877002 - DNA, 15 bp, Homo sapiens
ctgtgtactgcagtt

SEQ ID NO: 2877003 - DNA, 15 bp, Homo sapiens
ctgtgtcctctcccc

SEQ ID NO: 2877004 - DNA, 13 bp, Homo sapiens
ctgttactgaaat

SEQ ID NO: 2877005 - DNA, 14 bp, Homo sapiens
ctgttactgaaatg

SEQ ID NO: 2877006 - DNA, 13 bp, Homo sapiens
ctgttagcagagt

SEQ ID NO: 2877007 - DNA, 22 bp, Homo sapiens
ctgttagcagagtctgtctctt

SEQ ID NO: 2877008 - DNA, 20 bp, Homo sapiens
ctgtttgggaggctggagtg

SEQ ID NO: 2877009 - DNA, 17 bp, Homo sapiens
cttaaataagaaacttt

SEQ ID NO: 2877010 - DNA, 13 bp, Homo sapiens
cttaacacttaca

SEQ ID NO: 2877011 - DNA, 21 bp, Homo sapiens
cttaatcagatagatattcct

SEQ ID NO: 2877012 - DNA, 16 bp, Homo sapiens
cttcaaagtttaataa

SEQ ID NO: 2877013 - DNA, 22 bp, Homo sapiens
cttcaggaagcataaagcaatt

SEQ ID NO: 2877014 - DNA, 17 bp, Homo sapiens
cttccactaccctccct

SEQ ID NO: 2877015 - DNA, 15 bp, Homo sapiens
cttcctctctctcac

SEQ ID NO: 2877016 - DNA, 23 bp, Homo sapiens
cttcctgggtcctgttccctacc

SEQ ID NO: 2877017 - DNA, 20 bp, Homo sapiens
cttcctgtgggccaggagct

SEQ ID NO: 2877018 - DNA, 19 bp, Homo sapiens
cttcctttaggtctggttg

SEQ ID NO: 2877019 - DNA, 19 bp, Homo sapiens
cttctagaaaacatttttg

SEQ ID NO: 2877020 - DNA, 13 bp, Homo sapiens
cttctatcctgca

SEQ ID NO: 2877021 - DNA, 21 bp, Homo sapiens
cttctgtgcatttgtgtctgc

SEQ ID NO: 2877022 - DNA, 23 bp, Homo sapiens
cttctgtgcatttgtgtctgcct

SEQ ID NO: 2877023 - DNA, 20 bp, Homo sapiens
cttcttccccaggtccttcc

SEQ ID NO: 2877024 - DNA, 23 bp, Homo sapiens
cttgcaggaaggactatgaaaag

SEQ ID NO: 2877025 - DNA, 22 bp, Homo sapiens
cttggctttgtcacttttcctt

SEQ ID NO: 2877026 - DNA, 17 bp, Homo sapiens
cttggggtaagccagag

SEQ ID NO: 2877027 - DNA, 13 bp, Homo sapiens
cttggttggctgg

SEQ ID NO: 2877028 - DNA, 21 bp, Homo sapiens
cttggttggctggcagctgag

SEQ ID NO: 2877029 - DNA, 16 bp, Homo sapiens
ctttccctcaccccct

SEQ ID NO: 2877030 - DNA, 19 bp, Homo sapiens
ctttccctcaccccctccc

SEQ ID NO: 2877031 - DNA, 20 bp, Homo sapiens
ctttgaagaggaaaatgaat

SEQ ID NO: 2877032 - DNA, 21 bp, Homo sapiens
ctttgaagttagctttaactt

SEQ ID NO: 2877033 - DNA, 16 bp, Homo sapiens
ctttgtaaaggtcaga

SEQ ID NO: 2877034 - DNA, 22 bp, Homo sapiens
ctttgtcacttttccttttctt

SEQ ID NO: 2877035 - DNA, 21 bp, Homo sapiens
cttttataggatttatttaaa

SEQ ID NO: 2877036 - DNA, 22 bp, Homo sapiens
cttttcccaaaatgttgaaata

SEQ ID NO: 2877037 - DNA, 15 bp, Homo sapiens
gaaaacttgaatctg

SEQ ID NO: 2877038 - DNA, 21 bp, Homo sapiens
gaaaagagatggcctgagaag

SEQ ID NO: 2877039 - DNA, 12 bp, Homo sapiens
gaaaagcccagt

SEQ ID NO: 2877040 - DNA, 21 bp, Homo sapiens
gaaaagtttaacctaaataat

SEQ ID NO: 2877041 - DNA, 22 bp, Homo sapiens
gaaacataaataaaatgaccag

SEQ ID NO: 2877042 - DNA, 15 bp, Homo sapiens
gaaaccccagggcag

SEQ ID NO: 2877043 - DNA, 17 bp, Homo sapiens
gaaaggagaggaaagaa

SEQ ID NO: 2877044 - DNA, 20 bp, Homo sapiens
gaaatttaaactataagcaa

SEQ ID NO: 2877045 - DNA, 21 bp, Homo sapiens
gaactgagccaaacacactgt

SEQ ID NO: 2877046 - DNA, 18 bp, Homo sapiens
gaactgtggtgccacatg

SEQ ID NO: 2877047 - DNA, 13 bp, Homo sapiens
gaagaaaaagaag

SEQ ID NO: 2877048 - DNA, 19 bp, Homo sapiens
gaagaagtttcatcatttt

SEQ ID NO: 2877049 - DNA, 21 bp, Homo sapiens
gaagaatctcatctcagtgaa

SEQ ID NO: 2877050 - DNA, 15 bp, Homo sapiens
gaagacccacgtgct

SEQ ID NO: 2877051 - DNA, 18 bp, Homo sapiens
gaagaggaaaatgaataa

SEQ ID NO: 2877052 - DNA, 21 bp, Homo sapiens
gaagatgcagcaaaatgtgaa

SEQ ID NO: 2877053 - DNA, 22 bp, Homo sapiens
gaagcaacctcagtaatttaga

SEQ ID NO: 2877054 - DNA, 10 bp, Homo sapiens
gaagcccagt

SEQ ID NO: 2877055 - DNA, 19 bp, Homo sapiens
gaagtaaaagcaaaaaaga

SEQ ID NO: 2877056 - DNA, 15 bp, Homo sapiens
gaagtaaatttgtcc

SEQ ID NO: 2877057 - DNA, 11 bp, Homo sapiens
gaagtttcatc

SEQ ID NO: 2877058 - DNA, 20 bp, Homo sapiens
gaataaggtacaagaagcat

SEQ ID NO: 2877059 - DNA, 19 bp, Homo sapiens
gaatataattgttttatct

SEQ ID NO: 2877060 - DNA, 20 bp, Homo sapiens
gaatataattgttttatctg

SEQ ID NO: 2877061 - DNA, 15 bp, Homo sapiens
gaatctgttactgaa

SEQ ID NO: 2877062 - DNA, 16 bp, Homo sapiens
gaatctgttactgaaa

SEQ ID NO: 2877063 - DNA, 23 bp, Homo sapiens
gaatctgttactgaaatgaggag

SEQ ID NO: 2877064 - DNA, 12 bp, Homo sapiens
gaatgagctggg

SEQ ID NO: 2877065 - DNA, 21 bp, Homo sapiens
gaatgagctgggccctgggtg

SEQ ID NO: 2877066 - DNA, 17 bp, Homo sapiens
gaatggctatgttttta

SEQ ID NO: 2877067 - DNA, 15 bp, Homo sapiens
gaatttgttctcttt

SEQ ID NO: 2877068 - DNA, 17 bp, Homo sapiens
gaatttttaaacaagta

SEQ ID NO: 2877069 - DNA, 23 bp, Homo sapiens
gacaatgcgaggtcgcaactgag

SEQ ID NO: 2877070 - DNA, 21 bp, Homo sapiens
gacacaggggacactgaacct

SEQ ID NO: 2877071 - DNA, 19 bp, Homo sapiens
gacactcctataaggagag

SEQ ID NO: 2877072 - DNA, 21 bp, Homo sapiens
gacagcataccttggactgac

SEQ ID NO: 2877073 - DNA, 14 bp, Homo sapiens
gacagctgcttctg

SEQ ID NO: 2877074 - DNA, 11 bp, Homo sapiens
gacatagcctt

SEQ ID NO: 2877075 - DNA, 12 bp, Homo sapiens
gacatagccttt

SEQ ID NO: 2877076 - DNA, 14 bp, Homo sapiens
gacatagcctttgt

SEQ ID NO: 2877077 - DNA, 13 bp, Homo sapiens
gacccagagtgga

SEQ ID NO: 2877078 - DNA, 16 bp, Homo sapiens
gaccctgttttccaca

SEQ ID NO: 2877079 - DNA, 19 bp, Homo sapiens
gaccctgttttccacacca

SEQ ID NO: 2877080 - DNA, 16 bp, Homo sapiens
gacctgaccggcacct

SEQ ID NO: 2877081 - DNA, 16 bp, Homo sapiens
gacgccactcatttca

SEQ ID NO: 2877082 - DNA, 19 bp, Homo sapiens
gacgccactcatttcatct

SEQ ID NO: 2877083 - DNA, 21 bp, Homo sapiens
gacgccactcatttcatctca

SEQ ID NO: 2877084 - DNA, 21 bp, Homo sapiens
gacgtcctgctggcacctcag

SEQ ID NO: 2877085 - DNA, 20 bp, Homo sapiens
gactaccagctaactccagt

SEQ ID NO: 2877086 - DNA, 14 bp, Homo sapiens
taagtacaaaaaca

SEQ ID NO: 2877087 - DNA, 15 bp, Homo sapiens
taagtgttcagtgtt

SEQ ID NO: 2877088 - DNA, 14 bp, Homo sapiens
taatagatgtttga

SEQ ID NO: 2877089 - DNA, 13 bp, Homo sapiens
taatagcaaagaa

SEQ ID NO: 2877090 - DNA, 14 bp, Homo sapiens
taatatcctaaaca

SEQ ID NO: 2877091 - DNA, 17 bp, Homo sapiens
taatatcctaaacatca

SEQ ID NO: 2877092 - DNA, 13 bp, Homo sapiens
taatgaaacaaag

SEQ ID NO: 2877093 - DNA, 23 bp, Homo sapiens
taatgaaacaaagagttcaagaa

SEQ ID NO: 2877094 - DNA, 12 bp, Homo sapiens
taatggagaaga

SEQ ID NO: 2877095 - DNA, 16 bp, Homo sapiens
taattcaattcaaagc

SEQ ID NO: 2877096 - DNA, 21 bp, Homo sapiens
taatttagaaaactttaaagc

SEQ ID NO: 2877097 - DNA, 14 bp, Homo sapiens
taatttagaaatca

SEQ ID NO: 2877098 - DNA, 15 bp, Homo sapiens
taatttagaaatcat

SEQ ID NO: 2877099 - DNA, 21 bp, Homo sapiens
taatttagacttcaagcatgg

SEQ ID NO: 2877100 - DNA, 17 bp, Homo sapiens
taatttagtttcatata

SEQ ID NO: 2877101 - DNA, 20 bp, Homo sapiens
taatttttgatactaagcat

SEQ ID NO: 2877102 - DNA, 21 bp, Homo sapiens
tacaagaagcattttgtaagt

SEQ ID NO: 2877103 - DNA, 13 bp, Homo sapiens
tacacctccctcc

SEQ ID NO: 2877104 - DNA, 22 bp, Homo sapiens
taccagctaactccagtctcct

SEQ ID NO: 2877105 - DNA, 17 bp, Homo sapiens
taccaggcaccaaaaga

SEQ ID NO: 2877106 - DNA, 21 bp, Homo sapiens
taccaggcaccaaaagaagta

SEQ ID NO: 2877107 - DNA, 12 bp, Homo sapiens
taccctccctcg

SEQ ID NO: 2877108 - DNA, 15 bp, Homo sapiens
tactaaagtgtctat

SEQ ID NO: 2877109 - DNA, 13 bp, Homo sapiens
tactatttcacaa

SEQ ID NO: 2877110 - DNA, 11 bp, Homo sapiens
tactcattttt

SEQ ID NO: 2877111 - DNA, 14 bp, Homo sapiens
tactcatttttcat

SEQ ID NO: 2877112 - DNA, 15 bp, Homo sapiens
tactcccccagccct

SEQ ID NO: 2877113 - DNA, 21 bp, Homo sapiens
tactgaaatgaggagagaagg

SEQ ID NO: 2877114 - DNA, 14 bp, Homo sapiens
tactgtaattaagt

SEQ ID NO: 2877115 - DNA, 20 bp, Homo sapiens
tacttctcattttttaaaaa

SEQ ID NO: 2877116 - DNA, 17 bp, Homo sapiens
tagaaatcattttgcaa

SEQ ID NO: 2877117 - DNA, 18 bp, Homo sapiens
tagaatataaacacataa

SEQ ID NO: 2877118 - DNA, 15 bp, Homo sapiens
tagacagaagaaaca

SEQ ID NO: 2877119 - DNA, 22 bp, Homo sapiens
tagacttcaagcatggctattt

SEQ ID NO: 2877120 - DNA, 14 bp, Homo sapiens
tagcaaagaattga

SEQ ID NO: 2877121 - DNA, 22 bp, Homo sapiens
tagcaactacagtctaaagctg

SEQ ID NO: 2877122 - DNA, 14 bp, Homo sapiens
tagcagagtctgtc

SEQ ID NO: 2877123 - DNA, 15 bp, Homo sapiens
tagcagagtctgtct

SEQ ID NO: 2877124 - DNA, 17 bp, Homo sapiens
tagcagagtctgtctct

SEQ ID NO: 2877125 - DNA, 21 bp, Homo sapiens
tagccaaaaatagctaaatac

SEQ ID NO: 2877126 - DNA, 21 bp, Homo sapiens
tagccagagggtgggagccta

SEQ ID NO: 2877127 - DNA, 15 bp, Homo sapiens
tagcccaagaggtct

SEQ ID NO: 2877128 - DNA, 17 bp, Homo sapiens
tagcccaagaggtctga

SEQ ID NO: 2877129 - DNA, 12 bp, Homo sapiens
tagctctgcctc

SEQ ID NO: 2877130 - DNA, 17 bp, Homo sapiens
tagctctgcctccctct

SEQ ID NO: 2877131 - DNA, 17 bp, Homo sapiens
taggatttatttaaaat

SEQ ID NO: 2877132 - DNA, 21 bp, Homo sapiens
taggatttatttaaaatagca

SEQ ID NO: 2877133 - DNA, 22 bp, Homo sapiens
taggatttatttaaaatagcaa

SEQ ID NO: 2877134 - DNA, 17 bp, Homo sapiens
tagtaatctgcattatt

SEQ ID NO: 2877135 - DNA, 13 bp, Homo sapiens
tagtgtgtcagag

SEQ ID NO: 2877136 - DNA, 12 bp, Homo sapiens
tagttgtgtctg

SEQ ID NO: 2877137 - DNA, 19 bp, Homo sapiens
tagtttcatataaagtatc

SEQ ID NO: 2877138 - DNA, 15 bp, Homo sapiens
tagtttcctatggaa

SEQ ID NO: 2877139 - DNA, 16 bp, Homo sapiens
tagttttctttgtaaa

SEQ ID NO: 2877140 - DNA, 18 bp, Homo sapiens
tagttttctttgtaaagg

SEQ ID NO: 2877141 - DNA, 16 bp, Homo sapiens
tataaactactgtaat

SEQ ID NO: 2877142 - DNA, 15 bp, Homo sapiens
tataagtgttcagtg

SEQ ID NO: 2877143 - DNA, 17 bp, Homo sapiens
tataagtgttcagtgtt

SEQ ID NO: 2877144 - DNA, 18 bp, Homo sapiens
tataagtgttcagtgttg

SEQ ID NO: 2877145 - DNA, 18 bp, Homo sapiens
tataatactaaagtgtct

SEQ ID NO: 2877146 - DNA, 20 bp, Homo sapiens
tataatactaaagtgtctat

SEQ ID NO: 2877147 - DNA, 18 bp, Homo sapiens
tataattgttttatctga

SEQ ID NO: 2877148 - DNA, 14 bp, Homo sapiens
tatataatactaaa

SEQ ID NO: 2877149 - DNA, 19 bp, Homo sapiens
tatataatactaaagtgtc

SEQ ID NO: 2877150 - DNA, 19 bp, Homo sapiens
tatatttaactctctttat

SEQ ID NO: 2877151 - DNA, 19 bp, Homo sapiens
tatcaaacaccaacataaa

SEQ ID NO: 2877152 - DNA, 19 bp, Homo sapiens
tatctgaatttttaaacaa

SEQ ID NO: 2877153 - DNA, 18 bp, Homo sapiens
tatcttactatttcacaa

SEQ ID NO: 2877154 - DNA, 14 bp, Homo sapiens
tatgaaaagctaga

SEQ ID NO: 2877155 - DNA, 19 bp, Homo sapiens
tatgaaaagctagaattga

SEQ ID NO: 2877156 - DNA, 18 bp, Homo sapiens
tatgatgttaaaaaaata

SEQ ID NO: 2877157 - DNA, 16 bp, Homo sapiens
tatgattttttcatga

SEQ ID NO: 2877158 - DNA, 18 bp, Homo sapiens
tattagttttctttgtaa

SEQ ID NO: 2877159 - DNA, 21 bp, Homo sapiens
tattagttttctttgtaaagg

SEQ ID NO: 2877160 - DNA, 17 bp, Homo sapiens
tattgtgcaatgtaaat

SEQ ID NO: 2877161 - DNA, 20 bp, Homo sapiens
tatttaaaaaactaaaaact

SEQ ID NO: 2877162 - DNA, 14 bp, Homo sapiens
tatttaaaatagca

SEQ ID NO: 2877163 - DNA, 19 bp, Homo sapiens
tatttaaaccgctaaaaga

SEQ ID NO: 2877164 - DNA, 15 bp, Homo sapiens
tatttcacaacagcc

SEQ ID NO: 2877165 - DNA, 12 bp, Homo sapiens
tatttgcaaatc

SEQ ID NO: 2877166 - DNA, 14 bp, Homo sapiens
tatttgtaatagat

SEQ ID NO: 2877167 - DNA, 20 bp, Homo sapiens
tatttgtaatagatgtttga

SEQ ID NO: 2877168 - DNA, 12 bp, Homo sapiens
tattttaaagaa

SEQ ID NO: 2877169 - DNA, 13 bp, Homo sapiens
tcaaagcaagcat

SEQ ID NO: 2877170 - DNA, 15 bp, Homo sapiens
tcaaagcaagcattc

SEQ ID NO: 2877171 - DNA, 19 bp, Homo sapiens
tcaaagcaagcattcagaa

SEQ ID NO: 2877172 - DNA, 13 bp, Homo sapiens
tcaaagtttaata

SEQ ID NO: 2877173 - DNA, 14 bp, Homo sapiens
tcaaagtttaataa

SEQ ID NO: 2877174 - DNA, 15 bp, Homo sapiens
tcaaatggaaaggag

SEQ ID NO: 2877175 - DNA, 23 bp, Homo sapiens
tcaaatggaaaggagaggaaaga

SEQ ID NO: 2877176 - DNA, 15 bp, Homo sapiens
tcaacccctcccctc

SEQ ID NO: 2877177 - DNA, 21 bp, Homo sapiens
tcaacccctcccctccatccc

SEQ ID NO: 2877178 - DNA, 20 bp, Homo sapiens
tcaacctactttcatactga

SEQ ID NO: 2877179 - DNA, 14 bp, Homo sapiens
tcaagaaaataagt

SEQ ID NO: 2877180 - DNA, 14 bp, Homo sapiens
tcaagaaataagtt

SEQ ID NO: 2877181 - DNA, 19 bp, Homo sapiens
tcaatcagtctcagaatgt

SEQ ID NO: 2877182 - DNA, 15 bp, Homo sapiens
tcaattcaaagctgt

SEQ ID NO: 2877183 - DNA, 22 bp, Homo sapiens
tcaattcaaagctgtgtgtttg

SEQ ID NO: 2877184 - DNA, 20 bp, Homo sapiens
tcaattctgatacagcctta

SEQ ID NO: 2877185 - DNA, 22 bp, Homo sapiens
tcacaacagcctgacaacattt

SEQ ID NO: 2877186 - DNA, 14 bp, Homo sapiens
tcacattccctctc

SEQ ID NO: 2877187 - DNA, 16 bp, Homo sapiens
tcacattccctctcat

SEQ ID NO: 2877188 - DNA, 17 bp, Homo sapiens
tcacattccctctcatc

SEQ ID NO: 2877189 - DNA, 23 bp, Homo sapiens
tcaccctctgggcagctgtcatg

SEQ ID NO: 2877190 - DNA, 16 bp, Homo sapiens
tcaccgggatgaacct

SEQ ID NO: 2877191 - DNA, 15 bp, Homo sapiens
tcacctacttcctcc

SEQ ID NO: 2877192 - DNA, 18 bp, Homo sapiens
tcacctacttcctcctcc

SEQ ID NO: 2877193 - DNA, 19 bp, Homo sapiens
tcacctacttcctcctcct

SEQ ID NO: 2877194 - DNA, 16 bp, Homo sapiens
tcacgctttttgaaaa

SEQ ID NO: 2877195 - DNA, 17 bp, Homo sapiens
tcactgctgtccctcct

SEQ ID NO: 2877196 - DNA, 20 bp, Homo sapiens
tcactgctgtccctcctgag

SEQ ID NO: 2877197 - DNA, 14 bp, Homo sapiens
tcacttgagacaaa

SEQ ID NO: 2877198 - DNA, 17 bp, Homo sapiens
tcacttttccttttctt

SEQ ID NO: 2877199 - DNA, 12 bp, Homo sapiens
tcagaataaatg

SEQ ID NO: 2877200 - DNA, 23 bp, Homo sapiens
tcagaataaatgggtaacactga

SEQ ID NO: 2877201 - DNA, 16 bp, Homo sapiens
tcagacaatccactct

SEQ ID NO: 2877202 - DNA, 23 bp, Homo sapiens
tcagacaatccactctcaggagg

SEQ ID NO: 2877203 - DNA, 14 bp, Homo sapiens
tcagaggagaagag

SEQ ID NO: 2877204 - DNA, 16 bp, Homo sapiens
tcagccgtgcactccc

SEQ ID NO: 2877205 - DNA, 20 bp, Homo sapiens
tcagccgtgcactccctaag

SEQ ID NO: 2877206 - DNA, 12 bp, Homo sapiens
tcaggaaaattg

SEQ ID NO: 2877207 - DNA, 12 bp, Homo sapiens
ttatacaataat

SEQ ID NO: 2877208 - DNA, 18 bp, Homo sapiens
ttatctgaatttttaaac

SEQ ID NO: 2877209 - DNA, 20 bp, Homo sapiens
ttatctgaatttttaaacaa

SEQ ID NO: 2877210 - DNA, 21 bp, Homo sapiens
ttatctgaatttttaaacaag

SEQ ID NO: 2877211 - DNA, 18 bp, Homo sapiens
ttatgaaaaagaagaatc

SEQ ID NO: 2877212 - DNA, 17 bp, Homo sapiens
ttattttgacataaagt

SEQ ID NO: 2877213 - DNA, 14 bp, Homo sapiens
ttcaacaattctaa

SEQ ID NO: 2877214 - DNA, 17 bp, Homo sapiens
ttcaacatgttatttgt

SEQ ID NO: 2877215 - DNA, 21 bp, Homo sapiens
ttcaacatgttatttgtaata

SEQ ID NO: 2877216 - DNA, 15 bp, Homo sapiens
ttcaattcaaagctg

SEQ ID NO: 2877217 - DNA, 19 bp, Homo sapiens
ttcacagcctataaccaga

SEQ ID NO: 2877218 - DNA, 12 bp, Homo sapiens
ttcagaagaaaa

SEQ ID NO: 2877219 - DNA, 14 bp, Homo sapiens
ttcagaagaaaaag

SEQ ID NO: 2877220 - DNA, 13 bp, Homo sapiens
ttcaggaaaattg

SEQ ID NO: 2877221 - DNA, 16 bp, Homo sapiens
ttcagtgttgacatag

SEQ ID NO: 2877222 - DNA, 17 bp, Homo sapiens
ttcagtgttgacatagc

SEQ ID NO: 2877223 - DNA, 18 bp, Homo sapiens
ttcagtgttgacatagcc

SEQ ID NO: 2877224 - DNA, 20 bp, Homo sapiens
ttcagtgttgacatagcctt

SEQ ID NO: 2877225 - DNA, 22 bp, Homo sapiens
ttcagtgttgacatagcctttg

SEQ ID NO: 2877226 - DNA, 18 bp, Homo sapiens
ttcatcgaacaaactgat

SEQ ID NO: 2877227 - DNA, 13 bp, Homo sapiens
ttcatctcattta

SEQ ID NO: 2877228 - DNA, 12 bp, Homo sapiens
ttcatgataatg

SEQ ID NO: 2877229 - DNA, 15 bp, Homo sapiens
ttcatgataatgaac

SEQ ID NO: 2877230 - DNA, 18 bp, Homo sapiens
ttccactaccctccctcg

SEQ ID NO: 2877231 - DNA, 16 bp, Homo sapiens
ttccatgtgaaaataa

SEQ ID NO: 2877232 - DNA, 19 bp, Homo sapiens
ttcccaaaatgttgaaata

SEQ ID NO: 2877233 - DNA, 19 bp, Homo sapiens
ttcccctacacctccctcc

SEQ ID NO: 2877234 - DNA, 14 bp, Homo sapiens
ttccctcaccccct

SEQ ID NO: 2877235 - DNA, 19 bp, Homo sapiens
ttccctcaccccctcccac

SEQ ID NO: 2877236 - DNA, 22 bp, Homo sapiens
ttccctcaccccctcccacccc

SEQ ID NO: 2877237 - DNA, 14 bp, Homo sapiens
ttccctctttcctg

SEQ ID NO: 2877238 - DNA, 15 bp, Homo sapiens
ttcccttctatgcag

SEQ ID NO: 2877239 - DNA, 14 bp, Homo sapiens
ttccctttgttgct

SEQ ID NO: 2877240 - DNA, 14 bp, Homo sapiens
ttccgtctcctctc

SEQ ID NO: 2877241 - DNA, 12 bp, Homo sapiens
ttcctctctctc

SEQ ID NO: 2877242 - DNA, 15 bp, Homo sapiens
ttcctctctctcacc

SEQ ID NO: 2877243 - DNA, 17 bp, Homo sapiens
ttcctgtgccaggactc

SEQ ID NO: 2877244 - DNA, 23 bp, Homo sapiens
ttcctgtgccaggactctctttc

SEQ ID NO: 2877245 - DNA, 14 bp, Homo sapiens
ttccttctcgtctt

SEQ ID NO: 2877246 - DNA, 19 bp, Homo sapiens
ttccttctcgtcttcctct

SEQ ID NO: 2877247 - DNA, 14 bp, Homo sapiens
ttccttttcttaaa

SEQ ID NO: 2877248 - DNA, 15 bp, Homo sapiens
ttccttttcttaaaa

SEQ ID NO: 2877249 - DNA, 15 bp, Homo sapiens
ttctaaaatgattgt

SEQ ID NO: 2877250 - DNA, 14 bp, Homo sapiens
ttctatagccaaaa

SEQ ID NO: 2877251 - DNA, 15 bp, Homo sapiens
ttctatagccaaaaa

SEQ ID NO: 2877252 - DNA, 17 bp, Homo sapiens
ttctcattttttaaaaa

SEQ ID NO: 2877253 - DNA, 22 bp, Homo sapiens
ttctcattttttaaaaaagctt

SEQ ID NO: 2877254 - DNA, 13 bp, Homo sapiens
ttctcttctatcc

SEQ ID NO: 2877255 - DNA, 15 bp, Homo sapiens
ttctgcaacagcctg

SEQ ID NO: 2877256 - DNA, 24 bp, Homo sapiens
ttctgtgcatttgtgtctgcctgc

SEQ ID NO: 2877257 - DNA, 16 bp, Homo sapiens
ttcttcaccaaatctt

SEQ ID NO: 2877258 - DNA, 20 bp, Homo sapiens
ttcttccccaggtccttcct

SEQ ID NO: 2877259 - DNA, 15 bp, Homo sapiens
ttctttgtaaaggtc

SEQ ID NO: 2877260 - DNA, 14 bp, Homo sapiens
ttcttttaaagaag

SEQ ID NO: 2877261 - DNA, 22 bp, Homo sapiens
ttgaaataattatgcagacaca

SEQ ID NO: 2877262 - DNA, 23 bp, Homo sapiens
ttgaagttagctttaacttaaat

SEQ ID NO: 2877263 - DNA, 19 bp, Homo sapiens
ttgaatctgttactgaaat

SEQ ID NO: 2877264 - DNA, 21 bp, Homo sapiens
ttgaatctgttactgaaatga

SEQ ID NO: 2877265 - DNA, 22 bp, Homo sapiens
ttgatgccaaaaaaaaatacat

SEQ ID NO: 2877266 - DNA, 14 bp, Homo sapiens
ttgatgccagctgt

SEQ ID NO: 2877267 - DNA, 16 bp, Homo sapiens
ttgcaccatctgcttg

SEQ ID NO: 2877268 - DNA, 17 bp, Homo sapiens
ttgccacaatgcctctc

SEQ ID NO: 2877269 - DNA, 19 bp, Homo sapiens
ttgccacaatgcctctccc

SEQ ID NO: 2877270 - DNA, 22 bp, Homo sapiens
ttgccacaatgcctctcccacg

SEQ ID NO: 2877271 - DNA, 12 bp, Homo sapiens
ttgctcctaccc

SEQ ID NO: 2877272 - DNA, 19 bp, Homo sapiens
ttgctcctacccctgtcct

SEQ ID NO: 2877273 - DNA, 15 bp, Homo sapiens
ttgctgtctggcttt

SEQ ID NO: 2877274 - DNA, 18 bp, Homo sapiens
ttgctgtctggctttccc

SEQ ID NO: 2877275 - DNA, 23 bp, Homo sapiens
ttggccaatgcacctaaagaaaa

SEQ ID NO: 2877276 - DNA, 16 bp, Homo sapiens
ttggttttgctacata

SEQ ID NO: 2877277 - DNA, 21 bp, Homo sapiens
ttggttttgctacataattat

SEQ ID NO: 2877278 - DNA, 15 bp, Homo sapiens
ttgtaaaggtcagag

SEQ ID NO: 2877279 - DNA, 20 bp, Homo sapiens
ttgtaaaggtcagagtcaaa

SEQ ID NO: 2877280 - DNA, 23 bp, Homo sapiens
ttgtcacttttccttttcttaaa

SEQ ID NO: 2877281 - DNA, 18 bp, Homo sapiens
ttgtccaatggctgtaaa

SEQ ID NO: 2877282 - DNA, 19 bp, Homo sapiens
ttgtccaatggctgtaaac

SEQ ID NO: 2877283 - DNA, 22 bp, Homo sapiens
ttgtccaatggctgtaaactat

SEQ ID NO: 2877284 - DNA, 12 bp, Homo sapiens
ttgtcttaatat

SEQ ID NO: 2877285 - DNA, 17 bp, Homo sapiens
ttgtgcaatgtaaatat

SEQ ID NO: 2877286 - DNA, 18 bp, Homo sapiens
ttgtgcaatgtaaatatt

SEQ ID NO: 2877287 - DNA, 22 bp, Homo sapiens
ttgtgcaatgtaaatattttaa

SEQ ID NO: 2877288 - DNA, 19 bp, Homo sapiens
ttgttaatttagaaaactt

SEQ ID NO: 2877289 - DNA, 13 bp, Homo sapiens
tttaaaaaagctt

SEQ ID NO: 2877290 - DNA, 17 bp, Homo sapiens
tttaaaaaagcttaaaa

SEQ ID NO: 2877291 - DNA, 15 bp, Homo sapiens
tttaaacaagtattt

SEQ ID NO: 2877292 - DNA, 20 bp, Homo sapiens
tttaaaccgctaaaagaaac

SEQ ID NO: 2877293 - DNA, 23 bp, Homo sapiens
tttaaaccgctaaaagaaacttt

SEQ ID NO: 2877294 - DNA, 20 bp, Homo sapiens
tttaaagaagtaaatttgtc

SEQ ID NO: 2877295 - DNA, 12 bp, Homo sapiens
tttaaagaattg

SEQ ID NO: 2877296 - DNA, 17 bp, Homo sapiens
tttaaagcgtttgcaca

SEQ ID NO: 2877297 - DNA, 13 bp, Homo sapiens
tttaacttaaata

SEQ ID NO: 2877298 - DNA, 20 bp, Homo sapiens
tttaagccaaaacaatgttt

SEQ ID NO: 2877299 - DNA, 14 bp, Homo sapiens
tttaataaatttat

SEQ ID NO: 2877300 - DNA, 18 bp, Homo sapiens
tttaatagcaaagaattg

SEQ ID NO: 2877301 - DNA, 12 bp, Homo sapiens
tttagaaaactt

SEQ ID NO: 2877302 - DNA, 16 bp, Homo sapiens
tttagaaatcattttg

SEQ ID NO: 2877303 - DNA, 18 bp, Homo sapiens
tttaggaagcaagcttaa

SEQ ID NO: 2877304 - DNA, 19 bp, Homo sapiens
tttatgtctgtggattttt

SEQ ID NO: 2877305 - DNA, 13 bp, Homo sapiens
tttcaaaagtgat

SEQ ID NO: 2877306 - DNA, 23 bp, Homo sapiens
tttcacaacagcctgacaacatt

SEQ ID NO: 2877307 - DNA, 21 bp, Homo sapiens
tttcaggacagctgcttctgt

SEQ ID NO: 2877308 - DNA, 14 bp, Homo sapiens
tttccacaccatca

SEQ ID NO: 2877309 - DNA, 20 bp, Homo sapiens
tttcccctctgtgtcctctc

SEQ ID NO: 2877310 - DNA, 20 bp, Homo sapiens
tttccttctcgtcttcctct

SEQ ID NO: 2877311 - DNA, 22 bp, Homo sapiens
tttccttctcgtcttcctctct

SEQ ID NO: 2877312 - DNA, 15 bp, Homo sapiens
tttccttttcttaaa

SEQ ID NO: 2877313 - DNA, 18 bp, Homo sapiens
tttctatagccaaaaata

SEQ ID NO: 2877314 - DNA, 12 bp, Homo sapiens
tttctctgagca

SEQ ID NO: 2877315 - DNA, 12 bp, Homo sapiens
tttcttaaataa

SEQ ID NO: 2877316 - DNA, 18 bp, Homo sapiens
tttcttaaataagaaact

SEQ ID NO: 2877317 - DNA, 20 bp, Homo sapiens
tttcttaaataagaaacttt

SEQ ID NO: 2877318 - DNA, 23 bp, Homo sapiens
tttgaaataattatgcagacaca

SEQ ID NO: 2877319 - DNA, 17 bp, Homo sapiens
tttgaagttagctttaa

SEQ ID NO: 2877320 - DNA, 23 bp, Homo sapiens
tttgaagttagctttaacttaaa

SEQ ID NO: 2877321 - DNA, 18 bp, Homo sapiens
tttgatactaagcattga

SEQ ID NO: 2877322 - DNA, 21 bp, Homo sapiens
tttgatagcagaagaaaaagt

SEQ ID NO: 2877323 - DNA, 21 bp, Homo sapiens
tttggtttcccaagagctacg

SEQ ID NO: 2877324 - DNA, 20 bp, Homo sapiens
tttgtccaatggctgtaaac

SEQ ID NO: 2877325 - DNA, 15 bp, Homo sapiens
tttgtgtctgcctgc

SEQ ID NO: 2877326 - DNA, 20 bp, Homo sapiens
tttgtgtctgcctgcctcat

SEQ ID NO: 2877327 - DNA, 22 bp, Homo sapiens
aagactatcttactatttcaca

SEQ ID NO: 2877328 - DNA, 13 bp, Homo sapiens
aagagaagtagaa

SEQ ID NO: 2877329 - DNA, 13 bp, Homo sapiens
aagaggaaaatga

SEQ ID NO: 2877330 - DNA, 14 bp, Homo sapiens
aagaggaaaatgaa

SEQ ID NO: 2877331 - DNA, 21 bp, Homo sapiens
aagaggaaaatgaataataca

SEQ ID NO: 2877332 - DNA, 18 bp, Homo sapiens
aagaggaagttaaaattt

SEQ ID NO: 2877333 - DNA, 20 bp, Homo sapiens
aagaggaagttaaaatttga

SEQ ID NO: 2877334 - DNA, 17 bp, Homo sapiens
aagaggactgagactgg

SEQ ID NO: 2877335 - DNA, 13 bp, Homo sapiens
aagattttttaat

SEQ ID NO: 2877336 - DNA, 19 bp, Homo sapiens
aagcaacctcagtaattta

SEQ ID NO: 2877337 - DNA, 17 bp, Homo sapiens
aagcaagaaagccgtac

SEQ ID NO: 2877338 - DNA, 15 bp, Homo sapiens
aagcaagcattcaga

SEQ ID NO: 2877339 - DNA, 19 bp, Homo sapiens
aagcaagcattcagaagaa

SEQ ID NO: 2877340 - DNA, 18 bp, Homo sapiens
aagcatggagagtggcat

SEQ ID NO: 2877341 - DNA, 15 bp, Homo sapiens
aagcattcagaagaa

SEQ ID NO: 2877342 - DNA, 16 bp, Homo sapiens
aagcattgaatggcta

SEQ ID NO: 2877343 - DNA, 15 bp, Homo sapiens
aagccagagcctggg

SEQ ID NO: 2877344 - DNA, 15 bp, Homo sapiens
aagccatgccaataa

SEQ ID NO: 2877345 - DNA, 17 bp, Homo sapiens
aagcttaaaactttgaa

SEQ ID NO: 2877346 - DNA, 17 bp, Homo sapiens
aaggacatgtgctattg

SEQ ID NO: 2877347 - DNA, 21 bp, Homo sapiens
aaggactatgaaaagctagaa

SEQ ID NO: 2877348 - DNA, 13 bp, Homo sapiens
aaggcaaaaatag

SEQ ID NO: 2877349 - DNA, 21 bp, Homo sapiens
aagggggctattccctggaga

SEQ ID NO: 2877350 - DNA, 18 bp, Homo sapiens
aagggtgggcatcaaaga

SEQ ID NO: 2877351 - DNA, 20 bp, Homo sapiens
aagtatttgttaatttagaa

SEQ ID NO: 2877352 - DNA, 20 bp, Homo sapiens
aagtccatagctgagctgga

SEQ ID NO: 2877353 - DNA, 17 bp, Homo sapiens
aagtgaagccccttgtc

SEQ ID NO: 2877354 - DNA, 19 bp, Homo sapiens
aagtgaagccccttgtcct

SEQ ID NO: 2877355 - DNA, 21 bp, Homo sapiens
aagtgatctgtcccctctccc

SEQ ID NO: 2877356 - DNA, 22 bp, Homo sapiens
aagtgatctgtcccctctcccc

SEQ ID NO: 2877357 - DNA, 15 bp, Homo sapiens
aagtgttcagtgttg

SEQ ID NO: 2877358 - DNA, 18 bp, Homo sapiens
aagtgttcagtgttgaca

SEQ ID NO: 2877359 - DNA, 16 bp, Homo sapiens
aagttagctttaactt

SEQ ID NO: 2877360 - DNA, 18 bp, Homo sapiens
aagttccgtctcctctcc

SEQ ID NO: 2877361 - DNA, 16 bp, Homo sapiens
aagttgcagtctcaga

SEQ ID NO: 2877362 - DNA, 17 bp, Homo sapiens
aagtttaataaatttat

SEQ ID NO: 2877363 - DNA, 20 bp, Homo sapiens
aataaatttattttcttgga

SEQ ID NO: 2877364 - DNA, 13 bp, Homo sapiens
aataagaaacttt

SEQ ID NO: 2877365 - DNA, 23 bp, Homo sapiens
aatacaatagtatgcagctaaaa

SEQ ID NO: 2877366 - DNA, 16 bp, Homo sapiens
aatactaaagtgtcta

SEQ ID NO: 2877367 - DNA, 22 bp, Homo sapiens
aatactgttatatctaaattta

SEQ ID NO: 2877368 - DNA, 14 bp, Homo sapiens
aatacttctcattt

SEQ ID NO: 2877369 - DNA, 20 bp, Homo sapiens
aatagcaaaagaagaagttt

SEQ ID NO: 2877370 - DNA, 15 bp, Homo sapiens
aatagtatttcccat

SEQ ID NO: 2877371 - DNA, 15 bp, Homo sapiens
aatataattgtttta

SEQ ID NO: 2877372 - DNA, 22 bp, Homo sapiens
aatatatatctatctatttgag

SEQ ID NO: 2877373 - DNA, 14 bp, Homo sapiens
aatatcctaaacat

SEQ ID NO: 2877374 - DNA, 16 bp, Homo sapiens
aatatcctaaacatca

SEQ ID NO: 2877375 - DNA, 16 bp, Homo sapiens
aatatgatgttaaaaa

SEQ ID NO: 2877376 - DNA, 13 bp, Homo sapiens
aatattttaaaga

SEQ ID NO: 2877377 - DNA, 16 bp, Homo sapiens
aatattttaaagaatt

SEQ ID NO: 2877378 - DNA, 11 bp, Homo sapiens
aatcacattca

SEQ ID NO: 2877379 - DNA, 14 bp, Homo sapiens
aatcacgctttttg

SEQ ID NO: 2877380 - DNA, 15 bp, Homo sapiens
aatcacgctttttga

SEQ ID NO: 2877381 - DNA, 16 bp, Homo sapiens
aatcacgctttttgaa

SEQ ID NO: 2877382 - DNA, 18 bp, Homo sapiens
aatcactcattctatgaa

SEQ ID NO: 2877383 - DNA, 24 bp, Homo sapiens
aatcagtctcagaatgtcattttg

SEQ ID NO: 2877384 - DNA, 14 bp, Homo sapiens
aatccactctcagg

SEQ ID NO: 2877385 - DNA, 21 bp, Homo sapiens
aatcccttaatatcctaaaca

SEQ ID NO: 2877386 - DNA, 14 bp, Homo sapiens
aatctagtttccta

SEQ ID NO: 2877387 - DNA, 17 bp, Homo sapiens
aatctcatctcagtgaa

SEQ ID NO: 2877388 - DNA, 11 bp, Homo sapiens
aatctcattcc

SEQ ID NO: 2877389 - DNA, 19 bp, Homo sapiens
aatgaccagtaattgtgaa

SEQ ID NO: 2877390 - DNA, 18 bp, Homo sapiens
aatgaggagagaaggaca

SEQ ID NO: 2877391 - DNA, 15 bp, Homo sapiens
aatgccttttcccaa

SEQ ID NO: 2877392 - DNA, 14 bp, Homo sapiens
aatggctatgtttt

SEQ ID NO: 2877393 - DNA, 20 bp, Homo sapiens
aatggctatgtttttaatgt

SEQ ID NO: 2877394 - DNA, 16 bp, Homo sapiens
aatggctgataatttt

SEQ ID NO: 2877395 - DNA, 18 bp, Homo sapiens
aatggctgataattttaa

SEQ ID NO: 2877396 - DNA, 17 bp, Homo sapiens
aatgtaaatattttaaa

SEQ ID NO: 2877397 - DNA, 16 bp, Homo sapiens
aatgtccagccacccc

SEQ ID NO: 2877398 - DNA, 17 bp, Homo sapiens
aatgtgaatgggaaaag

SEQ ID NO: 2877399 - DNA, 22 bp, Homo sapiens
aatgtgattcctttgaagagga

SEQ ID NO: 2877400 - DNA, 18 bp, Homo sapiens
aatgtgtattttatatga

SEQ ID NO: 2877401 - DNA, 15 bp, Homo sapiens
aatgttgaaatatga

SEQ ID NO: 2877402 - DNA, 15 bp, Homo sapiens
aatgtttaaaccttt

SEQ ID NO: 2877403 - DNA, 13 bp, Homo sapiens
aattatccaggaa

SEQ ID NO: 2877404 - DNA, 22 bp, Homo sapiens
aattatttaaaccgctaaaaga

SEQ ID NO: 2877405 - DNA, 13 bp, Homo sapiens
aattcaattcaaa

SEQ ID NO: 2877406 - DNA, 18 bp, Homo sapiens
aattgagtgtttaaagtt

SEQ ID NO: 2877407 - DNA, 17 bp, Homo sapiens
aatttagaaatcatttt

SEQ ID NO: 2877408 - DNA, 21 bp, Homo sapiens
aatttagtttcatataaagta

SEQ ID NO: 2877409 - DNA, 19 bp, Homo sapiens
aatttatcttgttcaatga

SEQ ID NO: 2877410 - DNA, 15 bp, Homo sapiens
aatttttaaacaagt

SEQ ID NO: 2877411 - DNA, 19 bp, Homo sapiens
aatttttaaacaagtattt

SEQ ID NO: 2877412 - DNA, 18 bp, Homo sapiens
aatttttttgtattttag

SEQ ID NO: 2877413 - DNA, 16 bp, Homo sapiens
acaaagagttcaagaa

SEQ ID NO: 2877414 - DNA, 14 bp, Homo sapiens
acaacaaggaccct

SEQ ID NO: 2877415 - DNA, 14 bp, Homo sapiens
acaacatttctata

SEQ ID NO: 2877416 - DNA, 20 bp, Homo sapiens
acaacatttctatagccaaa

SEQ ID NO: 2877417 - DNA, 18 bp, Homo sapiens
acaacctgagttcaagtc

SEQ ID NO: 2877418 - DNA, 15 bp, Homo sapiens
acaagaagcattttg

SEQ ID NO: 2877419 - DNA, 18 bp, Homo sapiens
acaagaagcattttgtaa

SEQ ID NO: 2877420 - DNA, 13 bp, Homo sapiens
acaatccactctc

SEQ ID NO: 2877421 - DNA, 13 bp, Homo sapiens
acaatgcctctcc

SEQ ID NO: 2877422 - DNA, 14 bp, Homo sapiens
acaattctaaaatg

SEQ ID NO: 2877423 - DNA, 23 bp, Homo sapiens
acaattctaaaatgattgtagta

SEQ ID NO: 2877424 - DNA, 13 bp, Homo sapiens
acacactgtaaat

SEQ ID NO: 2877425 - DNA, 13 bp, Homo sapiens
acacagcccaaga

SEQ ID NO: 2877426 - DNA, 16 bp, Homo sapiens
acacaggggacactga

SEQ ID NO: 2877427 - DNA, 22 bp, Homo sapiens
acacatactcatttttcatgat

SEQ ID NO: 2877428 - DNA, 24 bp, Homo sapiens
acactgaaccttgttgatgccagc

SEQ ID NO: 2877429 - DNA, 18 bp, Homo sapiens
acactgtaaatatccaca

SEQ ID NO: 2877430 - DNA, 18 bp, Homo sapiens
acactgtgtactgcagtt

SEQ ID NO: 2877431 - DNA, 16 bp, Homo sapiens
acagaaactatatgca

SEQ ID NO: 2877432 - DNA, 16 bp, Homo sapiens
acagaacatagacaga

SEQ ID NO: 2877433 - DNA, 13 bp, Homo sapiens
acagaggccaggc

SEQ ID NO: 2877434 - DNA, 17 bp, Homo sapiens
acagcctgacaacattt

SEQ ID NO: 2877435 - DNA, 20 bp, Homo sapiens
acagcctgacaacatttcta

SEQ ID NO: 2877436 - DNA, 13 bp, Homo sapiens
acagctgcttctg

SEQ ID NO: 2877437 - DNA, 17 bp, Homo sapiens
acagctgcttctgtgca

SEQ ID NO: 2877438 - DNA, 15 bp, Homo sapiens
acaggggacactgaa

SEQ ID NO: 2877439 - DNA, 15 bp, Homo sapiens
acagtctaaagctgg

SEQ ID NO: 2877440 - DNA, 18 bp, Homo sapiens
acagtgacactactttct

SEQ ID NO: 2877441 - DNA, 22 bp, Homo sapiens
acagtgcactcagagctgctga

SEQ ID NO: 2877442 - DNA, 19 bp, Homo sapiens
acataaaaatgatctaaac

SEQ ID NO: 2877443 - DNA, 19 bp, Homo sapiens
acataaataaaatgaccag

SEQ ID NO: 2877444 - DNA, 21 bp, Homo sapiens
acataatttagtttcatataa

SEQ ID NO: 2877445 - DNA, 17 bp, Homo sapiens
acatactcatttttcat

SEQ ID NO: 2877446 - DNA, 16 bp, Homo sapiens
acatagacagaagaaa

SEQ ID NO: 2877447 - DNA, 13 bp, Homo sapiens
acatagcctttgt

SEQ ID NO: 2877448 - DNA, 18 bp, Homo sapiens
atggattctaaaatgcct

SEQ ID NO: 2877449 - DNA, 15 bp, Homo sapiens
atggcccagcctgga

SEQ ID NO: 2877450 - DNA, 18 bp, Homo sapiens
atggcccagcctggagcc

SEQ ID NO: 2877451 - DNA, 19 bp, Homo sapiens
atggcccagcctggagccg

SEQ ID NO: 2877452 - DNA, 19 bp, Homo sapiens
atggctatgtttttaatgt

SEQ ID NO: 2877453 - DNA, 17 bp, Homo sapiens
atggctgtaaactataa

SEQ ID NO: 2877454 - DNA, 18 bp, Homo sapiens
atggctgtaaactataaa

SEQ ID NO: 2877455 - DNA, 20 bp, Homo sapiens
atggctgtaaactataaact

SEQ ID NO: 2877456 - DNA, 14 bp, Homo sapiens
atgggaaaagagat

SEQ ID NO: 2877457 - DNA, 20 bp, Homo sapiens
atggttttctccaagagcta

SEQ ID NO: 2877458 - DNA, 21 bp, Homo sapiens
atggttttctccaagagctac

SEQ ID NO: 2877459 - DNA, 13 bp, Homo sapiens
atgtaaaacattt

SEQ ID NO: 2877460 - DNA, 21 bp, Homo sapiens
atgtaaatattttaaagaatt

SEQ ID NO: 2877461 - DNA, 15 bp, Homo sapiens
atgtatagtaaatca

SEQ ID NO: 2877462 - DNA, 17 bp, Homo sapiens
atgtcaaggactcctgt

SEQ ID NO: 2877463 - DNA, 16 bp, Homo sapiens
atgtgaatgggaaaag

SEQ ID NO: 2877464 - DNA, 20 bp, Homo sapiens
atgtgattcctttgaagagg

SEQ ID NO: 2877465 - DNA, 18 bp, Homo sapiens
atgtgctattgaactgag

SEQ ID NO: 2877466 - DNA, 22 bp, Homo sapiens
atgtggccaagggctccagggc

SEQ ID NO: 2877467 - DNA, 21 bp, Homo sapiens
atgttaaaaaaataagaagaa

SEQ ID NO: 2877468 - DNA, 17 bp, Homo sapiens
atgtttatacaataatt

SEQ ID NO: 2877469 - DNA, 18 bp, Homo sapiens
atgtttatacaataattt

SEQ ID NO: 2877470 - DNA, 23 bp, Homo sapiens
atgttttggccaatgcacctaaa

SEQ ID NO: 2877471 - DNA, 12 bp, Homo sapiens
atgtttttaatg

SEQ ID NO: 2877472 - DNA, 13 bp, Homo sapiens
atgtttttaatgt

SEQ ID NO: 2877473 - DNA, 19 bp, Homo sapiens
atgtttttaatgtatagta

SEQ ID NO: 2877474 - DNA, 15 bp, Homo sapiens
attagttttctttgt

SEQ ID NO: 2877475 - DNA, 20 bp, Homo sapiens
attattggaatataattgtt

SEQ ID NO: 2877476 - DNA, 22 bp, Homo sapiens
attcccatcactgctgtccctc

SEQ ID NO: 2877477 - DNA, 13 bp, Homo sapiens
attccctctcatc

SEQ ID NO: 2877478 - DNA, 14 bp, Homo sapiens
attccctctcatcc

SEQ ID NO: 2877479 - DNA, 14 bp, Homo sapiens
attccttcactcat

SEQ ID NO: 2877480 - DNA, 20 bp, Homo sapiens
attctaaaatgattgtagta

SEQ ID NO: 2877481 - DNA, 20 bp, Homo sapiens
attctgcaacagcctgtttg

SEQ ID NO: 2877482 - DNA, 22 bp, Homo sapiens
attgaatggctatgtttttaat

SEQ ID NO: 2877483 - DNA, 21 bp, Homo sapiens
attgccacaatgcctctccca

SEQ ID NO: 2877484 - DNA, 22 bp, Homo sapiens
attgccacaatgcctctcccac

SEQ ID NO: 2877485 - DNA, 16 bp, Homo sapiens
attgtcttaatattgt

SEQ ID NO: 2877486 - DNA, 18 bp, Homo sapiens
attgtgcaatgtaaatat

SEQ ID NO: 2877487 - DNA, 20 bp, Homo sapiens
atttaaaatagcaaaagaag

SEQ ID NO: 2877488 - DNA, 23 bp, Homo sapiens
atttaaaatagcaaaagaagaag

SEQ ID NO: 2877489 - DNA, 18 bp, Homo sapiens
atttaaaccgctaaaaga

SEQ ID NO: 2877490 - DNA, 23 bp, Homo sapiens
atttaaaccgctaaaagaaactt

SEQ ID NO: 2877491 - DNA, 12 bp, Homo sapiens
atttaaactata

SEQ ID NO: 2877492 - DNA, 19 bp, Homo sapiens
atttaaactataagcaaga

SEQ ID NO: 2877493 - DNA, 20 bp, Homo sapiens
atttaaactataagcaagaa

SEQ ID NO: 2877494 - DNA, 21 bp, Homo sapiens
atttaaatttatgagtgttaa

SEQ ID NO: 2877495 - DNA, 13 bp, Homo sapiens
atttaagggaaaa

SEQ ID NO: 2877496 - DNA, 14 bp, Homo sapiens
atttaagggaaaaa

SEQ ID NO: 2877497 - DNA, 16 bp, Homo sapiens
atttaagggaaaaata

SEQ ID NO: 2877498 - DNA, 20 bp, Homo sapiens
atttaatagcaaagaattga

SEQ ID NO: 2877499 - DNA, 13 bp, Homo sapiens
atttagaaaactt

SEQ ID NO: 2877500 - DNA, 18 bp, Homo sapiens
atttatcttgttcaatga

SEQ ID NO: 2877501 - DNA, 16 bp, Homo sapiens
atttatttaaaatagc

SEQ ID NO: 2877502 - DNA, 16 bp, Homo sapiens
atttattttttcaaaa

SEQ ID NO: 2877503 - DNA, 17 bp, Homo sapiens
atttgtaatagatgttt

SEQ ID NO: 2877504 - DNA, 22 bp, Homo sapiens
atttgtccaatggctgtaaact

SEQ ID NO: 2877505 - DNA, 19 bp, Homo sapiens
atttgttaatttagaaaac

SEQ ID NO: 2877506 - DNA, 17 bp, Homo sapiens
attttaaagaattgtgt

SEQ ID NO: 2877507 - DNA, 18 bp, Homo sapiens
attttatattacactaca

SEQ ID NO: 2877508 - DNA, 12 bp, Homo sapiens
attttgtaagtt

SEQ ID NO: 2877509 - DNA, 17 bp, Homo sapiens
attttttaaaaaagctt

SEQ ID NO: 2877510 - DNA, 18 bp, Homo sapiens
attttttaaaaaagctta

SEQ ID NO: 2877511 - DNA, 16 bp, Homo sapiens
attttttcaaaaacag

SEQ ID NO: 2877512 - DNA, 20 bp, Homo sapiens
attttttccttcaaagttta

SEQ ID NO: 2877513 - DNA, 21 bp, Homo sapiens
attttttccttcaaagtttaa

SEQ ID NO: 2877514 - DNA, 19 bp, Homo sapiens
caaaaatgtccagccaccc

SEQ ID NO: 2877515 - DNA, 16 bp, Homo sapiens
caaaacaatgtttaaa

SEQ ID NO: 2877516 - DNA, 18 bp, Homo sapiens
caaaacaatgtttaaacc

SEQ ID NO: 2877517 - DNA, 15 bp, Homo sapiens
caaaagaagaagttt

SEQ ID NO: 2877518 - DNA, 17 bp, Homo sapiens
caaaagtgatctgtccc

SEQ ID NO: 2877519 - DNA, 16 bp, Homo sapiens
caaacacactgtaaat

SEQ ID NO: 2877520 - DNA, 20 bp, Homo sapiens
caaactgatgcgaaaacttg

SEQ ID NO: 2877521 - DNA, 18 bp, Homo sapiens
caaagaaatagcaagaga

SEQ ID NO: 2877522 - DNA, 23 bp, Homo sapiens
caaagcaagcattcagaagaaaa

SEQ ID NO: 2877523 - DNA, 20 bp, Homo sapiens
caaagtttaataaatttatt

SEQ ID NO: 2877524 - DNA, 13 bp, Homo sapiens
caacaattctaaa

SEQ ID NO: 2877525 - DNA, 11 bp, Homo sapiens
caacagcctgt

SEQ ID NO: 2877526 - DNA, 22 bp, Homo sapiens
caacatttctatagccaaaaat

SEQ ID NO: 2877527 - DNA, 21 bp, Homo sapiens
caacccctcccctccatccct

SEQ ID NO: 2877528 - DNA, 18 bp, Homo sapiens
caacctcagtaatttaga

SEQ ID NO: 2877529 - DNA, 17 bp, Homo sapiens
caaccttgtcccaagga

SEQ ID NO: 2877530 - DNA, 20 bp, Homo sapiens
caactccagccacccagcca

SEQ ID NO: 2877531 - DNA, 22 bp, Homo sapiens
caagagctacgtatttaatagc

SEQ ID NO: 2877532 - DNA, 16 bp, Homo sapiens
caagcattcagaagaa

SEQ ID NO: 2877533 - DNA, 20 bp, Homo sapiens
caagcttaatggctgataat

SEQ ID NO: 2877534 - DNA, 21 bp, Homo sapiens
caaggaccctgttttccacac

SEQ ID NO: 2877535 - DNA, 18 bp, Homo sapiens
caagggctccagggccag

SEQ ID NO: 2877536 - DNA, 16 bp, Homo sapiens
caagtatttgttaatt

SEQ ID NO: 2877537 - DNA, 20 bp, Homo sapiens
caagtatttgttaatttaga

SEQ ID NO: 2877538 - DNA, 17 bp, Homo sapiens
caagtccatagctgagc

SEQ ID NO: 2877539 - DNA, 20 bp, Homo sapiens
caagtccatagctgagctgg

SEQ ID NO: 2877540 - DNA, 17 bp, Homo sapiens
caagttccgtctcctct

SEQ ID NO: 2877541 - DNA, 23 bp, Homo sapiens
caagttccgtctcctctccagcc

SEQ ID NO: 2877542 - DNA, 23 bp, Homo sapiens
caataacgtttaagccaaaacaa

SEQ ID NO: 2877543 - DNA, 22 bp, Homo sapiens
caatcccttaatatcctaaaca

SEQ ID NO: 2877544 - DNA, 22 bp, Homo sapiens
caatgcgaggtcgcaactgaga

SEQ ID NO: 2877545 - DNA, 14 bp, Homo sapiens
caatgtaaatattt

SEQ ID NO: 2877546 - DNA, 17 bp, Homo sapiens
caatgtaaatattttaa

SEQ ID NO: 2877547 - DNA, 20 bp, Homo sapiens
caatttcccctctgtgtcct

SEQ ID NO: 2877548 - DNA, 16 bp, Homo sapiens
cacaatgcctctccca

SEQ ID NO: 2877549 - DNA, 21 bp, Homo sapiens
cacacctctggatccctggag

SEQ ID NO: 2877550 - DNA, 15 bp, Homo sapiens
cacagaggccaggca

SEQ ID NO: 2877551 - DNA, 17 bp, Homo sapiens
cacagaggccaggcatg

SEQ ID NO: 2877552 - DNA, 19 bp, Homo sapiens
cacagataactgaaaatta

SEQ ID NO: 2877553 - DNA, 22 bp, Homo sapiens
cacagataactgaaaattattt

SEQ ID NO: 2877554 - DNA, 13 bp, Homo sapiens
cacagcccaagag

SEQ ID NO: 2877555 - DNA, 17 bp, Homo sapiens
cacagtgcactcagagc

SEQ ID NO: 2877556 - DNA, 18 bp, Homo sapiens
cacatactcatttttcat

SEQ ID NO: 2877557 - DNA, 19 bp, Homo sapiens
cacatactcatttttcatg

SEQ ID NO: 2877558 - DNA, 19 bp, Homo sapiens
caccatcaccctctgggca

SEQ ID NO: 2877559 - DNA, 17 bp, Homo sapiens
caccccaggacgccact

SEQ ID NO: 2877560 - DNA, 19 bp, Homo sapiens
cacccccagccccgactcc

SEQ ID NO: 2877561 - DNA, 15 bp, Homo sapiens
cacccccaggcatct

SEQ ID NO: 2877562 - DNA, 14 bp, Homo sapiens
caccccctcccacc

SEQ ID NO: 2877563 - DNA, 16 bp, Homo sapiens
caccccctcccacccc

SEQ ID NO: 2877564 - DNA, 13 bp, Homo sapiens
cacctacttcctc

SEQ ID NO: 2877565 - DNA, 21 bp, Homo sapiens
cacctcagacaatccactctc

SEQ ID NO: 2877566 - DNA, 14 bp, Homo sapiens
cacctccctcccca

SEQ ID NO: 2877567 - DNA, 15 bp, Homo sapiens
ctgagttcaagtcaa

SEQ ID NO: 2877568 - DNA, 18 bp, Homo sapiens
ctgatgcgaaaacttgaa

SEQ ID NO: 2877569 - DNA, 14 bp, Homo sapiens
ctgcaacagcctgt

SEQ ID NO: 2877570 - DNA, 23 bp, Homo sapiens
ctgcaagtccatagctgagctgg

SEQ ID NO: 2877571 - DNA, 21 bp, Homo sapiens
ctgcagcagggcaggaagggg

SEQ ID NO: 2877572 - DNA, 14 bp, Homo sapiens
ctgccctgtatata

SEQ ID NO: 2877573 - DNA, 19 bp, Homo sapiens
ctgccctgtatataatact

SEQ ID NO: 2877574 - DNA, 17 bp, Homo sapiens
ctgcctcatgctctcta

SEQ ID NO: 2877575 - DNA, 11 bp, Homo sapiens
ctgccttctct

SEQ ID NO: 2877576 - DNA, 13 bp, Homo sapiens
ctgccttctcttc

SEQ ID NO: 2877577 - DNA, 15 bp, Homo sapiens
ctgctactcctgtgc

SEQ ID NO: 2877578 - DNA, 14 bp, Homo sapiens
ctgctcacaggcag

SEQ ID NO: 2877579 - DNA, 16 bp, Homo sapiens
ctgctcacattccctc

SEQ ID NO: 2877580 - DNA, 17 bp, Homo sapiens
ctgctcacattccctct

SEQ ID NO: 2877581 - DNA, 20 bp, Homo sapiens
ctgctgtccctcctgaggtc

SEQ ID NO: 2877582 - DNA, 19 bp, Homo sapiens
ctgctgtgggagagcgaag

SEQ ID NO: 2877583 - DNA, 13 bp, Homo sapiens
ctgcttctgtgca

SEQ ID NO: 2877584 - DNA, 20 bp, Homo sapiens
ctgcttctgtgcatttgtgt

SEQ ID NO: 2877585 - DNA, 19 bp, Homo sapiens
ctggaaaggatgcttctgc

SEQ ID NO: 2877586 - DNA, 21 bp, Homo sapiens
ctggaaaggatgcttctgctc

SEQ ID NO: 2877587 - DNA, 20 bp, Homo sapiens
ctggagaccccagagtaggg

SEQ ID NO: 2877588 - DNA, 16 bp, Homo sapiens
ctggaggctgcagagc

SEQ ID NO: 2877589 - DNA, 23 bp, Homo sapiens
ctggaggctgcagagctgaccca

SEQ ID NO: 2877590 - DNA, 20 bp, Homo sapiens
ctggaggtgggagacaagga

SEQ ID NO: 2877591 - DNA, 20 bp, Homo sapiens
ctggcagctgagagccctgc

SEQ ID NO: 2877592 - DNA, 16 bp, Homo sapiens
ctggccccctccctgg

SEQ ID NO: 2877593 - DNA, 18 bp, Homo sapiens
ctggccccctccctggat

SEQ ID NO: 2877594 - DNA, 16 bp, Homo sapiens
ctggcctggtccaggc

SEQ ID NO: 2877595 - DNA, 23 bp, Homo sapiens
ctgggatggggcatgtggccaag

SEQ ID NO: 2877596 - DNA, 15 bp, Homo sapiens
ctgggcactgggccg

SEQ ID NO: 2877597 - DNA, 16 bp, Homo sapiens
ctgggcagctgtcatg

SEQ ID NO: 2877598 - DNA, 16 bp, Homo sapiens
ctgggccggcagcctg

SEQ ID NO: 2877599 - DNA, 17 bp, Homo sapiens
ctgggccggcagcctgg

SEQ ID NO: 2877600 - DNA, 19 bp, Homo sapiens
ctgggtggggcagggcctg

SEQ ID NO: 2877601 - DNA, 20 bp, Homo sapiens
ctggttcacactgaccaaga

SEQ ID NO: 2877602 - DNA, 13 bp, Homo sapiens
ctggttccctctt

SEQ ID NO: 2877603 - DNA, 22 bp, Homo sapiens
ctggttccctctttcctgtgcc

SEQ ID NO: 2877604 - DNA, 14 bp, Homo sapiens
ctggtttaatgttt

SEQ ID NO: 2877605 - DNA, 16 bp, Homo sapiens
ctgtaaactataaact

SEQ ID NO: 2877606 - DNA, 14 bp, Homo sapiens
ctgtactgagttct

SEQ ID NO: 2877607 - DNA, 17 bp, Homo sapiens
ctgtactgtaatttctt

SEQ ID NO: 2877608 - DNA, 17 bp, Homo sapiens
ctgtctctgcctgcggc

SEQ ID NO: 2877609 - DNA, 14 bp, Homo sapiens
ctgtctgtcctgga

SEQ ID NO: 2877610 - DNA, 24 bp, Homo sapiens
ctgtggcgctgcagcagggcagga

SEQ ID NO: 2877611 - DNA, 20 bp, Homo sapiens
ctgtgggccaggagctcagc

SEQ ID NO: 2877612 - DNA, 13 bp, Homo sapiens
ctgttaaccattt

SEQ ID NO: 2877613 - DNA, 20 bp, Homo sapiens
ctgttagcagagtctgtctc

SEQ ID NO: 2877614 - DNA, 17 bp, Homo sapiens
ctgttatatctaaattt

SEQ ID NO: 2877615 - DNA, 23 bp, Homo sapiens
ctgttatcaaacaccaacataaa

SEQ ID NO: 2877616 - DNA, 11 bp, Homo sapiens
ctgttcctgcc

SEQ ID NO: 2877617 - DNA, 18 bp, Homo sapiens
ctgttcctgccttctctt

SEQ ID NO: 2877618 - DNA, 12 bp, Homo sapiens
ctgttgggtggg

SEQ ID NO: 2877619 - DNA, 22 bp, Homo sapiens
ctgttgggtgggtgggccctgc

SEQ ID NO: 2877620 - DNA, 20 bp, Homo sapiens
ctgtttagtagcagtgattg

SEQ ID NO: 2877621 - DNA, 13 bp, Homo sapiens
ctgttttccacac

SEQ ID NO: 2877622 - DNA, 20 bp, Homo sapiens
cttaatggctgataatttta

SEQ ID NO: 2877623 - DNA, 22 bp, Homo sapiens
cttaatggctgataattttaaa

SEQ ID NO: 2877624 - DNA, 20 bp, Homo sapiens
cttaccaggcaccaaaagaa

SEQ ID NO: 2877625 - DNA, 12 bp, Homo sapiens
cttacctgacgg

SEQ ID NO: 2877626 - DNA, 14 bp, Homo sapiens
cttagcccaagagg

SEQ ID NO: 2877627 - DNA, 18 bp, Homo sapiens
cttagcccaagaggtctg

SEQ ID NO: 2877628 - DNA, 22 bp, Homo sapiens
cttagcccaagaggtctgagcc

SEQ ID NO: 2877629 - DNA, 22 bp, Homo sapiens
cttatgacagaggttttgaaat

SEQ ID NO: 2877630 - DNA, 22 bp, Homo sapiens
cttatggggacagcataccttg

SEQ ID NO: 2877631 - DNA, 15 bp, Homo sapiens
cttcaaagtttaata

SEQ ID NO: 2877632 - DNA, 19 bp, Homo sapiens
cttccctagatggttccct

SEQ ID NO: 2877633 - DNA, 22 bp, Homo sapiens
cttccctagatggttccctttg

SEQ ID NO: 2877634 - DNA, 15 bp, Homo sapiens
cttcctcctcctcct

SEQ ID NO: 2877635 - DNA, 21 bp, Homo sapiens
cttcctgggtcctgttcccta

SEQ ID NO: 2877636 - DNA, 21 bp, Homo sapiens
cttctatcctgcaatttctcc

SEQ ID NO: 2877637 - DNA, 15 bp, Homo sapiens
cttctcttctatcct

SEQ ID NO: 2877638 - DNA, 21 bp, Homo sapiens
cttctgctcacattccctctc

SEQ ID NO: 2877639 - DNA, 22 bp, Homo sapiens
cttctgtggaagtagctttgaa

SEQ ID NO: 2877640 - DNA, 18 bp, Homo sapiens
cttgaagcacagagggct

SEQ ID NO: 2877641 - DNA, 19 bp, Homo sapiens
cttgaatctgttactgaaa

SEQ ID NO: 2877642 - DNA, 22 bp, Homo sapiens
cttgggaggttttattctgact

SEQ ID NO: 2877643 - DNA, 19 bp, Homo sapiens
cttggggtaagccagagcc

SEQ ID NO: 2877644 - DNA, 12 bp, Homo sapiens
cttgtgtctgtt

SEQ ID NO: 2877645 - DNA, 14 bp, Homo sapiens
ctttaggtctggtt

SEQ ID NO: 2877646 - DNA, 17 bp, Homo sapiens
ctttcatactgaagatg

SEQ ID NO: 2877647 - DNA, 11 bp, Homo sapiens
ctttccctcac

SEQ ID NO: 2877648 - DNA, 14 bp, Homo sapiens
ctttccctcacccc

SEQ ID NO: 2877649 - DNA, 17 bp, Homo sapiens
ctttctcactaaatctt

SEQ ID NO: 2877650 - DNA, 22 bp, Homo sapiens
ctttctcactaaatcttttata

SEQ ID NO: 2877651 - DNA, 13 bp, Homo sapiens
ctttgaagaggaa

SEQ ID NO: 2877652 - DNA, 18 bp, Homo sapiens
ctttgaagaggaaaatga

SEQ ID NO: 2877653 - DNA, 17 bp, Homo sapiens
ctttgtcacttttcctt

SEQ ID NO: 2877654 - DNA, 18 bp, Homo sapiens
cttttcccaaaatgttga

SEQ ID NO: 2877655 - DNA, 23 bp, Homo sapiens
ctttttaggccacctccaaggac

SEQ ID NO: 2877656 - DNA, 23 bp, Homo sapiens
gaaaaacaaactcgttttttaca

SEQ ID NO: 2877657 - DNA, 14 bp, Homo sapiens
gaaaaagaagaatc

SEQ ID NO: 2877658 - DNA, 13 bp, Homo sapiens
gaaaaagcgaaaa

SEQ ID NO: 2877659 - DNA, 11 bp, Homo sapiens
gaaaacctttc

SEQ ID NO: 2877660 - DNA, 12 bp, Homo sapiens
gaaaacttgaat

SEQ ID NO: 2877661 - DNA, 14 bp, Homo sapiens
gaaaacttgaatct

SEQ ID NO: 2877662 - DNA, 16 bp, Homo sapiens
gaaaacttgaatctgt

SEQ ID NO: 2877663 - DNA, 12 bp, Homo sapiens
gaaaactttaaa

SEQ ID NO: 2877664 - DNA, 21 bp, Homo sapiens
gaaaagcccagtgacctgacc

SEQ ID NO: 2877665 - DNA, 23 bp, Homo sapiens
gaaaagctagaattgagtgttta

SEQ ID NO: 2877666 - DNA, 17 bp, Homo sapiens
gaaaagtttaacctaaa

SEQ ID NO: 2877667 - DNA, 21 bp, Homo sapiens
gaaaataagtgctctgtcaaa

SEQ ID NO: 2877668 - DNA, 13 bp, Homo sapiens
gaaaatgaataat

SEQ ID NO: 2877669 - DNA, 13 bp, Homo sapiens
gaaaattatttaa

SEQ ID NO: 2877670 - DNA, 15 bp, Homo sapiens
gaaacataaataaaa

SEQ ID NO: 2877671 - DNA, 17 bp, Homo sapiens
gaaacttttttatttaa

SEQ ID NO: 2877672 - DNA, 21 bp, Homo sapiens
gaaatgtttatacaataattt

SEQ ID NO: 2877673 - DNA, 14 bp, Homo sapiens
gaaatttaaactat

SEQ ID NO: 2877674 - DNA, 12 bp, Homo sapiens
gaacaaactgat

SEQ ID NO: 2877675 - DNA, 13 bp, Homo sapiens
gaacaaactgatg

SEQ ID NO: 2877676 - DNA, 18 bp, Homo sapiens
gaacaaactgatgcgaaa

SEQ ID NO: 2877677 - DNA, 16 bp, Homo sapiens
gaacatagacagaaga

SEQ ID NO: 2877678 - DNA, 19 bp, Homo sapiens
gaacctaattcaattcaaa

SEQ ID NO: 2877679 - DNA, 20 bp, Homo sapiens
gaacctaccagttggccatg

SEQ ID NO: 2877680 - DNA, 19 bp, Homo sapiens
gaactagttttactttgaa

SEQ ID NO: 2877681 - DNA, 13 bp, Homo sapiens
gaactgagccaaa

SEQ ID NO: 2877682 - DNA, 22 bp, Homo sapiens
gaactgagccaaacacactgta

SEQ ID NO: 2877683 - DNA, 13 bp, Homo sapiens
gaagaatggccat

SEQ ID NO: 2877684 - DNA, 16 bp, Homo sapiens
gaagagagatcaaatg

SEQ ID NO: 2877685 - DNA, 16 bp, Homo sapiens
gaagaggaagcaagaa

SEQ ID NO: 2877686 - DNA, 20 bp, Homo sapiens
gaagcaacctcagtaattta

SEQ ID NO: 2877687 - DNA, 15 bp, Homo sapiens
taaacatcattcatt

SEQ ID NO: 2877688 - DNA, 17 bp, Homo sapiens
taaacatcattcatttt

SEQ ID NO: 2877689 - DNA, 14 bp, Homo sapiens
taaactactgtaat

SEQ ID NO: 2877690 - DNA, 21 bp, Homo sapiens
taaactactgtaattaagtgc

SEQ ID NO: 2877691 - DNA, 16 bp, Homo sapiens
taaactataaactact

SEQ ID NO: 2877692 - DNA, 17 bp, Homo sapiens
taaactataaactactg

SEQ ID NO: 2877693 - DNA, 16 bp, Homo sapiens
taaagattttttaata

SEQ ID NO: 2877694 - DNA, 21 bp, Homo sapiens
taaagcgtttgcacagatcaa

SEQ ID NO: 2877695 - DNA, 15 bp, Homo sapiens
taaagctggtttaat

SEQ ID NO: 2877696 - DNA, 12 bp, Homo sapiens
taaagtgtctat

SEQ ID NO: 2877697 - DNA, 21 bp, Homo sapiens
taaagtgtctattagttttct

SEQ ID NO: 2877698 - DNA, 11 bp, Homo sapiens
taaataagaaa

SEQ ID NO: 2877699 - DNA, 13 bp, Homo sapiens
taaataagaaact

SEQ ID NO: 2877700 - DNA, 13 bp, Homo sapiens
taaatagtatttc

SEQ ID NO: 2877701 - DNA, 14 bp, Homo sapiens
taaatattttaaag

SEQ ID NO: 2877702 - DNA, 21 bp, Homo sapiens
taaatcacgctttttgaaaaa

SEQ ID NO: 2877703 - DNA, 13 bp, Homo sapiens
taaatcttttata

SEQ ID NO: 2877704 - DNA, 19 bp, Homo sapiens
taaatcttttataggattt

SEQ ID NO: 2877705 - DNA, 23 bp, Homo sapiens
taaatcttttataggatttattt

SEQ ID NO: 2877706 - DNA, 15 bp, Homo sapiens
taaatttattttctt

SEQ ID NO: 2877707 - DNA, 15 bp, Homo sapiens
taaatttgtccaatg

SEQ ID NO: 2877708 - DNA, 23 bp, Homo sapiens
taaatttgtccaatggctgtaaa

SEQ ID NO: 2877709 - DNA, 20 bp, Homo sapiens
taacgtttaagccaaaacaa

SEQ ID NO: 2877710 - DNA, 19 bp, Homo sapiens
taactccagtctcctgaca

SEQ ID NO: 2877711 - DNA, 14 bp, Homo sapiens
taactctctttatg

SEQ ID NO: 2877712 - DNA, 14 bp, Homo sapiens
taacttaaatagta

SEQ ID NO: 2877713 - DNA, 16 bp, Homo sapiens
taacttaaatagtatt

SEQ ID NO: 2877714 - DNA, 20 bp, Homo sapiens
taagaaacttttttatttaa

SEQ ID NO: 2877715 - DNA, 12 bp, Homo sapiens
taagagaagtag

SEQ ID NO: 2877716 - DNA, 22 bp, Homo sapiens
taagcattgaatggctatgttt

SEQ ID NO: 2877717 - DNA, 14 bp, Homo sapiens
taagccagagcctg

SEQ ID NO: 2877718 - DNA, 15 bp, Homo sapiens
taagccagagcctgg

SEQ ID NO: 2877719 - DNA, 22 bp, Homo sapiens
taaggagagttcaagcctgtgg

SEQ ID NO: 2877720 - DNA, 11 bp, Homo sapiens
taagggaaaaa

SEQ ID NO: 2877721 - DNA, 19 bp, Homo sapiens
taaggtacaagaagcattt

SEQ ID NO: 2877722 - DNA, 14 bp, Homo sapiens
taagtgttcagtgt

SEQ ID NO: 2877723 - DNA, 20 bp, Homo sapiens
taagtgttcagtgttgacat

SEQ ID NO: 2877724 - DNA, 21 bp, Homo sapiens
taagtgttcagtgttgacata

SEQ ID NO: 2877725 - DNA, 22 bp, Homo sapiens
taagtgttcagtgttgacatag

SEQ ID NO: 2877726 - DNA, 20 bp, Homo sapiens
taataatatactgtactata

SEQ ID NO: 2877727 - DNA, 22 bp, Homo sapiens
taatagatgtttgatagatttt

SEQ ID NO: 2877728 - DNA, 15 bp, Homo sapiens
taatagcaaagaatt

SEQ ID NO: 2877729 - DNA, 22 bp, Homo sapiens
taatctgattatacaccatttt

SEQ ID NO: 2877730 - DNA, 17 bp, Homo sapiens
taatgaaacaaagagtt

SEQ ID NO: 2877731 - DNA, 13 bp, Homo sapiens
taatggagaagac

SEQ ID NO: 2877732 - DNA, 22 bp, Homo sapiens
taatggctgataattttaaatt

SEQ ID NO: 2877733 - DNA, 16 bp, Homo sapiens
taatgtttttctggaa

SEQ ID NO: 2877734 - DNA, 23 bp, Homo sapiens
taatttttattatgaaactttcc

SEQ ID NO: 2877735 - DNA, 23 bp, Homo sapiens
taatttttgatactaagcattga

SEQ ID NO: 2877736 - DNA, 14 bp, Homo sapiens
tacagtctaaagct

SEQ ID NO: 2877737 - DNA, 15 bp, Homo sapiens
tacagtctaaagctg

SEQ ID NO: 2877738 - DNA, 16 bp, Homo sapiens
tacatcacttgagaca

SEQ ID NO: 2877739 - DNA, 17 bp, Homo sapiens
tacattgaattagaaac

SEQ ID NO: 2877740 - DNA, 17 bp, Homo sapiens
taccaagtaaccatttc

SEQ ID NO: 2877741 - DNA, 18 bp, Homo sapiens
taccaggcaccaaaagaa

SEQ ID NO: 2877742 - DNA, 15 bp, Homo sapiens
taccgcagtggctct

SEQ ID NO: 2877743 - DNA, 20 bp, Homo sapiens
tacctgacggacgtcctgct

SEQ ID NO: 2877744 - DNA, 16 bp, Homo sapiens
tactcctgtgctctgg

SEQ ID NO: 2877745 - DNA, 19 bp, Homo sapiens
tactcctgtgctctggagg

SEQ ID NO: 2877746 - DNA, 17 bp, Homo sapiens
tactgagttctcatcca

SEQ ID NO: 2877747 - DNA, 13 bp, Homo sapiens
tactgtaatttct

SEQ ID NO: 2877748 - DNA, 24 bp, Homo sapiens
tacttcctcctcctcctcctgttc

SEQ ID NO: 2877749 - DNA, 22 bp, Homo sapiens
tactttggtggccacataagcc

SEQ ID NO: 2877750 - DNA, 15 bp, Homo sapiens
tagaaaactttaaag

SEQ ID NO: 2877751 - DNA, 14 bp, Homo sapiens
tagaaacataaata

SEQ ID NO: 2877752 - DNA, 15 bp, Homo sapiens
tagaacctaattcaa

SEQ ID NO: 2877753 - DNA, 19 bp, Homo sapiens
tagaattgagtgtttaaag

SEQ ID NO: 2877754 - DNA, 12 bp, Homo sapiens
tagacagaagaa

SEQ ID NO: 2877755 - DNA, 14 bp, Homo sapiens
tagacagaagaaac

SEQ ID NO: 2877756 - DNA, 13 bp, Homo sapiens
tagattttctgct

SEQ ID NO: 2877757 - DNA, 14 bp, Homo sapiens
tagcaaaagaagaa

SEQ ID NO: 2877758 - DNA, 16 bp, Homo sapiens
tagcaaaagaagaagt

SEQ ID NO: 2877759 - DNA, 21 bp, Homo sapiens
tagcaactacagtctaaagct

SEQ ID NO: 2877760 - DNA, 22 bp, Homo sapiens
tagcagaagaaaaagttgcagt

SEQ ID NO: 2877761 - DNA, 11 bp, Homo sapiens
tagcagagtct

SEQ ID NO: 2877762 - DNA, 16 bp, Homo sapiens
tagccaaaaatagcta

SEQ ID NO: 2877763 - DNA, 14 bp, Homo sapiens
tagctctgcctccc

SEQ ID NO: 2877764 - DNA, 13 bp, Homo sapiens
tagctgagctgga

SEQ ID NO: 2877765 - DNA, 16 bp, Homo sapiens
tagctgagctggaaag

SEQ ID NO: 2877766 - DNA, 22 bp, Homo sapiens
tagctttaacttaaatagtatt

SEQ ID NO: 2877767 - DNA, 21 bp, Homo sapiens
tagtaaatcacgctttttgaa

SEQ ID NO: 2877768 - DNA, 15 bp, Homo sapiens
tagttttcagccttg

SEQ ID NO: 2877769 - DNA, 15 bp, Homo sapiens
tataaactactgtaa

SEQ ID NO: 2877770 - DNA, 16 bp, Homo sapiens
tataagtgttcagtgt

SEQ ID NO: 2877771 - DNA, 19 bp, Homo sapiens
tataagtgttcagtgttga

SEQ ID NO: 2877772 - DNA, 23 bp, Homo sapiens
tataagtgttcagtgttgacata

SEQ ID NO: 2877773 - DNA, 21 bp, Homo sapiens
tataggatttatttaaaatag

SEQ ID NO: 2877774 - DNA, 14 bp, Homo sapiens
tatatctatctatt

SEQ ID NO: 2877775 - DNA, 11 bp, Homo sapiens
tatcacttaat

SEQ ID NO: 2877776 - DNA, 16 bp, Homo sapiens
tatcctaaacatcatt

SEQ ID NO: 2877777 - DNA, 12 bp, Homo sapiens
tatctatttgag

SEQ ID NO: 2877778 - DNA, 17 bp, Homo sapiens
tatcttactatttcaca

SEQ ID NO: 2877779 - DNA, 13 bp, Homo sapiens
tatggattctaaa

SEQ ID NO: 2877780 - DNA, 13 bp, Homo sapiens
tatgtaaaacatt

SEQ ID NO: 2877781 - DNA, 14 bp, Homo sapiens
tatgtcccagcccc

SEQ ID NO: 2877782 - DNA, 20 bp, Homo sapiens
tattagttttctttgtaaag

SEQ ID NO: 2877783 - DNA, 23 bp, Homo sapiens
tattcaagaaagtgaaaaaaaca

SEQ ID NO: 2877784 - DNA, 17 bp, Homo sapiens
tattctgcaacagcctg

SEQ ID NO: 2877785 - DNA, 19 bp, Homo sapiens
tattctgcaacagcctgtt

SEQ ID NO: 2877786 - DNA, 21 bp, Homo sapiens
tattgccacaatgcctctccc

SEQ ID NO: 2877787 - DNA, 19 bp, Homo sapiens
tattgtgcaatgtaaatat

SEQ ID NO: 2877788 - DNA, 14 bp, Homo sapiens
tatttaaaaaacta

SEQ ID NO: 2877789 - DNA, 15 bp, Homo sapiens
tatttaaaatagcaa

SEQ ID NO: 2877790 - DNA, 16 bp, Homo sapiens
tatttaactctcttta

SEQ ID NO: 2877791 - DNA, 13 bp, Homo sapiens
tatttaatagcaa

SEQ ID NO: 2877792 - DNA, 22 bp, Homo sapiens
tatttaatagcaaagaattgac

SEQ ID NO: 2877793 - DNA, 17 bp, Homo sapiens
tattttgacataaagtt

SEQ ID NO: 2877794 - DNA, 19 bp, Homo sapiens
tcaaaatttcaaaagtgat

SEQ ID NO: 2877795 - DNA, 12 bp, Homo sapiens
tcaaaggaagac

SEQ ID NO: 2877796 - DNA, 14 bp, Homo sapiens
tcaacaattctaaa

SEQ ID NO: 2877797 - DNA, 15 bp, Homo sapiens
tcaacaattctaaaa

SEQ ID NO: 2877798 - DNA, 17 bp, Homo sapiens
tcaacaattctaaaatg

SEQ ID NO: 2877799 - DNA, 16 bp, Homo sapiens
tcaacccctcccctcc

SEQ ID NO: 2877800 - DNA, 16 bp, Homo sapiens
tcaagctagccagagg

SEQ ID NO: 2877801 - DNA, 18 bp, Homo sapiens
tcaagttccgtctcctct

SEQ ID NO: 2877802 - DNA, 14 bp, Homo sapiens
tcacaacagcctga

SEQ ID NO: 2877803 - DNA, 13 bp, Homo sapiens
tcacattccctct

SEQ ID NO: 2877804 - DNA, 16 bp, Homo sapiens
tcacgctgaaacatgc

SEQ ID NO: 2877805 - DNA, 17 bp, Homo sapiens
tcactaaatcttttata

SEQ ID NO: 2877806 - DNA, 18 bp, Homo sapiens
tcactgctgtccctcctg

SEQ ID NO: 2877807 - DNA, 16 bp, Homo sapiens
tcagaagaaaaagaag

SEQ ID NO: 2877808 - DNA, 21 bp, Homo sapiens
acaaatctatgccactcagaa

SEQ ID NO: 2877809 - DNA, 13 bp, Homo sapiens
acaacaaggaccc

SEQ ID NO: 2877810 - DNA, 15 bp, Homo sapiens
acaacaaggaccctg

SEQ ID NO: 2877811 - DNA, 13 bp, Homo sapiens
acaactccagcca

SEQ ID NO: 2877812 - DNA, 20 bp, Homo sapiens
acaactccagccacccagcc

SEQ ID NO: 2877813 - DNA, 14 bp, Homo sapiens
acaaggaccctgtt

SEQ ID NO: 2877814 - DNA, 14 bp, Homo sapiens
acaagtatttgtta

SEQ ID NO: 2877815 - DNA, 19 bp, Homo sapiens
acaatccactctcaggagg

SEQ ID NO: 2877816 - DNA, 18 bp, Homo sapiens
acaatgcctctcccacga

SEQ ID NO: 2877817 - DNA, 18 bp, Homo sapiens
acaatgtctggctgaagc

SEQ ID NO: 2877818 - DNA, 17 bp, Homo sapiens
acaatgtttaaaccttt

SEQ ID NO: 2877819 - DNA, 24 bp, Homo sapiens
acaattctaaaatgattgtagtaa

SEQ ID NO: 2877820 - DNA, 13 bp, Homo sapiens
acacacctctgga

SEQ ID NO: 2877821 - DNA, 23 bp, Homo sapiens
acacacctctggatccctggagg

SEQ ID NO: 2877822 - DNA, 17 bp, Homo sapiens
acactacacactgtgta

SEQ ID NO: 2877823 - DNA, 17 bp, Homo sapiens
acacttacacccttttg

SEQ ID NO: 2877824 - DNA, 18 bp, Homo sapiens
acacttatggggacagca

SEQ ID NO: 2877825 - DNA, 20 bp, Homo sapiens
acacttatggggacagcata

SEQ ID NO: 2877826 - DNA, 12 bp, Homo sapiens
acagaagaaaca

SEQ ID NO: 2877827 - DNA, 14 bp, Homo sapiens
acagatgcccacgt

SEQ ID NO: 2877828 - DNA, 21 bp, Homo sapiens
acagcctgacaacatttctat

SEQ ID NO: 2877829 - DNA, 18 bp, Homo sapiens
acataagccattattcac

SEQ ID NO: 2877830 - DNA, 12 bp, Homo sapiens
acatactcattt

SEQ ID NO: 2877831 - DNA, 11 bp, Homo sapiens
acatagccttt

SEQ ID NO: 2877832 - DNA, 15 bp, Homo sapiens
acatagcctttgtgc

SEQ ID NO: 2877833 - DNA, 13 bp, Homo sapiens
acatatttgcaaa

SEQ ID NO: 2877834 - DNA, 17 bp, Homo sapiens
acatgctaagagaagta

SEQ ID NO: 2877835 - DNA, 18 bp, Homo sapiens
acatgctaagagaagtag

SEQ ID NO: 2877836 - DNA, 16 bp, Homo sapiens
acatgtgctattgaac

SEQ ID NO: 2877837 - DNA, 22 bp, Homo sapiens
acatgtgctattgaactgagcc

SEQ ID NO: 2877838 - DNA, 12 bp, Homo sapiens
acattccctctc

SEQ ID NO: 2877839 - DNA, 22 bp, Homo sapiens
acattgaattagaaacataaat

SEQ ID NO: 2877840 - DNA, 14 bp, Homo sapiens
acatttactgacca

SEQ ID NO: 2877841 - DNA, 16 bp, Homo sapiens
acatttattttgacat

SEQ ID NO: 2877842 - DNA, 13 bp, Homo sapiens
accaaaagaagta

SEQ ID NO: 2877843 - DNA, 14 bp, Homo sapiens
accaacataaaaat

SEQ ID NO: 2877844 - DNA, 15 bp, Homo sapiens
accagctaactccag

SEQ ID NO: 2877845 - DNA, 22 bp, Homo sapiens
accagggctctgtattctgcaa

SEQ ID NO: 2877846 - DNA, 18 bp, Homo sapiens
accagtaattgtgaaaat

SEQ ID NO: 2877847 - DNA, 22 bp, Homo sapiens
accatagcacaggctaattttt

SEQ ID NO: 2877848 - DNA, 14 bp, Homo sapiens
accatatttttaaa

SEQ ID NO: 2877849 - DNA, 18 bp, Homo sapiens
accatcaccctctgggca

SEQ ID NO: 2877850 - DNA, 19 bp, Homo sapiens
accatgccaggctaatttt

SEQ ID NO: 2877851 - DNA, 24 bp, Homo sapiens
acccagaaatagccactattaaca

SEQ ID NO: 2877852 - DNA, 21 bp, Homo sapiens
accccaggacgccactcattt

SEQ ID NO: 2877853 - DNA, 11 bp, Homo sapiens
acccccagccc

SEQ ID NO: 2877854 - DNA, 12 bp, Homo sapiens
acccccagcccc

SEQ ID NO: 2877855 - DNA, 20 bp, Homo sapiens
acccccagccccgactccag

SEQ ID NO: 2877856 - DNA, 22 bp, Homo sapiens
acccccagccccgactccagcc

SEQ ID NO: 2877857 - DNA, 16 bp, Homo sapiens
accccctcccaccccc

SEQ ID NO: 2877858 - DNA, 17 bp, Homo sapiens
accccctcccaccccca

SEQ ID NO: 2877859 - DNA, 18 bp, Homo sapiens
acccctgtcctggggctg

SEQ ID NO: 2877860 - DNA, 15 bp, Homo sapiens
accctgttttccaca

SEQ ID NO: 2877861 - DNA, 15 bp, Homo sapiens
accgctaaaagaaac

SEQ ID NO: 2877862 - DNA, 11 bp, Homo sapiens
accggcacctg

SEQ ID NO: 2877863 - DNA, 12 bp, Homo sapiens
acctaaagaaaa

SEQ ID NO: 2877864 - DNA, 17 bp, Homo sapiens
acctaaagaaaaacaaa

SEQ ID NO: 2877865 - DNA, 15 bp, Homo sapiens
acctacttcctcctc

SEQ ID NO: 2877866 - DNA, 22 bp, Homo sapiens
acctcagacaatccactctcag

SEQ ID NO: 2877867 - DNA, 21 bp, Homo sapiens
acctcagtaatttagaaatca

SEQ ID NO: 2877868 - DNA, 16 bp, Homo sapiens
acctgaccggcacctg

SEQ ID NO: 2877869 - DNA, 19 bp, Homo sapiens
acctgacggacgtcctgct

SEQ ID NO: 2877870 - DNA, 18 bp, Homo sapiens
accttgttgatgccagct

SEQ ID NO: 2877871 - DNA, 20 bp, Homo sapiens
accttgttgatgccagctgt

SEQ ID NO: 2877872 - DNA, 17 bp, Homo sapiens
acctttccctcaccccc

SEQ ID NO: 2877873 - DNA, 18 bp, Homo sapiens
acctttccctcaccccct

SEQ ID NO: 2877874 - DNA, 12 bp, Homo sapiens
acgccactcatt

SEQ ID NO: 2877875 - DNA, 13 bp, Homo sapiens
acgtatttaatag

SEQ ID NO: 2877876 - DNA, 15 bp, Homo sapiens
acgtatttaatagca

SEQ ID NO: 2877877 - DNA, 23 bp, Homo sapiens
acgtcctgctggcacctcagaca

SEQ ID NO: 2877878 - DNA, 16 bp, Homo sapiens
acgtgccagctctagt

SEQ ID NO: 2877879 - DNA, 17 bp, Homo sapiens
acgtgctaggggatgag

SEQ ID NO: 2877880 - DNA, 19 bp, Homo sapiens
acgtttaagccaaaacaat

SEQ ID NO: 2877881 - DNA, 14 bp, Homo sapiens
actaaagtgtctat

SEQ ID NO: 2877882 - DNA, 21 bp, Homo sapiens
actaccagctaactccagtct

SEQ ID NO: 2877883 - DNA, 11 bp, Homo sapiens
actactgtaat

SEQ ID NO: 2877884 - DNA, 16 bp, Homo sapiens
actataaactactgta

SEQ ID NO: 2877885 - DNA, 19 bp, Homo sapiens
actataaactactgtaatt

SEQ ID NO: 2877886 - DNA, 20 bp, Homo sapiens
actataagcaagaaggcaaa

SEQ ID NO: 2877887 - DNA, 16 bp, Homo sapiens
actatgaaaagctaga

SEQ ID NO: 2877888 - DNA, 21 bp, Homo sapiens
actatgaaaagctagaattga

SEQ ID NO: 2877889 - DNA, 13 bp, Homo sapiens
actcactcattcc

SEQ ID NO: 2877890 - DNA, 18 bp, Homo sapiens
actcagagctgctgagga

SEQ ID NO: 2877891 - DNA, 17 bp, Homo sapiens
actcatttcatctcatt

SEQ ID NO: 2877892 - DNA, 20 bp, Homo sapiens
actcatttttcatgataatg

SEQ ID NO: 2877893 - DNA, 23 bp, Homo sapiens
actcatttttcatgataatgaac

SEQ ID NO: 2877894 - DNA, 16 bp, Homo sapiens
actccagccagcgcct

SEQ ID NO: 2877895 - DNA, 21 bp, Homo sapiens
actccagccagcgcctccctc

SEQ ID NO: 2877896 - DNA, 22 bp, Homo sapiens
actccagccagcgcctccctcc

SEQ ID NO: 2877897 - DNA, 23 bp, Homo sapiens
actccagccagcgcctccctcca

SEQ ID NO: 2877898 - DNA, 20 bp, Homo sapiens
actccagtctcctgacatta

SEQ ID NO: 2877899 - DNA, 19 bp, Homo sapiens
actcccaaagctcagactt

SEQ ID NO: 2877900 - DNA, 14 bp, Homo sapiens
actcccccagccct

SEQ ID NO: 2877901 - DNA, 14 bp, Homo sapiens
actcctgtgctctg

SEQ ID NO: 2877902 - DNA, 21 bp, Homo sapiens
actcggcctcccaaagtgctg

SEQ ID NO: 2877903 - DNA, 14 bp, Homo sapiens
actcgttttttaca

SEQ ID NO: 2877904 - DNA, 24 bp, Homo sapiens
actctcaggaggcgcagcccgaag

SEQ ID NO: 2877905 - DNA, 12 bp, Homo sapiens
actgacacaggg

SEQ ID NO: 2877906 - DNA, 24 bp, Homo sapiens
actgagccaaacacactgtaaata

SEQ ID NO: 2877907 - DNA, 15 bp, Homo sapiens
actgctgtccctcct

SEQ ID NO: 2877908 - DNA, 17 bp, Homo sapiens
actgggccggcagcctg

SEQ ID NO: 2877909 - DNA, 18 bp, Homo sapiens
actgggccggcagcctgg

SEQ ID NO: 2877910 - DNA, 14 bp, Homo sapiens
actgggtaatgaaa

SEQ ID NO: 2877911 - DNA, 17 bp, Homo sapiens
actgtaatttctttgag

SEQ ID NO: 2877912 - DNA, 14 bp, Homo sapiens
actgtgtgttgtga

SEQ ID NO: 2877913 - DNA, 15 bp, Homo sapiens
actgtgtgttgtgaa

SEQ ID NO: 2877914 - DNA, 19 bp, Homo sapiens
actgtgtgttgtgaaataa

SEQ ID NO: 2877915 - DNA, 16 bp, Homo sapiens
acttaaatagtatttc

SEQ ID NO: 2877916 - DNA, 22 bp, Homo sapiens
acttagcccaagaggtctgagc

SEQ ID NO: 2877917 - DNA, 19 bp, Homo sapiens
acttcaagcatggctattt

SEQ ID NO: 2877918 - DNA, 14 bp, Homo sapiens
acttgaatctgtta

SEQ ID NO: 2877919 - DNA, 19 bp, Homo sapiens
acttgaatctgttactgaa

SEQ ID NO: 2877920 - DNA, 13 bp, Homo sapiens
actttctttctca

SEQ ID NO: 2877921 - DNA, 16 bp, Homo sapiens
actttctttctcacta

SEQ ID NO: 2877922 - DNA, 22 bp, Homo sapiens
actttctttctcactaaatctt

SEQ ID NO: 2877923 - DNA, 20 bp, Homo sapiens
acttttccttttcttaaaac

SEQ ID NO: 2877924 - DNA, 18 bp, Homo sapiens
agaaacaaggttttcagt

SEQ ID NO: 2877925 - DNA, 18 bp, Homo sapiens
agaaagccgtactgtcta

SEQ ID NO: 2877926 - DNA, 16 bp, Homo sapiens
agaaataagtttttgt

SEQ ID NO: 2877927 - DNA, 22 bp, Homo sapiens
agaaatcattttgcaatccctt

SEQ ID NO: 2877928 - DNA, 19 bp, Homo sapiens
agaacatagacagaagaaa

SEQ ID NO: 2877929 - DNA, 21 bp, Homo sapiens
agaacatagacagaagaaaca

SEQ ID NO: 2877930 - DNA, 19 bp, Homo sapiens
agaacctaattcaattcaa

SEQ ID NO: 2877931 - DNA, 13 bp, Homo sapiens
agaagaaaaagaa

SEQ ID NO: 2877932 - DNA, 19 bp, Homo sapiens
agaagacccacgtgctagg

SEQ ID NO: 2877933 - DNA, 23 bp, Homo sapiens
agaagcaacctcagtaatttaga

SEQ ID NO: 2877934 - DNA, 15 bp, Homo sapiens
agaagtaaaagcaaa

SEQ ID NO: 2877935 - DNA, 19 bp, Homo sapiens
agaagtaaatttgtccaat

SEQ ID NO: 2877936 - DNA, 19 bp, Homo sapiens
agaattgtgtcagactgtt

SEQ ID NO: 2877937 - DNA, 20 bp, Homo sapiens
agaattgtgtcagactgttt

SEQ ID NO: 2877938 - DNA, 14 bp, Homo sapiens
agacaatccactct

SEQ ID NO: 2877939 - DNA, 18 bp, Homo sapiens
agacaatccactctcagg

SEQ ID NO: 2877940 - DNA, 17 bp, Homo sapiens
agactatcttactattt

SEQ ID NO: 2877941 - DNA, 15 bp, Homo sapiens
agactccctcccctg

SEQ ID NO: 2877942 - DNA, 21 bp, Homo sapiens
agactccttcaacaattctaa

SEQ ID NO: 2877943 - DNA, 16 bp, Homo sapiens
agagaagtagaaatca

SEQ ID NO: 2877944 - DNA, 19 bp, Homo sapiens
agagatcaaatggaaagga

SEQ ID NO: 2877945 - DNA, 14 bp, Homo sapiens
agagccctgctgtg

SEQ ID NO: 2877946 - DNA, 16 bp, Homo sapiens
agagctacgtatttaa

SEQ ID NO: 2877947 - DNA, 17 bp, Homo sapiens
agagctacgtatttaat

SEQ ID NO: 2877948 - DNA, 11 bp, Homo sapiens
agaggagaaga

SEQ ID NO: 2877949 - DNA, 13 bp, Homo sapiens
agaggcagtgaga

SEQ ID NO: 2877950 - DNA, 16 bp, Homo sapiens
agaggtccctgcttac

SEQ ID NO: 2877951 - DNA, 15 bp, Homo sapiens
agaggtctgagccct

SEQ ID NO: 2877952 - DNA, 12 bp, Homo sapiens
agagtctgtctc

SEQ ID NO: 2877953 - DNA, 13 bp, Homo sapiens
agagtctgtctct

SEQ ID NO: 2877954 - DNA, 23 bp, Homo sapiens
agataagcttttggtaatattca

SEQ ID NO: 2877955 - DNA, 17 bp, Homo sapiens
agatgtttgatagattt

SEQ ID NO: 2877956 - DNA, 19 bp, Homo sapiens
agattttctgctactttgc

SEQ ID NO: 2877957 - DNA, 14 bp, Homo sapiens
agcaaaatgtgaat

SEQ ID NO: 2877958 - DNA, 15 bp, Homo sapiens
agcaaaatgtgaatg

SEQ ID NO: 2877959 - DNA, 17 bp, Homo sapiens
agcaaatcgaatgaaat

SEQ ID NO: 2877960 - DNA, 20 bp, Homo sapiens
agcaaatcgaatgaaattaa

SEQ ID NO: 2877961 - DNA, 15 bp, Homo sapiens
agcaacctcagtaat

SEQ ID NO: 2877962 - DNA, 24 bp, Homo sapiens
agcaagagatgagaaacaacagaa

SEQ ID NO: 2877963 - DNA, 17 bp, Homo sapiens
agcaagcttaatggctg

SEQ ID NO: 2877964 - DNA, 21 bp, Homo sapiens
agcacgccgtaaccaggggct

SEQ ID NO: 2877965 - DNA, 17 bp, Homo sapiens
agcagagtctgtctctt

SEQ ID NO: 2877966 - DNA, 19 bp, Homo sapiens
agcagggcaggaaggggaa

SEQ ID NO: 2877967 - DNA, 17 bp, Homo sapiens
agcatggctattttata

SEQ ID NO: 2877968 - DNA, 17 bp, Homo sapiens
agcatgggtgtgccctt

SEQ ID NO: 2877969 - DNA, 19 bp, Homo sapiens
agcattcagaagaaaaaga

SEQ ID NO: 2877970 - DNA, 17 bp, Homo sapiens
agcattttgtaagttga

SEQ ID NO: 2877971 - DNA, 15 bp, Homo sapiens
agccaaaaatagcta

SEQ ID NO: 2877972 - DNA, 22 bp, Homo sapiens
agccaaaaatagctaaatacct

SEQ ID NO: 2877973 - DNA, 16 bp, Homo sapiens
agccacagaaatgtgt

SEQ ID NO: 2877974 - DNA, 15 bp, Homo sapiens
agccacccagccagg

SEQ ID NO: 2877975 - DNA, 13 bp, Homo sapiens
agccagagcctgg

SEQ ID NO: 2877976 - DNA, 15 bp, Homo sapiens
agccagagcctgggg

SEQ ID NO: 2877977 - DNA, 15 bp, Homo sapiens
agccagcgcctccct

SEQ ID NO: 2877978 - DNA, 19 bp, Homo sapiens
agccagcgcctccctccac

SEQ ID NO: 2877979 - DNA, 19 bp, Homo sapiens
agccaggagcctcctgacc

SEQ ID NO: 2877980 - DNA, 14 bp, Homo sapiens
agcccagtgacctg

SEQ ID NO: 2877981 - DNA, 17 bp, Homo sapiens
agcccagtttcccttct

SEQ ID NO: 2877982 - DNA, 14 bp, Homo sapiens
agccccgactccag

SEQ ID NO: 2877983 - DNA, 17 bp, Homo sapiens
agccccgactccagcca

SEQ ID NO: 2877984 - DNA, 18 bp, Homo sapiens
agccccgactccagccag

SEQ ID NO: 2877985 - DNA, 21 bp, Homo sapiens
agccccgactccagccagcgc

SEQ ID NO: 2877986 - DNA, 23 bp, Homo sapiens
agccccgactccagccagcgcct

SEQ ID NO: 2877987 - DNA, 18 bp, Homo sapiens
agcccgaagcccagtttc

SEQ ID NO: 2877988 - DNA, 21 bp, Homo sapiens
agccctaaacatcattcttga

SEQ ID NO: 2877989 - DNA, 17 bp, Homo sapiens
agccctgctgtgggaga

SEQ ID NO: 2877990 - DNA, 22 bp, Homo sapiens
agcctctgcagcggaatctgtt

SEQ ID NO: 2877991 - DNA, 14 bp, Homo sapiens
agcctggagccgtg

SEQ ID NO: 2877992 - DNA, 16 bp, Homo sapiens
agcctggggtgttctc

SEQ ID NO: 2877993 - DNA, 20 bp, Homo sapiens
agcctggttccctctttcct

SEQ ID NO: 2877994 - DNA, 22 bp, Homo sapiens
agcctggttccctctttcctgt

SEQ ID NO: 2877995 - DNA, 12 bp, Homo sapiens
agcgcctccctc

SEQ ID NO: 2877996 - DNA, 14 bp, Homo sapiens
agcgcctccctcca

SEQ ID NO: 2877997 - DNA, 15 bp, Homo sapiens
agcgcctccctccac

SEQ ID NO: 2877998 - DNA, 22 bp, Homo sapiens
agcgcctccctccaccccagga

SEQ ID NO: 2877999 - DNA, 23 bp, Homo sapiens
agcgcctccctccaccccaggac

SEQ ID NO: 2878000 - DNA, 15 bp, Homo sapiens
agctacataatttag

SEQ ID NO: 2878001 - DNA, 20 bp, Homo sapiens
agctctagttttcagccttg

SEQ ID NO: 2878002 - DNA, 21 bp, Homo sapiens
agctgacccagagtggagtct

SEQ ID NO: 2878003 - DNA, 16 bp, Homo sapiens
agctgagagccctgct

SEQ ID NO: 2878004 - DNA, 12 bp, Homo sapiens
agcttaaaactt

SEQ ID NO: 2878005 - DNA, 13 bp, Homo sapiens
agcttaaaacttt

SEQ ID NO: 2878006 - DNA, 14 bp, Homo sapiens
aggaaaattgaatg

SEQ ID NO: 2878007 - DNA, 15 bp, Homo sapiens
aggaagcgtggggta

SEQ ID NO: 2878008 - DNA, 22 bp, Homo sapiens
aggacatgtgctattgaactga

SEQ ID NO: 2878009 - DNA, 19 bp, Homo sapiens
aggaccctgttttccacac

SEQ ID NO: 2878010 - DNA, 20 bp, Homo sapiens
aggaccctgttttccacacc

SEQ ID NO: 2878011 - DNA, 12 bp, Homo sapiens
aggacgccactc

SEQ ID NO: 2878012 - DNA, 14 bp, Homo sapiens
aggagagaaggaca

SEQ ID NO: 2878013 - DNA, 19 bp, Homo sapiens
aggagctcagccgtgcact

SEQ ID NO: 2878014 - DNA, 23 bp, Homo sapiens
aggaggcgcagcccgaagcccag

SEQ ID NO: 2878015 - DNA, 14 bp, Homo sapiens
aggatgcttctgct

SEQ ID NO: 2878016 - DNA, 18 bp, Homo sapiens
aggatgcttctgctcaca

SEQ ID NO: 2878017 - DNA, 17 bp, Homo sapiens
aggatttatttaaaata

SEQ ID NO: 2878018 - DNA, 21 bp, Homo sapiens
aggcaatttttacaacctgag

SEQ ID NO: 2878019 - DNA, 22 bp, Homo sapiens
aggcactataatttctgtaaca

SEQ ID NO: 2878020 - DNA, 16 bp, Homo sapiens
aggcagacaaccttgt

SEQ ID NO: 2878021 - DNA, 19 bp, Homo sapiens
aggcatctgttagcagagt

SEQ ID NO: 2878022 - DNA, 16 bp, Homo sapiens
aggcatggcccagcct

SEQ ID NO: 2878023 - DNA, 17 bp, Homo sapiens
aggcatggcccagcctg

SEQ ID NO: 2878024 - DNA, 18 bp, Homo sapiens
aggcatggcccagcctgg

SEQ ID NO: 2878025 - DNA, 21 bp, Homo sapiens
aggcatggcccagcctggagc

SEQ ID NO: 2878026 - DNA, 22 bp, Homo sapiens
aggcatggcccagcctggagcc

SEQ ID NO: 2878027 - DNA, 16 bp, Homo sapiens
aggcgcagcccgaagc

SEQ ID NO: 2878028 - DNA, 19 bp, Homo sapiens
aggcgcagcccgaagccca

SEQ ID NO: 2878029 - DNA, 19 bp, Homo sapiens
aggctgcagagctgaccca

SEQ ID NO: 2878030 - DNA, 13 bp, Homo sapiens
agggaaaaatata

SEQ ID NO: 2878031 - DNA, 19 bp, Homo sapiens
agggaataaggtacaagaa

SEQ ID NO: 2878032 - DNA, 20 bp, Homo sapiens
agggatggggagcagctggg

SEQ ID NO: 2878033 - DNA, 16 bp, Homo sapiens
agggcagggaaactgg

SEQ ID NO: 2878034 - DNA, 11 bp, Homo sapiens
agggcctggcc

SEQ ID NO: 2878035 - DNA, 13 bp, Homo sapiens
agggcctggcctg

SEQ ID NO: 2878036 - DNA, 14 bp, Homo sapiens
agggcctggcctgg

SEQ ID NO: 2878037 - DNA, 18 bp, Homo sapiens
agggctccagggccaggg

SEQ ID NO: 2878038 - DNA, 14 bp, Homo sapiens
aggggcctggcctg

SEQ ID NO: 2878039 - DNA, 17 bp, Homo sapiens
aggggcctggcctgggt

SEQ ID NO: 2878040 - DNA, 15 bp, Homo sapiens
aggtcctttccttct

SEQ ID NO: 2878041 - DNA, 22 bp, Homo sapiens
aggtctgagccctggtgtgttt

SEQ ID NO: 2878042 - DNA, 23 bp, Homo sapiens
aggtctgagccctggtgtgtttc

SEQ ID NO: 2878043 - DNA, 21 bp, Homo sapiens
aggtggggtacatttctctga

SEQ ID NO: 2878044 - DNA, 14 bp, Homo sapiens
aggtttatgaaaaa

SEQ ID NO: 2878045 - DNA, 16 bp, Homo sapiens
agtaaaagcaaaaaag

SEQ ID NO: 2878046 - DNA, 15 bp, Homo sapiens
agtaacatgccagct

SEQ ID NO: 2878047 - DNA, 13 bp, Homo sapiens
agtaattgtgaaa

SEQ ID NO: 2878048 - DNA, 17 bp, Homo sapiens
agtaggttgaggacagg

SEQ ID NO: 2878049 - DNA, 14 bp, Homo sapiens
agtagttaattctg

SEQ ID NO: 2878050 - DNA, 21 bp, Homo sapiens
agtattgccacaatgcctctc

SEQ ID NO: 2878051 - DNA, 15 bp, Homo sapiens
agtcagaggagaaga

SEQ ID NO: 2878052 - DNA, 22 bp, Homo sapiens
agtcagggtgggaagaaagaat

SEQ ID NO: 2878053 - DNA, 18 bp, Homo sapiens
agtccatagctgagctgg

SEQ ID NO: 2878054 - DNA, 21 bp, Homo sapiens
agtcgcttttgccttttcaaa

SEQ ID NO: 2878055 - DNA, 20 bp, Homo sapiens
agtctgagtcctgtctctgc

SEQ ID NO: 2878056 - DNA, 19 bp, Homo sapiens
agtctgtctcttggctttg

SEQ ID NO: 2878057 - DNA, 12 bp, Homo sapiens
agtgacctgacc

SEQ ID NO: 2878058 - DNA, 20 bp, Homo sapiens
agtgacctgaccggcacctg

SEQ ID NO: 2878059 - DNA, 14 bp, Homo sapiens
agtgcactcagagc

SEQ ID NO: 2878060 - DNA, 23 bp, Homo sapiens
agtgcactcagagctgctgagga

SEQ ID NO: 2878061 - DNA, 18 bp, Homo sapiens
agtggactgaatgtgcct

SEQ ID NO: 2878062 - DNA, 23 bp, Homo sapiens
agtggagtctgagtctgagtcct

SEQ ID NO: 2878063 - DNA, 23 bp, Homo sapiens
agtggggaggggcctggcctggg

SEQ ID NO: 2878064 - DNA, 22 bp, Homo sapiens
agtgtctattagttttctttgt

SEQ ID NO: 2878065 - DNA, 12 bp, Homo sapiens
agtgttcagtgt

SEQ ID NO: 2878066 - DNA, 14 bp, Homo sapiens
agtgttcagtgttg

SEQ ID NO: 2878067 - DNA, 17 bp, Homo sapiens
agtgttcagtgttgaca

SEQ ID NO: 2878068 - DNA, 19 bp, Homo sapiens
agtgttcagtgttgacata

SEQ ID NO: 2878069 - DNA, 23 bp, Homo sapiens
agtgttcagtgttgacatagcct

SEQ ID NO: 2878070 - DNA, 18 bp, Homo sapiens
agtgttgacatagccttt

SEQ ID NO: 2878071 - DNA, 19 bp, Homo sapiens
agtgttgacatagcctttg

SEQ ID NO: 2878072 - DNA, 20 bp, Homo sapiens
agttagctttaacttaaata

SEQ ID NO: 2878073 - DNA, 22 bp, Homo sapiens
agttagctttaacttaaatagt

SEQ ID NO: 2878074 - DNA, 13 bp, Homo sapiens
agttcaacatgtt

SEQ ID NO: 2878075 - DNA, 15 bp, Homo sapiens
agttcaagcctgtgg

SEQ ID NO: 2878076 - DNA, 14 bp, Homo sapiens
agttccgtctcctc

SEQ ID NO: 2878077 - DNA, 15 bp, Homo sapiens
agttccgtctcctct

SEQ ID NO: 2878078 - DNA, 19 bp, Homo sapiens
agttccgtctcctctccag

SEQ ID NO: 2878079 - DNA, 14 bp, Homo sapiens
agttctcatccaca

SEQ ID NO: 2878080 - DNA, 17 bp, Homo sapiens
agttctcatccacagag

SEQ ID NO: 2878081 - DNA, 21 bp, Homo sapiens
agttgtgtctggcagtttata

SEQ ID NO: 2878082 - DNA, 16 bp, Homo sapiens
agtttcatataaagta

SEQ ID NO: 2878083 - DNA, 16 bp, Homo sapiens
agtttggatatgtaaa

SEQ ID NO: 2878084 - DNA, 20 bp, Homo sapiens
agtttggatatgtaaaacat

SEQ ID NO: 2878085 - DNA, 16 bp, Homo sapiens
agttttcagccttggg

SEQ ID NO: 2878086 - DNA, 17 bp, Homo sapiens
agttttctttgtaaagg

SEQ ID NO: 2878087 - DNA, 16 bp, Homo sapiens
ataaaaatgatctaaa

SEQ ID NO: 2878088 - DNA, 14 bp, Homo sapiens
ataaactactgtaa

SEQ ID NO: 2878089 - DNA, 15 bp, Homo sapiens
ataaactactgtaat

SEQ ID NO: 2878090 - DNA, 13 bp, Homo sapiens
ataaagatttttt

SEQ ID NO: 2878091 - DNA, 15 bp, Homo sapiens
ataaagtatcatcag

SEQ ID NO: 2878092 - DNA, 17 bp, Homo sapiens
ataacgtttaagccaaa

SEQ ID NO: 2878093 - DNA, 20 bp, Homo sapiens
ataacgtttaagccaaaaca

SEQ ID NO: 2878094 - DNA, 22 bp, Homo sapiens
ataacgtttaagccaaaacaat

SEQ ID NO: 2878095 - DNA, 20 bp, Homo sapiens
ataactgaaaattatttaaa

SEQ ID NO: 2878096 - DNA, 21 bp, Homo sapiens
ataactgaaaattatttaaac

SEQ ID NO: 2878097 - DNA, 14 bp, Homo sapiens
ataagaaacttttt

SEQ ID NO: 2878098 - DNA, 15 bp, Homo sapiens
ataagaagaatgctt

SEQ ID NO: 2878099 - DNA, 19 bp, Homo sapiens
ataagaagaatgcttaatc

SEQ ID NO: 2878100 - DNA, 20 bp, Homo sapiens
ataagaagaatgcttaatca

SEQ ID NO: 2878101 - DNA, 21 bp, Homo sapiens
ataagcaagaaggcaaaaata

SEQ ID NO: 2878102 - DNA, 16 bp, Homo sapiens
ataagcttttggtaat

SEQ ID NO: 2878103 - DNA, 16 bp, Homo sapiens
ataagtgaagtaattt

SEQ ID NO: 2878104 - DNA, 15 bp, Homo sapiens
ataagtgttcagtgt

SEQ ID NO: 2878105 - DNA, 16 bp, Homo sapiens
ataagtgttcagtgtt

SEQ ID NO: 2878106 - DNA, 17 bp, Homo sapiens
ataatactaaagtgtct

SEQ ID NO: 2878107 - DNA, 17 bp, Homo sapiens
ataatgaacagaacata

SEQ ID NO: 2878108 - DNA, 17 bp, Homo sapiens
ataatttagtttcatat

SEQ ID NO: 2878109 - DNA, 14 bp, Homo sapiens
ataattttaaattc

SEQ ID NO: 2878110 - DNA, 12 bp, Homo sapiens
atacaataattt

SEQ ID NO: 2878111 - DNA, 18 bp, Homo sapiens
atacagccttacaataca

SEQ ID NO: 2878112 - DNA, 15 bp, Homo sapiens
atacattgaattaga

SEQ ID NO: 2878113 - DNA, 16 bp, Homo sapiens
ataccatgtataattt

SEQ ID NO: 2878114 - DNA, 15 bp, Homo sapiens
ataccttggactgac

SEQ ID NO: 2878115 - DNA, 21 bp, Homo sapiens
atactaagcattgaatggcta

SEQ ID NO: 2878116 - DNA, 14 bp, Homo sapiens
atagacagaagaaa

SEQ ID NO: 2878117 - DNA, 15 bp, Homo sapiens
atagcaaaagaagaa

SEQ ID NO: 2878118 - DNA, 16 bp, Homo sapiens
atagcaaaagaagaag

SEQ ID NO: 2878119 - DNA, 19 bp, Homo sapiens
atagcaaaagaagaagttt

SEQ ID NO: 2878120 - DNA, 13 bp, Homo sapiens
atagcaaagaatt

SEQ ID NO: 2878121 - DNA, 20 bp, Homo sapiens
atagcagaagaaaaagttgc

SEQ ID NO: 2878122 - DNA, 15 bp, Homo sapiens
atagccaaaaatagc

SEQ ID NO: 2878123 - DNA, 16 bp, Homo sapiens
atagccaaaaatagct

SEQ ID NO: 2878124 - DNA, 13 bp, Homo sapiens
atagctgagctgg

SEQ ID NO: 2878125 - DNA, 14 bp, Homo sapiens
atagctgagctgga

SEQ ID NO: 2878126 - DNA, 16 bp, Homo sapiens
ataggatttatttaaa

SEQ ID NO: 2878127 - DNA, 22 bp, Homo sapiens
ataggatttatttaaaatagca

SEQ ID NO: 2878128 - DNA, 23 bp, Homo sapiens
ataggatttatttaaaatagcaa

SEQ ID NO: 2878129 - DNA, 24 bp, Homo sapiens
atataaagtatcatcagtgtagaa

SEQ ID NO: 2878130 - DNA, 19 bp, Homo sapiens
atataatactaaagtgtct

SEQ ID NO: 2878131 - DNA, 18 bp, Homo sapiens
atataattgttttatctg

SEQ ID NO: 2878132 - DNA, 16 bp, Homo sapiens
atatatctatctattt

SEQ ID NO: 2878133 - DNA, 18 bp, Homo sapiens
atatatctatctatttga

SEQ ID NO: 2878134 - DNA, 19 bp, Homo sapiens
atatatctatctatttgag

SEQ ID NO: 2878135 - DNA, 18 bp, Homo sapiens
atatctatctatttgagg

SEQ ID NO: 2878136 - DNA, 13 bp, Homo sapiens
atatctcctgaaa

SEQ ID NO: 2878137 - DNA, 23 bp, Homo sapiens
atatctcctgaaaaggtttatga

SEQ ID NO: 2878138 - DNA, 12 bp, Homo sapiens
atatgtaaaaca

SEQ ID NO: 2878139 - DNA, 13 bp, Homo sapiens
atatgtaaaacat

SEQ ID NO: 2878140 - DNA, 14 bp, Homo sapiens
atatgtaaaacatt

SEQ ID NO: 2878141 - DNA, 22 bp, Homo sapiens
atattcctattgtgcaatgtaa

SEQ ID NO: 2878142 - DNA, 22 bp, Homo sapiens
atcaaacaccaacataaaaatg

SEQ ID NO: 2878143 - DNA, 19 bp, Homo sapiens
atcagctgttaaccatttg

SEQ ID NO: 2878144 - DNA, 22 bp, Homo sapiens
atcattttgcaatcccttaata

SEQ ID NO: 2878145 - DNA, 21 bp, Homo sapiens
atccacagactccctcccctg

SEQ ID NO: 2878146 - DNA, 17 bp, Homo sapiens
atccaggtcctttcctt

SEQ ID NO: 2878147 - DNA, 14 bp, Homo sapiens
ccccgactccagcc

SEQ ID NO: 2878148 - DNA, 17 bp, Homo sapiens
ccccgactccagccagc

SEQ ID NO: 2878149 - DNA, 18 bp, Homo sapiens
ccccgactccagccagcg

SEQ ID NO: 2878150 - DNA, 12 bp, Homo sapiens
cccctcccaccc

SEQ ID NO: 2878151 - DNA, 11 bp, Homo sapiens
cccctctgtgt

SEQ ID NO: 2878152 - DNA, 18 bp, Homo sapiens
cccctgctactcctgtgc

SEQ ID NO: 2878153 - DNA, 22 bp, Homo sapiens
cccctgggcatcttctggcttg

SEQ ID NO: 2878154 - DNA, 23 bp, Homo sapiens
cccctgggcatcttctggcttga

SEQ ID NO: 2878155 - DNA, 16 bp, Homo sapiens
ccccttgtcctctccc

SEQ ID NO: 2878156 - DNA, 11 bp, Homo sapiens
cccgaagccca

SEQ ID NO: 2878157 - DNA, 13 bp, Homo sapiens
cccgaatcctgag

SEQ ID NO: 2878158 - DNA, 14 bp, Homo sapiens
cccgcgggcctgga

SEQ ID NO: 2878159 - DNA, 17 bp, Homo sapiens
ccctaagaaaccccagg

SEQ ID NO: 2878160 - DNA, 17 bp, Homo sapiens
ccctatgtcccagcccc

SEQ ID NO: 2878161 - DNA, 18 bp, Homo sapiens
ccctcatggagaaacatc

SEQ ID NO: 2878162 - DNA, 21 bp, Homo sapiens
ccctcatggagaaacatccta

SEQ ID NO: 2878163 - DNA, 14 bp, Homo sapiens
ccctccatccctgg

SEQ ID NO: 2878164 - DNA, 15 bp, Homo sapiens
ccctcccacccccag

SEQ ID NO: 2878165 - DNA, 17 bp, Homo sapiens
ccctcccacccccagcc

SEQ ID NO: 2878166 - DNA, 21 bp, Homo sapiens
ccctcgcatccgcctctgagc

SEQ ID NO: 2878167 - DNA, 24 bp, Homo sapiens
ccctcgcatccgcctctgagccag

SEQ ID NO: 2878168 - DNA, 21 bp, Homo sapiens
ccctctcatccaggtcctttc

SEQ ID NO: 2878169 - DNA, 15 bp, Homo sapiens
ccctctgggcagctg

SEQ ID NO: 2878170 - DNA, 15 bp, Homo sapiens
ccctctttcctgtgc

SEQ ID NO: 2878171 - DNA, 18 bp, Homo sapiens
ccctgctactcctgtgct

SEQ ID NO: 2878172 - DNA, 13 bp, Homo sapiens
ccctgctgtggga

SEQ ID NO: 2878173 - DNA, 21 bp, Homo sapiens
ccctgggcatcttctggcttg

SEQ ID NO: 2878174 - DNA, 23 bp, Homo sapiens
ccctggtactcccccagccctca

SEQ ID NO: 2878175 - DNA, 14 bp, Homo sapiens
ccctggtgtgtttc

SEQ ID NO: 2878176 - DNA, 22 bp, Homo sapiens
ccctgtatataatactaaagtg

SEQ ID NO: 2878177 - DNA, 12 bp, Homo sapiens
ccctgtcctggg

SEQ ID NO: 2878178 - DNA, 19 bp, Homo sapiens
ccctgtgtgtcgttccctt

SEQ ID NO: 2878179 - DNA, 19 bp, Homo sapiens
ccctgttttccacaccatc

SEQ ID NO: 2878180 - DNA, 23 bp, Homo sapiens
cccttctatgcagtattgccaca

SEQ ID NO: 2878181 - DNA, 17 bp, Homo sapiens
ccctttgttgctgtctg

SEQ ID NO: 2878182 - DNA, 18 bp, Homo sapiens
ccgaagaggaagcaagaa

SEQ ID NO: 2878183 - DNA, 22 bp, Homo sapiens
ccgaagaggaagcaagaaagcc

SEQ ID NO: 2878184 - DNA, 10 bp, Homo sapiens
ccgactccag

SEQ ID NO: 2878185 - DNA, 14 bp, Homo sapiens
ccgactccagccag

SEQ ID NO: 2878186 - DNA, 16 bp, Homo sapiens
ccgcctctgagccagg

SEQ ID NO: 2878187 - DNA, 13 bp, Homo sapiens
ccggcagcctggt

SEQ ID NO: 2878188 - DNA, 16 bp, Homo sapiens
ccgtctcctctccagc

SEQ ID NO: 2878189 - DNA, 17 bp, Homo sapiens
ccgtgcactccctaaga

SEQ ID NO: 2878190 - DNA, 23 bp, Homo sapiens
cctaagaaaccccagggcaggga

SEQ ID NO: 2878191 - DNA, 21 bp, Homo sapiens
cctaaggacgaaaaacacagt

SEQ ID NO: 2878192 - DNA, 15 bp, Homo sapiens
ctccagccagcgcct

SEQ ID NO: 2878193 - DNA, 17 bp, Homo sapiens
ctccagtctcctgacat

SEQ ID NO: 2878194 - DNA, 16 bp, Homo sapiens
ctccatatctccttcc

SEQ ID NO: 2878195 - DNA, 19 bp, Homo sapiens
ctccatccctggccccctc

SEQ ID NO: 2878196 - DNA, 20 bp, Homo sapiens
ctcccaaagctcagacttgc

SEQ ID NO: 2878197 - DNA, 23 bp, Homo sapiens
ctcccaaagctcagacttgccag

SEQ ID NO: 2878198 - DNA, 12 bp, Homo sapiens
ctcccccagccc

SEQ ID NO: 2878199 - DNA, 14 bp, Homo sapiens
ctcccctctgccct

SEQ ID NO: 2878200 - DNA, 13 bp, Homo sapiens
ctcccgaatcctg

SEQ ID NO: 2878201 - DNA, 15 bp, Homo sapiens
ctcccgaatcctgag

SEQ ID NO: 2878202 - DNA, 18 bp, Homo sapiens
ctcccgcgggcctggaca

SEQ ID NO: 2878203 - DNA, 18 bp, Homo sapiens
ctccctactcccctgggc

SEQ ID NO: 2878204 - DNA, 14 bp, Homo sapiens
ctccctccacccca

SEQ ID NO: 2878205 - DNA, 22 bp, Homo sapiens
ctccctcgcatccgcctctgag

SEQ ID NO: 2878206 - DNA, 18 bp, Homo sapiens
ctccctgtagctctgcct

SEQ ID NO: 2878207 - DNA, 20 bp, Homo sapiens
ctccctgtagctctgcctcc

SEQ ID NO: 2878208 - DNA, 13 bp, Homo sapiens
ctcctacccctgt

SEQ ID NO: 2878209 - DNA, 15 bp, Homo sapiens
ctcctcaacccctcc

SEQ ID NO: 2878210 - DNA, 14 bp, Homo sapiens
ctcctcctcctcct

SEQ ID NO: 2878211 - DNA, 15 bp, Homo sapiens
ctcctcctcctgttc

SEQ ID NO: 2878212 - DNA, 20 bp, Homo sapiens
ctcctcctgttcctgccttc

SEQ ID NO: 2878213 - DNA, 12 bp, Homo sapiens
ctcctctccagc

SEQ ID NO: 2878214 - DNA, 15 bp, Homo sapiens
ctcctctccagccct

SEQ ID NO: 2878215 - DNA, 22 bp, Homo sapiens
ctcctgaaaaggtttatgaaaa

SEQ ID NO: 2878216 - DNA, 22 bp, Homo sapiens
ctcctgacattaagacacacct

SEQ ID NO: 2878217 - DNA, 20 bp, Homo sapiens
ctcctgaccctgtgatgcct

SEQ ID NO: 2878218 - DNA, 18 bp, Homo sapiens
ctcctgaggtctggattg

SEQ ID NO: 2878219 - DNA, 21 bp, Homo sapiens
ctcctgtgctctggaggctgc

SEQ ID NO: 2878220 - DNA, 13 bp, Homo sapiens
ctcctgttcctgc

SEQ ID NO: 2878221 - DNA, 14 bp, Homo sapiens
ctcctgttcctgcc

SEQ ID NO: 2878222 - DNA, 23 bp, Homo sapiens
ctccttcccctacacctccctcc

SEQ ID NO: 2878223 - DNA, 22 bp, Homo sapiens
ctcgcatccgcctctgagccag

SEQ ID NO: 2878224 - DNA, 14 bp, Homo sapiens
ctcgtcttcctctc

SEQ ID NO: 2878225 - DNA, 15 bp, Homo sapiens
ctctcaagctagcca

SEQ ID NO: 2878226 - DNA, 14 bp, Homo sapiens
ctctcatccaggtc

SEQ ID NO: 2878227 - DNA, 19 bp, Homo sapiens
ctctcatccaggtcctttc

SEQ ID NO: 2878228 - DNA, 20 bp, Homo sapiens
ctctcatccaggtcctttcc

SEQ ID NO: 2878229 - DNA, 15 bp, Homo sapiens
ctctcccctctgccc

SEQ ID NO: 2878230 - DNA, 17 bp, Homo sapiens
ctctcccctctgccctg

SEQ ID NO: 2878231 - DNA, 19 bp, Homo sapiens
ctctcccctctgccctgta

SEQ ID NO: 2878232 - DNA, 18 bp, Homo sapiens
ctctctataagtgttcag

SEQ ID NO: 2878233 - DNA, 19 bp, Homo sapiens
ctctctataagtgttcagt

SEQ ID NO: 2878234 - DNA, 23 bp, Homo sapiens
ctctctataagtgttcagtgttg

SEQ ID NO: 2878235 - DNA, 14 bp, Homo sapiens
ctctgagcagtcag

SEQ ID NO: 2878236 - DNA, 21 bp, Homo sapiens
ctctgagccaggagcctcctg

SEQ ID NO: 2878237 - DNA, 23 bp, Homo sapiens
ctctgtattctgcaacagcctgt

SEQ ID NO: 2878238 - DNA, 23 bp, Homo sapiens
ctctgtcaaatctagtttcctat

SEQ ID NO: 2878239 - DNA, 18 bp, Homo sapiens
ctctgtgtcctctcccct

SEQ ID NO: 2878240 - DNA, 16 bp, Homo sapiens
ctcttctatcctgcaa

SEQ ID NO: 2878241 - DNA, 13 bp, Homo sapiens
ctctttcctgtgc

SEQ ID NO: 2878242 - DNA, 20 bp, Homo sapiens
ctctttcctgtgccaggact

SEQ ID NO: 2878243 - DNA, 13 bp, Homo sapiens
ctctttcttccac

SEQ ID NO: 2878244 - DNA, 20 bp, Homo sapiens
ctctttcttccactaccctc

SEQ ID NO: 2878245 - DNA, 22 bp, Homo sapiens
ctgaagatgcagcaaaatgtga

SEQ ID NO: 2878246 - DNA, 21 bp, Homo sapiens
ctgaatttttaaacaagtatt

SEQ ID NO: 2878247 - DNA, 20 bp, Homo sapiens
ctgacacaggggacactgaa

SEQ ID NO: 2878248 - DNA, 20 bp, Homo sapiens
ctgacccagagtggagtctg

SEQ ID NO: 2878249 - DNA, 22 bp, Homo sapiens
ctgacccagagtggagtctgag

SEQ ID NO: 2878250 - DNA, 23 bp, Homo sapiens
ctgacccagagtggagtctgagt

SEQ ID NO: 2878251 - DNA, 21 bp, Homo sapiens
ctgaccctgtgatgcctgaca

SEQ ID NO: 2878252 - DNA, 16 bp, Homo sapiens
ctgaccggcacctgcg

SEQ ID NO: 2878253 - DNA, 20 bp, Homo sapiens
ctgagactggcacttagccc

SEQ ID NO: 2878254 - DNA, 14 bp, Homo sapiens
ctgagagccctgct

SEQ ID NO: 2878255 - DNA, 21 bp, Homo sapiens
ctgagagccctgctgtgggag

SEQ ID NO: 2878256 - DNA, 21 bp, Homo sapiens
ctgagccaaacacactgtaaa

SEQ ID NO: 2878257 - DNA, 18 bp, Homo sapiens
gagtctgagtctgagtcc

SEQ ID NO: 2878258 - DNA, 12 bp, Homo sapiens
gagtggagtctg

SEQ ID NO: 2878259 - DNA, 23 bp, Homo sapiens
gagtggagtctgagtctgagtcc

SEQ ID NO: 2878260 - DNA, 18 bp, Homo sapiens
gagtgtagcaactacagt

SEQ ID NO: 2878261 - DNA, 18 bp, Homo sapiens
gagttcaagcctgtggga

SEQ ID NO: 2878262 - DNA, 20 bp, Homo sapiens
gagtttgagaccagcctggc

SEQ ID NO: 2878263 - DNA, 14 bp, Homo sapiens
gataatgaacagaa

SEQ ID NO: 2878264 - DNA, 12 bp, Homo sapiens
gataattttaaa

SEQ ID NO: 2878265 - DNA, 22 bp, Homo sapiens
gatagattttctgctactttgc

SEQ ID NO: 2878266 - DNA, 19 bp, Homo sapiens
gatcctggattcactcact

SEQ ID NO: 2878267 - DNA, 14 bp, Homo sapiens
gatgcctgacacag

SEQ ID NO: 2878268 - DNA, 15 bp, Homo sapiens
gatgcctgacacagg

SEQ ID NO: 2878269 - DNA, 14 bp, Homo sapiens
gatggggacaaaga

SEQ ID NO: 2878270 - DNA, 18 bp, Homo sapiens
gatggggagcagctgggc

SEQ ID NO: 2878271 - DNA, 22 bp, Homo sapiens
gatgttaaaaaaataagaagaa

SEQ ID NO: 2878272 - DNA, 17 bp, Homo sapiens
gattacgtgaataaaat

SEQ ID NO: 2878273 - DNA, 18 bp, Homo sapiens
gatttatttaaaatagca

SEQ ID NO: 2878274 - DNA, 16 bp, Homo sapiens
gattttttaataattt

SEQ ID NO: 2878275 - DNA, 17 bp, Homo sapiens
gattttttaataattta

SEQ ID NO: 2878276 - DNA, 13 bp, Homo sapiens
gcaaaaaagaaaa

SEQ ID NO: 2878277 - DNA, 14 bp, Homo sapiens
gcaaaaaagaaaac

SEQ ID NO: 2878278 - DNA, 15 bp, Homo sapiens
gcaaaaaagaaaacc

SEQ ID NO: 2878279 - DNA, 17 bp, Homo sapiens
gcaaaaaagaaaacctt

SEQ ID NO: 2878280 - DNA, 23 bp, Homo sapiens
gcaaaaatagtttggatatgtaa

SEQ ID NO: 2878281 - DNA, 14 bp, Homo sapiens
gcaaagaattgact

SEQ ID NO: 2878282 - DNA, 16 bp, Homo sapiens
gcaagaaggcaaaaat

SEQ ID NO: 2878283 - DNA, 20 bp, Homo sapiens
gcaagaaggcaaaaatagtt

SEQ ID NO: 2878284 - DNA, 23 bp, Homo sapiens
gcaagaaggcaaaaatagtttgg

SEQ ID NO: 2878285 - DNA, 18 bp, Homo sapiens
gcaagcattcagaagaaa

SEQ ID NO: 2878286 - DNA, 22 bp, Homo sapiens
gcaagtccatagctgagctgga

SEQ ID NO: 2878287 - DNA, 15 bp, Homo sapiens
gcaatgtaaatattt

SEQ ID NO: 2878288 - DNA, 17 bp, Homo sapiens
gcacagagggctaggga

SEQ ID NO: 2878289 - DNA, 15 bp, Homo sapiens
gcacagatgcccacg

SEQ ID NO: 2878290 - DNA, 14 bp, Homo sapiens
gcacagcatgaggc

SEQ ID NO: 2878291 - DNA, 16 bp, Homo sapiens
gcacaggctaattttt

SEQ ID NO: 2878292 - DNA, 14 bp, Homo sapiens
gcaccatctgcttg

SEQ ID NO: 2878293 - DNA, 12 bp, Homo sapiens
gcacctcagaca

SEQ ID NO: 2878294 - DNA, 20 bp, Homo sapiens
gcacctcagacaatccactc

SEQ ID NO: 2878295 - DNA, 22 bp, Homo sapiens
gcacctgcgagaggtccctgct

SEQ ID NO: 2878296 - DNA, 20 bp, Homo sapiens
gcacgcggagtgagtttttt

SEQ ID NO: 2878297 - DNA, 18 bp, Homo sapiens
gcactccctaagaaaccc

SEQ ID NO: 2878298 - DNA, 16 bp, Homo sapiens
gcactgggccggcagc

SEQ ID NO: 2878299 - DNA, 21 bp, Homo sapiens
gcactgggccggcagcctggt

SEQ ID NO: 2878300 - DNA, 16 bp, Homo sapiens
gcagcccgaagcccag

SEQ ID NO: 2878301 - DNA, 17 bp, Homo sapiens
gcagcccgaagcccagt

SEQ ID NO: 2878302 - DNA, 17 bp, Homo sapiens
gcagcctggttccctct

SEQ ID NO: 2878303 - DNA, 16 bp, Homo sapiens
gcagctgagagccctg

SEQ ID NO: 2878304 - DNA, 21 bp, Homo sapiens
gcagctgagagccctgctgtg

SEQ ID NO: 2878305 - DNA, 12 bp, Homo sapiens
gcagctgtcatg

SEQ ID NO: 2878306 - DNA, 23 bp, Homo sapiens
gcagctgtcatggaaaagcccag

SEQ ID NO: 2878307 - DNA, 23 bp, Homo sapiens
gcaggaaggactatgaaaagcta

SEQ ID NO: 2878308 - DNA, 13 bp, Homo sapiens
gcagggcctggcc

SEQ ID NO: 2878309 - DNA, 15 bp, Homo sapiens
gcagtctcagaaagc

SEQ ID NO: 2878310 - DNA, 15 bp, Homo sapiens
gcagtttatatttaa

SEQ ID NO: 2878311 - DNA, 18 bp, Homo sapiens
gcagtttatatttaactc

SEQ ID NO: 2878312 - DNA, 17 bp, Homo sapiens
gcatccgcctctgagcc

SEQ ID NO: 2878313 - DNA, 23 bp, Homo sapiens
gcatccgcctctgagccaggagc

SEQ ID NO: 2878314 - DNA, 23 bp, Homo sapiens
gcatctgttagcagagtctgtct

SEQ ID NO: 2878315 - DNA, 17 bp, Homo sapiens
gcatgaggcaaaaatgt

SEQ ID NO: 2878316 - DNA, 15 bp, Homo sapiens
gcatggcccagcctg

SEQ ID NO: 2878317 - DNA, 23 bp, Homo sapiens
gcattattggaatataattgttt

SEQ ID NO: 2878318 - DNA, 22 bp, Homo sapiens
gcattttgtaagttgaagcaaa

SEQ ID NO: 2878319 - DNA, 16 bp, Homo sapiens
gccaaaaaaaaataca

SEQ ID NO: 2878320 - DNA, 23 bp, Homo sapiens
gccaaaacaatgtttaaaccttt

SEQ ID NO: 2878321 - DNA, 19 bp, Homo sapiens
gccaatgcacctaaagaaa

SEQ ID NO: 2878322 - DNA, 17 bp, Homo sapiens
gccacaatgcctctccc

SEQ ID NO: 2878323 - DNA, 11 bp, Homo sapiens
gccacagaaat

SEQ ID NO: 2878324 - DNA, 20 bp, Homo sapiens
gccactcatttcatctcatt

SEQ ID NO: 2878325 - DNA, 16 bp, Homo sapiens
gccagctgtactgagt

SEQ ID NO: 2878326 - DNA, 17 bp, Homo sapiens
gccagctgtactgagtt

SEQ ID NO: 2878327 - DNA, 12 bp, Homo sapiens
gccaggactctc

SEQ ID NO: 2878328 - DNA, 14 bp, Homo sapiens
gccaggactctctt

SEQ ID NO: 2878329 - DNA, 19 bp, Homo sapiens
gccaggatccccctctttg

SEQ ID NO: 2878330 - DNA, 20 bp, Homo sapiens
gccaggatccccctctttgc

SEQ ID NO: 2878331 - DNA, 19 bp, Homo sapiens
gccaggcatggcccagcct

SEQ ID NO: 2878332 - DNA, 15 bp, Homo sapiens
gccatgccaataaag

SEQ ID NO: 2878333 - DNA, 18 bp, Homo sapiens
gcccaagaggtctgagcc

SEQ ID NO: 2878334 - DNA, 19 bp, Homo sapiens
gcccaagaggtctgagccc

SEQ ID NO: 2878335 - DNA, 21 bp, Homo sapiens
gcccaagaggtctgagccctg

SEQ ID NO: 2878336 - DNA, 15 bp, Homo sapiens
gcccagtgacctgac

SEQ ID NO: 2878337 - DNA, 16 bp, Homo sapiens
gccccctccctggatg

SEQ ID NO: 2878338 - DNA, 14 bp, Homo sapiens
gccccgactccagc

SEQ ID NO: 2878339 - DNA, 18 bp, Homo sapiens
gccccttgtcctctcccg

SEQ ID NO: 2878340 - DNA, 22 bp, Homo sapiens
gccctgctgtgggagagcgaag

SEQ ID NO: 2878341 - DNA, 13 bp, Homo sapiens
gccggcagcctgg

SEQ ID NO: 2878342 - DNA, 23 bp, Homo sapiens
gccgtgcactccctaagaaaccc

SEQ ID NO: 2878343 - DNA, 19 bp, Homo sapiens
gcctcatgctctctataga

SEQ ID NO: 2878344 - DNA, 15 bp, Homo sapiens
gcctccctccacccc

SEQ ID NO: 2878345 - DNA, 13 bp, Homo sapiens
gcctccctctcca

SEQ ID NO: 2878346 - DNA, 13 bp, Homo sapiens
gcctctgagccag

SEQ ID NO: 2878347 - DNA, 19 bp, Homo sapiens
gcctctgagccaggagcct

SEQ ID NO: 2878348 - DNA, 21 bp, Homo sapiens
gcctgacacaggggacactga

SEQ ID NO: 2878349 - DNA, 21 bp, Homo sapiens
gcctgcggcccagaagtttcc

SEQ ID NO: 2878350 - DNA, 13 bp, Homo sapiens
gcctggcctgggt

SEQ ID NO: 2878351 - DNA, 13 bp, Homo sapiens
gcctggcctggtc

SEQ ID NO: 2878352 - DNA, 15 bp, Homo sapiens
gcctggcctggtcca

SEQ ID NO: 2878353 - DNA, 20 bp, Homo sapiens
gcctgggtggggcagggcct

SEQ ID NO: 2878354 - DNA, 14 bp, Homo sapiens
gcctggttccctct

SEQ ID NO: 2878355 - DNA, 17 bp, Homo sapiens
gcctggttccctctttc

SEQ ID NO: 2878356 - DNA, 15 bp, Homo sapiens
gcctgtgggagtaga

SEQ ID NO: 2878357 - DNA, 22 bp, Homo sapiens
gcgaaaaaatcaggtggctttt

SEQ ID NO: 2878358 - DNA, 18 bp, Homo sapiens
gcgagaggtccctgctta

SEQ ID NO: 2878359 - DNA, 18 bp, Homo sapiens
gcgcaacaacaaggaccc

SEQ ID NO: 2878360 - DNA, 16 bp, Homo sapiens
gcgcagcccgaagccc

SEQ ID NO: 2878361 - DNA, 12 bp, Homo sapiens
gcgcctccctcc

SEQ ID NO: 2878362 - DNA, 17 bp, Homo sapiens
gcgcctccctccacccc

SEQ ID NO: 2878363 - DNA, 18 bp, Homo sapiens
gcgcctccctccacccca

SEQ ID NO: 2878364 - DNA, 13 bp, Homo sapiens
gcgtgtgcacgtg

SEQ ID NO: 2878365 - DNA, 23 bp, Homo sapiens
gctaactccagtctcctgacatt

SEQ ID NO: 2878366 - DNA, 21 bp, Homo sapiens
gctaattaggtctcatccttt

SEQ ID NO: 2878367 - DNA, 13 bp, Homo sapiens
gctactcctgtgc

SEQ ID NO: 2878368 - DNA, 21 bp, Homo sapiens
gctagaattgagtgtttaaag

SEQ ID NO: 2878369 - DNA, 23 bp, Homo sapiens
gctatacctgggcatactaataa

SEQ ID NO: 2878370 - DNA, 16 bp, Homo sapiens
gctatgtttttaatgt

SEQ ID NO: 2878371 - DNA, 18 bp, Homo sapiens
gctattttatattacact

SEQ ID NO: 2878372 - DNA, 17 bp, Homo sapiens
gctccctgtagctctgc

SEQ ID NO: 2878373 - DNA, 23 bp, Homo sapiens
gctccctgtagctctgcctccct

SEQ ID NO: 2878374 - DNA, 22 bp, Homo sapiens
gctcctcaacccctcccctcca

SEQ ID NO: 2878375 - DNA, 19 bp, Homo sapiens
gctctagttttcagccttg

SEQ ID NO: 2878376 - DNA, 22 bp, Homo sapiens
gctctagttttcagccttggga

SEQ ID NO: 2878377 - DNA, 18 bp, Homo sapiens
gctctgaggcccgatctc

SEQ ID NO: 2878378 - DNA, 15 bp, Homo sapiens
gctgataattttaaa

SEQ ID NO: 2878379 - DNA, 12 bp, Homo sapiens
ggcatgtggaga

SEQ ID NO: 2878380 - DNA, 16 bp, Homo sapiens
ggccaagggctccagg

SEQ ID NO: 2878381 - DNA, 22 bp, Homo sapiens
ggccaatgcacctaaagaaaaa

SEQ ID NO: 2878382 - DNA, 22 bp, Homo sapiens
ggccaggcatggcccagcctgg

SEQ ID NO: 2878383 - DNA, 13 bp, Homo sapiens
ggcccagcctgga

SEQ ID NO: 2878384 - DNA, 15 bp, Homo sapiens
ggccggcagcctggt

SEQ ID NO: 2878385 - DNA, 21 bp, Homo sapiens
ggcctagtggggaggggcctg

SEQ ID NO: 2878386 - DNA, 14 bp, Homo sapiens
ggcctggacactta

SEQ ID NO: 2878387 - DNA, 20 bp, Homo sapiens
ggcctgggtggggcagggcc

SEQ ID NO: 2878388 - DNA, 16 bp, Homo sapiens
ggcgcagcccgaagcc

SEQ ID NO: 2878389 - DNA, 20 bp, Homo sapiens
ggcgcagcccgaagcccagt

SEQ ID NO: 2878390 - DNA, 15 bp, Homo sapiens
ggctattccctggag

SEQ ID NO: 2878391 - DNA, 23 bp, Homo sapiens
ggctcgctccctgtagctctgcc

SEQ ID NO: 2878392 - DNA, 15 bp, Homo sapiens
ggctgataattttaa

SEQ ID NO: 2878393 - DNA, 11 bp, Homo sapiens
ggcttcctggg

SEQ ID NO: 2878394 - DNA, 14 bp, Homo sapiens
ggcttgactggatg

SEQ ID NO: 2878395 - DNA, 21 bp, Homo sapiens
gggaggttttattctgacttc

SEQ ID NO: 2878396 - DNA, 23 bp, Homo sapiens
gggatatccctatgtcccagccc

SEQ ID NO: 2878397 - DNA, 17 bp, Homo sapiens
gggcatcttctggcttg

SEQ ID NO: 2878398 - DNA, 15 bp, Homo sapiens
gggccaggagctcag

SEQ ID NO: 2878399 - DNA, 15 bp, Homo sapiens
gggccggcagcctgg

SEQ ID NO: 2878400 - DNA, 12 bp, Homo sapiens
gggcttccctag

SEQ ID NO: 2878401 - DNA, 15 bp, Homo sapiens
gggcttcctgggtcc

SEQ ID NO: 2878402 - DNA, 15 bp, Homo sapiens
ggggacactgaacct

SEQ ID NO: 2878403 - DNA, 12 bp, Homo sapiens
ggggcctggcct

SEQ ID NO: 2878404 - DNA, 13 bp, Homo sapiens
ggggcctggcctg

SEQ ID NO: 2878405 - DNA, 12 bp, Homo sapiens
gggggagggagg

SEQ ID NO: 2878406 - DNA, 20 bp, Homo sapiens
ggggtacatttctctgagca

SEQ ID NO: 2878407 - DNA, 13 bp, Homo sapiens
gggtaacactgat

SEQ ID NO: 2878408 - DNA, 18 bp, Homo sapiens
gggtaagccagagcctgg

SEQ ID NO: 2878409 - DNA, 19 bp, Homo sapiens
gggtacatttctctgagca

SEQ ID NO: 2878410 - DNA, 15 bp, Homo sapiens
gggtgggaagaaaga

SEQ ID NO: 2878411 - DNA, 16 bp, Homo sapiens
gggtgggaagaaagaa

SEQ ID NO: 2878412 - DNA, 18 bp, Homo sapiens
ggtcctcatctgcaaagc

SEQ ID NO: 2878413 - DNA, 12 bp, Homo sapiens
ggtcctttcctt

SEQ ID NO: 2878414 - DNA, 12 bp, Homo sapiens
ggtctgagccct

SEQ ID NO: 2878415 - DNA, 16 bp, Homo sapiens
ggtctgagccctggtg

SEQ ID NO: 2878416 - DNA, 15 bp, Homo sapiens
ggtgagaaatttaaa

SEQ ID NO: 2878417 - DNA, 21 bp, Homo sapiens
ggtgaggtgggggtctggcct

SEQ ID NO: 2878418 - DNA, 14 bp, Homo sapiens
ggtggcttttgcgg

SEQ ID NO: 2878419 - DNA, 23 bp, Homo sapiens
ggtggcttttgcggttcaggaaa

SEQ ID NO: 2878420 - DNA, 15 bp, Homo sapiens
ggtgggaagaaagaa

SEQ ID NO: 2878421 - DNA, 18 bp, Homo sapiens
ggtgtgtttcaggacagc

SEQ ID NO: 2878422 - DNA, 20 bp, Homo sapiens
ggtgttacacagcccaagag

SEQ ID NO: 2878423 - DNA, 12 bp, Homo sapiens
ggttccctcttt

SEQ ID NO: 2878424 - DNA, 13 bp, Homo sapiens
ggttgaggacagg

SEQ ID NO: 2878425 - DNA, 13 bp, Homo sapiens
ggtttaatgtttt

SEQ ID NO: 2878426 - DNA, 19 bp, Homo sapiens
ggtttaatgttttggccaa

SEQ ID NO: 2878427 - DNA, 20 bp, Homo sapiens
gtaaaacatttattttgaca

SEQ ID NO: 2878428 - DNA, 15 bp, Homo sapiens
gtaaactataaacta

SEQ ID NO: 2878429 - DNA, 13 bp, Homo sapiens
gtaaatattttaa

SEQ ID NO: 2878430 - DNA, 12 bp, Homo sapiens
gtaagccagagc

SEQ ID NO: 2878431 - DNA, 14 bp, Homo sapiens
gtaagccagagcct

SEQ ID NO: 2878432 - DNA, 22 bp, Homo sapiens
gtaattaagtgcaatttcccct

SEQ ID NO: 2878433 - DNA, 18 bp, Homo sapiens
gtaatttagaaatcattt

SEQ ID NO: 2878434 - DNA, 15 bp, Homo sapiens
gtacaagaagcattt

SEQ ID NO: 2878435 - DNA, 21 bp, Homo sapiens
gtacaagaagcattttgtaag

SEQ ID NO: 2878436 - DNA, 15 bp, Homo sapiens
gtactcccccagccc

SEQ ID NO: 2878437 - DNA, 19 bp, Homo sapiens
gtagggttgccagtcctgc

SEQ ID NO: 2878438 - DNA, 20 bp, Homo sapiens
gtatataatactaaagtgtc

SEQ ID NO: 2878439 - DNA, 22 bp, Homo sapiens
gtattgccacaatgcctctccc

SEQ ID NO: 2878440 - DNA, 17 bp, Homo sapiens
gtcaagttccgtctcct

SEQ ID NO: 2878441 - DNA, 22 bp, Homo sapiens
gtcaagttccgtctcctctcca

SEQ ID NO: 2878442 - DNA, 22 bp, Homo sapiens
gtcaccgggatgaacctatcct

SEQ ID NO: 2878443 - DNA, 18 bp, Homo sapiens
gtcacttttccttttctt

SEQ ID NO: 2878444 - DNA, 14 bp, Homo sapiens
gtcagaggagaaga

SEQ ID NO: 2878445 - DNA, 18 bp, Homo sapiens
gtcagagtaacatgccag

SEQ ID NO: 2878446 - DNA, 15 bp, Homo sapiens
gtcagggtgggaaga

SEQ ID NO: 2878447 - DNA, 14 bp, Homo sapiens
gtcatggaaaagcc

SEQ ID NO: 2878448 - DNA, 12 bp, Homo sapiens
gtccagccaccc

SEQ ID NO: 2878449 - DNA, 20 bp, Homo sapiens
gtcccaaggaatcagcagga

SEQ ID NO: 2878450 - DNA, 21 bp, Homo sapiens
gtccccccccaacctttccct

SEQ ID NO: 2878451 - DNA, 22 bp, Homo sapiens
gtcccctctcccctcatggaga

SEQ ID NO: 2878452 - DNA, 20 bp, Homo sapiens
gtcccctgctactcctgtgc

SEQ ID NO: 2878453 - DNA, 23 bp, Homo sapiens
gtcctctcccgcgggcctggaca

SEQ ID NO: 2878454 - DNA, 11 bp, Homo sapiens
ccgaagcccag

SEQ ID NO: 2878455 - DNA, 18 bp, Homo sapiens
ccgaagcccagtttccct

SEQ ID NO: 2878456 - DNA, 23 bp, Homo sapiens
ccgggaccctgctcacaggcagg

SEQ ID NO: 2878457 - DNA, 16 bp, Homo sapiens
cctaaagaaaaacaaa

SEQ ID NO: 2878458 - DNA, 15 bp, Homo sapiens
cctactcccctgggc

SEQ ID NO: 2878459 - DNA, 18 bp, Homo sapiens
cctagtggggaggggcct

SEQ ID NO: 2878460 - DNA, 19 bp, Homo sapiens
cctattgtgcaatgtaaat

SEQ ID NO: 2878461 - DNA, 21 bp, Homo sapiens
cctcaaagcaagcattcagaa

SEQ ID NO: 2878462 - DNA, 14 bp, Homo sapiens
cctcaacccctccc

SEQ ID NO: 2878463 - DNA, 21 bp, Homo sapiens
cctcaccccctcccaccccca

SEQ ID NO: 2878464 - DNA, 13 bp, Homo sapiens
cctcatgctctct

SEQ ID NO: 2878465 - DNA, 14 bp, Homo sapiens
cctcatgctctcta

SEQ ID NO: 2878466 - DNA, 15 bp, Homo sapiens
cctccaccccaggac

SEQ ID NO: 2878467 - DNA, 14 bp, Homo sapiens
cctccatccctggc

SEQ ID NO: 2878468 - DNA, 13 bp, Homo sapiens
cctcccaccccca

SEQ ID NO: 2878469 - DNA, 14 bp, Homo sapiens
cctcccacccccag

SEQ ID NO: 2878470 - DNA, 15 bp, Homo sapiens
cctccctactcccct

SEQ ID NO: 2878471 - DNA, 18 bp, Homo sapiens
cctccctactcccctggg

SEQ ID NO: 2878472 - DNA, 12 bp, Homo sapiens
cctccctccacc

SEQ ID NO: 2878473 - DNA, 13 bp, Homo sapiens
cctccctccaccc

SEQ ID NO: 2878474 - DNA, 20 bp, Homo sapiens
cctccctccaccccaggacg

SEQ ID NO: 2878475 - DNA, 13 bp, Homo sapiens
cctccctctccat

SEQ ID NO: 2878476 - DNA, 21 bp, Homo sapiens
cctcgcatccgcctctgagcc

SEQ ID NO: 2878477 - DNA, 22 bp, Homo sapiens
cctctcatccaggtcctttcct

SEQ ID NO: 2878478 - DNA, 14 bp, Homo sapiens
cctctcccacgatg

SEQ ID NO: 2878479 - DNA, 20 bp, Homo sapiens
cctctcgctcctcaacccct

SEQ ID NO: 2878480 - DNA, 20 bp, Homo sapiens
cctctctctcacctacttcc

SEQ ID NO: 2878481 - DNA, 13 bp, Homo sapiens
cctctggatccct

SEQ ID NO: 2878482 - DNA, 19 bp, Homo sapiens
cctctgtgtcctctcccct

SEQ ID NO: 2878483 - DNA, 19 bp, Homo sapiens
cctgacacaggggacactg

SEQ ID NO: 2878484 - DNA, 15 bp, Homo sapiens
cctgaccggcacctg

SEQ ID NO: 2878485 - DNA, 18 bp, Homo sapiens
cctgaccggcacctgcga

SEQ ID NO: 2878486 - DNA, 13 bp, Homo sapiens
cctgagaagagag

SEQ ID NO: 2878487 - DNA, 17 bp, Homo sapiens
cctgaggggatatccct

SEQ ID NO: 2878488 - DNA, 14 bp, Homo sapiens
cctgcctcatgctc

SEQ ID NO: 2878489 - DNA, 20 bp, Homo sapiens
cctgccttctcttctatcct

SEQ ID NO: 2878490 - DNA, 20 bp, Homo sapiens
cctgctactcctgtgctctg

SEQ ID NO: 2878491 - DNA, 14 bp, Homo sapiens
cctgctcacaggca

SEQ ID NO: 2878492 - DNA, 16 bp, Homo sapiens
cctggatgacattaaa

SEQ ID NO: 2878493 - DNA, 16 bp, Homo sapiens
cctggcctggtccagg

SEQ ID NO: 2878494 - DNA, 20 bp, Homo sapiens
cctgggtcctgttccctacc

SEQ ID NO: 2878495 - DNA, 23 bp, Homo sapiens
cctgggtggggcagggcctggcc

SEQ ID NO: 2878496 - DNA, 14 bp, Homo sapiens
cctggtccaggctt

SEQ ID NO: 2878497 - DNA, 14 bp, Homo sapiens
cctggttccctctt

SEQ ID NO: 2878498 - DNA, 20 bp, Homo sapiens
cctggttccctctttcctgt

SEQ ID NO: 2878499 - DNA, 13 bp, Homo sapiens
cctgtagctctgc

SEQ ID NO: 2878500 - DNA, 15 bp, Homo sapiens
cctgtagctctgcct

SEQ ID NO: 2878501 - DNA, 22 bp, Homo sapiens
cctgtgccaggactctctttct

SEQ ID NO: 2878502 - DNA, 13 bp, Homo sapiens
cctgtgctctgga

SEQ ID NO: 2878503 - DNA, 16 bp, Homo sapiens
cctgttcctgccttct

SEQ ID NO: 2878504 - DNA, 18 bp, Homo sapiens
cctgtttgggaggctgga

SEQ ID NO: 2878505 - DNA, 13 bp, Homo sapiens
cctgttttccaca

SEQ ID NO: 2878506 - DNA, 14 bp, Homo sapiens
cctgttttccacac

SEQ ID NO: 2878507 - DNA, 22 bp, Homo sapiens
ccttcaacaattctaaaatgat

SEQ ID NO: 2878508 - DNA, 22 bp, Homo sapiens
ccttccagtggctcgctccctg

SEQ ID NO: 2878509 - DNA, 15 bp, Homo sapiens
ccttcccctacacct

SEQ ID NO: 2878510 - DNA, 23 bp, Homo sapiens
ccttgggaggttttattctgact

SEQ ID NO: 2878511 - DNA, 14 bp, Homo sapiens
ccttgtcctctccc

SEQ ID NO: 2878512 - DNA, 14 bp, Homo sapiens
ccttgttgatgcca

SEQ ID NO: 2878513 - DNA, 23 bp, Homo sapiens
ccttgttgatgccagctgtactg

SEQ ID NO: 2878514 - DNA, 17 bp, Homo sapiens
cctttccctcaccccct

SEQ ID NO: 2878515 - DNA, 14 bp, Homo sapiens
cctttgaagaggaa

SEQ ID NO: 2878516 - DNA, 22 bp, Homo sapiens
ccttttttaggaagcaagctta

SEQ ID NO: 2878517 - DNA, 12 bp, Homo sapiens
cgaaaacttgaa

SEQ ID NO: 2878518 - DNA, 11 bp, Homo sapiens
cgaagcccagt

SEQ ID NO: 2878519 - DNA, 11 bp, Homo sapiens
cgactccagcc

SEQ ID NO: 2878520 - DNA, 15 bp, Homo sapiens
cgactccagccagcg

SEQ ID NO: 2878521 - DNA, 16 bp, Homo sapiens
cgactccagccagcgc

SEQ ID NO: 2878522 - DNA, 21 bp, Homo sapiens
cgactccagccagcgcctccc

SEQ ID NO: 2878523 - DNA, 15 bp, Homo sapiens
cgagaggtccctgct

SEQ ID NO: 2878524 - DNA, 16 bp, Homo sapiens
cgagaggtccctgctt

SEQ ID NO: 2878525 - DNA, 21 bp, Homo sapiens
cgatcctggattcactcactc

SEQ ID NO: 2878526 - DNA, 17 bp, Homo sapiens
cgatgtcaaggactcct

SEQ ID NO: 2878527 - DNA, 16 bp, Homo sapiens
cgcaacaacaaggacc

SEQ ID NO: 2878528 - DNA, 17 bp, Homo sapiens
cgcacttcccatttgtg

SEQ ID NO: 2878529 - DNA, 13 bp, Homo sapiens
cgcctccctccac

SEQ ID NO: 2878530 - DNA, 15 bp, Homo sapiens
cgcctccctccaccc

SEQ ID NO: 2878531 - DNA, 14 bp, Homo sapiens
cgcctctgagccag

SEQ ID NO: 2878532 - DNA, 12 bp, Homo sapiens
catggagaaaca

SEQ ID NO: 2878533 - DNA, 13 bp, Homo sapiens
catggcccagcct

SEQ ID NO: 2878534 - DNA, 15 bp, Homo sapiens
catggcccagcctgg

SEQ ID NO: 2878535 - DNA, 19 bp, Homo sapiens
catggcccagcctggagcc

SEQ ID NO: 2878536 - DNA, 20 bp, Homo sapiens
catggcccagcctggagccg

SEQ ID NO: 2878537 - DNA, 12 bp, Homo sapiens
catgtggccaag

SEQ ID NO: 2878538 - DNA, 20 bp, Homo sapiens
cattaagacacacctctgga

SEQ ID NO: 2878539 - DNA, 13 bp, Homo sapiens
cattcagaagaaa

SEQ ID NO: 2878540 - DNA, 13 bp, Homo sapiens
cattcattttgaa

SEQ ID NO: 2878541 - DNA, 15 bp, Homo sapiens
cattcattttgaaat

SEQ ID NO: 2878542 - DNA, 17 bp, Homo sapiens
cattcccagagtcagag

SEQ ID NO: 2878543 - DNA, 18 bp, Homo sapiens
cattcccatcactgctgt

SEQ ID NO: 2878544 - DNA, 16 bp, Homo sapiens
catttaagggaaaaat

SEQ ID NO: 2878545 - DNA, 19 bp, Homo sapiens
catttaagggaaaaatata

SEQ ID NO: 2878546 - DNA, 13 bp, Homo sapiens
catttactgacca

SEQ ID NO: 2878547 - DNA, 14 bp, Homo sapiens
catttctctgagca

SEQ ID NO: 2878548 - DNA, 20 bp, Homo sapiens
catttgtgtctgcctgcctc

SEQ ID NO: 2878549 - DNA, 14 bp, Homo sapiens
cattttggtacttt

SEQ ID NO: 2878550 - DNA, 22 bp, Homo sapiens
catttttgagcagatcttggaa

SEQ ID NO: 2878551 - DNA, 17 bp, Homo sapiens
ccaaacacactgtaaat

SEQ ID NO: 2878552 - DNA, 18 bp, Homo sapiens
ccaaacacactgtaaata

SEQ ID NO: 2878553 - DNA, 17 bp, Homo sapiens
ccaacctttccctcacc

SEQ ID NO: 2878554 - DNA, 19 bp, Homo sapiens
ccaacctttccctcacccc

SEQ ID NO: 2878555 - DNA, 20 bp, Homo sapiens
ccaacctttccctcaccccc

SEQ ID NO: 2878556 - DNA, 22 bp, Homo sapiens
ccaagagctacgtatttaatag

SEQ ID NO: 2878557 - DNA, 17 bp, Homo sapiens
ccaagaggactgagact

SEQ ID NO: 2878558 - DNA, 20 bp, Homo sapiens
ccaagggctccagggccagg

SEQ ID NO: 2878559 - DNA, 19 bp, Homo sapiens
ccaatcacattcaggcatg

SEQ ID NO: 2878560 - DNA, 20 bp, Homo sapiens
ccaatcacattcaggcatgc

SEQ ID NO: 2878561 - DNA, 19 bp, Homo sapiens
ccacaatgcctctcccacg

SEQ ID NO: 2878562 - DNA, 20 bp, Homo sapiens
ccacaccatcaccctctggg

SEQ ID NO: 2878563 - DNA, 14 bp, Homo sapiens
ccacacctccctac

SEQ ID NO: 2878564 - DNA, 15 bp, Homo sapiens
ccacacctccctact

SEQ ID NO: 2878565 - DNA, 13 bp, Homo sapiens
ccaccccaggacg

SEQ ID NO: 2878566 - DNA, 12 bp, Homo sapiens
ccacccccagcc

SEQ ID NO: 2878567 - DNA, 12 bp, Homo sapiens
ccacccccaggc

SEQ ID NO: 2878568 - DNA, 12 bp, Homo sapiens
ccactatttcca

SEQ ID NO: 2878569 - DNA, 17 bp, Homo sapiens
ccactcccaaagctcag

SEQ ID NO: 2878570 - DNA, 18 bp, Homo sapiens
ccactgttgggtgggtgg

SEQ ID NO: 2878571 - DNA, 24 bp, Homo sapiens
ccagagtagggttgccagtcctgc

SEQ ID NO: 2878572 - DNA, 20 bp, Homo sapiens
ccagagtggagtctgagtct

SEQ ID NO: 2878573 - DNA, 18 bp, Homo sapiens
ccagatcgatcctggatt

SEQ ID NO: 2878574 - DNA, 22 bp, Homo sapiens
ccagcaggccagggactcagcg

SEQ ID NO: 2878575 - DNA, 16 bp, Homo sapiens
ccagccacccagccag

SEQ ID NO: 2878576 - DNA, 14 bp, Homo sapiens
ccagccagcgcctc

SEQ ID NO: 2878577 - DNA, 15 bp, Homo sapiens
ccagccagcgcctcc

SEQ ID NO: 2878578 - DNA, 22 bp, Homo sapiens
ccagccagcgcctccctccacc

SEQ ID NO: 2878579 - DNA, 17 bp, Homo sapiens
ccagccccgactccagc

SEQ ID NO: 2878580 - DNA, 18 bp, Homo sapiens
ccagcgcctccctccacc

SEQ ID NO: 2878581 - DNA, 20 bp, Homo sapiens
ccagcgcctccctccacccc

SEQ ID NO: 2878582 - DNA, 21 bp, Homo sapiens
ccagcgcctccctccacccca

SEQ ID NO: 2878583 - DNA, 21 bp, Homo sapiens
ccaggacgccactcatttcat

SEQ ID NO: 2878584 - DNA, 22 bp, Homo sapiens
ccaggacgccactcatttcatc

SEQ ID NO: 2878585 - DNA, 23 bp, Homo sapiens
ccaggacgccactcatttcatct

SEQ ID NO: 2878586 - DNA, 15 bp, Homo sapiens
ccaggactctctttc

SEQ ID NO: 2878587 - DNA, 15 bp, Homo sapiens
ccaggagcctcctga

SEQ ID NO: 2878588 - DNA, 22 bp, Homo sapiens
ccaggagcctcctgaccctgtg

SEQ ID NO: 2878589 - DNA, 14 bp, Homo sapiens
ccaggagctcagcc

SEQ ID NO: 2878590 - DNA, 17 bp, Homo sapiens
ccaggcaccaaaagaag

SEQ ID NO: 2878591 - DNA, 20 bp, Homo sapiens
ccaggcatctgttagcagag

SEQ ID NO: 2878592 - DNA, 23 bp, Homo sapiens
ccaggcatctgttagcagagtct

SEQ ID NO: 2878593 - DNA, 22 bp, Homo sapiens
ccagggactcagcgtcccctgc

SEQ ID NO: 2878594 - DNA, 14 bp, Homo sapiens
ccaggtcctttcct

SEQ ID NO: 2878595 - DNA, 15 bp, Homo sapiens
ccatcaccctctggg

SEQ ID NO: 2878596 - DNA, 22 bp, Homo sapiens
ccatcactgctgtccctcctga

SEQ ID NO: 2878597 - DNA, 16 bp, Homo sapiens
ccatccctggccccct

SEQ ID NO: 2878598 - DNA, 19 bp, Homo sapiens
ccatctgcttggttggctg

SEQ ID NO: 2878599 - DNA, 13 bp, Homo sapiens
ccatgccaataaa

SEQ ID NO: 2878600 - DNA, 18 bp, Homo sapiens
ccatgccaataaagtgat

SEQ ID NO: 2878601 - DNA, 14 bp, Homo sapiens
ccatgtataatttt

SEQ ID NO: 2878602 - DNA, 15 bp, Homo sapiens
cccaacctttccctc

SEQ ID NO: 2878603 - DNA, 23 bp, Homo sapiens
cccaagagctacgtatttaatag

SEQ ID NO: 2878604 - DNA, 14 bp, Homo sapiens
cccaagaggactga

SEQ ID NO: 2878605 - DNA, 16 bp, Homo sapiens
ctgcctgcctcatgct

SEQ ID NO: 2878606 - DNA, 15 bp, Homo sapiens
ctgcctgcggcccag

SEQ ID NO: 2878607 - DNA, 16 bp, Homo sapiens
ctgccttctcttctat

SEQ ID NO: 2878608 - DNA, 18 bp, Homo sapiens
ctgctcacaggcaggctt

SEQ ID NO: 2878609 - DNA, 14 bp, Homo sapiens
ctgctcacattccc

SEQ ID NO: 2878610 - DNA, 15 bp, Homo sapiens
ctgctggcacctcag

SEQ ID NO: 2878611 - DNA, 16 bp, Homo sapiens
ctgctggcacctcaga

SEQ ID NO: 2878612 - DNA, 14 bp, Homo sapiens
ctgcttacctgacg

SEQ ID NO: 2878613 - DNA, 16 bp, Homo sapiens
ctgcttctgtgcattt

SEQ ID NO: 2878614 - DNA, 12 bp, Homo sapiens
ctggcacctcag

SEQ ID NO: 2878615 - DNA, 17 bp, Homo sapiens
ctggccccctccctgga

SEQ ID NO: 2878616 - DNA, 20 bp, Homo sapiens
ctggccccctccctggatga

SEQ ID NO: 2878617 - DNA, 23 bp, Homo sapiens
ctggcctagtggggaggggcctg

SEQ ID NO: 2878618 - DNA, 16 bp, Homo sapiens
ctggcctcaaagcaag

SEQ ID NO: 2878619 - DNA, 20 bp, Homo sapiens
ctggctgtttgatagcagaa

SEQ ID NO: 2878620 - DNA, 19 bp, Homo sapiens
ctgggcatcttctggcttg

SEQ ID NO: 2878621 - DNA, 13 bp, Homo sapiens
ctgggccctgggt

SEQ ID NO: 2878622 - DNA, 16 bp, Homo sapiens
ctgggccctgggtgag

SEQ ID NO: 2878623 - DNA, 19 bp, Homo sapiens
ctgggccggcagcctggtt

SEQ ID NO: 2878624 - DNA, 18 bp, Homo sapiens
ctgggtcctgttccctac

SEQ ID NO: 2878625 - DNA, 20 bp, Homo sapiens
ctgggtggggcagggcctgg

SEQ ID NO: 2878626 - DNA, 19 bp, Homo sapiens
ctggtactcccccagccct

SEQ ID NO: 2878627 - DNA, 18 bp, Homo sapiens
ctggttccctctttcctg

SEQ ID NO: 2878628 - DNA, 21 bp, Homo sapiens
ctggttgttgcaccatctgct

SEQ ID NO: 2878629 - DNA, 14 bp, Homo sapiens
ctgtaaactataaa

SEQ ID NO: 2878630 - DNA, 18 bp, Homo sapiens
ctgtaaatatccacagac

SEQ ID NO: 2878631 - DNA, 20 bp, Homo sapiens
ctgtactgagttctcatcca

SEQ ID NO: 2878632 - DNA, 23 bp, Homo sapiens
ctgtatataatactaaagtgtct

SEQ ID NO: 2878633 - DNA, 16 bp, Homo sapiens
ctgtcatggaaaagcc

SEQ ID NO: 2878634 - DNA, 15 bp, Homo sapiens
ctgtcccctctcccc

SEQ ID NO: 2878635 - DNA, 13 bp, Homo sapiens
ctgtctctgcctg

SEQ ID NO: 2878636 - DNA, 16 bp, Homo sapiens
ctgtctcttggctttg

SEQ ID NO: 2878637 - DNA, 17 bp, Homo sapiens
ctgtgcatttgtgtctg

SEQ ID NO: 2878638 - DNA, 16 bp, Homo sapiens
ctgtgggagagcgaag

SEQ ID NO: 2878639 - DNA, 13 bp, Homo sapiens
ctgtgtcctctcc

SEQ ID NO: 2878640 - DNA, 14 bp, Homo sapiens
ctgtgtcctctccc

SEQ ID NO: 2878641 - DNA, 15 bp, Homo sapiens
ctgttagcagagtct

SEQ ID NO: 2878642 - DNA, 19 bp, Homo sapiens
ctgttagcagagtctgtct

SEQ ID NO: 2878643 - DNA, 20 bp, Homo sapiens
ctgttgggtgggtgggccct

SEQ ID NO: 2878644 - DNA, 17 bp, Homo sapiens
ctgtttagtagcagtga

SEQ ID NO: 2878645 - DNA, 12 bp, Homo sapiens
cttaaaactttg

SEQ ID NO: 2878646 - DNA, 19 bp, Homo sapiens
cttaccaggcaccaaaaga

SEQ ID NO: 2878647 - DNA, 11 bp, Homo sapiens
cttacctgacg

SEQ ID NO: 2878648 - DNA, 17 bp, Homo sapiens
cttagcccaagaggtct

SEQ ID NO: 2878649 - DNA, 23 bp, Homo sapiens
cttagcccaagaggtctgagccc

SEQ ID NO: 2878650 - DNA, 16 bp, Homo sapiens
cttattgggagtagga

SEQ ID NO: 2878651 - DNA, 22 bp, Homo sapiens
cttcaagcatggctattttata

SEQ ID NO: 2878652 - DNA, 13 bp, Homo sapiens
cttcctcctcctc

SEQ ID NO: 2878653 - DNA, 19 bp, Homo sapiens
cttcctcctcctcctcctg

SEQ ID NO: 2878654 - DNA, 10 bp, Homo sapiens
cttcctgggt

SEQ ID NO: 2878655 - DNA, 18 bp, Homo sapiens
cttcctttaggtctggtt

SEQ ID NO: 2878656 - DNA, 14 bp, Homo sapiens
cttctatcctgcaa

SEQ ID NO: 2878657 - DNA, 15 bp, Homo sapiens
cttctatgcagtatt

SEQ ID NO: 2878658 - DNA, 14 bp, Homo sapiens
cttctcgtcttcct

SEQ ID NO: 2878659 - DNA, 15 bp, Homo sapiens
cttctcgtcttcctc

SEQ ID NO: 2878660 - DNA, 18 bp, Homo sapiens
cttctgctcacattccct

SEQ ID NO: 2878661 - DNA, 22 bp, Homo sapiens
cttctgctcacattccctctca

SEQ ID NO: 2878662 - DNA, 14 bp, Homo sapiens
cttctgtggaagta

SEQ ID NO: 2878663 - DNA, 20 bp, Homo sapiens
cttgaatctgttactgaaat

SEQ ID NO: 2878664 - DNA, 16 bp, Homo sapiens
cttgccaggctccctt

SEQ ID NO: 2878665 - DNA, 22 bp, Homo sapiens
cttggttggctggcagctgaga

SEQ ID NO: 2878666 - DNA, 21 bp, Homo sapiens
cttggttttgctacataatta

SEQ ID NO: 2878667 - DNA, 15 bp, Homo sapiens
ctttaacttaaatag

SEQ ID NO: 2878668 - DNA, 21 bp, Homo sapiens
ctttatgtctgtggatttttt

SEQ ID NO: 2878669 - DNA, 18 bp, Homo sapiens
ctttccctcaccccctcc

SEQ ID NO: 2878670 - DNA, 23 bp, Homo sapiens
ctttgaactagttttactttgaa

SEQ ID NO: 2878671 - DNA, 20 bp, Homo sapiens
cttttaaagaagtaaatttg

SEQ ID NO: 2878672 - DNA, 23 bp, Homo sapiens
cttttgcggttcaggaaaattga

SEQ ID NO: 2878673 - DNA, 17 bp, Homo sapiens
gaaaacatatttgcaaa

SEQ ID NO: 2878674 - DNA, 15 bp, Homo sapiens
gaaaacctttcttca

SEQ ID NO: 2878675 - DNA, 14 bp, Homo sapiens
gaaaagagatggcc

SEQ ID NO: 2878676 - DNA, 17 bp, Homo sapiens
gaaaaggtttatgaaaa

SEQ ID NO: 2878677 - DNA, 22 bp, Homo sapiens
gaaaaggtttatgaaaaagaag

SEQ ID NO: 2878678 - DNA, 22 bp, Homo sapiens
gaaaagtttaacctaaataatt

SEQ ID NO: 2878679 - DNA, 12 bp, Homo sapiens
gaaaatgaataa

SEQ ID NO: 2878680 - DNA, 23 bp, Homo sapiens
gaaaattatttaaaccgctaaaa

SEQ ID NO: 2878681 - DNA, 13 bp, Homo sapiens
gaaacataaataa

SEQ ID NO: 2878682 - DNA, 18 bp, Homo sapiens
gaaacataaataaaatga

SEQ ID NO: 2878683 - DNA, 16 bp, Homo sapiens
gaaactttctttctca

SEQ ID NO: 2878684 - DNA, 17 bp, Homo sapiens
gaaagccgtactgtcta

SEQ ID NO: 2878685 - DNA, 17 bp, Homo sapiens
gaaaggatgcttctgct

SEQ ID NO: 2878686 - DNA, 14 bp, Homo sapiens
gaacaaactgatgc

SEQ ID NO: 2878687 - DNA, 23 bp, Homo sapiens
gaacagaacatagacagaagaaa

SEQ ID NO: 2878688 - DNA, 22 bp, Homo sapiens
gaaccttgttgatgccagctgt

SEQ ID NO: 2878689 - DNA, 16 bp, Homo sapiens
gaactgagccaaacac

SEQ ID NO: 2878690 - DNA, 14 bp, Homo sapiens
gaagaaaaagaagc

SEQ ID NO: 2878691 - DNA, 20 bp, Homo sapiens
gaagaaacaaggttttcagt

SEQ ID NO: 2878692 - DNA, 24 bp, Homo sapiens
gaagaatgcttaatcagatagata

SEQ ID NO: 2878693 - DNA, 23 bp, Homo sapiens
gaagactatcttactatttcaca

SEQ ID NO: 2878694 - DNA, 17 bp, Homo sapiens
gaagcaaatcgaatgaa

SEQ ID NO: 2878695 - DNA, 16 bp, Homo sapiens
gaagcaagcttaatgg

SEQ ID NO: 2878696 - DNA, 20 bp, Homo sapiens
gaagcacagagggctaggga

SEQ ID NO: 2878697 - DNA, 17 bp, Homo sapiens
gaagggaataaggtaca

SEQ ID NO: 2878698 - DNA, 19 bp, Homo sapiens
gaataaggtacaagaagca

SEQ ID NO: 2878699 - DNA, 23 bp, Homo sapiens
gaataaggtacaagaagcatttt

SEQ ID NO: 2878700 - DNA, 12 bp, Homo sapiens
gaatctgttact

SEQ ID NO: 2878701 - DNA, 15 bp, Homo sapiens
gaatgagctgggccc

SEQ ID NO: 2878702 - DNA, 12 bp, Homo sapiens
gaatgcaagagt

SEQ ID NO: 2878703 - DNA, 18 bp, Homo sapiens
gaattagaaacataaata

SEQ ID NO: 2878704 - DNA, 15 bp, Homo sapiens
gaattgagtgtttaa

SEQ ID NO: 2878705 - DNA, 20 bp, Homo sapiens
gacaaagaaatagcaagaga

SEQ ID NO: 2878706 - DNA, 12 bp, Homo sapiens
gacacacctctg

SEQ ID NO: 2878707 - DNA, 19 bp, Homo sapiens
gacacatactcatttttca

SEQ ID NO: 2878708 - DNA, 19 bp, Homo sapiens
gacacttatggggacagca

SEQ ID NO: 2878709 - DNA, 22 bp, Homo sapiens
gacagcataccttggactgact

SEQ ID NO: 2878710 - DNA, 18 bp, Homo sapiens
gacagctgcttctgtgca

SEQ ID NO: 2878711 - DNA, 15 bp, Homo sapiens
gacatagcctttgtg

SEQ ID NO: 2878712 - DNA, 18 bp, Homo sapiens
gacccacgtgctagggga

SEQ ID NO: 2878713 - DNA, 22 bp, Homo sapiens
gacccagagtggagtctgagtc

SEQ ID NO: 2878714 - DNA, 15 bp, Homo sapiens
gaccccagagtaggg

SEQ ID NO: 2878715 - DNA, 17 bp, Homo sapiens
gaccctgctcacaggca

SEQ ID NO: 2878716 - DNA, 18 bp, Homo sapiens
gaccctgctcacaggcag

SEQ ID NO: 2878717 - DNA, 18 bp, Homo sapiens
gaccctgttttccacacc

SEQ ID NO: 2878718 - DNA, 13 bp, Homo sapiens
gacctgaccggca

SEQ ID NO: 2878719 - DNA, 17 bp, Homo sapiens
gacggacgtcctgctgg

SEQ ID NO: 2878720 - DNA, 17 bp, Homo sapiens
gactatcttactatttc

SEQ ID NO: 2878721 - DNA, 9 bp, Homo sapiens
gactccagc

SEQ ID NO: 2878722 - DNA, 16 bp, Homo sapiens
gactccagccagcgcc

SEQ ID NO: 2878723 - DNA, 19 bp, Homo sapiens
gactccagccagcgcctcc

SEQ ID NO: 2878724 - DNA, 20 bp, Homo sapiens
gactccagccagcgcctccc

SEQ ID NO: 2878725 - DNA, 21 bp, Homo sapiens
gactccagccagcgcctccct

SEQ ID NO: 2878726 - DNA, 21 bp, Homo sapiens
gacttcaagcatggctatttt

SEQ ID NO: 2878727 - DNA, 17 bp, Homo sapiens
gacttgaagcacagagg

SEQ ID NO: 2878728 - DNA, 15 bp, Homo sapiens
gagacaaggaaccac

SEQ ID NO: 2878729 - DNA, 13 bp, Homo sapiens
gagacatgtacct

SEQ ID NO: 2878730 - DNA, 18 bp, Homo sapiens
gagacatgtaccttgacc

SEQ ID NO: 2878731 - DNA, 16 bp, Homo sapiens
gagaggtccctgctta

SEQ ID NO: 2878732 - DNA, 16 bp, Homo sapiens
gagagttcaagcctgt

SEQ ID NO: 2878733 - DNA, 17 bp, Homo sapiens
gagatgagaaacaacag

SEQ ID NO: 2878734 - DNA, 20 bp, Homo sapiens
gagcagctgggcactgggcc

SEQ ID NO: 2878735 - DNA, 18 bp, Homo sapiens
gagccaaacacactgtaa

SEQ ID NO: 2878736 - DNA, 19 bp, Homo sapiens
gagccaaacacactgtaaa

SEQ ID NO: 2878737 - DNA, 23 bp, Homo sapiens
gagccaaacacactgtaaatatc

SEQ ID NO: 2878738 - DNA, 13 bp, Homo sapiens
gagccaggagcct

SEQ ID NO: 2878739 - DNA, 14 bp, Homo sapiens
gagccaggagcctc

SEQ ID NO: 2878740 - DNA, 16 bp, Homo sapiens
gagccctgctgtggga

SEQ ID NO: 2878741 - DNA, 16 bp, Homo sapiens
gagctgggccctgggt

SEQ ID NO: 2878742 - DNA, 12 bp, Homo sapiens
gaggaagcaaga

SEQ ID NO: 2878743 - DNA, 15 bp, Homo sapiens
gaggacaggagaggg

SEQ ID NO: 2878744 - DNA, 21 bp, Homo sapiens
gaggcgcagcccgaagcccag

SEQ ID NO: 2878745 - DNA, 13 bp, Homo sapiens
gaggggcctggcc

SEQ ID NO: 2878746 - DNA, 19 bp, Homo sapiens
gaggggcctggcctgggtg

SEQ ID NO: 2878747 - DNA, 13 bp, Homo sapiens
gaggggctgaatg

SEQ ID NO: 2878748 - DNA, 19 bp, Homo sapiens
gagtagctgggactacagg

SEQ ID NO: 2878749 - DNA, 17 bp, Homo sapiens
gagtagggttgccagtc

SEQ ID NO: 2878750 - DNA, 22 bp, Homo sapiens
gagtagggttgccagtcctgca

SEQ ID NO: 2878751 - DNA, 16 bp, Homo sapiens
gagtcagaggagaaga

SEQ ID NO: 2878752 - DNA, 17 bp, Homo sapiens
gagtcctgtctctgcct

SEQ ID NO: 2878753 - DNA, 13 bp, Homo sapiens
gagtctgagtcct

SEQ ID NO: 2878754 - DNA, 18 bp, Homo sapiens
gagtctgagtcctgtctc

SEQ ID NO: 2878755 - DNA, 20 bp, Homo sapiens
gagtggccaatccctgtgtg

SEQ ID NO: 2878756 - DNA, 20 bp, Homo sapiens
gataactgaaaattatttaa

SEQ ID NO: 2878757 - DNA, 13 bp, Homo sapiens
gataatgaacaga

SEQ ID NO: 2878758 - DNA, 20 bp, Homo sapiens
gatacttaagtgctgcaatt

SEQ ID NO: 2878759 - DNA, 22 bp, Homo sapiens
gatatccctatgtcccagcccc

SEQ ID NO: 2878760 - DNA, 17 bp, Homo sapiens
gatatgtaaaacattta

SEQ ID NO: 2878761 - DNA, 18 bp, Homo sapiens
gatatgtaaaacatttat

SEQ ID NO: 2878762 - DNA, 19 bp, Homo sapiens
gatatgtaaaacatttatt

SEQ ID NO: 2878763 - DNA, 19 bp, Homo sapiens
gatccccctctttgcacag

SEQ ID NO: 2878764 - DNA, 17 bp, Homo sapiens
gatcctggattcactca

SEQ ID NO: 2878765 - DNA, 19 bp, Homo sapiens
gatctgtcccctctcccct

SEQ ID NO: 2878766 - DNA, 19 bp, Homo sapiens
gatgagaaacaacagaaac

SEQ ID NO: 2878767 - DNA, 19 bp, Homo sapiens
gatgccaaaaaaaaataca

SEQ ID NO: 2878768 - DNA, 20 bp, Homo sapiens
gatgcgaaaacttgaatctg

SEQ ID NO: 2878769 - DNA, 11 bp, Homo sapiens
gatgcttctgc

SEQ ID NO: 2878770 - DNA, 16 bp, Homo sapiens
gatggggagcagctgg

SEQ ID NO: 2878771 - DNA, 17 bp, Homo sapiens
gatggggagcagctggg

SEQ ID NO: 2878772 - DNA, 14 bp, Homo sapiens
gatttcttttaaag

SEQ ID NO: 2878773 - DNA, 16 bp, Homo sapiens
gatttcttttaaagaa

SEQ ID NO: 2878774 - DNA, 18 bp, Homo sapiens
gatttcttttaaagaagt

SEQ ID NO: 2878775 - DNA, 19 bp, Homo sapiens
gattttttaataatttaga

SEQ ID NO: 2878776 - DNA, 18 bp, Homo sapiens
gattttttccttcaaagt

SEQ ID NO: 2878777 - DNA, 22 bp, Homo sapiens
gcaaatcgaatgaaattaactg

SEQ ID NO: 2878778 - DNA, 19 bp, Homo sapiens
gcaacctcagtaatttaga

SEQ ID NO: 2878779 - DNA, 17 bp, Homo sapiens
gcaagagatgagaaaca

SEQ ID NO: 2878780 - DNA, 20 bp, Homo sapiens
gcaagtccatagctgagctg

SEQ ID NO: 2878781 - DNA, 18 bp, Homo sapiens
gcaatgggggagggaggg

SEQ ID NO: 2878782 - DNA, 15 bp, Homo sapiens
gcaatttcccctctg

SEQ ID NO: 2878783 - DNA, 19 bp, Homo sapiens
gcaatttttacaacctgag

SEQ ID NO: 2878784 - DNA, 14 bp, Homo sapiens
gcacagatgcccac

SEQ ID NO: 2878785 - DNA, 14 bp, Homo sapiens
gcaccaaaagaagt

SEQ ID NO: 2878786 - DNA, 15 bp, Homo sapiens
gcaccaaaagaagta

SEQ ID NO: 2878787 - DNA, 19 bp, Homo sapiens
gcaccaccatgccaggcta

SEQ ID NO: 2878788 - DNA, 14 bp, Homo sapiens
gcacctaaagaaaa

SEQ ID NO: 2878789 - DNA, 17 bp, Homo sapiens
gcacctaaagaaaaaca

SEQ ID NO: 2878790 - DNA, 20 bp, Homo sapiens
gcactgggccggcagcctgg

SEQ ID NO: 2878791 - DNA, 14 bp, Homo sapiens
gcagacaaccttgt

SEQ ID NO: 2878792 - DNA, 13 bp, Homo sapiens
gcagagtctgtct

SEQ ID NO: 2878793 - DNA, 21 bp, Homo sapiens
gcagcccgaagcccagtttcc

SEQ ID NO: 2878794 - DNA, 14 bp, Homo sapiens
gcagctgagagccc

SEQ ID NO: 2878795 - DNA, 13 bp, Homo sapiens
gcagctgggcact

SEQ ID NO: 2878796 - DNA, 17 bp, Homo sapiens
gcagtcagggtgggaag

SEQ ID NO: 2878797 - DNA, 16 bp, Homo sapiens
gcagtctcagaaagcc

SEQ ID NO: 2878798 - DNA, 19 bp, Homo sapiens
gcatccgcctctgagccag

SEQ ID NO: 2878799 - DNA, 16 bp, Homo sapiens
gcatctgttagcagag

SEQ ID NO: 2878800 - DNA, 18 bp, Homo sapiens
gcatctgttagcagagtc

SEQ ID NO: 2878801 - DNA, 19 bp, Homo sapiens
gcatctgttagcagagtct

SEQ ID NO: 2878802 - DNA, 18 bp, Homo sapiens
gcatgaggcaaaaatgtc

SEQ ID NO: 2878803 - DNA, 17 bp, Homo sapiens
gcatggcccagcctgga

SEQ ID NO: 2878804 - DNA, 11 bp, Homo sapiens
gcatgtggaga

SEQ ID NO: 2878805 - DNA, 18 bp, Homo sapiens
gcatttgtgtctgcctgc

SEQ ID NO: 2878806 - DNA, 17 bp, Homo sapiens
gccaaacacactgtaaa

SEQ ID NO: 2878807 - DNA, 14 bp, Homo sapiens
gccactcatttcat

SEQ ID NO: 2878808 - DNA, 15 bp, Homo sapiens
gccactcatttcatc

SEQ ID NO: 2878809 - DNA, 16 bp, Homo sapiens
gccactcatttcatct

SEQ ID NO: 2878810 - DNA, 16 bp, Homo sapiens
gccagagcctggggtg

SEQ ID NO: 2878811 - DNA, 14 bp, Homo sapiens
gccagcgcctccct

SEQ ID NO: 2878812 - DNA, 15 bp, Homo sapiens
gccagcgcctccctc

SEQ ID NO: 2878813 - DNA, 16 bp, Homo sapiens
gccagcgcctccctcc

SEQ ID NO: 2878814 - DNA, 17 bp, Homo sapiens
gccagcgcctccctcca

SEQ ID NO: 2878815 - DNA, 18 bp, Homo sapiens
gccagcgcctccctccac

SEQ ID NO: 2878816 - DNA, 20 bp, Homo sapiens
gccagcgcctccctccaccc

SEQ ID NO: 2878817 - DNA, 16 bp, Homo sapiens
gccagctctagttttc

SEQ ID NO: 2878818 - DNA, 23 bp, Homo sapiens
gccagcttcctgtgggccaggag

SEQ ID NO: 2878819 - DNA, 21 bp, Homo sapiens
gccaggagcctcctgaccctg

SEQ ID NO: 2878820 - DNA, 16 bp, Homo sapiens
gccaggatccccctct

SEQ ID NO: 2878821 - DNA, 15 bp, Homo sapiens
taaaaatgatctaaa

SEQ ID NO: 2878822 - DNA, 15 bp, Homo sapiens
taaaacaatttattt

SEQ ID NO: 2878823 - DNA, 15 bp, Homo sapiens
taaaactttgaagtt

SEQ ID NO: 2878824 - DNA, 16 bp, Homo sapiens
taaaagcaaaaaagaa

SEQ ID NO: 2878825 - DNA, 17 bp, Homo sapiens
taaaagcaaaaaagaaa

SEQ ID NO: 2878826 - DNA, 13 bp, Homo sapiens
taaaatagcaaaa

SEQ ID NO: 2878827 - DNA, 22 bp, Homo sapiens
taaaatagcaaaagaagaagtt

SEQ ID NO: 2878828 - DNA, 15 bp, Homo sapiens
taaactataaactac

SEQ ID NO: 2878829 - DNA, 18 bp, Homo sapiens
taaactataaactactgt

SEQ ID NO: 2878830 - DNA, 19 bp, Homo sapiens
taaactataaactactgta

SEQ ID NO: 2878831 - DNA, 17 bp, Homo sapiens
taaagaagtaaatttgt

SEQ ID NO: 2878832 - DNA, 21 bp, Homo sapiens
taaagaagtaaatttgtccaa

SEQ ID NO: 2878833 - DNA, 12 bp, Homo sapiens
taaagatttttt

SEQ ID NO: 2878834 - DNA, 15 bp, Homo sapiens
taaagcgtttgcaca

SEQ ID NO: 2878835 - DNA, 23 bp, Homo sapiens
taaagtgtctattagttttcttt

SEQ ID NO: 2878836 - DNA, 15 bp, Homo sapiens
taaagttcaacatgt

SEQ ID NO: 2878837 - DNA, 16 bp, Homo sapiens
taaagttgataaagat

SEQ ID NO: 2878838 - DNA, 15 bp, Homo sapiens
taaataaaatgacca

SEQ ID NO: 2878839 - DNA, 15 bp, Homo sapiens
taaataagaaacttt

SEQ ID NO: 2878840 - DNA, 16 bp, Homo sapiens
taaataagaaactttt

SEQ ID NO: 2878841 - DNA, 18 bp, Homo sapiens
taaatattttaaagaatt

SEQ ID NO: 2878842 - DNA, 16 bp, Homo sapiens
taaatcacgctttttg

SEQ ID NO: 2878843 - DNA, 18 bp, Homo sapiens
taaatcacgctttttgaa

SEQ ID NO: 2878844 - DNA, 22 bp, Homo sapiens
taaattctctctcttgcaggaa

SEQ ID NO: 2878845 - DNA, 13 bp, Homo sapiens
taacatgccagct

SEQ ID NO: 2878846 - DNA, 21 bp, Homo sapiens
taactccagtctcctgacatt

SEQ ID NO: 2878847 - DNA, 19 bp, Homo sapiens
taactgggtaatgaaacaa

SEQ ID NO: 2878848 - DNA, 19 bp, Homo sapiens
taagaaacttttttattta

SEQ ID NO: 2878849 - DNA, 17 bp, Homo sapiens
taagacacacctctgga

SEQ ID NO: 2878850 - DNA, 14 bp, Homo sapiens
taagagaagtagaa

SEQ ID NO: 2878851 - DNA, 17 bp, Homo sapiens
taagatctatagcctct

SEQ ID NO: 2878852 - DNA, 16 bp, Homo sapiens
taagccaaaacaatgt

SEQ ID NO: 2878853 - DNA, 16 bp, Homo sapiens
taagccagagcctggg

SEQ ID NO: 2878854 - DNA, 17 bp, Homo sapiens
taagggaaaaatatata

SEQ ID NO: 2878855 - DNA, 19 bp, Homo sapiens
taagtgggaagtgaagccc

SEQ ID NO: 2878856 - DNA, 23 bp, Homo sapiens
taagtgttcagtgttgacatagc

SEQ ID NO: 2878857 - DNA, 22 bp, Homo sapiens
taataatttagacttcaagcat

SEQ ID NO: 2878858 - DNA, 21 bp, Homo sapiens
taatagatgtttgatagattt

SEQ ID NO: 2878859 - DNA, 12 bp, Homo sapiens
taatatcctaaa

SEQ ID NO: 2878860 - DNA, 14 bp, Homo sapiens
taattatccaggaa

SEQ ID NO: 2878861 - DNA, 16 bp, Homo sapiens
taatttagaaaacttt

SEQ ID NO: 2878862 - DNA, 13 bp, Homo sapiens
taattttaaattc

SEQ ID NO: 2878863 - DNA, 21 bp, Homo sapiens
taatttttgatactaagcatt

SEQ ID NO: 2878864 - DNA, 17 bp, Homo sapiens
tacaaagcccttttata

SEQ ID NO: 2878865 - DNA, 14 bp, Homo sapiens
tacaagaagcattt

SEQ ID NO: 2878866 - DNA, 19 bp, Homo sapiens
tacaagaagcattttgtaa

SEQ ID NO: 2878867 - DNA, 16 bp, Homo sapiens
tacacagcccaagagg

SEQ ID NO: 2878868 - DNA, 17 bp, Homo sapiens
tacatgctaagagaagt

SEQ ID NO: 2878869 - DNA, 19 bp, Homo sapiens
tacatgctaagagaagtag

SEQ ID NO: 2878870 - DNA, 20 bp, Homo sapiens
taccttgaccatcgtccttc

SEQ ID NO: 2878871 - DNA, 16 bp, Homo sapiens
tacgtatttaatagca

SEQ ID NO: 2878872 - DNA, 20 bp, Homo sapiens
tactaagcattgaatggcta

SEQ ID NO: 2878873 - DNA, 12 bp, Homo sapiens
tactatttcaca

SEQ ID NO: 2878874 - DNA, 16 bp, Homo sapiens
tactcatttttcatga

SEQ ID NO: 2878875 - DNA, 19 bp, Homo sapiens
tactcccccagccctcagt

SEQ ID NO: 2878876 - DNA, 21 bp, Homo sapiens
tactcccctgggcatcttctg

SEQ ID NO: 2878877 - DNA, 17 bp, Homo sapiens
tactcctgtgctctgga

SEQ ID NO: 2878878 - DNA, 22 bp, Homo sapiens
tactgaagatgcagcaaaatgt

SEQ ID NO: 2878879 - DNA, 14 bp, Homo sapiens
tacttcctcctcct

SEQ ID NO: 2878880 - DNA, 18 bp, Homo sapiens
tagaaaaatctcattccc

SEQ ID NO: 2878881 - DNA, 11 bp, Homo sapiens
tagaaaacttt

SEQ ID NO: 2878882 - DNA, 18 bp, Homo sapiens
tagaaacataaataaaat

SEQ ID NO: 2878883 - DNA, 11 bp, Homo sapiens
tagaaatcata

SEQ ID NO: 2878884 - DNA, 13 bp, Homo sapiens
tagaaatcatttt

SEQ ID NO: 2878885 - DNA, 16 bp, Homo sapiens
tagaaatcattttgca

SEQ ID NO: 2878886 - DNA, 15 bp, Homo sapiens
tagaatataaacaca

SEQ ID NO: 2878887 - DNA, 17 bp, Homo sapiens
tagaattgagtgtttaa

SEQ ID NO: 2878888 - DNA, 16 bp, Homo sapiens
tagaggtgagaaattt

SEQ ID NO: 2878889 - DNA, 16 bp, Homo sapiens
tagcagagtctgtctc

SEQ ID NO: 2878890 - DNA, 14 bp, Homo sapiens
tagcagatggagta

SEQ ID NO: 2878891 - DNA, 17 bp, Homo sapiens
tagccagagggtgggag

SEQ ID NO: 2878892 - DNA, 14 bp, Homo sapiens
tagctgggactaca

SEQ ID NO: 2878893 - DNA, 19 bp, Homo sapiens
taggaatattttcttctgc

SEQ ID NO: 2878894 - DNA, 23 bp, Homo sapiens
taggattccatgtgaaaataaaa

SEQ ID NO: 2878895 - DNA, 16 bp, Homo sapiens
taggatttatttaaaa

SEQ ID NO: 2878896 - DNA, 15 bp, Homo sapiens
taggctggaatgttc

SEQ ID NO: 2878897 - DNA, 12 bp, Homo sapiens
taggtctggttg

SEQ ID NO: 2878898 - DNA, 18 bp, Homo sapiens
taggttgaggacaggaga

SEQ ID NO: 2878899 - DNA, 18 bp, Homo sapiens
tagtaaatcacgcttttt

SEQ ID NO: 2878900 - DNA, 13 bp, Homo sapiens
tagttaattctgt

SEQ ID NO: 2878901 - DNA, 20 bp, Homo sapiens
tagtttcatataaagtatca

SEQ ID NO: 2878902 - DNA, 13 bp, Homo sapiens
tagttttctttgt

SEQ ID NO: 2878903 - DNA, 18 bp, Homo sapiens
tataaactactgtaatta

SEQ ID NO: 2878904 - DNA, 22 bp, Homo sapiens
tataagcaagaaggcaaaaata

SEQ ID NO: 2878905 - DNA, 20 bp, Homo sapiens
tataagtgttcagtgttgac

SEQ ID NO: 2878906 - DNA, 21 bp, Homo sapiens
tataagtgttcagtgttgaca

SEQ ID NO: 2878907 - DNA, 13 bp, Homo sapiens
tataatactaaag

SEQ ID NO: 2878908 - DNA, 22 bp, Homo sapiens
tataattgttttatctgaattt

SEQ ID NO: 2878909 - DNA, 22 bp, Homo sapiens
tatacctgggcatactaataaa

SEQ ID NO: 2878910 - DNA, 18 bp, Homo sapiens
tatagccaaaaatagcta

SEQ ID NO: 2878911 - DNA, 19 bp, Homo sapiens
tataggatttatttaaaat

SEQ ID NO: 2878912 - DNA, 16 bp, Homo sapiens
tatataatactaaagt

SEQ ID NO: 2878913 - DNA, 20 bp, Homo sapiens
tatatatctatctatttgag

SEQ ID NO: 2878914 - DNA, 15 bp, Homo sapiens
tatatatttttctga

SEQ ID NO: 2878915 - DNA, 19 bp, Homo sapiens
tatatctatctatttgagg

SEQ ID NO: 2878916 - DNA, 22 bp, Homo sapiens
tatattacactacacactgtgt

SEQ ID NO: 2878917 - DNA, 14 bp, Homo sapiens
tatcaggcaagata

SEQ ID NO: 2878918 - DNA, 16 bp, Homo sapiens
tatctccttcccctac

SEQ ID NO: 2878919 - DNA, 20 bp, Homo sapiens
tatctgaatttttaaacaag

SEQ ID NO: 2878920 - DNA, 14 bp, Homo sapiens
tatgatgttaaaaa

SEQ ID NO: 2878921 - DNA, 14 bp, Homo sapiens
tatggattctaaaa

SEQ ID NO: 2878922 - DNA, 13 bp, Homo sapiens
tatgtttttaatg

SEQ ID NO: 2878923 - DNA, 15 bp, Homo sapiens
tattcattcattttg

SEQ ID NO: 2878924 - DNA, 13 bp, Homo sapiens
tattccctggaga

SEQ ID NO: 2878925 - DNA, 18 bp, Homo sapiens
tattctgcaacagcctgt

SEQ ID NO: 2878926 - DNA, 22 bp, Homo sapiens
tattgccacaatgcctctccca

SEQ ID NO: 2878927 - DNA, 23 bp, Homo sapiens
tatttaaaatagcaaaagaagaa

SEQ ID NO: 2878928 - DNA, 18 bp, Homo sapiens
tatttaatagcaaagaat

SEQ ID NO: 2878929 - DNA, 20 bp, Homo sapiens
tatttaatagcaaagaattg

SEQ ID NO: 2878930 - DNA, 16 bp, Homo sapiens
tattttaaagaattgt

SEQ ID NO: 2878931 - DNA, 13 bp, Homo sapiens
tattttcttggat

SEQ ID NO: 2878932 - DNA, 18 bp, Homo sapiens
tattttgacataaagttg

SEQ ID NO: 2878933 - DNA, 22 bp, Homo sapiens
tcaaaagtgatctgtcccctct

SEQ ID NO: 2878934 - DNA, 21 bp, Homo sapiens
tcaaacaccaacataaaaatg

SEQ ID NO: 2878935 - DNA, 19 bp, Homo sapiens
tcaaagctgtgtgtttgga

SEQ ID NO: 2878936 - DNA, 23 bp, Homo sapiens
tcaacccctcccctccatccctg

SEQ ID NO: 2878937 - DNA, 14 bp, Homo sapiens
tcaagcctgtggga

SEQ ID NO: 2878938 - DNA, 20 bp, Homo sapiens
tcaagcctgtgggagtagaa

SEQ ID NO: 2878939 - DNA, 22 bp, Homo sapiens
tcaatcagtctcagaatgtcat

SEQ ID NO: 2878940 - DNA, 17 bp, Homo sapiens
tcaattcaaagctgtgt

SEQ ID NO: 2878941 - DNA, 15 bp, Homo sapiens
tcacattcaggcatg

SEQ ID NO: 2878942 - DNA, 19 bp, Homo sapiens
tcacattccctctcatcca

SEQ ID NO: 2878943 - DNA, 22 bp, Homo sapiens
tcaccccctcccacccccagcc

SEQ ID NO: 2878944 - DNA, 21 bp, Homo sapiens
gccaggatccccctctttgca

SEQ ID NO: 2878945 - DNA, 23 bp, Homo sapiens
gccaggcatggcccagcctggag

SEQ ID NO: 2878946 - DNA, 20 bp, Homo sapiens
gccaggctccctttctcttc

SEQ ID NO: 2878947 - DNA, 22 bp, Homo sapiens
gcccaagaggactgagactggc

SEQ ID NO: 2878948 - DNA, 14 bp, Homo sapiens
gcccaagaggtctg

SEQ ID NO: 2878949 - DNA, 12 bp, Homo sapiens
gcccagcctgga

SEQ ID NO: 2878950 - DNA, 14 bp, Homo sapiens
gcccagcctggagc

SEQ ID NO: 2878951 - DNA, 21 bp, Homo sapiens
gcccaggcagacaaccttgtc

SEQ ID NO: 2878952 - DNA, 12 bp, Homo sapiens
gccccgactcca

SEQ ID NO: 2878953 - DNA, 17 bp, Homo sapiens
gccccgactccagccag

SEQ ID NO: 2878954 - DNA, 18 bp, Homo sapiens
gccccgactccagccagc

SEQ ID NO: 2878955 - DNA, 20 bp, Homo sapiens
gccccgactccagccagcgc

SEQ ID NO: 2878956 - DNA, 17 bp, Homo sapiens
gccccttgtcctctccc

SEQ ID NO: 2878957 - DNA, 14 bp, Homo sapiens
gcccgaagcccagt

SEQ ID NO: 2878958 - DNA, 18 bp, Homo sapiens
gcccgaagcccagtttcc

SEQ ID NO: 2878959 - DNA, 23 bp, Homo sapiens
gccctgccgggaccctgctcaca

SEQ ID NO: 2878960 - DNA, 16 bp, Homo sapiens
gccctggtgtgtttcc

SEQ ID NO: 2878961 - DNA, 21 bp, Homo sapiens
gcccttggggtaagccagagc

SEQ ID NO: 2878962 - DNA, 16 bp, Homo sapiens
gccgtaaccaggggct

SEQ ID NO: 2878963 - DNA, 16 bp, Homo sapiens
gcctaatggagaagac

SEQ ID NO: 2878964 - DNA, 19 bp, Homo sapiens
gcctagtggggaggggcct

SEQ ID NO: 2878965 - DNA, 23 bp, Homo sapiens
gcctagtggggaggggcctggcc

SEQ ID NO: 2878966 - DNA, 22 bp, Homo sapiens
gcctattagtagttaattctgt

SEQ ID NO: 2878967 - DNA, 19 bp, Homo sapiens
gcctccctccaccccagga

SEQ ID NO: 2878968 - DNA, 21 bp, Homo sapiens
gcctccctccaccccaggacg

SEQ ID NO: 2878969 - DNA, 22 bp, Homo sapiens
gcctctcgctcctcaacccctc

SEQ ID NO: 2878970 - DNA, 17 bp, Homo sapiens
gcctctgagccaggagc

SEQ ID NO: 2878971 - DNA, 20 bp, Homo sapiens
gcctgacacaggggacactg

SEQ ID NO: 2878972 - DNA, 22 bp, Homo sapiens
gcctgagaagagagatcaaatg

SEQ ID NO: 2878973 - DNA, 18 bp, Homo sapiens
gcctgcctcatgctctct

SEQ ID NO: 2878974 - DNA, 12 bp, Homo sapiens
gcctggcctggt

SEQ ID NO: 2878975 - DNA, 22 bp, Homo sapiens
gcctgggtggggcagggcctgg

SEQ ID NO: 2878976 - DNA, 23 bp, Homo sapiens
gcctgggtggggcagggcctggc

SEQ ID NO: 2878977 - DNA, 20 bp, Homo sapiens
gcctggttccctctttcctg

SEQ ID NO: 2878978 - DNA, 21 bp, Homo sapiens
gccttctcttctatcctgcaa

SEQ ID NO: 2878979 - DNA, 11 bp, Homo sapiens
gccttttcaaa

SEQ ID NO: 2878980 - DNA, 14 bp, Homo sapiens
gcgaatgagctggg

SEQ ID NO: 2878981 - DNA, 18 bp, Homo sapiens
gcgcagcccgaagcccag

SEQ ID NO: 2878982 - DNA, 19 bp, Homo sapiens
gcgcctccctccaccccag

SEQ ID NO: 2878983 - DNA, 22 bp, Homo sapiens
gcgcctccctccaccccaggac

SEQ ID NO: 2878984 - DNA, 23 bp, Homo sapiens
gcgctgcagcagggcaggaaggg

SEQ ID NO: 2878985 - DNA, 12 bp, Homo sapiens
gcggttcaggaa

SEQ ID NO: 2878986 - DNA, 20 bp, Homo sapiens
gcgtcccctgctactcctgt

SEQ ID NO: 2878987 - DNA, 12 bp, Homo sapiens
gctaaaagaaac

SEQ ID NO: 2878988 - DNA, 15 bp, Homo sapiens
gctaaaagaaacttt

SEQ ID NO: 2878989 - DNA, 13 bp, Homo sapiens
gctaagagaagta

SEQ ID NO: 2878990 - DNA, 19 bp, Homo sapiens
gctaatttttttgtatttt

SEQ ID NO: 2878991 - DNA, 13 bp, Homo sapiens
gctacataattta

SEQ ID NO: 2878992 - DNA, 14 bp, Homo sapiens
gctacgtatttaat

SEQ ID NO: 2878993 - DNA, 12 bp, Homo sapiens
gctagccagagg

SEQ ID NO: 2878994 - DNA, 13 bp, Homo sapiens
gctagccagaggg

SEQ ID NO: 2878995 - DNA, 13 bp, Homo sapiens
gctatggttttct

SEQ ID NO: 2878996 - DNA, 12 bp, Homo sapiens
gctccattccca

SEQ ID NO: 2878997 - DNA, 16 bp, Homo sapiens
gctccctgtagctctg

SEQ ID NO: 2878998 - DNA, 19 bp, Homo sapiens
gctccctgtagctctgcct

SEQ ID NO: 2878999 - DNA, 21 bp, Homo sapiens
gctcctacccctgtcctgggg

SEQ ID NO: 2879000 - DNA, 16 bp, Homo sapiens
gctcgctccctgtagc

SEQ ID NO: 2879001 - DNA, 21 bp, Homo sapiens
gctcgctccctgtagctctgc

SEQ ID NO: 2879002 - DNA, 22 bp, Homo sapiens
gctcgctccctgtagctctgcc

SEQ ID NO: 2879003 - DNA, 23 bp, Homo sapiens
gctctgcctccctctccatatct

SEQ ID NO: 2879004 - DNA, 23 bp, Homo sapiens
gctctgtattctgcaacagcctg

SEQ ID NO: 2879005 - DNA, 14 bp, Homo sapiens
gctgataattttaa

SEQ ID NO: 2879006 - DNA, 17 bp, Homo sapiens
gctgcagagctgaccca

SEQ ID NO: 2879007 - DNA, 17 bp, Homo sapiens
gctgcagcagggcagga

SEQ ID NO: 2879008 - DNA, 18 bp, Homo sapiens
gctgctgaggacaatgtc

SEQ ID NO: 2879009 - DNA, 12 bp, Homo sapiens
gctgcttctgtg

SEQ ID NO: 2879010 - DNA, 14 bp, Homo sapiens
gctggcacctcaga

SEQ ID NO: 2879011 - DNA, 15 bp, Homo sapiens
gctggcagctgagag

SEQ ID NO: 2879012 - DNA, 14 bp, Homo sapiens
gctgggactacagg

SEQ ID NO: 2879013 - DNA, 22 bp, Homo sapiens
gctgggtgtgtttcaggacagc

SEQ ID NO: 2879014 - DNA, 16 bp, Homo sapiens
gctgtccctcctgagg

SEQ ID NO: 2879015 - DNA, 20 bp, Homo sapiens
gctgtccctcctgaggtctg

SEQ ID NO: 2879016 - DNA, 18 bp, Homo sapiens
gcttaaaactttgaagtt

SEQ ID NO: 2879017 - DNA, 17 bp, Homo sapiens
gcttaatcagatagata

SEQ ID NO: 2879018 - DNA, 20 bp, Homo sapiens
gcttaatggctgataatttt

SEQ ID NO: 2879019 - DNA, 12 bp, Homo sapiens
gcttacctgacg

SEQ ID NO: 2879020 - DNA, 15 bp, Homo sapiens
gcttccctagatggt

SEQ ID NO: 2879021 - DNA, 18 bp, Homo sapiens
gctttaacttaaatagta

SEQ ID NO: 2879022 - DNA, 21 bp, Homo sapiens
ggaaaagcccagtgacctgac

SEQ ID NO: 2879023 - DNA, 23 bp, Homo sapiens
ggaaccaccgaagaggaagcaag

SEQ ID NO: 2879024 - DNA, 15 bp, Homo sapiens
ggaaggagacttagg

SEQ ID NO: 2879025 - DNA, 15 bp, Homo sapiens
ggaagtgaagcccct

SEQ ID NO: 2879026 - DNA, 15 bp, Homo sapiens
ggaatataattgttt

SEQ ID NO: 2879027 - DNA, 22 bp, Homo sapiens
ggacatgtgctattgaactgag

SEQ ID NO: 2879028 - DNA, 23 bp, Homo sapiens
ggacatgtgctattgaactgagc

SEQ ID NO: 2879029 - DNA, 17 bp, Homo sapiens
ggaccctgttttccaca

SEQ ID NO: 2879030 - DNA, 20 bp, Homo sapiens
ggacgtcctgctggcacctc

SEQ ID NO: 2879031 - DNA, 23 bp, Homo sapiens
ggactgagactggcacttagccc

SEQ ID NO: 2879032 - DNA, 15 bp, Homo sapiens
ggagacaaggaacca

SEQ ID NO: 2879033 - DNA, 22 bp, Homo sapiens
ggagagttcaagcctgtgggag

SEQ ID NO: 2879034 - DNA, 14 bp, Homo sapiens
ggaggcgcagcccg

SEQ ID NO: 2879035 - DNA, 13 bp, Homo sapiens
ggaggctgcagag

SEQ ID NO: 2879036 - DNA, 21 bp, Homo sapiens
ggaggctgcagagctgaccca

SEQ ID NO: 2879037 - DNA, 19 bp, Homo sapiens
ggaggtggaggttgcagtg

SEQ ID NO: 2879038 - DNA, 20 bp, Homo sapiens
ggaggtggaggttgcagtga

SEQ ID NO: 2879039 - DNA, 14 bp, Homo sapiens
ggagtggaaacaaa

SEQ ID NO: 2879040 - DNA, 12 bp, Homo sapiens
ggagttgctcct

SEQ ID NO: 2879041 - DNA, 24 bp, Homo sapiens
ggagttgctcctacccctgtcctg

SEQ ID NO: 2879042 - DNA, 14 bp, Homo sapiens
ggatccctggaggg

SEQ ID NO: 2879043 - DNA, 18 bp, Homo sapiens
ggatggggagcagctggg

SEQ ID NO: 2879044 - DNA, 19 bp, Homo sapiens
ggatggggcatgtggccaa

SEQ ID NO: 2879045 - DNA, 17 bp, Homo sapiens
ggatgtgtgggccagga

SEQ ID NO: 2879046 - DNA, 15 bp, Homo sapiens
ggcactgggccggca

SEQ ID NO: 2879047 - DNA, 22 bp, Homo sapiens
ggcactgggccggcagcctggt

SEQ ID NO: 2879048 - DNA, 22 bp, Homo sapiens
ggcagctgagagccctgctgtg

SEQ ID NO: 2879049 - DNA, 16 bp, Homo sapiens
ggcagggcctggcctg

SEQ ID NO: 2879050 - DNA, 16 bp, Homo sapiens
ggcatcaaagatgaga

SEQ ID NO: 2879051 - DNA, 21 bp, Homo sapiens
ggcatctgttagcagagtctg

SEQ ID NO: 2879052 - DNA, 22 bp, Homo sapiens
ggcatctgttagcagagtctgt

SEQ ID NO: 2879053 - DNA, 17 bp, Homo sapiens
ggcatgcgaatgagctg

SEQ ID NO: 2879054 - DNA, 18 bp, Homo sapiens
ggcatggcccagcctgga

SEQ ID NO: 2879055 - DNA, 20 bp, Homo sapiens
ggccacctccaaggactcta

SEQ ID NO: 2879056 - DNA, 16 bp, Homo sapiens
ggccaggcatggccca

SEQ ID NO: 2879057 - DNA, 23 bp, Homo sapiens
ggccaggcatggcccagcctgga

SEQ ID NO: 2879058 - DNA, 12 bp, Homo sapiens
ggcccagcctgg

SEQ ID NO: 2879059 - DNA, 23 bp, Homo sapiens
ggcccaggcagacaaccttgtcc

SEQ ID NO: 2879060 - DNA, 23 bp, Homo sapiens
ggcctcaaagcaagcattcagaa

SEQ ID NO: 2879061 - DNA, 13 bp, Homo sapiens
ggcctggcctggg

SEQ ID NO: 2879062 - DNA, 14 bp, Homo sapiens
ggcctggcctgggt

SEQ ID NO: 2879063 - DNA, 15 bp, Homo sapiens
ggcctggcctgggtg

SEQ ID NO: 2879064 - DNA, 22 bp, Homo sapiens
ggcctgggtggggcagggcctg

SEQ ID NO: 2879065 - DNA, 16 bp, Homo sapiens
ggctattccctggaga

SEQ ID NO: 2879066 - DNA, 17 bp, Homo sapiens
ggctggcagctgagagc

SEQ ID NO: 2879067 - DNA, 14 bp, Homo sapiens
gggaagtgaagccc

SEQ ID NO: 2879068 - DNA, 18 bp, Homo sapiens
gggactcagcgtcccctg

SEQ ID NO: 2879069 - DNA, 13 bp, Homo sapiens
gggagcagctggg

SEQ ID NO: 2879070 - DNA, 15 bp, Homo sapiens
gggagcagctgggca

SEQ ID NO: 2879071 - DNA, 14 bp, Homo sapiens
gggaggggaaccag

SEQ ID NO: 2879072 - DNA, 16 bp, Homo sapiens
gggaggggcctggcct

SEQ ID NO: 2879073 - DNA, 19 bp, Homo sapiens
gggaggggcctggcctggg

SEQ ID NO: 2879074 - DNA, 23 bp, Homo sapiens
gggaggttttattctgacttcct

SEQ ID NO: 2879075 - DNA, 10 bp, Homo sapiens
gggagtagga

SEQ ID NO: 2879076 - DNA, 22 bp, Homo sapiens
gggcactgggccggcagcctgg

SEQ ID NO: 2879077 - DNA, 15 bp, Homo sapiens
gggcaggaaggggaa

SEQ ID NO: 2879078 - DNA, 16 bp, Homo sapiens
gggccaggagctcagc

SEQ ID NO: 2879079 - DNA, 16 bp, Homo sapiens
gggccggcagcctggt

SEQ ID NO: 2879080 - DNA, 14 bp, Homo sapiens
gggctattccctgg

SEQ ID NO: 2879081 - DNA, 16 bp, Homo sapiens
ggggcagggcctggcc

SEQ ID NO: 2879082 - DNA, 18 bp, Homo sapiens
ggggtaagccagagcctg

SEQ ID NO: 2879083 - DNA, 19 bp, Homo sapiens
ggggtaagccagagcctgg

SEQ ID NO: 2879084 - DNA, 14 bp, Homo sapiens
gggtaagccagagc

SEQ ID NO: 2879085 - DNA, 17 bp, Homo sapiens
gggtaagccagagcctg

SEQ ID NO: 2879086 - DNA, 20 bp, Homo sapiens
gggtttcaccatgttggcca

SEQ ID NO: 2879087 - DNA, 20 bp, Homo sapiens
ggtaagccagagcctggggt

SEQ ID NO: 2879088 - DNA, 18 bp, Homo sapiens
ggtacatttctctgagca

SEQ ID NO: 2879089 - DNA, 19 bp, Homo sapiens
ggtactcccccagccctca

SEQ ID NO: 2879090 - DNA, 14 bp, Homo sapiens
ggtcaaaggaagac

SEQ ID NO: 2879091 - DNA, 20 bp, Homo sapiens
ggtcctcatctgcaaagcat

SEQ ID NO: 2879092 - DNA, 22 bp, Homo sapiens
ggtcctgggatggggcatgtgg

SEQ ID NO: 2879093 - DNA, 22 bp, Homo sapiens
ggtccttcctttaggtctggtt

SEQ ID NO: 2879094 - DNA, 13 bp, Homo sapiens
ggtctgagccctg

SEQ ID NO: 2879095 - DNA, 24 bp, Homo sapiens
ggtctggttgttgcaccatctgct

SEQ ID NO: 2879096 - DNA, 13 bp, Homo sapiens
ggtgagaaattta

SEQ ID NO: 2879097 - DNA, 23 bp, Homo sapiens
ggtgaggtgggggtctggcctag

SEQ ID NO: 2879098 - DNA, 21 bp, Homo sapiens
ggtgtgtttcaggacagctgc

SEQ ID NO: 2879099 - DNA, 14 bp, Homo sapiens
ggtgttaatttttg

SEQ ID NO: 2879100 - DNA, 16 bp, Homo sapiens
ggttccctctttcctg

SEQ ID NO: 2879101 - DNA, 16 bp, Homo sapiens
ggttgaggacaggaga

SEQ ID NO: 2879102 - DNA, 19 bp, Homo sapiens
ggtttcaccatgttggcca

SEQ ID NO: 2879103 - DNA, 22 bp, Homo sapiens
ggttttattctgacttcctctg

SEQ ID NO: 2879104 - DNA, 18 bp, Homo sapiens
gtaaaacatttattttga

SEQ ID NO: 2879105 - DNA, 12 bp, Homo sapiens
gtaaaagcaaaa

SEQ ID NO: 2879106 - DNA, 23 bp, Homo sapiens
gtaaactataaactactgtaatt

SEQ ID NO: 2879107 - DNA, 23 bp, Homo sapiens
gtaaatattttaaagaattgtgt

SEQ ID NO: 2879108 - DNA, 15 bp, Homo sapiens
gtaagccagagcctg

SEQ ID NO: 2879109 - DNA, 15 bp, Homo sapiens
gtaccagggctctgt

SEQ ID NO: 2879110 - DNA, 17 bp, Homo sapiens
gtactgagttctcatcc

SEQ ID NO: 2879111 - DNA, 13 bp, Homo sapiens
gtagctctgcctc

SEQ ID NO: 2879112 - DNA, 17 bp, Homo sapiens
gtagctgggactacagg

SEQ ID NO: 2879113 - DNA, 22 bp, Homo sapiens
gtatttgttaatttagaaaact

SEQ ID NO: 2879114 - DNA, 22 bp, Homo sapiens
gtcacgaggtccagacccactc

SEQ ID NO: 2879115 - DNA, 22 bp, Homo sapiens
gtcacttttccttttcttaaaa

SEQ ID NO: 2879116 - DNA, 17 bp, Homo sapiens
gtcatggaaaagcccag

SEQ ID NO: 2879117 - DNA, 18 bp, Homo sapiens
gtcattttggtactttgg

SEQ ID NO: 2879118 - DNA, 20 bp, Homo sapiens
gtcattttggtactttggtg

SEQ ID NO: 2879119 - DNA, 19 bp, Homo sapiens
gtccaatggctgtaaacta

SEQ ID NO: 2879120 - DNA, 23 bp, Homo sapiens
gtcccctgctactcctgtgctct

SEQ ID NO: 2879121 - DNA, 11 bp, Homo sapiens
gtcctctcccc

SEQ ID NO: 2879122 - DNA, 15 bp, Homo sapiens
gtcctgctggcacct

SEQ ID NO: 2879123 - DNA, 14 bp, Homo sapiens
gtcctttccttctc

SEQ ID NO: 2879124 - DNA, 13 bp, Homo sapiens
gtcgccaggctag

SEQ ID NO: 2879125 - DNA, 23 bp, Homo sapiens
gtcgttcccttgtgtctgttgct

SEQ ID NO: 2879126 - DNA, 13 bp, Homo sapiens
gtctgagccctgg

SEQ ID NO: 2879127 - DNA, 18 bp, Homo sapiens
gtctgagtcctgtctctg

SEQ ID NO: 2879128 - DNA, 18 bp, Homo sapiens
gtctgagtctgagtcctg

SEQ ID NO: 2879129 - DNA, 17 bp, Homo sapiens
gtctgcctgcctcatgc

SEQ ID NO: 2879130 - DNA, 19 bp, Homo sapiens
gtctggcagtttatattta

SEQ ID NO: 2879131 - DNA, 13 bp, Homo sapiens
gtctgtggatttt

SEQ ID NO: 2879132 - DNA, 16 bp, Homo sapiens
gtctgtggattttttc

SEQ ID NO: 2879133 - DNA, 23 bp, Homo sapiens
gtgaagccccttgtcctctcccg

SEQ ID NO: 2879134 - DNA, 19 bp, Homo sapiens
gtgagcatgggtgtgccct

SEQ ID NO: 2879135 - DNA, 22 bp, Homo sapiens
gtgaggtgggggtctggcctag

SEQ ID NO: 2879136 - DNA, 19 bp, Homo sapiens
gtgattcctttgaagagga

SEQ ID NO: 2879137 - DNA, 19 bp, Homo sapiens
gtgatttacccctaattaa

SEQ ID NO: 2879138 - DNA, 20 bp, Homo sapiens
gtgcaatgtaaatattttaa

SEQ ID NO: 2879139 - DNA, 19 bp, Homo sapiens
gtgcatttgtgtctgcctg

SEQ ID NO: 2879140 - DNA, 15 bp, Homo sapiens
gtgccagctctagtt

SEQ ID NO: 2879141 - DNA, 20 bp, Homo sapiens
gtgcctaatggagaagaccc

SEQ ID NO: 2879142 - DNA, 20 bp, Homo sapiens
gtgctgggattacaggtgta

SEQ ID NO: 2879143 - DNA, 18 bp, Homo sapiens
gtggagtctgagtctgag

SEQ ID NO: 2879144 - DNA, 15 bp, Homo sapiens
gtggctcgctccctg

SEQ ID NO: 2879145 - DNA, 14 bp, Homo sapiens
gtgggaagaaagaa

SEQ ID NO: 2879146 - DNA, 18 bp, Homo sapiens
gtggggtacatttctctg

SEQ ID NO: 2879147 - DNA, 13 bp, Homo sapiens
gtgggtgggccct

SEQ ID NO: 2879148 - DNA, 16 bp, Homo sapiens
gtgtagcaactacagt

SEQ ID NO: 2879149 - DNA, 20 bp, Homo sapiens
gtgtcagagtaacatgccag

SEQ ID NO: 2879150 - DNA, 13 bp, Homo sapiens
gtgtcctctcccc

SEQ ID NO: 2879151 - DNA, 15 bp, Homo sapiens
gtgtgtttcaggaca

SEQ ID NO: 2879152 - DNA, 19 bp, Homo sapiens
gtgtgtttcaggacagctg

SEQ ID NO: 2879153 - DNA, 22 bp, Homo sapiens
gtgtgtttccagatcgatcctg

SEQ ID NO: 2879154 - DNA, 12 bp, Homo sapiens
gtgttaattttt

SEQ ID NO: 2879155 - DNA, 16 bp, Homo sapiens
gtgttcagtgttgaca

SEQ ID NO: 2879156 - DNA, 21 bp, Homo sapiens
gtgtttaaagttcaacatgtt

SEQ ID NO: 2879157 - DNA, 19 bp, Homo sapiens
gttaatttagaaaacttta

SEQ ID NO: 2879158 - DNA, 14 bp, Homo sapiens
gttaatttttgata

SEQ ID NO: 2879159 - DNA, 16 bp, Homo sapiens
gttacacagcccaaga

SEQ ID NO: 2879160 - DNA, 23 bp, Homo sapiens
gttactgaaatgaggagagaagg

SEQ ID NO: 2879161 - DNA, 17 bp, Homo sapiens
gttagcagagtctgtct

SEQ ID NO: 2879162 - DNA, 21 bp, Homo sapiens
gttagcagagtctgtctcttg

SEQ ID NO: 2879163 - DNA, 17 bp, Homo sapiens
gttatttgtaatagatg

SEQ ID NO: 2879164 - DNA, 20 bp, Homo sapiens
gttcagtgttgacatagcct

SEQ ID NO: 2879165 - DNA, 12 bp, Homo sapiens
gttccctctttc

SEQ ID NO: 2879166 - DNA, 20 bp, Homo sapiens
gttcccttgtgtctgttgct

SEQ ID NO: 2879167 - DNA, 22 bp, Homo sapiens
gttccgtctcctctccagccct

SEQ ID NO: 2879168 - DNA, 11 bp, Homo sapiens
gttcctgcctt

SEQ ID NO: 2879169 - DNA, 21 bp, Homo sapiens
gttctcatccacagaggccag

SEQ ID NO: 2879170 - DNA, 14 bp, Homo sapiens
gttgacatagcctt

SEQ ID NO: 2879171 - DNA, 19 bp, Homo sapiens
gttgcaccatctgcttggt

SEQ ID NO: 2879172 - DNA, 15 bp, Homo sapiens
gttgcagtctcagaa

SEQ ID NO: 2879173 - DNA, 21 bp, Homo sapiens
gttgctcctacccctgtcctg

SEQ ID NO: 2879174 - DNA, 17 bp, Homo sapiens
gtttaagccaaaacaat

SEQ ID NO: 2879175 - DNA, 13 bp, Homo sapiens
gtttaatgttttg

SEQ ID NO: 2879176 - DNA, 16 bp, Homo sapiens
gtttcaggacagctgc

SEQ ID NO: 2879177 - DNA, 16 bp, Homo sapiens
gtttcccaagagctac

SEQ ID NO: 2879178 - DNA, 22 bp, Homo sapiens
gtttcttaaataagaaactttt

SEQ ID NO: 2879179 - DNA, 20 bp, Homo sapiens
gtttggatatgtaaaacatt

SEQ ID NO: 2879180 - DNA, 22 bp, Homo sapiens
gttttcagtcaagttccgtctc

SEQ ID NO: 2879181 - DNA, 16 bp, Homo sapiens
gttttctttgtaaagg

SEQ ID NO: 2879182 - DNA, 19 bp, Homo sapiens
gttttctttgtaaaggtca

SEQ ID NO: 2879183 - DNA, 15 bp, Homo sapiens
taaaaaaataagaag

SEQ ID NO: 2879184 - DNA, 17 bp, Homo sapiens
taaaaaactaaaaacta

SEQ ID NO: 2879185 - DNA, 19 bp, Homo sapiens
taaaaaactaaaaactaga

SEQ ID NO: 2879186 - DNA, 17 bp, Homo sapiens
taaaaaagcttaaaact

SEQ ID NO: 2879187 - DNA, 18 bp, Homo sapiens
taaaaaagcttaaaactt

SEQ ID NO: 2879188 - DNA, 17 bp, Homo sapiens
tcactcactcactcatt

SEQ ID NO: 2879189 - DNA, 15 bp, Homo sapiens
tcactcactcattcc

SEQ ID NO: 2879190 - DNA, 21 bp, Homo sapiens
tcactgctgtccctcctgagg

SEQ ID NO: 2879191 - DNA, 11 bp, Homo sapiens
tcacttttcct

SEQ ID NO: 2879192 - DNA, 15 bp, Homo sapiens
tcacttttccttttc

SEQ ID NO: 2879193 - DNA, 16 bp, Homo sapiens
tcacttttccttttct

SEQ ID NO: 2879194 - DNA, 13 bp, Homo sapiens
tcagacaatccac

SEQ ID NO: 2879195 - DNA, 20 bp, Homo sapiens
tcagcctcctgagtagctgg

SEQ ID NO: 2879196 - DNA, 14 bp, Homo sapiens
tcagcgtcccctgc

SEQ ID NO: 2879197 - DNA, 23 bp, Homo sapiens
tcaggaggcgcagcccgaagccc

SEQ ID NO: 2879198 - DNA, 13 bp, Homo sapiens
ctattcagaataa

SEQ ID NO: 2879199 - DNA, 19 bp, Homo sapiens
ctattcagaataaatgggt

SEQ ID NO: 2879200 - DNA, 14 bp, Homo sapiens
ctattccctggaga

SEQ ID NO: 2879201 - DNA, 15 bp, Homo sapiens
ctattccctggagac

SEQ ID NO: 2879202 - DNA, 19 bp, Homo sapiens
ctcaaagcaagcattcaga

SEQ ID NO: 2879203 - DNA, 19 bp, Homo sapiens
ctcaacccctcccctccat

SEQ ID NO: 2879204 - DNA, 15 bp, Homo sapiens
ctcacattccctctc

SEQ ID NO: 2879205 - DNA, 17 bp, Homo sapiens
ctcacattccctctcat

SEQ ID NO: 2879206 - DNA, 14 bp, Homo sapiens
ctcaccccctccca

SEQ ID NO: 2879207 - DNA, 15 bp, Homo sapiens
ctcaccccctcccac

SEQ ID NO: 2879208 - DNA, 21 bp, Homo sapiens
ctcaccccctcccacccccag

SEQ ID NO: 2879209 - DNA, 16 bp, Homo sapiens
ctcacctacttcctcc

SEQ ID NO: 2879210 - DNA, 22 bp, Homo sapiens
ctcagacaatccactctcagga

SEQ ID NO: 2879211 - DNA, 15 bp, Homo sapiens
ctcagacttgccagg

SEQ ID NO: 2879212 - DNA, 16 bp, Homo sapiens
ctcaggaggcgcagcc

SEQ ID NO: 2879213 - DNA, 19 bp, Homo sapiens
ctcaggaggcgcagcccga

SEQ ID NO: 2879214 - DNA, 19 bp, Homo sapiens
ctcagtaatttagaaatca

SEQ ID NO: 2879215 - DNA, 22 bp, Homo sapiens
ctcagtaatttagaaatcattt

SEQ ID NO: 2879216 - DNA, 22 bp, Homo sapiens
ctcatccaggtcctttccttct

SEQ ID NO: 2879217 - DNA, 23 bp, Homo sapiens
ctcatccaggtcctttccttctc

SEQ ID NO: 2879218 - DNA, 11 bp, Homo sapiens
ctcatctcagt

SEQ ID NO: 2879219 - DNA, 18 bp, Homo sapiens
ctcatctcagtgaagaat

SEQ ID NO: 2879220 - DNA, 16 bp, Homo sapiens
ctcatttaagggaaaa

SEQ ID NO: 2879221 - DNA, 16 bp, Homo sapiens
ctcatttcatctcatt

SEQ ID NO: 2879222 - DNA, 14 bp, Homo sapiens
ctccaaggactcta

SEQ ID NO: 2879223 - DNA, 11 bp, Homo sapiens
ctccaccccag

SEQ ID NO: 2879224 - DNA, 13 bp, Homo sapiens
ctccaccccagga

SEQ ID NO: 2879225 - DNA, 11 bp, Homo sapiens
ctccagccagc

SEQ ID NO: 2879226 - DNA, 14 bp, Homo sapiens
ctccagccagcgcc

SEQ ID NO: 2879227 - DNA, 17 bp, Homo sapiens
ctccagccagcgcctcc

SEQ ID NO: 2879228 - DNA, 22 bp, Homo sapiens
ctccagccagcgcctccctcca

SEQ ID NO: 2879229 - DNA, 20 bp, Homo sapiens
ctccagtctcctgacattaa

SEQ ID NO: 2879230 - DNA, 11 bp, Homo sapiens
ctccatccctg

SEQ ID NO: 2879231 - DNA, 15 bp, Homo sapiens
ctccatccctggccc

SEQ ID NO: 2879232 - DNA, 16 bp, Homo sapiens
ctccatccctggcccc

SEQ ID NO: 2879233 - DNA, 23 bp, Homo sapiens
ctccatgactgtgtgttgtgaaa

SEQ ID NO: 2879234 - DNA, 20 bp, Homo sapiens
ctccattcccatcactgctg

SEQ ID NO: 2879235 - DNA, 11 bp, Homo sapiens
ctcccaccccc

SEQ ID NO: 2879236 - DNA, 19 bp, Homo sapiens
ctcccacgatgtcaaggac

SEQ ID NO: 2879237 - DNA, 13 bp, Homo sapiens
ctcccccagccct

SEQ ID NO: 2879238 - DNA, 16 bp, Homo sapiens
ctcccctctgccctgt

SEQ ID NO: 2879239 - DNA, 13 bp, Homo sapiens
ctccctccacccc

SEQ ID NO: 2879240 - DNA, 15 bp, Homo sapiens
ctccctccaccccag

SEQ ID NO: 2879241 - DNA, 18 bp, Homo sapiens
ctccctccaccccaggac

SEQ ID NO: 2879242 - DNA, 14 bp, Homo sapiens
ctccctcgcatccg

SEQ ID NO: 2879243 - DNA, 21 bp, Homo sapiens
ctccctcgcatccgcctctga

SEQ ID NO: 2879244 - DNA, 12 bp, Homo sapiens
ctccctggatga

SEQ ID NO: 2879245 - DNA, 19 bp, Homo sapiens
ctccctgtagctctgcctc

SEQ ID NO: 2879246 - DNA, 23 bp, Homo sapiens
ctcctacccctgtcctggggctg

SEQ ID NO: 2879247 - DNA, 12 bp, Homo sapiens
ctcctcctgttc

SEQ ID NO: 2879248 - DNA, 13 bp, Homo sapiens
ctcctctccagcc

SEQ ID NO: 2879249 - DNA, 15 bp, Homo sapiens
ctcctgaccctgtga

SEQ ID NO: 2879250 - DNA, 21 bp, Homo sapiens
ctcctgtctgtcctggaggtg

SEQ ID NO: 2879251 - DNA, 14 bp, Homo sapiens
ctcctgtgctctgg

SEQ ID NO: 2879252 - DNA, 19 bp, Homo sapiens
ctcctgttcctgccttctc

SEQ ID NO: 2879253 - DNA, 22 bp, Homo sapiens
ctcctgttcctgccttctcttc

SEQ ID NO: 2879254 - DNA, 21 bp, Homo sapiens
ctccttcaacaattctaaaat

SEQ ID NO: 2879255 - DNA, 22 bp, Homo sapiens
ctcgctccctgtagctctgcct

SEQ ID NO: 2879256 - DNA, 15 bp, Homo sapiens
ctcgtcttcctctct

SEQ ID NO: 2879257 - DNA, 19 bp, Homo sapiens
ctcgtcttcctctctctca

SEQ ID NO: 2879258 - DNA, 23 bp, Homo sapiens
ctctaaaagggggctattccctg

SEQ ID NO: 2879259 - DNA, 18 bp, Homo sapiens
ctctataagtgttcagtg

SEQ ID NO: 2879260 - DNA, 20 bp, Homo sapiens
ctctataagtgttcagtgtt

SEQ ID NO: 2879261 - DNA, 21 bp, Homo sapiens
ctctataagtgttcagtgttg

SEQ ID NO: 2879262 - DNA, 19 bp, Homo sapiens
ctctcacctacttcctcct

SEQ ID NO: 2879263 - DNA, 19 bp, Homo sapiens
ctctcaggaggcgcagccc

SEQ ID NO: 2879264 - DNA, 22 bp, Homo sapiens
ctctcaggaggcgcagcccgaa

SEQ ID NO: 2879265 - DNA, 13 bp, Homo sapiens
ctctccagcccta

SEQ ID NO: 2879266 - DNA, 21 bp, Homo sapiens
ctctcccacgatgtcaaggac

SEQ ID NO: 2879267 - DNA, 18 bp, Homo sapiens
ctctcccctcatggagaa

SEQ ID NO: 2879268 - DNA, 21 bp, Homo sapiens
ctctctataagtgttcagtgt

SEQ ID NO: 2879269 - DNA, 13 bp, Homo sapiens
ctctctctcacct

SEQ ID NO: 2879270 - DNA, 12 bp, Homo sapiens
ctctgagccagg

SEQ ID NO: 2879271 - DNA, 13 bp, Homo sapiens
ctctgagccagga

SEQ ID NO: 2879272 - DNA, 23 bp, Homo sapiens
ctctgagccaggagcctcctgac

SEQ ID NO: 2879273 - DNA, 17 bp, Homo sapiens
ctctgcctccctctcca

SEQ ID NO: 2879274 - DNA, 13 bp, Homo sapiens
ctctggatccctg

SEQ ID NO: 2879275 - DNA, 17 bp, Homo sapiens
ctctggatccctggagg

SEQ ID NO: 2879276 - DNA, 17 bp, Homo sapiens
ctgaaaaggtttatgaa

SEQ ID NO: 2879277 - DNA, 22 bp, Homo sapiens
ctgaaatgaggagagaaggaca

SEQ ID NO: 2879278 - DNA, 17 bp, Homo sapiens
aaaaactaaaaactaga

SEQ ID NO: 2879279 - DNA, 14 bp, Homo sapiens
aaaaagaagaatct

SEQ ID NO: 2879280 - DNA, 20 bp, Homo sapiens
aaaaagcttaaaactttgaa

SEQ ID NO: 2879281 - DNA, 18 bp, Homo sapiens
aaaaatatatatctatct

SEQ ID NO: 2879282 - DNA, 14 bp, Homo sapiens
aaaaatgatctaaa

SEQ ID NO: 2879283 - DNA, 14 bp, Homo sapiens
aaaactaaatttat

SEQ ID NO: 2879284 - DNA, 22 bp, Homo sapiens
aaaactagaggtgagaaattta

SEQ ID NO: 2879285 - DNA, 12 bp, Homo sapiens
aaaagaaacttt

SEQ ID NO: 2879286 - DNA, 23 bp, Homo sapiens
aaaaggtttatgaaaaagaagaa

SEQ ID NO: 2879287 - DNA, 20 bp, Homo sapiens
aaaataaatttttataagga

SEQ ID NO: 2879288 - DNA, 10 bp, Homo sapiens
aaaatacatg

SEQ ID NO: 2879289 - DNA, 17 bp, Homo sapiens
aaaatagcaaaagaaga

SEQ ID NO: 2879290 - DNA, 20 bp, Homo sapiens
aaaatagctaaatacctcaa

SEQ ID NO: 2879291 - DNA, 16 bp, Homo sapiens
aaaatagtttggatat

SEQ ID NO: 2879292 - DNA, 20 bp, Homo sapiens
aaaatagtttggatatgtaa

SEQ ID NO: 2879293 - DNA, 13 bp, Homo sapiens
aaaatatatatct

SEQ ID NO: 2879294 - DNA, 19 bp, Homo sapiens
aaaatgaccagtaattgtg

SEQ ID NO: 2879295 - DNA, 13 bp, Homo sapiens
aaaatgttgaaat

SEQ ID NO: 2879296 - DNA, 18 bp, Homo sapiens
aaaatttcaaaagtgatc

SEQ ID NO: 2879297 - DNA, 18 bp, Homo sapiens
aaacaaagagttcaagaa

SEQ ID NO: 2879298 - DNA, 16 bp, Homo sapiens
aaacaaagggtgggca

SEQ ID NO: 2879299 - DNA, 13 bp, Homo sapiens
aaacaacagaaac

SEQ ID NO: 2879300 - DNA, 15 bp, Homo sapiens
aaacacactgtaaat

SEQ ID NO: 2879301 - DNA, 13 bp, Homo sapiens
aaacataaataaa

SEQ ID NO: 2879302 - DNA, 17 bp, Homo sapiens
aaacatttattttgaca

SEQ ID NO: 2879303 - DNA, 20 bp, Homo sapiens
aaacatttattttgacataa

SEQ ID NO: 2879304 - DNA, 20 bp, Homo sapiens
aaacccttaacctaaattta

SEQ ID NO: 2879305 - DNA, 14 bp, Homo sapiens
aaaccgctaaaaga

SEQ ID NO: 2879306 - DNA, 23 bp, Homo sapiens
aaaccgctaaaagaaactttctt

SEQ ID NO: 2879307 - DNA, 14 bp, Homo sapiens
aaactaaaaactag

SEQ ID NO: 2879308 - DNA, 21 bp, Homo sapiens
aaactataaactactgtaatt

SEQ ID NO: 2879309 - DNA, 22 bp, Homo sapiens
aaactataagcaagaaggcaaa

SEQ ID NO: 2879310 - DNA, 16 bp, Homo sapiens
aaactttgaagttagc

SEQ ID NO: 2879311 - DNA, 13 bp, Homo sapiens
aaagaaaaccttt

SEQ ID NO: 2879312 - DNA, 14 bp, Homo sapiens
aaagcaaaaaagaa

SEQ ID NO: 2879313 - DNA, 20 bp, Homo sapiens
aaagcaagcattcagaagaa

SEQ ID NO: 2879314 - DNA, 14 bp, Homo sapiens
aaagcaattgtgaa

SEQ ID NO: 2879315 - DNA, 16 bp, Homo sapiens
aaagcatgatttttaa

SEQ ID NO: 2879316 - DNA, 13 bp, Homo sapiens
aaagcatggagag

SEQ ID NO: 2879317 - DNA, 12 bp, Homo sapiens
aaagcgaaaaaa

SEQ ID NO: 2879318 - DNA, 18 bp, Homo sapiens
aaagctggtttaatgttt

SEQ ID NO: 2879319 - DNA, 19 bp, Homo sapiens
aaagcttaaaactttgaag

SEQ ID NO: 2879320 - DNA, 22 bp, Homo sapiens
aaagggggctattccctggaga

SEQ ID NO: 2879321 - DNA, 14 bp, Homo sapiens
aaagtgatctgtcc

SEQ ID NO: 2879322 - DNA, 20 bp, Homo sapiens
aaagtgatctgtcccctctc

SEQ ID NO: 2879323 - DNA, 22 bp, Homo sapiens
aaagtgatctgtcccctctccc

SEQ ID NO: 2879324 - DNA, 23 bp, Homo sapiens
aaagtgatctgtcccctctcccc

SEQ ID NO: 2879325 - DNA, 15 bp, Homo sapiens
aaagtttaataaatt

SEQ ID NO: 2879326 - DNA, 14 bp, Homo sapiens
aaataaaatgacca

SEQ ID NO: 2879327 - DNA, 16 bp, Homo sapiens
aaataaaatgaccagt

SEQ ID NO: 2879328 - DNA, 12 bp, Homo sapiens
aaataagaaact

SEQ ID NO: 2879329 - DNA, 14 bp, Homo sapiens
aaataagaaacttt

SEQ ID NO: 2879330 - DNA, 15 bp, Homo sapiens
aaataagaaactttt

SEQ ID NO: 2879331 - DNA, 21 bp, Homo sapiens
aaataagaaacttttttattt

SEQ ID NO: 2879332 - DNA, 17 bp, Homo sapiens
aaatagcaaaagaagaa

SEQ ID NO: 2879333 - DNA, 12 bp, Homo sapiens
aaatagtatttc

SEQ ID NO: 2879334 - DNA, 15 bp, Homo sapiens
aaatatttaaattta

SEQ ID NO: 2879335 - DNA, 14 bp, Homo sapiens
aaatattttaaaga

SEQ ID NO: 2879336 - DNA, 23 bp, Homo sapiens
aaatattttaaagaattgtgtca

SEQ ID NO: 2879337 - DNA, 21 bp, Homo sapiens
aaatattttttaaaaccataa

SEQ ID NO: 2879338 - DNA, 15 bp, Homo sapiens
aaatcaagaaaataa

SEQ ID NO: 2879339 - DNA, 22 bp, Homo sapiens
aaatcaattctgatacagcctt

SEQ ID NO: 2879340 - DNA, 14 bp, Homo sapiens
aaatcattttgcaa

SEQ ID NO: 2879341 - DNA, 13 bp, Homo sapiens
aaatgatctaaac

SEQ ID NO: 2879342 - DNA, 14 bp, Homo sapiens
aaatgattgtagta

SEQ ID NO: 2879343 - DNA, 19 bp, Homo sapiens
aaatgtgaatgggaaaaga

SEQ ID NO: 2879344 - DNA, 23 bp, Homo sapiens
aaatgttgaaatatgatgttaaa

SEQ ID NO: 2879345 - DNA, 21 bp, Homo sapiens
aaatgtttatacaataattta

SEQ ID NO: 2879346 - DNA, 20 bp, Homo sapiens
aaattaactgggtaatgaaa

SEQ ID NO: 2879347 - DNA, 14 bp, Homo sapiens
aaattgaatgcaaa

SEQ ID NO: 2879348 - DNA, 15 bp, Homo sapiens
aaattgaatgcaaac

SEQ ID NO: 2879349 - DNA, 14 bp, Homo sapiens
aaatttaaactata

SEQ ID NO: 2879350 - DNA, 21 bp, Homo sapiens
aaatttatcttgttcaatgaa

SEQ ID NO: 2879351 - DNA, 23 bp, Homo sapiens
aacaaagagttcaagaaataagt

SEQ ID NO: 2879352 - DNA, 12 bp, Homo sapiens
aacaattctaaa

SEQ ID NO: 2879353 - DNA, 19 bp, Homo sapiens
aacaattctaaaatgattg

SEQ ID NO: 2879354 - DNA, 13 bp, Homo sapiens
aacacactgtaaa

SEQ ID NO: 2879355 - DNA, 22 bp, Homo sapiens
aacacactgtaaatatccacag

SEQ ID NO: 2879356 - DNA, 18 bp, Homo sapiens
aacagcctgacaacattt

SEQ ID NO: 2879357 - DNA, 23 bp, Homo sapiens
aacagcctgtttgggaggctgga

SEQ ID NO: 2879358 - DNA, 19 bp, Homo sapiens
aacatagacagaagaaaca

SEQ ID NO: 2879359 - DNA, 21 bp, Homo sapiens
aacatagacagaagaaacaag

SEQ ID NO: 2879360 - DNA, 19 bp, Homo sapiens
aacatttattttgacataa

SEQ ID NO: 2879361 - DNA, 20 bp, Homo sapiens
aacccctcccctccatccct

SEQ ID NO: 2879362 - DNA, 13 bp, Homo sapiens
aacctaaataatt

SEQ ID NO: 2879363 - DNA, 21 bp, Homo sapiens
aacctgtggcgctgcagcagg

SEQ ID NO: 2879364 - DNA, 11 bp, Homo sapiens
aacctttccct

SEQ ID NO: 2879365 - DNA, 13 bp, Homo sapiens
aacctttccctca

SEQ ID NO: 2879366 - DNA, 14 bp, Homo sapiens
aacctttccctcac

SEQ ID NO: 2879367 - DNA, 18 bp, Homo sapiens
aacctttccctcaccccc

SEQ ID NO: 2879368 - DNA, 20 bp, Homo sapiens
aacctttccctcaccccctc

SEQ ID NO: 2879369 - DNA, 22 bp, Homo sapiens
aacctttccctcaccccctccc

SEQ ID NO: 2879370 - DNA, 16 bp, Homo sapiens
aacctttcttcaccaa

SEQ ID NO: 2879371 - DNA, 12 bp, Homo sapiens
aactactgtaat

SEQ ID NO: 2879372 - DNA, 13 bp, Homo sapiens
aactactgtaatt

SEQ ID NO: 2879373 - DNA, 20 bp, Homo sapiens
aactagaggtgagaaattta

SEQ ID NO: 2879374 - DNA, 16 bp, Homo sapiens
aactataaactactgt

SEQ ID NO: 2879375 - DNA, 19 bp, Homo sapiens
aactataaactactgtaat

SEQ ID NO: 2879376 - DNA, 15 bp, Homo sapiens
aactcgttttttaca

SEQ ID NO: 2879377 - DNA, 18 bp, Homo sapiens
aactgggtaatgaaacaa

SEQ ID NO: 2879378 - DNA, 15 bp, Homo sapiens
aactgtggtgccaca

SEQ ID NO: 2879379 - DNA, 16 bp, Homo sapiens
aacttggttttgctac

SEQ ID NO: 2879380 - DNA, 21 bp, Homo sapiens
aacttggttttgctacataat

SEQ ID NO: 2879381 - DNA, 15 bp, Homo sapiens
aactttgaagttagc

SEQ ID NO: 2879382 - DNA, 15 bp, Homo sapiens
aagaaaaagttgcag

SEQ ID NO: 2879383 - DNA, 11 bp, Homo sapiens
aagaaactttc

SEQ ID NO: 2879384 - DNA, 14 bp, Homo sapiens
aagaaactttttta

SEQ ID NO: 2879385 - DNA, 14 bp, Homo sapiens
aagaagtaaatttg

SEQ ID NO: 2879386 - DNA, 15 bp, Homo sapiens
agtccatagctgagc

SEQ ID NO: 2879387 - DNA, 20 bp, Homo sapiens
agtctaaagctggtttaatg

SEQ ID NO: 2879388 - DNA, 19 bp, Homo sapiens
agtctcagaatgtcatttt

SEQ ID NO: 2879389 - DNA, 23 bp, Homo sapiens
agtctgagtcctgtctctgcctg

SEQ ID NO: 2879390 - DNA, 14 bp, Homo sapiens
agtctgagtctgag

SEQ ID NO: 2879391 - DNA, 15 bp, Homo sapiens
agtctgagtctgagt

SEQ ID NO: 2879392 - DNA, 21 bp, Homo sapiens
agtgaagccccttgtcctctc

SEQ ID NO: 2879393 - DNA, 13 bp, Homo sapiens
agtgacctgaccg

SEQ ID NO: 2879394 - DNA, 21 bp, Homo sapiens
agtgatctgtcccctctcccc

SEQ ID NO: 2879395 - DNA, 17 bp, Homo sapiens
agtgattgtcttaatat

SEQ ID NO: 2879396 - DNA, 23 bp, Homo sapiens
agtgatttgggggtgcaatgata

SEQ ID NO: 2879397 - DNA, 22 bp, Homo sapiens
agtggactggcctcaaagcaag

SEQ ID NO: 2879398 - DNA, 19 bp, Homo sapiens
agtggagtctgagtctgag

SEQ ID NO: 2879399 - DNA, 18 bp, Homo sapiens
agtgggaagtgaagcccc

SEQ ID NO: 2879400 - DNA, 17 bp, Homo sapiens
agtggggaggggcctgg

SEQ ID NO: 2879401 - DNA, 15 bp, Homo sapiens
agtgtagaacctaat

SEQ ID NO: 2879402 - DNA, 13 bp, Homo sapiens
agtgttcagtgtt

SEQ ID NO: 2879403 - DNA, 18 bp, Homo sapiens
agtgttcagtgttgacat

SEQ ID NO: 2879404 - DNA, 15 bp, Homo sapiens
agtgttgacatagcc

SEQ ID NO: 2879405 - DNA, 13 bp, Homo sapiens
agttcaagaaata

SEQ ID NO: 2879406 - DNA, 19 bp, Homo sapiens
agttcaagaaataagtttt

SEQ ID NO: 2879407 - DNA, 16 bp, Homo sapiens
agttcaagcctgtggg

SEQ ID NO: 2879408 - DNA, 22 bp, Homo sapiens
agttccgtctcctctccagccc

SEQ ID NO: 2879409 - DNA, 13 bp, Homo sapiens
agttgcagtctca

SEQ ID NO: 2879410 - DNA, 20 bp, Homo sapiens
agttgcagtctcagaaagcc

SEQ ID NO: 2879411 - DNA, 20 bp, Homo sapiens
agttgctcctacccctgtcc

SEQ ID NO: 2879412 - DNA, 17 bp, Homo sapiens
agtttaataaatttatt

SEQ ID NO: 2879413 - DNA, 18 bp, Homo sapiens
agtttatatttaactctc

SEQ ID NO: 2879414 - DNA, 13 bp, Homo sapiens
agtttcccttcta

SEQ ID NO: 2879415 - DNA, 17 bp, Homo sapiens
agtttggatatgtaaaa

SEQ ID NO: 2879416 - DNA, 22 bp, Homo sapiens
agtttggatatgtaaaacattt

SEQ ID NO: 2879417 - DNA, 13 bp, Homo sapiens
agttttcagcctt

SEQ ID NO: 2879418 - DNA, 13 bp, Homo sapiens
agttttctttgta

SEQ ID NO: 2879419 - DNA, 16 bp, Homo sapiens
agttttctttgtaaag

SEQ ID NO: 2879420 - DNA, 13 bp, Homo sapiens
ataaaatgaccag

SEQ ID NO: 2879421 - DNA, 15 bp, Homo sapiens
ataaaatggtgaaag

SEQ ID NO: 2879422 - DNA, 16 bp, Homo sapiens
ataaagttgataaaga

SEQ ID NO: 2879423 - DNA, 18 bp, Homo sapiens
ataaatgggtaacactga

SEQ ID NO: 2879424 - DNA, 14 bp, Homo sapiens
ataactgaaaatta

SEQ ID NO: 2879425 - DNA, 13 bp, Homo sapiens
ataagaagaatgc

SEQ ID NO: 2879426 - DNA, 16 bp, Homo sapiens
ataagcaagaaggcaa

SEQ ID NO: 2879427 - DNA, 23 bp, Homo sapiens
ataagcaagaaggcaaaaatagt

SEQ ID NO: 2879428 - DNA, 19 bp, Homo sapiens
ataagtgttcagtgttgac

SEQ ID NO: 2879429 - DNA, 22 bp, Homo sapiens
ataagtgttcagtgttgacata

SEQ ID NO: 2879430 - DNA, 14 bp, Homo sapiens
ataatactaaagtg

SEQ ID NO: 2879431 - DNA, 19 bp, Homo sapiens
atacattgaattagaaaca

SEQ ID NO: 2879432 - DNA, 18 bp, Homo sapiens
atacctgggcatactaat

SEQ ID NO: 2879433 - DNA, 12 bp, Homo sapiens
atactaaagtgt

SEQ ID NO: 2879434 - DNA, 14 bp, Homo sapiens
atactaaagtgtct

SEQ ID NO: 2879435 - DNA, 17 bp, Homo sapiens
atactaagcattgaatg

SEQ ID NO: 2879436 - DNA, 17 bp, Homo sapiens
atactcatttttcatga

SEQ ID NO: 2879437 - DNA, 11 bp, Homo sapiens
atactgaagat

SEQ ID NO: 2879438 - DNA, 16 bp, Homo sapiens
atacttctcatttttt

SEQ ID NO: 2879439 - DNA, 13 bp, Homo sapiens
atagacagaagaa

SEQ ID NO: 2879440 - DNA, 16 bp, Homo sapiens
atagacagaagaaaca

SEQ ID NO: 2879441 - DNA, 17 bp, Homo sapiens
atagacagaagaaacaa

SEQ ID NO: 2879442 - DNA, 12 bp, Homo sapiens
atagatgtttga

SEQ ID NO: 2879443 - DNA, 18 bp, Homo sapiens
atagcaaaagaagaagtt

SEQ ID NO: 2879444 - DNA, 14 bp, Homo sapiens
atagcaaagaattg

SEQ ID NO: 2879445 - DNA, 13 bp, Homo sapiens
atagccaaaaata

SEQ ID NO: 2879446 - DNA, 21 bp, Homo sapiens
ataggatttatttaaaatagc

SEQ ID NO: 2879447 - DNA, 13 bp, Homo sapiens
atagtaaatcacg

SEQ ID NO: 2879448 - DNA, 19 bp, Homo sapiens
atagtaaatcacgcttttt

SEQ ID NO: 2879449 - DNA, 18 bp, Homo sapiens
atagtatgcagctaaaaa

SEQ ID NO: 2879450 - DNA, 22 bp, Homo sapiens
atagtatgcagctaaaaaataa

SEQ ID NO: 2879451 - DNA, 19 bp, Homo sapiens
atagtttggatatgtaaaa

SEQ ID NO: 2879452 - DNA, 15 bp, Homo sapiens
atataatactaaagt

SEQ ID NO: 2879453 - DNA, 15 bp, Homo sapiens
atatcctaaacatca

SEQ ID NO: 2879454 - DNA, 22 bp, Homo sapiens
atatcctaaacatcattcattt

SEQ ID NO: 2879455 - DNA, 13 bp, Homo sapiens
atatctatctatt

SEQ ID NO: 2879456 - DNA, 24 bp, Homo sapiens
atatgtaaaacatttattttgaca

SEQ ID NO: 2879457 - DNA, 16 bp, Homo sapiens
atattttaaagaattg

SEQ ID NO: 2879458 - DNA, 15 bp, Homo sapiens
atatttttaaagaaa

SEQ ID NO: 2879459 - DNA, 23 bp, Homo sapiens
atcaaacaccaacataaaaatga

SEQ ID NO: 2879460 - DNA, 22 bp, Homo sapiens
atcaaatggaaaggagaggaaa

SEQ ID NO: 2879461 - DNA, 19 bp, Homo sapiens
atcacttgagacaaatcta

SEQ ID NO: 2879462 - DNA, 13 bp, Homo sapiens
atccaaaatattt

SEQ ID NO: 2879463 - DNA, 20 bp, Homo sapiens
atccacagactccctcccct

SEQ ID NO: 2879464 - DNA, 18 bp, Homo sapiens
atccaggtcctttccttc

SEQ ID NO: 2879465 - DNA, 14 bp, Homo sapiens
atcccacatgatct

SEQ ID NO: 2879466 - DNA, 18 bp, Homo sapiens
atccctatgtcccagccc

SEQ ID NO: 2879467 - DNA, 11 bp, Homo sapiens
atccctggccc

SEQ ID NO: 2879468 - DNA, 20 bp, Homo sapiens
atccctgtgtgtcgttccct

SEQ ID NO: 2879469 - DNA, 14 bp, Homo sapiens
atcctaaacatcat

SEQ ID NO: 2879470 - DNA, 22 bp, Homo sapiens
atcctaagtgggaagtgaagcc

SEQ ID NO: 2879471 - DNA, 23 bp, Homo sapiens
atccttcatcgaacaaactgatg

SEQ ID NO: 2879472 - DNA, 15 bp, Homo sapiens
atctatctatttgag

SEQ ID NO: 2879473 - DNA, 14 bp, Homo sapiens
atctcagtgaagaa

SEQ ID NO: 2879474 - DNA, 13 bp, Homo sapiens
atctcatttaagg

SEQ ID NO: 2879475 - DNA, 17 bp, Homo sapiens
atctccttcccctacac

SEQ ID NO: 2879476 - DNA, 20 bp, Homo sapiens
atctgaatttttaaacaagt

SEQ ID NO: 2879477 - DNA, 13 bp, Homo sapiens
atctgcaaagcat

SEQ ID NO: 2879478 - DNA, 15 bp, Homo sapiens
atctgtcccctctcc

SEQ ID NO: 2879479 - DNA, 16 bp, Homo sapiens
atctgtcccctctccc

SEQ ID NO: 2879480 - DNA, 15 bp, Homo sapiens
atctgttagcagagt

SEQ ID NO: 2879481 - DNA, 17 bp, Homo sapiens
atctgttagcagagtct

SEQ ID NO: 2879482 - DNA, 14 bp, Homo sapiens
atcttctggcttga

SEQ ID NO: 2879483 - DNA, 16 bp, Homo sapiens
atcttgactcactgca

SEQ ID NO: 2879484 - DNA, 21 bp, Homo sapiens
atcttggttgatgccaaaaaa

SEQ ID NO: 2879485 - DNA, 14 bp, Homo sapiens
atcttgttcaatga

SEQ ID NO: 2879486 - DNA, 16 bp, Homo sapiens
atgaaaaagaagaatc

SEQ ID NO: 2879487 - DNA, 16 bp, Homo sapiens
atgaacagaacataga

SEQ ID NO: 2879488 - DNA, 21 bp, Homo sapiens
atgaacagaacatagacagaa

SEQ ID NO: 2879489 - DNA, 15 bp, Homo sapiens
atgacatgacctttc

SEQ ID NO: 2879490 - DNA, 12 bp, Homo sapiens
atgagctgggcc

SEQ ID NO: 2879491 - DNA, 17 bp, Homo sapiens
atgaggagagaaggaca

SEQ ID NO: 2879492 - DNA, 19 bp, Homo sapiens
atgagtgttaataaaattt

SEQ ID NO: 2879493 - DNA, 14 bp, Homo sapiens
atgattattcaaga

SEQ ID NO: 2879494 - DNA, 15 bp, Homo sapiens
atgattttttcatga

SEQ ID NO: 2879495 - DNA, 16 bp, Homo sapiens
atgcagtattgccaca

SEQ ID NO: 2879496 - DNA, 17 bp, Homo sapiens
atgccaaaaaaaaatac

SEQ ID NO: 2879497 - DNA, 16 bp, Homo sapiens
atgcctctcccacgat

SEQ ID NO: 2879498 - DNA, 21 bp, Homo sapiens
atgcctgacacaggggacact

SEQ ID NO: 2879499 - DNA, 23 bp, Homo sapiens
atgccttttcccaaaatgttgaa

SEQ ID NO: 2879500 - DNA, 18 bp, Homo sapiens
atgctaagagaagtagaa

SEQ ID NO: 2879501 - DNA, 14 bp, Homo sapiens
atgctagagaatca

SEQ ID NO: 2879502 - DNA, 16 bp, Homo sapiens
atgctgccttaaaaga

SEQ ID NO: 2879503 - DNA, 21 bp, Homo sapiens
atgcttctgctcacattccct

SEQ ID NO: 2879504 - DNA, 16 bp, Homo sapiens
atggaaggagacttag

SEQ ID NO: 2879505 - DNA, 12 bp, Homo sapiens
atggattctaaa

SEQ ID NO: 2879506 - DNA, 15 bp, Homo sapiens
atggattctaaaatg

SEQ ID NO: 2879507 - DNA, 9 bp, Homo sapiens
ccctggccc

SEQ ID NO: 2879508 - DNA, 13 bp, Homo sapiens
ccctggccccctc

SEQ ID NO: 2879509 - DNA, 20 bp, Homo sapiens
ccctggccccctccctggat

SEQ ID NO: 2879510 - DNA, 21 bp, Homo sapiens
ccctggccccctccctggatg

SEQ ID NO: 2879511 - DNA, 21 bp, Homo sapiens
ccctgtagctctgcctccctc

SEQ ID NO: 2879512 - DNA, 19 bp, Homo sapiens
ccctgtatataatactaaa

SEQ ID NO: 2879513 - DNA, 14 bp, Homo sapiens
ccctgttttccaca

SEQ ID NO: 2879514 - DNA, 15 bp, Homo sapiens
ccctgttttccacac

SEQ ID NO: 2879515 - DNA, 17 bp, Homo sapiens
ccctgttttccacacca

SEQ ID NO: 2879516 - DNA, 16 bp, Homo sapiens
cccttaacctaaattt

SEQ ID NO: 2879517 - DNA, 22 bp, Homo sapiens
cccttggggtaagccagagcct

SEQ ID NO: 2879518 - DNA, 16 bp, Homo sapiens
cccttgtcctctcccg

SEQ ID NO: 2879519 - DNA, 12 bp, Homo sapiens
cccttgtgtctg

SEQ ID NO: 2879520 - DNA, 12 bp, Homo sapiens
ccgactccagcc

SEQ ID NO: 2879521 - DNA, 13 bp, Homo sapiens
ccgactccagcca

SEQ ID NO: 2879522 - DNA, 15 bp, Homo sapiens
ccgactccagccagc

SEQ ID NO: 2879523 - DNA, 12 bp, Homo sapiens
ccgcctctgagc

SEQ ID NO: 2879524 - DNA, 13 bp, Homo sapiens
ccgcctctgagcc

SEQ ID NO: 2879525 - DNA, 14 bp, Homo sapiens
ccgctaaaagaaac

SEQ ID NO: 2879526 - DNA, 18 bp, Homo sapiens
ccgctaaaagaaactttc

SEQ ID NO: 2879527 - DNA, 23 bp, Homo sapiens
ccggcagcctggttccctctttc

SEQ ID NO: 2879528 - DNA, 22 bp, Homo sapiens
ccgggaccctgctcacaggcag

SEQ ID NO: 2879529 - DNA, 13 bp, Homo sapiens
ccgtctcctctcc

SEQ ID NO: 2879530 - DNA, 14 bp, Homo sapiens
ccgtgcactcccta

SEQ ID NO: 2879531 - DNA, 11 bp, Homo sapiens
cctaaataatt

SEQ ID NO: 2879532 - DNA, 22 bp, Homo sapiens
cctaaatcaagcatctttctgt

SEQ ID NO: 2879533 - DNA, 22 bp, Homo sapiens
cctaagaaaccccagggcaggg

SEQ ID NO: 2879534 - DNA, 14 bp, Homo sapiens
cctacacctccctc

SEQ ID NO: 2879535 - DNA, 15 bp, Homo sapiens
cctacccctgtcctg

SEQ ID NO: 2879536 - DNA, 16 bp, Homo sapiens
cctacttcctcctcct

SEQ ID NO: 2879537 - DNA, 17 bp, Homo sapiens
cctacttcctcctcctc

SEQ ID NO: 2879538 - DNA, 12 bp, Homo sapiens
cctagtggggag

SEQ ID NO: 2879539 - DNA, 20 bp, Homo sapiens
cctagtggggaggggcctgg

SEQ ID NO: 2879540 - DNA, 15 bp, Homo sapiens
cctcagacaatccac

SEQ ID NO: 2879541 - DNA, 18 bp, Homo sapiens
cctcagacaatccactct

SEQ ID NO: 2879542 - DNA, 17 bp, Homo sapiens
cctcagcttcccacgga

SEQ ID NO: 2879543 - DNA, 15 bp, Homo sapiens
cctccaaggactcta

SEQ ID NO: 2879544 - DNA, 14 bp, Homo sapiens
cctccaccccagga

SEQ ID NO: 2879545 - DNA, 16 bp, Homo sapiens
cctcccctccatccct

SEQ ID NO: 2879546 - DNA, 19 bp, Homo sapiens
cctccctccaccccaggac

SEQ ID NO: 2879547 - DNA, 16 bp, Homo sapiens
cctcctcctcctcctg

SEQ ID NO: 2879548 - DNA, 15 bp, Homo sapiens
cctcctcctgttcct

SEQ ID NO: 2879549 - DNA, 17 bp, Homo sapiens
cctcctgttcctgcctt

SEQ ID NO: 2879550 - DNA, 21 bp, Homo sapiens
cctcctgttcctgccttctct

SEQ ID NO: 2879551 - DNA, 17 bp, Homo sapiens
cctctcaagctagccag

SEQ ID NO: 2879552 - DNA, 20 bp, Homo sapiens
cctctcatccaggtcctttc

SEQ ID NO: 2879553 - DNA, 23 bp, Homo sapiens
cctctcatccaggtcctttcctt

SEQ ID NO: 2879554 - DNA, 13 bp, Homo sapiens
cctctccagccct

SEQ ID NO: 2879555 - DNA, 10 bp, Homo sapiens
cctctctctc

SEQ ID NO: 2879556 - DNA, 13 bp, Homo sapiens
cctctgagccagg

SEQ ID NO: 2879557 - DNA, 24 bp, Homo sapiens
cctctgattttggcatgtggagac

SEQ ID NO: 2879558 - DNA, 12 bp, Homo sapiens
cctctgccctgt

SEQ ID NO: 2879559 - DNA, 16 bp, Homo sapiens
cctctggatccctgga

SEQ ID NO: 2879560 - DNA, 19 bp, Homo sapiens
cctctttcctgtgccagga

SEQ ID NO: 2879561 - DNA, 22 bp, Homo sapiens
cctgacacaggggacactgaac

SEQ ID NO: 2879562 - DNA, 21 bp, Homo sapiens
cctgaccctgtgatgcctgac

SEQ ID NO: 2879563 - DNA, 14 bp, Homo sapiens
cctgaccggcacct

SEQ ID NO: 2879564 - DNA, 15 bp, Homo sapiens
cctgcctcatgctct

SEQ ID NO: 2879565 - DNA, 14 bp, Homo sapiens
cctgccttctcttc

SEQ ID NO: 2879566 - DNA, 16 bp, Homo sapiens
cctgctactcctgtgc

SEQ ID NO: 2879567 - DNA, 14 bp, Homo sapiens
cctgctggcacctc

SEQ ID NO: 2879568 - DNA, 17 bp, Homo sapiens
cctgctggcacctcaga

SEQ ID NO: 2879569 - DNA, 19 bp, Homo sapiens
cctggagccgtggccgagg

SEQ ID NO: 2879570 - DNA, 18 bp, Homo sapiens
cctggaggggctgaatgt

SEQ ID NO: 2879571 - DNA, 13 bp, Homo sapiens
cctggccccctcc

SEQ ID NO: 2879572 - DNA, 12 bp, Homo sapiens
cctggcctgggt

SEQ ID NO: 2879573 - DNA, 12 bp, Homo sapiens
cctggcctggtc

SEQ ID NO: 2879574 - DNA, 17 bp, Homo sapiens
cctgggcatactaataa

SEQ ID NO: 2879575 - DNA, 13 bp, Homo sapiens
cctggggctgggt

SEQ ID NO: 2879576 - DNA, 17 bp, Homo sapiens
cctggttccctctttcc

SEQ ID NO: 2879577 - DNA, 14 bp, Homo sapiens
cctgtagctctgcc

SEQ ID NO: 2879578 - DNA, 16 bp, Homo sapiens
cctgtagctctgcctc

SEQ ID NO: 2879579 - DNA, 20 bp, Homo sapiens
cctgtagctctgcctccctc

SEQ ID NO: 2879580 - DNA, 20 bp, Homo sapiens
cctgtatataatactaaagt

SEQ ID NO: 2879581 - DNA, 14 bp, Homo sapiens
cctgtctctgcctg

SEQ ID NO: 2879582 - DNA, 16 bp, Homo sapiens
cctgtctctgcctgcg

SEQ ID NO: 2879583 - DNA, 19 bp, Homo sapiens
cctgtgatgcctgacacag

SEQ ID NO: 2879584 - DNA, 21 bp, Homo sapiens
cctgtgccaggactctctttc

SEQ ID NO: 2879585 - DNA, 19 bp, Homo sapiens
cctgtggcgctgcagcagg

SEQ ID NO: 2879586 - DNA, 14 bp, Homo sapiens
cctgtgggccagga

SEQ ID NO: 2879587 - DNA, 20 bp, Homo sapiens
cctgtgggccaggagctcag

SEQ ID NO: 2879588 - DNA, 21 bp, Homo sapiens
cctgtgggccaggagctcagc

SEQ ID NO: 2879589 - DNA, 13 bp, Homo sapiens
cctgttccctacc

SEQ ID NO: 2879590 - DNA, 14 bp, Homo sapiens
cctgttccctaccc

SEQ ID NO: 2879591 - DNA, 22 bp, Homo sapiens
cctgttcctgccttctcttcta

SEQ ID NO: 2879592 - DNA, 17 bp, Homo sapiens
cctgtttgggaggctgg

SEQ ID NO: 2879593 - DNA, 20 bp, Homo sapiens
cctgtttgggaggctggagt

SEQ ID NO: 2879594 - DNA, 18 bp, Homo sapiens
cctgttttccacaccatc

SEQ ID NO: 2879595 - DNA, 18 bp, Homo sapiens
ccttcatcgaacaaactg

SEQ ID NO: 2879596 - DNA, 19 bp, Homo sapiens
ccttcctttaggtctggtt

SEQ ID NO: 2879597 - DNA, 19 bp, Homo sapiens
ccttctcgtcttcctctct

SEQ ID NO: 2879598 - DNA, 15 bp, Homo sapiens
ccttgtcctctcccg

SEQ ID NO: 2879599 - DNA, 15 bp, Homo sapiens
ccttgtgtctgttgc

SEQ ID NO: 2879600 - DNA, 16 bp, Homo sapiens
cctttccctcaccccc

SEQ ID NO: 2879601 - DNA, 19 bp, Homo sapiens
cctttccttctcgtcttcc

SEQ ID NO: 2879602 - DNA, 12 bp, Homo sapiens
cctttgaagagg

SEQ ID NO: 2879603 - DNA, 15 bp, Homo sapiens
cctttgttgctgtct

SEQ ID NO: 2879604 - DNA, 17 bp, Homo sapiens
cctttgttgctgtctgg

SEQ ID NO: 2879605 - DNA, 22 bp, Homo sapiens
ccttttcaaatcaagaaaataa

SEQ ID NO: 2879606 - DNA, 23 bp, Homo sapiens
ccttttcccaaaatgttgaaata

SEQ ID NO: 2879607 - DNA, 10 bp, Homo sapiens
cgactccagc

SEQ ID NO: 2879608 - DNA, 12 bp, Homo sapiens
cgactccagcca

SEQ ID NO: 2879609 - DNA, 13 bp, Homo sapiens
cgagaggtccctg

SEQ ID NO: 2879610 - DNA, 14 bp, Homo sapiens
cgaggtccagaccc

SEQ ID NO: 2879611 - DNA, 19 bp, Homo sapiens
cgcatccgcctctgagcca

SEQ ID NO: 2879612 - DNA, 19 bp, Homo sapiens
cgccactcatttcatctca

SEQ ID NO: 2879613 - DNA, 12 bp, Homo sapiens
cgcctctgagcc

SEQ ID NO: 2879614 - DNA, 21 bp, Homo sapiens
cgcctctgagccaggagcctc

SEQ ID NO: 2879615 - DNA, 15 bp, Homo sapiens
cgctaaaagaaactt

SEQ ID NO: 2879616 - DNA, 22 bp, Homo sapiens
cggcacctgcgagaggtccctg

SEQ ID NO: 2879617 - DNA, 12 bp, Homo sapiens
cggcagcctggt

SEQ ID NO: 2879618 - DNA, 21 bp, Homo sapiens
cggcccagaagtttccctcaa

SEQ ID NO: 2879619 - DNA, 20 bp, Homo sapiens
cggtggctcacgcctgtaat

SEQ ID NO: 2879620 - DNA, 15 bp, Homo sapiens
cgtatttaatagcaa

SEQ ID NO: 2879621 - DNA, 22 bp, Homo sapiens
cgtccccccccaacctttccct

SEQ ID NO: 2879622 - DNA, 12 bp, Homo sapiens
cgtctcctctcc

SEQ ID NO: 2879623 - DNA, 22 bp, Homo sapiens
cgtgcactccctaagaaacccc

SEQ ID NO: 2879624 - DNA, 17 bp, Homo sapiens
cgtgccagctctagttt

SEQ ID NO: 2879625 - DNA, 19 bp, Homo sapiens
cgtgcgtgtgtgtgtgttt

SEQ ID NO: 2879626 - DNA, 17 bp, Homo sapiens
cgtttaagccaaaacaa

SEQ ID NO: 2879627 - DNA, 13 bp, Homo sapiens
ctaaaagaaactt

SEQ ID NO: 2879628 - DNA, 16 bp, Homo sapiens
gccaggagcctcctga

SEQ ID NO: 2879629 - DNA, 13 bp, Homo sapiens
gccagtcctgcaa

SEQ ID NO: 2879630 - DNA, 20 bp, Homo sapiens
gccatgccaataaagtgatc

SEQ ID NO: 2879631 - DNA, 17 bp, Homo sapiens
gcccaagaggactgaga

SEQ ID NO: 2879632 - DNA, 20 bp, Homo sapiens
gcccaagaggactgagactg

SEQ ID NO: 2879633 - DNA, 11 bp, Homo sapiens
gcccagcctgg

SEQ ID NO: 2879634 - DNA, 15 bp, Homo sapiens
gcccagcctggagcc

SEQ ID NO: 2879635 - DNA, 16 bp, Homo sapiens
gcccagcctggagccg

SEQ ID NO: 2879636 - DNA, 13 bp, Homo sapiens
gcccagctctgag

SEQ ID NO: 2879637 - DNA, 16 bp, Homo sapiens
gcccagtgacctgacc

SEQ ID NO: 2879638 - DNA, 17 bp, Homo sapiens
gcccagtgacctgaccg

SEQ ID NO: 2879639 - DNA, 15 bp, Homo sapiens
gccccctccctggat

SEQ ID NO: 2879640 - DNA, 19 bp, Homo sapiens
gccccgactccagccagcg

SEQ ID NO: 2879641 - DNA, 13 bp, Homo sapiens
gcccgaagcccag

SEQ ID NO: 2879642 - DNA, 14 bp, Homo sapiens
gccctgctgtggga

SEQ ID NO: 2879643 - DNA, 15 bp, Homo sapiens
gccgtactgtctatg

SEQ ID NO: 2879644 - DNA, 16 bp, Homo sapiens
gcctagtggggagggg

SEQ ID NO: 2879645 - DNA, 20 bp, Homo sapiens
gcctagtggggaggggcctg

SEQ ID NO: 2879646 - DNA, 16 bp, Homo sapiens
gcctccctccacccca

SEQ ID NO: 2879647 - DNA, 23 bp, Homo sapiens
gcctccctctccatatctccttc

SEQ ID NO: 2879648 - DNA, 14 bp, Homo sapiens
gcctctcccacgat

SEQ ID NO: 2879649 - DNA, 12 bp, Homo sapiens
gcctctgagcca

SEQ ID NO: 2879650 - DNA, 22 bp, Homo sapiens
gcctgacacaggggacactgaa

SEQ ID NO: 2879651 - DNA, 14 bp, Homo sapiens
gcctggagccgtgg

SEQ ID NO: 2879652 - DNA, 21 bp, Homo sapiens
gcctgggtggggcagggcctg

SEQ ID NO: 2879653 - DNA, 15 bp, Homo sapiens
gcctggttccctctt

SEQ ID NO: 2879654 - DNA, 21 bp, Homo sapiens
gcctggttccctctttcctgt

SEQ ID NO: 2879655 - DNA, 24 bp, Homo sapiens
gcctggttccctctttcctgtgcc

SEQ ID NO: 2879656 - DNA, 11 bp, Homo sapiens
gcctgtgggag

SEQ ID NO: 2879657 - DNA, 20 bp, Homo sapiens
gcgaaaacttgaatctgtta

SEQ ID NO: 2879658 - DNA, 14 bp, Homo sapiens
gcgcctccctccac

SEQ ID NO: 2879659 - DNA, 16 bp, Homo sapiens
gcgcctccctccaccc

SEQ ID NO: 2879660 - DNA, 21 bp, Homo sapiens
gcgcctccctccaccccagga

SEQ ID NO: 2879661 - DNA, 23 bp, Homo sapiens
gcgcctccctccaccccaggacg

SEQ ID NO: 2879662 - DNA, 19 bp, Homo sapiens
gcggcccagaagtttccct

SEQ ID NO: 2879663 - DNA, 21 bp, Homo sapiens
gctaactccagtctcctgaca

SEQ ID NO: 2879664 - DNA, 20 bp, Homo sapiens
gctaattttttgttgtttct

SEQ ID NO: 2879665 - DNA, 21 bp, Homo sapiens
gctaatttttttgtattttag

SEQ ID NO: 2879666 - DNA, 16 bp, Homo sapiens
gctactcctgtgctct

SEQ ID NO: 2879667 - DNA, 18 bp, Homo sapiens
gctatgtttttaatgtat

SEQ ID NO: 2879668 - DNA, 14 bp, Homo sapiens
gctattccctggag

SEQ ID NO: 2879669 - DNA, 23 bp, Homo sapiens
gctattttatattacactacaca

SEQ ID NO: 2879670 - DNA, 16 bp, Homo sapiens
gctcacattccctctc

SEQ ID NO: 2879671 - DNA, 18 bp, Homo sapiens
gctcacattccctctcat

SEQ ID NO: 2879672 - DNA, 20 bp, Homo sapiens
gctcacattccctctcatcc

SEQ ID NO: 2879673 - DNA, 17 bp, Homo sapiens
gctcagacttgccaggc

SEQ ID NO: 2879674 - DNA, 14 bp, Homo sapiens
gctccagggccagg

SEQ ID NO: 2879675 - DNA, 13 bp, Homo sapiens
gctccctttctct

SEQ ID NO: 2879676 - DNA, 14 bp, Homo sapiens
gctctgtattctgc

SEQ ID NO: 2879677 - DNA, 15 bp, Homo sapiens
gctctgtattctgca

SEQ ID NO: 2879678 - DNA, 17 bp, Homo sapiens
gctgagagccctgctgt

SEQ ID NO: 2879679 - DNA, 21 bp, Homo sapiens
gctggaaaggatgcttctgct

SEQ ID NO: 2879680 - DNA, 19 bp, Homo sapiens
gctggcagctgagagccct

SEQ ID NO: 2879681 - DNA, 11 bp, Homo sapiens
gctggctcacc

SEQ ID NO: 2879682 - DNA, 23 bp, Homo sapiens
gctgggcactgggccggcagcct

SEQ ID NO: 2879683 - DNA, 15 bp, Homo sapiens
gctggtttaatgttt

SEQ ID NO: 2879684 - DNA, 20 bp, Homo sapiens
gctgtactgagttctcatcc

SEQ ID NO: 2879685 - DNA, 18 bp, Homo sapiens
gctgtcatggaaaagccc

SEQ ID NO: 2879686 - DNA, 21 bp, Homo sapiens
gctgtcatggaaaagcccagt

SEQ ID NO: 2879687 - DNA, 16 bp, Homo sapiens
gcttcctgggtcctgt

SEQ ID NO: 2879688 - DNA, 12 bp, Homo sapiens
gcttctgctcac

SEQ ID NO: 2879689 - DNA, 21 bp, Homo sapiens
gcttctgctcacattccctct

SEQ ID NO: 2879690 - DNA, 22 bp, Homo sapiens
gcttctgtgcatttgtgtctgc

SEQ ID NO: 2879691 - DNA, 13 bp, Homo sapiens
gcttggttggctg

SEQ ID NO: 2879692 - DNA, 20 bp, Homo sapiens
gctttgtcacttttcctttt

SEQ ID NO: 2879693 - DNA, 17 bp, Homo sapiens
gcttttgccttttcaaa

SEQ ID NO: 2879694 - DNA, 19 bp, Homo sapiens
ggaataaggtacaagaagc

SEQ ID NO: 2879695 - DNA, 16 bp, Homo sapiens
ggacacttatggggac

SEQ ID NO: 2879696 - DNA, 18 bp, Homo sapiens
ggaccctgttttccacac

SEQ ID NO: 2879697 - DNA, 23 bp, Homo sapiens
ggacgaaaaacacagtgcactca

SEQ ID NO: 2879698 - DNA, 20 bp, Homo sapiens
ggacgccactcatttcatct

SEQ ID NO: 2879699 - DNA, 19 bp, Homo sapiens
ggactatgaaaagctagaa

SEQ ID NO: 2879700 - DNA, 14 bp, Homo sapiens
ggagaagacccacg

SEQ ID NO: 2879701 - DNA, 12 bp, Homo sapiens
ggagaggaaaga

SEQ ID NO: 2879702 - DNA, 21 bp, Homo sapiens
ggagcagctgggcactgggcc

SEQ ID NO: 2879703 - DNA, 20 bp, Homo sapiens
ggagcctcctgaccctgtga

SEQ ID NO: 2879704 - DNA, 20 bp, Homo sapiens
ggaggcgcagcccgaagccc

SEQ ID NO: 2879705 - DNA, 14 bp, Homo sapiens
ggagtctgagtctg

SEQ ID NO: 2879706 - DNA, 22 bp, Homo sapiens
ggagtctgagtctgagtcctgt

SEQ ID NO: 2879707 - DNA, 16 bp, Homo sapiens
ggatatgtaaaacatt

SEQ ID NO: 2879708 - DNA, 13 bp, Homo sapiens
ggatccccctctt

SEQ ID NO: 2879709 - DNA, 15 bp, Homo sapiens
ggatggaaggagact

SEQ ID NO: 2879710 - DNA, 19 bp, Homo sapiens
ggatggtcatcgtgacagc

SEQ ID NO: 2879711 - DNA, 19 bp, Homo sapiens
ggatttatttaaaatagca

SEQ ID NO: 2879712 - DNA, 23 bp, Homo sapiens
ggcacctcagacaatccactctc

SEQ ID NO: 2879713 - DNA, 20 bp, Homo sapiens
ggcactgggccggcagcctg

SEQ ID NO: 2879714 - DNA, 22 bp, Homo sapiens
ggcacttagcccaagaggtctg

SEQ ID NO: 2879715 - DNA, 14 bp, Homo sapiens
ggcagggcctggcc

SEQ ID NO: 2879716 - DNA, 16 bp, Homo sapiens
ggcatctgttagcaga

SEQ ID NO: 2879717 - DNA, 16 bp, Homo sapiens
ggcatgcgaatgagct

SEQ ID NO: 2879718 - DNA, 19 bp, Homo sapiens
ggcatgcgaatgagctggg

SEQ ID NO: 2879719 - DNA, 19 bp, Homo sapiens
ggcatggcccagcctggag

SEQ ID NO: 2879720 - DNA, 21 bp, Homo sapiens
ggcatggcccagcctggagcc

SEQ ID NO: 2879721 - DNA, 14 bp, Homo sapiens
ggcatgtggagaca

SEQ ID NO: 2879722 - DNA, 14 bp, Homo sapiens
ggccaggagctcag

SEQ ID NO: 2879723 - DNA, 15 bp, Homo sapiens
ggccaggagctcagc

SEQ ID NO: 2879724 - DNA, 21 bp, Homo sapiens
ggccaggatccccctctttgc

SEQ ID NO: 2879725 - DNA, 22 bp, Homo sapiens
ggccaggatccccctctttgca

SEQ ID NO: 2879726 - DNA, 17 bp, Homo sapiens
ggcccagaagtttccct

SEQ ID NO: 2879727 - DNA, 15 bp, Homo sapiens
ggcccagcctggagc

SEQ ID NO: 2879728 - DNA, 21 bp, Homo sapiens
ggcccaggcagacaaccttgt

SEQ ID NO: 2879729 - DNA, 22 bp, Homo sapiens
ggcccaggcagacaaccttgtc

SEQ ID NO: 2879730 - DNA, 16 bp, Homo sapiens
ggccccctccctggat

SEQ ID NO: 2879731 - DNA, 17 bp, Homo sapiens
ggccccctccctggatg

SEQ ID NO: 2879732 - DNA, 18 bp, Homo sapiens
ggccctgccgggaccctg

SEQ ID NO: 2879733 - DNA, 21 bp, Homo sapiens
ggccgagggcttccctagatg

SEQ ID NO: 2879734 - DNA, 13 bp, Homo sapiens
ggcctggcctggt

SEQ ID NO: 2879735 - DNA, 21 bp, Homo sapiens
ggcctgggtggggcagggcct

SEQ ID NO: 2879736 - DNA, 13 bp, Homo sapiens
ggctccagggcca

SEQ ID NO: 2879737 - DNA, 17 bp, Homo sapiens
ggctccagggccagggt

SEQ ID NO: 2879738 - DNA, 13 bp, Homo sapiens
ggctccattccca

SEQ ID NO: 2879739 - DNA, 18 bp, Homo sapiens
ggctgcagagctgaccca

SEQ ID NO: 2879740 - DNA, 22 bp, Homo sapiens
ggctgtaaactataaactactg

SEQ ID NO: 2879741 - DNA, 19 bp, Homo sapiens
ggctgtccaatcacattca

SEQ ID NO: 2879742 - DNA, 11 bp, Homo sapiens
gggacactgaa

SEQ ID NO: 2879743 - DNA, 19 bp, Homo sapiens
gggagcagctgggcactgg

SEQ ID NO: 2879744 - DNA, 13 bp, Homo sapiens
gggcagggcctgg

SEQ ID NO: 2879745 - DNA, 14 bp, Homo sapiens
gggcctggcctggg

SEQ ID NO: 2879746 - DNA, 20 bp, Homo sapiens
gggcttccctagatggttcc

SEQ ID NO: 2879747 - DNA, 19 bp, Homo sapiens
ggggtacatttctctgagc

SEQ ID NO: 2879748 - DNA, 21 bp, Homo sapiens
tctctataagtgttcagtgtt

SEQ ID NO: 2879749 - DNA, 22 bp, Homo sapiens
tctctataagtgttcagtgttg

SEQ ID NO: 2879750 - DNA, 16 bp, Homo sapiens
tctctcacctacttcc

SEQ ID NO: 2879751 - DNA, 18 bp, Homo sapiens
tctcttctatcctgcaat

SEQ ID NO: 2879752 - DNA, 16 bp, Homo sapiens
tctgaataacactgga

SEQ ID NO: 2879753 - DNA, 15 bp, Homo sapiens
tctgaatttttaaac

SEQ ID NO: 2879754 - DNA, 17 bp, Homo sapiens
tctgaatttttaaacaa

SEQ ID NO: 2879755 - DNA, 22 bp, Homo sapiens
tctgagcagtcagggtgggaag

SEQ ID NO: 2879756 - DNA, 14 bp, Homo sapiens
tctgagtcctgtct

SEQ ID NO: 2879757 - DNA, 22 bp, Homo sapiens
tctgagtcctgtctctgcctgc

SEQ ID NO: 2879758 - DNA, 17 bp, Homo sapiens
tctgagtctgagtcctg

SEQ ID NO: 2879759 - DNA, 19 bp, Homo sapiens
tctgattatacaccatttt

SEQ ID NO: 2879760 - DNA, 14 bp, Homo sapiens
tctgattttggcat

SEQ ID NO: 2879761 - DNA, 13 bp, Homo sapiens
tctgccctgtata

SEQ ID NO: 2879762 - DNA, 17 bp, Homo sapiens
tctgctcacattccctc

SEQ ID NO: 2879763 - DNA, 18 bp, Homo sapiens
tctgctcacattccctct

SEQ ID NO: 2879764 - DNA, 23 bp, Homo sapiens
tctgctcacattccctctcatcc

SEQ ID NO: 2879765 - DNA, 17 bp, Homo sapiens
tctggaggctgcagagc

SEQ ID NO: 2879766 - DNA, 15 bp, Homo sapiens
tctggatccctggag

SEQ ID NO: 2879767 - DNA, 12 bp, Homo sapiens
tctgggcagctg

SEQ ID NO: 2879768 - DNA, 14 bp, Homo sapiens
tctgtattctgcaa

SEQ ID NO: 2879769 - DNA, 16 bp, Homo sapiens
tctgtcccctctcccc

SEQ ID NO: 2879770 - DNA, 19 bp, Homo sapiens
tctgtgcatttgtgtctgc

SEQ ID NO: 2879771 - DNA, 23 bp, Homo sapiens
tctgtgcatttgtgtctgcctgc

SEQ ID NO: 2879772 - DNA, 15 bp, Homo sapiens
tcttaaataagaaac

SEQ ID NO: 2879773 - DNA, 16 bp, Homo sapiens
tcttaaataagaaact

SEQ ID NO: 2879774 - DNA, 13 bp, Homo sapiens
tcttcctctctct

SEQ ID NO: 2879775 - DNA, 15 bp, Homo sapiens
tcttcctctctctca

SEQ ID NO: 2879776 - DNA, 14 bp, Homo sapiens
tctttcctgtgcca

SEQ ID NO: 2879777 - DNA, 17 bp, Homo sapiens
tctttctcactaaatct

SEQ ID NO: 2879778 - DNA, 18 bp, Homo sapiens
tctttctcactaaatctt

SEQ ID NO: 2879779 - DNA, 14 bp, Homo sapiens
tgaaaattatttaa

SEQ ID NO: 2879780 - DNA, 17 bp, Homo sapiens
tgaaaattatttaaacc

SEQ ID NO: 2879781 - DNA, 15 bp, Homo sapiens
tgaaataaaatggtg

SEQ ID NO: 2879782 - DNA, 21 bp, Homo sapiens
tgaaatgaggagagaaggaca

SEQ ID NO: 2879783 - DNA, 14 bp, Homo sapiens
tgaacctatccttc

SEQ ID NO: 2879784 - DNA, 16 bp, Homo sapiens
tgaagaatacttctca

SEQ ID NO: 2879785 - DNA, 12 bp, Homo sapiens
tgaagaggaaaa

SEQ ID NO: 2879786 - DNA, 16 bp, Homo sapiens
tgaagaggaaaatgaa

SEQ ID NO: 2879787 - DNA, 17 bp, Homo sapiens
tgaatctgttactgaaa

SEQ ID NO: 2879788 - DNA, 21 bp, Homo sapiens
tgaatggctatgtttttaatg

SEQ ID NO: 2879789 - DNA, 19 bp, Homo sapiens
tgaattagaaacataaata

SEQ ID NO: 2879790 - DNA, 21 bp, Homo sapiens
tgaattagaaacataaataaa

SEQ ID NO: 2879791 - DNA, 23 bp, Homo sapiens
tgaatttttaaacaagtatttgt

SEQ ID NO: 2879792 - DNA, 19 bp, Homo sapiens
tgacacaggggacactgaa

SEQ ID NO: 2879793 - DNA, 15 bp, Homo sapiens
tgacatagcctttgt

SEQ ID NO: 2879794 - DNA, 19 bp, Homo sapiens
tgaccatcgtccttcctct

SEQ ID NO: 2879795 - DNA, 20 bp, Homo sapiens
tgaccctgtgatgcctgaca

SEQ ID NO: 2879796 - DNA, 15 bp, Homo sapiens
tgagaaatttaaact

SEQ ID NO: 2879797 - DNA, 19 bp, Homo sapiens
tgagaagccaaagccccta

SEQ ID NO: 2879798 - DNA, 19 bp, Homo sapiens
tgagccaaacacactgtaa

SEQ ID NO: 2879799 - DNA, 18 bp, Homo sapiens
tgagccaggagcctcctg

SEQ ID NO: 2879800 - DNA, 13 bp, Homo sapiens
tgaggtctggatt

SEQ ID NO: 2879801 - DNA, 14 bp, Homo sapiens
tgagtcctgtctct

SEQ ID NO: 2879802 - DNA, 18 bp, Homo sapiens
tgagtcctgtctctgcct

SEQ ID NO: 2879803 - DNA, 19 bp, Homo sapiens
tgagtcctgtctctgcctg

SEQ ID NO: 2879804 - DNA, 14 bp, Homo sapiens
tgagttctcatcca

SEQ ID NO: 2879805 - DNA, 20 bp, Homo sapiens
tgataaagattttttaataa

SEQ ID NO: 2879806 - DNA, 16 bp, Homo sapiens
tgataatgaacagaac

SEQ ID NO: 2879807 - DNA, 13 bp, Homo sapiens
tgataattttaaa

SEQ ID NO: 2879808 - DNA, 13 bp, Homo sapiens
tgatctgtcccct

SEQ ID NO: 2879809 - DNA, 15 bp, Homo sapiens
tgatgcctgacacag

SEQ ID NO: 2879810 - DNA, 20 bp, Homo sapiens
tgatgcctgacacaggggac

SEQ ID NO: 2879811 - DNA, 13 bp, Homo sapiens
tgatgttaaaaaa

SEQ ID NO: 2879812 - DNA, 14 bp, Homo sapiens
tgatgttaaaaaaa

SEQ ID NO: 2879813 - DNA, 23 bp, Homo sapiens
tgatgttaaaaaaataagaagaa

SEQ ID NO: 2879814 - DNA, 17 bp, Homo sapiens
tgattcctttgaagagg

SEQ ID NO: 2879815 - DNA, 20 bp, Homo sapiens
tgattcctttgaagaggaaa

SEQ ID NO: 2879816 - DNA, 13 bp, Homo sapiens
tgattgtcttaat

SEQ ID NO: 2879817 - DNA, 18 bp, Homo sapiens
tgattgtcttaatattgt

SEQ ID NO: 2879818 - DNA, 11 bp, Homo sapiens
tgcaacttttt

SEQ ID NO: 2879819 - DNA, 23 bp, Homo sapiens
tgcaagtccatagctgagctgga

SEQ ID NO: 2879820 - DNA, 13 bp, Homo sapiens
tgcacctaaagaa

SEQ ID NO: 2879821 - DNA, 19 bp, Homo sapiens
tgcactccctaagaaaccc

SEQ ID NO: 2879822 - DNA, 18 bp, Homo sapiens
tgcagagctgacccagag

SEQ ID NO: 2879823 - DNA, 18 bp, Homo sapiens
tgcagatggtgagagata

SEQ ID NO: 2879824 - DNA, 15 bp, Homo sapiens
tgcagtattgccaca

SEQ ID NO: 2879825 - DNA, 13 bp, Homo sapiens
tgcagtctcagaa

SEQ ID NO: 2879826 - DNA, 16 bp, Homo sapiens
tgccaaaaaaaaatac

SEQ ID NO: 2879827 - DNA, 14 bp, Homo sapiens
tgccaataaagtga

SEQ ID NO: 2879828 - DNA, 20 bp, Homo sapiens
tgccaataaagtgatctgtg

SEQ ID NO: 2879829 - DNA, 16 bp, Homo sapiens
tgccacaatgcctctc

SEQ ID NO: 2879830 - DNA, 21 bp, Homo sapiens
tgccacaatgcctctcccacg

SEQ ID NO: 2879831 - DNA, 23 bp, Homo sapiens
tgccaggctccctttctcttctt

SEQ ID NO: 2879832 - DNA, 19 bp, Homo sapiens
tgcccagccctaaacatca

SEQ ID NO: 2879833 - DNA, 14 bp, Homo sapiens
tgcccccatcccac

SEQ ID NO: 2879834 - DNA, 17 bp, Homo sapiens
tgccctgtatataatac

SEQ ID NO: 2879835 - DNA, 20 bp, Homo sapiens
tgccctgtatataatactaa

SEQ ID NO: 2879836 - DNA, 23 bp, Homo sapiens
tgccctgtatataatactaaagt

SEQ ID NO: 2879837 - DNA, 12 bp, Homo sapiens
tgccttttcaaa

SEQ ID NO: 2879838 - DNA, 21 bp, Homo sapiens
tgcgaaaacttgaatctgtta

SEQ ID NO: 2879839 - DNA, 19 bp, Homo sapiens
tgcgaggtcgcaactgaga

SEQ ID NO: 2879840 - DNA, 17 bp, Homo sapiens
tgcgcaacaacaaggac

SEQ ID NO: 2879841 - DNA, 18 bp, Homo sapiens
tgcgcaacaacaaggacc

SEQ ID NO: 2879842 - DNA, 19 bp, Homo sapiens
tgcgcaacaacaaggaccc

SEQ ID NO: 2879843 - DNA, 18 bp, Homo sapiens
tgcgtgtgtgtgtgtttg

SEQ ID NO: 2879844 - DNA, 16 bp, Homo sapiens
tgctaagagaagtaga

SEQ ID NO: 2879845 - DNA, 12 bp, Homo sapiens
tgctactcctgt

SEQ ID NO: 2879846 - DNA, 15 bp, Homo sapiens
tgctactcctgtgct

SEQ ID NO: 2879847 - DNA, 16 bp, Homo sapiens
tgctactcctgtgctc

SEQ ID NO: 2879848 - DNA, 17 bp, Homo sapiens
tgctactcctgtgctct

SEQ ID NO: 2879849 - DNA, 13 bp, Homo sapiens
tgctattgaactg

SEQ ID NO: 2879850 - DNA, 16 bp, Homo sapiens
tgctattgaactgagc

SEQ ID NO: 2879851 - DNA, 14 bp, Homo sapiens
tgctcacaggcagg

SEQ ID NO: 2879852 - DNA, 12 bp, Homo sapiens
tgcttctgctca

SEQ ID NO: 2879853 - DNA, 23 bp, Homo sapiens
tgcttctgctcacattccctctc

SEQ ID NO: 2879854 - DNA, 12 bp, Homo sapiens
tgcttctgtgca

SEQ ID NO: 2879855 - DNA, 19 bp, Homo sapiens
tggaaaggagaggaaagaa

SEQ ID NO: 2879856 - DNA, 23 bp, Homo sapiens
tggagacactcctataaggagag

SEQ ID NO: 2879857 - DNA, 16 bp, Homo sapiens
tggagtctgagtctga

SEQ ID NO: 2879858 - DNA, 15 bp, Homo sapiens
tggattctaaaatgc

SEQ ID NO: 2879859 - DNA, 18 bp, Homo sapiens
tggcacttagcccaagag

SEQ ID NO: 2879860 - DNA, 23 bp, Homo sapiens
tggcacttagcccaagaggtctg

SEQ ID NO: 2879861 - DNA, 16 bp, Homo sapiens
tggcagtttatattta

SEQ ID NO: 2879862 - DNA, 21 bp, Homo sapiens
tggcctgggtggggcagggcc

SEQ ID NO: 2879863 - DNA, 15 bp, Homo sapiens
tggcctggtccaggc

SEQ ID NO: 2879864 - DNA, 15 bp, Homo sapiens
tggctcgctccctgt

SEQ ID NO: 2879865 - DNA, 14 bp, Homo sapiens
tggctgataatttt

SEQ ID NO: 2879866 - DNA, 22 bp, Homo sapiens
tggctggcagctgagagccctg

SEQ ID NO: 2879867 - DNA, 16 bp, Homo sapiens
tggctgtaaactataa

SEQ ID NO: 2879868 - DNA, 21 bp, Homo sapiens
tggctgtaaactataaactac

SEQ ID NO: 2879869 - DNA, 22 bp, Homo sapiens
ttccttctcgtcttcctctctc

SEQ ID NO: 2879870 - DNA, 14 bp, Homo sapiens
ttcctttgaagagg

SEQ ID NO: 2879871 - DNA, 15 bp, Homo sapiens
ttcctttgaagagga

SEQ ID NO: 2879872 - DNA, 17 bp, Homo sapiens
ttctatagccaaaaata

SEQ ID NO: 2879873 - DNA, 21 bp, Homo sapiens
ttctatagccaaaaatagcta

SEQ ID NO: 2879874 - DNA, 23 bp, Homo sapiens
ttctatagccaaaaatagctaaa

SEQ ID NO: 2879875 - DNA, 15 bp, Homo sapiens
ttctcactaaatctt

SEQ ID NO: 2879876 - DNA, 23 bp, Homo sapiens
ttctcattttttaaaaaagctta

SEQ ID NO: 2879877 - DNA, 16 bp, Homo sapiens
ttctccaagagctaca

SEQ ID NO: 2879878 - DNA, 18 bp, Homo sapiens
ttctcgtcttcctctctc

SEQ ID NO: 2879879 - DNA, 16 bp, Homo sapiens
ttctgcaacagcctgt

SEQ ID NO: 2879880 - DNA, 17 bp, Homo sapiens
ttctgctcacattccct

SEQ ID NO: 2879881 - DNA, 18 bp, Homo sapiens
ttctgctcacattccctc

SEQ ID NO: 2879882 - DNA, 20 bp, Homo sapiens
ttctgctcacattccctctc

SEQ ID NO: 2879883 - DNA, 22 bp, Homo sapiens
ttctgtggaagtagctttgaac

SEQ ID NO: 2879884 - DNA, 18 bp, Homo sapiens
ttcttaaataagaaactt

SEQ ID NO: 2879885 - DNA, 19 bp, Homo sapiens
ttcttaaataagaaacttt

SEQ ID NO: 2879886 - DNA, 15 bp, Homo sapiens
ttctttctcactaaa

SEQ ID NO: 2879887 - DNA, 16 bp, Homo sapiens
ttctttgtaaaggtca

SEQ ID NO: 2879888 - DNA, 22 bp, Homo sapiens
ttgaactgagccaaacacactg

SEQ ID NO: 2879889 - DNA, 13 bp, Homo sapiens
ttgaagaggaaaa

SEQ ID NO: 2879890 - DNA, 21 bp, Homo sapiens
ttgaagaggaaaatgaataat

SEQ ID NO: 2879891 - DNA, 16 bp, Homo sapiens
ttgaatggctatgttt

SEQ ID NO: 2879892 - DNA, 23 bp, Homo sapiens
ttgaattagaaacataaataaaa

SEQ ID NO: 2879893 - DNA, 19 bp, Homo sapiens
ttgacataaagttgataaa

SEQ ID NO: 2879894 - DNA, 14 bp, Homo sapiens
ttgacatagccttt

SEQ ID NO: 2879895 - DNA, 15 bp, Homo sapiens
ttgacatagcctttg

SEQ ID NO: 2879896 - DNA, 15 bp, Homo sapiens
ttgagatttctttta

SEQ ID NO: 2879897 - DNA, 18 bp, Homo sapiens
ttgagggccttgcacata

SEQ ID NO: 2879898 - DNA, 13 bp, Homo sapiens
ttgatgaatgttg

SEQ ID NO: 2879899 - DNA, 21 bp, Homo sapiens
ttgccacaatgcctctcccac

SEQ ID NO: 2879900 - DNA, 13 bp, Homo sapiens
ttgctacataatt

SEQ ID NO: 2879901 - DNA, 16 bp, Homo sapiens
ttgggaggctgaggta

SEQ ID NO: 2879902 - DNA, 15 bp, Homo sapiens
ttgggaggctggagt

SEQ ID NO: 2879903 - DNA, 22 bp, Homo sapiens
ttgggaggttttattctgactt

SEQ ID NO: 2879904 - DNA, 15 bp, Homo sapiens
ttgggatatctcctg

SEQ ID NO: 2879905 - DNA, 22 bp, Homo sapiens
ttggtgttacacagcccaagag

SEQ ID NO: 2879906 - DNA, 15 bp, Homo sapiens
ttgtcacttttcctt

SEQ ID NO: 2879907 - DNA, 20 bp, Homo sapiens
ttgtcccaaggaatcagcag

SEQ ID NO: 2879908 - DNA, 17 bp, Homo sapiens
ttgtcttaatattgtgg

SEQ ID NO: 2879909 - DNA, 23 bp, Homo sapiens
ttgtgcaatgtaaatattttaaa

SEQ ID NO: 2879910 - DNA, 15 bp, Homo sapiens
ttgtgtctgcctgcc

SEQ ID NO: 2879911 - DNA, 19 bp, Homo sapiens
ttgtgtctggcagtttata

SEQ ID NO: 2879912 - DNA, 12 bp, Homo sapiens
ttgtgtctgttg

SEQ ID NO: 2879913 - DNA, 21 bp, Homo sapiens
ttgttaatttagaaaacttta

SEQ ID NO: 2879914 - DNA, 22 bp, Homo sapiens
ttgttaatttagaaaactttaa

SEQ ID NO: 2879915 - DNA, 15 bp, Homo sapiens
ttgtttcttaaataa

SEQ ID NO: 2879916 - DNA, 14 bp, Homo sapiens
tttaaaaaagctta

SEQ ID NO: 2879917 - DNA, 23 bp, Homo sapiens
tttaaaaaagcttaaaactttga

SEQ ID NO: 2879918 - DNA, 17 bp, Homo sapiens
tttaaaccgctaaaaga

SEQ ID NO: 2879919 - DNA, 21 bp, Homo sapiens
tttaaaccgctaaaagaaact

SEQ ID NO: 2879920 - DNA, 18 bp, Homo sapiens
tttaagccaaaacaatgt

SEQ ID NO: 2879921 - DNA, 11 bp, Homo sapiens
tttaataattt

SEQ ID NO: 2879922 - DNA, 12 bp, Homo sapiens
tttactttgaac

SEQ ID NO: 2879923 - DNA, 13 bp, Homo sapiens
tttagaaaacttt

SEQ ID NO: 2879924 - DNA, 14 bp, Homo sapiens
tttagaaaacttta

SEQ ID NO: 2879925 - DNA, 15 bp, Homo sapiens
tttagaaaactttaa

SEQ ID NO: 2879926 - DNA, 15 bp, Homo sapiens
tttagacttcaagca

SEQ ID NO: 2879927 - DNA, 21 bp, Homo sapiens
tttagtagcagtgattgtctt

SEQ ID NO: 2879928 - DNA, 16 bp, Homo sapiens
tttatattacactaca

SEQ ID NO: 2879929 - DNA, 22 bp, Homo sapiens
tttatttaaaaaactaaaaact

SEQ ID NO: 2879930 - DNA, 11 bp, Homo sapiens
tttcaggacag

SEQ ID NO: 2879931 - DNA, 21 bp, Homo sapiens
tttcatctcatttaagggaaa

SEQ ID NO: 2879932 - DNA, 22 bp, Homo sapiens
tttcatctcatttaagggaaaa

SEQ ID NO: 2879933 - DNA, 15 bp, Homo sapiens
tttccctcaccccct

SEQ ID NO: 2879934 - DNA, 18 bp, Homo sapiens
tttccttcaaagtttaat

SEQ ID NO: 2879935 - DNA, 19 bp, Homo sapiens
tttcttaaataagaaactt

SEQ ID NO: 2879936 - DNA, 15 bp, Homo sapiens
tttctttgtaaaggt

SEQ ID NO: 2879937 - DNA, 20 bp, Homo sapiens
tttcttttaaagaagtaaat

SEQ ID NO: 2879938 - DNA, 15 bp, Homo sapiens
tttgaaaaagcgaaa

SEQ ID NO: 2879939 - DNA, 23 bp, Homo sapiens
tttgaaaaagcgaaaaaatcagg

SEQ ID NO: 2879940 - DNA, 19 bp, Homo sapiens
tttgagcagatcttggaat

SEQ ID NO: 2879941 - DNA, 16 bp, Homo sapiens
tttgatactaagcatt

SEQ ID NO: 2879942 - DNA, 17 bp, Homo sapiens
tttgatactaagcattg

SEQ ID NO: 2879943 - DNA, 15 bp, Homo sapiens
tttggatatgtaaaa

SEQ ID NO: 2879944 - DNA, 19 bp, Homo sapiens
tttggtttcccaagagcta

SEQ ID NO: 2879945 - DNA, 16 bp, Homo sapiens
tttgtaagttgaagca

SEQ ID NO: 2879946 - DNA, 20 bp, Homo sapiens
tttgtaagttgaagcaaatc

SEQ ID NO: 2879947 - DNA, 22 bp, Homo sapiens
tttgtccaatggctgtaaacta

SEQ ID NO: 2879948 - DNA, 22 bp, Homo sapiens
tttgtgagcatgggtgtgccct

SEQ ID NO: 2879949 - DNA, 14 bp, Homo sapiens
tttgtggtcacagc

SEQ ID NO: 2879950 - DNA, 13 bp, Homo sapiens
tttgtgtttcaga

SEQ ID NO: 2879951 - DNA, 21 bp, Homo sapiens
tttgttaatttagaaaacttt

SEQ ID NO: 2879952 - DNA, 22 bp, Homo sapiens
tttgttaatttagaaaacttta

SEQ ID NO: 2879953 - DNA, 19 bp, Homo sapiens
tttgttagactagtttctt

SEQ ID NO: 2879954 - DNA, 17 bp, Homo sapiens
ttttaaaaaagcttaaa

SEQ ID NO: 2879955 - DNA, 20 bp, Homo sapiens
ttttaaaaaagcttaaaact

SEQ ID NO: 2879956 - DNA, 22 bp, Homo sapiens
ttttaaaaaagcttaaaacttt

SEQ ID NO: 2879957 - DNA, 17 bp, Homo sapiens
ttttaaagaagtaaatt

SEQ ID NO: 2879958 - DNA, 18 bp, Homo sapiens
ttttaggaagcaagctta

SEQ ID NO: 2879959 - DNA, 23 bp, Homo sapiens
ttttcagtcaagttccgtctcct

SEQ ID NO: 2879960 - DNA, 18 bp, Homo sapiens
ttttcccaaaatgttgaa

SEQ ID NO: 2879961 - DNA, 16 bp, Homo sapiens
ttttccttcaaagttt

SEQ ID NO: 2879962 - DNA, 18 bp, Homo sapiens
ttttccttttcttaaaac

SEQ ID NO: 2879963 - DNA, 18 bp, Homo sapiens
ttttgatactaagcattg

SEQ ID NO: 2879964 - DNA, 19 bp, Homo sapiens
ttttgttgtttcttaaata

SEQ ID NO: 2879965 - DNA, 17 bp, Homo sapiens
tttttaaaaaagcttaa

SEQ ID NO: 2879966 - DNA, 16 bp, Homo sapiens
tttttaaacaagtatt

SEQ ID NO: 2879967 - DNA, 18 bp, Homo sapiens
tttttaatgtatagtaaa

SEQ ID NO: 2879968 - DNA, 23 bp, Homo sapiens
tttttgctgctacttctgtggaa

SEQ ID NO: 2879969 - DNA, 12 bp, Homo sapiens
aaaaaaaataca

SEQ ID NO: 2879970 - DNA, 18 bp, Homo sapiens
aaaaagcgaaaaaatcag

SEQ ID NO: 2879971 - DNA, 17 bp, Homo sapiens
aaaaagcttaaaacttt

SEQ ID NO: 2879972 - DNA, 19 bp, Homo sapiens
aaaaagcttaaaactttga

SEQ ID NO: 2879973 - DNA, 19 bp, Homo sapiens
aaaaatgtccagccacccc

SEQ ID NO: 2879974 - DNA, 12 bp, Homo sapiens
aaaacatttatt

SEQ ID NO: 2879975 - DNA, 13 bp, Homo sapiens
aaaacatttattt

SEQ ID NO: 2879976 - DNA, 22 bp, Homo sapiens
aaaacatttattttgacataaa

SEQ ID NO: 2879977 - DNA, 17 bp, Homo sapiens
aaaaccataaaataaat

SEQ ID NO: 2879978 - DNA, 13 bp, Homo sapiens
aaaactaaaaact

SEQ ID NO: 2879979 - DNA, 15 bp, Homo sapiens
aaaacttgaatctgt

SEQ ID NO: 2879980 - DNA, 20 bp, Homo sapiens
aaaacttgaatctgttactg

SEQ ID NO: 2879981 - DNA, 13 bp, Homo sapiens
aaaactttaaagc

SEQ ID NO: 2879982 - DNA, 11 bp, Homo sapiens
aaaagaagtaa

SEQ ID NO: 2879983 - DNA, 16 bp, Homo sapiens
aaaagcaaaaaagaaa

SEQ ID NO: 2879984 - DNA, 13 bp, Homo sapiens
aaaatagtttgga

SEQ ID NO: 2879985 - DNA, 19 bp, Homo sapiens
aaaatagtttggatatgta

SEQ ID NO: 2879986 - DNA, 22 bp, Homo sapiens
aaaatagtttggatatgtaaaa

SEQ ID NO: 2879987 - DNA, 20 bp, Homo sapiens
aaaatgaccagtaattgtga

SEQ ID NO: 2879988 - DNA, 17 bp, Homo sapiens
aaaatgttgaaatatga

SEQ ID NO: 2879989 - DNA, 13 bp, Homo sapiens
aaaattatttaaa

SEQ ID NO: 2879990 - DNA, 12 bp, Homo sapiens
aaaattgaatgc

SEQ ID NO: 2879991 - DNA, 14 bp, Homo sapiens
aaacaaagccatgc

SEQ ID NO: 2879992 - DNA, 13 bp, Homo sapiens
aaacaagtatttg

SEQ ID NO: 2879993 - DNA, 23 bp, Homo sapiens
aaacaagtatttgttaatttaga

SEQ ID NO: 2879994 - DNA, 14 bp, Homo sapiens
aaacaatgtttaaa

SEQ ID NO: 2879995 - DNA, 14 bp, Homo sapiens
aaacacactgtaaa

SEQ ID NO: 2879996 - DNA, 17 bp, Homo sapiens
aaacataaataaaatga

SEQ ID NO: 2879997 - DNA, 19 bp, Homo sapiens
aaacatcattcatttttgt

SEQ ID NO: 2879998 - DNA, 14 bp, Homo sapiens
aaacatttattttg

SEQ ID NO: 2879999 - DNA, 18 bp, Homo sapiens
aaacatttattttgacat

SEQ ID NO: 2880000 - DNA, 15 bp, Homo sapiens
aaaccgctaaaagaa

SEQ ID NO: 2880001 - DNA, 16 bp, Homo sapiens
aaaccgctaaaagaaa

SEQ ID NO: 2880002 - DNA, 18 bp, Homo sapiens
aaaccgctaaaagaaact

SEQ ID NO: 2880003 - DNA, 21 bp, Homo sapiens
aaaccgctaaaagaaactttc

SEQ ID NO: 2880004 - DNA, 14 bp, Homo sapiens
aaactactgtaatt

SEQ ID NO: 2880005 - DNA, 22 bp, Homo sapiens
aaactagaggtgagaaatttaa

SEQ ID NO: 2880006 - DNA, 22 bp, Homo sapiens
aaactataaactactgtaatta

SEQ ID NO: 2880007 - DNA, 18 bp, Homo sapiens
aaacttgaatctgttact

SEQ ID NO: 2880008 - DNA, 21 bp, Homo sapiens
aaacttgaatctgttactgaa

SEQ ID NO: 2880009 - DNA, 22 bp, Homo sapiens
aaacttgaatctgttactgaaa

SEQ ID NO: 2880010 - DNA, 13 bp, Homo sapiens
aaagaaaaacaaa

SEQ ID NO: 2880011 - DNA, 12 bp, Homo sapiens
aaagaaactttc

SEQ ID NO: 2880012 - DNA, 16 bp, Homo sapiens
aaagaagtaaatttgt

SEQ ID NO: 2880013 - DNA, 20 bp, Homo sapiens
aaagaagtaaatttgtccaa

SEQ ID NO: 2880014 - DNA, 18 bp, Homo sapiens
aaagagatggcctgagaa

SEQ ID NO: 2880015 - DNA, 20 bp, Homo sapiens
aaagagttcaagaaataagt

SEQ ID NO: 2880016 - DNA, 20 bp, Homo sapiens
aaagataccatgtataattt

SEQ ID NO: 2880017 - DNA, 21 bp, Homo sapiens
aaagataccatgtataatttt

SEQ ID NO: 2880018 - DNA, 13 bp, Homo sapiens
aaagattttttaa

SEQ ID NO: 2880019 - DNA, 21 bp, Homo sapiens
aaagattttttaataatttag

SEQ ID NO: 2880020 - DNA, 15 bp, Homo sapiens
aaagcaaaaaagaaa

SEQ ID NO: 2880021 - DNA, 21 bp, Homo sapiens
aaagcaaaaaagaaaaccttt

SEQ ID NO: 2880022 - DNA, 22 bp, Homo sapiens
aaagccatgccaataaagtgat

SEQ ID NO: 2880023 - DNA, 16 bp, Homo sapiens
aaagcgaaaaaatcag

SEQ ID NO: 2880024 - DNA, 14 bp, Homo sapiens
aaagcgtttgcaca

SEQ ID NO: 2880025 - DNA, 20 bp, Homo sapiens
aaagctagaattgagtgttt

SEQ ID NO: 2880026 - DNA, 16 bp, Homo sapiens
aaaggtttatgaaaaa

SEQ ID NO: 2880027 - DNA, 19 bp, Homo sapiens
aaaggtttatgaaaaagaa

SEQ ID NO: 2880028 - DNA, 20 bp, Homo sapiens
aaagtttaacctaaataatt

SEQ ID NO: 2880029 - DNA, 18 bp, Homo sapiens
aaataaaatggtgaaaga

SEQ ID NO: 2880030 - DNA, 20 bp, Homo sapiens
aaataaatttttataaggaa

SEQ ID NO: 2880031 - DNA, 13 bp, Homo sapiens
aaataagtttttg

SEQ ID NO: 2880032 - DNA, 13 bp, Homo sapiens
aaataattatgca

SEQ ID NO: 2880033 - DNA, 13 bp, Homo sapiens
aaatacatgctaa

SEQ ID NO: 2880034 - DNA, 20 bp, Homo sapiens
aaatagtttggatatgtaaa

SEQ ID NO: 2880035 - DNA, 22 bp, Homo sapiens
aaatatatatctatctatttga

SEQ ID NO: 2880036 - DNA, 15 bp, Homo sapiens
aaatattttaaagaa

SEQ ID NO: 2880037 - DNA, 20 bp, Homo sapiens
aaatcgaatgaaattaactg

SEQ ID NO: 2880038 - DNA, 13 bp, Homo sapiens
aaatctatgccac

SEQ ID NO: 2880039 - DNA, 14 bp, Homo sapiens
aaatctatgccact

SEQ ID NO: 2880040 - DNA, 20 bp, Homo sapiens
aaatctatgccactcagaat

SEQ ID NO: 2880041 - DNA, 12 bp, Homo sapiens
aaatctcattcc

SEQ ID NO: 2880042 - DNA, 18 bp, Homo sapiens
aaatcttttataggattt

SEQ ID NO: 2880043 - DNA, 12 bp, Homo sapiens
aaatgaggagag

SEQ ID NO: 2880044 - DNA, 20 bp, Homo sapiens
aaatgtttatacaataattt

SEQ ID NO: 2880045 - DNA, 13 bp, Homo sapiens
aaattgaatgcaa

SEQ ID NO: 2880046 - DNA, 19 bp, Homo sapiens
aaatttaaactataagcaa

SEQ ID NO: 2880047 - DNA, 24 bp, Homo sapiens
aaatttgtccaatggctgtaaact

SEQ ID NO: 2880048 - DNA, 20 bp, Homo sapiens
aacaaactcgttttttacaa

SEQ ID NO: 2880049 - DNA, 12 bp, Homo sapiens
aacaacagaaac

SEQ ID NO: 2880050 - DNA, 15 bp, Homo sapiens
aacaaggaccctgtt

SEQ ID NO: 2880051 - DNA, 12 bp, Homo sapiens
aacaagtatttg

SEQ ID NO: 2880052 - DNA, 12 bp, Homo sapiens
aacacactgtaa

SEQ ID NO: 2880053 - DNA, 14 bp, Homo sapiens
aacacactgtaaat

SEQ ID NO: 2880054 - DNA, 15 bp, Homo sapiens
aacacactgtaaata

SEQ ID NO: 2880055 - DNA, 17 bp, Homo sapiens
aacataaataaaatgac

SEQ ID NO: 2880056 - DNA, 18 bp, Homo sapiens
aacataaataaaatgacc

SEQ ID NO: 2880057 - DNA, 22 bp, Homo sapiens
aacatcctaagtgggaagtgaa

SEQ ID NO: 2880058 - DNA, 21 bp, Homo sapiens
aacccctcccctccatccctg

SEQ ID NO: 2880059 - DNA, 14 bp, Homo sapiens
aacctcagtaattt

SEQ ID NO: 2880060 - DNA, 18 bp, Homo sapiens
aacctcagtaatttagaa

SEQ ID NO: 2880061 - DNA, 18 bp, Homo sapiens
aacctttcttcaccaaat

SEQ ID NO: 2880062 - DNA, 14 bp, Homo sapiens
aactacagtctaaa

SEQ ID NO: 2880063 - DNA, 23 bp, Homo sapiens
aactactgtaattaagtgcaatt

SEQ ID NO: 2880064 - DNA, 17 bp, Homo sapiens
aactataaactactgta

SEQ ID NO: 2880065 - DNA, 13 bp, Homo sapiens
aactctaattcta

SEQ ID NO: 2880066 - DNA, 12 bp, Homo sapiens
aactgaaaatta

SEQ ID NO: 2880067 - DNA, 13 bp, Homo sapiens
aactgaaaattat

SEQ ID NO: 2880068 - DNA, 20 bp, Homo sapiens
aactgatgcgaaaacttgaa

SEQ ID NO: 2880069 - DNA, 21 bp, Homo sapiens
aactgatgcgaaaacttgaat

SEQ ID NO: 2880070 - DNA, 19 bp, Homo sapiens
aactggctgtttgatagca

SEQ ID NO: 2880071 - DNA, 13 bp, Homo sapiens
aacttgaatctgt

SEQ ID NO: 2880072 - DNA, 22 bp, Homo sapiens
aacttggttttgctacataatt

SEQ ID NO: 2880073 - DNA, 23 bp, Homo sapiens
aacttttttatttaaaaaactaa

SEQ ID NO: 2880074 - DNA, 16 bp, Homo sapiens
aagaaacaaggttttc

SEQ ID NO: 2880075 - DNA, 23 bp, Homo sapiens
aagaaactttctttctcactaaa

SEQ ID NO: 2880076 - DNA, 19 bp, Homo sapiens
aagaaggcaaaaatagttt

SEQ ID NO: 2880077 - DNA, 17 bp, Homo sapiens
aagaagtaaatttgtcc

SEQ ID NO: 2880078 - DNA, 12 bp, Homo sapiens
aagaatctcatc

SEQ ID NO: 2880079 - DNA, 20 bp, Homo sapiens
aagaatctcatctcagtgaa

SEQ ID NO: 2880080 - DNA, 16 bp, Homo sapiens
aagaatgcaagagtgg

SEQ ID NO: 2880081 - DNA, 17 bp, Homo sapiens
aagaatgcttaatcaga

SEQ ID NO: 2880082 - DNA, 14 bp, Homo sapiens
aagacacacctctg

SEQ ID NO: 2880083 - DNA, 14 bp, Homo sapiens
aagagctacataat

SEQ ID NO: 2880084 - DNA, 16 bp, Homo sapiens
caataaagtgatctgt

SEQ ID NO: 2880085 - DNA, 16 bp, Homo sapiens
caatccactctcagga

SEQ ID NO: 2880086 - DNA, 18 bp, Homo sapiens
caatgcacctaaagaaaa

SEQ ID NO: 2880087 - DNA, 16 bp, Homo sapiens
caatgcctctcccacg

SEQ ID NO: 2880088 - DNA, 15 bp, Homo sapiens
caatggctgtaaact

SEQ ID NO: 2880089 - DNA, 17 bp, Homo sapiens
caatgggggagggaggg

SEQ ID NO: 2880090 - DNA, 19 bp, Homo sapiens
caatgtaaatattttaaag

SEQ ID NO: 2880091 - DNA, 13 bp, Homo sapiens
caattcaaagctg

SEQ ID NO: 2880092 - DNA, 21 bp, Homo sapiens
caattgcacgcggagtgagtt

SEQ ID NO: 2880093 - DNA, 22 bp, Homo sapiens
caatttctcccgaatcctgagg

SEQ ID NO: 2880094 - DNA, 17 bp, Homo sapiens
cacaccatcaccctctg

SEQ ID NO: 2880095 - DNA, 11 bp, Homo sapiens
cacactgtaaa

SEQ ID NO: 2880096 - DNA, 12 bp, Homo sapiens
cacactgtaaat

SEQ ID NO: 2880097 - DNA, 14 bp, Homo sapiens
cacactgtaaatat

SEQ ID NO: 2880098 - DNA, 22 bp, Homo sapiens
cacactgtaaatatccacagac

SEQ ID NO: 2880099 - DNA, 13 bp, Homo sapiens
cacagactccctc

SEQ ID NO: 2880100 - DNA, 14 bp, Homo sapiens
cacagaggccaggc

SEQ ID NO: 2880101 - DNA, 16 bp, Homo sapiens
cacaggggacactgaa

SEQ ID NO: 2880102 - DNA, 16 bp, Homo sapiens
cacataggaaactttt

SEQ ID NO: 2880103 - DNA, 13 bp, Homo sapiens
cacattccctctc

SEQ ID NO: 2880104 - DNA, 17 bp, Homo sapiens
cacattccctctcatcc

SEQ ID NO: 2880105 - DNA, 12 bp, Homo sapiens
caccatctgctt

SEQ ID NO: 2880106 - DNA, 18 bp, Homo sapiens
caccccaggacgccactc

SEQ ID NO: 2880107 - DNA, 12 bp, Homo sapiens
cacccccagccc

SEQ ID NO: 2880108 - DNA, 19 bp, Homo sapiens
caccccctcccacccccag

SEQ ID NO: 2880109 - DNA, 17 bp, Homo sapiens
caccctctgggcagctg

SEQ ID NO: 2880110 - DNA, 22 bp, Homo sapiens
caccctctgggcagctgtcatg

SEQ ID NO: 2880111 - DNA, 12 bp, Homo sapiens
cacctaaagaaa

SEQ ID NO: 2880112 - DNA, 19 bp, Homo sapiens
cacctgcgagaggtccctg

SEQ ID NO: 2880113 - DNA, 20 bp, Homo sapiens
cacgattacgtgaataaaat

SEQ ID NO: 2880114 - DNA, 13 bp, Homo sapiens
cactcatttcatc

SEQ ID NO: 2880115 - DNA, 22 bp, Homo sapiens
cactgttgggtgggtgggccct

SEQ ID NO: 2880116 - DNA, 22 bp, Homo sapiens
cacttacttcgtgcgcaacaac

SEQ ID NO: 2880117 - DNA, 19 bp, Homo sapiens
cacttcccatttgtgtttc

SEQ ID NO: 2880118 - DNA, 13 bp, Homo sapiens
cacttttcctttt

SEQ ID NO: 2880119 - DNA, 20 bp, Homo sapiens
cacttttccttttcttaaaa

SEQ ID NO: 2880120 - DNA, 15 bp, Homo sapiens
cagaagaaaaagttg

SEQ ID NO: 2880121 - DNA, 21 bp, Homo sapiens
cagaagaaaaagttgcagtct

SEQ ID NO: 2880122 - DNA, 23 bp, Homo sapiens
cagaataaatgggtaacactgat

SEQ ID NO: 2880123 - DNA, 13 bp, Homo sapiens
cagacaaccttgt

SEQ ID NO: 2880124 - DNA, 15 bp, Homo sapiens
cagacaatccactct

SEQ ID NO: 2880125 - DNA, 18 bp, Homo sapiens
cagagtaacatgccagct

SEQ ID NO: 2880126 - DNA, 18 bp, Homo sapiens
cagagtcagaggagaaga

SEQ ID NO: 2880127 - DNA, 12 bp, Homo sapiens
cagagtctgtct

SEQ ID NO: 2880128 - DNA, 15 bp, Homo sapiens
cagagtggagtctga

SEQ ID NO: 2880129 - DNA, 22 bp, Homo sapiens
cagataactgaaaattatttaa

SEQ ID NO: 2880130 - DNA, 15 bp, Homo sapiens
cagatcgatcctgga

SEQ ID NO: 2880131 - DNA, 13 bp, Homo sapiens
cagatcttggaat

SEQ ID NO: 2880132 - DNA, 17 bp, Homo sapiens
cagccacccccaggcat

SEQ ID NO: 2880133 - DNA, 17 bp, Homo sapiens
cagccagcgcctccctc

SEQ ID NO: 2880134 - DNA, 20 bp, Homo sapiens
cagccagcgcctccctccac

SEQ ID NO: 2880135 - DNA, 22 bp, Homo sapiens
cagccagcgcctccctccaccc

SEQ ID NO: 2880136 - DNA, 20 bp, Homo sapiens
cagccaggaggggctgtcca

SEQ ID NO: 2880137 - DNA, 18 bp, Homo sapiens
cagccccgactccagcca

SEQ ID NO: 2880138 - DNA, 19 bp, Homo sapiens
cagcccctggtactccccc

SEQ ID NO: 2880139 - DNA, 15 bp, Homo sapiens
cagcccgaagcccag

SEQ ID NO: 2880140 - DNA, 17 bp, Homo sapiens
cagcccgaagcccagtt

SEQ ID NO: 2880141 - DNA, 16 bp, Homo sapiens
cagccctaaacatcat

SEQ ID NO: 2880142 - DNA, 13 bp, Homo sapiens
cagccctcagttt

SEQ ID NO: 2880143 - DNA, 16 bp, Homo sapiens
cagcctggagccgtgg

SEQ ID NO: 2880144 - DNA, 20 bp, Homo sapiens
cagcctggttccctctttcc

SEQ ID NO: 2880145 - DNA, 22 bp, Homo sapiens
cagcctggttccctctttcctg

SEQ ID NO: 2880146 - DNA, 14 bp, Homo sapiens
cagcgtcccctgct

SEQ ID NO: 2880147 - DNA, 22 bp, Homo sapiens
cagctgcttctgtgcatttgtg

SEQ ID NO: 2880148 - DNA, 14 bp, Homo sapiens
cagctgtactgagt

SEQ ID NO: 2880149 - DNA, 16 bp, Homo sapiens
cagctgtactgagttc

SEQ ID NO: 2880150 - DNA, 20 bp, Homo sapiens
cagctgtcatggaaaagccc

SEQ ID NO: 2880151 - DNA, 21 bp, Homo sapiens
cagctgtcatggaaaagccca

SEQ ID NO: 2880152 - DNA, 13 bp, Homo sapiens
caggaaaattgaa

SEQ ID NO: 2880153 - DNA, 17 bp, Homo sapiens
caggaaaattgaatgca

SEQ ID NO: 2880154 - DNA, 16 bp, Homo sapiens
caggaaggactatgaa

SEQ ID NO: 2880155 - DNA, 19 bp, Homo sapiens
caggaaggactatgaaaag

SEQ ID NO: 2880156 - DNA, 14 bp, Homo sapiens
caggaggcgcagcc

SEQ ID NO: 2880157 - DNA, 22 bp, Homo sapiens
caggaggcgcagcccgaagccc

SEQ ID NO: 2880158 - DNA, 23 bp, Homo sapiens
caggaggcgcagcccgaagccca

SEQ ID NO: 2880159 - DNA, 20 bp, Homo sapiens
caggatgtgtgggccaggat

SEQ ID NO: 2880160 - DNA, 22 bp, Homo sapiens
caggatgtgtgggccaggatcc

SEQ ID NO: 2880161 - DNA, 17 bp, Homo sapiens
caggcagacaaccttgt

SEQ ID NO: 2880162 - DNA, 20 bp, Homo sapiens
caggcatgcgaatgagctgg

SEQ ID NO: 2880163 - DNA, 17 bp, Homo sapiens
caggcatggcccagcct

SEQ ID NO: 2880164 - DNA, 21 bp, Homo sapiens
caggcatggcccagcctggag

SEQ ID NO: 2880165 - DNA, 14 bp, Homo sapiens
cagggcctggcctg

SEQ ID NO: 2880166 - DNA, 22 bp, Homo sapiens
caggggacactgaaccttgttg

SEQ ID NO: 2880167 - DNA, 20 bp, Homo sapiens
cagggtgggaagaaagaatg

SEQ ID NO: 2880168 - DNA, 22 bp, Homo sapiens
caggtccttcctttaggtctgg

SEQ ID NO: 2880169 - DNA, 14 bp, Homo sapiens
cagtaatttagaaa

SEQ ID NO: 2880170 - DNA, 21 bp, Homo sapiens
cagtattgccacaatgcctct

SEQ ID NO: 2880171 - DNA, 20 bp, Homo sapiens
cagtatttattttttcaaaa

SEQ ID NO: 2880172 - DNA, 15 bp, Homo sapiens
cagtctcagaaagcc

SEQ ID NO: 2880173 - DNA, 19 bp, Homo sapiens
cagtctcagaatgtcattt

SEQ ID NO: 2880174 - DNA, 14 bp, Homo sapiens
cagtctcctgacat

SEQ ID NO: 2880175 - DNA, 15 bp, Homo sapiens
cagtctcctgacatt

SEQ ID NO: 2880176 - DNA, 16 bp, Homo sapiens
cagtgattgtcttaat

SEQ ID NO: 2880177 - DNA, 13 bp, Homo sapiens
cagtggctcgctc

SEQ ID NO: 2880178 - DNA, 18 bp, Homo sapiens
cagtggctcgctccctgt

SEQ ID NO: 2880179 - DNA, 16 bp, Homo sapiens
cagtgttgacatagcc

SEQ ID NO: 2880180 - DNA, 21 bp, Homo sapiens
cagtgttgacatagcctttgt

SEQ ID NO: 2880181 - DNA, 16 bp, Homo sapiens
cataaaataaattttt

SEQ ID NO: 2880182 - DNA, 19 bp, Homo sapiens
cataaagcaattgtgaaat

SEQ ID NO: 2880183 - DNA, 20 bp, Homo sapiens
catagacagaagaaacaagg

SEQ ID NO: 2880184 - DNA, 15 bp, Homo sapiens
catcaccctctgggc

SEQ ID NO: 2880185 - DNA, 12 bp, Homo sapiens
catcccacatga

SEQ ID NO: 2880186 - DNA, 15 bp, Homo sapiens
catccgcctctgagc

SEQ ID NO: 2880187 - DNA, 18 bp, Homo sapiens
catccgcctctgagccag

SEQ ID NO: 2880188 - DNA, 23 bp, Homo sapiens
catctcatttaagggaaaaatat

SEQ ID NO: 2880189 - DNA, 18 bp, Homo sapiens
catctgcttggttggctg

SEQ ID NO: 2880190 - DNA, 22 bp, Homo sapiens
catctgcttggttggctggcag

SEQ ID NO: 2880191 - DNA, 18 bp, Homo sapiens
catctgttagcagagtct

SEQ ID NO: 2880192 - DNA, 22 bp, Homo sapiens
catctgttagcagagtctgtct

SEQ ID NO: 2880193 - DNA, 18 bp, Homo sapiens
catgactgcccagctctg

SEQ ID NO: 2880194 - DNA, 18 bp, Homo sapiens
catgataatgaacagaac

SEQ ID NO: 2880195 - DNA, 16 bp, Homo sapiens
catgctaagagaagta

SEQ ID NO: 2880196 - DNA, 17 bp, Homo sapiens
catggaaaagcccagtg

SEQ ID NO: 2880197 - DNA, 14 bp, Homo sapiens
catggctattttat

SEQ ID NO: 2880198 - DNA, 23 bp, Homo sapiens
catgtgactgtattacctattca

SEQ ID NO: 2880199 - DNA, 18 bp, Homo sapiens
catgtgctattgaactga

SEQ ID NO: 2880200 - DNA, 20 bp, Homo sapiens
catgtgctattgaactgagc

SEQ ID NO: 2880201 - DNA, 23 bp, Homo sapiens
cattcccagagtcagaggagaag

SEQ ID NO: 2880202 - DNA, 22 bp, Homo sapiens
cattgaatggctatgtttttaa

SEQ ID NO: 2880203 - DNA, 14 bp, Homo sapiens
cattgaattagaaa

SEQ ID NO: 2880204 - DNA, 13 bp, Homo sapiens
gcccagcctggag

SEQ ID NO: 2880205 - DNA, 18 bp, Homo sapiens
gcccccatcccacatgat

SEQ ID NO: 2880206 - DNA, 14 bp, Homo sapiens
gccccctccctgga

SEQ ID NO: 2880207 - DNA, 13 bp, Homo sapiens
gccccgactccag

SEQ ID NO: 2880208 - DNA, 15 bp, Homo sapiens
gccccgactccagcc

SEQ ID NO: 2880209 - DNA, 16 bp, Homo sapiens
gccccgactccagcca

SEQ ID NO: 2880210 - DNA, 21 bp, Homo sapiens
gccccgactccagccagcgcc

SEQ ID NO: 2880211 - DNA, 12 bp, Homo sapiens
gcccgaagccca

SEQ ID NO: 2880212 - DNA, 17 bp, Homo sapiens
gccctgctgtgggagag

SEQ ID NO: 2880213 - DNA, 14 bp, Homo sapiens
gccggcagcctggt

SEQ ID NO: 2880214 - DNA, 17 bp, Homo sapiens
gccgtgcactccctaag

SEQ ID NO: 2880215 - DNA, 15 bp, Homo sapiens
gcctaatggagaaga

SEQ ID NO: 2880216 - DNA, 21 bp, Homo sapiens
gcctagtggggaggggcctgg

SEQ ID NO: 2880217 - DNA, 22 bp, Homo sapiens
gcctcaaagcaagcattcagaa

SEQ ID NO: 2880218 - DNA, 14 bp, Homo sapiens
gcctccctccaccc

SEQ ID NO: 2880219 - DNA, 17 bp, Homo sapiens
gcctccctccaccccag

SEQ ID NO: 2880220 - DNA, 18 bp, Homo sapiens
gcctccctccaccccagg

SEQ ID NO: 2880221 - DNA, 20 bp, Homo sapiens
gcctccctccaccccaggac

SEQ ID NO: 2880222 - DNA, 21 bp, Homo sapiens
gcctccctctccatatctcct

SEQ ID NO: 2880223 - DNA, 19 bp, Homo sapiens
gcctctcgctcctcaaccc

SEQ ID NO: 2880224 - DNA, 14 bp, Homo sapiens
gcctctgagccagg

SEQ ID NO: 2880225 - DNA, 15 bp, Homo sapiens
gcctctgagccagga

SEQ ID NO: 2880226 - DNA, 20 bp, Homo sapiens
gcctctgagccaggagcctc

SEQ ID NO: 2880227 - DNA, 17 bp, Homo sapiens
gcctgtttgggaggctg

SEQ ID NO: 2880228 - DNA, 19 bp, Homo sapiens
gcctgtttgggaggctgga

SEQ ID NO: 2880229 - DNA, 21 bp, Homo sapiens
gcctgtttgggaggctggagt

SEQ ID NO: 2880230 - DNA, 18 bp, Homo sapiens
gccttctcttctatcctg

SEQ ID NO: 2880231 - DNA, 12 bp, Homo sapiens
gccttttcaaat

SEQ ID NO: 2880232 - DNA, 15 bp, Homo sapiens
gcgcagcccgaagcc

SEQ ID NO: 2880233 - DNA, 19 bp, Homo sapiens
gcgcagcccgaagcccagt

SEQ ID NO: 2880234 - DNA, 19 bp, Homo sapiens
gcgtcccctgctactcctg

SEQ ID NO: 2880235 - DNA, 11 bp, Homo sapiens
gcgtgcagatg

SEQ ID NO: 2880236 - DNA, 16 bp, Homo sapiens
gctaaaagaaactttc

SEQ ID NO: 2880237 - DNA, 14 bp, Homo sapiens
gctaagagaagtag

SEQ ID NO: 2880238 - DNA, 14 bp, Homo sapiens
gctactcctgtgct

SEQ ID NO: 2880239 - DNA, 16 bp, Homo sapiens
gctactttgctgctat

SEQ ID NO: 2880240 - DNA, 23 bp, Homo sapiens
gctactttgctgctatggttttc

SEQ ID NO: 2880241 - DNA, 15 bp, Homo sapiens
gctattccctggaga

SEQ ID NO: 2880242 - DNA, 15 bp, Homo sapiens
gctcacattccctct

SEQ ID NO: 2880243 - DNA, 23 bp, Homo sapiens
gctcacattccctctcatccagg

SEQ ID NO: 2880244 - DNA, 22 bp, Homo sapiens
gctcagacttgccaggctccct

SEQ ID NO: 2880245 - DNA, 19 bp, Homo sapiens
gctcagccgtgcactccct

SEQ ID NO: 2880246 - DNA, 15 bp, Homo sapiens
gctccattcccatca

SEQ ID NO: 2880247 - DNA, 21 bp, Homo sapiens
gctcctcaacccctcccctcc

SEQ ID NO: 2880248 - DNA, 23 bp, Homo sapiens
gctcgctccctgtagctctgcct

SEQ ID NO: 2880249 - DNA, 13 bp, Homo sapiens
gctgagagccctg

SEQ ID NO: 2880250 - DNA, 11 bp, Homo sapiens
gctgagctgga

SEQ ID NO: 2880251 - DNA, 12 bp, Homo sapiens
gctgataatttt

SEQ ID NO: 2880252 - DNA, 13 bp, Homo sapiens
gctgataatttta

SEQ ID NO: 2880253 - DNA, 17 bp, Homo sapiens
gctgtcatggaaaagcc

SEQ ID NO: 2880254 - DNA, 20 bp, Homo sapiens
gctgtcatggaaaagcccag

SEQ ID NO: 2880255 - DNA, 15 bp, Homo sapiens
gctgtccctcctgag

SEQ ID NO: 2880256 - DNA, 12 bp, Homo sapiens
gcttaaaacttt

SEQ ID NO: 2880257 - DNA, 13 bp, Homo sapiens
gcttaaaactttg

SEQ ID NO: 2880258 - DNA, 22 bp, Homo sapiens
gcttatgacagaggttttgaaa

SEQ ID NO: 2880259 - DNA, 11 bp, Homo sapiens
gcttcctgggt

SEQ ID NO: 2880260 - DNA, 20 bp, Homo sapiens
gcttcctgtgggccaggagc

SEQ ID NO: 2880261 - DNA, 19 bp, Homo sapiens
gcttctgctcacattccct

SEQ ID NO: 2880262 - DNA, 20 bp, Homo sapiens
ggaaccaccgaagaggaagc

SEQ ID NO: 2880263 - DNA, 23 bp, Homo sapiens
ggaaccagtaggttgaggacagg

SEQ ID NO: 2880264 - DNA, 19 bp, Homo sapiens
ggaagacttgaagcacaga

SEQ ID NO: 2880265 - DNA, 15 bp, Homo sapiens
ggaagcaagaaagcc

SEQ ID NO: 2880266 - DNA, 13 bp, Homo sapiens
ggaagtgaagccc

SEQ ID NO: 2880267 - DNA, 23 bp, Homo sapiens
ggacaaagaaatagcaagagatg

SEQ ID NO: 2880268 - DNA, 19 bp, Homo sapiens
ggacactgaaccttgttga

SEQ ID NO: 2880269 - DNA, 12 bp, Homo sapiens
ggagagtggcat

SEQ ID NO: 2880270 - DNA, 21 bp, Homo sapiens
ggagagttcaagcctgtggga

SEQ ID NO: 2880271 - DNA, 23 bp, Homo sapiens
ggaggcgcagcccgaagcccagt

SEQ ID NO: 2880272 - DNA, 14 bp, Homo sapiens
ggaggctgcagagc

SEQ ID NO: 2880273 - DNA, 16 bp, Homo sapiens
ggagtctgagtctgag

SEQ ID NO: 2880274 - DNA, 18 bp, Homo sapiens
ggagtctgagtctgagtc

SEQ ID NO: 2880275 - DNA, 20 bp, Homo sapiens
ggatgaggggcttcctgggt

SEQ ID NO: 2880276 - DNA, 22 bp, Homo sapiens
ggatggtcatcgtgacagcagc

SEQ ID NO: 2880277 - DNA, 14 bp, Homo sapiens
ggatttatttaaaa

SEQ ID NO: 2880278 - DNA, 17 bp, Homo sapiens
ggcacttagcccaagag

SEQ ID NO: 2880279 - DNA, 15 bp, Homo sapiens
ggcagggcctggcct

SEQ ID NO: 2880280 - DNA, 18 bp, Homo sapiens
ggcatcaaagatgagaag

SEQ ID NO: 2880281 - DNA, 23 bp, Homo sapiens
ggcatgcgaatgagctgggccct

SEQ ID NO: 2880282 - DNA, 24 bp, Homo sapiens
ggcatgcgaatgagctgggccctg

SEQ ID NO: 2880283 - DNA, 20 bp, Homo sapiens
ggcatggcccagcctggagc

SEQ ID NO: 2880284 - DNA, 13 bp, Homo sapiens
ggccccctccctg

SEQ ID NO: 2880285 - DNA, 14 bp, Homo sapiens
ggccggcagcctgg

SEQ ID NO: 2880286 - DNA, 18 bp, Homo sapiens
ggcgcagcccgaagccca

SEQ ID NO: 2880287 - DNA, 19 bp, Homo sapiens
ggcgcagcccgaagcccag

SEQ ID NO: 2880288 - DNA, 20 bp, Homo sapiens
ggctagagtgcggtggcgcg

SEQ ID NO: 2880289 - DNA, 22 bp, Homo sapiens
ggctcgctccctgtagctctgc

SEQ ID NO: 2880290 - DNA, 16 bp, Homo sapiens
ggctctgtattctgca

SEQ ID NO: 2880291 - DNA, 20 bp, Homo sapiens
ggctctgtattctgcaacag

SEQ ID NO: 2880292 - DNA, 18 bp, Homo sapiens
ggctgtttgatagcagaa

SEQ ID NO: 2880293 - DNA, 15 bp, Homo sapiens
gggaagtgaagcccc

SEQ ID NO: 2880294 - DNA, 13 bp, Homo sapiens
gggaggggcctgg

SEQ ID NO: 2880295 - DNA, 15 bp, Homo sapiens
gggcatactaataaa

SEQ ID NO: 2880296 - DNA, 15 bp, Homo sapiens
gggcatcttctggct

SEQ ID NO: 2880297 - DNA, 17 bp, Homo sapiens
gggctattccctggaga

SEQ ID NO: 2880298 - DNA, 17 bp, Homo sapiens
gggcttcctgggtcctg

SEQ ID NO: 2880299 - DNA, 16 bp, Homo sapiens
ggggaggggcctggcc

SEQ ID NO: 2880300 - DNA, 18 bp, Homo sapiens
ggggctattccctggaga

SEQ ID NO: 2880301 - DNA, 15 bp, Homo sapiens
ggggtaagccagagc

SEQ ID NO: 2880302 - DNA, 14 bp, Homo sapiens
ggggtcaaaggaag

SEQ ID NO: 2880303 - DNA, 19 bp, Homo sapiens
gggtaagccagagcctggg

SEQ ID NO: 2880304 - DNA, 17 bp, Homo sapiens
gggtacatttctctgag

SEQ ID NO: 2880305 - DNA, 21 bp, Homo sapiens
gggtcctcatctgcaaagcat

SEQ ID NO: 2880306 - DNA, 21 bp, Homo sapiens
gggtgcaatgataatgaagaa

SEQ ID NO: 2880307 - DNA, 22 bp, Homo sapiens
gggtgggcatcaaagatgagaa

SEQ ID NO: 2880308 - DNA, 12 bp, Homo sapiens
gggtgtgccctt

SEQ ID NO: 2880309 - DNA, 15 bp, Homo sapiens
ggtaagccagagcct

SEQ ID NO: 2880310 - DNA, 14 bp, Homo sapiens
ggtacatttctctg

SEQ ID NO: 2880311 - DNA, 11 bp, Homo sapiens
ggtgggccctg

SEQ ID NO: 2880312 - DNA, 14 bp, Homo sapiens
ggttccctctttcc

SEQ ID NO: 2880313 - DNA, 21 bp, Homo sapiens
ggttgttgcaccatctgcttg

SEQ ID NO: 2880314 - DNA, 22 bp, Homo sapiens
ggttgttgcaccatctgcttgg

SEQ ID NO: 2880315 - DNA, 20 bp, Homo sapiens
ggtttcaccatgttggccag

SEQ ID NO: 2880316 - DNA, 11 bp, Homo sapiens
gtaaaacattt

SEQ ID NO: 2880317 - DNA, 18 bp, Homo sapiens
gtaaaagcaaaaaagaaa

SEQ ID NO: 2880318 - DNA, 19 bp, Homo sapiens
gtaaaagcaaaaaagaaaa

SEQ ID NO: 2880319 - DNA, 22 bp, Homo sapiens
gtaaactataaactactgtaat

SEQ ID NO: 2880320 - DNA, 14 bp, Homo sapiens
gtaaatattttaaa

SEQ ID NO: 2880321 - DNA, 21 bp, Homo sapiens
gtaaatcacgctttttgaaaa

SEQ ID NO: 2880322 - DNA, 13 bp, Homo sapiens
gtaaccaggggct

SEQ ID NO: 2880323 - DNA, 16 bp, Homo sapiens
gtaagccagagcctgg

SEQ ID NO: 2880324 - DNA, 19 bp, Homo sapiens
tggacatgtgtcccagcca

SEQ ID NO: 2880325 - DNA, 21 bp, Homo sapiens
tggactgactaccagctaact

SEQ ID NO: 2880326 - DNA, 13 bp, Homo sapiens
tggagtctgagtc

SEQ ID NO: 2880327 - DNA, 17 bp, Homo sapiens
tggatatgtaaaacatt

SEQ ID NO: 2880328 - DNA, 13 bp, Homo sapiens
tggattctaaaat

SEQ ID NO: 2880329 - DNA, 23 bp, Homo sapiens
tggattttttccttcaaagttta

SEQ ID NO: 2880330 - DNA, 16 bp, Homo sapiens
tggcagctgagagccc

SEQ ID NO: 2880331 - DNA, 20 bp, Homo sapiens
tggccattttgtaccagggc

SEQ ID NO: 2880332 - DNA, 20 bp, Homo sapiens
tggcctagtggggaggggcc

SEQ ID NO: 2880333 - DNA, 22 bp, Homo sapiens
tggcctagtggggaggggcctg

SEQ ID NO: 2880334 - DNA, 15 bp, Homo sapiens
tggcctcaaagcaag

SEQ ID NO: 2880335 - DNA, 14 bp, Homo sapiens
tggcctgagaagag

SEQ ID NO: 2880336 - DNA, 18 bp, Homo sapiens
tggcctgggtggggcagg

SEQ ID NO: 2880337 - DNA, 12 bp, Homo sapiens
tggctattttat

SEQ ID NO: 2880338 - DNA, 14 bp, Homo sapiens
tggctttgtcactt

SEQ ID NO: 2880339 - DNA, 17 bp, Homo sapiens
tgggccaggagctcagc

SEQ ID NO: 2880340 - DNA, 17 bp, Homo sapiens
tgggccggcagcctggt

SEQ ID NO: 2880341 - DNA, 21 bp, Homo sapiens
tggggaggggcctggcctggg

SEQ ID NO: 2880342 - DNA, 19 bp, Homo sapiens
tggggatggggacaaagaa

SEQ ID NO: 2880343 - DNA, 15 bp, Homo sapiens
tggggcagggcctgg

SEQ ID NO: 2880344 - DNA, 17 bp, Homo sapiens
tggggcagggcctggcc

SEQ ID NO: 2880345 - DNA, 15 bp, Homo sapiens
tggggtaagccagag

SEQ ID NO: 2880346 - DNA, 19 bp, Homo sapiens
tggggtaagccagagcctg

SEQ ID NO: 2880347 - DNA, 20 bp, Homo sapiens
tggggtatggattctaaaat

SEQ ID NO: 2880348 - DNA, 18 bp, Homo sapiens
tgggtaatgaaacaaaga

SEQ ID NO: 2880349 - DNA, 21 bp, Homo sapiens
tgggtggggcagggcctggcc

SEQ ID NO: 2880350 - DNA, 14 bp, Homo sapiens
tgggtgtgtttcag

SEQ ID NO: 2880351 - DNA, 18 bp, Homo sapiens
tgggtgtgtttcaggaca

SEQ ID NO: 2880352 - DNA, 22 bp, Homo sapiens
tgggtgtgtttcaggacagctg

SEQ ID NO: 2880353 - DNA, 14 bp, Homo sapiens
tgggtgttaatttt

SEQ ID NO: 2880354 - DNA, 18 bp, Homo sapiens
tggtcatcgtgacagcag

SEQ ID NO: 2880355 - DNA, 21 bp, Homo sapiens
tggtgttacacagcccaagag

SEQ ID NO: 2880356 - DNA, 15 bp, Homo sapiens
tggttcacactgacc

SEQ ID NO: 2880357 - DNA, 24 bp, Homo sapiens
tggttccctctttcctgtgccagg

SEQ ID NO: 2880358 - DNA, 17 bp, Homo sapiens
tggtttcccaagagcta

SEQ ID NO: 2880359 - DNA, 19 bp, Homo sapiens
tggttttctccaagagcta

SEQ ID NO: 2880360 - DNA, 22 bp, Homo sapiens
tgtaaactataaactactgtaa

SEQ ID NO: 2880361 - DNA, 22 bp, Homo sapiens
tgtaaatattttaaagaattgt

SEQ ID NO: 2880362 - DNA, 15 bp, Homo sapiens
tgtaccagggctctg

SEQ ID NO: 2880363 - DNA, 17 bp, Homo sapiens
tgtaccagggctctgta

SEQ ID NO: 2880364 - DNA, 15 bp, Homo sapiens
tgtagtgtgtcagag

SEQ ID NO: 2880365 - DNA, 18 bp, Homo sapiens
tgtatataatactaaagt

SEQ ID NO: 2880366 - DNA, 20 bp, Homo sapiens
tgtattctgcaacagcctgt

SEQ ID NO: 2880367 - DNA, 22 bp, Homo sapiens
tgtcacttttccttttcttaaa

SEQ ID NO: 2880368 - DNA, 20 bp, Homo sapiens
tgtcagagtaacatgccagc

SEQ ID NO: 2880369 - DNA, 15 bp, Homo sapiens
tgtcatggaaaagcc

SEQ ID NO: 2880370 - DNA, 19 bp, Homo sapiens
tgtcatggaaaagcccagt

SEQ ID NO: 2880371 - DNA, 14 bp, Homo sapiens
tgtcccagcccctg

SEQ ID NO: 2880372 - DNA, 16 bp, Homo sapiens
tgtcccagcccctggt

SEQ ID NO: 2880373 - DNA, 17 bp, Homo sapiens
tgtcccctctcccctca

SEQ ID NO: 2880374 - DNA, 12 bp, Homo sapiens
tgtcctctcccc

SEQ ID NO: 2880375 - DNA, 23 bp, Homo sapiens
tgtcctctcccgcgggcctggac

SEQ ID NO: 2880376 - DNA, 21 bp, Homo sapiens
tgtcgttcccttgtgtctgtt

SEQ ID NO: 2880377 - DNA, 24 bp, Homo sapiens
tgtcgttcccttgtgtctgttgct

SEQ ID NO: 2880378 - DNA, 22 bp, Homo sapiens
tgtctattagttttctttgtaa

SEQ ID NO: 2880379 - DNA, 22 bp, Homo sapiens
tgtctcttggctttgtcacttt

SEQ ID NO: 2880380 - DNA, 14 bp, Homo sapiens
tgtctgcctgcctc

SEQ ID NO: 2880381 - DNA, 14 bp, Homo sapiens
tgtctggctgaagc

SEQ ID NO: 2880382 - DNA, 15 bp, Homo sapiens
tgtctgtggattttt

SEQ ID NO: 2880383 - DNA, 20 bp, Homo sapiens
tgtgactgctggtaaaataa

SEQ ID NO: 2880384 - DNA, 22 bp, Homo sapiens
tgtgagggatggggagcagctg

SEQ ID NO: 2880385 - DNA, 18 bp, Homo sapiens
tgtgcaatgtaaatattt

SEQ ID NO: 2880386 - DNA, 21 bp, Homo sapiens
tgtgccaggactctctttctt

SEQ ID NO: 2880387 - DNA, 16 bp, Homo sapiens
tgtgcgtgcgtgtgtg

SEQ ID NO: 2880388 - DNA, 13 bp, Homo sapiens
tgtgctctggagg

SEQ ID NO: 2880389 - DNA, 13 bp, Homo sapiens
tgtgggccaggag

SEQ ID NO: 2880390 - DNA, 22 bp, Homo sapiens
tgtgggtgttaatttttgatac

SEQ ID NO: 2880391 - DNA, 13 bp, Homo sapiens
tgtgtctgcctgc

SEQ ID NO: 2880392 - DNA, 16 bp, Homo sapiens
tgtgtctgcctgcctc

SEQ ID NO: 2880393 - DNA, 17 bp, Homo sapiens
tgtgtctgcctgcctca

SEQ ID NO: 2880394 - DNA, 10 bp, Homo sapiens
tgtgtgtttg

SEQ ID NO: 2880395 - DNA, 19 bp, Homo sapiens
tgtgtttcaggacagctgc

SEQ ID NO: 2880396 - DNA, 14 bp, Homo sapiens
tgtgtttgtgagca

SEQ ID NO: 2880397 - DNA, 17 bp, Homo sapiens
tgttaatttagaaaact

SEQ ID NO: 2880398 - DNA, 17 bp, Homo sapiens
tgttacacagcccaaga

SEQ ID NO: 2880399 - DNA, 12 bp, Homo sapiens
tgttactgaaat

SEQ ID NO: 2880400 - DNA, 15 bp, Homo sapiens
tgttactgaaatgag

SEQ ID NO: 2880401 - DNA, 12 bp, Homo sapiens
tgttagcagagt

SEQ ID NO: 2880402 - DNA, 14 bp, Homo sapiens
tgttagcagagtct

SEQ ID NO: 2880403 - DNA, 14 bp, Homo sapiens
tgttcagtgttgac

SEQ ID NO: 2880404 - DNA, 18 bp, Homo sapiens
tgttcagtgttgacatag

SEQ ID NO: 2880405 - DNA, 23 bp, Homo sapiens
tgttcagtgttgacatagccttt

SEQ ID NO: 2880406 - DNA, 12 bp, Homo sapiens
tgttcctgcctt

SEQ ID NO: 2880407 - DNA, 13 bp, Homo sapiens
tgttcctgccttc

SEQ ID NO: 2880408 - DNA, 15 bp, Homo sapiens
tgttgacatagcctt

SEQ ID NO: 2880409 - DNA, 13 bp, Homo sapiens
tgttgagacagag

SEQ ID NO: 2880410 - DNA, 20 bp, Homo sapiens
tgttgggtgggtgggccctg

SEQ ID NO: 2880411 - DNA, 12 bp, Homo sapiens
tgttgtgaaata

SEQ ID NO: 2880412 - DNA, 15 bp, Homo sapiens
tgttgtttcttaaat

SEQ ID NO: 2880413 - DNA, 14 bp, Homo sapiens
tgtttaaacctttt

SEQ ID NO: 2880414 - DNA, 12 bp, Homo sapiens
tgtttaaagttc

SEQ ID NO: 2880415 - DNA, 16 bp, Homo sapiens
tgtttagtagcagtga

SEQ ID NO: 2880416 - DNA, 19 bp, Homo sapiens
tgtttcaggacagctgctt

SEQ ID NO: 2880417 - DNA, 11 bp, Homo sapiens
tgttttccaca

SEQ ID NO: 2880418 - DNA, 12 bp, Homo sapiens
tgttttccacac

SEQ ID NO: 2880419 - DNA, 12 bp, Homo sapiens
ttaaaaaagctt

SEQ ID NO: 2880420 - DNA, 19 bp, Homo sapiens
ttaaaaaagcttaaaactt

SEQ ID NO: 2880421 - DNA, 19 bp, Homo sapiens
ttaaaatagcaaaagaaga

SEQ ID NO: 2880422 - DNA, 21 bp, Homo sapiens
ttaaaatagcaaaagaagaag

SEQ ID NO: 2880423 - DNA, 16 bp, Homo sapiens
ttaaaccgctaaaaga

SEQ ID NO: 2880424 - DNA, 19 bp, Homo sapiens
ttaaaccgctaaaagaaac

SEQ ID NO: 2880425 - DNA, 14 bp, Homo sapiens
ttaaaccttttttg

SEQ ID NO: 2880426 - DNA, 17 bp, Homo sapiens
ttaaataagaaactttt

SEQ ID NO: 2880427 - DNA, 17 bp, Homo sapiens
ttaactgggtaatgaaa

SEQ ID NO: 2880428 - DNA, 15 bp, Homo sapiens
ttaacttaaatagta

SEQ ID NO: 2880429 - DNA, 16 bp, Homo sapiens
ttaagccaaaacaatg

SEQ ID NO: 2880430 - DNA, 19 bp, Homo sapiens
ttaataatttagacttcaa

SEQ ID NO: 2880431 - DNA, 19 bp, Homo sapiens
ttaatatcctaaacatcat

SEQ ID NO: 2880432 - DNA, 18 bp, Homo sapiens
ttaatggctgataatttt

SEQ ID NO: 2880433 - DNA, 19 bp, Homo sapiens
ttaatgtatagtaaatcac

SEQ ID NO: 2880434 - DNA, 21 bp, Homo sapiens
ttaccaggcaccaaaagaagt

SEQ ID NO: 2880435 - DNA, 13 bp, Homo sapiens
ttactgaaatgag

SEQ ID NO: 2880436 - DNA, 18 bp, Homo sapiens
ttacttcgtgcgcaacaa

SEQ ID NO: 2880437 - DNA, 11 bp, Homo sapiens
ttactttgaac

SEQ ID NO: 2880438 - DNA, 13 bp, Homo sapiens
ttagaaatcattt

SEQ ID NO: 2880439 - DNA, 16 bp, Homo sapiens
ttagcagagtctgtct

SEQ ID NO: 2880440 - DNA, 17 bp, Homo sapiens
ttagcagagtctgtctc

SEQ ID NO: 2880441 - DNA, 18 bp, Homo sapiens
ttagcagagtctgtctct

SEQ ID NO: 2880442 - DNA, 17 bp, Homo sapiens
ttagcccaagaggtctg

SEQ ID NO: 2880443 - DNA, 21 bp, Homo sapiens
ttagcccaagaggtctgagcc

SEQ ID NO: 2880444 - DNA, 23 bp, Homo sapiens
ttaggattccatgtgaaaataaa

SEQ ID NO: 2880445 - DNA, 21 bp, Homo sapiens
aactccagccacccagccagg

SEQ ID NO: 2880446 - DNA, 20 bp, Homo sapiens
aactccagtctcctgacatt

SEQ ID NO: 2880447 - DNA, 17 bp, Homo sapiens
aactgaaaattatttaa

SEQ ID NO: 2880448 - DNA, 22 bp, Homo sapiens
aactgagccaaacacactgtaa

SEQ ID NO: 2880449 - DNA, 23 bp, Homo sapiens
aactgagccaaacacactgtaaa

SEQ ID NO: 2880450 - DNA, 24 bp, Homo sapiens
aactgagccaaacacactgtaaat

SEQ ID NO: 2880451 - DNA, 16 bp, Homo sapiens
aacttgaatctgttac

SEQ ID NO: 2880452 - DNA, 20 bp, Homo sapiens
aagaaaaacaaactcgtttt

SEQ ID NO: 2880453 - DNA, 19 bp, Homo sapiens
aagaaacaggccagataag

SEQ ID NO: 2880454 - DNA, 21 bp, Homo sapiens
aagaaagaatgcaagagtgga

SEQ ID NO: 2880455 - DNA, 17 bp, Homo sapiens
aagaaagtgaaaaaaac

SEQ ID NO: 2880456 - DNA, 20 bp, Homo sapiens
aagaaagtgaaaaaaacaac

SEQ ID NO: 2880457 - DNA, 22 bp, Homo sapiens
aagaaatgtttatacaataatt

SEQ ID NO: 2880458 - DNA, 22 bp, Homo sapiens
aagaagcattttgtaagttgaa

SEQ ID NO: 2880459 - DNA, 15 bp, Homo sapiens
aagaaggcaaaaata

SEQ ID NO: 2880460 - DNA, 22 bp, Homo sapiens
aagaagtaaaagcaaaaaagaa

SEQ ID NO: 2880461 - DNA, 13 bp, Homo sapiens
aagaagtaaattt

SEQ ID NO: 2880462 - DNA, 12 bp, Homo sapiens
aagaatacttct

SEQ ID NO: 2880463 - DNA, 16 bp, Homo sapiens
aagaatacttctcatt

SEQ ID NO: 2880464 - DNA, 17 bp, Homo sapiens
aagaatacttctcattt

SEQ ID NO: 2880465 - DNA, 17 bp, Homo sapiens
aagagatggcctgagaa

SEQ ID NO: 2880466 - DNA, 20 bp, Homo sapiens
aagagctacgtatttaatag

SEQ ID NO: 2880467 - DNA, 15 bp, Homo sapiens
aagaggactgagact

SEQ ID NO: 2880468 - DNA, 13 bp, Homo sapiens
aagaggtctgagc

SEQ ID NO: 2880469 - DNA, 15 bp, Homo sapiens
aagaggtctgagccc

SEQ ID NO: 2880470 - DNA, 18 bp, Homo sapiens
aagaggtctgagccctgg

SEQ ID NO: 2880471 - DNA, 14 bp, Homo sapiens
aagagttcaagaaa

SEQ ID NO: 2880472 - DNA, 16 bp, Homo sapiens
aagagttcaagaaata

SEQ ID NO: 2880473 - DNA, 17 bp, Homo sapiens
aagatacttaagtgctg

SEQ ID NO: 2880474 - DNA, 21 bp, Homo sapiens
aagcaacctcagtaatttaga

SEQ ID NO: 2880475 - DNA, 20 bp, Homo sapiens
aagcataaagcaattgtgaa

SEQ ID NO: 2880476 - DNA, 15 bp, Homo sapiens
aagcatggctatttt

SEQ ID NO: 2880477 - DNA, 21 bp, Homo sapiens
aagcattcagaagaaaaagaa

SEQ ID NO: 2880478 - DNA, 18 bp, Homo sapiens
aagccaaaacaatgttta

SEQ ID NO: 2880479 - DNA, 13 bp, Homo sapiens
aagccacagaaat

SEQ ID NO: 2880480 - DNA, 12 bp, Homo sapiens
aagccagagcct

SEQ ID NO: 2880481 - DNA, 14 bp, Homo sapiens
aagccagagcctgg

SEQ ID NO: 2880482 - DNA, 18 bp, Homo sapiens
aagcccagtgacctgacc

SEQ ID NO: 2880483 - DNA, 15 bp, Homo sapiens
aagcgaaaaaatcag

SEQ ID NO: 2880484 - DNA, 14 bp, Homo sapiens
aagcttaaaacttt

SEQ ID NO: 2880485 - DNA, 15 bp, Homo sapiens
aagcttaaaactttg

SEQ ID NO: 2880486 - DNA, 19 bp, Homo sapiens
aagcttaatggctgataat

SEQ ID NO: 2880487 - DNA, 21 bp, Homo sapiens
aagcttaatggctgataattt

SEQ ID NO: 2880488 - DNA, 16 bp, Homo sapiens
aaggaaccaccgaaga

SEQ ID NO: 2880489 - DNA, 20 bp, Homo sapiens
aaggaccctgttttccacac

SEQ ID NO: 2880490 - DNA, 15 bp, Homo sapiens
aaggactctaaaagg

SEQ ID NO: 2880491 - DNA, 17 bp, Homo sapiens
aaggagagttcaagcct

SEQ ID NO: 2880492 - DNA, 22 bp, Homo sapiens
aaggagagttcaagcctgtggg

SEQ ID NO: 2880493 - DNA, 19 bp, Homo sapiens
aaggagtgtagcaactaca

SEQ ID NO: 2880494 - DNA, 21 bp, Homo sapiens
aaggcaaaaatagtttggata

SEQ ID NO: 2880495 - DNA, 11 bp, Homo sapiens
aagggaaaaat

SEQ ID NO: 2880496 - DNA, 12 bp, Homo sapiens
aagggaaaaata

SEQ ID NO: 2880497 - DNA, 13 bp, Homo sapiens
aagtaaaagcaaa

SEQ ID NO: 2880498 - DNA, 21 bp, Homo sapiens
aagtaaaagcaaaaaagaaaa

SEQ ID NO: 2880499 - DNA, 12 bp, Homo sapiens
aagtacaaaaac

SEQ ID NO: 2880500 - DNA, 13 bp, Homo sapiens
aagtagaaatcat

SEQ ID NO: 2880501 - DNA, 19 bp, Homo sapiens
aagtatttgttaatttaga

SEQ ID NO: 2880502 - DNA, 22 bp, Homo sapiens
aagtgaagccccttgtcctctc

SEQ ID NO: 2880503 - DNA, 20 bp, Homo sapiens
aagtgatctgtcccctctcc

SEQ ID NO: 2880504 - DNA, 22 bp, Homo sapiens
aagtgctctgtcaaaagcacaa

SEQ ID NO: 2880505 - DNA, 14 bp, Homo sapiens
aagtgttcagtgtt

SEQ ID NO: 2880506 - DNA, 20 bp, Homo sapiens
aagtgttcagtgttgacata

SEQ ID NO: 2880507 - DNA, 21 bp, Homo sapiens
aagtgttcagtgttgacatag

SEQ ID NO: 2880508 - DNA, 16 bp, Homo sapiens
aagttcaacatgttat

SEQ ID NO: 2880509 - DNA, 22 bp, Homo sapiens
aagttccgtctcctctccagcc

SEQ ID NO: 2880510 - DNA, 14 bp, Homo sapiens
aagtttaataaatt

SEQ ID NO: 2880511 - DNA, 15 bp, Homo sapiens
aataaggtacaagaa

SEQ ID NO: 2880512 - DNA, 19 bp, Homo sapiens
aataaggtacaagaagcat

SEQ ID NO: 2880513 - DNA, 19 bp, Homo sapiens
aatacaatagtatgcagct

SEQ ID NO: 2880514 - DNA, 21 bp, Homo sapiens
aatacatgctaagagaagtag

SEQ ID NO: 2880515 - DNA, 22 bp, Homo sapiens
aatacatgctaagagaagtaga

SEQ ID NO: 2880516 - DNA, 17 bp, Homo sapiens
aatacattgaattagaa

SEQ ID NO: 2880517 - DNA, 14 bp, Homo sapiens
aatagcaaagaatt

SEQ ID NO: 2880518 - DNA, 16 bp, Homo sapiens
aatagtatttcccatt

SEQ ID NO: 2880519 - DNA, 15 bp, Homo sapiens
aatatcctaaacatc

SEQ ID NO: 2880520 - DNA, 17 bp, Homo sapiens
aatatcctaaacatcat

SEQ ID NO: 2880521 - DNA, 15 bp, Homo sapiens
aatattttaaagaat

SEQ ID NO: 2880522 - DNA, 14 bp, Homo sapiens
aatcagatagatat

SEQ ID NO: 2880523 - DNA, 16 bp, Homo sapiens
aatcagatagatattc

SEQ ID NO: 2880524 - DNA, 20 bp, Homo sapiens
aatcatagctggttcacact

SEQ ID NO: 2880525 - DNA, 13 bp, Homo sapiens
aatcattttgcaa

SEQ ID NO: 2880526 - DNA, 13 bp, Homo sapiens
aatccactctcag

SEQ ID NO: 2880527 - DNA, 12 bp, Homo sapiens
aatctcattccc

SEQ ID NO: 2880528 - DNA, 16 bp, Homo sapiens
aatctgcattattgga

SEQ ID NO: 2880529 - DNA, 17 bp, Homo sapiens
aatctgcattattggaa

SEQ ID NO: 2880530 - DNA, 15 bp, Homo sapiens
aatctgttactgaaa

SEQ ID NO: 2880531 - DNA, 17 bp, Homo sapiens
aatctgttactgaaatg

SEQ ID NO: 2880532 - DNA, 14 bp, Homo sapiens
aatgaaattaactg

SEQ ID NO: 2880533 - DNA, 14 bp, Homo sapiens
aatgaacagaacat

SEQ ID NO: 2880534 - DNA, 22 bp, Homo sapiens
aatgaacagaacatagacagaa

SEQ ID NO: 2880535 - DNA, 19 bp, Homo sapiens
aatgagctgggccctgggt

SEQ ID NO: 2880536 - DNA, 16 bp, Homo sapiens
aatgcacctaaagaaa

SEQ ID NO: 2880537 - DNA, 14 bp, Homo sapiens
aatgcttaatcaga

SEQ ID NO: 2880538 - DNA, 15 bp, Homo sapiens
aatggctgataattt

SEQ ID NO: 2880539 - DNA, 19 bp, Homo sapiens
aatggctgataattttaaa

SEQ ID NO: 2880540 - DNA, 13 bp, Homo sapiens
aatggctgtaaac

SEQ ID NO: 2880541 - DNA, 18 bp, Homo sapiens
aatggctgtaaactataa

SEQ ID NO: 2880542 - DNA, 20 bp, Homo sapiens
aatgtaaatattttaaagaa

SEQ ID NO: 2880543 - DNA, 22 bp, Homo sapiens
aatgtaaatattttaaagaatt

SEQ ID NO: 2880544 - DNA, 13 bp, Homo sapiens
aatgtatagtaaa

SEQ ID NO: 2880545 - DNA, 14 bp, Homo sapiens
aatgtcattttggt

SEQ ID NO: 2880546 - DNA, 21 bp, Homo sapiens
aatgtgattcctttgaagagg

SEQ ID NO: 2880547 - DNA, 20 bp, Homo sapiens
aatgtgcctaatggagaaga

SEQ ID NO: 2880548 - DNA, 19 bp, Homo sapiens
aatgtttatacaataattt

SEQ ID NO: 2880549 - DNA, 22 bp, Homo sapiens
aattaactgggtaatgaaacaa

SEQ ID NO: 2880550 - DNA, 13 bp, Homo sapiens
aattaagtgcaat

SEQ ID NO: 2880551 - DNA, 15 bp, Homo sapiens
aattaagtgcaattt

SEQ ID NO: 2880552 - DNA, 18 bp, Homo sapiens
aattaagtgcaatttccc

SEQ ID NO: 2880553 - DNA, 15 bp, Homo sapiens
aattcaattcaaagc

SEQ ID NO: 2880554 - DNA, 14 bp, Homo sapiens
aattctaaaatgat

SEQ ID NO: 2880555 - DNA, 22 bp, Homo sapiens
aattgcacgcggagtgagtttt

SEQ ID NO: 2880556 - DNA, 14 bp, Homo sapiens
aatttagaaatcat

SEQ ID NO: 2880557 - DNA, 15 bp, Homo sapiens
aatttagaaatcatt

SEQ ID NO: 2880558 - DNA, 12 bp, Homo sapiens
aatttagtttca

SEQ ID NO: 2880559 - DNA, 21 bp, Homo sapiens
aatttatgagtgttaataaaa

SEQ ID NO: 2880560 - DNA, 13 bp, Homo sapiens
aatttattttctt

SEQ ID NO: 2880561 - DNA, 19 bp, Homo sapiens
aatttcaaaagtgatctgt

SEQ ID NO: 2880562 - DNA, 21 bp, Homo sapiens
aatttctcccgaatcctgagg

SEQ ID NO: 2880563 - DNA, 23 bp, Homo sapiens
aatttgtccaatggctgtaaact

SEQ ID NO: 2880564 - DNA, 14 bp, Homo sapiens
acaaacatgaatcc

SEQ ID NO: 2880565 - DNA, 21 bp, Homo sapiens
acaaactcgttttttacaaag

SEQ ID NO: 2880566 - DNA, 21 bp, Homo sapiens
acaaagagttcaagaaataag

SEQ ID NO: 2880567 - DNA, 22 bp, Homo sapiens
acaaagagttcaagaaataagt

SEQ ID NO: 2880568 - DNA, 14 bp, Homo sapiens
caaacacactgtaa

SEQ ID NO: 2880569 - DNA, 16 bp, Homo sapiens
caaacaccaacataaa

SEQ ID NO: 2880570 - DNA, 15 bp, Homo sapiens
caaagagttcaagaa

SEQ ID NO: 2880571 - DNA, 22 bp, Homo sapiens
caaagcccctacaactccagcc

SEQ ID NO: 2880572 - DNA, 15 bp, Homo sapiens
caaagcccttttata

SEQ ID NO: 2880573 - DNA, 14 bp, Homo sapiens
caaatggaaaggag

SEQ ID NO: 2880574 - DNA, 17 bp, Homo sapiens
caacaacaaggaccctg

SEQ ID NO: 2880575 - DNA, 12 bp, Homo sapiens
caacaaggaccc

SEQ ID NO: 2880576 - DNA, 14 bp, Homo sapiens
caacaaggaccctg

SEQ ID NO: 2880577 - DNA, 23 bp, Homo sapiens
caacatgttatttgtaatagatg

SEQ ID NO: 2880578 - DNA, 22 bp, Homo sapiens
caacccctcccctccatccctg

SEQ ID NO: 2880579 - DNA, 15 bp, Homo sapiens
caacctttccctcac

SEQ ID NO: 2880580 - DNA, 18 bp, Homo sapiens
caacctttccctcacccc

SEQ ID NO: 2880581 - DNA, 13 bp, Homo sapiens
caactccagccac

SEQ ID NO: 2880582 - DNA, 14 bp, Homo sapiens
caactgagatctcc

SEQ ID NO: 2880583 - DNA, 17 bp, Homo sapiens
caagaagcattttgtaa

SEQ ID NO: 2880584 - DNA, 16 bp, Homo sapiens
caagaaggcaaaaata

SEQ ID NO: 2880585 - DNA, 19 bp, Homo sapiens
caagagctacataatttag

SEQ ID NO: 2880586 - DNA, 15 bp, Homo sapiens
caagaggactgagac

SEQ ID NO: 2880587 - DNA, 12 bp, Homo sapiens
caagaggtctga

SEQ ID NO: 2880588 - DNA, 14 bp, Homo sapiens
caagaggtctgagc

SEQ ID NO: 2880589 - DNA, 16 bp, Homo sapiens
caagaggtctgagccc

SEQ ID NO: 2880590 - DNA, 20 bp, Homo sapiens
caagaggtctgagccctggt

SEQ ID NO: 2880591 - DNA, 22 bp, Homo sapiens
caagcattcagaagaaaaagaa

SEQ ID NO: 2880592 - DNA, 22 bp, Homo sapiens
caagctagccagagggtgggag

SEQ ID NO: 2880593 - DNA, 16 bp, Homo sapiens
caaggaatcagcagga

SEQ ID NO: 2880594 - DNA, 20 bp, Homo sapiens
caaggaccctgttttccaca

SEQ ID NO: 2880595 - DNA, 19 bp, Homo sapiens
caaggactcctgtctgtcc

SEQ ID NO: 2880596 - DNA, 22 bp, Homo sapiens
caagtatttgttaatttagaaa

SEQ ID NO: 2880597 - DNA, 19 bp, Homo sapiens
caataaagtgatctgtgtt

SEQ ID NO: 2880598 - DNA, 15 bp, Homo sapiens
caataacgtttaagc

SEQ ID NO: 2880599 - DNA, 12 bp, Homo sapiens
caatcacattca

SEQ ID NO: 2880600 - DNA, 15 bp, Homo sapiens
caatccactctcagg

SEQ ID NO: 2880601 - DNA, 23 bp, Homo sapiens
caatgcacctaaagaaaaacaaa

SEQ ID NO: 2880602 - DNA, 17 bp, Homo sapiens
caatgcctctcccacga

SEQ ID NO: 2880603 - DNA, 19 bp, Homo sapiens
atccaggtcctttccttct

SEQ ID NO: 2880604 - DNA, 20 bp, Homo sapiens
atccccctctttgcacagca

SEQ ID NO: 2880605 - DNA, 19 bp, Homo sapiens
atccctatgtcccagcccc

SEQ ID NO: 2880606 - DNA, 21 bp, Homo sapiens
atccctatgtcccagcccctg

SEQ ID NO: 2880607 - DNA, 10 bp, Homo sapiens
atccctggcc

SEQ ID NO: 2880608 - DNA, 16 bp, Homo sapiens
atccctggccccctcc

SEQ ID NO: 2880609 - DNA, 21 bp, Homo sapiens
atcccttaatatcctaaacat

SEQ ID NO: 2880610 - DNA, 19 bp, Homo sapiens
atccgcctctgagccagga

SEQ ID NO: 2880611 - DNA, 20 bp, Homo sapiens
atcctaagtgggaagtgaag

SEQ ID NO: 2880612 - DNA, 16 bp, Homo sapiens
atcctgcaatttctcc

SEQ ID NO: 2880613 - DNA, 22 bp, Homo sapiens
atccttccagtggctcgctccc

SEQ ID NO: 2880614 - DNA, 14 bp, Homo sapiens
atcgaatgaaatta

SEQ ID NO: 2880615 - DNA, 15 bp, Homo sapiens
atcgtgacagcagca

SEQ ID NO: 2880616 - DNA, 20 bp, Homo sapiens
atctcatctcagtgaagaat

SEQ ID NO: 2880617 - DNA, 19 bp, Homo sapiens
atctcatttaagggaaaaa

SEQ ID NO: 2880618 - DNA, 20 bp, Homo sapiens
atctcatttaagggaaaaat

SEQ ID NO: 2880619 - DNA, 23 bp, Homo sapiens
atctcatttaagggaaaaatata

SEQ ID NO: 2880620 - DNA, 14 bp, Homo sapiens
atctgaatttttaa

SEQ ID NO: 2880621 - DNA, 18 bp, Homo sapiens
atctgaatttttaaacaa

SEQ ID NO: 2880622 - DNA, 19 bp, Homo sapiens
atctgaatttttaaacaag

SEQ ID NO: 2880623 - DNA, 17 bp, Homo sapiens
atctgcttggttggctg

SEQ ID NO: 2880624 - DNA, 15 bp, Homo sapiens
atctgttactgaaat

SEQ ID NO: 2880625 - DNA, 18 bp, Homo sapiens
atctgttagcagagtctg

SEQ ID NO: 2880626 - DNA, 15 bp, Homo sapiens
atgaaaaagaagaat

SEQ ID NO: 2880627 - DNA, 18 bp, Homo sapiens
atgaaaagctagaattga

SEQ ID NO: 2880628 - DNA, 17 bp, Homo sapiens
atgaagaggaagttaaa

SEQ ID NO: 2880629 - DNA, 19 bp, Homo sapiens
atgacaagattaggaatat

SEQ ID NO: 2880630 - DNA, 19 bp, Homo sapiens
atgaccagtaattgtgaaa

SEQ ID NO: 2880631 - DNA, 15 bp, Homo sapiens
atgagaaacaacaga

SEQ ID NO: 2880632 - DNA, 22 bp, Homo sapiens
caggcatctgttagcagagtct

SEQ ID NO: 2880633 - DNA, 21 bp, Homo sapiens
caggcatgcgaatgagctggg

SEQ ID NO: 2880634 - DNA, 20 bp, Homo sapiens
caggcatggcccagcctgga

SEQ ID NO: 2880635 - DNA, 13 bp, Homo sapiens
caggctaattttt

SEQ ID NO: 2880636 - DNA, 22 bp, Homo sapiens
caggctaatttttttgtatttt

SEQ ID NO: 2880637 - DNA, 16 bp, Homo sapiens
caggctccctttctct

SEQ ID NO: 2880638 - DNA, 17 bp, Homo sapiens
cagggcctggcctggtc

SEQ ID NO: 2880639 - DNA, 14 bp, Homo sapiens
caggggacactgaa

SEQ ID NO: 2880640 - DNA, 12 bp, Homo sapiens
caggtcctttcc

SEQ ID NO: 2880641 - DNA, 16 bp, Homo sapiens
caggtcctttccttct

SEQ ID NO: 2880642 - DNA, 23 bp, Homo sapiens
caggtcctttccttctcgtcttc

SEQ ID NO: 2880643 - DNA, 13 bp, Homo sapiens
cagtaaaaatcca

SEQ ID NO: 2880644 - DNA, 14 bp, Homo sapiens
cagtaattgtgaaa

SEQ ID NO: 2880645 - DNA, 13 bp, Homo sapiens
cagtgacctgacc

SEQ ID NO: 2880646 - DNA, 23 bp, Homo sapiens
cagtgttgacatagcctttgtgc

SEQ ID NO: 2880647 - DNA, 14 bp, Homo sapiens
cagtttatatttaa

SEQ ID NO: 2880648 - DNA, 19 bp, Homo sapiens
cagtttatatttaactctc

SEQ ID NO: 2880649 - DNA, 18 bp, Homo sapiens
cagtttcccttctatgca

SEQ ID NO: 2880650 - DNA, 19 bp, Homo sapiens
cagttttcagtcaagttcc

SEQ ID NO: 2880651 - DNA, 14 bp, Homo sapiens
cataaataaaatga

SEQ ID NO: 2880652 - DNA, 21 bp, Homo sapiens
cataattatccaggaagggaa

SEQ ID NO: 2880653 - DNA, 16 bp, Homo sapiens
cataccttggactgac

SEQ ID NO: 2880654 - DNA, 22 bp, Homo sapiens
catactcatttttcatgataat

SEQ ID NO: 2880655 - DNA, 15 bp, Homo sapiens
catatctccttcccc

SEQ ID NO: 2880656 - DNA, 20 bp, Homo sapiens
catcaccctctgggcagctg

SEQ ID NO: 2880657 - DNA, 21 bp, Homo sapiens
catcaccctctgggcagctgt

SEQ ID NO: 2880658 - DNA, 15 bp, Homo sapiens
catccaggtcctttc

SEQ ID NO: 2880659 - DNA, 17 bp, Homo sapiens
catccaggtcctttcct

SEQ ID NO: 2880660 - DNA, 12 bp, Homo sapiens
catccctggccc

SEQ ID NO: 2880661 - DNA, 17 bp, Homo sapiens
catccgcctctgagcca

SEQ ID NO: 2880662 - DNA, 19 bp, Homo sapiens
catccgcctctgagccagg

SEQ ID NO: 2880663 - DNA, 22 bp, Homo sapiens
catccgcctctgagccaggagc

SEQ ID NO: 2880664 - DNA, 19 bp, Homo sapiens
catcctaagtgggaagtga

SEQ ID NO: 2880665 - DNA, 19 bp, Homo sapiens
catcgaacaaactgatgcg

SEQ ID NO: 2880666 - DNA, 16 bp, Homo sapiens
catcgtccttcctctc

SEQ ID NO: 2880667 - DNA, 18 bp, Homo sapiens
catctcatttaagggaaa

SEQ ID NO: 2880668 - DNA, 19 bp, Homo sapiens
catctcatttaagggaaaa

SEQ ID NO: 2880669 - DNA, 19 bp, Homo sapiens
catctgcaaagcatggaga

SEQ ID NO: 2880670 - DNA, 12 bp, Homo sapiens
catgccaataaa

SEQ ID NO: 2880671 - DNA, 18 bp, Homo sapiens
catgccaataaagtgatc

SEQ ID NO: 2880672 - DNA, 17 bp, Homo sapiens
catgcgaatgagctggg

SEQ ID NO: 2880673 - DNA, 18 bp, Homo sapiens
catgcgaatgagctgggc

SEQ ID NO: 2880674 - DNA, 14 bp, Homo sapiens
catggaaaagccca

SEQ ID NO: 2880675 - DNA, 15 bp, Homo sapiens
catggaaaagcccag

SEQ ID NO: 2880676 - DNA, 21 bp, Homo sapiens
catggacatgtgtcccagcca

SEQ ID NO: 2880677 - DNA, 17 bp, Homo sapiens
catggcccagcctggag

SEQ ID NO: 2880678 - DNA, 15 bp, Homo sapiens
catggctattttata

SEQ ID NO: 2880679 - DNA, 18 bp, Homo sapiens
catgggtgtgcccttggg

SEQ ID NO: 2880680 - DNA, 22 bp, Homo sapiens
catgtgctattgaactgagcca

SEQ ID NO: 2880681 - DNA, 23 bp, Homo sapiens
catgttatttgtaatagatgttt

SEQ ID NO: 2880682 - DNA, 18 bp, Homo sapiens
cattattggaatataatt

SEQ ID NO: 2880683 - DNA, 18 bp, Homo sapiens
cattcagaagaaaaagaa

SEQ ID NO: 2880684 - DNA, 15 bp, Homo sapiens
cattccctctcatcc

SEQ ID NO: 2880685 - DNA, 14 bp, Homo sapiens
catttaagggaaaa

SEQ ID NO: 2880686 - DNA, 16 bp, Homo sapiens
catttcatctcattta

SEQ ID NO: 2880687 - DNA, 22 bp, Homo sapiens
catttgtgtttcagaaaggagt

SEQ ID NO: 2880688 - DNA, 12 bp, Homo sapiens
ccaaaaatagct

SEQ ID NO: 2880689 - DNA, 17 bp, Homo sapiens
ccaaaatgttgaaatat

SEQ ID NO: 2880690 - DNA, 16 bp, Homo sapiens
ccaacctttccctcac

SEQ ID NO: 2880691 - DNA, 18 bp, Homo sapiens
ccaagaggactgagactg

SEQ ID NO: 2880692 - DNA, 14 bp, Homo sapiens
ccaagaggtctgag

SEQ ID NO: 2880693 - DNA, 19 bp, Homo sapiens
ccaagaggtctgagccctg

SEQ ID NO: 2880694 - DNA, 13 bp, Homo sapiens
ccaatcacattca

SEQ ID NO: 2880695 - DNA, 16 bp, Homo sapiens
ccaatccctgtgtgtc

SEQ ID NO: 2880696 - DNA, 14 bp, Homo sapiens
ccacaatgcctctc

SEQ ID NO: 2880697 - DNA, 17 bp, Homo sapiens
ccacaatgcctctccca

SEQ ID NO: 2880698 - DNA, 18 bp, Homo sapiens
ccacaatgcctctcccac

SEQ ID NO: 2880699 - DNA, 21 bp, Homo sapiens
ccacaatgcctctcccacgat

SEQ ID NO: 2880700 - DNA, 16 bp, Homo sapiens
ccacagataactgaaa

SEQ ID NO: 2880701 - DNA, 12 bp, Homo sapiens
ccacccagccag

SEQ ID NO: 2880702 - DNA, 14 bp, Homo sapiens
ccacccccagcccc

SEQ ID NO: 2880703 - DNA, 15 bp, Homo sapiens
ccacccccagccccg

SEQ ID NO: 2880704 - DNA, 16 bp, Homo sapiens
ccacccccagccccga

SEQ ID NO: 2880705 - DNA, 13 bp, Homo sapiens
ccacgatgtcaag

SEQ ID NO: 2880706 - DNA, 13 bp, Homo sapiens
ccactcatttcat

SEQ ID NO: 2880707 - DNA, 13 bp, Homo sapiens
ccactctcaggag

SEQ ID NO: 2880708 - DNA, 14 bp, Homo sapiens
ccactctcaggagg

SEQ ID NO: 2880709 - DNA, 15 bp, Homo sapiens
ccactgttgggtggg

SEQ ID NO: 2880710 - DNA, 15 bp, Homo sapiens
ccagagtggagtctg

SEQ ID NO: 2880711 - DNA, 21 bp, Homo sapiens
ccagagtggagtctgagtctg

SEQ ID NO: 2880712 - DNA, 17 bp, Homo sapiens
ccagccacccccaggca

SEQ ID NO: 2880713 - DNA, 18 bp, Homo sapiens
ccagccccgactccagcc

SEQ ID NO: 2880714 - DNA, 19 bp, Homo sapiens
ccagccccgactccagcca

SEQ ID NO: 2880715 - DNA, 20 bp, Homo sapiens
ccagccccgactccagccag

SEQ ID NO: 2880716 - DNA, 12 bp, Homo sapiens
ccagcctggagc

SEQ ID NO: 2880717 - DNA, 13 bp, Homo sapiens
ccagcgcctccct

SEQ ID NO: 2880718 - DNA, 14 bp, Homo sapiens
ccagcgcctccctc

SEQ ID NO: 2880719 - DNA, 22 bp, Homo sapiens
ccagcgcctccctccaccccag

SEQ ID NO: 2880720 - DNA, 14 bp, Homo sapiens
ccaggacgccactc

SEQ ID NO: 2880721 - DNA, 16 bp, Homo sapiens
ccaggacgccactcat

SEQ ID NO: 2880722 - DNA, 20 bp, Homo sapiens
ccaggacgccactcatttca

SEQ ID NO: 2880723 - DNA, 16 bp, Homo sapiens
ccaggactctctttct

SEQ ID NO: 2880724 - DNA, 20 bp, Homo sapiens
ccaggactctctttcttcca

SEQ ID NO: 2880725 - DNA, 18 bp, Homo sapiens
ccaggcagacaaccttgt

SEQ ID NO: 2880726 - DNA, 21 bp, Homo sapiens
ccaggcatctgttagcagagt

SEQ ID NO: 2880727 - DNA, 20 bp, Homo sapiens
ccaggcatggcccagcctgg

SEQ ID NO: 2880728 - DNA, 21 bp, Homo sapiens
ccaggcatggcccagcctgga

SEQ ID NO: 2880729 - DNA, 24 bp, Homo sapiens
ccaggctaatttttttgtatttta

SEQ ID NO: 2880730 - DNA, 18 bp, Homo sapiens
ccagggtgtgagggatgg

SEQ ID NO: 2880731 - DNA, 12 bp, Homo sapiens
ccagtcctgcaa

SEQ ID NO: 2880732 - DNA, 21 bp, Homo sapiens
ccatcaccctctgggcagctg

SEQ ID NO: 2880733 - DNA, 13 bp, Homo sapiens
ccatccctggccc

SEQ ID NO: 2880734 - DNA, 18 bp, Homo sapiens
ccatgtgaaaataaaata

SEQ ID NO: 2880735 - DNA, 20 bp, Homo sapiens
ccatgttggccaggatggtc

SEQ ID NO: 2880736 - DNA, 17 bp, Homo sapiens
cccaagaggtctgagcc

SEQ ID NO: 2880737 - DNA, 13 bp, Homo sapiens
cccacccccagcc

SEQ ID NO: 2880738 - DNA, 16 bp, Homo sapiens
cccacccccagccccg

SEQ ID NO: 2880739 - DNA, 17 bp, Homo sapiens
cccagagtggagtctga

SEQ ID NO: 2880740 - DNA, 17 bp, Homo sapiens
cccagccccgactccag

SEQ ID NO: 2880741 - DNA, 21 bp, Homo sapiens
cccagccccgactccagccag

SEQ ID NO: 2880742 - DNA, 22 bp, Homo sapiens
cccagccccgactccagccagc

SEQ ID NO: 2880743 - DNA, 11 bp, Homo sapiens
cccagcctgga

SEQ ID NO: 2880744 - DNA, 13 bp, Homo sapiens
cccagcctggagc

SEQ ID NO: 2880745 - DNA, 15 bp, Homo sapiens
cccagtttcccttct

SEQ ID NO: 2880746 - DNA, 16 bp, Homo sapiens
cccagtttcccttcta

SEQ ID NO: 2880747 - DNA, 22 bp, Homo sapiens
ccccaggcatctgttagcagag

SEQ ID NO: 2880748 - DNA, 11 bp, Homo sapiens
cccccagccct

SEQ ID NO: 2880749 - DNA, 14 bp, Homo sapiens
ccccctccctggat

SEQ ID NO: 2880750 - DNA, 22 bp, Homo sapiens
ctgagccaaacacactgtaaat

SEQ ID NO: 2880751 - DNA, 16 bp, Homo sapiens
ctgagccaggagcctc

SEQ ID NO: 2880752 - DNA, 19 bp, Homo sapiens
ctgagccaggagcctcctg

SEQ ID NO: 2880753 - DNA, 20 bp, Homo sapiens
ctgagccaggagcctcctga

SEQ ID NO: 2880754 - DNA, 13 bp, Homo sapiens
ctgagctggaaag

SEQ ID NO: 2880755 - DNA, 15 bp, Homo sapiens
ctgaggtctggattg

SEQ ID NO: 2880756 - DNA, 19 bp, Homo sapiens
ctgagtcctgtctctgcct

SEQ ID NO: 2880757 - DNA, 20 bp, Homo sapiens
ctgagtcctgtctctgcctg

SEQ ID NO: 2880758 - DNA, 14 bp, Homo sapiens
ctgagtctgagtcc

SEQ ID NO: 2880759 - DNA, 15 bp, Homo sapiens
ctgagttctcatcca

SEQ ID NO: 2880760 - DNA, 15 bp, Homo sapiens
ctgataattttaaat

SEQ ID NO: 2880761 - DNA, 17 bp, Homo sapiens
ctgatgcgaaaacttga

SEQ ID NO: 2880762 - DNA, 14 bp, Homo sapiens
ctgcagcagggcag

SEQ ID NO: 2880763 - DNA, 23 bp, Homo sapiens
ctgcattattggaatataattgt

SEQ ID NO: 2880764 - DNA, 12 bp, Homo sapiens
ctgcccccatcc

SEQ ID NO: 2880765 - DNA, 13 bp, Homo sapiens
ctgccctgtatat

SEQ ID NO: 2880766 - DNA, 12 bp, Homo sapiens
ctgccttctctt

SEQ ID NO: 2880767 - DNA, 14 bp, Homo sapiens
ctgccttctcttct

SEQ ID NO: 2880768 - DNA, 22 bp, Homo sapiens
ctgcgttaattgagcacctact

SEQ ID NO: 2880769 - DNA, 21 bp, Homo sapiens
ctgctatggttttctccaaga

SEQ ID NO: 2880770 - DNA, 18 bp, Homo sapiens
ctgctcacattccctctc

SEQ ID NO: 2880771 - DNA, 19 bp, Homo sapiens
ctgctcacattccctctca

SEQ ID NO: 2880772 - DNA, 21 bp, Homo sapiens
ctgctcacattccctctcatc

SEQ ID NO: 2880773 - DNA, 16 bp, Homo sapiens
ctgctgtccctcctga

SEQ ID NO: 2880774 - DNA, 13 bp, Homo sapiens
ctgcttacctgac

SEQ ID NO: 2880775 - DNA, 23 bp, Homo sapiens
ctgcttctgtgcatttgtgtctg

SEQ ID NO: 2880776 - DNA, 23 bp, Homo sapiens
ctggaaaggatgcttctgctcac

SEQ ID NO: 2880777 - DNA, 18 bp, Homo sapiens
ctggcacttagcccaaga

SEQ ID NO: 2880778 - DNA, 19 bp, Homo sapiens
ctggcacttagcccaagag

SEQ ID NO: 2880779 - DNA, 23 bp, Homo sapiens
ctggcacttagcccaagaggtct

SEQ ID NO: 2880780 - DNA, 12 bp, Homo sapiens
ctggcagctgag

SEQ ID NO: 2880781 - DNA, 18 bp, Homo sapiens
ctggcagctgagagccct

SEQ ID NO: 2880782 - DNA, 13 bp, Homo sapiens
ctggccccctccc

SEQ ID NO: 2880783 - DNA, 15 bp, Homo sapiens
ctggccccctccctg

SEQ ID NO: 2880784 - DNA, 19 bp, Homo sapiens
ctggccccctccctggatg

SEQ ID NO: 2880785 - DNA, 22 bp, Homo sapiens
ctggcctagtggggaggggcct

SEQ ID NO: 2880786 - DNA, 21 bp, Homo sapiens
ctggcctcaaagcaagcattc

SEQ ID NO: 2880787 - DNA, 14 bp, Homo sapiens
ctgggcactgggcc

SEQ ID NO: 2880788 - DNA, 16 bp, Homo sapiens
ctgggcatcttctggc

SEQ ID NO: 2880789 - DNA, 17 bp, Homo sapiens
ctgggcatcttctggct

SEQ ID NO: 2880790 - DNA, 23 bp, Homo sapiens
ctgggtggggcagggcctggcct

SEQ ID NO: 2880791 - DNA, 12 bp, Homo sapiens
ctggtaaaataa

SEQ ID NO: 2880792 - DNA, 21 bp, Homo sapiens
ctggttccctctttcctgtgc

SEQ ID NO: 2880793 - DNA, 13 bp, Homo sapiens
ctgtaaactataa

SEQ ID NO: 2880794 - DNA, 16 bp, Homo sapiens
ctgtaattaagtgcaa

SEQ ID NO: 2880795 - DNA, 17 bp, Homo sapiens
ctgtaattaagtgcaat

SEQ ID NO: 2880796 - DNA, 12 bp, Homo sapiens
ctgtactgagtt

SEQ ID NO: 2880797 - DNA, 20 bp, Homo sapiens
ctgtagctctgcctccctct

SEQ ID NO: 2880798 - DNA, 18 bp, Homo sapiens
ctgtatataatactaaag

SEQ ID NO: 2880799 - DNA, 20 bp, Homo sapiens
ctgtatataatactaaagtg

SEQ ID NO: 2880800 - DNA, 12 bp, Homo sapiens
ctgtattctgca

SEQ ID NO: 2880801 - DNA, 20 bp, Homo sapiens
ctgtattctgcaacagcctg

SEQ ID NO: 2880802 - DNA, 19 bp, Homo sapiens
ctgtcaaatctagtttcct

SEQ ID NO: 2880803 - DNA, 19 bp, Homo sapiens
ctgtcatggaaaagcccag

SEQ ID NO: 2880804 - DNA, 20 bp, Homo sapiens
ctgtcatggaaaagcccagt

SEQ ID NO: 2880805 - DNA, 13 bp, Homo sapiens
ctgtcccctctcc

SEQ ID NO: 2880806 - DNA, 14 bp, Homo sapiens
ctgtcccctctccc

SEQ ID NO: 2880807 - DNA, 23 bp, Homo sapiens
gaaaaggtttatgaaaaagaaga

SEQ ID NO: 2880808 - DNA, 23 bp, Homo sapiens
gaaacaaagagttcaagaaataa

SEQ ID NO: 2880809 - DNA, 14 bp, Homo sapiens
gaaacaacagaaac

SEQ ID NO: 2880810 - DNA, 17 bp, Homo sapiens
gaaacataaataaaatg

SEQ ID NO: 2880811 - DNA, 18 bp, Homo sapiens
gaaacttttttatttaaa

SEQ ID NO: 2880812 - DNA, 14 bp, Homo sapiens
gaaaggagaggaaa

SEQ ID NO: 2880813 - DNA, 14 bp, Homo sapiens
gaaaggatgcttct

SEQ ID NO: 2880814 - DNA, 21 bp, Homo sapiens
gaaataagtttttgtttcaca

SEQ ID NO: 2880815 - DNA, 13 bp, Homo sapiens
gaaatttaaacta

SEQ ID NO: 2880816 - DNA, 23 bp, Homo sapiens
gaaatttaaactataagcaagaa

SEQ ID NO: 2880817 - DNA, 23 bp, Homo sapiens
gaagaatacttctcattttttaa

SEQ ID NO: 2880818 - DNA, 19 bp, Homo sapiens
gaagagagatcaaatggaa

SEQ ID NO: 2880819 - DNA, 14 bp, Homo sapiens
gaagaggaaaatga

SEQ ID NO: 2880820 - DNA, 15 bp, Homo sapiens
gaagaggaaaatgaa

SEQ ID NO: 2880821 - DNA, 14 bp, Homo sapiens
gaagcaagaaagcc

SEQ ID NO: 2880822 - DNA, 15 bp, Homo sapiens
gaagcccagtttccc

SEQ ID NO: 2880823 - DNA, 11 bp, Homo sapiens
gaagtaaattt

SEQ ID NO: 2880824 - DNA, 19 bp, Homo sapiens
gaagttagctttaacttaa

SEQ ID NO: 2880825 - DNA, 17 bp, Homo sapiens
gaataaggtacaagaag

SEQ ID NO: 2880826 - DNA, 18 bp, Homo sapiens
gaatctgttactgaaatg

SEQ ID NO: 2880827 - DNA, 14 bp, Homo sapiens
gaatgagctgggcc

SEQ ID NO: 2880828 - DNA, 19 bp, Homo sapiens
gaatggctatgtttttaat

SEQ ID NO: 2880829 - DNA, 13 bp, Homo sapiens
gaatgggaaaaga

SEQ ID NO: 2880830 - DNA, 19 bp, Homo sapiens
gaattgagtgtttaaagtt

SEQ ID NO: 2880831 - DNA, 13 bp, Homo sapiens
gacaaccttgtcc

SEQ ID NO: 2880832 - DNA, 19 bp, Homo sapiens
gacaaccttgtcccaagga

SEQ ID NO: 2880833 - DNA, 14 bp, Homo sapiens
gacaatccactctc

SEQ ID NO: 2880834 - DNA, 21 bp, Homo sapiens
gacaatccactctcaggaggc

SEQ ID NO: 2880835 - DNA, 20 bp, Homo sapiens
gacagcataccttggactga

SEQ ID NO: 2880836 - DNA, 17 bp, Homo sapiens
gacataaagttgataaa

SEQ ID NO: 2880837 - DNA, 20 bp, Homo sapiens
gacataaagttgataaagat

SEQ ID NO: 2880838 - DNA, 22 bp, Homo sapiens
gacataaagttgataaagattt

SEQ ID NO: 2880839 - DNA, 16 bp, Homo sapiens
gacatagcctttgtgc

SEQ ID NO: 2880840 - DNA, 20 bp, Homo sapiens
gacatgtgctattgaactga

SEQ ID NO: 2880841 - DNA, 22 bp, Homo sapiens
gaccctgtgatgcctgacacag

SEQ ID NO: 2880842 - DNA, 17 bp, Homo sapiens
gacgccactcatttcat

SEQ ID NO: 2880843 - DNA, 23 bp, Homo sapiens
gacgccactcatttcatctcatt

SEQ ID NO: 2880844 - DNA, 19 bp, Homo sapiens
gactatcttactatttcac

SEQ ID NO: 2880845 - DNA, 13 bp, Homo sapiens
gactccagccagc

SEQ ID NO: 2880846 - DNA, 23 bp, Homo sapiens
gactctctttcttccactaccct

SEQ ID NO: 2880847 - DNA, 9 bp, Homo sapiens
gagacagag

SEQ ID NO: 2880848 - DNA, 17 bp, Homo sapiens
gagactggcacttagcc

SEQ ID NO: 2880849 - DNA, 17 bp, Homo sapiens
gagatcaaatggaaagg

SEQ ID NO: 2880850 - DNA, 16 bp, Homo sapiens
gagcagctgggcactg

SEQ ID NO: 2880851 - DNA, 18 bp, Homo sapiens
gagcagctgggcactggg

SEQ ID NO: 2880852 - DNA, 20 bp, Homo sapiens
gagcagtcagggtgggaaga

SEQ ID NO: 2880853 - DNA, 15 bp, Homo sapiens
gagccctgctgtggg

SEQ ID NO: 2880854 - DNA, 21 bp, Homo sapiens
gagcgaagggggtcaaaggaa

SEQ ID NO: 2880855 - DNA, 15 bp, Homo sapiens
gagctacataattta

SEQ ID NO: 2880856 - DNA, 20 bp, Homo sapiens
gagctacgtatttaatagca

SEQ ID NO: 2880857 - DNA, 15 bp, Homo sapiens
gaggactgagactgg

SEQ ID NO: 2880858 - DNA, 15 bp, Homo sapiens
gaggcgcagcccgaa

SEQ ID NO: 2880859 - DNA, 22 bp, Homo sapiens
gaggcgcagcccgaagcccagt

SEQ ID NO: 2880860 - DNA, 16 bp, Homo sapiens
gaggctgcagagctga

SEQ ID NO: 2880861 - DNA, 16 bp, Homo sapiens
gaggggcctggcctgg

SEQ ID NO: 2880862 - DNA, 12 bp, Homo sapiens
gaggtctgagcc

SEQ ID NO: 2880863 - DNA, 14 bp, Homo sapiens
gaggtctgagccct

SEQ ID NO: 2880864 - DNA, 15 bp, Homo sapiens
gaggtctgagccctg

SEQ ID NO: 2880865 - DNA, 19 bp, Homo sapiens
gaggtctgagccctggtgt

SEQ ID NO: 2880866 - DNA, 19 bp, Homo sapiens
gaggtggaggttgcagtga

SEQ ID NO: 2880867 - DNA, 22 bp, Homo sapiens
gagtcaaaatttcaaaagtgat

SEQ ID NO: 2880868 - DNA, 14 bp, Homo sapiens
gagtcctgtctctg

SEQ ID NO: 2880869 - DNA, 18 bp, Homo sapiens
gagtcctgtctctgcctg

SEQ ID NO: 2880870 - DNA, 22 bp, Homo sapiens
gtcctgcaagtccatagctgag

SEQ ID NO: 2880871 - DNA, 16 bp, Homo sapiens
gtcctgttccctaccc

SEQ ID NO: 2880872 - DNA, 21 bp, Homo sapiens
gtctaaagctggtttaatgtt

SEQ ID NO: 2880873 - DNA, 14 bp, Homo sapiens
gtctattagttttc

SEQ ID NO: 2880874 - DNA, 20 bp, Homo sapiens
gtctcttggctttgtcactt

SEQ ID NO: 2880875 - DNA, 15 bp, Homo sapiens
gtctgagccctggtg

SEQ ID NO: 2880876 - DNA, 20 bp, Homo sapiens
gtctgcctgcctcatgctct

SEQ ID NO: 2880877 - DNA, 15 bp, Homo sapiens
gtgagaaatttaaac

SEQ ID NO: 2880878 - DNA, 19 bp, Homo sapiens
gtgatctgtcccctctccc

SEQ ID NO: 2880879 - DNA, 13 bp, Homo sapiens
gtgcactcagagc

SEQ ID NO: 2880880 - DNA, 17 bp, Homo sapiens
gtgcactccctaagaaa

SEQ ID NO: 2880881 - DNA, 18 bp, Homo sapiens
gtgcatttgtgtctgcct

SEQ ID NO: 2880882 - DNA, 16 bp, Homo sapiens
gtgcctaatggagaag

SEQ ID NO: 2880883 - DNA, 17 bp, Homo sapiens
gtgcctaatggagaaga

SEQ ID NO: 2880884 - DNA, 16 bp, Homo sapiens
gtgcgtgcgtgtgtgt

SEQ ID NO: 2880885 - DNA, 14 bp, Homo sapiens
gtgctattgaactg

SEQ ID NO: 2880886 - DNA, 17 bp, Homo sapiens
gtgctattgaactgagc

SEQ ID NO: 2880887 - DNA, 20 bp, Homo sapiens
gtggccaagggctccagggc

SEQ ID NO: 2880888 - DNA, 13 bp, Homo sapiens
gtgggccaggagc

SEQ ID NO: 2880889 - DNA, 15 bp, Homo sapiens
gtgtcctctcccctc

SEQ ID NO: 2880890 - DNA, 23 bp, Homo sapiens
gtgtcctctcccctctgccctgt

SEQ ID NO: 2880891 - DNA, 15 bp, Homo sapiens
gtgttaatttttgat

SEQ ID NO: 2880892 - DNA, 23 bp, Homo sapiens
gtgttacacagcccaagaggact

SEQ ID NO: 2880893 - DNA, 18 bp, Homo sapiens
gtgttcagtgttgacata

SEQ ID NO: 2880894 - DNA, 14 bp, Homo sapiens
gtgttgacatagcc

SEQ ID NO: 2880895 - DNA, 18 bp, Homo sapiens
gtgttgacatagcctttg

SEQ ID NO: 2880896 - DNA, 20 bp, Homo sapiens
gtgttgtgaaactgtaaatt

SEQ ID NO: 2880897 - DNA, 20 bp, Homo sapiens
gttagcagagtctgtctctt

SEQ ID NO: 2880898 - DNA, 16 bp, Homo sapiens
gttatttgtaatagat

SEQ ID NO: 2880899 - DNA, 16 bp, Homo sapiens
gttcaagaaataagtt

SEQ ID NO: 2880900 - DNA, 13 bp, Homo sapiens
gttcaagcctgtg

SEQ ID NO: 2880901 - DNA, 20 bp, Homo sapiens
gttcaagcctgtgggagtag

SEQ ID NO: 2880902 - DNA, 19 bp, Homo sapiens
gttcagtgttgacatagcc

SEQ ID NO: 2880903 - DNA, 22 bp, Homo sapiens
gttcagtgttgacatagccttt

SEQ ID NO: 2880904 - DNA, 15 bp, Homo sapiens
gttccctctttcctg

SEQ ID NO: 2880905 - DNA, 20 bp, Homo sapiens
gttccctttgttgctgtctg

SEQ ID NO: 2880906 - DNA, 9 bp, Homo sapiens
gttcctgcc

SEQ ID NO: 2880907 - DNA, 13 bp, Homo sapiens
gttcctgccttct

SEQ ID NO: 2880908 - DNA, 15 bp, Homo sapiens
gttcctgccttctct

SEQ ID NO: 2880909 - DNA, 18 bp, Homo sapiens
gttcctgccttctcttct

SEQ ID NO: 2880910 - DNA, 16 bp, Homo sapiens
gttctcatccacagag

SEQ ID NO: 2880911 - DNA, 23 bp, Homo sapiens
gttctcatccacagaggccaggc

SEQ ID NO: 2880912 - DNA, 13 bp, Homo sapiens
gttgacatagcct

SEQ ID NO: 2880913 - DNA, 18 bp, Homo sapiens
gttgaggacaggagaggg

SEQ ID NO: 2880914 - DNA, 17 bp, Homo sapiens
gttgcagtctcagaaag

SEQ ID NO: 2880915 - DNA, 15 bp, Homo sapiens
gttgggtgggtgggc

SEQ ID NO: 2880916 - DNA, 18 bp, Homo sapiens
gtttatgaaaaagaagaa

SEQ ID NO: 2880917 - DNA, 13 bp, Homo sapiens
gtttcaggacagc

SEQ ID NO: 2880918 - DNA, 21 bp, Homo sapiens
gtttggatatgtaaaacattt

SEQ ID NO: 2880919 - DNA, 22 bp, Homo sapiens
gtttgtgagcatgggtgtgccc

SEQ ID NO: 2880920 - DNA, 15 bp, Homo sapiens
gttttattctgactt

SEQ ID NO: 2880921 - DNA, 20 bp, Homo sapiens
taaaaaaataagaagaatgc

SEQ ID NO: 2880922 - DNA, 21 bp, Homo sapiens
taaaactttgaagttagcttt

SEQ ID NO: 2880923 - DNA, 19 bp, Homo sapiens
taaaagcaaaaaagaaaac

SEQ ID NO: 2880924 - DNA, 22 bp, Homo sapiens
taaaagcaaaaaagaaaacctt

SEQ ID NO: 2880925 - DNA, 16 bp, Homo sapiens
taaaatagcaaaagaa

SEQ ID NO: 2880926 - DNA, 21 bp, Homo sapiens
taaaatagcaaaagaagaagt

SEQ ID NO: 2880927 - DNA, 13 bp, Homo sapiens
taaacaagtattt

SEQ ID NO: 2880928 - DNA, 22 bp, Homo sapiens
taaacaagtatttgttaattta

SEQ ID NO: 2880929 - DNA, 13 bp, Homo sapiens
taaacaataaatg

SEQ ID NO: 2880930 - DNA, 23 bp, Homo sapiens
taaacagtatttattttttcaaa

SEQ ID NO: 2880931 - DNA, 17 bp, Homo sapiens
taaaccgctaaaagaaa

SEQ ID NO: 2880932 - DNA, 23 bp, Homo sapiens
taaactactgtaattaagtgcaa

SEQ ID NO: 2880933 - DNA, 20 bp, Homo sapiens
taaactataaactactgtaa

SEQ ID NO: 2880934 - DNA, 17 bp, Homo sapiens
taaactataagcaagaa

SEQ ID NO: 2880935 - DNA, 14 bp, Homo sapiens
taaagaagtaaatt

SEQ ID NO: 2880936 - DNA, 18 bp, Homo sapiens
taaagaagtaaatttgtc

SEQ ID NO: 2880937 - DNA, 21 bp, Homo sapiens
taaagattttttaataattta

SEQ ID NO: 2880938 - DNA, 22 bp, Homo sapiens
taaagattttttaataatttag

SEQ ID NO: 2880939 - DNA, 15 bp, Homo sapiens
taaagtgatctgtgt

SEQ ID NO: 2880940 - DNA, 12 bp, Homo sapiens
taaatagtattt

SEQ ID NO: 2880941 - DNA, 13 bp, Homo sapiens
taaatatccacag

SEQ ID NO: 2880942 - DNA, 22 bp, Homo sapiens
taaatatccacagactccctcc

SEQ ID NO: 2880943 - DNA, 15 bp, Homo sapiens
taaatattttaaaga

SEQ ID NO: 2880944 - DNA, 17 bp, Homo sapiens
taaatattttaaagaat

SEQ ID NO: 2880945 - DNA, 22 bp, Homo sapiens
taaatcaattctgatacagcct

SEQ ID NO: 2880946 - DNA, 19 bp, Homo sapiens
taaatcacgctttttgaaa

SEQ ID NO: 2880947 - DNA, 22 bp, Homo sapiens
taaatcacgctttttgaaaaag

SEQ ID NO: 2880948 - DNA, 12 bp, Homo sapiens
taacatttccta

SEQ ID NO: 2880949 - DNA, 20 bp, Homo sapiens
taaccagacacatactcatt

SEQ ID NO: 2880950 - DNA, 17 bp, Homo sapiens
taacgtttaagccaaaa

SEQ ID NO: 2880951 - DNA, 20 bp, Homo sapiens
taactccagtctcctgacat

SEQ ID NO: 2880952 - DNA, 17 bp, Homo sapiens
taactgggtaatgaaac

SEQ ID NO: 2880953 - DNA, 20 bp, Homo sapiens
taactgggtaatgaaacaaa

SEQ ID NO: 2880954 - DNA, 18 bp, Homo sapiens
taagagaagtagaaatca

SEQ ID NO: 2880955 - DNA, 14 bp, Homo sapiens
taagcaagaaggca

SEQ ID NO: 2880956 - DNA, 12 bp, Homo sapiens
taagggaaaaat

SEQ ID NO: 2880957 - DNA, 18 bp, Homo sapiens
taaggtacaagaagcatt

SEQ ID NO: 2880958 - DNA, 16 bp, Homo sapiens
taagtgttcagtgttg

SEQ ID NO: 2880959 - DNA, 19 bp, Homo sapiens
taagtgttcagtgttgaca

SEQ ID NO: 2880960 - DNA, 12 bp, Homo sapiens
taataaaattta

SEQ ID NO: 2880961 - DNA, 16 bp, Homo sapiens
taatactaaagtgtct

SEQ ID NO: 2880962 - DNA, 16 bp, Homo sapiens
taatagatgtttgata

SEQ ID NO: 2880963 - DNA, 15 bp, Homo sapiens
taatatcctaaacat

SEQ ID NO: 2880964 - DNA, 16 bp, Homo sapiens
taatgaaacaaagagt

SEQ ID NO: 2880965 - DNA, 15 bp, Homo sapiens
taatgcgaatagtgc

SEQ ID NO: 2880966 - DNA, 21 bp, Homo sapiens
taatggctgataattttaaat

SEQ ID NO: 2880967 - DNA, 13 bp, Homo sapiens
taattaagtgcaa

SEQ ID NO: 2880968 - DNA, 19 bp, Homo sapiens
taattcaattcaaagctgt

SEQ ID NO: 2880969 - DNA, 14 bp, Homo sapiens
taatttagaaaact

SEQ ID NO: 2880970 - DNA, 15 bp, Homo sapiens
taatttagaaaactt

SEQ ID NO: 2880971 - DNA, 17 bp, Homo sapiens
taatttagaaaacttta

SEQ ID NO: 2880972 - DNA, 16 bp, Homo sapiens
taatttagtttcatat

SEQ ID NO: 2880973 - DNA, 15 bp, Homo sapiens
tacaagaagcatttt

SEQ ID NO: 2880974 - DNA, 18 bp, Homo sapiens
tacatgctaagagaagta

SEQ ID NO: 2880975 - DNA, 16 bp, Homo sapiens
tacatttctctgagca

SEQ ID NO: 2880976 - DNA, 21 bp, Homo sapiens
taccagctaactccagtctcc

SEQ ID NO: 2880977 - DNA, 13 bp, Homo sapiens
tacccctgtcctg

SEQ ID NO: 2880978 - DNA, 20 bp, Homo sapiens
tacctgggcatactaataaa

SEQ ID NO: 2880979 - DNA, 15 bp, Homo sapiens
taccttgaccatcgt

SEQ ID NO: 2880980 - DNA, 14 bp, Homo sapiens
tactaaagtgtcta

SEQ ID NO: 2880981 - DNA, 14 bp, Homo sapiens
tactcccctgggca

SEQ ID NO: 2880982 - DNA, 15 bp, Homo sapiens
tactgtaattaagtg

SEQ ID NO: 2880983 - DNA, 21 bp, Homo sapiens
tacttcctcctcctcctcctg

SEQ ID NO: 2880984 - DNA, 17 bp, Homo sapiens
tagaaaaatctcattcc

SEQ ID NO: 2880985 - DNA, 16 bp, Homo sapiens
tagaaaactttaaagc

SEQ ID NO: 2880986 - DNA, 23 bp, Homo sapiens
tagaacctaattcaattcaaagc

SEQ ID NO: 2880987 - DNA, 20 bp, Homo sapiens
tagaattgagtgtttaaagt

SEQ ID NO: 2880988 - DNA, 17 bp, Homo sapiens
tagaggtgagaaattta

SEQ ID NO: 2880989 - DNA, 12 bp, Homo sapiens
tagcaaagaatt

SEQ ID NO: 2880990 - DNA, 20 bp, Homo sapiens
tagccagagggtgggagcct

SEQ ID NO: 2880991 - DNA, 20 bp, Homo sapiens
tagcccaagaggtctgagcc

SEQ ID NO: 2880992 - DNA, 16 bp, Homo sapiens
tagctttaacttaaat

SEQ ID NO: 2880993 - DNA, 16 bp, Homo sapiens
tatttaaaaaactaaa

SEQ ID NO: 2880994 - DNA, 21 bp, Homo sapiens
tatttaaaaaactaaaaacta

SEQ ID NO: 2880995 - DNA, 21 bp, Homo sapiens
tatttaaaatagcaaaagaag

SEQ ID NO: 2880996 - DNA, 21 bp, Homo sapiens
tatttaaaccgctaaaagaaa

SEQ ID NO: 2880997 - DNA, 23 bp, Homo sapiens
tatttaactctctttatgtctgt

SEQ ID NO: 2880998 - DNA, 19 bp, Homo sapiens
tatttaatagcaaagaatt

SEQ ID NO: 2880999 - DNA, 15 bp, Homo sapiens
tatttgtaatagatg

SEQ ID NO: 2881000 - DNA, 13 bp, Homo sapiens
tattttaaagaat

SEQ ID NO: 2881001 - DNA, 14 bp, Homo sapiens
tattttaaagaatt

SEQ ID NO: 2881002 - DNA, 17 bp, Homo sapiens
tcaaaagtgatctgtcc

SEQ ID NO: 2881003 - DNA, 21 bp, Homo sapiens
tcaaagcaagcattcagaaga

SEQ ID NO: 2881004 - DNA, 22 bp, Homo sapiens
tcaaagcaagcattcagaagaa

SEQ ID NO: 2881005 - DNA, 23 bp, Homo sapiens
tcaaatgcgcgtgtgcacgtgtg

SEQ ID NO: 2881006 - DNA, 19 bp, Homo sapiens
tcaacccctcccctccatc

SEQ ID NO: 2881007 - DNA, 17 bp, Homo sapiens
tcaagaaataagttttt

SEQ ID NO: 2881008 - DNA, 13 bp, Homo sapiens
tcaagcctgtggg

SEQ ID NO: 2881009 - DNA, 15 bp, Homo sapiens
tcaagctagccagag

SEQ ID NO: 2881010 - DNA, 14 bp, Homo sapiens
tcaaggactcctgt

SEQ ID NO: 2881011 - DNA, 21 bp, Homo sapiens
tcaagttccgtctcctctcca

SEQ ID NO: 2881012 - DNA, 21 bp, Homo sapiens
tcaatcagtctcagaatgtca

SEQ ID NO: 2881013 - DNA, 22 bp, Homo sapiens
tcacacccaacttggttttgct

SEQ ID NO: 2881014 - DNA, 15 bp, Homo sapiens
tcaccccctcccacc

SEQ ID NO: 2881015 - DNA, 17 bp, Homo sapiens
tcaccccctcccacccc

SEQ ID NO: 2881016 - DNA, 19 bp, Homo sapiens
tcaccccctcccaccccca

SEQ ID NO: 2881017 - DNA, 20 bp, Homo sapiens
tcaccccctcccacccccag

SEQ ID NO: 2881018 - DNA, 23 bp, Homo sapiens
tcaccccctcccacccccagccc

SEQ ID NO: 2881019 - DNA, 17 bp, Homo sapiens
tcacctacttcctcctc

SEQ ID NO: 2881020 - DNA, 12 bp, Homo sapiens
tcactaaatctt

SEQ ID NO: 2881021 - DNA, 16 bp, Homo sapiens
tcactcactcattcct

SEQ ID NO: 2881022 - DNA, 16 bp, Homo sapiens
tcactgctgtccctcc

SEQ ID NO: 2881023 - DNA, 20 bp, Homo sapiens
tcacttttccttttcttaaa

SEQ ID NO: 2881024 - DNA, 13 bp, Homo sapiens
tcagaagaaaaag

SEQ ID NO: 2881025 - DNA, 14 bp, Homo sapiens
tcagaatgtcattt

SEQ ID NO: 2881026 - DNA, 18 bp, Homo sapiens
tcagacaatccactctca

SEQ ID NO: 2881027 - DNA, 17 bp, Homo sapiens
tcaggacagctgcttct

SEQ ID NO: 2881028 - DNA, 15 bp, Homo sapiens
tcaggaggcgcagcc

SEQ ID NO: 2881029 - DNA, 18 bp, Homo sapiens
tcaggaggcgcagcccga

SEQ ID NO: 2881030 - DNA, 19 bp, Homo sapiens
tcaggaggcgcagcccgaa

SEQ ID NO: 2881031 - DNA, 19 bp, Homo sapiens
tcagggtgggaagaaagaa

SEQ ID NO: 2881032 - DNA, 21 bp, Homo sapiens
tcaggtgaaaaaggcaagcca

SEQ ID NO: 2881033 - DNA, 18 bp, Homo sapiens
tcagtaatttagaaatca

SEQ ID NO: 2881034 - DNA, 20 bp, Homo sapiens
tcagtaatttagaaatcatt

SEQ ID NO: 2881035 - DNA, 22 bp, Homo sapiens
tcagtgtagaacctaattcaat

SEQ ID NO: 2881036 - DNA, 16 bp, Homo sapiens
tcagtgttgacatagc

SEQ ID NO: 2881037 - DNA, 19 bp, Homo sapiens
tcagtgttgacatagcctt

SEQ ID NO: 2881038 - DNA, 21 bp, Homo sapiens
tcagtgttgacatagcctttg

SEQ ID NO: 2881039 - DNA, 15 bp, Homo sapiens
tcatcgaacaaactg

SEQ ID NO: 2881040 - DNA, 22 bp, Homo sapiens
tcatctcagtgaagaatacttc

SEQ ID NO: 2881041 - DNA, 22 bp, Homo sapiens
tcatctcatttaagggaaaaat

SEQ ID NO: 2881042 - DNA, 17 bp, Homo sapiens
tcatgataatgaacaga

SEQ ID NO: 2881043 - DNA, 13 bp, Homo sapiens
tcattcccagagt

SEQ ID NO: 2881044 - DNA, 15 bp, Homo sapiens
tcattcccagagtca

SEQ ID NO: 2881045 - DNA, 15 bp, Homo sapiens
tcattccttcactca

SEQ ID NO: 2881046 - DNA, 17 bp, Homo sapiens
tcatttaagggaaaaat

SEQ ID NO: 2881047 - DNA, 14 bp, Homo sapiens
tcatttcatctcat

SEQ ID NO: 2881048 - DNA, 18 bp, Homo sapiens
tcatttcatctcatttaa

SEQ ID NO: 2881049 - DNA, 14 bp, Homo sapiens
tcattttggtactt

SEQ ID NO: 2881050 - DNA, 19 bp, Homo sapiens
tccaatggctgtaaactat

SEQ ID NO: 2881051 - DNA, 21 bp, Homo sapiens
tccaatggctgtaaactataa

SEQ ID NO: 2881052 - DNA, 19 bp, Homo sapiens
tccaccccaggacgccact

SEQ ID NO: 2881053 - DNA, 21 bp, Homo sapiens
tccagccacccagccaggagg

SEQ ID NO: 2881054 - DNA, 12 bp, Homo sapiens
tccagccacccc

SEQ ID NO: 2881055 - DNA, 18 bp, Homo sapiens
tccagccacccccaggca

SEQ ID NO: 2881056 - DNA, 11 bp, Homo sapiens
tccagccagcg

SEQ ID NO: 2881057 - DNA, 19 bp, Homo sapiens
tccagccagcgcctccctc

SEQ ID NO: 2881058 - DNA, 21 bp, Homo sapiens
tccagccagcgcctccctcca

SEQ ID NO: 2881059 - DNA, 22 bp, Homo sapiens
tccagccagcgcctccctccac

SEQ ID NO: 2881060 - DNA, 23 bp, Homo sapiens
tccaggcttgggctccattccca

SEQ ID NO: 2881061 - DNA, 15 bp, Homo sapiens
tccaggtcctttcct

SEQ ID NO: 2881062 - DNA, 17 bp, Homo sapiens
tccagtctcctgacatt

SEQ ID NO: 2881063 - DNA, 14 bp, Homo sapiens
tccatccctggccc

SEQ ID NO: 2881064 - DNA, 19 bp, Homo sapiens
tccattcccatcactgctg

SEQ ID NO: 2881065 - DNA, 17 bp, Homo sapiens
tcccacccccagccccg

SEQ ID NO: 2881066 - DNA, 14 bp, Homo sapiens
tcccagagtcagag

SEQ ID NO: 2881067 - DNA, 20 bp, Homo sapiens
tcccagagtcagaggagaag

SEQ ID NO: 2881068 - DNA, 22 bp, Homo sapiens
tcccagcccctggtactccccc

SEQ ID NO: 2881069 - DNA, 12 bp, Homo sapiens
tcccatcactgc

SEQ ID NO: 2881070 - DNA, 17 bp, Homo sapiens
tcccatcactgctgtcc

SEQ ID NO: 2881071 - DNA, 16 bp, Homo sapiens
tcccctccatccctgg

SEQ ID NO: 2881072 - DNA, 13 bp, Homo sapiens
tcccctctgccct

SEQ ID NO: 2881073 - DNA, 21 bp, Homo sapiens
tcccctctgtgtcctctcccc

SEQ ID NO: 2881074 - DNA, 20 bp, Homo sapiens
tcccctgctactcctgtgct

SEQ ID NO: 2881075 - DNA, 21 bp, Homo sapiens
tcccgaatctttttaggccac

SEQ ID NO: 2881076 - DNA, 18 bp, Homo sapiens
tccctaagaaaccccagg

SEQ ID NO: 2881077 - DNA, 18 bp, Homo sapiens
tccctccaccccaggacg

SEQ ID NO: 2881078 - DNA, 13 bp, Homo sapiens
tccctcccctgcc

SEQ ID NO: 2881079 - DNA, 17 bp, Homo sapiens
tgcagtctcagaaagcc

SEQ ID NO: 2881080 - DNA, 16 bp, Homo sapiens
tgccaataaagtgatc

SEQ ID NO: 2881081 - DNA, 17 bp, Homo sapiens
tgccacaatgcctctcc

SEQ ID NO: 2881082 - DNA, 23 bp, Homo sapiens
tgccacaatgcctctcccacgat

SEQ ID NO: 2881083 - DNA, 13 bp, Homo sapiens
tgccaggactctc

SEQ ID NO: 2881084 - DNA, 18 bp, Homo sapiens
tgccaggactctctttct

SEQ ID NO: 2881085 - DNA, 14 bp, Homo sapiens
tgccaggctccctt

SEQ ID NO: 2881086 - DNA, 19 bp, Homo sapiens
tgccaggctccctttctct

SEQ ID NO: 2881087 - DNA, 13 bp, Homo sapiens
tgccagtcctgca

SEQ ID NO: 2881088 - DNA, 13 bp, Homo sapiens
tgcccccatccca

SEQ ID NO: 2881089 - DNA, 16 bp, Homo sapiens
tgcccccatcccacat

SEQ ID NO: 2881090 - DNA, 19 bp, Homo sapiens
tgccctgtatataatacta

SEQ ID NO: 2881091 - DNA, 16 bp, Homo sapiens
tgcctaatggagaaga

SEQ ID NO: 2881092 - DNA, 14 bp, Homo sapiens
tgcctccctctcca

SEQ ID NO: 2881093 - DNA, 20 bp, Homo sapiens
tgcctctcccacgatgtcaa

SEQ ID NO: 2881094 - DNA, 20 bp, Homo sapiens
tgcctctcgctcctcaaccc

SEQ ID NO: 2881095 - DNA, 15 bp, Homo sapiens
tgcctgcctcatgct

SEQ ID NO: 2881096 - DNA, 16 bp, Homo sapiens
tgccttctcttctatc

SEQ ID NO: 2881097 - DNA, 15 bp, Homo sapiens
tgcgaatgagctggg

SEQ ID NO: 2881098 - DNA, 23 bp, Homo sapiens
tgcgtccccccccaacctttccc

SEQ ID NO: 2881099 - DNA, 22 bp, Homo sapiens
tgctaagagaagtagaaatcat

SEQ ID NO: 2881100 - DNA, 14 bp, Homo sapiens
tgctcctacccctg

SEQ ID NO: 2881101 - DNA, 21 bp, Homo sapiens
tgctcctacccctgtcctggg

SEQ ID NO: 2881102 - DNA, 17 bp, Homo sapiens
tgctggcacctcagaca

SEQ ID NO: 2881103 - DNA, 15 bp, Homo sapiens
tgctgtccctcctga

SEQ ID NO: 2881104 - DNA, 16 bp, Homo sapiens
tgctgtccctcctgag

SEQ ID NO: 2881105 - DNA, 17 bp, Homo sapiens
tgctgtctggctttccc

SEQ ID NO: 2881106 - DNA, 14 bp, Homo sapiens
tgctgtgggagagc

SEQ ID NO: 2881107 - DNA, 13 bp, Homo sapiens
tgcttacctgacg

SEQ ID NO: 2881108 - DNA, 20 bp, Homo sapiens
tgcttatgtatgcctattca

SEQ ID NO: 2881109 - DNA, 13 bp, Homo sapiens
tggaaaagcccag

SEQ ID NO: 2881110 - DNA, 21 bp, Homo sapiens
tggaaaagcccagtgacctga

SEQ ID NO: 2881111 - DNA, 23 bp, Homo sapiens
tggaaaagcccagtgacctgacc

SEQ ID NO: 2881112 - DNA, 15 bp, Homo sapiens
tggaaaggagaggaa

SEQ ID NO: 2881113 - DNA, 16 bp, Homo sapiens
tggaaaggagaggaaa

SEQ ID NO: 2881114 - DNA, 23 bp, Homo sapiens
tggaaaggagaggaaagaactca

SEQ ID NO: 2881115 - DNA, 14 bp, Homo sapiens
tggaatataattgt

SEQ ID NO: 2881116 - DNA, 11 bp, Homo sapiens
tggactgacta

SEQ ID NO: 2881117 - DNA, 17 bp, Homo sapiens
tggagccgtggccgagg

SEQ ID NO: 2881118 - DNA, 16 bp, Homo sapiens
tggatatgtaaaacat

SEQ ID NO: 2881119 - DNA, 21 bp, Homo sapiens
tggatatgtaaaacatttatt

SEQ ID NO: 2881120 - DNA, 19 bp, Homo sapiens
tggcagctgagagccctgc

SEQ ID NO: 2881121 - DNA, 23 bp, Homo sapiens
tggcagctgagagccctgctgtg

SEQ ID NO: 2881122 - DNA, 20 bp, Homo sapiens
tggcagtttatatttaactc

SEQ ID NO: 2881123 - DNA, 16 bp, Homo sapiens
tggcatgtggagacac

SEQ ID NO: 2881124 - DNA, 14 bp, Homo sapiens
tggcccagcctgga

SEQ ID NO: 2881125 - DNA, 19 bp, Homo sapiens
tggcccagcctggagccgt

SEQ ID NO: 2881126 - DNA, 23 bp, Homo sapiens
tggcctagtggggaggggcctgg

SEQ ID NO: 2881127 - DNA, 14 bp, Homo sapiens
tggcctggtccagg

SEQ ID NO: 2881128 - DNA, 17 bp, Homo sapiens
tggctatgtttttaatg

SEQ ID NO: 2881129 - DNA, 18 bp, Homo sapiens
tggctatgtttttaatgt

SEQ ID NO: 2881130 - DNA, 19 bp, Homo sapiens
tggctgataattttaaatt

SEQ ID NO: 2881131 - DNA, 20 bp, Homo sapiens
tggcttttgcggttcaggaa

SEQ ID NO: 2881132 - DNA, 20 bp, Homo sapiens
tgggaggtggaggttgcagt

SEQ ID NO: 2881133 - DNA, 20 bp, Homo sapiens
tgggagtaggagttgctcct

SEQ ID NO: 2881134 - DNA, 14 bp, Homo sapiens
tgggcactgggccg

SEQ ID NO: 2881135 - DNA, 16 bp, Homo sapiens
tgggcatactaataaa

SEQ ID NO: 2881136 - DNA, 15 bp, Homo sapiens
tgggcatcaaagatg

SEQ ID NO: 2881137 - DNA, 17 bp, Homo sapiens
tgggcatcttctggctt

SEQ ID NO: 2881138 - DNA, 16 bp, Homo sapiens
tgggccaggagctcag

SEQ ID NO: 2881139 - DNA, 19 bp, Homo sapiens
tgggccaggatccccctct

SEQ ID NO: 2881140 - DNA, 15 bp, Homo sapiens
tggggagcagctggg

SEQ ID NO: 2881141 - DNA, 20 bp, Homo sapiens
tggggaggggcctggcctgg

SEQ ID NO: 2881142 - DNA, 13 bp, Homo sapiens
tgggtgggccctg

SEQ ID NO: 2881143 - DNA, 13 bp, Homo sapiens
tgggtgggtgggc

SEQ ID NO: 2881144 - DNA, 16 bp, Homo sapiens
tgggtgggtgggccct

SEQ ID NO: 2881145 - DNA, 17 bp, Homo sapiens
tggtactcccccagccc

SEQ ID NO: 2881146 - DNA, 20 bp, Homo sapiens
tggtatagatttctataaaa

SEQ ID NO: 2881147 - DNA, 23 bp, Homo sapiens
tggtgttacacagcccaagagga

SEQ ID NO: 2881148 - DNA, 17 bp, Homo sapiens
tggttccctctttcctg

SEQ ID NO: 2881149 - DNA, 13 bp, Homo sapiens
tggtttcccaaga

SEQ ID NO: 2881150 - DNA, 12 bp, Homo sapiens
tgtaaactataa

SEQ ID NO: 2881151 - DNA, 13 bp, Homo sapiens
tgtaaactataaa

SEQ ID NO: 2881152 - DNA, 14 bp, Homo sapiens
tgtaaatattttaa

SEQ ID NO: 2881153 - DNA, 18 bp, Homo sapiens
tgtaaatattttaaagaa

SEQ ID NO: 2881154 - DNA, 20 bp, Homo sapiens
tgtaaatattttaaagaatt

SEQ ID NO: 2881155 - DNA, 18 bp, Homo sapiens
tgtaatagatgtttgata

SEQ ID NO: 2881156 - DNA, 15 bp, Homo sapiens
tgtaccttgaccatc

SEQ ID NO: 2881157 - DNA, 21 bp, Homo sapiens
tgtactacgtgccagctctag

SEQ ID NO: 2881158 - DNA, 18 bp, Homo sapiens
tgtactgagttctcatcc

SEQ ID NO: 2881159 - DNA, 13 bp, Homo sapiens
tgtcccctctccc

SEQ ID NO: 2881160 - DNA, 23 bp, Homo sapiens
tgtcctctcccctctgccctgta

SEQ ID NO: 2881161 - DNA, 23 bp, Homo sapiens
tgtcgttcccttgtgtctgttgc

SEQ ID NO: 2881162 - DNA, 15 bp, Homo sapiens
tgtctggctttcccg

SEQ ID NO: 2881163 - DNA, 19 bp, Homo sapiens
tgtgattcctttgaagagg

SEQ ID NO: 2881164 - DNA, 15 bp, Homo sapiens
tgtgcatttgtgtct

SEQ ID NO: 2881165 - DNA, 18 bp, Homo sapiens
tgtgcatttgtgtctgcc

SEQ ID NO: 2881166 - DNA, 19 bp, Homo sapiens
tgtgcatttgtgtctgcct

SEQ ID NO: 2881167 - DNA, 17 bp, Homo sapiens
tgtgctattgaactgag

SEQ ID NO: 2881168 - DNA, 22 bp, Homo sapiens
tgtggattttttccttcaaagt

SEQ ID NO: 2881169 - DNA, 23 bp, Homo sapiens
tgtggccaagggctccagggcca

SEQ ID NO: 2881170 - DNA, 13 bp, Homo sapiens
tgtgggagtagaa

SEQ ID NO: 2881171 - DNA, 14 bp, Homo sapiens
tgtgggtgttaatt

SEQ ID NO: 2881172 - DNA, 21 bp, Homo sapiens
tgtgtcctctcccctctgccc

SEQ ID NO: 2881173 - DNA, 12 bp, Homo sapiens
tgtgtctgcctg

SEQ ID NO: 2881174 - DNA, 23 bp, Homo sapiens
tgtgtctgcctgcctcatgctct

SEQ ID NO: 2881175 - DNA, 14 bp, Homo sapiens
tgtgtgtgtgtttg

SEQ ID NO: 2881176 - DNA, 23 bp, Homo sapiens
tgtgtttcaggacagctgcttct

SEQ ID NO: 2881177 - DNA, 21 bp, Homo sapiens
tgtgtttccagatcgatcctg

SEQ ID NO: 2881178 - DNA, 19 bp, Homo sapiens
tgttaaaaaaataagaaga

SEQ ID NO: 2881179 - DNA, 20 bp, Homo sapiens
tgttaaaaaaataagaagaa

SEQ ID NO: 2881180 - DNA, 22 bp, Homo sapiens
tgttaaaaaaataagaagaatg

SEQ ID NO: 2881181 - DNA, 15 bp, Homo sapiens
tgttcagtgttgaca

SEQ ID NO: 2881182 - DNA, 16 bp, Homo sapiens
tgttcagtgttgacat

SEQ ID NO: 2881183 - DNA, 21 bp, Homo sapiens
tgttcagtgttgacatagcct

SEQ ID NO: 2881184 - DNA, 13 bp, Homo sapiens
tgttccctacccc

SEQ ID NO: 2881185 - DNA, 10 bp, Homo sapiens
tgttcctgcc

SEQ ID NO: 2881186 - DNA, 14 bp, Homo sapiens
tgttgacatagcct

SEQ ID NO: 2881187 - DNA, 19 bp, Homo sapiens
tgttgcaccatctgcttgg

SEQ ID NO: 2881188 - DNA, 13 bp, Homo sapiens
tgttgctgtctgg

SEQ ID NO: 2881189 - DNA, 17 bp, Homo sapiens
tgttgctgtctggcttt

SEQ ID NO: 2881190 - DNA, 16 bp, Homo sapiens
tgttgtttcttaaata

SEQ ID NO: 2881191 - DNA, 21 bp, Homo sapiens
tgttgtttcttaaataagaaa

SEQ ID NO: 2881192 - DNA, 23 bp, Homo sapiens
tgtttaaagttcaacatgttatt

SEQ ID NO: 2881193 - DNA, 18 bp, Homo sapiens
tgtttagtagcagtgatt

SEQ ID NO: 2881194 - DNA, 12 bp, Homo sapiens
ttaaaaaaataa

SEQ ID NO: 2881195 - DNA, 13 bp, Homo sapiens
ttaaaaaactaaa

SEQ ID NO: 2881196 - DNA, 20 bp, Homo sapiens
ttaaaaaactgacaggcact

SEQ ID NO: 2881197 - DNA, 23 bp, Homo sapiens
ttaaaaaactgacaggcactata

SEQ ID NO: 2881198 - DNA, 16 bp, Homo sapiens
ttaaaacacagaaact

SEQ ID NO: 2881199 - DNA, 18 bp, Homo sapiens
ttaaaaccataaaataaa

SEQ ID NO: 2881200 - DNA, 22 bp, Homo sapiens
ttaaaatagcaaaagaagaagt

SEQ ID NO: 2881201 - DNA, 23 bp, Homo sapiens
ttaaagaaatgtttatacaataa

SEQ ID NO: 2881202 - DNA, 18 bp, Homo sapiens
ttaaagaagtaaatttgt

SEQ ID NO: 2881203 - DNA, 14 bp, Homo sapiens
ttaaagtggactta

SEQ ID NO: 2881204 - DNA, 15 bp, Homo sapiens
ttaaataagaaactt

SEQ ID NO: 2881205 - DNA, 23 bp, Homo sapiens
ttaaatattttttaaaaccataa

SEQ ID NO: 2881206 - DNA, 23 bp, Homo sapiens
ttaaattctctctcttgcaggaa

SEQ ID NO: 2881207 - DNA, 16 bp, Homo sapiens
ttaacctaaataatta

SEQ ID NO: 2881208 - DNA, 16 bp, Homo sapiens
ttaagacacacctctg

SEQ ID NO: 2881209 - DNA, 13 bp, Homo sapiens
ttaagggaaaaat

SEQ ID NO: 2881210 - DNA, 16 bp, Homo sapiens
ttaagggaaaaatata

SEQ ID NO: 2881211 - DNA, 15 bp, Homo sapiens
ttaatagcaaagaat

SEQ ID NO: 2881212 - DNA, 16 bp, Homo sapiens
ttaatagcaaagaatt

SEQ ID NO: 2881213 - DNA, 18 bp, Homo sapiens
ttaatagcaaagaattga

SEQ ID NO: 2881214 - DNA, 17 bp, Homo sapiens
ttaatcagatagatatt

SEQ ID NO: 2881215 - DNA, 12 bp, Homo sapiens
ttaatttttgat

SEQ ID NO: 2881216 - DNA, 15 bp, Homo sapiens
ttacacagcccaaga

SEQ ID NO: 2881217 - DNA, 17 bp, Homo sapiens
ttacacagcccaagagg

SEQ ID NO: 2881218 - DNA, 22 bp, Homo sapiens
ttacactacacactgtgtactg

SEQ ID NO: 2881219 - DNA, 14 bp, Homo sapiens
ttacttttgggagg

SEQ ID NO: 2881220 - DNA, 19 bp, Homo sapiens
ttagcccaagaggtctgag

SEQ ID NO: 2881221 - DNA, 12 bp, Homo sapiens
ttaggtctggtt

SEQ ID NO: 2881222 - DNA, 18 bp, Homo sapiens
ttataggatttatttaaa

SEQ ID NO: 2881223 - DNA, 13 bp, Homo sapiens
ttatatttaactc

SEQ ID NO: 2881224 - DNA, 17 bp, Homo sapiens
ttatgaaaaagaagaat

SEQ ID NO: 2881225 - DNA, 19 bp, Homo sapiens
ttatgaaaaagaagaatct

SEQ ID NO: 2881226 - DNA, 17 bp, Homo sapiens
ttatttaaaaaactaaa

SEQ ID NO: 2881227 - DNA, 16 bp, Homo sapiens
ttatttaaaatagcaa

SEQ ID NO: 2881228 - DNA, 21 bp, Homo sapiens
ttatttaaaatagcaaaagaa

SEQ ID NO: 2881229 - DNA, 22 bp, Homo sapiens
ttatttaaaatagcaaaagaag

SEQ ID NO: 2881230 - DNA, 12 bp, Homo sapiens
ttatttgtaata

SEQ ID NO: 2881231 - DNA, 15 bp, Homo sapiens
ttattttgacataaa

SEQ ID NO: 2881232 - DNA, 14 bp, Homo sapiens
ttattttttcaaaa

SEQ ID NO: 2881233 - DNA, 21 bp, Homo sapiens
ttcaaaataaacaataaatgg

SEQ ID NO: 2881234 - DNA, 14 bp, Homo sapiens
ttcaaagtttaata

SEQ ID NO: 2881235 - DNA, 20 bp, Homo sapiens
ttcaagcctgtgggagtaga

SEQ ID NO: 2881236 - DNA, 13 bp, Homo sapiens
ttcagccttggga

SEQ ID NO: 2881237 - DNA, 13 bp, Homo sapiens
ttcagtgttgaca

SEQ ID NO: 2881238 - DNA, 14 bp, Homo sapiens
ttcagtgttgacat

SEQ ID NO: 2881239 - DNA, 13 bp, Homo sapiens
ttcatacatttga

SEQ ID NO: 2881240 - DNA, 14 bp, Homo sapiens
ttcatcatttttta

SEQ ID NO: 2881241 - DNA, 16 bp, Homo sapiens
ttcatctcatttaagg

SEQ ID NO: 2881242 - DNA, 18 bp, Homo sapiens
ttccaccacaggaatgta

SEQ ID NO: 2881243 - DNA, 16 bp, Homo sapiens
ttccactaccctccct

SEQ ID NO: 2881244 - DNA, 13 bp, Homo sapiens
ttccctctcatcc

SEQ ID NO: 2881245 - DNA, 20 bp, Homo sapiens
ttccctggagaccccagagt

SEQ ID NO: 2881246 - DNA, 15 bp, Homo sapiens
ttcccttgtgtctgt

SEQ ID NO: 2881247 - DNA, 17 bp, Homo sapiens
ttccctttgttgctgtc

SEQ ID NO: 2881248 - DNA, 23 bp, Homo sapiens
ttcctcctcctcctcctgttcct

SEQ ID NO: 2881249 - DNA, 22 bp, Homo sapiens
ttcctgtgggccaggagctcag

SEQ ID NO: 2881250 - DNA, 19 bp, Homo sapiens
ttctattcattcattttga

SEQ ID NO: 2881251 - DNA, 16 bp, Homo sapiens
ttctcgtcttcctctc

SEQ ID NO: 2881252 - DNA, 22 bp, Homo sapiens
ttctcgtcttcctctctctcac

SEQ ID NO: 2881253 - DNA, 15 bp, Homo sapiens
ttctcttctatcctg

SEQ ID NO: 2881254 - DNA, 11 bp, Homo sapiens
ttcttaaataa

SEQ ID NO: 2881255 - DNA, 21 bp, Homo sapiens
ttcttccccaggtccttcctt

SEQ ID NO: 2881256 - DNA, 14 bp, Homo sapiens
ttctttgtaaaggt

SEQ ID NO: 2881257 - DNA, 13 bp, Homo sapiens
ttgaaaaagcgaa

SEQ ID NO: 2881258 - DNA, 22 bp, Homo sapiens
ttgaagaggaaaatgaataata

SEQ ID NO: 2881259 - DNA, 19 bp, Homo sapiens
ttgaagttagctttaactt

SEQ ID NO: 2881260 - DNA, 15 bp, Homo sapiens
ttgaatgcaaaccat

SEQ ID NO: 2881261 - DNA, 20 bp, Homo sapiens
ttgaatggctatgtttttaa

SEQ ID NO: 2881262 - DNA, 14 bp, Homo sapiens
ttgaattagaaaca

SEQ ID NO: 2881263 - DNA, 12 bp, Homo sapiens
ttgacatagcct

SEQ ID NO: 2881264 - DNA, 18 bp, Homo sapiens
ttgacatagcctttgtgc

SEQ ID NO: 2881265 - DNA, 14 bp, Homo sapiens
ttgataaagatttt

SEQ ID NO: 2881266 - DNA, 15 bp, Homo sapiens
ttgatactaagcatt

SEQ ID NO: 2881267 - DNA, 18 bp, Homo sapiens
ttgcaatcccttaatatc

SEQ ID NO: 2881268 - DNA, 19 bp, Homo sapiens
ttgcacataggaaactttt

SEQ ID NO: 2881269 - DNA, 14 bp, Homo sapiens
ttgcatcctaagga

SEQ ID NO: 2881270 - DNA, 20 bp, Homo sapiens
ttgccacaatgcctctccca

SEQ ID NO: 2881271 - DNA, 15 bp, Homo sapiens
ttgccagtcctgcaa

SEQ ID NO: 2881272 - DNA, 11 bp, Homo sapiens
ttgctcctacc

SEQ ID NO: 2881273 - DNA, 19 bp, Homo sapiens
ttgctgtctggctttcccg

SEQ ID NO: 2881274 - DNA, 15 bp, Homo sapiens
ttggaatataattgt

SEQ ID NO: 2881275 - DNA, 19 bp, Homo sapiens
ttggatatgtaaaacattt

SEQ ID NO: 2881276 - DNA, 20 bp, Homo sapiens
ttggatatgtaaaacattta

SEQ ID NO: 2881277 - DNA, 14 bp, Homo sapiens
ttgtaaaggtcaga

SEQ ID NO: 2881278 - DNA, 18 bp, Homo sapiens
ttgtaaaggtcagagtca

SEQ ID NO: 2881279 - DNA, 21 bp, Homo sapiens
ttgtaatagatgtttgataga

SEQ ID NO: 2881280 - DNA, 12 bp, Homo sapiens
ttgtcctctccc

SEQ ID NO: 2881281 - DNA, 13 bp, Homo sapiens
ttgtcctctcccg

SEQ ID NO: 2881282 - DNA, 19 bp, Homo sapiens
ttgtggcacagatgcccac

SEQ ID NO: 2881283 - DNA, 13 bp, Homo sapiens
ttgtgtctgcctg

SEQ ID NO: 2881284 - DNA, 18 bp, Homo sapiens
ttgtgtctgcctgcctca

SEQ ID NO: 2881285 - DNA, 18 bp, Homo sapiens
ttgttgcatctcagataa

SEQ ID NO: 2881286 - DNA, 12 bp, Homo sapiens
ttgtttcttaaa

SEQ ID NO: 2881287 - DNA, 23 bp, Homo sapiens
ttgtttcttaaataagaaacttt

SEQ ID NO: 2881288 - DNA, 14 bp, Homo sapiens
tttaaaaaactaaa

SEQ ID NO: 2881289 - DNA, 15 bp, Homo sapiens
tttaaaaaactaaaa

SEQ ID NO: 2881290 - DNA, 21 bp, Homo sapiens
tttaaaaaactaaaaactaga

SEQ ID NO: 2881291 - DNA, 20 bp, Homo sapiens
tttaaaaaagcttaaaactt

SEQ ID NO: 2881292 - DNA, 12 bp, Homo sapiens
tttaaaatagca

SEQ ID NO: 2881293 - DNA, 22 bp, Homo sapiens
tttaaaccgctaaaagaaactt

SEQ ID NO: 2881294 - DNA, 12 bp, Homo sapiens
tttaaagaagta

SEQ ID NO: 2881295 - DNA, 14 bp, Homo sapiens
tttaaagaagtaaa

SEQ ID NO: 2881296 - DNA, 19 bp, Homo sapiens
tttaaagaagtaaatttgt

SEQ ID NO: 2881297 - DNA, 12 bp, Homo sapiens
tttaagccaaaa

SEQ ID NO: 2881298 - DNA, 18 bp, Homo sapiens
tttaatgtatagtaaatc

SEQ ID NO: 2881299 - DNA, 20 bp, Homo sapiens
tttaatgtatagtaaatcac

SEQ ID NO: 2881300 - DNA, 16 bp, Homo sapiens
tttaatgtttttctgg

SEQ ID NO: 2881301 - DNA, 18 bp, Homo sapiens
tttagaaatcattttgca

SEQ ID NO: 2881302 - DNA, 22 bp, Homo sapiens
tttagtagcagtgattgtctta

SEQ ID NO: 2881303 - DNA, 19 bp, Homo sapiens
tttatgaaaaagaagaatc

SEQ ID NO: 2881304 - DNA, 14 bp, Homo sapiens
tttattttgacata

SEQ ID NO: 2881305 - DNA, 23 bp, Homo sapiens
tttcagtcaagttccgtctcctc

SEQ ID NO: 2881306 - DNA, 13 bp, Homo sapiens
tttcatcattttt

SEQ ID NO: 2881307 - DNA, 19 bp, Homo sapiens
tttcatgataatgaacaga

SEQ ID NO: 2881308 - DNA, 12 bp, Homo sapiens
tttccacaccat

SEQ ID NO: 2881309 - DNA, 19 bp, Homo sapiens
tttccacaccatcaccctc

SEQ ID NO: 2881310 - DNA, 22 bp, Homo sapiens
tttcctgtgccaggactctctt

SEQ ID NO: 2881311 - DNA, 13 bp, Homo sapiens
tttccttctcgtc

SEQ ID NO: 2881312 - DNA, 18 bp, Homo sapiens
tttccttttcttaaaaca

SEQ ID NO: 2881313 - DNA, 16 bp, Homo sapiens
tttctcactaaatctt

SEQ ID NO: 2881314 - DNA, 15 bp, Homo sapiens
tttctccaagagcta

SEQ ID NO: 2881315 - DNA, 21 bp, Homo sapiens
tttctccaagagctacataat

SEQ ID NO: 2881316 - DNA, 19 bp, Homo sapiens
tttctcccgaatcctgagg

SEQ ID NO: 2881317 - DNA, 18 bp, Homo sapiens
tttcttcaccaaatcttg

SEQ ID NO: 2881318 - DNA, 20 bp, Homo sapiens
tttcttccactaccctccct

SEQ ID NO: 2881319 - DNA, 16 bp, Homo sapiens
tttcttttaaagaagt

SEQ ID NO: 2881320 - DNA, 20 bp, Homo sapiens
tttgaaaaagcgaaaaaatc

SEQ ID NO: 2881321 - DNA, 23 bp, Homo sapiens
tttggccaatgcacctaaagaaa

SEQ ID NO: 2881322 - DNA, 23 bp, Homo sapiens
tttgtaaaggtcagagtcaaaat

SEQ ID NO: 2881323 - DNA, 12 bp, Homo sapiens
tttgtgtttcag

SEQ ID NO: 2881324 - DNA, 14 bp, Homo sapiens
acattcaggcatgc

SEQ ID NO: 2881325 - DNA, 13 bp, Homo sapiens
acattccctctca

SEQ ID NO: 2881326 - DNA, 17 bp, Homo sapiens
acattccctctcatcca

SEQ ID NO: 2881327 - DNA, 14 bp, Homo sapiens
acattgaattagaa

SEQ ID NO: 2881328 - DNA, 22 bp, Homo sapiens
acatttactttaatttccttga

SEQ ID NO: 2881329 - DNA, 23 bp, Homo sapiens
accaacataaaaatgatctaaac

SEQ ID NO: 2881330 - DNA, 20 bp, Homo sapiens
accaagatacttaagtgctg

SEQ ID NO: 2881331 - DNA, 17 bp, Homo sapiens
accaggcaccaaaagaa

SEQ ID NO: 2881332 - DNA, 21 bp, Homo sapiens
accaggcaccaaaagaagtaa

SEQ ID NO: 2881333 - DNA, 12 bp, Homo sapiens
accagggctctg

SEQ ID NO: 2881334 - DNA, 23 bp, Homo sapiens
accagtaggttgaggacaggaga

SEQ ID NO: 2881335 - DNA, 12 bp, Homo sapiens
accatcaccctc

SEQ ID NO: 2881336 - DNA, 17 bp, Homo sapiens
accatcaccctctgggc

SEQ ID NO: 2881337 - DNA, 20 bp, Homo sapiens
accatgccaggctaattttt

SEQ ID NO: 2881338 - DNA, 11 bp, Homo sapiens
accccaggacg

SEQ ID NO: 2881339 - DNA, 20 bp, Homo sapiens
accccaggacgccactcatt

SEQ ID NO: 2881340 - DNA, 21 bp, Homo sapiens
acccccagccccgactccagc

SEQ ID NO: 2881341 - DNA, 23 bp, Homo sapiens
acccccagccccgactccagcca

SEQ ID NO: 2881342 - DNA, 19 bp, Homo sapiens
accccctcccacccccagc

SEQ ID NO: 2881343 - DNA, 14 bp, Homo sapiens
acccctcccctcca

SEQ ID NO: 2881344 - DNA, 16 bp, Homo sapiens
accctgctcacaggca

SEQ ID NO: 2881345 - DNA, 17 bp, Homo sapiens
accctgttttccacacc

SEQ ID NO: 2881346 - DNA, 19 bp, Homo sapiens
accctgttttccacaccat

SEQ ID NO: 2881347 - DNA, 20 bp, Homo sapiens
accctgttttccacaccatc

SEQ ID NO: 2881348 - DNA, 13 bp, Homo sapiens
acctaaataatta

SEQ ID NO: 2881349 - DNA, 17 bp, Homo sapiens
acctaccagttggccat

SEQ ID NO: 2881350 - DNA, 19 bp, Homo sapiens
acctcagacaatccactct

SEQ ID NO: 2881351 - DNA, 17 bp, Homo sapiens
acctgaccggcacctgc

SEQ ID NO: 2881352 - DNA, 18 bp, Homo sapiens
acctgaccggcacctgcg

SEQ ID NO: 2881353 - DNA, 17 bp, Homo sapiens
acctgacggacgtcctg

SEQ ID NO: 2881354 - DNA, 20 bp, Homo sapiens
acctgcgagaggtccctgct

SEQ ID NO: 2881355 - DNA, 23 bp, Homo sapiens
acctgcgagaggtccctgcttac

SEQ ID NO: 2881356 - DNA, 20 bp, Homo sapiens
accttgaccatcgtccttcc

SEQ ID NO: 2881357 - DNA, 21 bp, Homo sapiens
accttgttgatgccagctgta

SEQ ID NO: 2881358 - DNA, 20 bp, Homo sapiens
acctttcttcaccaaatctt

SEQ ID NO: 2881359 - DNA, 16 bp, Homo sapiens
acgccactcatttcat

SEQ ID NO: 2881360 - DNA, 17 bp, Homo sapiens
acgctttttgaaaaagc

SEQ ID NO: 2881361 - DNA, 15 bp, Homo sapiens
acggggtttcaccat

SEQ ID NO: 2881362 - DNA, 23 bp, Homo sapiens
acgtttaagccaaaacaatgttt

SEQ ID NO: 2881363 - DNA, 18 bp, Homo sapiens
actaaagtgtctattagt

SEQ ID NO: 2881364 - DNA, 15 bp, Homo sapiens
actaaatcttttata

SEQ ID NO: 2881365 - DNA, 16 bp, Homo sapiens
actacagtctaaagct

SEQ ID NO: 2881366 - DNA, 17 bp, Homo sapiens
actacagtctaaagctg

SEQ ID NO: 2881367 - DNA, 18 bp, Homo sapiens
actagaggtgagaaattt

SEQ ID NO: 2881368 - DNA, 21 bp, Homo sapiens
actagaggtgagaaatttaaa

SEQ ID NO: 2881369 - DNA, 17 bp, Homo sapiens
actataaactactgtaa

SEQ ID NO: 2881370 - DNA, 20 bp, Homo sapiens
actatgaaaagctagaattg

SEQ ID NO: 2881371 - DNA, 13 bp, Homo sapiens
actcattccttca

SEQ ID NO: 2881372 - DNA, 15 bp, Homo sapiens
actcattccttcact

SEQ ID NO: 2881373 - DNA, 11 bp, Homo sapiens
actccagccag

SEQ ID NO: 2881374 - DNA, 12 bp, Homo sapiens
actccagccagc

SEQ ID NO: 2881375 - DNA, 18 bp, Homo sapiens
actccagccagcgcctcc

SEQ ID NO: 2881376 - DNA, 20 bp, Homo sapiens
actccagccagcgcctccct

SEQ ID NO: 2881377 - DNA, 18 bp, Homo sapiens
actcccccagccctcagt

SEQ ID NO: 2881378 - DNA, 20 bp, Homo sapiens
actccctaagaaaccccagg

SEQ ID NO: 2881379 - DNA, 17 bp, Homo sapiens
actcctataaggagagt

SEQ ID NO: 2881380 - DNA, 22 bp, Homo sapiens
actcctgtgctctggaggctgc

SEQ ID NO: 2881381 - DNA, 22 bp, Homo sapiens
actcggcctcccaaagtgctgg

SEQ ID NO: 2881382 - DNA, 20 bp, Homo sapiens
actctctataagtgttcagt

SEQ ID NO: 2881383 - DNA, 22 bp, Homo sapiens
actctctataagtgttcagtgt

SEQ ID NO: 2881384 - DNA, 16 bp, Homo sapiens
actctctttcttccac

SEQ ID NO: 2881385 - DNA, 18 bp, Homo sapiens
actctctttcttccacta

SEQ ID NO: 2881386 - DNA, 18 bp, Homo sapiens
actgagccaaacacactg

SEQ ID NO: 2881387 - DNA, 20 bp, Homo sapiens
actgagccaaacacactgta

SEQ ID NO: 2881388 - DNA, 19 bp, Homo sapiens
actgatgcgaaaacttgaa

SEQ ID NO: 2881389 - DNA, 16 bp, Homo sapiens
actgctgtccctcctg

SEQ ID NO: 2881390 - DNA, 19 bp, Homo sapiens
actgctgtccctcctgagg

SEQ ID NO: 2881391 - DNA, 15 bp, Homo sapiens
actggcctcaaagca

SEQ ID NO: 2881392 - DNA, 22 bp, Homo sapiens
actggcctcaaagcaagcattc

SEQ ID NO: 2881393 - DNA, 12 bp, Homo sapiens
actgggccggca

SEQ ID NO: 2881394 - DNA, 20 bp, Homo sapiens
actgtaaagagaagtaattt

SEQ ID NO: 2881395 - DNA, 16 bp, Homo sapiens
actgtaaatatccaca

SEQ ID NO: 2881396 - DNA, 20 bp, Homo sapiens
actgtaaatatccacagact

SEQ ID NO: 2881397 - DNA, 22 bp, Homo sapiens
actgttgggtgggtgggccctg

SEQ ID NO: 2881398 - DNA, 18 bp, Homo sapiens
acttaccaggcaccaaaa

SEQ ID NO: 2881399 - DNA, 15 bp, Homo sapiens
acttagcccaagagg

SEQ ID NO: 2881400 - DNA, 14 bp, Homo sapiens
acttcctcctcctc

SEQ ID NO: 2881401 - DNA, 16 bp, Homo sapiens
acttcctcctcctcct

SEQ ID NO: 2881402 - DNA, 19 bp, Homo sapiens
acttctcattttttaaaaa

SEQ ID NO: 2881403 - DNA, 13 bp, Homo sapiens
acttgaatctgtt

SEQ ID NO: 2881404 - DNA, 22 bp, Homo sapiens
acttgaatctgttactgaaatg

SEQ ID NO: 2881405 - DNA, 12 bp, Homo sapiens
actttaaagcgt

SEQ ID NO: 2881406 - DNA, 15 bp, Homo sapiens
acttttccttttctt

SEQ ID NO: 2881407 - DNA, 17 bp, Homo sapiens
acttttccttttcttaa

SEQ ID NO: 2881408 - DNA, 15 bp, Homo sapiens
agaaacataaataaa

SEQ ID NO: 2881409 - DNA, 22 bp, Homo sapiens
agaaacataaataaaatgacca

SEQ ID NO: 2881410 - DNA, 15 bp, Homo sapiens
agaaactttctttct

SEQ ID NO: 2881411 - DNA, 13 bp, Homo sapiens
agaaataagtttt

SEQ ID NO: 2881412 - DNA, 14 bp, Homo sapiens
agaaataagttttt

SEQ ID NO: 2881413 - DNA, 23 bp, Homo sapiens
agaaataagtttttgtttcacag

SEQ ID NO: 2881414 - DNA, 15 bp, Homo sapiens
agaaatagcaagaga

SEQ ID NO: 2881415 - DNA, 14 bp, Homo sapiens
agaaatcatagctg

SEQ ID NO: 2881416 - DNA, 22 bp, Homo sapiens
agaaatgtttatacaataattt

SEQ ID NO: 2881417 - DNA, 13 bp, Homo sapiens
agaaatttaaact

SEQ ID NO: 2881418 - DNA, 14 bp, Homo sapiens
agaacctaattcaa

SEQ ID NO: 2881419 - DNA, 15 bp, Homo sapiens
agaacctaattcaat

SEQ ID NO: 2881420 - DNA, 15 bp, Homo sapiens
agaagaaaaagaagc

SEQ ID NO: 2881421 - DNA, 22 bp, Homo sapiens
agaagaatctcatctcagtgaa

SEQ ID NO: 2881422 - DNA, 18 bp, Homo sapiens
agaaggacatgtgctatt

SEQ ID NO: 2881423 - DNA, 22 bp, Homo sapiens
agaagtaaaagcaaaaaagaaa

SEQ ID NO: 2881424 - DNA, 20 bp, Homo sapiens
agaagtaaatttgtccaatg

SEQ ID NO: 2881425 - DNA, 17 bp, Homo sapiens
agaagtagaaatcatag

SEQ ID NO: 2881426 - DNA, 17 bp, Homo sapiens
agaatataaacacataa

SEQ ID NO: 2881427 - DNA, 15 bp, Homo sapiens
agacaatccactctc

SEQ ID NO: 2881428 - DNA, 19 bp, Homo sapiens
agacaatccactctcagga

SEQ ID NO: 2881429 - DNA, 12 bp, Homo sapiens
agacagaagaaa

SEQ ID NO: 2881430 - DNA, 21 bp, Homo sapiens
agaccatatttttaaagaaat

SEQ ID NO: 2881431 - DNA, 16 bp, Homo sapiens
agaccccagagtaggg

SEQ ID NO: 2881432 - DNA, 20 bp, Homo sapiens
agactatcttactatttcac

SEQ ID NO: 2881433 - DNA, 22 bp, Homo sapiens
agacttcaagcatggctatttt

SEQ ID NO: 2881434 - DNA, 15 bp, Homo sapiens
agacttgaagcacag

SEQ ID NO: 2881435 - DNA, 14 bp, Homo sapiens
agacttgccaggct

SEQ ID NO: 2881436 - DNA, 15 bp, Homo sapiens
agagatcaaatggaa

SEQ ID NO: 2881437 - DNA, 13 bp, Homo sapiens
agagccctgctgt

SEQ ID NO: 2881438 - DNA, 18 bp, Homo sapiens
agagcctggggtgttctc

SEQ ID NO: 2881439 - DNA, 14 bp, Homo sapiens
agagctacataatt

SEQ ID NO: 2881440 - DNA, 16 bp, Homo sapiens
agagctacataattta

SEQ ID NO: 2881441 - DNA, 18 bp, Homo sapiens
agagctacataatttagt

SEQ ID NO: 2881442 - DNA, 17 bp, Homo sapiens
agaggaaaatgaataat

SEQ ID NO: 2881443 - DNA, 20 bp, Homo sapiens
agaggaaaatgaataataca

SEQ ID NO: 2881444 - DNA, 17 bp, Homo sapiens
catttaagggaaaaata

SEQ ID NO: 2881445 - DNA, 22 bp, Homo sapiens
catttaagggaaaaatatatat

SEQ ID NO: 2881446 - DNA, 14 bp, Homo sapiens
catttcatctcatt

SEQ ID NO: 2881447 - DNA, 13 bp, Homo sapiens
catttctctgagc

SEQ ID NO: 2881448 - DNA, 23 bp, Homo sapiens
catttgacttctagaaaacattt

SEQ ID NO: 2881449 - DNA, 16 bp, Homo sapiens
catttttcatgataat

SEQ ID NO: 2881450 - DNA, 15 bp, Homo sapiens
ccaaacacactgtaa

SEQ ID NO: 2881451 - DNA, 16 bp, Homo sapiens
ccaaacacactgtaaa

SEQ ID NO: 2881452 - DNA, 20 bp, Homo sapiens
ccaacctgtggcgctgcagc

SEQ ID NO: 2881453 - DNA, 18 bp, Homo sapiens
ccaacctttccctcaccc

SEQ ID NO: 2881454 - DNA, 23 bp, Homo sapiens
ccaacctttccctcaccccctcc

SEQ ID NO: 2881455 - DNA, 16 bp, Homo sapiens
ccaagaggtctgagcc

SEQ ID NO: 2881456 - DNA, 18 bp, Homo sapiens
ccaagatacttaagtgct

SEQ ID NO: 2881457 - DNA, 16 bp, Homo sapiens
ccaaggaatcagcagg

SEQ ID NO: 2881458 - DNA, 17 bp, Homo sapiens
ccaaggaatcagcagga

SEQ ID NO: 2881459 - DNA, 18 bp, Homo sapiens
ccaatggctgtaaactat

SEQ ID NO: 2881460 - DNA, 16 bp, Homo sapiens
ccacaatgcctctccc

SEQ ID NO: 2881461 - DNA, 21 bp, Homo sapiens
ccacaccatcaccctctgggc

SEQ ID NO: 2881462 - DNA, 13 bp, Homo sapiens
ccacagaggccag

SEQ ID NO: 2881463 - DNA, 18 bp, Homo sapiens
ccacagataactgaaaat

SEQ ID NO: 2881464 - DNA, 21 bp, Homo sapiens
ccacatgatcttgagatttct

SEQ ID NO: 2881465 - DNA, 14 bp, Homo sapiens
ccacccagccagga

SEQ ID NO: 2881466 - DNA, 12 bp, Homo sapiens
ccaccccaggac

SEQ ID NO: 2881467 - DNA, 13 bp, Homo sapiens
ccacccccagccc

SEQ ID NO: 2881468 - DNA, 21 bp, Homo sapiens
ccaccgaagaggaagcaagaa

SEQ ID NO: 2881469 - DNA, 15 bp, Homo sapiens
ccactaccctccctc

SEQ ID NO: 2881470 - DNA, 15 bp, Homo sapiens
ccactcatttcatct

SEQ ID NO: 2881471 - DNA, 23 bp, Homo sapiens
ccactgttgggtgggtgggccct

SEQ ID NO: 2881472 - DNA, 17 bp, Homo sapiens
ccagagtcagaggagaa

SEQ ID NO: 2881473 - DNA, 17 bp, Homo sapiens
ccagagtggagtctgag

SEQ ID NO: 2881474 - DNA, 18 bp, Homo sapiens
ccagagtggagtctgagt

SEQ ID NO: 2881475 - DNA, 20 bp, Homo sapiens
ccagataagtgaagtaattt

SEQ ID NO: 2881476 - DNA, 17 bp, Homo sapiens
ccagccacccagccagg

SEQ ID NO: 2881477 - DNA, 18 bp, Homo sapiens
ccagccacccagccagga

SEQ ID NO: 2881478 - DNA, 11 bp, Homo sapiens
ccagccacccc

SEQ ID NO: 2881479 - DNA, 13 bp, Homo sapiens
ccagccagcgcct

SEQ ID NO: 2881480 - DNA, 14 bp, Homo sapiens
ccagccaggagggg

SEQ ID NO: 2881481 - DNA, 17 bp, Homo sapiens
ccagccaggaggggctg

SEQ ID NO: 2881482 - DNA, 14 bp, Homo sapiens
ccagccccgactcc

SEQ ID NO: 2881483 - DNA, 21 bp, Homo sapiens
ccagccccgactccagccagc

SEQ ID NO: 2881484 - DNA, 22 bp, Homo sapiens
ccagccccgactccagccagcg

SEQ ID NO: 2881485 - DNA, 15 bp, Homo sapiens
ccagcgcctccctcc

SEQ ID NO: 2881486 - DNA, 17 bp, Homo sapiens
ccagcgcctccctccac

SEQ ID NO: 2881487 - DNA, 16 bp, Homo sapiens
ccagctgtactgagtt

SEQ ID NO: 2881488 - DNA, 14 bp, Homo sapiens
ccagcttcctgtgg

SEQ ID NO: 2881489 - DNA, 22 bp, Homo sapiens
ccagcttcctgtgggccaggag

SEQ ID NO: 2881490 - DNA, 13 bp, Homo sapiens
ccaggactctctt

SEQ ID NO: 2881491 - DNA, 22 bp, Homo sapiens
ccaggcatctgttagcagagtc

SEQ ID NO: 2881492 - DNA, 15 bp, Homo sapiens
ccaggcatggcccag

SEQ ID NO: 2881493 - DNA, 19 bp, Homo sapiens
ccaggcatggcccagcctg

SEQ ID NO: 2881494 - DNA, 23 bp, Homo sapiens
ccaggcatggcccagcctggagc

SEQ ID NO: 2881495 - DNA, 23 bp, Homo sapiens
ccaggtcctttccttctcgtctt

SEQ ID NO: 2881496 - DNA, 15 bp, Homo sapiens
ccagtctcctgacat

SEQ ID NO: 2881497 - DNA, 14 bp, Homo sapiens
ccagtgacctgacc

SEQ ID NO: 2881498 - DNA, 18 bp, Homo sapiens
ccagtgacctgaccggca

SEQ ID NO: 2881499 - DNA, 13 bp, Homo sapiens
ccagtttcccttc

SEQ ID NO: 2881500 - DNA, 19 bp, Homo sapiens
ccatcaccctctgggcagc

SEQ ID NO: 2881501 - DNA, 23 bp, Homo sapiens
ccatccctggccccctccctgga

SEQ ID NO: 2881502 - DNA, 15 bp, Homo sapiens
ccatgtgaaaataaa

SEQ ID NO: 2881503 - DNA, 16 bp, Homo sapiens
cccacacctccctact

SEQ ID NO: 2881504 - DNA, 18 bp, Homo sapiens
cccacacctccctactcc

SEQ ID NO: 2881505 - DNA, 20 bp, Homo sapiens
cccagagtcagaggagaaga

SEQ ID NO: 2881506 - DNA, 16 bp, Homo sapiens
cccagccccgactcca

SEQ ID NO: 2881507 - DNA, 19 bp, Homo sapiens
cccagccccgactccagcc

SEQ ID NO: 2881508 - DNA, 15 bp, Homo sapiens
cccagcctggagccg

SEQ ID NO: 2881509 - DNA, 14 bp, Homo sapiens
cccagctctgaggc

SEQ ID NO: 2881510 - DNA, 22 bp, Homo sapiens
cccaggacgccactcatttcat

SEQ ID NO: 2881511 - DNA, 16 bp, Homo sapiens
cccatttgtgtttcag

SEQ ID NO: 2881512 - DNA, 15 bp, Homo sapiens
ccccaacctttccct

SEQ ID NO: 2881513 - DNA, 19 bp, Homo sapiens
ccccaacctttccctcacc

SEQ ID NO: 2881514 - DNA, 21 bp, Homo sapiens
ccccaacctttccctcacccc

SEQ ID NO: 2881515 - DNA, 19 bp, Homo sapiens
ccccagccccgactccagc

SEQ ID NO: 2881516 - DNA, 23 bp, Homo sapiens
ccccaggacgccactcatttcat

SEQ ID NO: 2881517 - DNA, 13 bp, Homo sapiens
ccccatcccacat

SEQ ID NO: 2881518 - DNA, 23 bp, Homo sapiens
cccccagccccgactccagccag

SEQ ID NO: 2881519 - DNA, 16 bp, Homo sapiens
ccccctccctggatga

SEQ ID NO: 2881520 - DNA, 23 bp, Homo sapiens
cccctcatggagaaacatcctaa

SEQ ID NO: 2881521 - DNA, 17 bp, Homo sapiens
cccctcccacccccagc

SEQ ID NO: 2881522 - DNA, 14 bp, Homo sapiens
cccctccctggatg

SEQ ID NO: 2881523 - DNA, 11 bp, Homo sapiens
cccctctcccc

SEQ ID NO: 2881524 - DNA, 19 bp, Homo sapiens
cccctctcccctcatggag

SEQ ID NO: 2881525 - DNA, 19 bp, Homo sapiens
cccctctgtgtcctctccc

SEQ ID NO: 2881526 - DNA, 16 bp, Homo sapiens
cccctctttgcacagc

SEQ ID NO: 2881527 - DNA, 19 bp, Homo sapiens
cccctgctactcctgtgct

SEQ ID NO: 2881528 - DNA, 20 bp, Homo sapiens
cccctgggcatcttctggct

SEQ ID NO: 2881529 - DNA, 12 bp, Homo sapiens
cccgaagcccag

SEQ ID NO: 2881530 - DNA, 14 bp, Homo sapiens
cccgaatcctgagg

SEQ ID NO: 2881531 - DNA, 15 bp, Homo sapiens
cccgactccagccag

SEQ ID NO: 2881532 - DNA, 20 bp, Homo sapiens
cccgactccagccagcgcct

SEQ ID NO: 2881533 - DNA, 15 bp, Homo sapiens
ccctacaactccagc

SEQ ID NO: 2881534 - DNA, 15 bp, Homo sapiens
ccctacacctccctc

SEQ ID NO: 2881535 - DNA, 16 bp, Homo sapiens
ccctactcccctgggc

SEQ ID NO: 2881536 - DNA, 23 bp, Homo sapiens
ccctagatggttccctttgttgc

SEQ ID NO: 2881537 - DNA, 14 bp, Homo sapiens
ccctccaccccagg

SEQ ID NO: 2881538 - DNA, 15 bp, Homo sapiens
ccctccaccccagga

SEQ ID NO: 2881539 - DNA, 13 bp, Homo sapiens
ccctccatccctg

SEQ ID NO: 2881540 - DNA, 20 bp, Homo sapiens
ccctcccacccccagccccg

SEQ ID NO: 2881541 - DNA, 15 bp, Homo sapiens
ccctccctcgcatcc

SEQ ID NO: 2881542 - DNA, 18 bp, Homo sapiens
ccctctcatccaggtcct

SEQ ID NO: 2881543 - DNA, 20 bp, Homo sapiens
ccctctgggcagctgtcatg

SEQ ID NO: 2881544 - DNA, 18 bp, Homo sapiens
ccctctttcctgtgccag

SEQ ID NO: 2881545 - DNA, 19 bp, Homo sapiens
ccctctttcctgtgccagg

SEQ ID NO: 2881546 - DNA, 13 bp, Homo sapiens
ccctgcccccatc

SEQ ID NO: 2881547 - DNA, 14 bp, Homo sapiens
ccctgctgtgggag

SEQ ID NO: 2881548 - DNA, 13 bp, Homo sapiens
ccctgcttacctg

SEQ ID NO: 2881549 - DNA, 16 bp, Homo sapiens
ccctgtagctctgcct

SEQ ID NO: 2881550 - DNA, 17 bp, Homo sapiens
ccctgtagctctgcctc

SEQ ID NO: 2881551 - DNA, 13 bp, Homo sapiens
ccctgtgatgcct

SEQ ID NO: 2881552 - DNA, 14 bp, Homo sapiens
ccctgtgatgcctg

SEQ ID NO: 2881553 - DNA, 20 bp, Homo sapiens
cccttggggtaagccagagc

SEQ ID NO: 2881554 - DNA, 14 bp, Homo sapiens
ccctttctcttctt

SEQ ID NO: 2881555 - DNA, 15 bp, Homo sapiens
ccctttgttgctgtc

SEQ ID NO: 2881556 - DNA, 21 bp, Homo sapiens
ccctttgttgctgtctggctt

SEQ ID NO: 2881557 - DNA, 12 bp, Homo sapiens
ccgaagcccagt

SEQ ID NO: 2881558 - DNA, 11 bp, Homo sapiens
ccgactccagc

SEQ ID NO: 2881559 - DNA, 16 bp, Homo sapiens
ccgactccagccagcg

SEQ ID NO: 2881560 - DNA, 13 bp, Homo sapiens
ccggcacctgcga

SEQ ID NO: 2881561 - DNA, 15 bp, Homo sapiens
ccggcacctgcgaga

SEQ ID NO: 2881562 - DNA, 12 bp, Homo sapiens
ccggcagcctgg

SEQ ID NO: 2881563 - DNA, 14 bp, Homo sapiens
ccggcagcctggtt

SEQ ID NO: 2881564 - DNA, 21 bp, Homo sapiens
ccgggaccctgctcacaggca

SEQ ID NO: 2881565 - DNA, 15 bp, Homo sapiens
gactatgaaaagcta

SEQ ID NO: 2881566 - DNA, 10 bp, Homo sapiens
gactccagcc

SEQ ID NO: 2881567 - DNA, 12 bp, Homo sapiens
gactccagccag

SEQ ID NO: 2881568 - DNA, 14 bp, Homo sapiens
gactccagccagcg

SEQ ID NO: 2881569 - DNA, 15 bp, Homo sapiens
gactccagccagcgc

SEQ ID NO: 2881570 - DNA, 14 bp, Homo sapiens
gactccctcccctg

SEQ ID NO: 2881571 - DNA, 21 bp, Homo sapiens
gactcctgtctgtcctggagg

SEQ ID NO: 2881572 - DNA, 16 bp, Homo sapiens
gactgagactggcact

SEQ ID NO: 2881573 - DNA, 22 bp, Homo sapiens
gactgagactggcacttagccc

SEQ ID NO: 2881574 - DNA, 18 bp, Homo sapiens
gactgctggtaaaataat

SEQ ID NO: 2881575 - DNA, 19 bp, Homo sapiens
gactgtgtgttgtgaaata

SEQ ID NO: 2881576 - DNA, 20 bp, Homo sapiens
gacttgaagcacagagggct

SEQ ID NO: 2881577 - DNA, 17 bp, Homo sapiens
gagaccccagagtaggg

SEQ ID NO: 2881578 - DNA, 16 bp, Homo sapiens
gagagccctgctgtgg

SEQ ID NO: 2881579 - DNA, 19 bp, Homo sapiens
gagagccctgctgtgggag

SEQ ID NO: 2881580 - DNA, 15 bp, Homo sapiens
gagaggtccctgctt

SEQ ID NO: 2881581 - DNA, 18 bp, Homo sapiens
gagatcaaatggaaagga

SEQ ID NO: 2881582 - DNA, 15 bp, Homo sapiens
gagcagatcttggaa

SEQ ID NO: 2881583 - DNA, 17 bp, Homo sapiens
gagcagtcagggtggga

SEQ ID NO: 2881584 - DNA, 17 bp, Homo sapiens
gagccctgctgtgggag

SEQ ID NO: 2881585 - DNA, 15 bp, Homo sapiens
gagccgtggccgagg

SEQ ID NO: 2881586 - DNA, 17 bp, Homo sapiens
gagcctcctgaccctgt

SEQ ID NO: 2881587 - DNA, 15 bp, Homo sapiens
gagctacgtatttaa

SEQ ID NO: 2881588 - DNA, 22 bp, Homo sapiens
gagctggaaaggatgcttctgc

SEQ ID NO: 2881589 - DNA, 23 bp, Homo sapiens
gaggcaaaaatgtccagccaccc

SEQ ID NO: 2881590 - DNA, 17 bp, Homo sapiens
gaggcgcagcccgaagc

SEQ ID NO: 2881591 - DNA, 17 bp, Homo sapiens
gagggcttccctagatg

SEQ ID NO: 2881592 - DNA, 12 bp, Homo sapiens
gaggggcctggc

SEQ ID NO: 2881593 - DNA, 15 bp, Homo sapiens
gaggggcctggcctg

SEQ ID NO: 2881594 - DNA, 20 bp, Homo sapiens
gaggtctgagccctggtgtg

SEQ ID NO: 2881595 - DNA, 21 bp, Homo sapiens
gaggtgggagacaaggaacca

SEQ ID NO: 2881596 - DNA, 21 bp, Homo sapiens
gaggtgggggtctggcctagt

SEQ ID NO: 2881597 - DNA, 18 bp, Homo sapiens
gaggttttattctgactt

SEQ ID NO: 2881598 - DNA, 19 bp, Homo sapiens
gagtagggttgccagtcct

SEQ ID NO: 2881599 - DNA, 13 bp, Homo sapiens
gagtcagaggaga

SEQ ID NO: 2881600 - DNA, 20 bp, Homo sapiens
gagtcctgtctctgcctgcg

SEQ ID NO: 2881601 - DNA, 13 bp, Homo sapiens
gagtctgtctctt

SEQ ID NO: 2881602 - DNA, 17 bp, Homo sapiens
gagtctgtctcttggct

SEQ ID NO: 2881603 - DNA, 22 bp, Homo sapiens
gagtggcatcttctttgcatcc

SEQ ID NO: 2881604 - DNA, 19 bp, Homo sapiens
gagttctcatccacagagg

SEQ ID NO: 2881605 - DNA, 23 bp, Homo sapiens
gagttgctcctacccctgtcctg

SEQ ID NO: 2881606 - DNA, 17 bp, Homo sapiens
gataaagattttttaat

SEQ ID NO: 2881607 - DNA, 19 bp, Homo sapiens
gataaagattttttaataa

SEQ ID NO: 2881608 - DNA, 18 bp, Homo sapiens
gataattttaaattctct

SEQ ID NO: 2881609 - DNA, 22 bp, Homo sapiens
gatattcctattgtgcaatgta

SEQ ID NO: 2881610 - DNA, 18 bp, Homo sapiens
gatcctggattcactcac

SEQ ID NO: 2881611 - DNA, 23 bp, Homo sapiens
gatccttcatcgaacaaactgat

SEQ ID NO: 2881612 - DNA, 20 bp, Homo sapiens
gatctccactgttgggtggg

SEQ ID NO: 2881613 - DNA, 23 bp, Homo sapiens
gatgaggggcttcctgggtcctg

SEQ ID NO: 2881614 - DNA, 17 bp, Homo sapiens
gatgcagcaaaatgtga

SEQ ID NO: 2881615 - DNA, 20 bp, Homo sapiens
gatgcttctgctcacattcc

SEQ ID NO: 2881616 - DNA, 13 bp, Homo sapiens
gatggcctgagaa

SEQ ID NO: 2881617 - DNA, 12 bp, Homo sapiens
gattattcaaga

SEQ ID NO: 2881618 - DNA, 13 bp, Homo sapiens
gattattcaagaa

SEQ ID NO: 2881619 - DNA, 21 bp, Homo sapiens
gattcctttgaagaggaaaat

SEQ ID NO: 2881620 - DNA, 18 bp, Homo sapiens
gcaaaaaagaaaaccttt

SEQ ID NO: 2881621 - DNA, 22 bp, Homo sapiens
gcaaaaatgtccagccaccccc

SEQ ID NO: 2881622 - DNA, 11 bp, Homo sapiens
gcaacagcctg

SEQ ID NO: 2881623 - DNA, 11 bp, Homo sapiens
gcaagaaagcc

SEQ ID NO: 2881624 - DNA, 21 bp, Homo sapiens
gcaagaaggcaaaaatagttt

SEQ ID NO: 2881625 - DNA, 17 bp, Homo sapiens
gcaagattttgtcaaaa

SEQ ID NO: 2881626 - DNA, 23 bp, Homo sapiens
gcaagcttaatggctgataattt

SEQ ID NO: 2881627 - DNA, 19 bp, Homo sapiens
gcaatgtaaatattttaaa

SEQ ID NO: 2881628 - DNA, 23 bp, Homo sapiens
gcaatgtaaatattttaaagaat

SEQ ID NO: 2881629 - DNA, 16 bp, Homo sapiens
gcaccaaaagaagtaa

SEQ ID NO: 2881630 - DNA, 18 bp, Homo sapiens
gcaccaaaagaagtaaaa

SEQ ID NO: 2881631 - DNA, 15 bp, Homo sapiens
gcaccatctgcttgg

SEQ ID NO: 2881632 - DNA, 14 bp, Homo sapiens
gcacctcagacaat

SEQ ID NO: 2881633 - DNA, 16 bp, Homo sapiens
gcacctcagacaatcc

SEQ ID NO: 2881634 - DNA, 12 bp, Homo sapiens
gcactcagagct

SEQ ID NO: 2881635 - DNA, 15 bp, Homo sapiens
gcactccctaagaaa

SEQ ID NO: 2881636 - DNA, 22 bp, Homo sapiens
gcactccctaagaaaccccagg

SEQ ID NO: 2881637 - DNA, 19 bp, Homo sapiens
gcactgggccggcagcctg

SEQ ID NO: 2881638 - DNA, 17 bp, Homo sapiens
gcagaccttttttagga

SEQ ID NO: 2881639 - DNA, 14 bp, Homo sapiens
gcagagtctgtctc

SEQ ID NO: 2881640 - DNA, 21 bp, Homo sapiens
gcagcagggcaggaaggggaa

SEQ ID NO: 2881641 - DNA, 18 bp, Homo sapiens
gcagcccgaagcccagtt

SEQ ID NO: 2881642 - DNA, 22 bp, Homo sapiens
gcagcctggttccctctttcct

SEQ ID NO: 2881643 - DNA, 22 bp, Homo sapiens
gcagctcaagttagcatttcaa

SEQ ID NO: 2881644 - DNA, 17 bp, Homo sapiens
gcagctgagagccctgc

SEQ ID NO: 2881645 - DNA, 23 bp, Homo sapiens
gcagctgagagccctgctgtggg

SEQ ID NO: 2881646 - DNA, 14 bp, Homo sapiens
gcagctgggcactg

SEQ ID NO: 2881647 - DNA, 15 bp, Homo sapiens
gcagggcctggcctg

SEQ ID NO: 2881648 - DNA, 16 bp, Homo sapiens
gcagggcctggcctgg

SEQ ID NO: 2881649 - DNA, 17 bp, Homo sapiens
gcagggcctggcctggt

SEQ ID NO: 2881650 - DNA, 23 bp, Homo sapiens
gcagtattgccacaatgcctctc

SEQ ID NO: 2881651 - DNA, 13 bp, Homo sapiens
gcatccgcctctg

SEQ ID NO: 2881652 - DNA, 18 bp, Homo sapiens
gcatccgcctctgagcca

SEQ ID NO: 2881653 - DNA, 17 bp, Homo sapiens
gcatctgttagcagagt

SEQ ID NO: 2881654 - DNA, 15 bp, Homo sapiens
gcatcttctggcttg

SEQ ID NO: 2881655 - DNA, 17 bp, Homo sapiens
gcatgcgaatgagctgg

SEQ ID NO: 2881656 - DNA, 19 bp, Homo sapiens
gcatgcgaatgagctgggc

SEQ ID NO: 2881657 - DNA, 19 bp, Homo sapiens
gcatggcccagcctggagc

SEQ ID NO: 2881658 - DNA, 15 bp, Homo sapiens
gcatggctattttat

SEQ ID NO: 2881659 - DNA, 16 bp, Homo sapiens
gcattcagaagaaaaa

SEQ ID NO: 2881660 - DNA, 19 bp, Homo sapiens
gcattgaatggctatgttt

SEQ ID NO: 2881661 - DNA, 13 bp, Homo sapiens
gccaaaaatagct

SEQ ID NO: 2881662 - DNA, 23 bp, Homo sapiens
gccaagggctccagggccagggt

SEQ ID NO: 2881663 - DNA, 18 bp, Homo sapiens
gccaataaagtgatctgt

SEQ ID NO: 2881664 - DNA, 19 bp, Homo sapiens
gccacaatgcctctcccac

SEQ ID NO: 2881665 - DNA, 20 bp, Homo sapiens
gccacaatgcctctcccacg

SEQ ID NO: 2881666 - DNA, 14 bp, Homo sapiens
gccacccagccagg

SEQ ID NO: 2881667 - DNA, 12 bp, Homo sapiens
gccactcatttc

SEQ ID NO: 2881668 - DNA, 13 bp, Homo sapiens
gccactcatttca

SEQ ID NO: 2881669 - DNA, 18 bp, Homo sapiens
gccactcatttcatctca

SEQ ID NO: 2881670 - DNA, 12 bp, Homo sapiens
gccagagcctgg

SEQ ID NO: 2881671 - DNA, 21 bp, Homo sapiens
gccagcgcctccctccacccc

SEQ ID NO: 2881672 - DNA, 22 bp, Homo sapiens
gccagcgcctccctccacccca

SEQ ID NO: 2881673 - DNA, 23 bp, Homo sapiens
gccagcgcctccctccaccccag

SEQ ID NO: 2881674 - DNA, 21 bp, Homo sapiens
gccagctctagttttcagcct

SEQ ID NO: 2881675 - DNA, 14 bp, Homo sapiens
gccaggagctcagc

SEQ ID NO: 2881676 - DNA, 18 bp, Homo sapiens
gccaggaggggctgtcca

SEQ ID NO: 2881677 - DNA, 17 bp, Homo sapiens
gccaggatccccctctt

SEQ ID NO: 2881678 - DNA, 21 bp, Homo sapiens
gccaggcatggcccagcctgg

SEQ ID NO: 2881679 - DNA, 22 bp, Homo sapiens
gccaggcatggcccagcctgga

SEQ ID NO: 2881680 - DNA, 15 bp, Homo sapiens
gccaggctaattttt

SEQ ID NO: 2881681 - DNA, 20 bp, Homo sapiens
gccatgaagtcaccgggatg

SEQ ID NO: 2881682 - DNA, 14 bp, Homo sapiens
gccatgccaataaa

SEQ ID NO: 2881683 - DNA, 17 bp, Homo sapiens
gcccaagaggtctgagc

SEQ ID NO: 2881684 - DNA, 16 bp, Homo sapiens
gcccagccctaaacat

SEQ ID NO: 2881685 - DNA, 15 bp, Homo sapiens
tctgagccctggtgt

SEQ ID NO: 2881686 - DNA, 20 bp, Homo sapiens
tctgagccctggtgtgtttc

SEQ ID NO: 2881687 - DNA, 16 bp, Homo sapiens
tctgagtcctgtctct

SEQ ID NO: 2881688 - DNA, 16 bp, Homo sapiens
tctgcaacagcctgtt

SEQ ID NO: 2881689 - DNA, 13 bp, Homo sapiens
tctgcctgcctca

SEQ ID NO: 2881690 - DNA, 19 bp, Homo sapiens
tctgcctgcctcatgctct

SEQ ID NO: 2881691 - DNA, 22 bp, Homo sapiens
tctgcctgcctcatgctctcta

SEQ ID NO: 2881692 - DNA, 16 bp, Homo sapiens
tctgctactttgctgc

SEQ ID NO: 2881693 - DNA, 22 bp, Homo sapiens
tctggcctagtggggaggggcc

SEQ ID NO: 2881694 - DNA, 14 bp, Homo sapiens
tctggcttgactgg

SEQ ID NO: 2881695 - DNA, 14 bp, Homo sapiens
tctgtcccctctcc

SEQ ID NO: 2881696 - DNA, 22 bp, Homo sapiens
tctgtgcatttgtgtctgcctg

SEQ ID NO: 2881697 - DNA, 21 bp, Homo sapiens
tctgtggaagtagctttgaac

SEQ ID NO: 2881698 - DNA, 14 bp, Homo sapiens
tctgttactgaaat

SEQ ID NO: 2881699 - DNA, 19 bp, Homo sapiens
tcttaaataagaaactttt

SEQ ID NO: 2881700 - DNA, 15 bp, Homo sapiens
tcttactatttcaca

SEQ ID NO: 2881701 - DNA, 14 bp, Homo sapiens
tcttctatcctgca

SEQ ID NO: 2881702 - DNA, 17 bp, Homo sapiens
tgaaaagctagaattga

SEQ ID NO: 2881703 - DNA, 21 bp, Homo sapiens
tgaaaaggtttatgaaaaaga

SEQ ID NO: 2881704 - DNA, 13 bp, Homo sapiens
tgaaaattattta

SEQ ID NO: 2881705 - DNA, 14 bp, Homo sapiens
tgaaacaaagagtt

SEQ ID NO: 2881706 - DNA, 23 bp, Homo sapiens
tgaaacaaagagttcaagaaata

SEQ ID NO: 2881707 - DNA, 13 bp, Homo sapiens
tgaacagaacata

SEQ ID NO: 2881708 - DNA, 21 bp, Homo sapiens
tgaaccttgttgatgccagct

SEQ ID NO: 2881709 - DNA, 22 bp, Homo sapiens
tgaactgagccaaacacactgt

SEQ ID NO: 2881710 - DNA, 19 bp, Homo sapiens
tgaagaatacttctcattt

SEQ ID NO: 2881711 - DNA, 20 bp, Homo sapiens
tgaagaatacttctcatttt

SEQ ID NO: 2881712 - DNA, 21 bp, Homo sapiens
tgaagaatacttctcattttt

SEQ ID NO: 2881713 - DNA, 19 bp, Homo sapiens
tgaagaggaaaatgaataa

SEQ ID NO: 2881714 - DNA, 18 bp, Homo sapiens
tgaagccccttgtcctct

SEQ ID NO: 2881715 - DNA, 22 bp, Homo sapiens
tgaagccccttgtcctctcccg

SEQ ID NO: 2881716 - DNA, 23 bp, Homo sapiens
tgaagccccttgtcctctcccgc

SEQ ID NO: 2881717 - DNA, 19 bp, Homo sapiens
tgaagtcaccgggatgaac

SEQ ID NO: 2881718 - DNA, 18 bp, Homo sapiens
tgaagttagctttaactt

SEQ ID NO: 2881719 - DNA, 23 bp, Homo sapiens
tgaagttagctttaacttaaata

SEQ ID NO: 2881720 - DNA, 13 bp, Homo sapiens
tgaatctgttact

SEQ ID NO: 2881721 - DNA, 15 bp, Homo sapiens
tgaatctgttactga

SEQ ID NO: 2881722 - DNA, 21 bp, Homo sapiens
tgaatctgttactgaaatgag

SEQ ID NO: 2881723 - DNA, 19 bp, Homo sapiens
tgaatgcaaaccatagcac

SEQ ID NO: 2881724 - DNA, 20 bp, Homo sapiens
tgaatggctatgtttttaat

SEQ ID NO: 2881725 - DNA, 14 bp, Homo sapiens
tgaatgggaaaaga

SEQ ID NO: 2881726 - DNA, 17 bp, Homo sapiens
tgaatttttaaacaagt

SEQ ID NO: 2881727 - DNA, 22 bp, Homo sapiens
tgacacaggggacactgaacct

SEQ ID NO: 2881728 - DNA, 14 bp, Homo sapiens
tgacataaagttga

SEQ ID NO: 2881729 - DNA, 13 bp, Homo sapiens
tgacatagccttt

SEQ ID NO: 2881730 - DNA, 14 bp, Homo sapiens
tgacatagcctttg

SEQ ID NO: 2881731 - DNA, 16 bp, Homo sapiens
tgacatagcctttgtg

SEQ ID NO: 2881732 - DNA, 15 bp, Homo sapiens
tgaccaagatactta

SEQ ID NO: 2881733 - DNA, 12 bp, Homo sapiens
tgaccatgtact

SEQ ID NO: 2881734 - DNA, 20 bp, Homo sapiens
tgacccagagtggagtctga

SEQ ID NO: 2881735 - DNA, 18 bp, Homo sapiens
tgacctcgtgatccaccc

SEQ ID NO: 2881736 - DNA, 21 bp, Homo sapiens
tgacctgaccggcacctgcga

SEQ ID NO: 2881737 - DNA, 18 bp, Homo sapiens
tgactgtgtgttgtgaaa

SEQ ID NO: 2881738 - DNA, 13 bp, Homo sapiens
tgagaaatttaaa

SEQ ID NO: 2881739 - DNA, 18 bp, Homo sapiens
tgagaaatttaaactata

SEQ ID NO: 2881740 - DNA, 18 bp, Homo sapiens
tgagaagagagatcaaat

SEQ ID NO: 2881741 - DNA, 13 bp, Homo sapiens
tgagactggcact

SEQ ID NO: 2881742 - DNA, 21 bp, Homo sapiens
tgagatttcttttaaagaagt

SEQ ID NO: 2881743 - DNA, 18 bp, Homo sapiens
tgagccaaacacactgta

SEQ ID NO: 2881744 - DNA, 12 bp, Homo sapiens
tgagccaggagc

SEQ ID NO: 2881745 - DNA, 13 bp, Homo sapiens
tgagccaggagcc

SEQ ID NO: 2881746 - DNA, 23 bp, Homo sapiens
tgagctggaaaggatgcttctgc

SEQ ID NO: 2881747 - DNA, 21 bp, Homo sapiens
tgagctgggccctgggtgagg

SEQ ID NO: 2881748 - DNA, 14 bp, Homo sapiens
tgaggacaggagag

SEQ ID NO: 2881749 - DNA, 16 bp, Homo sapiens
tgaggagagaaggaca

SEQ ID NO: 2881750 - DNA, 20 bp, Homo sapiens
tgagggccttgcacatagga

SEQ ID NO: 2881751 - DNA, 18 bp, Homo sapiens
tgataaagattttttaat

SEQ ID NO: 2881752 - DNA, 14 bp, Homo sapiens
tgataattttaaat

SEQ ID NO: 2881753 - DNA, 12 bp, Homo sapiens
tgatacagcctt

SEQ ID NO: 2881754 - DNA, 14 bp, Homo sapiens
tgatactaagcatt

SEQ ID NO: 2881755 - DNA, 15 bp, Homo sapiens
tgatctgtcccctct

SEQ ID NO: 2881756 - DNA, 18 bp, Homo sapiens
tgatgccaaaaaaaaata

SEQ ID NO: 2881757 - DNA, 13 bp, Homo sapiens
tgatgccagctgt

SEQ ID NO: 2881758 - DNA, 17 bp, Homo sapiens
tgatgcgaaaacttgaa

SEQ ID NO: 2881759 - DNA, 21 bp, Homo sapiens
tgatgcgaaaacttgaatctg

SEQ ID NO: 2881760 - DNA, 21 bp, Homo sapiens
tgattcctttgaagaggaaaa

SEQ ID NO: 2881761 - DNA, 14 bp, Homo sapiens
tgattgtcttaata

SEQ ID NO: 2881762 - DNA, 13 bp, Homo sapiens
tgcaacagcctgt

SEQ ID NO: 2881763 - DNA, 13 bp, Homo sapiens
tgcaagagtggac

SEQ ID NO: 2881764 - DNA, 16 bp, Homo sapiens
tgcaatttcccctctg

SEQ ID NO: 2881765 - DNA, 21 bp, Homo sapiens
tgcacctaaagaaaaacaaac

SEQ ID NO: 2881766 - DNA, 14 bp, Homo sapiens
tgcactccctaaga

SEQ ID NO: 2881767 - DNA, 20 bp, Homo sapiens
tgcagcagggcaggaagggg

SEQ ID NO: 2881768 - DNA, 22 bp, Homo sapiens
tgcagcagggcaggaaggggaa

SEQ ID NO: 2881769 - DNA, 14 bp, Homo sapiens
tgcagtattgccac

SEQ ID NO: 2881770 - DNA, 16 bp, Homo sapiens
tgcagtattgccacaa

SEQ ID NO: 2881771 - DNA, 19 bp, Homo sapiens
tgcatttgtgtctgcctgc

SEQ ID NO: 2881772 - DNA, 17 bp, Homo sapiens
tgccaataaagtgatct

SEQ ID NO: 2881773 - DNA, 21 bp, Homo sapiens
tgccaataaagtgatctgtgt

SEQ ID NO: 2881774 - DNA, 15 bp, Homo sapiens
tgccacaatgcctct

SEQ ID NO: 2881775 - DNA, 15 bp, Homo sapiens
tgccaggactctctt

SEQ ID NO: 2881776 - DNA, 16 bp, Homo sapiens
tgccaggctaattttt

SEQ ID NO: 2881777 - DNA, 17 bp, Homo sapiens
tgccaggctaatttttt

SEQ ID NO: 2881778 - DNA, 14 bp, Homo sapiens
tgccagtcctgcaa

SEQ ID NO: 2881779 - DNA, 24 bp, Homo sapiens
tgccctgtatataatactaaagtg

SEQ ID NO: 2881780 - DNA, 11 bp, Homo sapiens
tgcccttgggg

SEQ ID NO: 2881781 - DNA, 14 bp, Homo sapiens
tgcctcatgctctc

SEQ ID NO: 2881782 - DNA, 19 bp, Homo sapiens
tgcctgcctcatgctctct

SEQ ID NO: 2881783 - DNA, 13 bp, Homo sapiens
tgccttctcttct

SEQ ID NO: 2881784 - DNA, 14 bp, Homo sapiens
tgccttctcttcta

SEQ ID NO: 2881785 - DNA, 18 bp, Homo sapiens
tgccttctcttctatcct

SEQ ID NO: 2881786 - DNA, 13 bp, Homo sapiens
tgccttttcaaat

SEQ ID NO: 2881787 - DNA, 21 bp, Homo sapiens
tgccttttcaaatcaagaaaa

SEQ ID NO: 2881788 - DNA, 14 bp, Homo sapiens
tgcgaaaacttgaa

SEQ ID NO: 2881789 - DNA, 19 bp, Homo sapiens
tgcgaatgagctgggccct

SEQ ID NO: 2881790 - DNA, 14 bp, Homo sapiens
tgcgcgtgtgcacg

SEQ ID NO: 2881791 - DNA, 23 bp, Homo sapiens
tgcggttcaggaaaattgaatgc

SEQ ID NO: 2881792 - DNA, 13 bp, Homo sapiens
tgctaagagaagt

SEQ ID NO: 2881793 - DNA, 15 bp, Homo sapiens
tgctaggggatgagg

SEQ ID NO: 2881794 - DNA, 14 bp, Homo sapiens
tgctatggttttct

SEQ ID NO: 2881795 - DNA, 14 bp, Homo sapiens
tgctattgaactga

SEQ ID NO: 2881796 - DNA, 17 bp, Homo sapiens
tgctcacattccctctc

SEQ ID NO: 2881797 - DNA, 18 bp, Homo sapiens
tgctcacattccctctca

SEQ ID NO: 2881798 - DNA, 12 bp, Homo sapiens
tgctggcacctc

SEQ ID NO: 2881799 - DNA, 13 bp, Homo sapiens
tgctggcacctca

SEQ ID NO: 2881800 - DNA, 15 bp, Homo sapiens
tgctggcacctcaga

SEQ ID NO: 2881801 - DNA, 14 bp, Homo sapiens
tgctgtctggcttt

SEQ ID NO: 2881802 - DNA, 18 bp, Homo sapiens
tgcttggttggctggcag

SEQ ID NO: 2881803 - DNA, 15 bp, Homo sapiens
tggaaaagcccagtg

SEQ ID NO: 2881804 - DNA, 14 bp, Homo sapiens
tggaaaggagagga

SEQ ID NO: 2881805 - DNA, 17 bp, Homo sapiens
tggaaaggagaggaaag

SEQ ID NO: 2881806 - DNA, 20 bp, Homo sapiens
agagccctgctgtgggagag

SEQ ID NO: 2881807 - DNA, 23 bp, Homo sapiens
agagctgacccagagtggagtct

SEQ ID NO: 2881808 - DNA, 14 bp, Homo sapiens
agaggaagcaagaa

SEQ ID NO: 2881809 - DNA, 17 bp, Homo sapiens
agaggaagttaaaattt

SEQ ID NO: 2881810 - DNA, 15 bp, Homo sapiens
agaggagaagagaca

SEQ ID NO: 2881811 - DNA, 12 bp, Homo sapiens
agaggaggatgg

SEQ ID NO: 2881812 - DNA, 16 bp, Homo sapiens
agaggtctgagccctg

SEQ ID NO: 2881813 - DNA, 21 bp, Homo sapiens
agagtagggttgccagtcctg

SEQ ID NO: 2881814 - DNA, 16 bp, Homo sapiens
agagtcagaggagaag

SEQ ID NO: 2881815 - DNA, 19 bp, Homo sapiens
agagtggccaatccctgtg

SEQ ID NO: 2881816 - DNA, 16 bp, Homo sapiens
agatcaaatggaaagg

SEQ ID NO: 2881817 - DNA, 14 bp, Homo sapiens
agatggttcccttt

SEQ ID NO: 2881818 - DNA, 15 bp, Homo sapiens
agatggttccctttg

SEQ ID NO: 2881819 - DNA, 13 bp, Homo sapiens
agattttttaata

SEQ ID NO: 2881820 - DNA, 16 bp, Homo sapiens
agattttttaataatt

SEQ ID NO: 2881821 - DNA, 14 bp, Homo sapiens
agcaaaagaagaag

SEQ ID NO: 2881822 - DNA, 22 bp, Homo sapiens
agcaaatcgaatgaaattaact

SEQ ID NO: 2881823 - DNA, 19 bp, Homo sapiens
agcaagaaggcaaaaatag

SEQ ID NO: 2881824 - DNA, 13 bp, Homo sapiens
agcacagagggct

SEQ ID NO: 2881825 - DNA, 16 bp, Homo sapiens
agcagagtctgtctct

SEQ ID NO: 2881826 - DNA, 17 bp, Homo sapiens
agcatggagagtggcat

SEQ ID NO: 2881827 - DNA, 15 bp, Homo sapiens
agcatggctatttta

SEQ ID NO: 2881828 - DNA, 18 bp, Homo sapiens
agcatggctattttatat

SEQ ID NO: 2881829 - DNA, 20 bp, Homo sapiens
agcatgggtgtgcccttggg

SEQ ID NO: 2881830 - DNA, 15 bp, Homo sapiens
agcattcagaagaaa

SEQ ID NO: 2881831 - DNA, 17 bp, Homo sapiens
agcattcagaagaaaaa

SEQ ID NO: 2881832 - DNA, 15 bp, Homo sapiens
agcattgaatggcta

SEQ ID NO: 2881833 - DNA, 14 bp, Homo sapiens
agccaaaaatagct

SEQ ID NO: 2881834 - DNA, 14 bp, Homo sapiens
agccaaacacactg

SEQ ID NO: 2881835 - DNA, 17 bp, Homo sapiens
agccaaacacactgtaa

SEQ ID NO: 2881836 - DNA, 19 bp, Homo sapiens
agccaagatcgtgccattg

SEQ ID NO: 2881837 - DNA, 16 bp, Homo sapiens
agccacccagccagga

SEQ ID NO: 2881838 - DNA, 14 bp, Homo sapiens
agccagcgcctccc

SEQ ID NO: 2881839 - DNA, 18 bp, Homo sapiens
agccagcgcctccctcca

SEQ ID NO: 2881840 - DNA, 16 bp, Homo sapiens
agccaggagcctcctg

SEQ ID NO: 2881841 - DNA, 22 bp, Homo sapiens
agcccaagaggtctgagccctg

SEQ ID NO: 2881842 - DNA, 16 bp, Homo sapiens
agcccagtgacctgac

SEQ ID NO: 2881843 - DNA, 17 bp, Homo sapiens
agcccagtgacctgacc

SEQ ID NO: 2881844 - DNA, 18 bp, Homo sapiens
agcccagtgacctgaccg

SEQ ID NO: 2881845 - DNA, 14 bp, Homo sapiens
agcccagtttccct

SEQ ID NO: 2881846 - DNA, 23 bp, Homo sapiens
agcccagtttcccttctatgcag

SEQ ID NO: 2881847 - DNA, 16 bp, Homo sapiens
agccccgactccagcc

SEQ ID NO: 2881848 - DNA, 19 bp, Homo sapiens
agcccctacaactccagcc

SEQ ID NO: 2881849 - DNA, 15 bp, Homo sapiens
agcccgaagcccagt

SEQ ID NO: 2881850 - DNA, 22 bp, Homo sapiens
agcctaggcaacaagagtgaaa

SEQ ID NO: 2881851 - DNA, 15 bp, Homo sapiens
agcctcctgaccctg

SEQ ID NO: 2881852 - DNA, 17 bp, Homo sapiens
agcctgacaacatttct

SEQ ID NO: 2881853 - DNA, 13 bp, Homo sapiens
agcctggagccgt

SEQ ID NO: 2881854 - DNA, 15 bp, Homo sapiens
agcctggttccctct

SEQ ID NO: 2881855 - DNA, 16 bp, Homo sapiens
agcctggttccctctt

SEQ ID NO: 2881856 - DNA, 18 bp, Homo sapiens
agcctggttccctctttc

SEQ ID NO: 2881857 - DNA, 11 bp, Homo sapiens
agcctgtggga

SEQ ID NO: 2881858 - DNA, 17 bp, Homo sapiens
agcctgtgggagtagaa

SEQ ID NO: 2881859 - DNA, 20 bp, Homo sapiens
agcctgtgggagtagaaaaa

SEQ ID NO: 2881860 - DNA, 23 bp, Homo sapiens
agcctgtttgggaggctggagtg

SEQ ID NO: 2881861 - DNA, 13 bp, Homo sapiens
agcgcacttccca

SEQ ID NO: 2881862 - DNA, 18 bp, Homo sapiens
agcgcctccctccacccc

SEQ ID NO: 2881863 - DNA, 20 bp, Homo sapiens
agcgtcccctgctactcctg

SEQ ID NO: 2881864 - DNA, 16 bp, Homo sapiens
agcgtggggtagcaga

SEQ ID NO: 2881865 - DNA, 14 bp, Homo sapiens
agctagaattgagt

SEQ ID NO: 2881866 - DNA, 20 bp, Homo sapiens
agctagccagagggtgggag

SEQ ID NO: 2881867 - DNA, 19 bp, Homo sapiens
agctctagttttcagcctt

SEQ ID NO: 2881868 - DNA, 11 bp, Homo sapiens
agctctgcctc

SEQ ID NO: 2881869 - DNA, 14 bp, Homo sapiens
agctgagagccctg

SEQ ID NO: 2881870 - DNA, 22 bp, Homo sapiens
agctgagagccctgctgtggga

SEQ ID NO: 2881871 - DNA, 12 bp, Homo sapiens
agctgagctgga

SEQ ID NO: 2881872 - DNA, 20 bp, Homo sapiens
agctggtttaatgttttggc

SEQ ID NO: 2881873 - DNA, 20 bp, Homo sapiens
agctgtcatggaaaagccca

SEQ ID NO: 2881874 - DNA, 22 bp, Homo sapiens
agcttaaaactttgaagttagc

SEQ ID NO: 2881875 - DNA, 19 bp, Homo sapiens
agcttaatggctgataatt

SEQ ID NO: 2881876 - DNA, 22 bp, Homo sapiens
agcttaatggctgataatttta

SEQ ID NO: 2881877 - DNA, 18 bp, Homo sapiens
agctttaacttaaatagt

SEQ ID NO: 2881878 - DNA, 17 bp, Homo sapiens
aggaagcaagcttaatg

SEQ ID NO: 2881879 - DNA, 19 bp, Homo sapiens
aggacgccactcatttcat

SEQ ID NO: 2881880 - DNA, 23 bp, Homo sapiens
aggacgccactcatttcatctca

SEQ ID NO: 2881881 - DNA, 14 bp, Homo sapiens
aggactctctttct

SEQ ID NO: 2881882 - DNA, 12 bp, Homo sapiens
aggagaggaaag

SEQ ID NO: 2881883 - DNA, 22 bp, Homo sapiens
aggagagttcaagcctgtggga

SEQ ID NO: 2881884 - DNA, 20 bp, Homo sapiens
aggagcctcctgaccctgtg

SEQ ID NO: 2881885 - DNA, 14 bp, Homo sapiens
aggatccccctctt

SEQ ID NO: 2881886 - DNA, 17 bp, Homo sapiens
aggcaccaaaagaagta

SEQ ID NO: 2881887 - DNA, 20 bp, Homo sapiens
aggcaccaaaagaagtaaaa

SEQ ID NO: 2881888 - DNA, 21 bp, Homo sapiens
aggcatctgttagcagagtct

SEQ ID NO: 2881889 - DNA, 23 bp, Homo sapiens
aggcatctgttagcagagtctgt

SEQ ID NO: 2881890 - DNA, 23 bp, Homo sapiens
aggccaggcatggcccagcctgg

SEQ ID NO: 2881891 - DNA, 21 bp, Homo sapiens
aggcgcagcccgaagcccagt

SEQ ID NO: 2881892 - DNA, 22 bp, Homo sapiens
aggcgcagcccgaagcccagtt

SEQ ID NO: 2881893 - DNA, 20 bp, Homo sapiens
aggctgcagagctgacccag

SEQ ID NO: 2881894 - DNA, 15 bp, Homo sapiens
agggatggggagcag

SEQ ID NO: 2881895 - DNA, 18 bp, Homo sapiens
agggatggggagcagctg

SEQ ID NO: 2881896 - DNA, 12 bp, Homo sapiens
agggcagtgaga

SEQ ID NO: 2881897 - DNA, 14 bp, Homo sapiens
agggctccagggcc

SEQ ID NO: 2881898 - DNA, 16 bp, Homo sapiens
aggggacactgaacct

SEQ ID NO: 2881899 - DNA, 19 bp, Homo sapiens
aggggatgaggggcttcct

SEQ ID NO: 2881900 - DNA, 18 bp, Homo sapiens
agggtgggaagaaagaat

SEQ ID NO: 2881901 - DNA, 16 bp, Homo sapiens
agggtgtgagggatgg

SEQ ID NO: 2881902 - DNA, 15 bp, Homo sapiens
aggtccagacccact

SEQ ID NO: 2881903 - DNA, 20 bp, Homo sapiens
aggtccctgcttacctgacg

SEQ ID NO: 2881904 - DNA, 21 bp, Homo sapiens
aggtcctttccttctcgtctt

SEQ ID NO: 2881905 - DNA, 22 bp, Homo sapiens
aggtctagtatccaaaatattt

SEQ ID NO: 2881906 - DNA, 20 bp, Homo sapiens
aggtggaggttgcagtgagc

SEQ ID NO: 2881907 - DNA, 16 bp, Homo sapiens
aggtgggagacaagga

SEQ ID NO: 2881908 - DNA, 15 bp, Homo sapiens
aggttgaggacagga

SEQ ID NO: 2881909 - DNA, 21 bp, Homo sapiens
aggtttatgaaaaagaagaat

SEQ ID NO: 2881910 - DNA, 12 bp, Homo sapiens
agtaaaagcaaa

SEQ ID NO: 2881911 - DNA, 19 bp, Homo sapiens
agtaaatcacgctttttga

SEQ ID NO: 2881912 - DNA, 20 bp, Homo sapiens
agtaaatcacgctttttgaa

SEQ ID NO: 2881913 - DNA, 16 bp, Homo sapiens
agtaacatgccagctt

SEQ ID NO: 2881914 - DNA, 23 bp, Homo sapiens
agtaatctgcattattggaatat

SEQ ID NO: 2881915 - DNA, 12 bp, Homo sapiens
agtaatttagaa

SEQ ID NO: 2881916 - DNA, 14 bp, Homo sapiens
agtagcagtgattg

SEQ ID NO: 2881917 - DNA, 22 bp, Homo sapiens
agtagcagtgattgtcttaata

SEQ ID NO: 2881918 - DNA, 20 bp, Homo sapiens
agtaggttgaggacaggaga

SEQ ID NO: 2881919 - DNA, 23 bp, Homo sapiens
agtaggttgaggacaggagaggg

SEQ ID NO: 2881920 - DNA, 18 bp, Homo sapiens
agtatttattttttcaaa

SEQ ID NO: 2881921 - DNA, 19 bp, Homo sapiens
agtatttattttttcaaaa

SEQ ID NO: 2881922 - DNA, 15 bp, Homo sapiens
agtatttgttaattt

SEQ ID NO: 2881923 - DNA, 13 bp, Homo sapiens
agtcaaaatttca

SEQ ID NO: 2881924 - DNA, 16 bp, Homo sapiens
agtcagaggagaagag

SEQ ID NO: 2881925 - DNA, 20 bp, Homo sapiens
agtcagaggagaagagacat

SEQ ID NO: 2881926 - DNA, 18 bp, Homo sapiens
catggcccagcctggagc

SEQ ID NO: 2881927 - DNA, 17 bp, Homo sapiens
catggctattttatatt

SEQ ID NO: 2881928 - DNA, 17 bp, Homo sapiens
catgtataattttctac

SEQ ID NO: 2881929 - DNA, 16 bp, Homo sapiens
catgtgaaaataaaat

SEQ ID NO: 2881930 - DNA, 14 bp, Homo sapiens
catgttatttgtaa

SEQ ID NO: 2881931 - DNA, 18 bp, Homo sapiens
cattaagacacacctctg

SEQ ID NO: 2881932 - DNA, 17 bp, Homo sapiens
cattcagaagaaaaaga

SEQ ID NO: 2881933 - DNA, 17 bp, Homo sapiens
cattcatttttgttgtt

SEQ ID NO: 2881934 - DNA, 15 bp, Homo sapiens
catttaagggaaaaa

SEQ ID NO: 2881935 - DNA, 18 bp, Homo sapiens
catttaagggaaaaatat

SEQ ID NO: 2881936 - DNA, 14 bp, Homo sapiens
catttattttgaca

SEQ ID NO: 2881937 - DNA, 15 bp, Homo sapiens
catttcatctcattt

SEQ ID NO: 2881938 - DNA, 23 bp, Homo sapiens
catttctatagccaaaaatagct

SEQ ID NO: 2881939 - DNA, 23 bp, Homo sapiens
catttctcattagcccagttaat

SEQ ID NO: 2881940 - DNA, 19 bp, Homo sapiens
catttctctgagcagtcag

SEQ ID NO: 2881941 - DNA, 15 bp, Homo sapiens
catttgtgtctgcct

SEQ ID NO: 2881942 - DNA, 16 bp, Homo sapiens
cattttggtactttgg

SEQ ID NO: 2881943 - DNA, 19 bp, Homo sapiens
ccaaaaaaaaatacatgct

SEQ ID NO: 2881944 - DNA, 13 bp, Homo sapiens
ccaaaaatagcta

SEQ ID NO: 2881945 - DNA, 14 bp, Homo sapiens
ccaaaacaatgttt

SEQ ID NO: 2881946 - DNA, 15 bp, Homo sapiens
ccaacataaaaatga

SEQ ID NO: 2881947 - DNA, 15 bp, Homo sapiens
ccaacctttccctca

SEQ ID NO: 2881948 - DNA, 15 bp, Homo sapiens
ccaagaggtctgagc

SEQ ID NO: 2881949 - DNA, 17 bp, Homo sapiens
ccaagaggtctgagccc

SEQ ID NO: 2881950 - DNA, 15 bp, Homo sapiens
ccaataaagtgatct

SEQ ID NO: 2881951 - DNA, 21 bp, Homo sapiens
ccaatccctgtgtgtcgttcc

SEQ ID NO: 2881952 - DNA, 18 bp, Homo sapiens
ccaatgcacctaaagaaa

SEQ ID NO: 2881953 - DNA, 15 bp, Homo sapiens
ccaatggctgtaaac

SEQ ID NO: 2881954 - DNA, 20 bp, Homo sapiens
ccacagactccctcccctgc

SEQ ID NO: 2881955 - DNA, 19 bp, Homo sapiens
ccacagaggccaggcatgg

SEQ ID NO: 2881956 - DNA, 20 bp, Homo sapiens
ccacgatgtcaaggactcct

SEQ ID NO: 2881957 - DNA, 22 bp, Homo sapiens
ccacgattacgtgaataaaatg

SEQ ID NO: 2881958 - DNA, 14 bp, Homo sapiens
ccactcatttcatc

SEQ ID NO: 2881959 - DNA, 23 bp, Homo sapiens
ccactctcaggaggcgcagcccg

SEQ ID NO: 2881960 - DNA, 23 bp, Homo sapiens
ccagagtagggttgccagtcctg

SEQ ID NO: 2881961 - DNA, 19 bp, Homo sapiens
ccagagtggagtctgagtc

SEQ ID NO: 2881962 - DNA, 20 bp, Homo sapiens
ccagcaggccagggactcag

SEQ ID NO: 2881963 - DNA, 16 bp, Homo sapiens
ccagccacccccaggc

SEQ ID NO: 2881964 - DNA, 12 bp, Homo sapiens
ccagccagcgcc

SEQ ID NO: 2881965 - DNA, 16 bp, Homo sapiens
ccagccagcgcctccc

SEQ ID NO: 2881966 - DNA, 17 bp, Homo sapiens
ccagccagcgcctccct

SEQ ID NO: 2881967 - DNA, 20 bp, Homo sapiens
ccagccagcgcctccctcca

SEQ ID NO: 2881968 - DNA, 15 bp, Homo sapiens
ccagccccgactcca

SEQ ID NO: 2881969 - DNA, 16 bp, Homo sapiens
ccagccccgactccag

SEQ ID NO: 2881970 - DNA, 16 bp, Homo sapiens
ccagcctggagccgtg

SEQ ID NO: 2881971 - DNA, 16 bp, Homo sapiens
ccagcgcctccctcca

SEQ ID NO: 2881972 - DNA, 19 bp, Homo sapiens
ccagcgcctccctccaccc

SEQ ID NO: 2881973 - DNA, 23 bp, Homo sapiens
ccagcgcctccctccaccccagg

SEQ ID NO: 2881974 - DNA, 14 bp, Homo sapiens
ccagctaactccag

SEQ ID NO: 2881975 - DNA, 23 bp, Homo sapiens
ccagctaactccagtctcctgac

SEQ ID NO: 2881976 - DNA, 23 bp, Homo sapiens
ccagctgtactgagttctcatcc

SEQ ID NO: 2881977 - DNA, 15 bp, Homo sapiens
ccagcttcctgtggg

SEQ ID NO: 2881978 - DNA, 21 bp, Homo sapiens
ccagcttcctgtgggccagga

SEQ ID NO: 2881979 - DNA, 15 bp, Homo sapiens
ccaggacgccactca

SEQ ID NO: 2881980 - DNA, 19 bp, Homo sapiens
ccaggagcctcctgaccct

SEQ ID NO: 2881981 - DNA, 24 bp, Homo sapiens
ccaggcatctgttagcagagtctg

SEQ ID NO: 2881982 - DNA, 21 bp, Homo sapiens
ccaggctccctttctcttctt

SEQ ID NO: 2881983 - DNA, 14 bp, Homo sapiens
ccaggtccttcctt

SEQ ID NO: 2881984 - DNA, 19 bp, Homo sapiens
ccagtaggttgaggacagg

SEQ ID NO: 2881985 - DNA, 13 bp, Homo sapiens
ccagtgacctgac

SEQ ID NO: 2881986 - DNA, 11 bp, Homo sapiens
ccataaaataa

SEQ ID NO: 2881987 - DNA, 16 bp, Homo sapiens
ccatagctgagctgga

SEQ ID NO: 2881988 - DNA, 14 bp, Homo sapiens
ccatatctccttcc

SEQ ID NO: 2881989 - DNA, 19 bp, Homo sapiens
ccatatctccttcccctac

SEQ ID NO: 2881990 - DNA, 22 bp, Homo sapiens
ccatccctggccccctccctgg

SEQ ID NO: 2881991 - DNA, 23 bp, Homo sapiens
ccatgactgtgtgttgtgaaata

SEQ ID NO: 2881992 - DNA, 15 bp, Homo sapiens
cccaaagctcagact

SEQ ID NO: 2881993 - DNA, 16 bp, Homo sapiens
cccaacctttccctca

SEQ ID NO: 2881994 - DNA, 17 bp, Homo sapiens
cccaacctttccctcac

SEQ ID NO: 2881995 - DNA, 20 bp, Homo sapiens
cccaacctttccctcacccc

SEQ ID NO: 2881996 - DNA, 18 bp, Homo sapiens
cccaagaggactgagact

SEQ ID NO: 2881997 - DNA, 14 bp, Homo sapiens
cccaagaggtctga

SEQ ID NO: 2881998 - DNA, 16 bp, Homo sapiens
cccaagaggtctgagc

SEQ ID NO: 2881999 - DNA, 18 bp, Homo sapiens
cccaagaggtctgagccc

SEQ ID NO: 2882000 - DNA, 20 bp, Homo sapiens
cccaagaggtctgagccctg

SEQ ID NO: 2882001 - DNA, 17 bp, Homo sapiens
cccaaggaatcagcagg

SEQ ID NO: 2882002 - DNA, 18 bp, Homo sapiens
cccaaggaatcagcagga

SEQ ID NO: 2882003 - DNA, 18 bp, Homo sapiens
cccacccccagccccgac

SEQ ID NO: 2882004 - DNA, 17 bp, Homo sapiens
cccagagtcagaggaga

SEQ ID NO: 2882005 - DNA, 19 bp, Homo sapiens
cccagagtggagtctgagt

SEQ ID NO: 2882006 - DNA, 21 bp, Homo sapiens
cccagagtggagtctgagtct

SEQ ID NO: 2882007 - DNA, 23 bp, Homo sapiens
cccagccacagtgttatgctctg

SEQ ID NO: 2882008 - DNA, 17 bp, Homo sapiens
cccagccaggaggggct

SEQ ID NO: 2882009 - DNA, 18 bp, Homo sapiens
cccagccccgactccagc

SEQ ID NO: 2882010 - DNA, 23 bp, Homo sapiens
cccagccccgactccagccagcg

SEQ ID NO: 2882011 - DNA, 10 bp, Homo sapiens
cccagcctgg

SEQ ID NO: 2882012 - DNA, 19 bp, Homo sapiens
cccaggacgccactcattt

SEQ ID NO: 2882013 - DNA, 23 bp, Homo sapiens
cccaggacgccactcatttcatc

SEQ ID NO: 2882014 - DNA, 18 bp, Homo sapiens
cccaggcagacaaccttg

SEQ ID NO: 2882015 - DNA, 19 bp, Homo sapiens
cccaggcagacaaccttgt

SEQ ID NO: 2882016 - DNA, 20 bp, Homo sapiens
cccaggcagacaaccttgtc

SEQ ID NO: 2882017 - DNA, 14 bp, Homo sapiens
cccaggcatctgtt

SEQ ID NO: 2882018 - DNA, 21 bp, Homo sapiens
cccaggcatctgttagcagag

SEQ ID NO: 2882019 - DNA, 12 bp, Homo sapiens
cccagggcaggg

SEQ ID NO: 2882020 - DNA, 16 bp, Homo sapiens
cccagtgacctgaccg

SEQ ID NO: 2882021 - DNA, 22 bp, Homo sapiens
cccagtttcccttctatgcagt

SEQ ID NO: 2882022 - DNA, 23 bp, Homo sapiens
ccccagccccgactccagccagc

SEQ ID NO: 2882023 - DNA, 22 bp, Homo sapiens
ccccagggcagggaaactggct

SEQ ID NO: 2882024 - DNA, 15 bp, Homo sapiens
cccccaacctttccc

SEQ ID NO: 2882025 - DNA, 24 bp, Homo sapiens
cccccagccccgactccagccagc

SEQ ID NO: 2882026 - DNA, 15 bp, Homo sapiens
ccccgactccagcca

SEQ ID NO: 2882027 - DNA, 13 bp, Homo sapiens
cccctcccctcca

SEQ ID NO: 2882028 - DNA, 23 bp, Homo sapiens
cccctggtactcccccagccctc

SEQ ID NO: 2882029 - DNA, 13 bp, Homo sapiens
cccgaagcccagt

SEQ ID NO: 2882030 - DNA, 16 bp, Homo sapiens
cccgactccagccagc

SEQ ID NO: 2882031 - DNA, 24 bp, Homo sapiens
ccctatgtcccagcccctggtact

SEQ ID NO: 2882032 - DNA, 18 bp, Homo sapiens
ccctcaccccctcccacc

SEQ ID NO: 2882033 - DNA, 20 bp, Homo sapiens
ccctcatggagaaacatcct

SEQ ID NO: 2882034 - DNA, 13 bp, Homo sapiens
ccctccaccccag

SEQ ID NO: 2882035 - DNA, 19 bp, Homo sapiens
ccctccccacacctcccta

SEQ ID NO: 2882036 - DNA, 18 bp, Homo sapiens
ccctcccctccatccctg

SEQ ID NO: 2882037 - DNA, 16 bp, Homo sapiens
ccctcccctgccccca

SEQ ID NO: 2882038 - DNA, 16 bp, Homo sapiens
ccctctgccctgtata

SEQ ID NO: 2882039 - DNA, 19 bp, Homo sapiens
ccctctgggcagctgtcat

SEQ ID NO: 2882040 - DNA, 19 bp, Homo sapiens
ccctctgtgtcctctcccc

SEQ ID NO: 2882041 - DNA, 17 bp, Homo sapiens
ccctctttcctgtgcca

SEQ ID NO: 2882042 - DNA, 16 bp, Homo sapiens
ccctctttgcacagca

SEQ ID NO: 2882043 - DNA, 22 bp, Homo sapiens
ccctgctactcctgtgctctgg

SEQ ID NO: 2882044 - DNA, 17 bp, Homo sapiens
ccctgcttacctgacgg

SEQ ID NO: 2882045 - DNA, 13 bp, Homo sapiens
ctaaacatcattc

SEQ ID NO: 2882046 - DNA, 23 bp, Homo sapiens
ctaaacatcattcatttttgttg

SEQ ID NO: 2882047 - DNA, 17 bp, Homo sapiens
ctaaagaaaaacaaact

SEQ ID NO: 2882048 - DNA, 14 bp, Homo sapiens
ctaaaggactggtt

SEQ ID NO: 2882049 - DNA, 13 bp, Homo sapiens
ctaaagtgtctat

SEQ ID NO: 2882050 - DNA, 11 bp, Homo sapiens
ctaaataatta

SEQ ID NO: 2882051 - DNA, 15 bp, Homo sapiens
ctaagaaaccccagg

SEQ ID NO: 2882052 - DNA, 15 bp, Homo sapiens
ctaagagaagtagaa

SEQ ID NO: 2882053 - DNA, 19 bp, Homo sapiens
ctaagtgggaagtgaagcc

SEQ ID NO: 2882054 - DNA, 14 bp, Homo sapiens
ctaatggagaagac

SEQ ID NO: 2882055 - DNA, 14 bp, Homo sapiens
ctaattttttgttg

SEQ ID NO: 2882056 - DNA, 14 bp, Homo sapiens
ctacaactccagcc

SEQ ID NO: 2882057 - DNA, 15 bp, Homo sapiens
ctacatttactttaa

SEQ ID NO: 2882058 - DNA, 13 bp, Homo sapiens
ctaccctccctcg

SEQ ID NO: 2882059 - DNA, 14 bp, Homo sapiens
ctacgtatttaata

SEQ ID NO: 2882060 - DNA, 13 bp, Homo sapiens
ctactcctgtgct

SEQ ID NO: 2882061 - DNA, 14 bp, Homo sapiens
ctactcctgtgctc

SEQ ID NO: 2882062 - DNA, 18 bp, Homo sapiens
ctactgtaattaagtgca

SEQ ID NO: 2882063 - DNA, 19 bp, Homo sapiens
ctactgtaattaagtgcaa

SEQ ID NO: 2882064 - DNA, 12 bp, Homo sapiens
ctagatggttcc

SEQ ID NO: 2882065 - DNA, 20 bp, Homo sapiens
ctagatggttccctttgttg

SEQ ID NO: 2882066 - DNA, 14 bp, Homo sapiens
ctaggggatgaggg

SEQ ID NO: 2882067 - DNA, 23 bp, Homo sapiens
ctagtggggaggggcctggcctg

SEQ ID NO: 2882068 - DNA, 22 bp, Homo sapiens
ctataaactactgtaattaagt

SEQ ID NO: 2882069 - DNA, 22 bp, Homo sapiens
ctataagcaagaaggcaaaaat

SEQ ID NO: 2882070 - DNA, 19 bp, Homo sapiens
ctataagtgttcagtgttg

SEQ ID NO: 2882071 - DNA, 20 bp, Homo sapiens
ctatacctgggcatactaat

SEQ ID NO: 2882072 - DNA, 20 bp, Homo sapiens
ctatataatatatcatcttt

SEQ ID NO: 2882073 - DNA, 19 bp, Homo sapiens
ctatcctgcaatttctccc

SEQ ID NO: 2882074 - DNA, 14 bp, Homo sapiens
ctatctatttgagg

SEQ ID NO: 2882075 - DNA, 18 bp, Homo sapiens
ctatcttactatttcaca

SEQ ID NO: 2882076 - DNA, 24 bp, Homo sapiens
ctatgcagtattgccacaatgcct

SEQ ID NO: 2882077 - DNA, 14 bp, Homo sapiens
ctatgtttttaatg

SEQ ID NO: 2882078 - DNA, 13 bp, Homo sapiens
ctattcaaaataa

SEQ ID NO: 2882079 - DNA, 21 bp, Homo sapiens
ctcaacccctcccctccatcc

SEQ ID NO: 2882080 - DNA, 13 bp, Homo sapiens
ctcaagctagcca

SEQ ID NO: 2882081 - DNA, 18 bp, Homo sapiens
ctcaagttagcatttcaa

SEQ ID NO: 2882082 - DNA, 20 bp, Homo sapiens
ctcacattccctctcatcca

SEQ ID NO: 2882083 - DNA, 22 bp, Homo sapiens
ctcaccccctcccacccccagc

SEQ ID NO: 2882084 - DNA, 23 bp, Homo sapiens
ctcaccccctcccacccccagcc

SEQ ID NO: 2882085 - DNA, 14 bp, Homo sapiens
ctcacctacttcct

SEQ ID NO: 2882086 - DNA, 15 bp, Homo sapiens
ctcagaaagccttcc

SEQ ID NO: 2882087 - DNA, 16 bp, Homo sapiens
ctcagacaatccactc

SEQ ID NO: 2882088 - DNA, 17 bp, Homo sapiens
ctcagacaatccactct

SEQ ID NO: 2882089 - DNA, 13 bp, Homo sapiens
ctcagtaatttag

SEQ ID NO: 2882090 - DNA, 15 bp, Homo sapiens
ctcagtgaagaatac

SEQ ID NO: 2882091 - DNA, 18 bp, Homo sapiens
ctcagtgaagaatacttc

SEQ ID NO: 2882092 - DNA, 14 bp, Homo sapiens
ctcatgctctctat

SEQ ID NO: 2882093 - DNA, 17 bp, Homo sapiens
ctcatttaagggaaaaa

SEQ ID NO: 2882094 - DNA, 22 bp, Homo sapiens
ctcatttaagggaaaaatatat

SEQ ID NO: 2882095 - DNA, 13 bp, Homo sapiens
ctcatttcatctc

SEQ ID NO: 2882096 - DNA, 15 bp, Homo sapiens
ctcatttcatctcat

SEQ ID NO: 2882097 - DNA, 13 bp, Homo sapiens
ctcattttttaaa

SEQ ID NO: 2882098 - DNA, 17 bp, Homo sapiens
ctccaacctgtggcgct

SEQ ID NO: 2882099 - DNA, 22 bp, Homo sapiens
ctccaccccaggacgccactca

SEQ ID NO: 2882100 - DNA, 22 bp, Homo sapiens
ctccactgttgggtgggtgggc

SEQ ID NO: 2882101 - DNA, 12 bp, Homo sapiens
ctccagccagcg

SEQ ID NO: 2882102 - DNA, 13 bp, Homo sapiens
ctccagccagcgc

SEQ ID NO: 2882103 - DNA, 21 bp, Homo sapiens
ctccagccagcgcctccctcc

SEQ ID NO: 2882104 - DNA, 23 bp, Homo sapiens
ctccagccagcgcctccctccac

SEQ ID NO: 2882105 - DNA, 17 bp, Homo sapiens
ctccagggccagggtgt

SEQ ID NO: 2882106 - DNA, 13 bp, Homo sapiens
ctccatccctggc

SEQ ID NO: 2882107 - DNA, 24 bp, Homo sapiens
ctccatccctggccccctccctgg

SEQ ID NO: 2882108 - DNA, 17 bp, Homo sapiens
ctcccaaagctcagact

SEQ ID NO: 2882109 - DNA, 15 bp, Homo sapiens
ctcccacccccagcc

SEQ ID NO: 2882110 - DNA, 22 bp, Homo sapiens
ctcccatgactgcccagctctg

SEQ ID NO: 2882111 - DNA, 15 bp, Homo sapiens
ctcccctccatccct

SEQ ID NO: 2882112 - DNA, 19 bp, Homo sapiens
ctcccctccatccctggcc

SEQ ID NO: 2882113 - DNA, 23 bp, Homo sapiens
ctcccctccatccctggccccct

SEQ ID NO: 2882114 - DNA, 15 bp, Homo sapiens
ctcccctctgccctg

SEQ ID NO: 2882115 - DNA, 15 bp, Homo sapiens
ctccctaagaaaccc

SEQ ID NO: 2882116 - DNA, 22 bp, Homo sapiens
ctccctccccacacctccctac

SEQ ID NO: 2882117 - DNA, 15 bp, Homo sapiens
ctcctacccctgtcc

SEQ ID NO: 2882118 - DNA, 19 bp, Homo sapiens
ctcctacccctgtcctggg

SEQ ID NO: 2882119 - DNA, 15 bp, Homo sapiens
ctcctcctcctcctg

SEQ ID NO: 2882120 - DNA, 13 bp, Homo sapiens
ctcctgaggtctg

SEQ ID NO: 2882121 - DNA, 15 bp, Homo sapiens
ctcctgaggtctgga

SEQ ID NO: 2882122 - DNA, 17 bp, Homo sapiens
ctcctgaggtctggatt

SEQ ID NO: 2882123 - DNA, 14 bp, Homo sapiens
ctcctgtctgtcct

SEQ ID NO: 2882124 - DNA, 19 bp, Homo sapiens
ctcctgtctgtcctggagg

SEQ ID NO: 2882125 - DNA, 21 bp, Homo sapiens
ctcctgttcctgccttctctt

SEQ ID NO: 2882126 - DNA, 17 bp, Homo sapiens
ctcgcatccgcctctga

SEQ ID NO: 2882127 - DNA, 19 bp, Homo sapiens
ctcgcatccgcctctgagc

SEQ ID NO: 2882128 - DNA, 23 bp, Homo sapiens
ctcgcatccgcctctgagccagg

SEQ ID NO: 2882129 - DNA, 13 bp, Homo sapiens
ctcgtcttcctct

SEQ ID NO: 2882130 - DNA, 16 bp, Homo sapiens
ctcgtcttcctctctc

SEQ ID NO: 2882131 - DNA, 15 bp, Homo sapiens
ctctaaaagggggct

SEQ ID NO: 2882132 - DNA, 21 bp, Homo sapiens
ctctagttttcagccttggga

SEQ ID NO: 2882133 - DNA, 17 bp, Homo sapiens
ctctataagtgttcagt

SEQ ID NO: 2882134 - DNA, 19 bp, Homo sapiens
ctctataagtgttcagtgt

SEQ ID NO: 2882135 - DNA, 22 bp, Homo sapiens
ctctataagtgttcagtgttga

SEQ ID NO: 2882136 - DNA, 12 bp, Homo sapiens
ctctcaggaggc

SEQ ID NO: 2882137 - DNA, 21 bp, Homo sapiens
ctctcaggaggcgcagcccga

SEQ ID NO: 2882138 - DNA, 22 bp, Homo sapiens
ctctcatccaggtcctttcctt

SEQ ID NO: 2882139 - DNA, 15 bp, Homo sapiens
ctctccatatctcct

SEQ ID NO: 2882140 - DNA, 21 bp, Homo sapiens
ctctctcacctacttcctcct

SEQ ID NO: 2882141 - DNA, 16 bp, Homo sapiens
ctctctttcttccact

SEQ ID NO: 2882142 - DNA, 20 bp, Homo sapiens
ctctgagccaggagcctcct

SEQ ID NO: 2882143 - DNA, 22 bp, Homo sapiens
ctctgaggcccgatctccactg

SEQ ID NO: 2882144 - DNA, 14 bp, Homo sapiens
ctctgccctgtata

SEQ ID NO: 2882145 - DNA, 15 bp, Homo sapiens
ctctgccctgtatat

SEQ ID NO: 2882146 - DNA, 14 bp, Homo sapiens
ctctgcctccctct

SEQ ID NO: 2882147 - DNA, 15 bp, Homo sapiens
ctctggatccctgga

SEQ ID NO: 2882148 - DNA, 14 bp, Homo sapiens
ctctgtattctgca

SEQ ID NO: 2882149 - DNA, 22 bp, Homo sapiens
ctctgtattctgcaacagcctg

SEQ ID NO: 2882150 - DNA, 17 bp, Homo sapiens
ctctgtgtcctctcccc

SEQ ID NO: 2882151 - DNA, 15 bp, Homo sapiens
ctcttctatcctgca

SEQ ID NO: 2882152 - DNA, 23 bp, Homo sapiens
ctcttggctttgtcacttttcct

SEQ ID NO: 2882153 - DNA, 22 bp, Homo sapiens
ctctttcttccactaccctccc

SEQ ID NO: 2882154 - DNA, 17 bp, Homo sapiens
ctgaaaattatttaaac

SEQ ID NO: 2882155 - DNA, 21 bp, Homo sapiens
ctgaaatgaggagagaaggac

SEQ ID NO: 2882156 - DNA, 18 bp, Homo sapiens
ctgaatttttaaacaagt

SEQ ID NO: 2882157 - DNA, 22 bp, Homo sapiens
ctgaatttttaaacaagtattt

SEQ ID NO: 2882158 - DNA, 23 bp, Homo sapiens
ctgagaagagagatcaaatggaa

SEQ ID NO: 2882159 - DNA, 12 bp, Homo sapiens
ctgagagccctg

SEQ ID NO: 2882160 - DNA, 13 bp, Homo sapiens
ctgagtcctgtct

SEQ ID NO: 2882161 - DNA, 18 bp, Homo sapiens
ctgagtcctgtctctgcc

SEQ ID NO: 2882162 - DNA, 21 bp, Homo sapiens
ctgagtcctgtctctgcctgc

SEQ ID NO: 2882163 - DNA, 19 bp, Homo sapiens
ctgagtctgagtcctgtct

SEQ ID NO: 2882164 - DNA, 22 bp, Homo sapiens
ctgagtctgagtcctgtctctg

SEQ ID NO: 2882165 - DNA, 14 bp, Homo sapiens
gggtgggaagaaag

SEQ ID NO: 2882166 - DNA, 11 bp, Homo sapiens
gggtgggccct

SEQ ID NO: 2882167 - DNA, 13 bp, Homo sapiens
gggtgtgcccttg

SEQ ID NO: 2882168 - DNA, 16 bp, Homo sapiens
gggttgccagtcctgc

SEQ ID NO: 2882169 - DNA, 17 bp, Homo sapiens
gggttgccagtcctgca

SEQ ID NO: 2882170 - DNA, 12 bp, Homo sapiens
ggtaacactgat

SEQ ID NO: 2882171 - DNA, 16 bp, Homo sapiens
ggtcctttccttctcg

SEQ ID NO: 2882172 - DNA, 21 bp, Homo sapiens
ggtcctttccttctcgtcttc

SEQ ID NO: 2882173 - DNA, 14 bp, Homo sapiens
ggtctgagccctgg

SEQ ID NO: 2882174 - DNA, 15 bp, Homo sapiens
ggtctggcctagtgg

SEQ ID NO: 2882175 - DNA, 20 bp, Homo sapiens
ggtgcaatgggggagggagg

SEQ ID NO: 2882176 - DNA, 15 bp, Homo sapiens
ggttgccagtcctgc

SEQ ID NO: 2882177 - DNA, 22 bp, Homo sapiens
gtaaatttgtccaatggctgta

SEQ ID NO: 2882178 - DNA, 18 bp, Homo sapiens
gtaacatgccagcttcct

SEQ ID NO: 2882179 - DNA, 19 bp, Homo sapiens
gtaattaagtgcaatttcc

SEQ ID NO: 2882180 - DNA, 17 bp, Homo sapiens
gtacatttctctgagca

SEQ ID NO: 2882181 - DNA, 16 bp, Homo sapiens
gtactcccccagccct

SEQ ID NO: 2882182 - DNA, 12 bp, Homo sapiens
gtagctctgcct

SEQ ID NO: 2882183 - DNA, 14 bp, Homo sapiens
gtagctctgcctcc

SEQ ID NO: 2882184 - DNA, 17 bp, Homo sapiens
gtagggttgccagtcct

SEQ ID NO: 2882185 - DNA, 15 bp, Homo sapiens
gtaggttgaggacag

SEQ ID NO: 2882186 - DNA, 16 bp, Homo sapiens
gtaggttgaggacagg

SEQ ID NO: 2882187 - DNA, 17 bp, Homo sapiens
gtatagatttctataaa

SEQ ID NO: 2882188 - DNA, 21 bp, Homo sapiens
gtatataatactaaagtgtct

SEQ ID NO: 2882189 - DNA, 13 bp, Homo sapiens
gtatcatcagtgt

SEQ ID NO: 2882190 - DNA, 19 bp, Homo sapiens
gtattctgcaacagcctgt

SEQ ID NO: 2882191 - DNA, 23 bp, Homo sapiens
gtattgccacaatgcctctccca

SEQ ID NO: 2882192 - DNA, 17 bp, Homo sapiens
gtatttgttaatttaga

SEQ ID NO: 2882193 - DNA, 18 bp, Homo sapiens
gtatttgttaatttagaa

SEQ ID NO: 2882194 - DNA, 23 bp, Homo sapiens
gtatttgttaatttagaaaactt

SEQ ID NO: 2882195 - DNA, 15 bp, Homo sapiens
gtcacagctaataag

SEQ ID NO: 2882196 - DNA, 13 bp, Homo sapiens
gtcacttttcctt

SEQ ID NO: 2882197 - DNA, 17 bp, Homo sapiens
gtcacttttccttttct

SEQ ID NO: 2882198 - DNA, 19 bp, Homo sapiens
gtcatggaaaagcccagtg

SEQ ID NO: 2882199 - DNA, 17 bp, Homo sapiens
gtccaatggctgtaaac

SEQ ID NO: 2882200 - DNA, 18 bp, Homo sapiens
gtccaatggctgtaaact

SEQ ID NO: 2882201 - DNA, 13 bp, Homo sapiens
gtccagccacccc

SEQ ID NO: 2882202 - DNA, 18 bp, Homo sapiens
gtccagccacccccaggc

SEQ ID NO: 2882203 - DNA, 21 bp, Homo sapiens
gtccagccacccccaggcatc

SEQ ID NO: 2882204 - DNA, 15 bp, Homo sapiens
gtcccctctcccctc

SEQ ID NO: 2882205 - DNA, 13 bp, Homo sapiens
gtccctcctgagg

SEQ ID NO: 2882206 - DNA, 17 bp, Homo sapiens
gtccctgcttacctgac

SEQ ID NO: 2882207 - DNA, 18 bp, Homo sapiens
gtccctgcttacctgacg

SEQ ID NO: 2882208 - DNA, 17 bp, Homo sapiens
gtcctcatctgcaaagc

SEQ ID NO: 2882209 - DNA, 12 bp, Homo sapiens
gtcctctcccct

SEQ ID NO: 2882210 - DNA, 21 bp, Homo sapiens
gtcctctcccctctgccctgt

SEQ ID NO: 2882211 - DNA, 15 bp, Homo sapiens
gtcctggggctgggt

SEQ ID NO: 2882212 - DNA, 15 bp, Homo sapiens
gtcctgtctctgcct

SEQ ID NO: 2882213 - DNA, 16 bp, Homo sapiens
gtcctgtctctgcctg

SEQ ID NO: 2882214 - DNA, 15 bp, Homo sapiens
gtcctgttccctacc

SEQ ID NO: 2882215 - DNA, 16 bp, Homo sapiens
gtccttcctctcaagc

SEQ ID NO: 2882216 - DNA, 15 bp, Homo sapiens
gtctcctctccagcc

SEQ ID NO: 2882217 - DNA, 17 bp, Homo sapiens
gtctcctctccagccct

SEQ ID NO: 2882218 - DNA, 12 bp, Homo sapiens
gtctgagccctg

SEQ ID NO: 2882219 - DNA, 19 bp, Homo sapiens
gtctgagtcctgtctctgc

SEQ ID NO: 2882220 - DNA, 21 bp, Homo sapiens
gtctgagtcctgtctctgcct

SEQ ID NO: 2882221 - DNA, 22 bp, Homo sapiens
gtctgagtcctgtctctgcctg

SEQ ID NO: 2882222 - DNA, 23 bp, Homo sapiens
gtctgagtcctgtctctgcctgc

SEQ ID NO: 2882223 - DNA, 23 bp, Homo sapiens
gtctgcctgcctcatgctctcta

SEQ ID NO: 2882224 - DNA, 18 bp, Homo sapiens
gtctgtcctggaggtggg

SEQ ID NO: 2882225 - DNA, 16 bp, Homo sapiens
gtgagcatgggtgtgc

SEQ ID NO: 2882226 - DNA, 22 bp, Homo sapiens
gtgatccttcatcgaacaaact

SEQ ID NO: 2882227 - DNA, 19 bp, Homo sapiens
gtgcaatgggggagggagg

SEQ ID NO: 2882228 - DNA, 13 bp, Homo sapiens
gtgcaatgtaaat

SEQ ID NO: 2882229 - DNA, 17 bp, Homo sapiens
gtgcaatgtaaatattt

SEQ ID NO: 2882230 - DNA, 22 bp, Homo sapiens
gtgcaatgtaaatattttaaag

SEQ ID NO: 2882231 - DNA, 16 bp, Homo sapiens
gtgcagaaatttgaat

SEQ ID NO: 2882232 - DNA, 23 bp, Homo sapiens
gtgcatttgtgtctgcctgcctc

SEQ ID NO: 2882233 - DNA, 17 bp, Homo sapiens
gtgccaggactctcttt

SEQ ID NO: 2882234 - DNA, 12 bp, Homo sapiens
gtgcccttgggg

SEQ ID NO: 2882235 - DNA, 17 bp, Homo sapiens
gtgcgcaacaacaagga

SEQ ID NO: 2882236 - DNA, 16 bp, Homo sapiens
gtgctaggggatgagg

SEQ ID NO: 2882237 - DNA, 18 bp, Homo sapiens
gtgctattgaactgagcc

SEQ ID NO: 2882238 - DNA, 17 bp, Homo sapiens
gtggcacagatgcccac

SEQ ID NO: 2882239 - DNA, 14 bp, Homo sapiens
gtggctggctcacc

SEQ ID NO: 2882240 - DNA, 17 bp, Homo sapiens
gtgggaagtgaagcccc

SEQ ID NO: 2882241 - DNA, 14 bp, Homo sapiens
gtgggagacaagga

SEQ ID NO: 2882242 - DNA, 19 bp, Homo sapiens
gtgggccaggagctcagcc

SEQ ID NO: 2882243 - DNA, 14 bp, Homo sapiens
gtgggccaggatcc

SEQ ID NO: 2882244 - DNA, 12 bp, Homo sapiens
gtgtcctctccc

SEQ ID NO: 2882245 - DNA, 14 bp, Homo sapiens
gtgtcgttcccttg

SEQ ID NO: 2882246 - DNA, 20 bp, Homo sapiens
gtgtgtttcaggacagctgc

SEQ ID NO: 2882247 - DNA, 13 bp, Homo sapiens
gtgttcagtgttg

SEQ ID NO: 2882248 - DNA, 15 bp, Homo sapiens
gtgttcagtgttgac

SEQ ID NO: 2882249 - DNA, 17 bp, Homo sapiens
gtgttcagtgttgacat

SEQ ID NO: 2882250 - DNA, 13 bp, Homo sapiens
gtgttgacatagc

SEQ ID NO: 2882251 - DNA, 15 bp, Homo sapiens
gtgttgacatagcct

SEQ ID NO: 2882252 - DNA, 16 bp, Homo sapiens
gtgttgacatagcctt

SEQ ID NO: 2882253 - DNA, 19 bp, Homo sapiens
gtgtttcaggacagctgct

SEQ ID NO: 2882254 - DNA, 15 bp, Homo sapiens
gttagcagagtctgt

SEQ ID NO: 2882255 - DNA, 16 bp, Homo sapiens
gttagcagagtctgtc

SEQ ID NO: 2882256 - DNA, 22 bp, Homo sapiens
gttcaatgaagaggaagttaaa

SEQ ID NO: 2882257 - DNA, 18 bp, Homo sapiens
gttcagtgttgacatagc

SEQ ID NO: 2882258 - DNA, 21 bp, Homo sapiens
gttcagtgttgacatagcctt

SEQ ID NO: 2882259 - DNA, 13 bp, Homo sapiens
gttccctctttcc

SEQ ID NO: 2882260 - DNA, 20 bp, Homo sapiens
gttccctctttcctgtgcca

SEQ ID NO: 2882261 - DNA, 14 bp, Homo sapiens
gttccgtctcctct

SEQ ID NO: 2882262 - DNA, 16 bp, Homo sapiens
gttccgtctcctctcc

SEQ ID NO: 2882263 - DNA, 14 bp, Homo sapiens
gttcctgccttctc

SEQ ID NO: 2882264 - DNA, 17 bp, Homo sapiens
gttcctgccttctcttc

SEQ ID NO: 2882265 - DNA, 16 bp, Homo sapiens
gttgaaatatgatgtt

SEQ ID NO: 2882266 - DNA, 23 bp, Homo sapiens
gttgaagcaaatcgaatgaaatt

SEQ ID NO: 2882267 - DNA, 15 bp, Homo sapiens
gttgacatagccttt

SEQ ID NO: 2882268 - DNA, 17 bp, Homo sapiens
gttgacatagcctttgt

SEQ ID NO: 2882269 - DNA, 16 bp, Homo sapiens
gttgcaccatctgctt

SEQ ID NO: 2882270 - DNA, 17 bp, Homo sapiens
gttgcaccatctgcttg

SEQ ID NO: 2882271 - DNA, 19 bp, Homo sapiens
gttgcagtctcagaaagcc

SEQ ID NO: 2882272 - DNA, 20 bp, Homo sapiens
gttgctcctacccctgtcct

SEQ ID NO: 2882273 - DNA, 19 bp, Homo sapiens
gttgttgcaccatctgctt

SEQ ID NO: 2882274 - DNA, 23 bp, Homo sapiens
gtttcacagcctataaccagaca

SEQ ID NO: 2882275 - DNA, 18 bp, Homo sapiens
gtttttaatgtatagtaa

SEQ ID NO: 2882276 - DNA, 15 bp, Homo sapiens
gtttttctggaagta

SEQ ID NO: 2882277 - DNA, 19 bp, Homo sapiens
taaaaaagcttaaaacttt

SEQ ID NO: 2882278 - DNA, 20 bp, Homo sapiens
taaaacatttattttgacat

SEQ ID NO: 2882279 - DNA, 13 bp, Homo sapiens
taaaagaaacttt

SEQ ID NO: 2882280 - DNA, 12 bp, Homo sapiens
taaaagcaaaaa

SEQ ID NO: 2882281 - DNA, 18 bp, Homo sapiens
taaaagcaaaaaagaaaa

SEQ ID NO: 2882282 - DNA, 20 bp, Homo sapiens
taaaagcaaaaaagaaaacc

SEQ ID NO: 2882283 - DNA, 23 bp, Homo sapiens
taaaagggggctattccctggag

SEQ ID NO: 2882284 - DNA, 17 bp, Homo sapiens
taaaatagcaaaagaag

SEQ ID NO: 2882285 - DNA, 23 bp, Homo sapiens
taaacaagtatttgttaatttag

SEQ ID NO: 2882286 - DNA, 15 bp, Homo sapiens
tgggaagtgaagccc

SEQ ID NO: 2882287 - DNA, 16 bp, Homo sapiens
tgggaagtgaagcccc

SEQ ID NO: 2882288 - DNA, 17 bp, Homo sapiens
tgggagacaaggaacca

SEQ ID NO: 2882289 - DNA, 14 bp, Homo sapiens
tgggcagctgtcat

SEQ ID NO: 2882290 - DNA, 16 bp, Homo sapiens
tgggcatcttctggct

SEQ ID NO: 2882291 - DNA, 15 bp, Homo sapiens
tgggccggcagcctg

SEQ ID NO: 2882292 - DNA, 16 bp, Homo sapiens
tgggggtctggcctag

SEQ ID NO: 2882293 - DNA, 16 bp, Homo sapiens
tggggtaagccagagc

SEQ ID NO: 2882294 - DNA, 18 bp, Homo sapiens
tggggtaagccagagcct

SEQ ID NO: 2882295 - DNA, 22 bp, Homo sapiens
tggggtaagccagagcctgggg

SEQ ID NO: 2882296 - DNA, 16 bp, Homo sapiens
tggggtacatttctct

SEQ ID NO: 2882297 - DNA, 19 bp, Homo sapiens
tggggtatggattctaaaa

SEQ ID NO: 2882298 - DNA, 19 bp, Homo sapiens
tgggtgggccctgccggga

SEQ ID NO: 2882299 - DNA, 19 bp, Homo sapiens
tggtactcccccagccctc

SEQ ID NO: 2882300 - DNA, 20 bp, Homo sapiens
tggtcacagccatgaagtca

SEQ ID NO: 2882301 - DNA, 19 bp, Homo sapiens
tggtccaggcttgggctcc

SEQ ID NO: 2882302 - DNA, 18 bp, Homo sapiens
tggttgatgccaaaaaaa

SEQ ID NO: 2882303 - DNA, 22 bp, Homo sapiens
tggttgttgcaccatctgcttg

SEQ ID NO: 2882304 - DNA, 20 bp, Homo sapiens
tggttttctccaagagctac

SEQ ID NO: 2882305 - DNA, 19 bp, Homo sapiens
tgtaaaacatttattttga

SEQ ID NO: 2882306 - DNA, 21 bp, Homo sapiens
tgtaaactataaactactgta

SEQ ID NO: 2882307 - DNA, 14 bp, Homo sapiens
tgtaaaggtcagag

SEQ ID NO: 2882308 - DNA, 19 bp, Homo sapiens
tgtaaaggtcagagtcaaa

SEQ ID NO: 2882309 - DNA, 17 bp, Homo sapiens
tgtaaatattttaaaga

SEQ ID NO: 2882310 - DNA, 14 bp, Homo sapiens
tgtaattaagtgca

SEQ ID NO: 2882311 - DNA, 16 bp, Homo sapiens
tgtaattaagtgcaat

SEQ ID NO: 2882312 - DNA, 20 bp, Homo sapiens
tgtagcaactacagtctaaa

SEQ ID NO: 2882313 - DNA, 19 bp, Homo sapiens
tgtagtaatctgcattatt

SEQ ID NO: 2882314 - DNA, 15 bp, Homo sapiens
tgtatagtaaatcac

SEQ ID NO: 2882315 - DNA, 19 bp, Homo sapiens
tgtatataatactaaagtg

SEQ ID NO: 2882316 - DNA, 21 bp, Homo sapiens
tgtatataatactaaagtgtc

SEQ ID NO: 2882317 - DNA, 16 bp, Homo sapiens
tgtattttagcagaga

SEQ ID NO: 2882318 - DNA, 17 bp, Homo sapiens
tgtcatggaaaagccca

SEQ ID NO: 2882319 - DNA, 18 bp, Homo sapiens
tgtccaatggctgtaaac

SEQ ID NO: 2882320 - DNA, 20 bp, Homo sapiens
tgtccaatggctgtaaacta

SEQ ID NO: 2882321 - DNA, 21 bp, Homo sapiens
tgtccaatggctgtaaactat

SEQ ID NO: 2882322 - DNA, 13 bp, Homo sapiens
tgtcccagcccct

SEQ ID NO: 2882323 - DNA, 14 bp, Homo sapiens
tgtccctcctgagg

SEQ ID NO: 2882324 - DNA, 20 bp, Homo sapiens
tgtcgttcccttgtgtctgt

SEQ ID NO: 2882325 - DNA, 21 bp, Homo sapiens
tgtctgttgcttattgggagt

SEQ ID NO: 2882326 - DNA, 16 bp, Homo sapiens
tgtgaatgggaaaaga

SEQ ID NO: 2882327 - DNA, 20 bp, Homo sapiens
tgtgattcctttgaagagga

SEQ ID NO: 2882328 - DNA, 17 bp, Homo sapiens
tgtgcaatgtaaatatt

SEQ ID NO: 2882329 - DNA, 15 bp, Homo sapiens
tgtgctattgaactg

SEQ ID NO: 2882330 - DNA, 18 bp, Homo sapiens
tgtggcacagatgcccac

SEQ ID NO: 2882331 - DNA, 19 bp, Homo sapiens
tgtggcacagatgcccacg

SEQ ID NO: 2882332 - DNA, 23 bp, Homo sapiens
tgttaaaaaaataagaagaatgc

SEQ ID NO: 2882333 - DNA, 18 bp, Homo sapiens
tgttaatttagaaaactt

SEQ ID NO: 2882334 - DNA, 15 bp, Homo sapiens
tgttaatttttgata

SEQ ID NO: 2882335 - DNA, 16 bp, Homo sapiens
tgttaatttttgatac

SEQ ID NO: 2882336 - DNA, 20 bp, Homo sapiens
tgttacacagcccaagagga

SEQ ID NO: 2882337 - DNA, 23 bp, Homo sapiens
tgttactgaaatgaggagagaag

SEQ ID NO: 2882338 - DNA, 17 bp, Homo sapiens
tgttagcagagtctgtc

SEQ ID NO: 2882339 - DNA, 18 bp, Homo sapiens
tgttagcagagtctgtct

SEQ ID NO: 2882340 - DNA, 17 bp, Homo sapiens
tgttatttgtaatagat

SEQ ID NO: 2882341 - DNA, 13 bp, Homo sapiens
tgttcagtgttga

SEQ ID NO: 2882342 - DNA, 22 bp, Homo sapiens
tgttcagtgttgacatagcctt

SEQ ID NO: 2882343 - DNA, 16 bp, Homo sapiens
tgttcctgccttctct

SEQ ID NO: 2882344 - DNA, 17 bp, Homo sapiens
tgttcctgccttctctt

SEQ ID NO: 2882345 - DNA, 20 bp, Homo sapiens
tgttcctgccttctcttcta

SEQ ID NO: 2882346 - DNA, 13 bp, Homo sapiens
tgttgacatagcc

SEQ ID NO: 2882347 - DNA, 17 bp, Homo sapiens
tgttgacatagcctttg

SEQ ID NO: 2882348 - DNA, 18 bp, Homo sapiens
tgttgacatagcctttgt

SEQ ID NO: 2882349 - DNA, 16 bp, Homo sapiens
tgttgctgtctggctt

SEQ ID NO: 2882350 - DNA, 23 bp, Homo sapiens
tgtttcaggacagctgcttctgt

SEQ ID NO: 2882351 - DNA, 13 bp, Homo sapiens
tgtttgatagatt

SEQ ID NO: 2882352 - DNA, 18 bp, Homo sapiens
tgtttgggaggctggagt

SEQ ID NO: 2882353 - DNA, 15 bp, Homo sapiens
ttaaaacaatttatt

SEQ ID NO: 2882354 - DNA, 23 bp, Homo sapiens
ttaaaatagcaaaagaagaagtt

SEQ ID NO: 2882355 - DNA, 17 bp, Homo sapiens
ttaactctctttatgtc

SEQ ID NO: 2882356 - DNA, 19 bp, Homo sapiens
ttaactctctttatgtctg

SEQ ID NO: 2882357 - DNA, 13 bp, Homo sapiens
ttaacttaaatag

SEQ ID NO: 2882358 - DNA, 14 bp, Homo sapiens
ttaatatcctaaac

SEQ ID NO: 2882359 - DNA, 17 bp, Homo sapiens
ttaatatcctaaacatc

SEQ ID NO: 2882360 - DNA, 16 bp, Homo sapiens
ttaatggctgataatt

SEQ ID NO: 2882361 - DNA, 15 bp, Homo sapiens
ttaatttagaaaact

SEQ ID NO: 2882362 - DNA, 13 bp, Homo sapiens
ttaatttttgata

SEQ ID NO: 2882363 - DNA, 23 bp, Homo sapiens
ttaccaggcaccaaaagaagtaa

SEQ ID NO: 2882364 - DNA, 12 bp, Homo sapiens
ttactgaccatg

SEQ ID NO: 2882365 - DNA, 13 bp, Homo sapiens
ttagcccaagagg

SEQ ID NO: 2882366 - DNA, 22 bp, Homo sapiens
ttagcccaagaggtctgagccc

SEQ ID NO: 2882367 - DNA, 13 bp, Homo sapiens
ttagctttaactt

SEQ ID NO: 2882368 - DNA, 15 bp, Homo sapiens
ttatatgatttttga

SEQ ID NO: 2882369 - DNA, 14 bp, Homo sapiens
ttatgaaaaagaag

SEQ ID NO: 2882370 - DNA, 21 bp, Homo sapiens
ttatgacagaggttttgaaat

SEQ ID NO: 2882371 - DNA, 18 bp, Homo sapiens
ttatgagtgttaataaaa

SEQ ID NO: 2882372 - DNA, 15 bp, Homo sapiens
ttatttaaaatagca

SEQ ID NO: 2882373 - DNA, 23 bp, Homo sapiens
ttatttaaaccgctaaaagaaac

SEQ ID NO: 2882374 - DNA, 16 bp, Homo sapiens
ttatttgtaatagatg

SEQ ID NO: 2882375 - DNA, 17 bp, Homo sapiens
ttatttgtaatagatgt

SEQ ID NO: 2882376 - DNA, 20 bp, Homo sapiens
ttcaaagctgtgtgtttgga

SEQ ID NO: 2882377 - DNA, 23 bp, Homo sapiens
ttcaaagctgtgtgtttggaaga

SEQ ID NO: 2882378 - DNA, 18 bp, Homo sapiens
ttcaaatcaagaaaataa

SEQ ID NO: 2882379 - DNA, 15 bp, Homo sapiens
ttcaacaattctaaa

SEQ ID NO: 2882380 - DNA, 19 bp, Homo sapiens
ttcaacaattctaaaatga

SEQ ID NO: 2882381 - DNA, 14 bp, Homo sapiens
ttcagaataaatgg

SEQ ID NO: 2882382 - DNA, 18 bp, Homo sapiens
ttcaggaaaattgaatgc

SEQ ID NO: 2882383 - DNA, 13 bp, Homo sapiens
ttcaggacagctg

SEQ ID NO: 2882384 - DNA, 15 bp, Homo sapiens
ttcagtgttgacata

SEQ ID NO: 2882385 - DNA, 19 bp, Homo sapiens
ttcagtgttgacatagcct

SEQ ID NO: 2882386 - DNA, 12 bp, Homo sapiens
ttcatctcattt

SEQ ID NO: 2882387 - DNA, 19 bp, Homo sapiens
ttcatctcatttaagggaa

SEQ ID NO: 2882388 - DNA, 23 bp, Homo sapiens
ttcatctcatttaagggaaaaat

SEQ ID NO: 2882389 - DNA, 22 bp, Homo sapiens
ttcccaaaatgttgaaatatga

SEQ ID NO: 2882390 - DNA, 22 bp, Homo sapiens
ttcccagagtcagaggagaaga

SEQ ID NO: 2882391 - DNA, 17 bp, Homo sapiens
ttcccatcactgctgtc

SEQ ID NO: 2882392 - DNA, 23 bp, Homo sapiens
ttcccctctgtgtcctctcccct

SEQ ID NO: 2882393 - DNA, 21 bp, Homo sapiens
ttccctagatggttccctttg

SEQ ID NO: 2882394 - DNA, 12 bp, Homo sapiens
ttccctcacccc

SEQ ID NO: 2882395 - DNA, 19 bp, Homo sapiens
ttccctctttcctgtgcca

SEQ ID NO: 2882396 - DNA, 14 bp, Homo sapiens
ttcccttctatgca

SEQ ID NO: 2882397 - DNA, 18 bp, Homo sapiens
ttccctttgttgctgtct

SEQ ID NO: 2882398 - DNA, 16 bp, Homo sapiens
ttccgtctcctctcca

SEQ ID NO: 2882399 - DNA, 19 bp, Homo sapiens
ttcctcctcctcctcctgt

SEQ ID NO: 2882400 - DNA, 24 bp, Homo sapiens
ttcctcctcctcctcctgttcctg

SEQ ID NO: 2882401 - DNA, 15 bp, Homo sapiens
ttcctgccttctctt

SEQ ID NO: 2882402 - DNA, 16 bp, Homo sapiens
ttcctgccttctcttc

SEQ ID NO: 2882403 - DNA, 14 bp, Homo sapiens
ttcctgtgccagga

SEQ ID NO: 2882404 - DNA, 12 bp, Homo sapiens
ttccttctcgtc

SEQ ID NO: 2882405 - DNA, 21 bp, Homo sapiens
ttccttctcgtcttcctctct

SEQ ID NO: 2882406 - DNA, 19 bp, Homo sapiens
atctataactacatattga

SEQ ID NO: 2882407 - DNA, 15 bp, Homo sapiens
atctatttacataaa

SEQ ID NO: 2882408 - DNA, 19 bp, Homo sapiens
atctcaaattgtaattaat

SEQ ID NO: 2882409 - DNA, 14 bp, Homo sapiens
atctccctcccaca

SEQ ID NO: 2882410 - DNA, 21 bp, Homo sapiens
atgaagactgttaaatgaaac

SEQ ID NO: 2882411 - DNA, 22 bp, Homo sapiens
atgaagactgttaaatgaaacc

SEQ ID NO: 2882412 - DNA, 20 bp, Homo sapiens
atgatttggggattcagatt

SEQ ID NO: 2882413 - DNA, 14 bp, Homo sapiens
atgcttctttaaaa

SEQ ID NO: 2882414 - DNA, 17 bp, Homo sapiens
atggctacttgctttga

SEQ ID NO: 2882415 - DNA, 14 bp, Homo sapiens
atggtatccagaat

SEQ ID NO: 2882416 - DNA, 14 bp, Homo sapiens
atgtgctgctttga

SEQ ID NO: 2882417 - DNA, 16 bp, Homo sapiens
atgtgctgctttgata

SEQ ID NO: 2882418 - DNA, 13 bp, Homo sapiens
attaatgctttgg

SEQ ID NO: 2882419 - DNA, 18 bp, Homo sapiens
attacttgaactttccaa

SEQ ID NO: 2882420 - DNA, 17 bp, Homo sapiens
attagtactggattatt

SEQ ID NO: 2882421 - DNA, 20 bp, Homo sapiens
attatattcctcttgcattt

SEQ ID NO: 2882422 - DNA, 14 bp, Homo sapiens
attcagatttctct

SEQ ID NO: 2882423 - DNA, 20 bp, Homo sapiens
attcagatttctctttgaaa

SEQ ID NO: 2882424 - DNA, 12 bp, Homo sapiens
attcataaatct

SEQ ID NO: 2882425 - DNA, 17 bp, Homo sapiens
attctatggagctattt

SEQ ID NO: 2882426 - DNA, 19 bp, Homo sapiens
attgcaatctataatattt

SEQ ID NO: 2882427 - DNA, 14 bp, Homo sapiens
attgtcattagtga

SEQ ID NO: 2882428 - DNA, 21 bp, Homo sapiens
attgtcctcccctattttaag

SEQ ID NO: 2882429 - DNA, 17 bp, Homo sapiens
attgtgaataatgattt

SEQ ID NO: 2882430 - DNA, 12 bp, Homo sapiens
atttaagtttgt

SEQ ID NO: 2882431 - DNA, 16 bp, Homo sapiens
atttctctttgaaaca

SEQ ID NO: 2882432 - DNA, 22 bp, Homo sapiens
atttgtgtgttcactaaactct

SEQ ID NO: 2882433 - DNA, 23 bp, Homo sapiens
attttaagacgtgaatgtctcag

SEQ ID NO: 2882434 - DNA, 18 bp, Homo sapiens
attttctctgatactttt

SEQ ID NO: 2882435 - DNA, 14 bp, Homo sapiens
atttttaagtggtt

SEQ ID NO: 2882436 - DNA, 13 bp, Homo sapiens
atttttattatta

SEQ ID NO: 2882437 - DNA, 20 bp, Homo sapiens
atttttgtacgttatatatt

SEQ ID NO: 2882438 - DNA, 15 bp, Homo sapiens
attttttttgtaact

SEQ ID NO: 2882439 - DNA, 16 bp, Homo sapiens
caaactgatttctcac

SEQ ID NO: 2882440 - DNA, 12 bp, Homo sapiens
caaatgtaacta

SEQ ID NO: 2882441 - DNA, 16 bp, Homo sapiens
caaattgtaattaata

SEQ ID NO: 2882442 - DNA, 21 bp, Homo sapiens
caaattgtaattaataataga

SEQ ID NO: 2882443 - DNA, 17 bp, Homo sapiens
caagattttctactttt

SEQ ID NO: 2882444 - DNA, 19 bp, Homo sapiens
caagattttttttgtaact

SEQ ID NO: 2882445 - DNA, 20 bp, Homo sapiens
caagtacatggctagctttt

SEQ ID NO: 2882446 - DNA, 12 bp, Homo sapiens
caagttcaatct

SEQ ID NO: 2882447 - DNA, 20 bp, Homo sapiens
caatatttaagtttgttgct

SEQ ID NO: 2882448 - DNA, 14 bp, Homo sapiens
caatgcgtgttgta

SEQ ID NO: 2882449 - DNA, 16 bp, Homo sapiens
caatgtgactttgaaa

SEQ ID NO: 2882450 - DNA, 15 bp, Homo sapiens
caattacatgtttgg

SEQ ID NO: 2882451 - DNA, 13 bp, Homo sapiens
caattatattgtc

SEQ ID NO: 2882452 - DNA, 13 bp, Homo sapiens
caattgtcttttt

SEQ ID NO: 2882453 - DNA, 11 bp, Homo sapiens
caccatgaaac

SEQ ID NO: 2882454 - DNA, 16 bp, Homo sapiens
cactaaactctgaata

SEQ ID NO: 2882455 - DNA, 22 bp, Homo sapiens
cactaaactctgaataagcact

SEQ ID NO: 2882456 - DNA, 20 bp, Homo sapiens
cacttctaagttgagtatat

SEQ ID NO: 2882457 - DNA, 20 bp, Homo sapiens
cactttttaaaaaactttct

SEQ ID NO: 2882458 - DNA, 17 bp, Homo sapiens
cagaaccagtctttcaa

SEQ ID NO: 2882459 - DNA, 16 bp, Homo sapiens
cagaatctgtatgatt

SEQ ID NO: 2882460 - DNA, 22 bp, Homo sapiens
cagaggtaactatcaatattta

SEQ ID NO: 2882461 - DNA, 12 bp, Homo sapiens
cagatgagctgt

SEQ ID NO: 2882462 - DNA, 14 bp, Homo sapiens
caggggtctgagcc

SEQ ID NO: 2882463 - DNA, 12 bp, Homo sapiens
cagtaaacactg

SEQ ID NO: 2882464 - DNA, 14 bp, Homo sapiens
cagtaaacactgtg

SEQ ID NO: 2882465 - DNA, 15 bp, Homo sapiens
cagtaaacactgtgt

SEQ ID NO: 2882466 - DNA, 21 bp, Homo sapiens
cagtaaacactgtgtattgtt

SEQ ID NO: 2882467 - DNA, 21 bp, Homo sapiens
cagtacaatgtgactttgaaa

SEQ ID NO: 2882468 - DNA, 20 bp, Homo sapiens
cagtctttcaactcattgca

SEQ ID NO: 2882469 - DNA, 17 bp, Homo sapiens
catactcctatgcttta

SEQ ID NO: 2882470 - DNA, 22 bp, Homo sapiens
catagaattgcaatctataata

SEQ ID NO: 2882471 - DNA, 19 bp, Homo sapiens
catgaaagagaaagactga

SEQ ID NO: 2882472 - DNA, 18 bp, Homo sapiens
catggctacttgctttga

SEQ ID NO: 2882473 - DNA, 12 bp, Homo sapiens
catgttttgtat

SEQ ID NO: 2882474 - DNA, 16 bp, Homo sapiens
cattgatttgattttt

SEQ ID NO: 2882475 - DNA, 16 bp, Homo sapiens
cattttaaaagcaatt

SEQ ID NO: 2882476 - DNA, 16 bp, Homo sapiens
ccaacatctccctccc

SEQ ID NO: 2882477 - DNA, 12 bp, Homo sapiens
ccaccccaacat

SEQ ID NO: 2882478 - DNA, 21 bp, Homo sapiens
cccagtcaattacatgtttgg

SEQ ID NO: 2882479 - DNA, 19 bp, Homo sapiens
ccccaacatctccctccca

SEQ ID NO: 2882480 - DNA, 15 bp, Homo sapiens
cctaaagaggaaaag

SEQ ID NO: 2882481 - DNA, 15 bp, Homo sapiens
cctcggtactcccat

SEQ ID NO: 2882482 - DNA, 17 bp, Homo sapiens
cgaatttttcagatgat

SEQ ID NO: 2882483 - DNA, 14 bp, Homo sapiens
cggagaccctgagt

SEQ ID NO: 2882484 - DNA, 19 bp, Homo sapiens
cggagcaggggtctgagcc

SEQ ID NO: 2882485 - DNA, 15 bp, Homo sapiens
cgggctctgacagcc

SEQ ID NO: 2882486 - DNA, 12 bp, Homo sapiens
cggggtgcagaa

SEQ ID NO: 2882487 - DNA, 14 bp, Homo sapiens
cgtgaatgtctcag

SEQ ID NO: 2882488 - DNA, 13 bp, Homo sapiens
cgttatatattgt

SEQ ID NO: 2882489 - DNA, 16 bp, Homo sapiens
ctaaactctgaataag

SEQ ID NO: 2882490 - DNA, 22 bp, Homo sapiens
ctacatggggtctgggtggggg

SEQ ID NO: 2882491 - DNA, 16 bp, Homo sapiens
ctactcattttaatga

SEQ ID NO: 2882492 - DNA, 17 bp, Homo sapiens
ctacttttgcatgaaaa

SEQ ID NO: 2882493 - DNA, 18 bp, Homo sapiens
ctacttttgcatgaaaat

SEQ ID NO: 2882494 - DNA, 12 bp, Homo sapiens
ctataaacactg

SEQ ID NO: 2882495 - DNA, 20 bp, Homo sapiens
ctataactacatattgaata

SEQ ID NO: 2882496 - DNA, 15 bp, Homo sapiens
ctatcaatatttaag

SEQ ID NO: 2882497 - DNA, 16 bp, Homo sapiens
ctcaccagaattattt

SEQ ID NO: 2882498 - DNA, 20 bp, Homo sapiens
ctcactattacttgaacttt

SEQ ID NO: 2882499 - DNA, 17 bp, Homo sapiens
ctcctgtgtggaagaag

SEQ ID NO: 2882500 - DNA, 21 bp, Homo sapiens
ctctgaataagcactttttaa

SEQ ID NO: 2882501 - DNA, 22 bp, Homo sapiens
ctctgtataatctatttacata

SEQ ID NO: 2882502 - DNA, 18 bp, Homo sapiens
ctgcggagaccctgagtc

SEQ ID NO: 2882503 - DNA, 23 bp, Homo sapiens
ctgggggcttcgcttccttagcc

SEQ ID NO: 2882504 - DNA, 15 bp, Homo sapiens
ctggtgatatatctc

SEQ ID NO: 2882505 - DNA, 19 bp, Homo sapiens
gtaactatcaatatttaag

SEQ ID NO: 2882506 - DNA, 18 bp, Homo sapiens
gtacgttatatattgtat

SEQ ID NO: 2882507 - DNA, 14 bp, Homo sapiens
gtataatctattta

SEQ ID NO: 2882508 - DNA, 14 bp, Homo sapiens
gtgatttttttgtc

SEQ ID NO: 2882509 - DNA, 21 bp, Homo sapiens
gttatatattgtattaagggc

SEQ ID NO: 2882510 - DNA, 18 bp, Homo sapiens
gttcactaaactctgaat

SEQ ID NO: 2882511 - DNA, 22 bp, Homo sapiens
gtttcctaaaatatctgggtgg

SEQ ID NO: 2882512 - DNA, 14 bp, Homo sapiens
gtttgtgtgcatga

SEQ ID NO: 2882513 - DNA, 16 bp, Homo sapiens
gttttaccctatatct

SEQ ID NO: 2882514 - DNA, 20 bp, Homo sapiens
taaaaaaaactctttaactt

SEQ ID NO: 2882515 - DNA, 11 bp, Homo sapiens
taaacactgtt

SEQ ID NO: 2882516 - DNA, 19 bp, Homo sapiens
taaactctgaataagcact

SEQ ID NO: 2882517 - DNA, 21 bp, Homo sapiens
taaaggtttctattttctctg

SEQ ID NO: 2882518 - DNA, 23 bp, Homo sapiens
taacatagaattgcaatctataa

SEQ ID NO: 2882519 - DNA, 18 bp, Homo sapiens
taactacatattgaatag

SEQ ID NO: 2882520 - DNA, 16 bp, Homo sapiens
taactatcaatattta

SEQ ID NO: 2882521 - DNA, 18 bp, Homo sapiens
taactatcaatatttaag

SEQ ID NO: 2882522 - DNA, 17 bp, Homo sapiens
taacttcaaatatagag

SEQ ID NO: 2882523 - DNA, 13 bp, Homo sapiens
taagacgtgaatg

SEQ ID NO: 2882524 - DNA, 19 bp, Homo sapiens
taagacgtgaatgtctcag

SEQ ID NO: 2882525 - DNA, 20 bp, Homo sapiens
taagacgtgaatgtctcagc

SEQ ID NO: 2882526 - DNA, 15 bp, Homo sapiens
taagcactttttaaa

SEQ ID NO: 2882527 - DNA, 16 bp, Homo sapiens
taagcactttttaaaa

SEQ ID NO: 2882528 - DNA, 21 bp, Homo sapiens
taagcactttttaaaaaactt

SEQ ID NO: 2882529 - DNA, 12 bp, Homo sapiens
taagttgagtat

SEQ ID NO: 2882530 - DNA, 12 bp, Homo sapiens
taatgattgttt

SEQ ID NO: 2882531 - DNA, 18 bp, Homo sapiens
tacaagacaacattgtaa

SEQ ID NO: 2882532 - DNA, 16 bp, Homo sapiens
tacaatgtgactttga

SEQ ID NO: 2882533 - DNA, 20 bp, Homo sapiens
tacaatgtgactttgaaaat

SEQ ID NO: 2882534 - DNA, 13 bp, Homo sapiens
tacatacagaggt

SEQ ID NO: 2882535 - DNA, 20 bp, Homo sapiens
tactacttttgcatgaaaat

SEQ ID NO: 2882536 - DNA, 17 bp, Homo sapiens
tacttttgcatgaaaat

SEQ ID NO: 2882537 - DNA, 14 bp, Homo sapiens
tacttttttgaaat

SEQ ID NO: 2882538 - DNA, 21 bp, Homo sapiens
tagaagtaactggtgatatat

SEQ ID NO: 2882539 - DNA, 17 bp, Homo sapiens
tagaattgcaatctata

SEQ ID NO: 2882540 - DNA, 18 bp, Homo sapiens
tagaattgcaatctataa

SEQ ID NO: 2882541 - DNA, 20 bp, Homo sapiens
tagaattgcaatctataata

SEQ ID NO: 2882542 - DNA, 17 bp, Homo sapiens
tagagatatttttgtac

SEQ ID NO: 2882543 - DNA, 17 bp, Homo sapiens
tagagctttcaagtaca

SEQ ID NO: 2882544 - DNA, 16 bp, Homo sapiens
taggcatatgcttctt

SEQ ID NO: 2882545 - DNA, 12 bp, Homo sapiens
tataaacactgt

SEQ ID NO: 2882546 - DNA, 22 bp, Homo sapiens
tatagaaagcaagatgtactat

SEQ ID NO: 2882547 - DNA, 15 bp, Homo sapiens
tatataccgtggggg

SEQ ID NO: 2882548 - DNA, 14 bp, Homo sapiens
tatatatataaaca

SEQ ID NO: 2882549 - DNA, 16 bp, Homo sapiens
tatatattgtattaag

SEQ ID NO: 2882550 - DNA, 17 bp, Homo sapiens
tatatctcaaattgtaa

SEQ ID NO: 2882551 - DNA, 19 bp, Homo sapiens
tatattcctcttgcatttc

SEQ ID NO: 2882552 - DNA, 23 bp, Homo sapiens
tatcaggatttcctcttgaacca

SEQ ID NO: 2882553 - DNA, 16 bp, Homo sapiens
tatctataaacactgt

SEQ ID NO: 2882554 - DNA, 15 bp, Homo sapiens
tattattaatgcttt

SEQ ID NO: 2882555 - DNA, 21 bp, Homo sapiens
tattctcttaatttttcttaa

SEQ ID NO: 2882556 - DNA, 17 bp, Homo sapiens
tattttaagacgtgaat

SEQ ID NO: 2882557 - DNA, 11 bp, Homo sapiens
tatttttgtac

SEQ ID NO: 2882558 - DNA, 14 bp, Homo sapiens
tatttttgtacgtt

SEQ ID NO: 2882559 - DNA, 12 bp, Homo sapiens
tcaatatttaag

SEQ ID NO: 2882560 - DNA, 17 bp, Homo sapiens
tcaatatttaagtttgt

SEQ ID NO: 2882561 - DNA, 15 bp, Homo sapiens
tcaatgtcaagtacc

SEQ ID NO: 2882562 - DNA, 14 bp, Homo sapiens
tcaattacatgttt

SEQ ID NO: 2882563 - DNA, 19 bp, Homo sapiens
tcacatccttgacttttta

SEQ ID NO: 2882564 - DNA, 16 bp, Homo sapiens
tcagatttctctttga

SEQ ID NO: 2882565 - DNA, 18 bp, Homo sapiens
tcagatttctctttgaaa

SEQ ID NO: 2882566 - DNA, 19 bp, Homo sapiens
tcagatttctctttgaaac

SEQ ID NO: 2882567 - DNA, 17 bp, Homo sapiens
tcaggatttcctcttga

SEQ ID NO: 2882568 - DNA, 18 bp, Homo sapiens
tcaggatttcctcttgaa

SEQ ID NO: 2882569 - DNA, 14 bp, Homo sapiens
tcagtaaacactgt

SEQ ID NO: 2882570 - DNA, 15 bp, Homo sapiens
tcagtaaacactgtg

SEQ ID NO: 2882571 - DNA, 20 bp, Homo sapiens
tcatactcctatgctttagc

SEQ ID NO: 2882572 - DNA, 16 bp, Homo sapiens
tcatgtaaattttgta

SEQ ID NO: 2882573 - DNA, 23 bp, Homo sapiens
tcatgtaaattttgtatgaaaaa

SEQ ID NO: 2882574 - DNA, 21 bp, Homo sapiens
tcatttacaagacaacattgt

SEQ ID NO: 2882575 - DNA, 17 bp, Homo sapiens
tcctcggtactcccata

SEQ ID NO: 2882576 - DNA, 14 bp, Homo sapiens
tctataaacactgt

SEQ ID NO: 2882577 - DNA, 15 bp, Homo sapiens
tctataaacactgtt

SEQ ID NO: 2882578 - DNA, 19 bp, Homo sapiens
tctattttctctgatactt

SEQ ID NO: 2882579 - DNA, 23 bp, Homo sapiens
tctctgatacttttttgaaatca

SEQ ID NO: 2882580 - DNA, 16 bp, Homo sapiens
tctctgtataatctat

SEQ ID NO: 2882581 - DNA, 14 bp, Homo sapiens
tctctttgaaacat

SEQ ID NO: 2882582 - DNA, 17 bp, Homo sapiens
tctgatacttttttgaa

SEQ ID NO: 2882583 - DNA, 16 bp, Homo sapiens
tctttaacttgtaata

SEQ ID NO: 2882584 - DNA, 17 bp, Homo sapiens
tctttcaactcattgca

SEQ ID NO: 2882585 - DNA, 19 bp, Homo sapiens
tctttgaaacatgcttgtg

SEQ ID NO: 2882586 - DNA, 12 bp, Homo sapiens
tcttttctgaat

SEQ ID NO: 2882587 - DNA, 19 bp, Homo sapiens
tcttttctgaatcttctga

SEQ ID NO: 2882588 - DNA, 21 bp, Homo sapiens
tgaacttatttacacatagtt

SEQ ID NO: 2882589 - DNA, 17 bp, Homo sapiens
tgaactttccaaaacct

SEQ ID NO: 2882590 - DNA, 18 bp, Homo sapiens
tgaatgtctcagcgaggt

SEQ ID NO: 2882591 - DNA, 21 bp, Homo sapiens
tgactttcaggaattgcccat

SEQ ID NO: 2882592 - DNA, 16 bp, Homo sapiens
tgagaaatgaatgctg

SEQ ID NO: 2882593 - DNA, 13 bp, Homo sapiens
tgagacatattta

SEQ ID NO: 2882594 - DNA, 14 bp, Homo sapiens
tgagtatattataa

SEQ ID NO: 2882595 - DNA, 11 bp, Homo sapiens
tgatttctcac

SEQ ID NO: 2882596 - DNA, 18 bp, Homo sapiens
tgcaatctataatatttg

SEQ ID NO: 2882597 - DNA, 12 bp, Homo sapiens
tgcatgtaatca

SEQ ID NO: 2882598 - DNA, 13 bp, Homo sapiens
tgcatgtaatcaa

SEQ ID NO: 2882599 - DNA, 19 bp, Homo sapiens
tgcccattgtttttctgat

SEQ ID NO: 2882600 - DNA, 17 bp, Homo sapiens
tgctcaggtgcaagtgc

SEQ ID NO: 2882601 - DNA, 19 bp, Homo sapiens
tgctcgcccacaaactgat

SEQ ID NO: 2882602 - DNA, 13 bp, Homo sapiens
tgctttgatatat

SEQ ID NO: 2882603 - DNA, 15 bp, Homo sapiens
tggagctattttaaa

SEQ ID NO: 2882604 - DNA, 14 bp, Homo sapiens
ctgtataatctatt

SEQ ID NO: 2882605 - DNA, 20 bp, Homo sapiens
ctgtcagggcagtacaatgt

SEQ ID NO: 2882606 - DNA, 22 bp, Homo sapiens
cttaaggagaggagaaactgag

SEQ ID NO: 2882607 - DNA, 16 bp, Homo sapiens
cttcaaatatagagat

SEQ ID NO: 2882608 - DNA, 19 bp, Homo sapiens
cttccttaattcactccca

SEQ ID NO: 2882609 - DNA, 21 bp, Homo sapiens
cttccttaattcactcccaca

SEQ ID NO: 2882610 - DNA, 14 bp, Homo sapiens
cttgaactttccaa

SEQ ID NO: 2882611 - DNA, 16 bp, Homo sapiens
cttgctcaggtgcaag

SEQ ID NO: 2882612 - DNA, 20 bp, Homo sapiens
cttggggttttcagtatgaa

SEQ ID NO: 2882613 - DNA, 19 bp, Homo sapiens
ctttaaaaaagctataaat

SEQ ID NO: 2882614 - DNA, 22 bp, Homo sapiens
ctttccaaaacctaaagaggaa

SEQ ID NO: 2882615 - DNA, 16 bp, Homo sapiens
gaaatcagtaaacact

SEQ ID NO: 2882616 - DNA, 19 bp, Homo sapiens
gaaatcagtaaacactgtg

SEQ ID NO: 2882617 - DNA, 17 bp, Homo sapiens
gaactttccaaaaccta

SEQ ID NO: 2882618 - DNA, 19 bp, Homo sapiens
gaagtaactggtgatatat

SEQ ID NO: 2882619 - DNA, 17 bp, Homo sapiens
gaatctgtatgattcta

SEQ ID NO: 2882620 - DNA, 13 bp, Homo sapiens
gaatgctgagacc

SEQ ID NO: 2882621 - DNA, 22 bp, Homo sapiens
gaatgtgagtgtgtttgtgtgc

SEQ ID NO: 2882622 - DNA, 18 bp, Homo sapiens
gacgtgaatgtctcagcg

SEQ ID NO: 2882623 - DNA, 18 bp, Homo sapiens
gactttgaaaatatatac

SEQ ID NO: 2882624 - DNA, 11 bp, Homo sapiens
gagaaactgag

SEQ ID NO: 2882625 - DNA, 19 bp, Homo sapiens
gagaggagaaactgagaaa

SEQ ID NO: 2882626 - DNA, 21 bp, Homo sapiens
gaggcagcgtgaaagcagatg

SEQ ID NO: 2882627 - DNA, 21 bp, Homo sapiens
gaggtaactatcaatatttaa

SEQ ID NO: 2882628 - DNA, 15 bp, Homo sapiens
gatgtgctgctttga

SEQ ID NO: 2882629 - DNA, 13 bp, Homo sapiens
gattgttcatcat

SEQ ID NO: 2882630 - DNA, 11 bp, Homo sapiens
gattgtttaaa

SEQ ID NO: 2882631 - DNA, 21 bp, Homo sapiens
gatttcctcttgaaccagaac

SEQ ID NO: 2882632 - DNA, 19 bp, Homo sapiens
gcaaagagacccagtcaat

SEQ ID NO: 2882633 - DNA, 14 bp, Homo sapiens
gcaattatattgtc

SEQ ID NO: 2882634 - DNA, 16 bp, Homo sapiens
gcaggggtctgagcca

SEQ ID NO: 2882635 - DNA, 22 bp, Homo sapiens
gcatatgcttctttaaaaaagc

SEQ ID NO: 2882636 - DNA, 15 bp, Homo sapiens
gcatgaaagagaaag

SEQ ID NO: 2882637 - DNA, 14 bp, Homo sapiens
gcccacaaactgat

SEQ ID NO: 2882638 - DNA, 19 bp, Homo sapiens
gccgcgtggaatgtgagtg

SEQ ID NO: 2882639 - DNA, 14 bp, Homo sapiens
gcgaggtgtaaagt

SEQ ID NO: 2882640 - DNA, 15 bp, Homo sapiens
gctcaggtgcaagtg

SEQ ID NO: 2882641 - DNA, 21 bp, Homo sapiens
gcttaaggagaggagaaactg

SEQ ID NO: 2882642 - DNA, 20 bp, Homo sapiens
gcttctttaaaaaagctata

SEQ ID NO: 2882643 - DNA, 12 bp, Homo sapiens
gctttagcttat

SEQ ID NO: 2882644 - DNA, 18 bp, Homo sapiens
ggaaatggtatccagaat

SEQ ID NO: 2882645 - DNA, 20 bp, Homo sapiens
ggcaaagagacccagtcaat

SEQ ID NO: 2882646 - DNA, 14 bp, Homo sapiens
ggcttaaaaaaaac

SEQ ID NO: 2882647 - DNA, 15 bp, Homo sapiens
ggcttaaggagagga

SEQ ID NO: 2882648 - DNA, 18 bp, Homo sapiens
gtaaattttgtatgaaaa

SEQ ID NO: 2882649 - DNA, 23 bp, Homo sapiens
gtaattaataatagattgtgaat

SEQ ID NO: 2882650 - DNA, 22 bp, Homo sapiens
gtacaatgtgactttgaaaata

SEQ ID NO: 2882651 - DNA, 12 bp, Homo sapiens
gtatattataat

SEQ ID NO: 2882652 - DNA, 14 bp, Homo sapiens
gtatattataatag

SEQ ID NO: 2882653 - DNA, 15 bp, Homo sapiens
gtatccagaatggaa

SEQ ID NO: 2882654 - DNA, 18 bp, Homo sapiens
gtcaagattttttttgta

SEQ ID NO: 2882655 - DNA, 18 bp, Homo sapiens
gtgctcgcccacaaactg

SEQ ID NO: 2882656 - DNA, 13 bp, Homo sapiens
gttatatattgta

SEQ ID NO: 2882657 - DNA, 16 bp, Homo sapiens
gttatatattgtatta

SEQ ID NO: 2882658 - DNA, 17 bp, Homo sapiens
gttatatattgtattaa

SEQ ID NO: 2882659 - DNA, 23 bp, Homo sapiens
gtttctattttctctgatacttt

SEQ ID NO: 2882660 - DNA, 15 bp, Homo sapiens
gttttatatccattt

SEQ ID NO: 2882661 - DNA, 21 bp, Homo sapiens
taaaacacacctaagagaaaa

SEQ ID NO: 2882662 - DNA, 21 bp, Homo sapiens
taaaatttcccctaatctttt

SEQ ID NO: 2882663 - DNA, 14 bp, Homo sapiens
taaactctgaataa

SEQ ID NO: 2882664 - DNA, 22 bp, Homo sapiens
taaactctgaataagcactttt

SEQ ID NO: 2882665 - DNA, 18 bp, Homo sapiens
taacttcaaatatagaga

SEQ ID NO: 2882666 - DNA, 15 bp, Homo sapiens
taacttgtaataaac

SEQ ID NO: 2882667 - DNA, 13 bp, Homo sapiens
taagcacttttta

SEQ ID NO: 2882668 - DNA, 20 bp, Homo sapiens
taaggagaggagaaactgag

SEQ ID NO: 2882669 - DNA, 13 bp, Homo sapiens
taagggcatttta

SEQ ID NO: 2882670 - DNA, 14 bp, Homo sapiens
taatctatttacat

SEQ ID NO: 2882671 - DNA, 14 bp, Homo sapiens
taatcttttctgaa

SEQ ID NO: 2882672 - DNA, 21 bp, Homo sapiens
tacatacagaggtaactatca

SEQ ID NO: 2882673 - DNA, 20 bp, Homo sapiens
tacatcttttcaacaagtaa

SEQ ID NO: 2882674 - DNA, 21 bp, Homo sapiens
taccaagaaaggaacctgtca

SEQ ID NO: 2882675 - DNA, 16 bp, Homo sapiens
taccctatatctataa

SEQ ID NO: 2882676 - DNA, 23 bp, Homo sapiens
taccctatatctataaacactgt

SEQ ID NO: 2882677 - DNA, 14 bp, Homo sapiens
tacgttatatattg

SEQ ID NO: 2882678 - DNA, 21 bp, Homo sapiens
tactataacatagaattgcaa

SEQ ID NO: 2882679 - DNA, 16 bp, Homo sapiens
tagatgtgctgctttg

SEQ ID NO: 2882680 - DNA, 21 bp, Homo sapiens
tagattagtactggattattc

SEQ ID NO: 2882681 - DNA, 19 bp, Homo sapiens
tagcttatttttacagtta

SEQ ID NO: 2882682 - DNA, 14 bp, Homo sapiens
tagttaatctataa

SEQ ID NO: 2882683 - DNA, 15 bp, Homo sapiens
tataaattatattcc

SEQ ID NO: 2882684 - DNA, 14 bp, Homo sapiens
tataatctatttac

SEQ ID NO: 2882685 - DNA, 18 bp, Homo sapiens
tatatctataaacactgt

SEQ ID NO: 2882686 - DNA, 20 bp, Homo sapiens
tatatctataaacactgttt

SEQ ID NO: 2882687 - DNA, 19 bp, Homo sapiens
tatatctcaaattgtaatt

SEQ ID NO: 2882688 - DNA, 21 bp, Homo sapiens
tatattgtcctcccctatttt

SEQ ID NO: 2882689 - DNA, 15 bp, Homo sapiens
tatccagaatggaat

SEQ ID NO: 2882690 - DNA, 21 bp, Homo sapiens
tatccagaatggaattttgct

SEQ ID NO: 2882691 - DNA, 14 bp, Homo sapiens
tatctcaaattgta

SEQ ID NO: 2882692 - DNA, 19 bp, Homo sapiens
tatgtttgtacaagattgt

SEQ ID NO: 2882693 - DNA, 16 bp, Homo sapiens
tattattaatgctttg

SEQ ID NO: 2882694 - DNA, 15 bp, Homo sapiens
tattcaggctttagg

SEQ ID NO: 2882695 - DNA, 22 bp, Homo sapiens
tatttaagtttgttgctgtcaa

SEQ ID NO: 2882696 - DNA, 22 bp, Homo sapiens
tatttgtgtgttcactaaactc

SEQ ID NO: 2882697 - DNA, 18 bp, Homo sapiens
tcaaatatagagatattt

SEQ ID NO: 2882698 - DNA, 13 bp, Homo sapiens
tcaaattgtaatt

SEQ ID NO: 2882699 - DNA, 18 bp, Homo sapiens
tcaagattttttttgtaa

SEQ ID NO: 2882700 - DNA, 21 bp, Homo sapiens
tcaagattttttttgtaactt

SEQ ID NO: 2882701 - DNA, 16 bp, Homo sapiens
tcacatccttgacttt

SEQ ID NO: 2882702 - DNA, 16 bp, Homo sapiens
tcactattacttgaac

SEQ ID NO: 2882703 - DNA, 19 bp, Homo sapiens
aaaaactctttaacttgta

SEQ ID NO: 2882704 - DNA, 20 bp, Homo sapiens
aaaaactctttaacttgtaa

SEQ ID NO: 2882705 - DNA, 18 bp, Homo sapiens
aaaaactttctactcatt

SEQ ID NO: 2882706 - DNA, 21 bp, Homo sapiens
aaaactctttaacttgtaata

SEQ ID NO: 2882707 - DNA, 18 bp, Homo sapiens
aaaagcaattatattgtc

SEQ ID NO: 2882708 - DNA, 23 bp, Homo sapiens
aaacctaaagaggaaaagtgcaa

SEQ ID NO: 2882709 - DNA, 12 bp, Homo sapiens
aaactctttaac

SEQ ID NO: 2882710 - DNA, 20 bp, Homo sapiens
aaactctttaacttgtaata

SEQ ID NO: 2882711 - DNA, 23 bp, Homo sapiens
aaactctttaacttgtaataaac

SEQ ID NO: 2882712 - DNA, 17 bp, Homo sapiens
aaactgatttctcacgg

SEQ ID NO: 2882713 - DNA, 15 bp, Homo sapiens
aaagcaattatattg

SEQ ID NO: 2882714 - DNA, 14 bp, Homo sapiens
aaagtgcaatgcgt

SEQ ID NO: 2882715 - DNA, 20 bp, Homo sapiens
aaatatagagatatttttgt

SEQ ID NO: 2882716 - DNA, 15 bp, Homo sapiens
aaatcagtaaacact

SEQ ID NO: 2882717 - DNA, 22 bp, Homo sapiens
aaatcatactcctatgctttag

SEQ ID NO: 2882718 - DNA, 12 bp, Homo sapiens
aaattatattcc

SEQ ID NO: 2882719 - DNA, 16 bp, Homo sapiens
tggattattcaggctt

SEQ ID NO: 2882720 - DNA, 18 bp, Homo sapiens
tggggattcagatttctc

SEQ ID NO: 2882721 - DNA, 16 bp, Homo sapiens
tgtaaaggtcactttt

SEQ ID NO: 2882722 - DNA, 22 bp, Homo sapiens
tgtaataaacccttaactggca

SEQ ID NO: 2882723 - DNA, 18 bp, Homo sapiens
tgtattgttgtaaaatgt

SEQ ID NO: 2882724 - DNA, 13 bp, Homo sapiens
tgtcaagattttt

SEQ ID NO: 2882725 - DNA, 13 bp, Homo sapiens
tgtggtgatgaaa

SEQ ID NO: 2882726 - DNA, 20 bp, Homo sapiens
tgtgttcactaaactctgaa

SEQ ID NO: 2882727 - DNA, 15 bp, Homo sapiens
tgttcactaaactct

SEQ ID NO: 2882728 - DNA, 13 bp, Homo sapiens
tgttgtaaaatgt

SEQ ID NO: 2882729 - DNA, 22 bp, Homo sapiens
tgttgtacatacagaggtaact

SEQ ID NO: 2882730 - DNA, 23 bp, Homo sapiens
tgtttaaaggtttctattttctc

SEQ ID NO: 2882731 - DNA, 17 bp, Homo sapiens
tgtttgtacaagattgt

SEQ ID NO: 2882732 - DNA, 18 bp, Homo sapiens
tgtttgtacaagattgtc

SEQ ID NO: 2882733 - DNA, 14 bp, Homo sapiens
tgtttgtgtgcatg

SEQ ID NO: 2882734 - DNA, 20 bp, Homo sapiens
tgtttgtgtgcatgaaagag

SEQ ID NO: 2882735 - DNA, 21 bp, Homo sapiens
ttaaaaaaaactctttaactt

SEQ ID NO: 2882736 - DNA, 22 bp, Homo sapiens
ttaaatcatactcctatgcttt

SEQ ID NO: 2882737 - DNA, 20 bp, Homo sapiens
ttaagacgtgaatgtctcag

SEQ ID NO: 2882738 - DNA, 22 bp, Homo sapiens
ttaataatagattgtgaataat

SEQ ID NO: 2882739 - DNA, 15 bp, Homo sapiens
ttaattcactcccac

SEQ ID NO: 2882740 - DNA, 13 bp, Homo sapiens
ttacaacctagaa

SEQ ID NO: 2882741 - DNA, 12 bp, Homo sapiens
ttacttgaactt

SEQ ID NO: 2882742 - DNA, 18 bp, Homo sapiens
ttagatgtgctgctttga

SEQ ID NO: 2882743 - DNA, 20 bp, Homo sapiens
ttagatgtgctgctttgata

SEQ ID NO: 2882744 - DNA, 17 bp, Homo sapiens
ttatagttaatctataa

SEQ ID NO: 2882745 - DNA, 11 bp, Homo sapiens
ttatatattgt

SEQ ID NO: 2882746 - DNA, 18 bp, Homo sapiens
ttatcgtccagtgacttt

SEQ ID NO: 2882747 - DNA, 14 bp, Homo sapiens
ttattaatgctttg

SEQ ID NO: 2882748 - DNA, 16 bp, Homo sapiens
ttccaaaacctaaaga

SEQ ID NO: 2882749 - DNA, 14 bp, Homo sapiens
ttccagaatctgta

SEQ ID NO: 2882750 - DNA, 13 bp, Homo sapiens
ttcctcttgaacc

SEQ ID NO: 2882751 - DNA, 16 bp, Homo sapiens
ttctattttctctgat

SEQ ID NO: 2882752 - DNA, 22 bp, Homo sapiens
ttcttccttaattcactcccac

SEQ ID NO: 2882753 - DNA, 23 bp, Homo sapiens
ttgaaatcagtaaacactgtgta

SEQ ID NO: 2882754 - DNA, 18 bp, Homo sapiens
ttgaactttccaaaacct

SEQ ID NO: 2882755 - DNA, 18 bp, Homo sapiens
ttgagtatattataatag

SEQ ID NO: 2882756 - DNA, 16 bp, Homo sapiens
ttgccaggcttaagga

SEQ ID NO: 2882757 - DNA, 23 bp, Homo sapiens
ttgtaataaacccttaactggca

SEQ ID NO: 2882758 - DNA, 22 bp, Homo sapiens
ttgtacatacagaggtaactat

SEQ ID NO: 2882759 - DNA, 13 bp, Homo sapiens
ttgtttttctgat

SEQ ID NO: 2882760 - DNA, 11 bp, Homo sapiens
tttaaaaaact

SEQ ID NO: 2882761 - DNA, 21 bp, Homo sapiens
tttaaaggtttctattttctc

SEQ ID NO: 2882762 - DNA, 16 bp, Homo sapiens
tttatatccattttta

SEQ ID NO: 2882763 - DNA, 20 bp, Homo sapiens
tttgaaatcagtaaacactg

SEQ ID NO: 2882764 - DNA, 19 bp, Homo sapiens
tttggggattcagatttct

SEQ ID NO: 2882765 - DNA, 11 bp, Homo sapiens
tttgtaacttc

SEQ ID NO: 2882766 - DNA, 15 bp, Homo sapiens
tttgtaacttcaaat

SEQ ID NO: 2882767 - DNA, 19 bp, Homo sapiens
tttgtacgttatatattgt

SEQ ID NO: 2882768 - DNA, 23 bp, Homo sapiens
tttgtgtgttcactaaactctga

SEQ ID NO: 2882769 - DNA, 18 bp, Homo sapiens
tttgttccagaatctgta

SEQ ID NO: 2882770 - DNA, 19 bp, Homo sapiens
ttttaccctatatctataa

SEQ ID NO: 2882771 - DNA, 15 bp, Homo sapiens
ttttcacatccttga

SEQ ID NO: 2882772 - DNA, 18 bp, Homo sapiens
ttttctgatatgtttgta

SEQ ID NO: 2882773 - DNA, 15 bp, Homo sapiens
ttttgtaacttcaaa

SEQ ID NO: 2882774 - DNA, 14 bp, Homo sapiens
tttttgtaacttca

SEQ ID NO: 2882775 - DNA, 18 bp, Homo sapiens
tttttgtaacttcaaata

SEQ ID NO: 2882776 - DNA, 23 bp, Homo sapiens
tttttgtacgttatatattgtat

SEQ ID NO: 2882777 - DNA, 13 bp, Homo sapiens
ttttttgaaatca

SEQ ID NO: 2882778 - DNA, 13 bp, Homo sapiens
ttttttgtaactt

SEQ ID NO: 2882779 - DNA, 14 bp, Homo sapiens
tttttttgtaactt

SEQ ID NO: 2882780 - DNA, 12 bp, Homo sapiens
aaaactctttaa

SEQ ID NO: 2882781 - DNA, 16 bp, Homo sapiens
aaaagctataaattat

SEQ ID NO: 2882782 - DNA, 13 bp, Homo sapiens
aaaagtgcaatgc

SEQ ID NO: 2882783 - DNA, 21 bp, Homo sapiens
aaaagtgcaatgcgtgttgta

SEQ ID NO: 2882784 - DNA, 16 bp, Homo sapiens
aaagcaattatattgt

SEQ ID NO: 2882785 - DNA, 20 bp, Homo sapiens
aacatggctacttgctttga

SEQ ID NO: 2882786 - DNA, 16 bp, Homo sapiens
aactatcaatatttaa

SEQ ID NO: 2882787 - DNA, 17 bp, Homo sapiens
aactgagaaatgaatgc

SEQ ID NO: 2882788 - DNA, 18 bp, Homo sapiens
aactgagaaatgaatgct

SEQ ID NO: 2882789 - DNA, 19 bp, Homo sapiens
aactggtcaccatgaaact

SEQ ID NO: 2882790 - DNA, 19 bp, Homo sapiens
aagaggaaaagtgcaatgc

SEQ ID NO: 2882791 - DNA, 16 bp, Homo sapiens
aagattttttttgtaa

SEQ ID NO: 2882792 - DNA, 13 bp, Homo sapiens
aagcaattatatt

SEQ ID NO: 2882793 - DNA, 22 bp, Homo sapiens
aagcctcactattacttgaact

SEQ ID NO: 2882794 - DNA, 14 bp, Homo sapiens
aagctataaattat

SEQ ID NO: 2882795 - DNA, 22 bp, Homo sapiens
aaggatatttactacttttgca

SEQ ID NO: 2882796 - DNA, 20 bp, Homo sapiens
aagtgcaatgcgtgttgtac

SEQ ID NO: 2882797 - DNA, 14 bp, Homo sapiens
aagtggttttaata

SEQ ID NO: 2882798 - DNA, 18 bp, Homo sapiens
aatagggctaggaatata

SEQ ID NO: 2882799 - DNA, 14 bp, Homo sapiens
aatatagagatatt

SEQ ID NO: 2882800 - DNA, 16 bp, Homo sapiens
aatatagagatatttt

SEQ ID NO: 2882801 - DNA, 18 bp, Homo sapiens
aatatagagatatttttg

SEQ ID NO: 2882802 - DNA, 18 bp, Homo sapiens
aatatttaagtttgttgc

SEQ ID NO: 2882803 - DNA, 21 bp, Homo sapiens
aatcaacatggctacttgctt

SEQ ID NO: 2882804 - DNA, 20 bp, Homo sapiens
aatcatactcctatgcttta

SEQ ID NO: 2882805 - DNA, 22 bp, Homo sapiens
aatcttttctgaatcttctgaa

SEQ ID NO: 2882806 - DNA, 20 bp, Homo sapiens
aatgtctcagcgaggtgtaa

SEQ ID NO: 2882807 - DNA, 14 bp, Homo sapiens
aatgtgactttgaa

SEQ ID NO: 2882808 - DNA, 23 bp, Homo sapiens
aattatattcctcttgcatttca

SEQ ID NO: 2882809 - DNA, 23 bp, Homo sapiens
aattcactcccacacccaagaag

SEQ ID NO: 2882810 - DNA, 16 bp, Homo sapiens
accagggcgcaagcct

SEQ ID NO: 2882811 - DNA, 15 bp, Homo sapiens
accctatatctataa

SEQ ID NO: 2882812 - DNA, 14 bp, Homo sapiens
acgttatatattgt

SEQ ID NO: 2882813 - DNA, 17 bp, Homo sapiens
acgttatatattgtatt

SEQ ID NO: 2882814 - DNA, 13 bp, Homo sapiens
actattacttgaa

SEQ ID NO: 2882815 - DNA, 15 bp, Homo sapiens
actattacttgaact

SEQ ID NO: 2882816 - DNA, 20 bp, Homo sapiens
actctgaataagcacttttt

SEQ ID NO: 2882817 - DNA, 23 bp, Homo sapiens
actctgaataagcactttttaaa

SEQ ID NO: 2882818 - DNA, 16 bp, Homo sapiens
actgagaaatgaatgc

SEQ ID NO: 2882819 - DNA, 15 bp, Homo sapiens
acttcaaatatagag

SEQ ID NO: 2882820 - DNA, 19 bp, Homo sapiens
acttctaagttgagtatat

SEQ ID NO: 2882821 - DNA, 20 bp, Homo sapiens
acttgaactttccaaaacct

SEQ ID NO: 2882822 - DNA, 22 bp, Homo sapiens
acttgagtggaggtttatagtt

SEQ ID NO: 2882823 - DNA, 17 bp, Homo sapiens
actttctactcatttta

SEQ ID NO: 2882824 - DNA, 21 bp, Homo sapiens
agaagtactgcccttttgtgt

SEQ ID NO: 2882825 - DNA, 12 bp, Homo sapiens
agacgtgaatgt

SEQ ID NO: 2882826 - DNA, 12 bp, Homo sapiens
agactgattacc

SEQ ID NO: 2882827 - DNA, 22 bp, Homo sapiens
agactggtttatccacccacaa

SEQ ID NO: 2882828 - DNA, 15 bp, Homo sapiens
agatgtactataaca

SEQ ID NO: 2882829 - DNA, 14 bp, Homo sapiens
agattgtgaataat

SEQ ID NO: 2882830 - DNA, 19 bp, Homo sapiens
agcacagtctgatgacaca

SEQ ID NO: 2882831 - DNA, 17 bp, Homo sapiens
agcacttctaagttgag

SEQ ID NO: 2882832 - DNA, 23 bp, Homo sapiens
agccaaggccctgagttggcagt

SEQ ID NO: 2882833 - DNA, 22 bp, Homo sapiens
agcctcactattacttgaactt

SEQ ID NO: 2882834 - DNA, 12 bp, Homo sapiens
agccttgctcag

SEQ ID NO: 2882835 - DNA, 16 bp, Homo sapiens
agccttgctcaggtgc

SEQ ID NO: 2882836 - DNA, 16 bp, Homo sapiens
agctataaattatatt

SEQ ID NO: 2882837 - DNA, 14 bp, Homo sapiens
agcttatttttaca

SEQ ID NO: 2882838 - DNA, 18 bp, Homo sapiens
aggaaaagtgcaatgcgt

SEQ ID NO: 2882839 - DNA, 19 bp, Homo sapiens
aggaatatagattaaatca

SEQ ID NO: 2882840 - DNA, 22 bp, Homo sapiens
aggacattgatttgatttttat

SEQ ID NO: 2882841 - DNA, 14 bp, Homo sapiens
aggacttcccgagc

SEQ ID NO: 2882842 - DNA, 23 bp, Homo sapiens
aggcttaaggagaggagaaactg

SEQ ID NO: 2882843 - DNA, 14 bp, Homo sapiens
aggtttctattttc

SEQ ID NO: 2882844 - DNA, 16 bp, Homo sapiens
agtaaacactgtgtat

SEQ ID NO: 2882845 - DNA, 18 bp, Homo sapiens
agtaactggtgatatatc

SEQ ID NO: 2882846 - DNA, 22 bp, Homo sapiens
agtacaatgtgactttgaaaat

SEQ ID NO: 2882847 - DNA, 21 bp, Homo sapiens
agttgttcgccgcgtggaatg

SEQ ID NO: 2882848 - DNA, 22 bp, Homo sapiens
ataacatagaattgcaatctat

SEQ ID NO: 2882849 - DNA, 17 bp, Homo sapiens
ataactacatattgaat

SEQ ID NO: 2882850 - DNA, 18 bp, Homo sapiens
atacagaggtaactatca

SEQ ID NO: 2882851 - DNA, 12 bp, Homo sapiens
atagattaaatc

SEQ ID NO: 2882852 - DNA, 15 bp, Homo sapiens
atagattgtgaataa

SEQ ID NO: 2882853 - DNA, 18 bp, Homo sapiens
atagattgtgaataatga

SEQ ID NO: 2882854 - DNA, 19 bp, Homo sapiens
atatatctcaaattgtaat

SEQ ID NO: 2882855 - DNA, 22 bp, Homo sapiens
atatttttgtacgttatatatt

SEQ ID NO: 2882856 - DNA, 23 bp, Homo sapiens
atatttttgtacgttatatattg

SEQ ID NO: 2882857 - DNA, 19 bp, Homo sapiens
atcaggatttcctcttgaa

SEQ ID NO: 2882858 - DNA, 18 bp, Homo sapiens
atcatactcctatgcttt

SEQ ID NO: 2882859 - DNA, 19 bp, Homo sapiens
atcatttacaagacaacat

SEQ ID NO: 2882860 - DNA, 12 bp, Homo sapiens
atctatttacat

SEQ ID NO: 2882861 - DNA, 14 bp, Homo sapiens
atctgtatgattct

SEQ ID NO: 2882862 - DNA, 15 bp, Homo sapiens
atctgtatgattcta

SEQ ID NO: 2882863 - DNA, 19 bp, Homo sapiens
atctgtatgattctatgga

SEQ ID NO: 2882864 - DNA, 13 bp, Homo sapiens
atgagcacttcta

SEQ ID NO: 2882865 - DNA, 12 bp, Homo sapiens
atgcttctttaa

SEQ ID NO: 2882866 - DNA, 15 bp, Homo sapiens
atgcttgtgtttctt

SEQ ID NO: 2882867 - DNA, 14 bp, Homo sapiens
atgctttagcttat

SEQ ID NO: 2882868 - DNA, 15 bp, Homo sapiens
atgctttagcttatt

SEQ ID NO: 2882869 - DNA, 15 bp, Homo sapiens
atgctttccaaaacc

SEQ ID NO: 2882870 - DNA, 20 bp, Homo sapiens
atgtaaattttgtatgaaaa

SEQ ID NO: 2882871 - DNA, 21 bp, Homo sapiens
atgtgactttgaaaatatata

SEQ ID NO: 2882872 - DNA, 14 bp, Homo sapiens
atgtttgtacaaga

SEQ ID NO: 2882873 - DNA, 19 bp, Homo sapiens
attacctcctgtgtggaag

SEQ ID NO: 2882874 - DNA, 14 bp, Homo sapiens
attacttgaacttt

SEQ ID NO: 2882875 - DNA, 16 bp, Homo sapiens
attacttgaactttcc

SEQ ID NO: 2882876 - DNA, 14 bp, Homo sapiens
attattaatgcttt

SEQ ID NO: 2882877 - DNA, 15 bp, Homo sapiens
attattaatgctttg

SEQ ID NO: 2882878 - DNA, 12 bp, Homo sapiens
attcactcccac

SEQ ID NO: 2882879 - DNA, 21 bp, Homo sapiens
attcactcccacacccaagaa

SEQ ID NO: 2882880 - DNA, 19 bp, Homo sapiens
attcagatttctctttgaa

SEQ ID NO: 2882881 - DNA, 18 bp, Homo sapiens
attgtaattaataataga

SEQ ID NO: 2882882 - DNA, 23 bp, Homo sapiens
atttcacttgagtggaggtttat

SEQ ID NO: 2882883 - DNA, 18 bp, Homo sapiens
atttgtgtgttcactaaa

SEQ ID NO: 2882884 - DNA, 20 bp, Homo sapiens
attttaaaagcaattatatt

SEQ ID NO: 2882885 - DNA, 21 bp, Homo sapiens
attttaaaagcaattatattg

SEQ ID NO: 2882886 - DNA, 22 bp, Homo sapiens
attttaaaagcaattatattgt

SEQ ID NO: 2882887 - DNA, 16 bp, Homo sapiens
atttttacagttatag

SEQ ID NO: 2882888 - DNA, 22 bp, Homo sapiens
caaatatagagatatttttgta

SEQ ID NO: 2882889 - DNA, 19 bp, Homo sapiens
caaatgtaactatgtttta

SEQ ID NO: 2882890 - DNA, 15 bp, Homo sapiens
caaattgtaattaat

SEQ ID NO: 2882891 - DNA, 14 bp, Homo sapiens
caactcattgcatc

SEQ ID NO: 2882892 - DNA, 16 bp, Homo sapiens
caagattgtcattagt

SEQ ID NO: 2882893 - DNA, 18 bp, Homo sapiens
caagcctcactattactt

SEQ ID NO: 2882894 - DNA, 23 bp, Homo sapiens
cactggcgcatcatatgcagtga

SEQ ID NO: 2882895 - DNA, 21 bp, Homo sapiens
cacttctaagttgagtatatt

SEQ ID NO: 2882896 - DNA, 23 bp, Homo sapiens
cacttgagtggaggtttatagtt

SEQ ID NO: 2882897 - DNA, 12 bp, Homo sapiens
cagaatctgtat

SEQ ID NO: 2882898 - DNA, 13 bp, Homo sapiens
cagggcgcaagcc

SEQ ID NO: 2882899 - DNA, 14 bp, Homo sapiens
cagtcaattacatg

SEQ ID NO: 2882900 - DNA, 19 bp, Homo sapiens
cataaaatgggtgatatgc

SEQ ID NO: 2882901 - DNA, 16 bp, Homo sapiens
catacagaggtaacta

SEQ ID NO: 2882902 - DNA, 22 bp, Homo sapiens
cataggttcacaccattttgtt

SEQ ID NO: 2882903 - DNA, 22 bp, Homo sapiens
catcccgctggtgcctcccggg

SEQ ID NO: 2882904 - DNA, 20 bp, Homo sapiens
cattttaaaagcaattatat

SEQ ID NO: 2882905 - DNA, 18 bp, Homo sapiens
ccgagcggtgtggggacc

SEQ ID NO: 2882906 - DNA, 20 bp, Homo sapiens
ccggagcaggggtctgagcc

SEQ ID NO: 2882907 - DNA, 20 bp, Homo sapiens
cctaaagaggaaaagtgcaa

SEQ ID NO: 2882908 - DNA, 22 bp, Homo sapiens
cctaaagaggaaaagtgcaatg

SEQ ID NO: 2882909 - DNA, 20 bp, Homo sapiens
cctcactattacttgaactt

SEQ ID NO: 2882910 - DNA, 20 bp, Homo sapiens
cctcctgtgtggaagaagga

SEQ ID NO: 2882911 - DNA, 21 bp, Homo sapiens
cctgtgtggaagaaggaaaca

SEQ ID NO: 2882912 - DNA, 21 bp, Homo sapiens
cgcttccttagccttgctcag

SEQ ID NO: 2882913 - DNA, 17 bp, Homo sapiens
cgtcaacgtgcatttta

SEQ ID NO: 2882914 - DNA, 14 bp, Homo sapiens
cgttatatattgta

SEQ ID NO: 2882915 - DNA, 22 bp, Homo sapiens
ctaaaatatctgggtggcttaa

SEQ ID NO: 2882916 - DNA, 22 bp, Homo sapiens
ctaagttgagtatattataata

SEQ ID NO: 2882917 - DNA, 12 bp, Homo sapiens
ctactcatttta

SEQ ID NO: 2882918 - DNA, 14 bp, Homo sapiens
ctataaacactgtt

SEQ ID NO: 2882919 - DNA, 13 bp, Homo sapiens
ctataaattatat

SEQ ID NO: 2882920 - DNA, 17 bp, Homo sapiens
ctatatctataaacact

SEQ ID NO: 2882921 - DNA, 18 bp, Homo sapiens
ctatatctataaacactg

SEQ ID NO: 2882922 - DNA, 13 bp, Homo sapiens
ctatcaatattta

SEQ ID NO: 2882923 - DNA, 14 bp, Homo sapiens
ctatcaatatttaa

SEQ ID NO: 2882924 - DNA, 18 bp, Homo sapiens
ctattacttgaactttcc

SEQ ID NO: 2882925 - DNA, 20 bp, Homo sapiens
ctattacttgaactttccaa

SEQ ID NO: 2882926 - DNA, 19 bp, Homo sapiens
ctattttaagacgtgaatg

SEQ ID NO: 2882927 - DNA, 22 bp, Homo sapiens
ctattttctctgatactttttt

SEQ ID NO: 2882928 - DNA, 18 bp, Homo sapiens
ctcaaattgtaattaata

SEQ ID NO: 2882929 - DNA, 18 bp, Homo sapiens
ctcattttaatgattgtt

SEQ ID NO: 2882930 - DNA, 19 bp, Homo sapiens
ctctgaataagcacttttt

SEQ ID NO: 2882931 - DNA, 14 bp, Homo sapiens
ctctgatacttttt

SEQ ID NO: 2882932 - DNA, 17 bp, Homo sapiens
ctctgatacttttttga

SEQ ID NO: 2882933 - DNA, 20 bp, Homo sapiens
ctctgatacttttttgaaat

SEQ ID NO: 2882934 - DNA, 17 bp, Homo sapiens
ctctttaacttgtaata

SEQ ID NO: 2882935 - DNA, 11 bp, Homo sapiens
ctctttgaaac

SEQ ID NO: 2882936 - DNA, 16 bp, Homo sapiens
ctgaataagcactttt

SEQ ID NO: 2882937 - DNA, 19 bp, Homo sapiens
ctgaataagcactttttaa

SEQ ID NO: 2882938 - DNA, 21 bp, Homo sapiens
ctgagactttcagtgcactgt

SEQ ID NO: 2882939 - DNA, 18 bp, Homo sapiens
ctgagccacagccgtgct

SEQ ID NO: 2882940 - DNA, 15 bp, Homo sapiens
ctgatacttttttga

SEQ ID NO: 2882941 - DNA, 16 bp, Homo sapiens
ctgatacttttttgaa

SEQ ID NO: 2882942 - DNA, 19 bp, Homo sapiens
ctgtataatctatttacat

SEQ ID NO: 2882943 - DNA, 19 bp, Homo sapiens
cttaaaaaaaactctttaa

SEQ ID NO: 2882944 - DNA, 19 bp, Homo sapiens
cttaaggagaggagaaact

SEQ ID NO: 2882945 - DNA, 20 bp, Homo sapiens
cttagtggggttttatatcc

SEQ ID NO: 2882946 - DNA, 17 bp, Homo sapiens
cttctttaattgatcta

SEQ ID NO: 2882947 - DNA, 15 bp, Homo sapiens
cttgaactttccaaa

SEQ ID NO: 2882948 - DNA, 18 bp, Homo sapiens
ctttagcttatttttaca

SEQ ID NO: 2882949 - DNA, 14 bp, Homo sapiens
ctttcaactcattg

SEQ ID NO: 2882950 - DNA, 22 bp, Homo sapiens
ctttgatatataggacattgat

SEQ ID NO: 2882951 - DNA, 18 bp, Homo sapiens
gaagtaactggtgatata

SEQ ID NO: 2882952 - DNA, 16 bp, Homo sapiens
gaataagcacttttta

SEQ ID NO: 2882953 - DNA, 18 bp, Homo sapiens
gaatagtcgcgcaagcat

SEQ ID NO: 2882954 - DNA, 17 bp, Homo sapiens
gaatatagattaaatca

SEQ ID NO: 2882955 - DNA, 16 bp, Homo sapiens
gaatctgtatgattct

SEQ ID NO: 2882956 - DNA, 11 bp, Homo sapiens
gaatgtctcag

SEQ ID NO: 2882957 - DNA, 20 bp, Homo sapiens
gaattgcccattgtttttct

SEQ ID NO: 2882958 - DNA, 21 bp, Homo sapiens
gaattgcccattgtttttctg

SEQ ID NO: 2882959 - DNA, 15 bp, Homo sapiens
gacaattgtcttttt

SEQ ID NO: 2882960 - DNA, 18 bp, Homo sapiens
gacagccctgcggagacc

SEQ ID NO: 2882961 - DNA, 19 bp, Homo sapiens
gaccctgagtccgggaggc

SEQ ID NO: 2882962 - DNA, 20 bp, Homo sapiens
gaccctgagtccgggaggca

SEQ ID NO: 2882963 - DNA, 22 bp, Homo sapiens
gagaaactgagaaatgaatgct

SEQ ID NO: 2882964 - DNA, 16 bp, Homo sapiens
gagcaggggtctgagc

SEQ ID NO: 2882965 - DNA, 17 bp, Homo sapiens
gagcaggggtctgagcc

SEQ ID NO: 2882966 - DNA, 16 bp, Homo sapiens
gagctattttaaacca

SEQ ID NO: 2882967 - DNA, 16 bp, Homo sapiens
gaggaaaagtgcaatg

SEQ ID NO: 2882968 - DNA, 18 bp, Homo sapiens
gaggtaactatcaatatt

SEQ ID NO: 2882969 - DNA, 20 bp, Homo sapiens
gagtggaggtttatagttaa

SEQ ID NO: 2882970 - DNA, 22 bp, Homo sapiens
gagtgtgtttgtgtgcatgaaa

SEQ ID NO: 2882971 - DNA, 12 bp, Homo sapiens
gatatttttgta

SEQ ID NO: 2882972 - DNA, 22 bp, Homo sapiens
gatatttttgtacgttatatat

SEQ ID NO: 2882973 - DNA, 20 bp, Homo sapiens
gattacctcctgtgtggaag

SEQ ID NO: 2882974 - DNA, 14 bp, Homo sapiens
gattcagatttctc

SEQ ID NO: 2882975 - DNA, 21 bp, Homo sapiens
gattttttttgtaacttcaaa

SEQ ID NO: 2882976 - DNA, 16 bp, Homo sapiens
gcaattatattgtcct

SEQ ID NO: 2882977 - DNA, 20 bp, Homo sapiens
gcactcctcggtactcccat

SEQ ID NO: 2882978 - DNA, 14 bp, Homo sapiens
gcaggggtctgagc

SEQ ID NO: 2882979 - DNA, 15 bp, Homo sapiens
gcaggggtctgagcc

SEQ ID NO: 2882980 - DNA, 21 bp, Homo sapiens
gcccacaaactgatttctcac

SEQ ID NO: 2882981 - DNA, 23 bp, Homo sapiens
gccgtgctcgcccacaaactgat

SEQ ID NO: 2882982 - DNA, 19 bp, Homo sapiens
gcctcactattacttgaac

SEQ ID NO: 2882983 - DNA, 13 bp, Homo sapiens
gcggggtgcagaa

SEQ ID NO: 2882984 - DNA, 20 bp, Homo sapiens
gctacatggggtctgggtgg

SEQ ID NO: 2882985 - DNA, 18 bp, Homo sapiens
gctaggaatatagattaa

SEQ ID NO: 2882986 - DNA, 21 bp, Homo sapiens
gctattttaaaccaattgcag

SEQ ID NO: 2882987 - DNA, 13 bp, Homo sapiens
gctcaggtgcaag

SEQ ID NO: 2882988 - DNA, 16 bp, Homo sapiens
gctcgcccacaaactg

SEQ ID NO: 2882989 - DNA, 16 bp, Homo sapiens
gctctgacagccctgc

SEQ ID NO: 2882990 - DNA, 17 bp, Homo sapiens
gcttccttagccttgct

SEQ ID NO: 2882991 - DNA, 20 bp, Homo sapiens
gctttaggcatatgcttctt

SEQ ID NO: 2882992 - DNA, 22 bp, Homo sapiens
ggaaacaccgagtctctgtata

SEQ ID NO: 2882993 - DNA, 16 bp, Homo sapiens
ggagaccctgagtccg

SEQ ID NO: 2882994 - DNA, 19 bp, Homo sapiens
ggagcaggggtctgagcca

SEQ ID NO: 2882995 - DNA, 12 bp, Homo sapiens
ggagctatttta

SEQ ID NO: 2882996 - DNA, 23 bp, Homo sapiens
gggctctgacagccctgcggaga

SEQ ID NO: 2882997 - DNA, 14 bp, Homo sapiens
ggtcaccatgaaac

SEQ ID NO: 2882998 - DNA, 19 bp, Homo sapiens
tgtcagggcagtacaatgt

SEQ ID NO: 2882999 - DNA, 13 bp, Homo sapiens
tgtgactttgaaa

SEQ ID NO: 2883000 - DNA, 22 bp, Homo sapiens
tgtgagtgtgtttgtgtgcatg

SEQ ID NO: 2883001 - DNA, 17 bp, Homo sapiens
tgtgcatgaaagagaaa

SEQ ID NO: 2883002 - DNA, 18 bp, Homo sapiens
tgtggtttactagcagga

SEQ ID NO: 2883003 - DNA, 13 bp, Homo sapiens
tgttgctgtcaag

SEQ ID NO: 2883004 - DNA, 20 bp, Homo sapiens
tgtttgtacaagattgtcat

SEQ ID NO: 2883005 - DNA, 17 bp, Homo sapiens
aactatcaatatttaag

SEQ ID NO: 2883006 - DNA, 18 bp, Homo sapiens
aactatcaatatttaagt

SEQ ID NO: 2883007 - DNA, 20 bp, Homo sapiens
aactcattgcatcatttaca

SEQ ID NO: 2883008 - DNA, 11 bp, Homo sapiens
aactctttaac

SEQ ID NO: 2883009 - DNA, 13 bp, Homo sapiens
aactctttaactt

SEQ ID NO: 2883010 - DNA, 17 bp, Homo sapiens
aacttcaaatatagaga

SEQ ID NO: 2883011 - DNA, 17 bp, Homo sapiens
aagatgtactataacat

SEQ ID NO: 2883012 - DNA, 17 bp, Homo sapiens
aagattgtcattagtga

SEQ ID NO: 2883013 - DNA, 15 bp, Homo sapiens
aagattttttttgta

SEQ ID NO: 2883014 - DNA, 19 bp, Homo sapiens
aagattttttttgtaactt

SEQ ID NO: 2883015 - DNA, 20 bp, Homo sapiens
aagcacagtctgatgacaca

SEQ ID NO: 2883016 - DNA, 16 bp, Homo sapiens
aagtcttttttgatca

SEQ ID NO: 2883017 - DNA, 16 bp, Homo sapiens
aagttgagtatattat

SEQ ID NO: 2883018 - DNA, 18 bp, Homo sapiens
aataatagattgtgaata

SEQ ID NO: 2883019 - DNA, 15 bp, Homo sapiens
aatatagattaaatc

SEQ ID NO: 2883020 - DNA, 15 bp, Homo sapiens
aattgcaatctataa

SEQ ID NO: 2883021 - DNA, 18 bp, Homo sapiens
aatttcccctaatctttt

SEQ ID NO: 2883022 - DNA, 17 bp, Homo sapiens
acaagacaacattgtaa

SEQ ID NO: 2883023 - DNA, 19 bp, Homo sapiens
acaagattgtcattagtga

SEQ ID NO: 2883024 - DNA, 24 bp, Homo sapiens
acaccgagtctctgtataatctat

SEQ ID NO: 2883025 - DNA, 18 bp, Homo sapiens
accaaatgtaactatgtt

SEQ ID NO: 2883026 - DNA, 15 bp, Homo sapiens
acgttatatattgta

SEQ ID NO: 2883027 - DNA, 16 bp, Homo sapiens
acgttatatattgtat

SEQ ID NO: 2883028 - DNA, 19 bp, Homo sapiens
acgttatatattgtattaa

SEQ ID NO: 2883029 - DNA, 19 bp, Homo sapiens
actataacatagaattgca

SEQ ID NO: 2883030 - DNA, 23 bp, Homo sapiens
actataacatagaattgcaatct

SEQ ID NO: 2883031 - DNA, 16 bp, Homo sapiens
actatcaatatttaag

SEQ ID NO: 2883032 - DNA, 17 bp, Homo sapiens
actatcaatatttaagt

SEQ ID NO: 2883033 - DNA, 20 bp, Homo sapiens
actcattgcatcatttacaa

SEQ ID NO: 2883034 - DNA, 19 bp, Homo sapiens
actcattttaatgattgtt

SEQ ID NO: 2883035 - DNA, 18 bp, Homo sapiens
actcctcggtactcccat

SEQ ID NO: 2883036 - DNA, 22 bp, Homo sapiens
actctgaataagcactttttaa

SEQ ID NO: 2883037 - DNA, 15 bp, Homo sapiens
actgagaaatgaatg

SEQ ID NO: 2883038 - DNA, 13 bp, Homo sapiens
actgatttctcac

SEQ ID NO: 2883039 - DNA, 15 bp, Homo sapiens
actggattattcagg

SEQ ID NO: 2883040 - DNA, 22 bp, Homo sapiens
actgtttgttccagaatctgta

SEQ ID NO: 2883041 - DNA, 23 bp, Homo sapiens
acttctaagttgagtatattata

SEQ ID NO: 2883042 - DNA, 15 bp, Homo sapiens
acttgaactttccaa

SEQ ID NO: 2883043 - DNA, 14 bp, Homo sapiens
actttccaaaacct

SEQ ID NO: 2883044 - DNA, 16 bp, Homo sapiens
acttttttgaaatcag

SEQ ID NO: 2883045 - DNA, 13 bp, Homo sapiens
agaaatgaatgct

SEQ ID NO: 2883046 - DNA, 17 bp, Homo sapiens
agaaccagtctttcaac

SEQ ID NO: 2883047 - DNA, 19 bp, Homo sapiens
agaaccagtctttcaactc

SEQ ID NO: 2883048 - DNA, 19 bp, Homo sapiens
agaagaatccgagtgtttg

SEQ ID NO: 2883049 - DNA, 17 bp, Homo sapiens
agaattgcaatctataa

SEQ ID NO: 2883050 - DNA, 14 bp, Homo sapiens
agaggagaaactga

SEQ ID NO: 2883051 - DNA, 14 bp, Homo sapiens
agatgagcacttct

SEQ ID NO: 2883052 - DNA, 14 bp, Homo sapiens
agatgtgctgcttt

SEQ ID NO: 2883053 - DNA, 16 bp, Homo sapiens
agatgtgctgctttga

SEQ ID NO: 2883054 - DNA, 13 bp, Homo sapiens
agattgtgaataa

SEQ ID NO: 2883055 - DNA, 18 bp, Homo sapiens
agattgtgaataatgatt

SEQ ID NO: 2883056 - DNA, 14 bp, Homo sapiens
agatttctctttga

SEQ ID NO: 2883057 - DNA, 18 bp, Homo sapiens
agattttttttgtaactt

SEQ ID NO: 2883058 - DNA, 15 bp, Homo sapiens
agcaaaatgcatgta

SEQ ID NO: 2883059 - DNA, 20 bp, Homo sapiens
agcaaaatgcatgtaatcaa

SEQ ID NO: 2883060 - DNA, 15 bp, Homo sapiens
agcaagatgtactat

SEQ ID NO: 2883061 - DNA, 14 bp, Homo sapiens
agcactttttaaaa

SEQ ID NO: 2883062 - DNA, 15 bp, Homo sapiens
agcaggggtctgagc

SEQ ID NO: 2883063 - DNA, 15 bp, Homo sapiens
agccacagccgtgct

SEQ ID NO: 2883064 - DNA, 18 bp, Homo sapiens
agcctcactattacttga

SEQ ID NO: 2883065 - DNA, 18 bp, Homo sapiens
aggcatatgcttctttaa

SEQ ID NO: 2883066 - DNA, 22 bp, Homo sapiens
aggcttaaggagaggagaaact

SEQ ID NO: 2883067 - DNA, 13 bp, Homo sapiens
agggcattttaaa

SEQ ID NO: 2883068 - DNA, 15 bp, Homo sapiens
agggctaggaatata

SEQ ID NO: 2883069 - DNA, 21 bp, Homo sapiens
agggctaggaatatagattaa

SEQ ID NO: 2883070 - DNA, 20 bp, Homo sapiens
aggtaactatcaatatttaa

SEQ ID NO: 2883071 - DNA, 17 bp, Homo sapiens
aggtgcaagtgccccag

SEQ ID NO: 2883072 - DNA, 12 bp, Homo sapiens
agtaaacactgt

SEQ ID NO: 2883073 - DNA, 19 bp, Homo sapiens
agtacaatgtgactttgaa

SEQ ID NO: 2883074 - DNA, 16 bp, Homo sapiens
agtatattataataga

SEQ ID NO: 2883075 - DNA, 16 bp, Homo sapiens
agtctgagtaaaatct

SEQ ID NO: 2883076 - DNA, 14 bp, Homo sapiens
agtgcaatgcgtgt

SEQ ID NO: 2883077 - DNA, 17 bp, Homo sapiens
agtggaggtttatagtt

SEQ ID NO: 2883078 - DNA, 13 bp, Homo sapiens
agttaatctataa

SEQ ID NO: 2883079 - DNA, 15 bp, Homo sapiens
agttatagaaagcaa

SEQ ID NO: 2883080 - DNA, 17 bp, Homo sapiens
agttttaccctatatct

SEQ ID NO: 2883081 - DNA, 17 bp, Homo sapiens
atacttttttgaaatca

SEQ ID NO: 2883082 - DNA, 18 bp, Homo sapiens
atagaattgcaatctata

SEQ ID NO: 2883083 - DNA, 19 bp, Homo sapiens
atagattgtgaataatgat

SEQ ID NO: 2883084 - DNA, 21 bp, Homo sapiens
ataggaaatggtatccagaat

SEQ ID NO: 2883085 - DNA, 16 bp, Homo sapiens
atatatctcaaattgt

SEQ ID NO: 2883086 - DNA, 13 bp, Homo sapiens
atatttacaacct

SEQ ID NO: 2883087 - DNA, 14 bp, Homo sapiens
atcagtaaacactg

SEQ ID NO: 2883088 - DNA, 19 bp, Homo sapiens
atcagtaaacactgtgtat

SEQ ID NO: 2883089 - DNA, 17 bp, Homo sapiens
atcatactcctatgctt

SEQ ID NO: 2883090 - DNA, 14 bp, Homo sapiens
atcatttacaagac

SEQ ID NO: 2883091 - DNA, 15 bp, Homo sapiens
atccttgacttttta

SEQ ID NO: 2883092 - DNA, 13 bp, Homo sapiens
atctataaacact

SEQ ID NO: 2883093 - DNA, 14 bp, Homo sapiens
atctataaacactg

SEQ ID NO: 2883094 - DNA, 17 bp, Homo sapiens
atctcaaattgtaatta

SEQ ID NO: 2883095 - DNA, 13 bp, Homo sapiens
atgcatgtaatca

SEQ ID NO: 2883096 - DNA, 19 bp, Homo sapiens
atgcatgtaatcaacatgg

SEQ ID NO: 2883097 - DNA, 18 bp, Homo sapiens
atgtttgtacaagattgt

SEQ ID NO: 2883098 - DNA, 22 bp, Homo sapiens
atgttttatcgtccagtgactt

SEQ ID NO: 2883099 - DNA, 15 bp, Homo sapiens
attaaatcatactcc

SEQ ID NO: 2883100 - DNA, 13 bp, Homo sapiens
attacttgaactt

SEQ ID NO: 2883101 - DNA, 16 bp, Homo sapiens
attattaatgctttgg

SEQ ID NO: 2883102 - DNA, 15 bp, Homo sapiens
attgatttgattttt

SEQ ID NO: 2883103 - DNA, 23 bp, Homo sapiens
attgtcctcccctattttaagac

SEQ ID NO: 2883104 - DNA, 17 bp, Homo sapiens
tcatactcctatgcttt

SEQ ID NO: 2883105 - DNA, 12 bp, Homo sapiens
tcatatgaaaaa

SEQ ID NO: 2883106 - DNA, 21 bp, Homo sapiens
tcatatgaaaaaaatgcattt

SEQ ID NO: 2883107 - DNA, 16 bp, Homo sapiens
tcccctaatcttttct

SEQ ID NO: 2883108 - DNA, 13 bp, Homo sapiens
tcctatgctttag

SEQ ID NO: 2883109 - DNA, 17 bp, Homo sapiens
tcctcccctattttaag

SEQ ID NO: 2883110 - DNA, 16 bp, Homo sapiens
tcctcggtactcccat

SEQ ID NO: 2883111 - DNA, 17 bp, Homo sapiens
tcctcttgcatttcact

SEQ ID NO: 2883112 - DNA, 17 bp, Homo sapiens
tccttaattcactccca

SEQ ID NO: 2883113 - DNA, 17 bp, Homo sapiens
tctataaacactgtttg

SEQ ID NO: 2883114 - DNA, 21 bp, Homo sapiens
tctataatatttgtgtgttca

SEQ ID NO: 2883115 - DNA, 23 bp, Homo sapiens
tctcaaattgtaattaataatag

SEQ ID NO: 2883116 - DNA, 22 bp, Homo sapiens
tctctgtataatctatttacat

SEQ ID NO: 2883117 - DNA, 12 bp, Homo sapiens
tctctttgaaac

SEQ ID NO: 2883118 - DNA, 23 bp, Homo sapiens
tctgaaggcgtcaacgtgcattt

SEQ ID NO: 2883119 - DNA, 15 bp, Homo sapiens
tctgaatcttctgaa

SEQ ID NO: 2883120 - DNA, 19 bp, Homo sapiens
tctgatacttttttgaaat

SEQ ID NO: 2883121 - DNA, 16 bp, Homo sapiens
tcttgaaccagaacca

SEQ ID NO: 2883122 - DNA, 14 bp, Homo sapiens
tcttgcatttcact

SEQ ID NO: 2883123 - DNA, 15 bp, Homo sapiens
tcttttctgaatctt

SEQ ID NO: 2883124 - DNA, 22 bp, Homo sapiens
tcttttctgaatcttctgaaac

SEQ ID NO: 2883125 - DNA, 20 bp, Homo sapiens
tgaaacatgcttgtgtttct

SEQ ID NO: 2883126 - DNA, 18 bp, Homo sapiens
tgaaccagaaccagtctt

SEQ ID NO: 2883127 - DNA, 14 bp, Homo sapiens
tgaactttccaaaa

SEQ ID NO: 2883128 - DNA, 13 bp, Homo sapiens
tgaataagcactt

SEQ ID NO: 2883129 - DNA, 14 bp, Homo sapiens
tgaatgctgagacc

SEQ ID NO: 2883130 - DNA, 16 bp, Homo sapiens
tgatacttttttgaaa

SEQ ID NO: 2883131 - DNA, 21 bp, Homo sapiens
tgatttggggattcagatttc

SEQ ID NO: 2883132 - DNA, 22 bp, Homo sapiens
tgatttggggattcagatttct

SEQ ID NO: 2883133 - DNA, 21 bp, Homo sapiens
tgcatgtaatcaacatggcta

SEQ ID NO: 2883134 - DNA, 22 bp, Homo sapiens
tgctttgaggctcaccagaatt

SEQ ID NO: 2883135 - DNA, 12 bp, Homo sapiens
tgctttgatata

SEQ ID NO: 2883136 - DNA, 13 bp, Homo sapiens
tggggattcagat

SEQ ID NO: 2883137 - DNA, 19 bp, Homo sapiens
tgtactataacatagaatt

SEQ ID NO: 2883138 - DNA, 20 bp, Homo sapiens
tgtagcaaccttctgcattc

SEQ ID NO: 2883139 - DNA, 14 bp, Homo sapiens
tgtataatctattt

SEQ ID NO: 2883140 - DNA, 24 bp, Homo sapiens
tgtcattagtgagacatatttaca

SEQ ID NO: 2883141 - DNA, 20 bp, Homo sapiens
tgtgactttgaaaatatata

SEQ ID NO: 2883142 - DNA, 13 bp, Homo sapiens
tgtgtattgttgt

SEQ ID NO: 2883143 - DNA, 20 bp, Homo sapiens
tgtgtattgttgtaaaatgt

SEQ ID NO: 2883144 - DNA, 16 bp, Homo sapiens
tgtttgtgtgcatgaa

SEQ ID NO: 2883145 - DNA, 22 bp, Homo sapiens
ttaaaagcaattatattgtcct

SEQ ID NO: 2883146 - DNA, 16 bp, Homo sapiens
ttaagacgtgaatgtc

SEQ ID NO: 2883147 - DNA, 16 bp, Homo sapiens
ttacagttatagaaag

SEQ ID NO: 2883148 - DNA, 15 bp, Homo sapiens
ttacttgaactttcc

SEQ ID NO: 2883149 - DNA, 17 bp, Homo sapiens
ttacttgaactttccaa

SEQ ID NO: 2883150 - DNA, 14 bp, Homo sapiens
ttagccttgctcag

SEQ ID NO: 2883151 - DNA, 17 bp, Homo sapiens
ttatcgtccagtgactt

SEQ ID NO: 2883152 - DNA, 15 bp, Homo sapiens
ttcagatttctcttt

SEQ ID NO: 2883153 - DNA, 17 bp, Homo sapiens
ttcagatttctctttga

SEQ ID NO: 2883154 - DNA, 22 bp, Homo sapiens
ttcaggctttaggcatatgctt

SEQ ID NO: 2883155 - DNA, 15 bp, Homo sapiens
ttcctcttgaaccag

SEQ ID NO: 2883156 - DNA, 20 bp, Homo sapiens
ttctaagttgagtatattat

SEQ ID NO: 2883157 - DNA, 15 bp, Homo sapiens
ttgaactttccaaaa

SEQ ID NO: 2883158 - DNA, 13 bp, Homo sapiens
ttgatttgatttt

SEQ ID NO: 2883159 - DNA, 16 bp, Homo sapiens
ttgtaacttcaaatat

SEQ ID NO: 2883160 - DNA, 19 bp, Homo sapiens
ttgtcctcccctattttaa

SEQ ID NO: 2883161 - DNA, 14 bp, Homo sapiens
tttaaaaaactttc

SEQ ID NO: 2883162 - DNA, 18 bp, Homo sapiens
tttaaaaaactttctact

SEQ ID NO: 2883163 - DNA, 20 bp, Homo sapiens
tttaagtttgttgctgtcaa

SEQ ID NO: 2883164 - DNA, 21 bp, Homo sapiens
tttaggcatatgcttctttaa

SEQ ID NO: 2883165 - DNA, 17 bp, Homo sapiens
tttatagttaatctata

SEQ ID NO: 2883166 - DNA, 18 bp, Homo sapiens
tttatagttaatctataa

SEQ ID NO: 2883167 - DNA, 16 bp, Homo sapiens
tttcaactcattgcat

SEQ ID NO: 2883168 - DNA, 18 bp, Homo sapiens
tttcaactcattgcatca

SEQ ID NO: 2883169 - DNA, 16 bp, Homo sapiens
tttctattttctctga

SEQ ID NO: 2883170 - DNA, 12 bp, Homo sapiens
tttctctttgaa

SEQ ID NO: 2883171 - DNA, 15 bp, Homo sapiens
tttctctttgaaaca

SEQ ID NO: 2883172 - DNA, 20 bp, Homo sapiens
tttctctttgaaacatgctt

SEQ ID NO: 2883173 - DNA, 20 bp, Homo sapiens
tttgaggctcaccagaatta

SEQ ID NO: 2883174 - DNA, 17 bp, Homo sapiens
tttgtacaagattgtca

SEQ ID NO: 2883175 - DNA, 15 bp, Homo sapiens
tttgttgctgtcaag

SEQ ID NO: 2883176 - DNA, 18 bp, Homo sapiens
ttttaaaagcaattatat

SEQ ID NO: 2883177 - DNA, 21 bp, Homo sapiens
ttttaaaagcaattatattgt

SEQ ID NO: 2883178 - DNA, 16 bp, Homo sapiens
ttttaatgattgttta

SEQ ID NO: 2883179 - DNA, 17 bp, Homo sapiens
ttttaatgattgtttaa

SEQ ID NO: 2883180 - DNA, 19 bp, Homo sapiens
ttttagatgtgctgctttg

SEQ ID NO: 2883181 - DNA, 14 bp, Homo sapiens
ttttatcaggattt

SEQ ID NO: 2883182 - DNA, 18 bp, Homo sapiens
ttttcacatccttgactt

SEQ ID NO: 2883183 - DNA, 21 bp, Homo sapiens
ttttcattcaggtatttgtaa

SEQ ID NO: 2883184 - DNA, 16 bp, Homo sapiens
ttttctgaatcttctg

SEQ ID NO: 2883185 - DNA, 20 bp, Homo sapiens
tttttagatgtgctgctttg

SEQ ID NO: 2883186 - DNA, 13 bp, Homo sapiens
aaaaaaaactctt

SEQ ID NO: 2883187 - DNA, 12 bp, Homo sapiens
aaaaaaactctt

SEQ ID NO: 2883188 - DNA, 11 bp, Homo sapiens
aaaaaactctt

SEQ ID NO: 2883189 - DNA, 19 bp, Homo sapiens
aaaaagctataaattatat

SEQ ID NO: 2883190 - DNA, 14 bp, Homo sapiens
aaaagtgcaatgcg

SEQ ID NO: 2883191 - DNA, 23 bp, Homo sapiens
aaacactgtttgttccagaatct

SEQ ID NO: 2883192 - DNA, 16 bp, Homo sapiens
aaacctaaagaggaaa

SEQ ID NO: 2883193 - DNA, 13 bp, Homo sapiens
aaactgatttctc

SEQ ID NO: 2883194 - DNA, 21 bp, Homo sapiens
aaactttctactcattttaat

SEQ ID NO: 2883195 - DNA, 23 bp, Homo sapiens
aaagggcccacagtgacttttgc

SEQ ID NO: 2883196 - DNA, 18 bp, Homo sapiens
aaatgtaactatgtttta

SEQ ID NO: 2883197 - DNA, 21 bp, Homo sapiens
aacatagaattgcaatctata

SEQ ID NO: 2883198 - DNA, 22 bp, Homo sapiens
aactatcaatatttaagtttgt

SEQ ID NO: 2883199 - DNA, 18 bp, Homo sapiens
aactctgaataagcactt

SEQ ID NO: 2883200 - DNA, 14 bp, Homo sapiens
aactgatttctcac

SEQ ID NO: 2883201 - DNA, 18 bp, Homo sapiens
aacttgtaataaaccctt

SEQ ID NO: 2883202 - DNA, 14 bp, Homo sapiens
aagacaacattgta

SEQ ID NO: 2883203 - DNA, 17 bp, Homo sapiens
aagacaacattgtaaga

SEQ ID NO: 2883204 - DNA, 20 bp, Homo sapiens
aagattttttttgtaacttc

SEQ ID NO: 2883205 - DNA, 21 bp, Homo sapiens
aaggaatagtcgcgcaagcat

SEQ ID NO: 2883206 - DNA, 16 bp, Homo sapiens
aagggcattttaaaag

SEQ ID NO: 2883207 - DNA, 18 bp, Homo sapiens
aagtaactggtgatatat

SEQ ID NO: 2883208 - DNA, 19 bp, Homo sapiens
aagttcaatctgtttttca

SEQ ID NO: 2883209 - DNA, 18 bp, Homo sapiens
aagttgagtatattataa

SEQ ID NO: 2883210 - DNA, 11 bp, Homo sapiens
aatatagagat

SEQ ID NO: 2883211 - DNA, 21 bp, Homo sapiens
aatatagagatatttttgtac

SEQ ID NO: 2883212 - DNA, 17 bp, Homo sapiens
aatatagattaaatcat

SEQ ID NO: 2883213 - DNA, 19 bp, Homo sapiens
aatcatactcctatgcttt

SEQ ID NO: 2883214 - DNA, 16 bp, Homo sapiens
aatccgagtgtttgcc

SEQ ID NO: 2883215 - DNA, 23 bp, Homo sapiens
aatctatttacataaaatgggtg

SEQ ID NO: 2883216 - DNA, 14 bp, Homo sapiens
aatcttttctgaat

SEQ ID NO: 2883217 - DNA, 13 bp, Homo sapiens
aatgattgtttaa

SEQ ID NO: 2883218 - DNA, 14 bp, Homo sapiens
aatgattgtttaaa

SEQ ID NO: 2883219 - DNA, 15 bp, Homo sapiens
aatgctttccaaaac

SEQ ID NO: 2883220 - DNA, 13 bp, Homo sapiens
aatgggtgatatg

SEQ ID NO: 2883221 - DNA, 11 bp, Homo sapiens
aattatattcc

SEQ ID NO: 2883222 - DNA, 15 bp, Homo sapiens
aattatttttaagtg

SEQ ID NO: 2883223 - DNA, 13 bp, Homo sapiens
aattcactcccac

SEQ ID NO: 2883224 - DNA, 16 bp, Homo sapiens
aattttgtatgaaaaa

SEQ ID NO: 2883225 - DNA, 16 bp, Homo sapiens
acaaactgatttctca

SEQ ID NO: 2883226 - DNA, 17 bp, Homo sapiens
acaaactgatttctcac

SEQ ID NO: 2883227 - DNA, 15 bp, Homo sapiens
acaagacaacattgt

SEQ ID NO: 2883228 - DNA, 21 bp, Homo sapiens
acaaggaatagtcgcgcaagc

SEQ ID NO: 2883229 - DNA, 17 bp, Homo sapiens
acaatgtgactttgaaa

SEQ ID NO: 2883230 - DNA, 20 bp, Homo sapiens
acaatgtgactttgaaaata

SEQ ID NO: 2883231 - DNA, 13 bp, Homo sapiens
acagaggtaacta

SEQ ID NO: 2883232 - DNA, 16 bp, Homo sapiens
acagttatagaaagca

SEQ ID NO: 2883233 - DNA, 20 bp, Homo sapiens
acatgcttgtgtttcttagt

SEQ ID NO: 2883234 - DNA, 20 bp, Homo sapiens
accagtctttcaactcattg

SEQ ID NO: 2883235 - DNA, 17 bp, Homo sapiens
accgagtctctgtataa

SEQ ID NO: 2883236 - DNA, 14 bp, Homo sapiens
acgtgaatgtctca

SEQ ID NO: 2883237 - DNA, 22 bp, Homo sapiens
actaaactctgaataagcactt

SEQ ID NO: 2883238 - DNA, 16 bp, Homo sapiens
actacatattgaatag

SEQ ID NO: 2883239 - DNA, 18 bp, Homo sapiens
actatcaatatttaagtt

SEQ ID NO: 2883240 - DNA, 22 bp, Homo sapiens
actatgttttatcgtccagtga

SEQ ID NO: 2883241 - DNA, 20 bp, Homo sapiens
actggtttatccacccacaa

SEQ ID NO: 2883242 - DNA, 22 bp, Homo sapiens
actggtttatccacccacaaca

SEQ ID NO: 2883243 - DNA, 19 bp, Homo sapiens
actttctactcattttaat

SEQ ID NO: 2883244 - DNA, 18 bp, Homo sapiens
acttttttgaaatcagta

SEQ ID NO: 2883245 - DNA, 15 bp, Homo sapiens
agaaagcaagatgta

SEQ ID NO: 2883246 - DNA, 22 bp, Homo sapiens
agaaccagtctttcaactcatt

SEQ ID NO: 2883247 - DNA, 20 bp, Homo sapiens
agaattgcaatctataatat

SEQ ID NO: 2883248 - DNA, 17 bp, Homo sapiens
agacgtgaatgtctcag

SEQ ID NO: 2883249 - DNA, 19 bp, Homo sapiens
agacgtgaatgtctcagcg

SEQ ID NO: 2883250 - DNA, 17 bp, Homo sapiens
agactgttaaatgaaac

SEQ ID NO: 2883251 - DNA, 21 bp, Homo sapiens
agaggtaactatcaatattta

SEQ ID NO: 2883252 - DNA, 12 bp, Homo sapiens
agatatttttgt

SEQ ID NO: 2883253 - DNA, 17 bp, Homo sapiens
agatatttttgtacgtt

SEQ ID NO: 2883254 - DNA, 23 bp, Homo sapiens
agatatttttgtacgttatatat

SEQ ID NO: 2883255 - DNA, 22 bp, Homo sapiens
agatgtactataacatagaatt

SEQ ID NO: 2883256 - DNA, 15 bp, Homo sapiens
agatttctctttgaa

SEQ ID NO: 2883257 - DNA, 17 bp, Homo sapiens
agattttttttgtaact

SEQ ID NO: 2883258 - DNA, 14 bp, Homo sapiens
agcaattatattgt

SEQ ID NO: 2883259 - DNA, 15 bp, Homo sapiens
agcaattatattgtc

SEQ ID NO: 2883260 - DNA, 21 bp, Homo sapiens
agcactcctcggtactcccat

SEQ ID NO: 2883261 - DNA, 20 bp, Homo sapiens
agcacttctaagttgagtat

SEQ ID NO: 2883262 - DNA, 23 bp, Homo sapiens
agccgtgctcgcccacaaactga

SEQ ID NO: 2883263 - DNA, 16 bp, Homo sapiens
aggaaaagtgcaatgc

SEQ ID NO: 2883264 - DNA, 17 bp, Homo sapiens
aggaaaagtgcaatgcg

SEQ ID NO: 2883265 - DNA, 17 bp, Homo sapiens
aggcatatgcttcttta

SEQ ID NO: 2883266 - DNA, 14 bp, Homo sapiens
aggggtctgagcca

SEQ ID NO: 2883267 - DNA, 22 bp, Homo sapiens
aggtaactatcaatatttaagt

SEQ ID NO: 2883268 - DNA, 13 bp, Homo sapiens
agtaaacactgtg

SEQ ID NO: 2883269 - DNA, 15 bp, Homo sapiens
agtcaattacatgtt

SEQ ID NO: 2883270 - DNA, 23 bp, Homo sapiens
agtctctgtataatctatttaca

SEQ ID NO: 2883271 - DNA, 19 bp, Homo sapiens
agtgcaatgcgtgttgtac

SEQ ID NO: 2883272 - DNA, 19 bp, Homo sapiens
agttttaccctatatctat

SEQ ID NO: 2883273 - DNA, 12 bp, Homo sapiens
ataaacactgtt

SEQ ID NO: 2883274 - DNA, 14 bp, Homo sapiens
ataaattatattcc

SEQ ID NO: 2883275 - DNA, 15 bp, Homo sapiens
atacagaggtaacta

SEQ ID NO: 2883276 - DNA, 16 bp, Homo sapiens
atactcctatgcttta

SEQ ID NO: 2883277 - DNA, 20 bp, Homo sapiens
atagagatatttttgtacgt

SEQ ID NO: 2883278 - DNA, 14 bp, Homo sapiens
atagattaaatcat

SEQ ID NO: 2883279 - DNA, 20 bp, Homo sapiens
atagattaaatcatactcct

SEQ ID NO: 2883280 - DNA, 13 bp, Homo sapiens
atagattgtgaat

SEQ ID NO: 2883281 - DNA, 15 bp, Homo sapiens
atatagattaaatca

SEQ ID NO: 2883282 - DNA, 14 bp, Homo sapiens
atataggacattga

SEQ ID NO: 2883283 - DNA, 14 bp, Homo sapiens
atatatctcaaatt

SEQ ID NO: 2883284 - DNA, 17 bp, Homo sapiens
atatctataaacactgt

SEQ ID NO: 2883285 - DNA, 20 bp, Homo sapiens
atatgaaaaaaatgcatttt

SEQ ID NO: 2883286 - DNA, 13 bp, Homo sapiens
atatgcttcttta

SEQ ID NO: 2883287 - DNA, 16 bp, Homo sapiens
atattgtattaagggc

SEQ ID NO: 2883288 - DNA, 14 bp, Homo sapiens
atatttaagtttgt

SEQ ID NO: 2883289 - DNA, 15 bp, Homo sapiens
atatttaagtttgtt

SEQ ID NO: 2883290 - DNA, 13 bp, Homo sapiens
atcagtaaacact

SEQ ID NO: 2883291 - DNA, 15 bp, Homo sapiens
atcagtaaacactgt

SEQ ID NO: 2883292 - DNA, 19 bp, Homo sapiens
atcatactcctatgcttta

SEQ ID NO: 2883293 - DNA, 17 bp, Homo sapiens
atctataactacatatt

SEQ ID NO: 2883294 - DNA, 11 bp, Homo sapiens
atctataatat

SEQ ID NO: 2883295 - DNA, 14 bp, Homo sapiens
atctatttacataa

SEQ ID NO: 2883296 - DNA, 16 bp, Homo sapiens
atcttttctgaatctt

SEQ ID NO: 2883297 - DNA, 18 bp, Homo sapiens
atcttttctgaatcttct

SEQ ID NO: 2883298 - DNA, 17 bp, Homo sapiens
atgacacatttggcagt

SEQ ID NO: 2883299 - DNA, 14 bp, Homo sapiens
atgagcacttctaa

SEQ ID NO: 2883300 - DNA, 18 bp, Homo sapiens
atggagctattttaaacc

SEQ ID NO: 2883301 - DNA, 14 bp, Homo sapiens
atgtactataacat

SEQ ID NO: 2883302 - DNA, 17 bp, Homo sapiens
atgtactataacataga

SEQ ID NO: 2883303 - DNA, 16 bp, Homo sapiens
atgtcaagtaccaaaa

SEQ ID NO: 2883304 - DNA, 13 bp, Homo sapiens
atgtgactttgaa

SEQ ID NO: 2883305 - DNA, 13 bp, Homo sapiens
atgtgctgctttg

SEQ ID NO: 2883306 - DNA, 19 bp, Homo sapiens
atgtgctgctttgatatat

SEQ ID NO: 2883307 - DNA, 20 bp, Homo sapiens
atgtgctgctttgatatata

SEQ ID NO: 2883308 - DNA, 17 bp, Homo sapiens
atgtttggtaccaagaa

SEQ ID NO: 2883309 - DNA, 12 bp, Homo sapiens
attaatgctttg

SEQ ID NO: 2883310 - DNA, 15 bp, Homo sapiens
attattcaggcttta

SEQ ID NO: 2883311 - DNA, 13 bp, Homo sapiens
attcactcccaca

SEQ ID NO: 2883312 - DNA, 15 bp, Homo sapiens
attgcatcatttaca

SEQ ID NO: 2883313 - DNA, 20 bp, Homo sapiens
attgtttttctgatatgttt

SEQ ID NO: 2883314 - DNA, 21 bp, Homo sapiens
atttaagtttgttgctgtcaa

SEQ ID NO: 2883315 - DNA, 19 bp, Homo sapiens
atttacaagacaacattgt

SEQ ID NO: 2883316 - DNA, 15 bp, Homo sapiens
atttactacttttgc

SEQ ID NO: 2883317 - DNA, 16 bp, Homo sapiens
atttcccctaatcttt

SEQ ID NO: 2883318 - DNA, 17 bp, Homo sapiens
atttcccctaatctttt

SEQ ID NO: 2883319 - DNA, 16 bp, Homo sapiens
atttcctcttgaacca

SEQ ID NO: 2883320 - DNA, 19 bp, Homo sapiens
atttgatttttattattaa

SEQ ID NO: 2883321 - DNA, 17 bp, Homo sapiens
attttctctgatacttt

SEQ ID NO: 2883322 - DNA, 19 bp, Homo sapiens
attttctctgatacttttt

SEQ ID NO: 2883323 - DNA, 15 bp, Homo sapiens
atttttatcaggatt

SEQ ID NO: 2883324 - DNA, 20 bp, Homo sapiens
caaattgtaattaataatag

SEQ ID NO: 2883325 - DNA, 20 bp, Homo sapiens
caagattttttttgtaactt

SEQ ID NO: 2883326 - DNA, 21 bp, Homo sapiens
caagattttttttgtaacttc

SEQ ID NO: 2883327 - DNA, 12 bp, Homo sapiens
caattatattgt

SEQ ID NO: 2883328 - DNA, 21 bp, Homo sapiens
cacatccttgactttttagat

SEQ ID NO: 2883329 - DNA, 17 bp, Homo sapiens
cactattacttgaactt

SEQ ID NO: 2883330 - DNA, 17 bp, Homo sapiens
cactttttaaaaaactt

SEQ ID NO: 2883331 - DNA, 16 bp, Homo sapiens
cagaaccagtctttca

SEQ ID NO: 2883332 - DNA, 18 bp, Homo sapiens
cagaatctgtatgattct

SEQ ID NO: 2883333 - DNA, 16 bp, Homo sapiens
cagatttctctttgaa

SEQ ID NO: 2883334 - DNA, 15 bp, Homo sapiens
caggggtctgagcca

SEQ ID NO: 2883335 - DNA, 17 bp, Homo sapiens
catacagaggtaactat

SEQ ID NO: 2883336 - DNA, 15 bp, Homo sapiens
catatgcttctttaa

SEQ ID NO: 2883337 - DNA, 18 bp, Homo sapiens
catgcttgtgtttcttag

SEQ ID NO: 2883338 - DNA, 19 bp, Homo sapiens
catgcttgtgtttcttagt

SEQ ID NO: 2883339 - DNA, 16 bp, Homo sapiens
catgtaaattttgtat

SEQ ID NO: 2883340 - DNA, 21 bp, Homo sapiens
cattagtgagacatatttaca

SEQ ID NO: 2883341 - DNA, 13 bp, Homo sapiens
cattgatttgatt

SEQ ID NO: 2883342 - DNA, 22 bp, Homo sapiens
cattgatttgatttttattatt

SEQ ID NO: 2883343 - DNA, 17 bp, Homo sapiens
cattgtttttctgatat

SEQ ID NO: 2883344 - DNA, 22 bp, Homo sapiens
cattttaaaagcaattatattg

SEQ ID NO: 2883345 - DNA, 23 bp, Homo sapiens
cattttaaaagcaattatattgt

SEQ ID NO: 2883346 - DNA, 14 bp, Homo sapiens
ccagaattattttt

SEQ ID NO: 2883347 - DNA, 22 bp, Homo sapiens
ccccaacatctccctcccacat

SEQ ID NO: 2883348 - DNA, 23 bp, Homo sapiens
ccccagggggcggggtgcagaag

SEQ ID NO: 2883349 - DNA, 12 bp, Homo sapiens
ccgggctctgac

SEQ ID NO: 2883350 - DNA, 14 bp, Homo sapiens
cctcttgcatttca

SEQ ID NO: 2883351 - DNA, 17 bp, Homo sapiens
ccttaattcactcccac

SEQ ID NO: 2883352 - DNA, 15 bp, Homo sapiens
cggagaccctgagtc

SEQ ID NO: 2883353 - DNA, 16 bp, Homo sapiens
cgtgaaagcagatgag

SEQ ID NO: 2883354 - DNA, 16 bp, Homo sapiens
cgtgaatgtctcagcg

SEQ ID NO: 2883355 - DNA, 12 bp, Homo sapiens
ctacatattgaa

SEQ ID NO: 2883356 - DNA, 14 bp, Homo sapiens
ctaggaatatagat

SEQ ID NO: 2883357 - DNA, 18 bp, Homo sapiens
ctatcaatatttaagttt

SEQ ID NO: 2883358 - DNA, 21 bp, Homo sapiens
ctattacttgaactttccaaa

SEQ ID NO: 2883359 - DNA, 14 bp, Homo sapiens
ctcagcgaggtgta

SEQ ID NO: 2883360 - DNA, 21 bp, Homo sapiens
ctcattttaatgattgtttaa

SEQ ID NO: 2883361 - DNA, 15 bp, Homo sapiens
ctcccctattttaag

SEQ ID NO: 2883362 - DNA, 19 bp, Homo sapiens
ctcccctattttaagacgt

SEQ ID NO: 2883363 - DNA, 18 bp, Homo sapiens
ctcctatgctttagctta

SEQ ID NO: 2883364 - DNA, 22 bp, Homo sapiens
ctcctattctcttaatttttct

SEQ ID NO: 2883365 - DNA, 22 bp, Homo sapiens
ctctgacagccctgcggagacc

SEQ ID NO: 2883366 - DNA, 16 bp, Homo sapiens
ctctgatacttttttg

SEQ ID NO: 2883367 - DNA, 22 bp, Homo sapiens
ctctgatacttttttgaaatca

SEQ ID NO: 2883368 - DNA, 18 bp, Homo sapiens
ctgaataagcacttttta

SEQ ID NO: 2883369 - DNA, 20 bp, Homo sapiens
ctgacagccctgcggagacc

SEQ ID NO: 2883370 - DNA, 16 bp, Homo sapiens
ctgagtccgggaggca

SEQ ID NO: 2883371 - DNA, 13 bp, Homo sapiens
ctgatatgtttgt

SEQ ID NO: 2883372 - DNA, 12 bp, Homo sapiens
ctgatttctcac

SEQ ID NO: 2883373 - DNA, 18 bp, Homo sapiens
ctgtataatctatttaca

SEQ ID NO: 2883374 - DNA, 22 bp, Homo sapiens
cttgcatttcacttgagtggag

SEQ ID NO: 2883375 - DNA, 22 bp, Homo sapiens
ctttaaaaaagctataaattat

SEQ ID NO: 2883376 - DNA, 21 bp, Homo sapiens
ctttaggcatatgcttcttta

SEQ ID NO: 2883377 - DNA, 16 bp, Homo sapiens
ctttctactcatttta

SEQ ID NO: 2883378 - DNA, 15 bp, Homo sapiens
cttttttgaaatcag

SEQ ID NO: 2883379 - DNA, 14 bp, Homo sapiens
gaaaagtgcaatgc

SEQ ID NO: 2883380 - DNA, 17 bp, Homo sapiens
gaaatggtatccagaat

SEQ ID NO: 2883381 - DNA, 20 bp, Homo sapiens
gaactggtcaccatgaaact

SEQ ID NO: 2883382 - DNA, 17 bp, Homo sapiens
gaataagcactttttaa

SEQ ID NO: 2883383 - DNA, 12 bp, Homo sapiens
gaatgtctcagc

SEQ ID NO: 2883384 - DNA, 17 bp, Homo sapiens
gaccgggctctgacagc

SEQ ID NO: 2883385 - DNA, 19 bp, Homo sapiens
gacgtgaatgtctcagcga

SEQ ID NO: 2883386 - DNA, 16 bp, Homo sapiens
gactggtaagtaactg

SEQ ID NO: 2883387 - DNA, 19 bp, Homo sapiens
gagaaatgaatgctgagac

SEQ ID NO: 2883388 - DNA, 18 bp, Homo sapiens
gagcaaaatgcatgtaat

SEQ ID NO: 2883389 - DNA, 20 bp, Homo sapiens
gagcaaaatgcatgtaatca

SEQ ID NO: 2883390 - DNA, 18 bp, Homo sapiens
gagcaggggtctgagcca

SEQ ID NO: 2883391 - DNA, 14 bp, Homo sapiens
gaggaaaagtgcaa

SEQ ID NO: 2883392 - DNA, 20 bp, Homo sapiens
gaggaaaagtgcaatgcgtg

SEQ ID NO: 2883393 - DNA, 16 bp, Homo sapiens
gaggagaaactgagaa

SEQ ID NO: 2883394 - DNA, 23 bp, Homo sapiens
gatgctttgtttctttcatatga

SEQ ID NO: 2883395 - DNA, 20 bp, Homo sapiens
gattcagatttctctttgaa

SEQ ID NO: 2883396 - DNA, 14 bp, Homo sapiens
gatttcctcttgaa

SEQ ID NO: 2883397 - DNA, 19 bp, Homo sapiens
gcactcctcggtactccca

SEQ ID NO: 2883398 - DNA, 17 bp, Homo sapiens
gcaggggtctgagccac

SEQ ID NO: 2883399 - DNA, 15 bp, Homo sapiens
gcagtaagtcttttt

SEQ ID NO: 2883400 - DNA, 18 bp, Homo sapiens
gcagtaagtcttttttga

SEQ ID NO: 2883401 - DNA, 19 bp, Homo sapiens
gcatttcacttgagtggag

SEQ ID NO: 2883402 - DNA, 22 bp, Homo sapiens
gcattttaaaagcaattatatt

SEQ ID NO: 2883403 - DNA, 14 bp, Homo sapiens
gcattttcccagat

SEQ ID NO: 2883404 - DNA, 14 bp, Homo sapiens
gccagtatttttta

SEQ ID NO: 2883405 - DNA, 20 bp, Homo sapiens
gccccagggggcggggtgca

SEQ ID NO: 2883406 - DNA, 17 bp, Homo sapiens
gctataaattatattcc

SEQ ID NO: 2883407 - DNA, 22 bp, Homo sapiens
gcttcgcttccttagccttgct

SEQ ID NO: 2883408 - DNA, 14 bp, Homo sapiens
ggaaaagtgcaatg

SEQ ID NO: 2883409 - DNA, 15 bp, Homo sapiens
ggctacttgctttga

SEQ ID NO: 2883410 - DNA, 13 bp, Homo sapiens
ggctcaccagaat

SEQ ID NO: 2883411 - DNA, 18 bp, Homo sapiens
gggcttcgcttccttagc

SEQ ID NO: 2883412 - DNA, 11 bp, Homo sapiens
gtaaacactgt

SEQ ID NO: 2883413 - DNA, 14 bp, Homo sapiens
gtaactatgtttta

SEQ ID NO: 2883414 - DNA, 11 bp, Homo sapiens
gtaacttcaaa

SEQ ID NO: 2883415 - DNA, 16 bp, Homo sapiens
gtaatgcttcaatcag

SEQ ID NO: 2883416 - DNA, 19 bp, Homo sapiens
gtcactgtttattttttta

SEQ ID NO: 2883417 - DNA, 16 bp, Homo sapiens
gtcctcccctatttta

SEQ ID NO: 2883418 - DNA, 18 bp, Homo sapiens
gtcctcccctattttaag

SEQ ID NO: 2883419 - DNA, 13 bp, Homo sapiens
gtgaatgtctcag

SEQ ID NO: 2883420 - DNA, 12 bp, Homo sapiens
gtgactttgaaa

SEQ ID NO: 2883421 - DNA, 12 bp, Homo sapiens
gtgctgctttga

SEQ ID NO: 2883422 - DNA, 14 bp, Homo sapiens
gttatatattgtat

SEQ ID NO: 2883423 - DNA, 15 bp, Homo sapiens
gttcactaaactctg

SEQ ID NO: 2883424 - DNA, 16 bp, Homo sapiens
gttcactaaactctga

SEQ ID NO: 2883425 - DNA, 20 bp, Homo sapiens
gttcactaaactctgaataa

SEQ ID NO: 2883426 - DNA, 16 bp, Homo sapiens
gttcgccgcgtggaat

SEQ ID NO: 2883427 - DNA, 14 bp, Homo sapiens
gtttgttccagaat

SEQ ID NO: 2883428 - DNA, 15 bp, Homo sapiens
gtttttctgatatgt

SEQ ID NO: 2883429 - DNA, 21 bp, Homo sapiens
taaaaaactttctactcattt

SEQ ID NO: 2883430 - DNA, 13 bp, Homo sapiens
taaactctgaata

SEQ ID NO: 2883431 - DNA, 20 bp, Homo sapiens
taaagaggaaaagtgcaatg

SEQ ID NO: 2883432 - DNA, 22 bp, Homo sapiens
taaagcacagtctgatgacaca

SEQ ID NO: 2883433 - DNA, 23 bp, Homo sapiens
taaaggtcacttttcacatcctt

SEQ ID NO: 2883434 - DNA, 22 bp, Homo sapiens
taaagttgttcgccgcgtggaa

SEQ ID NO: 2883435 - DNA, 15 bp, Homo sapiens
taactccccacccca

SEQ ID NO: 2883436 - DNA, 18 bp, Homo sapiens
taactggtgatatatctc

SEQ ID NO: 2883437 - DNA, 14 bp, Homo sapiens
taacttgtaataaa

SEQ ID NO: 2883438 - DNA, 14 bp, Homo sapiens
taagacgtgaatgt

SEQ ID NO: 2883439 - DNA, 15 bp, Homo sapiens
taagaggcagcgtga

SEQ ID NO: 2883440 - DNA, 18 bp, Homo sapiens
taagtgatttttttgtcc

SEQ ID NO: 2883441 - DNA, 18 bp, Homo sapiens
taagtggttttaataaaa

SEQ ID NO: 2883442 - DNA, 18 bp, Homo sapiens
taatagattgtgaataat

SEQ ID NO: 2883443 - DNA, 15 bp, Homo sapiens
taatcttttctgaat

SEQ ID NO: 2883444 - DNA, 11 bp, Homo sapiens
taatgctttgg

SEQ ID NO: 2883445 - DNA, 14 bp, Homo sapiens
tacaatgtgacttt

SEQ ID NO: 2883446 - DNA, 17 bp, Homo sapiens
tacaatgtgactttgaa

SEQ ID NO: 2883447 - DNA, 13 bp, Homo sapiens
taccctatatcta

SEQ ID NO: 2883448 - DNA, 22 bp, Homo sapiens
tacttgaactttccaaaaccta

SEQ ID NO: 2883449 - DNA, 15 bp, Homo sapiens
tacttttttgaaatc

SEQ ID NO: 2883450 - DNA, 18 bp, Homo sapiens
tagattaaatcatactcc

SEQ ID NO: 2883451 - DNA, 19 bp, Homo sapiens
tagttttaccctatatcta

SEQ ID NO: 2883452 - DNA, 18 bp, Homo sapiens
tataactacatattgaat

SEQ ID NO: 2883453 - DNA, 13 bp, Homo sapiens
tataatctattta

SEQ ID NO: 2883454 - DNA, 18 bp, Homo sapiens
tataatctatttacataa

SEQ ID NO: 2883455 - DNA, 19 bp, Homo sapiens
tatagttaatctataacta

SEQ ID NO: 2883456 - DNA, 13 bp, Homo sapiens
tatattataatag

SEQ ID NO: 2883457 - DNA, 15 bp, Homo sapiens
tatattgtattaagg

SEQ ID NO: 2883458 - DNA, 22 bp, Homo sapiens
tatattgtcctcccctatttta

SEQ ID NO: 2883459 - DNA, 12 bp, Homo sapiens
tattacttgaac

SEQ ID NO: 2883460 - DNA, 14 bp, Homo sapiens
tattacttgaactt

SEQ ID NO: 2883461 - DNA, 21 bp, Homo sapiens
tattacttgaactttccaaaa

SEQ ID NO: 2883462 - DNA, 14 bp, Homo sapiens
tattattaatgctt

SEQ ID NO: 2883463 - DNA, 20 bp, Homo sapiens
tattcctcttgcatttcact

SEQ ID NO: 2883464 - DNA, 16 bp, Homo sapiens
tattgtattaagggca

SEQ ID NO: 2883465 - DNA, 16 bp, Homo sapiens
tatttacaacctagaa

SEQ ID NO: 2883466 - DNA, 21 bp, Homo sapiens
tattttctctgatactttttt

SEQ ID NO: 2883467 - DNA, 18 bp, Homo sapiens
tcaaagggcccacagtga

SEQ ID NO: 2883468 - DNA, 16 bp, Homo sapiens
tcaaattgtaattaat

SEQ ID NO: 2883469 - DNA, 19 bp, Homo sapiens
tcaagattttttttgtaac

SEQ ID NO: 2883470 - DNA, 20 bp, Homo sapiens
tcaagattttttttgtaact

SEQ ID NO: 2883471 - DNA, 22 bp, Homo sapiens
tcaagattttttttgtaacttc

SEQ ID NO: 2883472 - DNA, 13 bp, Homo sapiens
tcaatatttaagt

SEQ ID NO: 2883473 - DNA, 16 bp, Homo sapiens
tcaatctgtttttcat

SEQ ID NO: 2883474 - DNA, 21 bp, Homo sapiens
tcacatccttgactttttaga

SEQ ID NO: 2883475 - DNA, 13 bp, Homo sapiens
tcactaaactctg

SEQ ID NO: 2883476 - DNA, 15 bp, Homo sapiens
tcagatttctctttg

SEQ ID NO: 2883477 - DNA, 11 bp, Homo sapiens
tcatatgaaaa

SEQ ID NO: 2883478 - DNA, 14 bp, Homo sapiens
tcattgcatcattt

SEQ ID NO: 2883479 - DNA, 18 bp, Homo sapiens
tccttaattcactcccac

SEQ ID NO: 2883480 - DNA, 19 bp, Homo sapiens
tccttaattcactcccaca

SEQ ID NO: 2883481 - DNA, 13 bp, Homo sapiens
tcggtactcccat

SEQ ID NO: 2883482 - DNA, 19 bp, Homo sapiens
tctaagttgagtatattat

SEQ ID NO: 2883483 - DNA, 15 bp, Homo sapiens
tctactcattttaat

SEQ ID NO: 2883484 - DNA, 20 bp, Homo sapiens
tctattttctctgatacttt

SEQ ID NO: 2883485 - DNA, 15 bp, Homo sapiens
tctgaataagcactt

SEQ ID NO: 2883486 - DNA, 18 bp, Homo sapiens
tctgaataagcacttttt

SEQ ID NO: 2883487 - DNA, 19 bp, Homo sapiens
tctgaataagcacttttta

SEQ ID NO: 2883488 - DNA, 17 bp, Homo sapiens
tctgaatcttctgaaac

SEQ ID NO: 2883489 - DNA, 21 bp, Homo sapiens
tctgacagccctgcggagacc

SEQ ID NO: 2883490 - DNA, 14 bp, Homo sapiens
tctgatatgtttgt

SEQ ID NO: 2883491 - DNA, 12 bp, Homo sapiens
tctttaacttgt

SEQ ID NO: 2883492 - DNA, 14 bp, Homo sapiens
tcttttctgaatct

SEQ ID NO: 2883493 - DNA, 18 bp, Homo sapiens
tcttttctgaatcttctg

SEQ ID NO: 2883494 - DNA, 12 bp, Homo sapiens
tgaaacatgctt

SEQ ID NO: 2883495 - DNA, 17 bp, Homo sapiens
tgaaatcagtaaacact

SEQ ID NO: 2883496 - DNA, 19 bp, Homo sapiens
tgaaatcagtaaacactgt

SEQ ID NO: 2883497 - DNA, 22 bp, Homo sapiens
tgaaatcagtaaacactgtgta

SEQ ID NO: 2883498 - DNA, 12 bp, Homo sapiens
tgaataagcact

SEQ ID NO: 2883499 - DNA, 15 bp, Homo sapiens
tgaataagcactttt

SEQ ID NO: 2883500 - DNA, 14 bp, Homo sapiens
tgaatcttctgaaa

SEQ ID NO: 2883501 - DNA, 22 bp, Homo sapiens
tgaatcttctgaaaccaaatgt

SEQ ID NO: 2883502 - DNA, 15 bp, Homo sapiens
tgagtacagcagaaa

SEQ ID NO: 2883503 - DNA, 15 bp, Homo sapiens
tgagtatattataat

SEQ ID NO: 2883504 - DNA, 16 bp, Homo sapiens
tgagtatattataata

SEQ ID NO: 2883505 - DNA, 16 bp, Homo sapiens
tgatatatctcaaatt

SEQ ID NO: 2883506 - DNA, 11 bp, Homo sapiens
tgcatgaaaat

SEQ ID NO: 2883507 - DNA, 15 bp, Homo sapiens
tggaatgtgagtgtg

SEQ ID NO: 2883508 - DNA, 20 bp, Homo sapiens
tgggatataagaggcagcgt

SEQ ID NO: 2883509 - DNA, 16 bp, Homo sapiens
tggtcaccatgaaact

SEQ ID NO: 2883510 - DNA, 18 bp, Homo sapiens
tgtaaaggtcacttttca

SEQ ID NO: 2883511 - DNA, 21 bp, Homo sapiens
tgtaaaggtcacttttcacat

SEQ ID NO: 2883512 - DNA, 13 bp, Homo sapiens
tgtaacttcaaat

SEQ ID NO: 2883513 - DNA, 14 bp, Homo sapiens
tgtaacttcaaata

SEQ ID NO: 2883514 - DNA, 23 bp, Homo sapiens
tgtaagagagatgagcacttcta

SEQ ID NO: 2883515 - DNA, 14 bp, Homo sapiens
tgtaataaaccctt

SEQ ID NO: 2883516 - DNA, 23 bp, Homo sapiens
tgtaataaacccttaactggcat

SEQ ID NO: 2883517 - DNA, 17 bp, Homo sapiens
tgtacgttatatattgt

SEQ ID NO: 2883518 - DNA, 22 bp, Homo sapiens
tgtcattagtgagacatattta

SEQ ID NO: 2883519 - DNA, 20 bp, Homo sapiens
tgtctcagcgaggtgtaaag

SEQ ID NO: 2883520 - DNA, 14 bp, Homo sapiens
tgtgactttgaaaa

SEQ ID NO: 2883521 - DNA, 18 bp, Homo sapiens
tgtgctgctttgatatat

SEQ ID NO: 2883522 - DNA, 17 bp, Homo sapiens
tgtgtggaagaaggaaa

SEQ ID NO: 2883523 - DNA, 19 bp, Homo sapiens
tgtgttcactaaactctga

SEQ ID NO: 2883524 - DNA, 14 bp, Homo sapiens
tgttaaatgaaacc

SEQ ID NO: 2883525 - DNA, 17 bp, Homo sapiens
tgttcactaaactctga

SEQ ID NO: 2883526 - DNA, 23 bp, Homo sapiens
tgttgtacatacagaggtaacta

SEQ ID NO: 2883527 - DNA, 17 bp, Homo sapiens
ttaaaaaaaactcttta

SEQ ID NO: 2883528 - DNA, 15 bp, Homo sapiens
ttaagacgtgaatgt

SEQ ID NO: 2883529 - DNA, 21 bp, Homo sapiens
ttaaggagaggagaaactgag

SEQ ID NO: 2883530 - DNA, 16 bp, Homo sapiens
ttacaacctagaagta

SEQ ID NO: 2883531 - DNA, 17 bp, Homo sapiens
ttaccctatatctataa

SEQ ID NO: 2883532 - DNA, 14 bp, Homo sapiens
ttatagttaatcta

SEQ ID NO: 2883533 - DNA, 17 bp, Homo sapiens
ttatatccatttttatc

SEQ ID NO: 2883534 - DNA, 20 bp, Homo sapiens
ttcccctaatcttttctgaa

SEQ ID NO: 2883535 - DNA, 12 bp, Homo sapiens
ttctctttgaaa

SEQ ID NO: 2883536 - DNA, 16 bp, Homo sapiens
ttctgaatcttctgaa

SEQ ID NO: 2883537 - DNA, 21 bp, Homo sapiens
ttgaaatcagtaaacactgtg

SEQ ID NO: 2883538 - DNA, 18 bp, Homo sapiens
ttgaagtggccagatgag

SEQ ID NO: 2883539 - DNA, 23 bp, Homo sapiens
ttgaatagggctaggaatataga

SEQ ID NO: 2883540 - DNA, 13 bp, Homo sapiens
ttgcaatctataa

SEQ ID NO: 2883541 - DNA, 16 bp, Homo sapiens
ttgcaatctataatat

SEQ ID NO: 2883542 - DNA, 14 bp, Homo sapiens
ttgtaacttcaaat

SEQ ID NO: 2883543 - DNA, 15 bp, Homo sapiens
ttgtaacttcaaata

SEQ ID NO: 2883544 - DNA, 21 bp, Homo sapiens
ttgtaattaataatagattgt

SEQ ID NO: 2883545 - DNA, 16 bp, Homo sapiens
ttgtacgttatatatt

SEQ ID NO: 2883546 - DNA, 20 bp, Homo sapiens
ttgtacgttatatattgtat

SEQ ID NO: 2883547 - DNA, 16 bp, Homo sapiens
tttaaaaaactttcta

SEQ ID NO: 2883548 - DNA, 19 bp, Homo sapiens
tttaaaaaactttctactc

SEQ ID NO: 2883549 - DNA, 20 bp, Homo sapiens
tttaaaagcaattatattgt

SEQ ID NO: 2883550 - DNA, 15 bp, Homo sapiens
tttaacttgtaataa

SEQ ID NO: 2883551 - DNA, 16 bp, Homo sapiens
tttacaacctagaagt

SEQ ID NO: 2883552 - DNA, 20 bp, Homo sapiens
tttacaagacaacattgtaa

SEQ ID NO: 2883553 - DNA, 15 bp, Homo sapiens
tttacagttatagaa

SEQ ID NO: 2883554 - DNA, 15 bp, Homo sapiens
tttaccctatatcta

SEQ ID NO: 2883555 - DNA, 20 bp, Homo sapiens
tttaggcatatgcttcttta

SEQ ID NO: 2883556 - DNA, 13 bp, Homo sapiens
tttatatccattt

SEQ ID NO: 2883557 - DNA, 13 bp, Homo sapiens
tttctactcattt

SEQ ID NO: 2883558 - DNA, 14 bp, Homo sapiens
tttctattttctct

SEQ ID NO: 2883559 - DNA, 13 bp, Homo sapiens
tttctctttgaaa

SEQ ID NO: 2883560 - DNA, 21 bp, Homo sapiens
tttgaaacatgcttgtgtttc

SEQ ID NO: 2883561 - DNA, 21 bp, Homo sapiens
tttgaaatcagtaaacactgt

SEQ ID NO: 2883562 - DNA, 13 bp, Homo sapiens
tttgtaacttcaa

SEQ ID NO: 2883563 - DNA, 14 bp, Homo sapiens
ttttaaaaaacttt

SEQ ID NO: 2883564 - DNA, 17 bp, Homo sapiens
ttttctactttttttaa

SEQ ID NO: 2883565 - DNA, 15 bp, Homo sapiens
ttttctgaatcttct

SEQ ID NO: 2883566 - DNA, 16 bp, Homo sapiens
ttttgtaacttcaaat

SEQ ID NO: 2883567 - DNA, 20 bp, Homo sapiens
ttttgtacgttatatattgt

SEQ ID NO: 2883568 - DNA, 13 bp, Homo sapiens
tttttaaaaaact

SEQ ID NO: 2883569 - DNA, 14 bp, Homo sapiens
tttttaaaaaactt

SEQ ID NO: 2883570 - DNA, 16 bp, Homo sapiens
tttttgtaacttcaaa

SEQ ID NO: 2883571 - DNA, 16 bp, Homo sapiens
ccacaaactgatttct

SEQ ID NO: 2883572 - DNA, 23 bp, Homo sapiens
ccaggcttaaggagaggagaaac

SEQ ID NO: 2883573 - DNA, 13 bp, Homo sapiens
cccacaaactgat

SEQ ID NO: 2883574 - DNA, 19 bp, Homo sapiens
ccctatatctataaacact

SEQ ID NO: 2883575 - DNA, 15 bp, Homo sapiens
ggtctgagccacagc

SEQ ID NO: 2883576 - DNA, 17 bp, Homo sapiens
ggtgtaaagttgttcgc

SEQ ID NO: 2883577 - DNA, 12 bp, Homo sapiens
gtaagtcttttt

SEQ ID NO: 2883578 - DNA, 15 bp, Homo sapiens
gtacgttatatattg

SEQ ID NO: 2883579 - DNA, 16 bp, Homo sapiens
gtacgttatatattgt

SEQ ID NO: 2883580 - DNA, 19 bp, Homo sapiens
gtattaagggcattttaaa

SEQ ID NO: 2883581 - DNA, 22 bp, Homo sapiens
gtcaagattttttttgtaactt

SEQ ID NO: 2883582 - DNA, 15 bp, Homo sapiens
gtcctcccctatttt

SEQ ID NO: 2883583 - DNA, 17 bp, Homo sapiens
gtctctgtataatctat

SEQ ID NO: 2883584 - DNA, 20 bp, Homo sapiens
gtctctgtataatctattta

SEQ ID NO: 2883585 - DNA, 14 bp, Homo sapiens
gtgaataatgattt

SEQ ID NO: 2883586 - DNA, 21 bp, Homo sapiens
gtgcaatgcgtgttgtacata

SEQ ID NO: 2883587 - DNA, 15 bp, Homo sapiens
gtgcatgaaagagaa

SEQ ID NO: 2883588 - DNA, 13 bp, Homo sapiens
gtgctgctttgat

SEQ ID NO: 2883589 - DNA, 23 bp, Homo sapiens
gttatatattgtattaagggcat

SEQ ID NO: 2883590 - DNA, 17 bp, Homo sapiens
gtttatagttaatctat

SEQ ID NO: 2883591 - DNA, 18 bp, Homo sapiens
gtttatagttaatctata

SEQ ID NO: 2883592 - DNA, 13 bp, Homo sapiens
gtttctattttct

SEQ ID NO: 2883593 - DNA, 21 bp, Homo sapiens
gttttatcgtccagtgacttt

SEQ ID NO: 2883594 - DNA, 19 bp, Homo sapiens
taaaagcaattatattgtc

SEQ ID NO: 2883595 - DNA, 12 bp, Homo sapiens
taaaataataaa

SEQ ID NO: 2883596 - DNA, 14 bp, Homo sapiens
taaacactgtgtat

SEQ ID NO: 2883597 - DNA, 22 bp, Homo sapiens
taaatcatactcctatgcttta

SEQ ID NO: 2883598 - DNA, 17 bp, Homo sapiens
taaattttgtatgaaaa

SEQ ID NO: 2883599 - DNA, 17 bp, Homo sapiens
taacatagaattgcaat

SEQ ID NO: 2883600 - DNA, 17 bp, Homo sapiens
taactggtgatatatct

SEQ ID NO: 2883601 - DNA, 23 bp, Homo sapiens
taatcaacatggctacttgcttt

SEQ ID NO: 2883602 - DNA, 16 bp, Homo sapiens
taatgctttggttctg

SEQ ID NO: 2883603 - DNA, 17 bp, Homo sapiens
tacaagacaacattgta

SEQ ID NO: 2883604 - DNA, 13 bp, Homo sapiens
tacaatgtgactt

SEQ ID NO: 2883605 - DNA, 18 bp, Homo sapiens
tacatacagaggtaacta

SEQ ID NO: 2883606 - DNA, 12 bp, Homo sapiens
tacatattgaat

SEQ ID NO: 2883607 - DNA, 16 bp, Homo sapiens
tacttgaactttccaa

SEQ ID NO: 2883608 - DNA, 17 bp, Homo sapiens
tacttgaactttccaaa

SEQ ID NO: 2883609 - DNA, 22 bp, Homo sapiens
tagattagtactggattattca

SEQ ID NO: 2883610 - DNA, 18 bp, Homo sapiens
tagccttgctcaggtgca

SEQ ID NO: 2883611 - DNA, 23 bp, Homo sapiens
tagtactggattattcaggcttt

SEQ ID NO: 2883612 - DNA, 13 bp, Homo sapiens
tataaacactgtt

SEQ ID NO: 2883613 - DNA, 13 bp, Homo sapiens
tataactacatat

SEQ ID NO: 2883614 - DNA, 15 bp, Homo sapiens
tataatctatttaca

SEQ ID NO: 2883615 - DNA, 18 bp, Homo sapiens
tatagaaagcaagatgta

SEQ ID NO: 2883616 - DNA, 19 bp, Homo sapiens
tatagagatatttttgtac

SEQ ID NO: 2883617 - DNA, 21 bp, Homo sapiens
tatagagatatttttgtacgt

SEQ ID NO: 2883618 - DNA, 15 bp, Homo sapiens
tatagattaaatcat

SEQ ID NO: 2883619 - DNA, 12 bp, Homo sapiens
tatatattgtat

SEQ ID NO: 2883620 - DNA, 16 bp, Homo sapiens
tatcaggatttcctct

SEQ ID NO: 2883621 - DNA, 15 bp, Homo sapiens
tattaagggcatttt

SEQ ID NO: 2883622 - DNA, 11 bp, Homo sapiens
tattattaatg

SEQ ID NO: 2883623 - DNA, 12 bp, Homo sapiens
tattgtattaag

SEQ ID NO: 2883624 - DNA, 20 bp, Homo sapiens
tattgtcctcccctatttta

SEQ ID NO: 2883625 - DNA, 16 bp, Homo sapiens
tatttttgtacgttat

SEQ ID NO: 2883626 - DNA, 21 bp, Homo sapiens
tcaacatggctacttgctttg

SEQ ID NO: 2883627 - DNA, 22 bp, Homo sapiens
tcaacatggctacttgctttga

SEQ ID NO: 2883628 - DNA, 18 bp, Homo sapiens
tcaatgtggtgatgaaat

SEQ ID NO: 2883629 - DNA, 18 bp, Homo sapiens
tcactattacttgaactt

SEQ ID NO: 2883630 - DNA, 20 bp, Homo sapiens
tcaggaattgcccattgttt

SEQ ID NO: 2883631 - DNA, 16 bp, Homo sapiens
tcatactcctatgctt

SEQ ID NO: 2883632 - DNA, 14 bp, Homo sapiens
tcatattgtttcct

SEQ ID NO: 2883633 - DNA, 17 bp, Homo sapiens
tcatgtaaattttgtat

SEQ ID NO: 2883634 - DNA, 12 bp, Homo sapiens
tccagtgacttt

SEQ ID NO: 2883635 - DNA, 19 bp, Homo sapiens
tccggcggcgagctctggc

SEQ ID NO: 2883636 - DNA, 15 bp, Homo sapiens
tcctcggtactccca

SEQ ID NO: 2883637 - DNA, 13 bp, Homo sapiens
tctataaacactg

SEQ ID NO: 2883638 - DNA, 22 bp, Homo sapiens
tctcagcgaggtgtaaagttgt

SEQ ID NO: 2883639 - DNA, 16 bp, Homo sapiens
tctgaaaccaaatgta

SEQ ID NO: 2883640 - DNA, 13 bp, Homo sapiens
tctgatacttttt

SEQ ID NO: 2883641 - DNA, 14 bp, Homo sapiens
tctgtataatctat

SEQ ID NO: 2883642 - DNA, 17 bp, Homo sapiens
tctgtataatctattta

SEQ ID NO: 2883643 - DNA, 14 bp, Homo sapiens
tctgtatgattcta

SEQ ID NO: 2883644 - DNA, 20 bp, Homo sapiens
tcttttctgaatcttctgaa

SEQ ID NO: 2883645 - DNA, 13 bp, Homo sapiens
tgaaaatatatac

SEQ ID NO: 2883646 - DNA, 18 bp, Homo sapiens
tgaaaccaaatgtaacta

SEQ ID NO: 2883647 - DNA, 18 bp, Homo sapiens
tgaaagagaaagactgat

SEQ ID NO: 2883648 - DNA, 20 bp, Homo sapiens
tgaaatcagtaaacactgtg

SEQ ID NO: 2883649 - DNA, 13 bp, Homo sapiens
tgaataatgattt

SEQ ID NO: 2883650 - DNA, 15 bp, Homo sapiens
tgactttcaggaatt

SEQ ID NO: 2883651 - DNA, 14 bp, Homo sapiens
tgactttgaaaata

SEQ ID NO: 2883652 - DNA, 17 bp, Homo sapiens
tgatacttttttgaaat

SEQ ID NO: 2883653 - DNA, 20 bp, Homo sapiens
tgatacttttttgaaatcag

SEQ ID NO: 2883654 - DNA, 15 bp, Homo sapiens
tgatatatctcaaat

SEQ ID NO: 2883655 - DNA, 21 bp, Homo sapiens
tgatatatctcaaattgtaat

SEQ ID NO: 2883656 - DNA, 20 bp, Homo sapiens
tgattacctcctgtgtggaa

SEQ ID NO: 2883657 - DNA, 18 bp, Homo sapiens
tgatttggggattcagat

SEQ ID NO: 2883658 - DNA, 14 bp, Homo sapiens
tgctgctttgatat

SEQ ID NO: 2883659 - DNA, 16 bp, Homo sapiens
tgctgctttgatatat

SEQ ID NO: 2883660 - DNA, 19 bp, Homo sapiens
tgctgggcattttcccaga

SEQ ID NO: 2883661 - DNA, 18 bp, Homo sapiens
tggcttaaaaaaaactct

SEQ ID NO: 2883662 - DNA, 19 bp, Homo sapiens
tggcttaaaaaaaactctt

SEQ ID NO: 2883663 - DNA, 16 bp, Homo sapiens
tggggattcagatttc

SEQ ID NO: 2883664 - DNA, 20 bp, Homo sapiens
tggggattcagatttctctt

SEQ ID NO: 2883665 - DNA, 20 bp, Homo sapiens
tgggtggcttaaaaaaaact

SEQ ID NO: 2883666 - DNA, 14 bp, Homo sapiens
tggtcaccatgaaa

SEQ ID NO: 2883667 - DNA, 20 bp, Homo sapiens
tgtaaattttgtatgaaaaa

SEQ ID NO: 2883668 - DNA, 17 bp, Homo sapiens
tgtaactatgttttatc

SEQ ID NO: 2883669 - DNA, 12 bp, Homo sapiens
tgtaacttcaaa

SEQ ID NO: 2883670 - DNA, 14 bp, Homo sapiens
tgtaatcaacatgg

SEQ ID NO: 2883671 - DNA, 15 bp, Homo sapiens
tgtacgttatatatt

SEQ ID NO: 2883672 - DNA, 20 bp, Homo sapiens
tgtactataacatagaattg

SEQ ID NO: 2883673 - DNA, 17 bp, Homo sapiens
tgtattaagggcatttt

SEQ ID NO: 2883674 - DNA, 22 bp, Homo sapiens
ttaaaaaactttctactcattt

SEQ ID NO: 2883675 - DNA, 19 bp, Homo sapiens
ttaagacgtgaatgtctca

SEQ ID NO: 2883676 - DNA, 15 bp, Homo sapiens
ttaagggcattttaa

SEQ ID NO: 2883677 - DNA, 18 bp, Homo sapiens
ttacttgaactttccaaa

SEQ ID NO: 2883678 - DNA, 22 bp, Homo sapiens
ttaggcgcccatggtacaagga

SEQ ID NO: 2883679 - DNA, 16 bp, Homo sapiens
ttagtgagacatattt

SEQ ID NO: 2883680 - DNA, 13 bp, Homo sapiens
ttatagttaatct

SEQ ID NO: 2883681 - DNA, 13 bp, Homo sapiens
ttatatattgtat

SEQ ID NO: 2883682 - DNA, 18 bp, Homo sapiens
ttatatattgtattaagg

SEQ ID NO: 2883683 - DNA, 12 bp, Homo sapiens
ttatattgtcct

SEQ ID NO: 2883684 - DNA, 13 bp, Homo sapiens
ttattaatgcttt

SEQ ID NO: 2883685 - DNA, 19 bp, Homo sapiens
ttcagatttctctttgaaa

SEQ ID NO: 2883686 - DNA, 22 bp, Homo sapiens
ttctattttctctgatactttt

SEQ ID NO: 2883687 - DNA, 16 bp, Homo sapiens
ttgactttttagatgt

SEQ ID NO: 2883688 - DNA, 19 bp, Homo sapiens
ttgctcaggtgcaagtgcc

SEQ ID NO: 2883689 - DNA, 13 bp, Homo sapiens
ttgtaacttcaaa

SEQ ID NO: 2883690 - DNA, 15 bp, Homo sapiens
ttgtacgttatatat

SEQ ID NO: 2883691 - DNA, 18 bp, Homo sapiens
ttgtacgttatatattgt

SEQ ID NO: 2883692 - DNA, 16 bp, Homo sapiens
ttgtgaataatgattt

SEQ ID NO: 2883693 - DNA, 22 bp, Homo sapiens
ttgtgtgttcactaaactctga

SEQ ID NO: 2883694 - DNA, 22 bp, Homo sapiens
ttgttcgccgcgtggaatgtga

SEQ ID NO: 2883695 - DNA, 16 bp, Homo sapiens
tttaagacgtgaatgt

SEQ ID NO: 2883696 - DNA, 21 bp, Homo sapiens
tttaagacgtgaatgtctcag

SEQ ID NO: 2883697 - DNA, 16 bp, Homo sapiens
tttaataaaataataa

SEQ ID NO: 2883698 - DNA, 16 bp, Homo sapiens
tttaatgattgtttaa

SEQ ID NO: 2883699 - DNA, 16 bp, Homo sapiens
tttaccctatatctat

SEQ ID NO: 2883700 - DNA, 18 bp, Homo sapiens
tttaccctatatctataa

SEQ ID NO: 2883701 - DNA, 19 bp, Homo sapiens
tttagatgtgctgctttga

SEQ ID NO: 2883702 - DNA, 14 bp, Homo sapiens
tttatagttaatct

SEQ ID NO: 2883703 - DNA, 16 bp, Homo sapiens
tttatagttaatctat

SEQ ID NO: 2883704 - DNA, 13 bp, Homo sapiens
tttcaactcattg

SEQ ID NO: 2883705 - DNA, 12 bp, Homo sapiens
tttcctcttgaa

SEQ ID NO: 2883706 - DNA, 17 bp, Homo sapiens
tttctactcattttaat

SEQ ID NO: 2883707 - DNA, 14 bp, Homo sapiens
tttctctttgaaac

SEQ ID NO: 2883708 - DNA, 14 bp, Homo sapiens
tttgaaatcagtaa

SEQ ID NO: 2883709 - DNA, 15 bp, Homo sapiens
tttgaaatcagtaaa

SEQ ID NO: 2883710 - DNA, 14 bp, Homo sapiens
tttgtaacttcaaa

SEQ ID NO: 2883711 - DNA, 18 bp, Homo sapiens
tttgtacgttatatattg

SEQ ID NO: 2883712 - DNA, 19 bp, Homo sapiens
tttgtgtgttcactaaact

SEQ ID NO: 2883713 - DNA, 14 bp, Homo sapiens
tttgttgctgtcaa

SEQ ID NO: 2883714 - DNA, 13 bp, Homo sapiens
ttttaagacgtga

SEQ ID NO: 2883715 - DNA, 22 bp, Homo sapiens
ttttaagacgtgaatgtctcag

SEQ ID NO: 2883716 - DNA, 19 bp, Homo sapiens
ttttattattaatgctttg

SEQ ID NO: 2883717 - DNA, 22 bp, Homo sapiens
ttttctctgatacttttttgaa

SEQ ID NO: 2883718 - DNA, 17 bp, Homo sapiens
ttttctgaatcttctga

SEQ ID NO: 2883719 - DNA, 22 bp, Homo sapiens
ttttgaaatcagtaaacactgt

SEQ ID NO: 2883720 - DNA, 12 bp, Homo sapiens
ttttgcatgaaa

SEQ ID NO: 2883721 - DNA, 11 bp, Homo sapiens
ttttgtaactt

SEQ ID NO: 2883722 - DNA, 17 bp, Homo sapiens
ttttgtaacttcaaata

SEQ ID NO: 2883723 - DNA, 23 bp, Homo sapiens
tttttgaaatcagtaaacactgt

SEQ ID NO: 2883724 - DNA, 21 bp, Homo sapiens
tttttgtacgttatatattgt

SEQ ID NO: 2883725 - DNA, 11 bp, Homo sapiens
ttttttgtaac

SEQ ID NO: 2883726 - DNA, 19 bp, Homo sapiens
acactgtttgttccagaat

SEQ ID NO: 2883727 - DNA, 16 bp, Homo sapiens
acattgatttgatttt

SEQ ID NO: 2883728 - DNA, 23 bp, Homo sapiens
acattgtaagagagatgagcact

SEQ ID NO: 2883729 - DNA, 19 bp, Homo sapiens
aaaaactttctactcattt

SEQ ID NO: 2883730 - DNA, 13 bp, Homo sapiens
aaaactctttaac

SEQ ID NO: 2883731 - DNA, 16 bp, Homo sapiens
aaaatgcatgtaatca

SEQ ID NO: 2883732 - DNA, 13 bp, Homo sapiens
aaactgagaaatg

SEQ ID NO: 2883733 - DNA, 20 bp, Homo sapiens
aaactgagaaatgaatgctg

SEQ ID NO: 2883734 - DNA, 13 bp, Homo sapiens
aaagcaattatat

SEQ ID NO: 2883735 - DNA, 15 bp, Homo sapiens
aaagtgcaatgcgtg

SEQ ID NO: 2883736 - DNA, 18 bp, Homo sapiens
aaatggtatccagaatgg

SEQ ID NO: 2883737 - DNA, 21 bp, Homo sapiens
aacactgtgtattgttgtaaa

SEQ ID NO: 2883738 - DNA, 22 bp, Homo sapiens
aacatagaattgcaatctataa

SEQ ID NO: 2883739 - DNA, 21 bp, Homo sapiens
aaccagtctttcaactcattg

SEQ ID NO: 2883740 - DNA, 18 bp, Homo sapiens
aacctaaagaggaaaagt

SEQ ID NO: 2883741 - DNA, 19 bp, Homo sapiens
aactatcaatatttaagtt

SEQ ID NO: 2883742 - DNA, 12 bp, Homo sapiens
aactctgaataa

SEQ ID NO: 2883743 - DNA, 15 bp, Homo sapiens
aactctgaataagca

SEQ ID NO: 2883744 - DNA, 14 bp, Homo sapiens
aactggtgatatat

SEQ ID NO: 2883745 - DNA, 16 bp, Homo sapiens
aacttcaaatatagag

SEQ ID NO: 2883746 - DNA, 18 bp, Homo sapiens
aagacgtgaatgtctcag

SEQ ID NO: 2883747 - DNA, 16 bp, Homo sapiens
aagatcgaatttttca

SEQ ID NO: 2883748 - DNA, 14 bp, Homo sapiens
aagattttttttgt

SEQ ID NO: 2883749 - DNA, 16 bp, Homo sapiens
aagcaattatattgtc

SEQ ID NO: 2883750 - DNA, 14 bp, Homo sapiens
aagggcattttaaa

SEQ ID NO: 2883751 - DNA, 17 bp, Homo sapiens
aagtgatttttttgtcc

SEQ ID NO: 2883752 - DNA, 17 bp, Homo sapiens
aataagcactttttaaa

SEQ ID NO: 2883753 - DNA, 20 bp, Homo sapiens
aatatagagatatttttgta

SEQ ID NO: 2883754 - DNA, 19 bp, Homo sapiens
aatatagattaaatcatac

SEQ ID NO: 2883755 - DNA, 23 bp, Homo sapiens
aatatttaagtttgttgctgtca

SEQ ID NO: 2883756 - DNA, 14 bp, Homo sapiens
aatcagtaaacact

SEQ ID NO: 2883757 - DNA, 16 bp, Homo sapiens
aatcagtaaacactgt

SEQ ID NO: 2883758 - DNA, 18 bp, Homo sapiens
aatgattgtttaaaggtt

SEQ ID NO: 2883759 - DNA, 23 bp, Homo sapiens
aatgcgtgttgtacatacagagg

SEQ ID NO: 2883760 - DNA, 19 bp, Homo sapiens
aatgtaaaggtcacttttc

SEQ ID NO: 2883761 - DNA, 17 bp, Homo sapiens
aatgtgagtgtgtttgt

SEQ ID NO: 2883762 - DNA, 17 bp, Homo sapiens
aattgtaattaataata

SEQ ID NO: 2883763 - DNA, 17 bp, Homo sapiens
aatttcccctaatcttt

SEQ ID NO: 2883764 - DNA, 14 bp, Homo sapiens
acagaggtaactat

SEQ ID NO: 2883765 - DNA, 18 bp, Homo sapiens
accaagaaaggaacctgt

SEQ ID NO: 2883766 - DNA, 19 bp, Homo sapiens
accagaaccagtctttcaa

SEQ ID NO: 2883767 - DNA, 14 bp, Homo sapiens
accagggcgcaagc

SEQ ID NO: 2883768 - DNA, 15 bp, Homo sapiens
acgtgaatgtctcag

SEQ ID NO: 2883769 - DNA, 21 bp, Homo sapiens
actaaactctgaataagcact

SEQ ID NO: 2883770 - DNA, 16 bp, Homo sapiens
actattacttgaactt

SEQ ID NO: 2883771 - DNA, 16 bp, Homo sapiens
actcccacacccaaga

SEQ ID NO: 2883772 - DNA, 14 bp, Homo sapiens
actcctatgcttta

SEQ ID NO: 2883773 - DNA, 15 bp, Homo sapiens
actctttaacttgta

SEQ ID NO: 2883774 - DNA, 19 bp, Homo sapiens
actctttaacttgtaataa

SEQ ID NO: 2883775 - DNA, 13 bp, Homo sapiens
actggtgatatat

SEQ ID NO: 2883776 - DNA, 15 bp, Homo sapiens
actggtgatatatct

SEQ ID NO: 2883777 - DNA, 17 bp, Homo sapiens
acttcaaatatagagat

SEQ ID NO: 2883778 - DNA, 18 bp, Homo sapiens
actttttaaaaaactttc

SEQ ID NO: 2883779 - DNA, 22 bp, Homo sapiens
agaagtaactggtgatatatct

SEQ ID NO: 2883780 - DNA, 15 bp, Homo sapiens
agaattgcaatctat

SEQ ID NO: 2883781 - DNA, 14 bp, Homo sapiens
agacatatttacaa

SEQ ID NO: 2883782 - DNA, 18 bp, Homo sapiens
agacgtgaatgtctcagc

SEQ ID NO: 2883783 - DNA, 18 bp, Homo sapiens
agactgttaaatgaaacc

SEQ ID NO: 2883784 - DNA, 14 bp, Homo sapiens
agatatttttgtac

SEQ ID NO: 2883785 - DNA, 19 bp, Homo sapiens
agatgagcacttctaagtt

SEQ ID NO: 2883786 - DNA, 19 bp, Homo sapiens
agattttttttgtaacttc

SEQ ID NO: 2883787 - DNA, 23 bp, Homo sapiens
agcctcactattacttgaacttt

SEQ ID NO: 2883788 - DNA, 22 bp, Homo sapiens
agcttatttttacagttataga

SEQ ID NO: 2883789 - DNA, 19 bp, Homo sapiens
aggaaaagtgcaatgcgtg

SEQ ID NO: 2883790 - DNA, 13 bp, Homo sapiens
aggagaaactgag

SEQ ID NO: 2883791 - DNA, 19 bp, Homo sapiens
aggcatatgcttctttaaa

SEQ ID NO: 2883792 - DNA, 19 bp, Homo sapiens
aggcgtcaacgtgcatttt

SEQ ID NO: 2883793 - DNA, 16 bp, Homo sapiens
agggctaggaatatag

SEQ ID NO: 2883794 - DNA, 17 bp, Homo sapiens
aggtaactatcaatatt

SEQ ID NO: 2883795 - DNA, 14 bp, Homo sapiens
aggtgtaaagttgt

SEQ ID NO: 2883796 - DNA, 18 bp, Homo sapiens
agtacaatgtgactttga

SEQ ID NO: 2883797 - DNA, 16 bp, Homo sapiens
agtggttttaataaaa

SEQ ID NO: 2883798 - DNA, 19 bp, Homo sapiens
agttgagtatattataata

SEQ ID NO: 2883799 - DNA, 23 bp, Homo sapiens
agttgagtatattataatagatt

SEQ ID NO: 2883800 - DNA, 17 bp, Homo sapiens
agtttgttgctgtcaag

SEQ ID NO: 2883801 - DNA, 12 bp, Homo sapiens
ataacatagaat

SEQ ID NO: 2883802 - DNA, 18 bp, Homo sapiens
ataatagattgtgaataa

SEQ ID NO: 2883803 - DNA, 14 bp, Homo sapiens
ataatctatttaca

SEQ ID NO: 2883804 - DNA, 15 bp, Homo sapiens
ataatctatttacat

SEQ ID NO: 2883805 - DNA, 16 bp, Homo sapiens
atacagaggtaactat

SEQ ID NO: 2883806 - DNA, 17 bp, Homo sapiens
atactcctatgctttag

SEQ ID NO: 2883807 - DNA, 14 bp, Homo sapiens
atacttttttgaaa

SEQ ID NO: 2883808 - DNA, 15 bp, Homo sapiens
atatgcttctttaaa

SEQ ID NO: 2883809 - DNA, 17 bp, Homo sapiens
atatttgtgtgttcact

SEQ ID NO: 2883810 - DNA, 22 bp, Homo sapiens
atccgagtgtttgccaggctta

SEQ ID NO: 2883811 - DNA, 14 bp, Homo sapiens
atccttgacttttt

SEQ ID NO: 2883812 - DNA, 15 bp, Homo sapiens
atctataaacactgt

SEQ ID NO: 2883813 - DNA, 22 bp, Homo sapiens
atttaagtttgttgctgtcaag

SEQ ID NO: 2883814 - DNA, 15 bp, Homo sapiens
atttcacttgagtgg

SEQ ID NO: 2883815 - DNA, 13 bp, Homo sapiens
atttctctttgaa

SEQ ID NO: 2883816 - DNA, 22 bp, Homo sapiens
atttggggattcagatttctct

SEQ ID NO: 2883817 - DNA, 17 bp, Homo sapiens
attttaagacgtgaatg

SEQ ID NO: 2883818 - DNA, 22 bp, Homo sapiens
atttttgtacgttatatattgt

SEQ ID NO: 2883819 - DNA, 16 bp, Homo sapiens
attttttttgtaactt

SEQ ID NO: 2883820 - DNA, 18 bp, Homo sapiens
caaattgtaattaataat

SEQ ID NO: 2883821 - DNA, 13 bp, Homo sapiens
caacaagtaactt

SEQ ID NO: 2883822 - DNA, 21 bp, Homo sapiens
caacatggctacttgctttga

SEQ ID NO: 2883823 - DNA, 22 bp, Homo sapiens
caagaagaaatgctttccaaaa

SEQ ID NO: 2883824 - DNA, 16 bp, Homo sapiens
caagacaacattgtaa

SEQ ID NO: 2883825 - DNA, 17 bp, Homo sapiens
caagttcaatctgtttt

SEQ ID NO: 2883826 - DNA, 19 bp, Homo sapiens
cacatccttgactttttag

SEQ ID NO: 2883827 - DNA, 13 bp, Homo sapiens
caccccaccaggg

SEQ ID NO: 2883828 - DNA, 12 bp, Homo sapiens
cactaaactctg

SEQ ID NO: 2883829 - DNA, 14 bp, Homo sapiens
cactgtgtattgtt

SEQ ID NO: 2883830 - DNA, 23 bp, Homo sapiens
cacttctaagttgagtatattat

SEQ ID NO: 2883831 - DNA, 13 bp, Homo sapiens
caggggtctgagc

SEQ ID NO: 2883832 - DNA, 14 bp, Homo sapiens
cagtaagtcttttt

SEQ ID NO: 2883833 - DNA, 18 bp, Homo sapiens
catactcctatgctttag

SEQ ID NO: 2883834 - DNA, 20 bp, Homo sapiens
catagaattgcaatctataa

SEQ ID NO: 2883835 - DNA, 11 bp, Homo sapiens
catatgaaaaa

SEQ ID NO: 2883836 - DNA, 22 bp, Homo sapiens
catatgaaaaaaatgcatttta

SEQ ID NO: 2883837 - DNA, 15 bp, Homo sapiens
catctccctcccaca

SEQ ID NO: 2883838 - DNA, 22 bp, Homo sapiens
catttttatcaggatttcctct

SEQ ID NO: 2883839 - DNA, 18 bp, Homo sapiens
cccggagcaggggtctga

SEQ ID NO: 2883840 - DNA, 12 bp, Homo sapiens
ccctattttaag

SEQ ID NO: 2883841 - DNA, 13 bp, Homo sapiens
ccctgcggagacc

SEQ ID NO: 2883842 - DNA, 22 bp, Homo sapiens
ccgctggtgcctcccgggacga

SEQ ID NO: 2883843 - DNA, 19 bp, Homo sapiens
ccggagcaggggtctgagc

SEQ ID NO: 2883844 - DNA, 20 bp, Homo sapiens
cctgcggagaccctgagtcc

SEQ ID NO: 2883845 - DNA, 13 bp, Homo sapiens
ccttgacttttta

SEQ ID NO: 2883846 - DNA, 12 bp, Homo sapiens
cgcatcatatgc

SEQ ID NO: 2883847 - DNA, 15 bp, Homo sapiens
cgcccacaaactgat

SEQ ID NO: 2883848 - DNA, 12 bp, Homo sapiens
cggtactcccat

SEQ ID NO: 2883849 - DNA, 15 bp, Homo sapiens
cgtgaatgtctcagc

SEQ ID NO: 2883850 - DNA, 15 bp, Homo sapiens
cgttatatattgtat

SEQ ID NO: 2883851 - DNA, 19 bp, Homo sapiens
ctaagttgagtatattata

SEQ ID NO: 2883852 - DNA, 21 bp, Homo sapiens
ctaagttgagtatattataat

SEQ ID NO: 2883853 - DNA, 14 bp, Homo sapiens
ctacatattgaata

SEQ ID NO: 2883854 - DNA, 22 bp, Homo sapiens
ctagaagtaactggtgatatat

SEQ ID NO: 2883855 - DNA, 17 bp, Homo sapiens
ctaggaatatagattaa

SEQ ID NO: 2883856 - DNA, 21 bp, Homo sapiens
ctataaacactgtttgttcca

SEQ ID NO: 2883857 - DNA, 19 bp, Homo sapiens
ctataacatagaattgcaa

SEQ ID NO: 2883858 - DNA, 19 bp, Homo sapiens
ctatatctataaacactgt

SEQ ID NO: 2883859 - DNA, 15 bp, Homo sapiens
ctattacttgaactt

SEQ ID NO: 2883860 - DNA, 16 bp, Homo sapiens
ctattacttgaacttt

SEQ ID NO: 2883861 - DNA, 13 bp, Homo sapiens
ctattttctctga

SEQ ID NO: 2883862 - DNA, 16 bp, Homo sapiens
ctattttctctgatac

SEQ ID NO: 2883863 - DNA, 17 bp, Homo sapiens
ctattttctctgatact

SEQ ID NO: 2883864 - DNA, 20 bp, Homo sapiens
ctcattttaatgattgttta

SEQ ID NO: 2883865 - DNA, 14 bp, Homo sapiens
ctcccctattttaa

SEQ ID NO: 2883866 - DNA, 12 bp, Homo sapiens
ctccctcccaca

SEQ ID NO: 2883867 - DNA, 13 bp, Homo sapiens
ctcctatgcttta

SEQ ID NO: 2883868 - DNA, 17 bp, Homo sapiens
ctcgcccacaaactgat

SEQ ID NO: 2883869 - DNA, 18 bp, Homo sapiens
ctctgatacttttttgaa

SEQ ID NO: 2883870 - DNA, 17 bp, Homo sapiens
ctctgatccttcttcct

SEQ ID NO: 2883871 - DNA, 19 bp, Homo sapiens
ctctttaacttgtaataaa

SEQ ID NO: 2883872 - DNA, 15 bp, Homo sapiens
ctgaatcttctgaaa

SEQ ID NO: 2883873 - DNA, 22 bp, Homo sapiens
ctgagaaatgaatgctgagacc

SEQ ID NO: 2883874 - DNA, 12 bp, Homo sapiens
ctgggcattttc

SEQ ID NO: 2883875 - DNA, 18 bp, Homo sapiens
cttagtggggttttatat

SEQ ID NO: 2883876 - DNA, 19 bp, Homo sapiens
cttcaaatatagagatatt

SEQ ID NO: 2883877 - DNA, 21 bp, Homo sapiens
cttctaagttgagtatattat

SEQ ID NO: 2883878 - DNA, 18 bp, Homo sapiens
cttgaacatgttttgtat

SEQ ID NO: 2883879 - DNA, 13 bp, Homo sapiens
cttgaactttcca

SEQ ID NO: 2883880 - DNA, 16 bp, Homo sapiens
cttgaactttccaaaa

SEQ ID NO: 2883881 - DNA, 16 bp, Homo sapiens
ctttgaaaatatatac

SEQ ID NO: 2883882 - DNA, 21 bp, Homo sapiens
ctttggttctgggttgtttcc

SEQ ID NO: 2883883 - DNA, 21 bp, Homo sapiens
ctttttagatgtgctgctttg

SEQ ID NO: 2883884 - DNA, 18 bp, Homo sapiens
gaaacaccgagtctctgt

SEQ ID NO: 2883885 - DNA, 20 bp, Homo sapiens
gaacctaactccccacccca

SEQ ID NO: 2883886 - DNA, 19 bp, Homo sapiens
gaatagggctaggaatata

SEQ ID NO: 2883887 - DNA, 18 bp, Homo sapiens
gaatctgtatgattctat

SEQ ID NO: 2883888 - DNA, 21 bp, Homo sapiens
gaatgctgagacccccggagc

SEQ ID NO: 2883889 - DNA, 14 bp, Homo sapiens
gacaacattgtaag

SEQ ID NO: 2883890 - DNA, 18 bp, Homo sapiens
gacattgatttgattttt

SEQ ID NO: 2883891 - DNA, 15 bp, Homo sapiens
gagaaagactgatta

SEQ ID NO: 2883892 - DNA, 20 bp, Homo sapiens
gagaaatgaatgctgagacc

SEQ ID NO: 2883893 - DNA, 23 bp, Homo sapiens
gaggcagcgtgaaagcagatgag

SEQ ID NO: 2883894 - DNA, 18 bp, Homo sapiens
gaggtttatagttaatct

SEQ ID NO: 2883895 - DNA, 15 bp, Homo sapiens
gagtatattataata

SEQ ID NO: 2883896 - DNA, 18 bp, Homo sapiens
gattgctgataataaatt

SEQ ID NO: 2883897 - DNA, 13 bp, Homo sapiens
gatttctctttga

SEQ ID NO: 2883898 - DNA, 22 bp, Homo sapiens
gatttctctttgaaacatgctt

SEQ ID NO: 2883899 - DNA, 14 bp, Homo sapiens
gcaatctataatat

SEQ ID NO: 2883900 - DNA, 18 bp, Homo sapiens
gcaatgcgtgttgtacat

SEQ ID NO: 2883901 - DNA, 16 bp, Homo sapiens
gcactttttaaaaaac

SEQ ID NO: 2883902 - DNA, 22 bp, Homo sapiens
gcagaaaatcttttactagtgt

SEQ ID NO: 2883903 - DNA, 15 bp, Homo sapiens
gcattttaaaagcaa

SEQ ID NO: 2883904 - DNA, 14 bp, Homo sapiens
gccctgcggagacc

SEQ ID NO: 2883905 - DNA, 13 bp, Homo sapiens
gcgaggtgtaaag

SEQ ID NO: 2883906 - DNA, 18 bp, Homo sapiens
gcggagaccctgagtccg

SEQ ID NO: 2883907 - DNA, 15 bp, Homo sapiens
gctgctttgatatat

SEQ ID NO: 2883908 - DNA, 17 bp, Homo sapiens
gcttaaaaaaaactctt

SEQ ID NO: 2883909 - DNA, 23 bp, Homo sapiens
gcttaaggagaggagaaactgag

SEQ ID NO: 2883910 - DNA, 12 bp, Homo sapiens
gctttgatatat

SEQ ID NO: 2883911 - DNA, 15 bp, Homo sapiens
ggtcaccatgaaact

SEQ ID NO: 2883912 - DNA, 12 bp, Homo sapiens
aaaaaaaaagca

SEQ ID NO: 2883913 - DNA, 12 bp, Homo sapiens
aaaaaaaaagtt

SEQ ID NO: 2883914 - DNA, 12 bp, Homo sapiens
aaaaaaaagaat

SEQ ID NO: 2883915 - DNA, 12 bp, Homo sapiens
aaaaaaaagtta

SEQ ID NO: 2883916 - DNA, 13 bp, Homo sapiens
aaaaaaaatgtga

SEQ ID NO: 2883917 - DNA, 11 bp, Homo sapiens
aaaaaaactgt

SEQ ID NO: 2883918 - DNA, 11 bp, Homo sapiens
aaaaaaagaat

SEQ ID NO: 2883919 - DNA, 11 bp, Homo sapiens
aaaaaaagaca

SEQ ID NO: 2883920 - DNA, 12 bp, Homo sapiens
aaaaaaagtatt

SEQ ID NO: 2883921 - DNA, 13 bp, Homo sapiens
aaaaaaatgttgt

SEQ ID NO: 2883922 - DNA, 12 bp, Homo sapiens
aaaaaagaggaa

SEQ ID NO: 2883923 - DNA, 21 bp, Homo sapiens
aaaaaagaggaaagaatgaaa

SEQ ID NO: 2883924 - DNA, 11 bp, Homo sapiens
aaaaaagcatg

SEQ ID NO: 2883925 - DNA, 11 bp, Homo sapiens
aaaaaaggaaa

SEQ ID NO: 2883926 - DNA, 13 bp, Homo sapiens
aaaaaaggaaaaa

SEQ ID NO: 2883927 - DNA, 13 bp, Homo sapiens
aaaaaagttatat

SEQ ID NO: 2883928 - DNA, 15 bp, Homo sapiens
aaaaaagttatatag

SEQ ID NO: 2883929 - DNA, 18 bp, Homo sapiens
aaaaaagttatataggtt

SEQ ID NO: 2883930 - DNA, 16 bp, Homo sapiens
aaaaaatgtgaaattt

SEQ ID NO: 2883931 - DNA, 11 bp, Homo sapiens
aaaaaattttt

SEQ ID NO: 2883932 - DNA, 16 bp, Homo sapiens
aaaaacaattaactgc

SEQ ID NO: 2883933 - DNA, 23 bp, Homo sapiens
aaaaacaattggttgtatataaa

SEQ ID NO: 2883934 - DNA, 17 bp, Homo sapiens
aaaaacagcgtcttcct

SEQ ID NO: 2883935 - DNA, 13 bp, Homo sapiens
aaaaacatgtatg

SEQ ID NO: 2883936 - DNA, 16 bp, Homo sapiens
aaaaacatgtatgtgc

SEQ ID NO: 2883937 - DNA, 17 bp, Homo sapiens
aaaaaccgttcaaattc

SEQ ID NO: 2883938 - DNA, 15 bp, Homo sapiens
aaaaactagtagttc

SEQ ID NO: 2883939 - DNA, 17 bp, Homo sapiens
aaaaactcgaggactgt

SEQ ID NO: 2883940 - DNA, 10 bp, Homo sapiens
aaaaacttcc

SEQ ID NO: 2883941 - DNA, 12 bp, Homo sapiens
aaaaagaaaaca

SEQ ID NO: 2883942 - DNA, 20 bp, Homo sapiens
aaaaagaaattcgcatgttt

SEQ ID NO: 2883943 - DNA, 22 bp, Homo sapiens
aaaaagaaattcgcatgtttaa

SEQ ID NO: 2883944 - DNA, 20 bp, Homo sapiens
aaaaagaacatgcagtttga

SEQ ID NO: 2883945 - DNA, 15 bp, Homo sapiens
aaaaagaagccacag

SEQ ID NO: 2883946 - DNA, 19 bp, Homo sapiens
aaaaagacgatgtttatgt

SEQ ID NO: 2883947 - DNA, 15 bp, Homo sapiens
aaaaagactcttttt

SEQ ID NO: 2883948 - DNA, 19 bp, Homo sapiens
aaaaagaggaaagaatgaa

SEQ ID NO: 2883949 - DNA, 16 bp, Homo sapiens
aaaaagatgacccatt

SEQ ID NO: 2883950 - DNA, 18 bp, Homo sapiens
aaaaagatgatcgctgta

SEQ ID NO: 2883951 - DNA, 21 bp, Homo sapiens
aaaaagatgatcgctgtattt

SEQ ID NO: 2883952 - DNA, 16 bp, Homo sapiens
aaaaagatttttaaaa

SEQ ID NO: 2883953 - DNA, 15 bp, Homo sapiens
aaaaagcaaatggaa

SEQ ID NO: 2883954 - DNA, 20 bp, Homo sapiens
aaaaagcatgatgggaaaat

SEQ ID NO: 2883955 - DNA, 14 bp, Homo sapiens
aaaaagccattgtt

SEQ ID NO: 2883956 - DNA, 19 bp, Homo sapiens
aaaaagcgctgtttccttg

SEQ ID NO: 2883957 - DNA, 11 bp, Homo sapiens
aaaaaggaaaa

SEQ ID NO: 2883958 - DNA, 16 bp, Homo sapiens
aaaaaggaaaaaaaga

SEQ ID NO: 2883959 - DNA, 14 bp, Homo sapiens
aaaaaggaaaaata

SEQ ID NO: 2883960 - DNA, 13 bp, Homo sapiens
aaaaaggaactgc

SEQ ID NO: 2883961 - DNA, 12 bp, Homo sapiens
aaaaaggaagga

SEQ ID NO: 2883962 - DNA, 13 bp, Homo sapiens
aaaaaggactgga

SEQ ID NO: 2883963 - DNA, 14 bp, Homo sapiens
aaaaaggactggaa

SEQ ID NO: 2883964 - DNA, 21 bp, Homo sapiens
aaaaaggactggaaaaatgaa

SEQ ID NO: 2883965 - DNA, 15 bp, Homo sapiens
aaaaaggatacataa

SEQ ID NO: 2883966 - DNA, 15 bp, Homo sapiens
aaaaagggagaaaga

SEQ ID NO: 2883967 - DNA, 18 bp, Homo sapiens
aaaaaggtttacagaatt

SEQ ID NO: 2883968 - DNA, 18 bp, Homo sapiens
aaaaagtacaattcattg

SEQ ID NO: 2883969 - DNA, 16 bp, Homo sapiens
aaaaagtccaatttta

SEQ ID NO: 2883970 - DNA, 20 bp, Homo sapiens
aaaaagtggcgttgttcata

SEQ ID NO: 2883971 - DNA, 23 bp, Homo sapiens
aaaaagttttgccctttttaagg

SEQ ID NO: 2883972 - DNA, 23 bp, Homo sapiens
aaaaagtttttttaaaaaagcaa

SEQ ID NO: 2883973 - DNA, 17 bp, Homo sapiens
aaaaataaataaaagcc

SEQ ID NO: 2883974 - DNA, 17 bp, Homo sapiens
aaaaataatttattttg

SEQ ID NO: 2883975 - DNA, 19 bp, Homo sapiens
aaaaataatttattttgct

SEQ ID NO: 2883976 - DNA, 17 bp, Homo sapiens
aaaaatacaaaaatttg

SEQ ID NO: 2883977 - DNA, 21 bp, Homo sapiens
aaaaatactttttctaatgag

SEQ ID NO: 2883978 - DNA, 15 bp, Homo sapiens
aaaaatagaaacata

SEQ ID NO: 2883979 - DNA, 19 bp, Homo sapiens
aaagctatatgttatggct

SEQ ID NO: 2883980 - DNA, 14 bp, Homo sapiens
aaagctctagaatc

SEQ ID NO: 2883981 - DNA, 13 bp, Homo sapiens
aaagctgagcctg

SEQ ID NO: 2883982 - DNA, 21 bp, Homo sapiens
aaagctgctcagggaaaagca

SEQ ID NO: 2883983 - DNA, 17 bp, Homo sapiens
aaagctgttattcttgt

SEQ ID NO: 2883984 - DNA, 12 bp, Homo sapiens
aaaggaaaaaaa

SEQ ID NO: 2883985 - DNA, 17 bp, Homo sapiens
aaaggaaaagattcctg

SEQ ID NO: 2883986 - DNA, 17 bp, Homo sapiens
aaaggaaagtgctttcc

SEQ ID NO: 2883987 - DNA, 23 bp, Homo sapiens
aaaggaacaaaaattacaaagaa

SEQ ID NO: 2883988 - DNA, 21 bp, Homo sapiens
aaaggacacgccgtctgtcct

SEQ ID NO: 2883989 - DNA, 15 bp, Homo sapiens
aaaggacagagccag

SEQ ID NO: 2883990 - DNA, 15 bp, Homo sapiens
aaaggacgtaaaatt

SEQ ID NO: 2883991 - DNA, 21 bp, Homo sapiens
aaaggacgtaaaatttacagt

SEQ ID NO: 2883992 - DNA, 12 bp, Homo sapiens
aaaggactctgg

SEQ ID NO: 2883993 - DNA, 17 bp, Homo sapiens
aaaggagacaaagcagg

SEQ ID NO: 2883994 - DNA, 20 bp, Homo sapiens
aaaggagagaacgggcgtca

SEQ ID NO: 2883995 - DNA, 22 bp, Homo sapiens
aaaggagagattattaaatcgt

SEQ ID NO: 2883996 - DNA, 24 bp, Homo sapiens
aaaggagagattattaaatcgttt

SEQ ID NO: 2883997 - DNA, 23 bp, Homo sapiens
aaaggagcccttatctgtgctca

SEQ ID NO: 2883998 - DNA, 22 bp, Homo sapiens
aaaggagctcgaaggatattgt

SEQ ID NO: 2883999 - DNA, 13 bp, Homo sapiens
aaaggatcacaga

SEQ ID NO: 2884000 - DNA, 19 bp, Homo sapiens
aaaggatctttgtggccaa

SEQ ID NO: 2884001 - DNA, 21 bp, Homo sapiens
aaaggattaggcaaaaataat

SEQ ID NO: 2884002 - DNA, 23 bp, Homo sapiens
aaaggatttgatgcttttctctc

SEQ ID NO: 2884003 - DNA, 20 bp, Homo sapiens
aaaggcacctataaaacagg

SEQ ID NO: 2884004 - DNA, 17 bp, Homo sapiens
aaaggcagtccagagct

SEQ ID NO: 2884005 - DNA, 16 bp, Homo sapiens
aaaggcattctctgaa

SEQ ID NO: 2884006 - DNA, 14 bp, Homo sapiens
aaaggccaaacctc

SEQ ID NO: 2884007 - DNA, 15 bp, Homo sapiens
aaaggccaaacctct

SEQ ID NO: 2884008 - DNA, 20 bp, Homo sapiens
aaaggccaaacctctgttca

SEQ ID NO: 2884009 - DNA, 23 bp, Homo sapiens
aaaggctgtgctgccctgaagaa

SEQ ID NO: 2884010 - DNA, 13 bp, Homo sapiens
aaagggaaaaaat

SEQ ID NO: 2884011 - DNA, 16 bp, Homo sapiens
aaagggaaaaaataaa

SEQ ID NO: 2884012 - DNA, 15 bp, Homo sapiens
aaagggaaactggct

SEQ ID NO: 2884013 - DNA, 14 bp, Homo sapiens
aaagggaacatgca

SEQ ID NO: 2884014 - DNA, 18 bp, Homo sapiens
aaagggagaaagaaaact

SEQ ID NO: 2884015 - DNA, 15 bp, Homo sapiens
aaagggagaggaaga

SEQ ID NO: 2884016 - DNA, 14 bp, Homo sapiens
aaagggatactttt

SEQ ID NO: 2884017 - DNA, 17 bp, Homo sapiens
aaagggcagccctcctt

SEQ ID NO: 2884018 - DNA, 21 bp, Homo sapiens
aaagggcatgggtcgggagag

SEQ ID NO: 2884019 - DNA, 13 bp, Homo sapiens
aaagggccaggtg

SEQ ID NO: 2884020 - DNA, 14 bp, Homo sapiens
aaagggcctggcca

SEQ ID NO: 2884021 - DNA, 17 bp, Homo sapiens
aaaggggaaagaacata

SEQ ID NO: 2884022 - DNA, 15 bp, Homo sapiens
aaagggtcttccttc

SEQ ID NO: 2884023 - DNA, 14 bp, Homo sapiens
aaagggtgaagcta

SEQ ID NO: 2884024 - DNA, 19 bp, Homo sapiens
aaagggtgaagctatttat

SEQ ID NO: 2884025 - DNA, 14 bp, Homo sapiens
aaaggtaaatacaa

SEQ ID NO: 2884026 - DNA, 13 bp, Homo sapiens
aaaggtctatgca

SEQ ID NO: 2884027 - DNA, 19 bp, Homo sapiens
aaaggtggactggaagggg

SEQ ID NO: 2884028 - DNA, 19 bp, Homo sapiens
aaaggttaatttttccttc

SEQ ID NO: 2884029 - DNA, 21 bp, Homo sapiens
aaaggttctaggtttcaaaga

SEQ ID NO: 2884030 - DNA, 21 bp, Homo sapiens
aaaggtttcaagacttgatac

SEQ ID NO: 2884031 - DNA, 12 bp, Homo sapiens
aaagtaaatctc

SEQ ID NO: 2884032 - DNA, 15 bp, Homo sapiens
aaagtagacaaatgg

SEQ ID NO: 2884033 - DNA, 22 bp, Homo sapiens
aaagtagcagtcatcatctttt

SEQ ID NO: 2884034 - DNA, 21 bp, Homo sapiens
aaagtatcctgcttctgatat

SEQ ID NO: 2884035 - DNA, 23 bp, Homo sapiens
aaagtatgccaggggagtatgta

SEQ ID NO: 2884036 - DNA, 13 bp, Homo sapiens
aaagtatgttgta

SEQ ID NO: 2884037 - DNA, 16 bp, Homo sapiens
aaagtattattttcca

SEQ ID NO: 2884038 - DNA, 19 bp, Homo sapiens
aaagtattctgtactctta

SEQ ID NO: 2884039 - DNA, 16 bp, Homo sapiens
aaagtattggcattca

SEQ ID NO: 2884040 - DNA, 13 bp, Homo sapiens
aaagtattgtaaa

SEQ ID NO: 2884041 - DNA, 13 bp, Homo sapiens
aaagtattttcct

SEQ ID NO: 2884042 - DNA, 18 bp, Homo sapiens
aaagtcaaaaggtgcctg

SEQ ID NO: 2884043 - DNA, 18 bp, Homo sapiens
aaagtcacaatgttcttt

SEQ ID NO: 2884044 - DNA, 17 bp, Homo sapiens
aaagtcacacatttcta

SEQ ID NO: 2884045 - DNA, 16 bp, Homo sapiens
aaagtcaggtccaatt

SEQ ID NO: 2884046 - DNA, 20 bp, Homo sapiens
aaagtccaattttaatttag

SEQ ID NO: 2884047 - DNA, 17 bp, Homo sapiens
aaagtctaaactgagct

SEQ ID NO: 2884048 - DNA, 19 bp, Homo sapiens
aaagtctccagaagaaaat

SEQ ID NO: 2884049 - DNA, 21 bp, Homo sapiens
aaagtctgtcaggtttggttt

SEQ ID NO: 2884050 - DNA, 20 bp, Homo sapiens
aaagtgaaagtccagaaact

SEQ ID NO: 2884051 - DNA, 23 bp, Homo sapiens
aaagtgaagcaaatcagaaactt

SEQ ID NO: 2884052 - DNA, 17 bp, Homo sapiens
aaagtgacagatgttat

SEQ ID NO: 2884053 - DNA, 22 bp, Homo sapiens
aaagtgagaaagaaagtaaaaa

SEQ ID NO: 2884054 - DNA, 18 bp, Homo sapiens
aaagtgagtactgttaag

SEQ ID NO: 2884055 - DNA, 23 bp, Homo sapiens
aaagtgattttatttttgcaaaa

SEQ ID NO: 2884056 - DNA, 21 bp, Homo sapiens
aaagtgccaaagaaagtggtc

SEQ ID NO: 2884057 - DNA, 17 bp, Homo sapiens
aaagtgcctcaagagga

SEQ ID NO: 2884058 - DNA, 21 bp, Homo sapiens
aaagtgcctttatctcagcca

SEQ ID NO: 2884059 - DNA, 23 bp, Homo sapiens
aaagtgcctttatctcagccatc

SEQ ID NO: 2884060 - DNA, 20 bp, Homo sapiens
aaagtgctaaggttctaagg

SEQ ID NO: 2884061 - DNA, 11 bp, Homo sapiens
aaagtgctctt

SEQ ID NO: 2884062 - DNA, 13 bp, Homo sapiens
aaagtgctgagat

SEQ ID NO: 2884063 - DNA, 16 bp, Homo sapiens
aaagtgcttgtgtaat

SEQ ID NO: 2884064 - DNA, 23 bp, Homo sapiens
aaagtgcttgtgtaatttatgtg

SEQ ID NO: 2884065 - DNA, 19 bp, Homo sapiens
aaagtggaaaacaaggaag

SEQ ID NO: 2884066 - DNA, 17 bp, Homo sapiens
aaagtggagaagcacac

SEQ ID NO: 2884067 - DNA, 21 bp, Homo sapiens
aaagtggagttgttttaacag

SEQ ID NO: 2884068 - DNA, 18 bp, Homo sapiens
aaagtggcctctttgtct

SEQ ID NO: 2884069 - DNA, 18 bp, Homo sapiens
aaagtggcgttgttcata

SEQ ID NO: 2884070 - DNA, 20 bp, Homo sapiens
aaagtggggctaaatgaagt

SEQ ID NO: 2884071 - DNA, 22 bp, Homo sapiens
aaagtggtgctcagttgtagaa

SEQ ID NO: 2884072 - DNA, 17 bp, Homo sapiens
aaacaactctttgagaa

SEQ ID NO: 2884073 - DNA, 16 bp, Homo sapiens
aaacaagactgcctcc

SEQ ID NO: 2884074 - DNA, 17 bp, Homo sapiens
aaacaagactgcctccc

SEQ ID NO: 2884075 - DNA, 23 bp, Homo sapiens
aaacaagccaagaaagatgtata

SEQ ID NO: 2884076 - DNA, 17 bp, Homo sapiens
aaacaattggttgtata

SEQ ID NO: 2884077 - DNA, 19 bp, Homo sapiens
aaacaattggttgtatata

SEQ ID NO: 2884078 - DNA, 13 bp, Homo sapiens
aaacacaaatgca

SEQ ID NO: 2884079 - DNA, 19 bp, Homo sapiens
aaacacaaatgcagggatt

SEQ ID NO: 2884080 - DNA, 12 bp, Homo sapiens
aaacacaacaca

SEQ ID NO: 2884081 - DNA, 16 bp, Homo sapiens
aaacacagtgtttttg

SEQ ID NO: 2884082 - DNA, 19 bp, Homo sapiens
aaacacagtgtttttgtaa

SEQ ID NO: 2884083 - DNA, 12 bp, Homo sapiens
aaacaccattca

SEQ ID NO: 2884084 - DNA, 12 bp, Homo sapiens
aaacacccctca

SEQ ID NO: 2884085 - DNA, 15 bp, Homo sapiens
aaacacctctgcttt

SEQ ID NO: 2884086 - DNA, 21 bp, Homo sapiens
aaacacgcacttagtctctaa

SEQ ID NO: 2884087 - DNA, 13 bp, Homo sapiens
aaacactatttgt

SEQ ID NO: 2884088 - DNA, 15 bp, Homo sapiens
aaacactatttgtga

SEQ ID NO: 2884089 - DNA, 21 bp, Homo sapiens
aaacactcaaaatgatgcaac

SEQ ID NO: 2884090 - DNA, 14 bp, Homo sapiens
aaacactgcctgcc

SEQ ID NO: 2884091 - DNA, 14 bp, Homo sapiens
aaacactgcgcttt

SEQ ID NO: 2884092 - DNA, 16 bp, Homo sapiens
aaacacttccagtctg

SEQ ID NO: 2884093 - DNA, 15 bp, Homo sapiens
aaacactttcctgga

SEQ ID NO: 2884094 - DNA, 15 bp, Homo sapiens
aaacagaaattaatc

SEQ ID NO: 2884095 - DNA, 13 bp, Homo sapiens
aaacagaacatca

SEQ ID NO: 2884096 - DNA, 14 bp, Homo sapiens
aaacagacaatatg

SEQ ID NO: 2884097 - DNA, 20 bp, Homo sapiens
aaacagaggtaaaaaaaaga

SEQ ID NO: 2884098 - DNA, 22 bp, Homo sapiens
aaacagatattacagcttattt

SEQ ID NO: 2884099 - DNA, 15 bp, Homo sapiens
aaacagatgtccctg

SEQ ID NO: 2884100 - DNA, 15 bp, Homo sapiens
aaacagcaaaccaag

SEQ ID NO: 2884101 - DNA, 23 bp, Homo sapiens
aaacagcagggtttgagcacaat

SEQ ID NO: 2884102 - DNA, 15 bp, Homo sapiens
aaacagcctcacaga

SEQ ID NO: 2884103 - DNA, 21 bp, Homo sapiens
aaacagcgctgggtccacccc

SEQ ID NO: 2884104 - DNA, 16 bp, Homo sapiens
aaacagcgtcttcctt

SEQ ID NO: 2884105 - DNA, 19 bp, Homo sapiens
aaacagctgccttagcttc

SEQ ID NO: 2884106 - DNA, 17 bp, Homo sapiens
aaacagggtctcactct

SEQ ID NO: 2884107 - DNA, 17 bp, Homo sapiens
aaacaggtcaatacagt

SEQ ID NO: 2884108 - DNA, 19 bp, Homo sapiens
aaacaggtgctggcccagc

SEQ ID NO: 2884109 - DNA, 24 bp, Homo sapiens
aaacaggtgctggcccagcatgga

SEQ ID NO: 2884110 - DNA, 18 bp, Homo sapiens
aaacagtgaatttaagca

SEQ ID NO: 2884111 - DNA, 15 bp, Homo sapiens
aaacagtgtttatga

SEQ ID NO: 2884112 - DNA, 15 bp, Homo sapiens
aaacataaaaagcag

SEQ ID NO: 2884113 - DNA, 20 bp, Homo sapiens
aaacataaaaagcagaattt

SEQ ID NO: 2884114 - DNA, 14 bp, Homo sapiens
aaacataaaatgag

SEQ ID NO: 2884115 - DNA, 15 bp, Homo sapiens
aaacataatagaatt

SEQ ID NO: 2884116 - DNA, 22 bp, Homo sapiens
aaacataatagaatttcctaat

SEQ ID NO: 2884117 - DNA, 22 bp, Homo sapiens
aaacatagaaaaatgatgtctt

SEQ ID NO: 2884118 - DNA, 16 bp, Homo sapiens
aaacatagactgaaga

SEQ ID NO: 2884119 - DNA, 18 bp, Homo sapiens
aaacatagactgaagatt

SEQ ID NO: 2884120 - DNA, 19 bp, Homo sapiens
aaacatcagttactctgaa

SEQ ID NO: 2884121 - DNA, 21 bp, Homo sapiens
aaacatcattggataaatttg

SEQ ID NO: 2884122 - DNA, 13 bp, Homo sapiens
aaacatctagaaa

SEQ ID NO: 2884123 - DNA, 15 bp, Homo sapiens
aaacatctattctct

SEQ ID NO: 2884124 - DNA, 11 bp, Homo sapiens
aaacatctgga

SEQ ID NO: 2884125 - DNA, 13 bp, Homo sapiens
aaacatgaaaaca

SEQ ID NO: 2884126 - DNA, 12 bp, Homo sapiens
aaacatgaagtg

SEQ ID NO: 2884127 - DNA, 15 bp, Homo sapiens
aaacatgggctgtga

SEQ ID NO: 2884128 - DNA, 17 bp, Homo sapiens
aaacatgggctgtgatt

SEQ ID NO: 2884129 - DNA, 22 bp, Homo sapiens
aaacatgggctgtgattactgc

SEQ ID NO: 2884130 - DNA, 13 bp, Homo sapiens
aaacatgtgcaac

SEQ ID NO: 2884131 - DNA, 14 bp, Homo sapiens
aaacattccagatg

SEQ ID NO: 2884132 - DNA, 17 bp, Homo sapiens
aaacattctcctttgca

SEQ ID NO: 2884133 - DNA, 17 bp, Homo sapiens
aaacattgcctttgaat

SEQ ID NO: 2884134 - DNA, 18 bp, Homo sapiens
aaacattgcctttgaatg

SEQ ID NO: 2884135 - DNA, 16 bp, Homo sapiens
aaacatttatgacaag

SEQ ID NO: 2884136 - DNA, 22 bp, Homo sapiens
aaacattttttaaggagggaga

SEQ ID NO: 2884137 - DNA, 15 bp, Homo sapiens
aaaccaaaaactgaa

SEQ ID NO: 2884138 - DNA, 14 bp, Homo sapiens
aaaccagcctcagc

SEQ ID NO: 2884139 - DNA, 23 bp, Homo sapiens
aaaccatattttattgtattttg

SEQ ID NO: 2884140 - DNA, 13 bp, Homo sapiens
aaaccatgtagaa

SEQ ID NO: 2884141 - DNA, 23 bp, Homo sapiens
aaaccattttcccatcatccttt

SEQ ID NO: 2884142 - DNA, 11 bp, Homo sapiens
aaacccagaga

SEQ ID NO: 2884143 - DNA, 15 bp, Homo sapiens
aaacccatttactta

SEQ ID NO: 2884144 - DNA, 18 bp, Homo sapiens
aaaccccttctctgtgac

SEQ ID NO: 2884145 - DNA, 16 bp, Homo sapiens
aaacccgacagaggga

SEQ ID NO: 2884146 - DNA, 18 bp, Homo sapiens
aaacccgaggaagatgct

SEQ ID NO: 2884147 - DNA, 23 bp, Homo sapiens
aaacccgagggttgattaaggca

SEQ ID NO: 2884148 - DNA, 13 bp, Homo sapiens
aaaccctcgaggc

SEQ ID NO: 2884149 - DNA, 24 bp, Homo sapiens
aaaccctcgaggcggatctttgga

SEQ ID NO: 2884150 - DNA, 12 bp, Homo sapiens
aaaccctgtctc

SEQ ID NO: 2884151 - DNA, 13 bp, Homo sapiens
aaaccgtccctga

SEQ ID NO: 2884152 - DNA, 20 bp, Homo sapiens
aaacctaagtcctttatgtg

SEQ ID NO: 2884153 - DNA, 11 bp, Homo sapiens
aaacctctgtt

SEQ ID NO: 2884154 - DNA, 14 bp, Homo sapiens
aaacctctgttcag

SEQ ID NO: 2884155 - DNA, 17 bp, Homo sapiens
aaacctctgttcagtgt

SEQ ID NO: 2884156 - DNA, 21 bp, Homo sapiens
aaacctctgttcagtgtaaat

SEQ ID NO: 2884157 - DNA, 22 bp, Homo sapiens
aaacctgactaggttctgtaga

SEQ ID NO: 2884158 - DNA, 14 bp, Homo sapiens
aaacctgcattttt

SEQ ID NO: 2884159 - DNA, 18 bp, Homo sapiens
aaacctgggctctggttt

SEQ ID NO: 2884160 - DNA, 13 bp, Homo sapiens
aaacctgtatctt

SEQ ID NO: 2884161 - DNA, 15 bp, Homo sapiens
aaacctgtgcctccc

SEQ ID NO: 2884162 - DNA, 11 bp, Homo sapiens
aaaccttgggc

SEQ ID NO: 2884163 - DNA, 14 bp, Homo sapiens
aaaccttggtgtag

SEQ ID NO: 2884164 - DNA, 12 bp, Homo sapiens
aaaccttgtttc

SEQ ID NO: 2884165 - DNA, 14 bp, Homo sapiens
aaaccttgtttgtt

SEQ ID NO: 2884166 - DNA, 18 bp, Homo sapiens
aaacgaaaacctgactag

SEQ ID NO: 2884167 - DNA, 16 bp, Homo sapiens
aaacgattagtgatgt

SEQ ID NO: 2884168 - DNA, 16 bp, Homo sapiens
aaacgatttaattctc

SEQ ID NO: 2884169 - DNA, 19 bp, Homo sapiens
aaacgatttaattctcttg

SEQ ID NO: 2884170 - DNA, 18 bp, Homo sapiens
aaacgcgcagatgtgcag

SEQ ID NO: 2884171 - DNA, 23 bp, Homo sapiens
aaacgcgcagatgtgcagcagat

SEQ ID NO: 2884172 - DNA, 24 bp, Homo sapiens
aaacgcgcagatgtgcagcagatt

SEQ ID NO: 2884173 - DNA, 14 bp, Homo sapiens
aaacgctgcctgcc

SEQ ID NO: 2884174 - DNA, 21 bp, Homo sapiens
aaacggtgtatataccttttg

SEQ ID NO: 2884175 - DNA, 19 bp, Homo sapiens
aaacggttcagtttcttct

SEQ ID NO: 2884176 - DNA, 13 bp, Homo sapiens
aaacgtaaatgtt

SEQ ID NO: 2884177 - DNA, 14 bp, Homo sapiens
aaagcaaagtcact

SEQ ID NO: 2884178 - DNA, 18 bp, Homo sapiens
aaagcaaatggaaaatgt

SEQ ID NO: 2884179 - DNA, 18 bp, Homo sapiens
aaagcaatacgtttgtgc

SEQ ID NO: 2884180 - DNA, 14 bp, Homo sapiens
aaagcaatatgcat

SEQ ID NO: 2884181 - DNA, 15 bp, Homo sapiens
aaagcacaaaatgga

SEQ ID NO: 2884182 - DNA, 16 bp, Homo sapiens
aaagcacagtttgaac

SEQ ID NO: 2884183 - DNA, 17 bp, Homo sapiens
aaagcacagtttgaaca

SEQ ID NO: 2884184 - DNA, 12 bp, Homo sapiens
aaagcacctgcc

SEQ ID NO: 2884185 - DNA, 17 bp, Homo sapiens
aaagcacttgaagaata

SEQ ID NO: 2884186 - DNA, 23 bp, Homo sapiens
aaagcagaattttaatgtgaaga

SEQ ID NO: 2884187 - DNA, 22 bp, Homo sapiens
aaagcagcgctagtggagggtt

SEQ ID NO: 2884188 - DNA, 19 bp, Homo sapiens
aaagcagctcaaaggcaca

SEQ ID NO: 2884189 - DNA, 17 bp, Homo sapiens
aaagcagtaactgacaa

SEQ ID NO: 2884190 - DNA, 17 bp, Homo sapiens
aaagcagttaaactgat

SEQ ID NO: 2884191 - DNA, 21 bp, Homo sapiens
aaagcatatgggttagatgtt

SEQ ID NO: 2884192 - DNA, 19 bp, Homo sapiens
aaagcatgatgggaaaata

SEQ ID NO: 2884193 - DNA, 20 bp, Homo sapiens
aaagcatgatgggaaaatat

SEQ ID NO: 2884194 - DNA, 16 bp, Homo sapiens
aaagcattattttttg

SEQ ID NO: 2884195 - DNA, 15 bp, Homo sapiens
aaagcatttgtacta

SEQ ID NO: 2884196 - DNA, 15 bp, Homo sapiens
aaagccaagaggctg

SEQ ID NO: 2884197 - DNA, 15 bp, Homo sapiens
aaagccaatgtgaac

SEQ ID NO: 2884198 - DNA, 21 bp, Homo sapiens
aaagccactggaaggagcaca

SEQ ID NO: 2884199 - DNA, 21 bp, Homo sapiens
aaagccagagtggccacggcc

SEQ ID NO: 2884200 - DNA, 21 bp, Homo sapiens
aaagccagcgtcctcctctgt

SEQ ID NO: 2884201 - DNA, 20 bp, Homo sapiens
aaagccagtcatcatctctt

SEQ ID NO: 2884202 - DNA, 22 bp, Homo sapiens
aaagccagtcatcatctcttga

SEQ ID NO: 2884203 - DNA, 15 bp, Homo sapiens
aaagccatatggaca

SEQ ID NO: 2884204 - DNA, 19 bp, Homo sapiens
aaagccatatggacactgt

SEQ ID NO: 2884205 - DNA, 13 bp, Homo sapiens
aaagccatgctgg

SEQ ID NO: 2884206 - DNA, 13 bp, Homo sapiens
aaagcccacctga

SEQ ID NO: 2884207 - DNA, 18 bp, Homo sapiens
aaagcccacctgggctgg

SEQ ID NO: 2884208 - DNA, 14 bp, Homo sapiens
aaagccctgagatc

SEQ ID NO: 2884209 - DNA, 20 bp, Homo sapiens
aaagcctgtcccaggactca

SEQ ID NO: 2884210 - DNA, 23 bp, Homo sapiens
aaagccttacagttatcctgcaa

SEQ ID NO: 2884211 - DNA, 22 bp, Homo sapiens
aaagccttcttatatctgaaga

SEQ ID NO: 2884212 - DNA, 17 bp, Homo sapiens
aaagcgtctttaagaga

SEQ ID NO: 2884213 - DNA, 18 bp, Homo sapiens
aaagcgtctttaagagac

SEQ ID NO: 2884214 - DNA, 15 bp, Homo sapiens
acaattggttgtata

SEQ ID NO: 2884215 - DNA, 19 bp, Homo sapiens
acaattggttgtatataaa

SEQ ID NO: 2884216 - DNA, 21 bp, Homo sapiens
acaattggttgtatataaagt

SEQ ID NO: 2884217 - DNA, 13 bp, Homo sapiens
acaatttaaaaca

SEQ ID NO: 2884218 - DNA, 22 bp, Homo sapiens
acaatttaaaacaatccttact

SEQ ID NO: 2884219 - DNA, 14 bp, Homo sapiens
acaatttaaattgt

SEQ ID NO: 2884220 - DNA, 14 bp, Homo sapiens
acaatttctttaaa

SEQ ID NO: 2884221 - DNA, 17 bp, Homo sapiens
acaatttctttaaaaaa

SEQ ID NO: 2884222 - DNA, 18 bp, Homo sapiens
acaatttctttaaaaaag

SEQ ID NO: 2884223 - DNA, 23 bp, Homo sapiens
acaatttgggcttcctgtttgta

SEQ ID NO: 2884224 - DNA, 15 bp, Homo sapiens
acaattttgtacaaa

SEQ ID NO: 2884225 - DNA, 18 bp, Homo sapiens
acaatttttttaattttg

SEQ ID NO: 2884226 - DNA, 22 bp, Homo sapiens
acacaaaaaggagcgggcaggg

SEQ ID NO: 2884227 - DNA, 19 bp, Homo sapiens
acacaaactgtaaataaaa

SEQ ID NO: 2884228 - DNA, 11 bp, Homo sapiens
acacaacacaa

SEQ ID NO: 2884229 - DNA, 13 bp, Homo sapiens
acacaacagccaa

SEQ ID NO: 2884230 - DNA, 16 bp, Homo sapiens
acacaacatgtatgtg

SEQ ID NO: 2884231 - DNA, 13 bp, Homo sapiens
acacaagaaaaag

SEQ ID NO: 2884232 - DNA, 14 bp, Homo sapiens
acacaagaaaaaga

SEQ ID NO: 2884233 - DNA, 18 bp, Homo sapiens
acacaagaaaaagataag

SEQ ID NO: 2884234 - DNA, 14 bp, Homo sapiens
acacaagagctgga

SEQ ID NO: 2884235 - DNA, 23 bp, Homo sapiens
acacaaggatagatgctggccca

SEQ ID NO: 2884236 - DNA, 21 bp, Homo sapiens
acacaaggtcatggccacact

SEQ ID NO: 2884237 - DNA, 23 bp, Homo sapiens
acacaagtaagagactcagcctg

SEQ ID NO: 2884238 - DNA, 12 bp, Homo sapiens
acacaataccta

SEQ ID NO: 2884239 - DNA, 16 bp, Homo sapiens
acacaatggtttttaa

SEQ ID NO: 2884240 - DNA, 21 bp, Homo sapiens
acacaatgttgcactgaaaac

SEQ ID NO: 2884241 - DNA, 21 bp, Homo sapiens
acacaatttaattcctctttt

SEQ ID NO: 2884242 - DNA, 11 bp, Homo sapiens
acacacacaca

SEQ ID NO: 2884243 - DNA, 12 bp, Homo sapiens
acacacacacac

SEQ ID NO: 2884244 - DNA, 23 bp, Homo sapiens
aatgtgaatcagaccctacccca

SEQ ID NO: 2884245 - DNA, 15 bp, Homo sapiens
aatgtgaatttttat

SEQ ID NO: 2884246 - DNA, 13 bp, Homo sapiens
aatgtgatcatct

SEQ ID NO: 2884247 - DNA, 15 bp, Homo sapiens
aatgtgatcatcttt

SEQ ID NO: 2884248 - DNA, 19 bp, Homo sapiens
aatgtgatcatctttgctg

SEQ ID NO: 2884249 - DNA, 12 bp, Homo sapiens
aatgtgatgaat

SEQ ID NO: 2884250 - DNA, 20 bp, Homo sapiens
aatgtgatgaatactgtatt

SEQ ID NO: 2884251 - DNA, 13 bp, Homo sapiens
aatgtgatgttct

SEQ ID NO: 2884252 - DNA, 19 bp, Homo sapiens
aatgtgctactgattgttt

SEQ ID NO: 2884253 - DNA, 18 bp, Homo sapiens
aattctcctgcctttgcc

SEQ ID NO: 2884254 - DNA, 16 bp, Homo sapiens
aattctgaatttgcaa

SEQ ID NO: 2884255 - DNA, 21 bp, Homo sapiens
aattctgatgctaggttgttt

SEQ ID NO: 2884256 - DNA, 12 bp, Homo sapiens
aattctggaaac

SEQ ID NO: 2884257 - DNA, 12 bp, Homo sapiens
aattctgtttct

SEQ ID NO: 2884258 - DNA, 18 bp, Homo sapiens
aattcttaaaaaattgaa

SEQ ID NO: 2884259 - DNA, 13 bp, Homo sapiens
aattcttactctg

SEQ ID NO: 2884260 - DNA, 15 bp, Homo sapiens
aattcttactctgga

SEQ ID NO: 2884261 - DNA, 13 bp, Homo sapiens
aattcttattttg

SEQ ID NO: 2884262 - DNA, 15 bp, Homo sapiens
aattcttggaatact

SEQ ID NO: 2884263 - DNA, 20 bp, Homo sapiens
aattcttggttgaggaaaca

SEQ ID NO: 2884264 - DNA, 17 bp, Homo sapiens
aattctttaaaattaca

SEQ ID NO: 2884265 - DNA, 17 bp, Homo sapiens
aattctttacaataaac

SEQ ID NO: 2884266 - DNA, 14 bp, Homo sapiens
aattctttatacaa

SEQ ID NO: 2884267 - DNA, 20 bp, Homo sapiens
aattctttatacaacagtgc

SEQ ID NO: 2884268 - DNA, 21 bp, Homo sapiens
aattctttatacaacagtgct

SEQ ID NO: 2884269 - DNA, 14 bp, Homo sapiens
aattctttttcaaa

SEQ ID NO: 2884270 - DNA, 22 bp, Homo sapiens
aattgaaaggcattctctgaag

SEQ ID NO: 2884271 - DNA, 17 bp, Homo sapiens
aattgaaattttattta

SEQ ID NO: 2884272 - DNA, 16 bp, Homo sapiens
aattgaagataggaga

SEQ ID NO: 2884273 - DNA, 14 bp, Homo sapiens
aattgaataatggt

SEQ ID NO: 2884274 - DNA, 17 bp, Homo sapiens
aattgacaacccaaact

SEQ ID NO: 2884275 - DNA, 23 bp, Homo sapiens
aattgacagatgaaaggagacaa

SEQ ID NO: 2884276 - DNA, 16 bp, Homo sapiens
aattgacatgaccctc

SEQ ID NO: 2884277 - DNA, 12 bp, Homo sapiens
aattgacattct

SEQ ID NO: 2884278 - DNA, 14 bp, Homo sapiens
aattgacttagata

SEQ ID NO: 2884279 - DNA, 17 bp, Homo sapiens
aattgacttagatatta

SEQ ID NO: 2884280 - DNA, 12 bp, Homo sapiens
aattgagcacaa

SEQ ID NO: 2884281 - DNA, 13 bp, Homo sapiens
aattgatcattca

SEQ ID NO: 2884282 - DNA, 14 bp, Homo sapiens
aattgatcattcat

SEQ ID NO: 2884283 - DNA, 19 bp, Homo sapiens
aattgattgtcagccacct

SEQ ID NO: 2884284 - DNA, 13 bp, Homo sapiens
aattgatttccaa

SEQ ID NO: 2884285 - DNA, 22 bp, Homo sapiens
aattgatttgcattgaacacaa

SEQ ID NO: 2884286 - DNA, 20 bp, Homo sapiens
aattgcaaaaacatagaaat

SEQ ID NO: 2884287 - DNA, 15 bp, Homo sapiens
aattgcaaaatgcgt

SEQ ID NO: 2884288 - DNA, 23 bp, Homo sapiens
aattgcaaaatgcgtatttgcat

SEQ ID NO: 2884289 - DNA, 14 bp, Homo sapiens
aattgcaaatcttg

SEQ ID NO: 2884290 - DNA, 21 bp, Homo sapiens
aattgcacaatattgaacttt

SEQ ID NO: 2884291 - DNA, 17 bp, Homo sapiens
aattgcactgaagtttt

SEQ ID NO: 2884292 - DNA, 23 bp, Homo sapiens
aattgcactgaagtttttgaaat

SEQ ID NO: 2884293 - DNA, 14 bp, Homo sapiens
aattgcagaactaa

SEQ ID NO: 2884294 - DNA, 21 bp, Homo sapiens
aattgcattcattgacttcag

SEQ ID NO: 2884295 - DNA, 11 bp, Homo sapiens
aattgcattga

SEQ ID NO: 2884296 - DNA, 21 bp, Homo sapiens
aattgcatttctatgccattt

SEQ ID NO: 2884297 - DNA, 22 bp, Homo sapiens
aattgcctatcctgctgttcta

SEQ ID NO: 2884298 - DNA, 22 bp, Homo sapiens
aattgcctgaaacccatttact

SEQ ID NO: 2884299 - DNA, 14 bp, Homo sapiens
aattgcctttttct

SEQ ID NO: 2884300 - DNA, 14 bp, Homo sapiens
aattgcgttggtct

SEQ ID NO: 2884301 - DNA, 22 bp, Homo sapiens
aattgcgttggtctctgcattt

SEQ ID NO: 2884302 - DNA, 21 bp, Homo sapiens
aattgctaacgttttttcttc

SEQ ID NO: 2884303 - DNA, 23 bp, Homo sapiens
aattgctgataccatatgaatga

SEQ ID NO: 2884304 - DNA, 18 bp, Homo sapiens
aattggaccatcctattt

SEQ ID NO: 2884305 - DNA, 20 bp, Homo sapiens
aattggcctgaacagatgta

SEQ ID NO: 2884306 - DNA, 22 bp, Homo sapiens
aattggccttcgattttaaata

SEQ ID NO: 2884307 - DNA, 22 bp, Homo sapiens
aattgggtggggggcttcatac

SEQ ID NO: 2884308 - DNA, 14 bp, Homo sapiens
aattggtcattcct

SEQ ID NO: 2884309 - DNA, 13 bp, Homo sapiens
aattgtagctttt

SEQ ID NO: 2884310 - DNA, 14 bp, Homo sapiens
aattgtataacagg

SEQ ID NO: 2884311 - DNA, 19 bp, Homo sapiens
aattgtataacaggttatt

SEQ ID NO: 2884312 - DNA, 23 bp, Homo sapiens
aattgtatttatgtatgtaaata

SEQ ID NO: 2884313 - DNA, 15 bp, Homo sapiens
aattgtcacatctat

SEQ ID NO: 2884314 - DNA, 13 bp, Homo sapiens
aattgtccccagt

SEQ ID NO: 2884315 - DNA, 21 bp, Homo sapiens
aattgtgaacagccaaaagct

SEQ ID NO: 2884316 - DNA, 21 bp, Homo sapiens
aattgtgaccaatacatttgt

SEQ ID NO: 2884317 - DNA, 19 bp, Homo sapiens
aattgtgatatttgacaga

SEQ ID NO: 2884318 - DNA, 16 bp, Homo sapiens
aattgtggtgtcttac

SEQ ID NO: 2884319 - DNA, 23 bp, Homo sapiens
aattgtgtaaaaaatggaaaaaa

SEQ ID NO: 2884320 - DNA, 20 bp, Homo sapiens
aattgttgaacaggtgtttt

SEQ ID NO: 2884321 - DNA, 21 bp, Homo sapiens
aattgttgaacaggtgttttt

SEQ ID NO: 2884322 - DNA, 16 bp, Homo sapiens
aattgttttattttta

SEQ ID NO: 2884323 - DNA, 16 bp, Homo sapiens
aatttaaaattaagta

SEQ ID NO: 2884324 - DNA, 19 bp, Homo sapiens
aatttaaacccattttagt

SEQ ID NO: 2884325 - DNA, 22 bp, Homo sapiens
aatttaaagttgtttgtgcctt

SEQ ID NO: 2884326 - DNA, 11 bp, Homo sapiens
aatttaaatgt

SEQ ID NO: 2884327 - DNA, 23 bp, Homo sapiens
aatttaagagcagtccatttcta

SEQ ID NO: 2884328 - DNA, 20 bp, Homo sapiens
aatttaagcatgagtggcct

SEQ ID NO: 2884329 - DNA, 13 bp, Homo sapiens
aatttaatgtttc

SEQ ID NO: 2884330 - DNA, 23 bp, Homo sapiens
aatttaattcatgtttcttaaat

SEQ ID NO: 2884331 - DNA, 16 bp, Homo sapiens
aatttacaaaaatata

SEQ ID NO: 2884332 - DNA, 21 bp, Homo sapiens
aatttacaaaaatataaaata

SEQ ID NO: 2884333 - DNA, 14 bp, Homo sapiens
aatttacatttaat

SEQ ID NO: 2884334 - DNA, 12 bp, Homo sapiens
aatttactctgt

SEQ ID NO: 2884335 - DNA, 21 bp, Homo sapiens
aatttactgtcttaaatcagt

SEQ ID NO: 2884336 - DNA, 21 bp, Homo sapiens
aatttagaaaaagaacatgca

SEQ ID NO: 2884337 - DNA, 19 bp, Homo sapiens
aatttagaaactaattgac

SEQ ID NO: 2884338 - DNA, 21 bp, Homo sapiens
aatttagaaactaattgactt

SEQ ID NO: 2884339 - DNA, 22 bp, Homo sapiens
aatttagaaactaattgacttt

SEQ ID NO: 2884340 - DNA, 15 bp, Homo sapiens
aatttagattgtaaa

SEQ ID NO: 2884341 - DNA, 15 bp, Homo sapiens
aatttataaaaatta

SEQ ID NO: 2884342 - DNA, 16 bp, Homo sapiens
aatttatattgtaaat

SEQ ID NO: 2884343 - DNA, 19 bp, Homo sapiens
aatttatgcacttataagg

SEQ ID NO: 2884344 - DNA, 12 bp, Homo sapiens
aatttattaaat

SEQ ID NO: 2884345 - DNA, 18 bp, Homo sapiens
aatttattaattgctttg

SEQ ID NO: 2884346 - DNA, 19 bp, Homo sapiens
aatttattctacttttaaa

SEQ ID NO: 2884347 - DNA, 22 bp, Homo sapiens
aatttattctacttttaaataa

SEQ ID NO: 2884348 - DNA, 18 bp, Homo sapiens
aatttattgcacattgtt

SEQ ID NO: 2884349 - DNA, 19 bp, Homo sapiens
aatttattgcacattgttc

SEQ ID NO: 2884350 - DNA, 15 bp, Homo sapiens
aatttattttgctct

SEQ ID NO: 2884351 - DNA, 12 bp, Homo sapiens
aatttcaaaatg

SEQ ID NO: 2884352 - DNA, 15 bp, Homo sapiens
aatttcaaacatttg

SEQ ID NO: 2884353 - DNA, 17 bp, Homo sapiens
aatttcaaatctgtaat

SEQ ID NO: 2884354 - DNA, 16 bp, Homo sapiens
aatttcaaggttctaa

SEQ ID NO: 2884355 - DNA, 17 bp, Homo sapiens
aatttcaaggttctaac

SEQ ID NO: 2884356 - DNA, 16 bp, Homo sapiens
aatttcactgtctttt

SEQ ID NO: 2884357 - DNA, 13 bp, Homo sapiens
aatttcagactcc

SEQ ID NO: 2884358 - DNA, 23 bp, Homo sapiens
aatttcagactcccattcctgaa

SEQ ID NO: 2884359 - DNA, 19 bp, Homo sapiens
aatttcaggaatcagaaat

SEQ ID NO: 2884360 - DNA, 13 bp, Homo sapiens
aatttccatatcc

SEQ ID NO: 2884361 - DNA, 15 bp, Homo sapiens
aatttcccaggaccc

SEQ ID NO: 2884362 - DNA, 14 bp, Homo sapiens
aatttccccaacag

SEQ ID NO: 2884363 - DNA, 15 bp, Homo sapiens
aatttccccaacagt

SEQ ID NO: 2884364 - DNA, 20 bp, Homo sapiens
aatttccccaacagtgtgaa

SEQ ID NO: 2884365 - DNA, 21 bp, Homo sapiens
aatttcctgttggatttgttt

SEQ ID NO: 2884366 - DNA, 15 bp, Homo sapiens
aatttctactttgaa

SEQ ID NO: 2884367 - DNA, 16 bp, Homo sapiens
aatttctactttgaag

SEQ ID NO: 2884368 - DNA, 14 bp, Homo sapiens
aatttctttaaaaa

SEQ ID NO: 2884369 - DNA, 15 bp, Homo sapiens
aatttctttgcctgt

SEQ ID NO: 2884370 - DNA, 18 bp, Homo sapiens
acaaagggttttaatgta

SEQ ID NO: 2884371 - DNA, 16 bp, Homo sapiens
acaaagtcacagtcgt

SEQ ID NO: 2884372 - DNA, 23 bp, Homo sapiens
acaaagtgccaaagaaagtggtc

SEQ ID NO: 2884373 - DNA, 20 bp, Homo sapiens
acaaagtgtgtctcaaaaat

SEQ ID NO: 2884374 - DNA, 14 bp, Homo sapiens
acaaagtgttgaaa

SEQ ID NO: 2884375 - DNA, 16 bp, Homo sapiens
acaaagtgttgaaaat

SEQ ID NO: 2884376 - DNA, 19 bp, Homo sapiens
acaaagtgttgaaaatgta

SEQ ID NO: 2884377 - DNA, 13 bp, Homo sapiens
acaaataaataaa

SEQ ID NO: 2884378 - DNA, 15 bp, Homo sapiens
acaaataatttaagt

SEQ ID NO: 2884379 - DNA, 17 bp, Homo sapiens
acaaataatttgaactt

SEQ ID NO: 2884380 - DNA, 16 bp, Homo sapiens
acaaatcaaacacaac

SEQ ID NO: 2884381 - DNA, 20 bp, Homo sapiens
acaaatctatttaattagga

SEQ ID NO: 2884382 - DNA, 19 bp, Homo sapiens
acaaatctgtataaatgtc

SEQ ID NO: 2884383 - DNA, 22 bp, Homo sapiens
acaaatctgtataaatgtctat

SEQ ID NO: 2884384 - DNA, 15 bp, Homo sapiens
acaaatgaaaatgaa

SEQ ID NO: 2884385 - DNA, 15 bp, Homo sapiens
acaaatgacactgca

SEQ ID NO: 2884386 - DNA, 17 bp, Homo sapiens
acaaatgtaaacatttt

SEQ ID NO: 2884387 - DNA, 15 bp, Homo sapiens
acaaatgtgaagatg

SEQ ID NO: 2884388 - DNA, 16 bp, Homo sapiens
acaaatgtgaagatgc

SEQ ID NO: 2884389 - DNA, 18 bp, Homo sapiens
acaaatgtgaagatgcat

SEQ ID NO: 2884390 - DNA, 18 bp, Homo sapiens
acaaatgtgtcccagtga

SEQ ID NO: 2884391 - DNA, 20 bp, Homo sapiens
acaaattaatatttgtgctt

SEQ ID NO: 2884392 - DNA, 20 bp, Homo sapiens
acaaattgcacagaagtcct

SEQ ID NO: 2884393 - DNA, 14 bp, Homo sapiens
acaacaaacactgt

SEQ ID NO: 2884394 - DNA, 15 bp, Homo sapiens
acaacaaactgaatt

SEQ ID NO: 2884395 - DNA, 13 bp, Homo sapiens
aatgtgctgtgta

SEQ ID NO: 2884396 - DNA, 15 bp, Homo sapiens
aatgtgctgtgtaaa

SEQ ID NO: 2884397 - DNA, 16 bp, Homo sapiens
aatgtgctgtgtaaag

SEQ ID NO: 2884398 - DNA, 19 bp, Homo sapiens
aatgtgctgtgtaaagtta

SEQ ID NO: 2884399 - DNA, 20 bp, Homo sapiens
aatgtgctgtgtaaagttag

SEQ ID NO: 2884400 - DNA, 21 bp, Homo sapiens
aatgtgctgtgtaaagttagt

SEQ ID NO: 2884401 - DNA, 16 bp, Homo sapiens
aatgtggtcctattta

SEQ ID NO: 2884402 - DNA, 16 bp, Homo sapiens
aatgtggtctgccaat

SEQ ID NO: 2884403 - DNA, 23 bp, Homo sapiens
aatgtggtctgccaatctgtaca

SEQ ID NO: 2884404 - DNA, 19 bp, Homo sapiens
aatgtgtcaaatacaaaaa

SEQ ID NO: 2884405 - DNA, 17 bp, Homo sapiens
aatgtgtctgcaacatg

SEQ ID NO: 2884406 - DNA, 18 bp, Homo sapiens
aatgtgtctgcaacatgg

SEQ ID NO: 2884407 - DNA, 23 bp, Homo sapiens
aatgtgtctgcaacatggattcc

SEQ ID NO: 2884408 - DNA, 14 bp, Homo sapiens
aatgtgttggacaa

SEQ ID NO: 2884409 - DNA, 15 bp, Homo sapiens
aatgttaaagtcagt

SEQ ID NO: 2884410 - DNA, 18 bp, Homo sapiens
aatgttaacaggtatttt

SEQ ID NO: 2884411 - DNA, 19 bp, Homo sapiens
aatgttaagacttgacagt

SEQ ID NO: 2884412 - DNA, 22 bp, Homo sapiens
aatgttaataaagcccgcgtct

SEQ ID NO: 2884413 - DNA, 21 bp, Homo sapiens
aatgttacatagtaaatggta

SEQ ID NO: 2884414 - DNA, 17 bp, Homo sapiens
aatgttagcctcaattt

SEQ ID NO: 2884415 - DNA, 13 bp, Homo sapiens
aatgttagttcta

SEQ ID NO: 2884416 - DNA, 17 bp, Homo sapiens
aatgttatcttctcaag

SEQ ID NO: 2884417 - DNA, 23 bp, Homo sapiens
aatgttatcttctcaagttctaa

SEQ ID NO: 2884418 - DNA, 21 bp, Homo sapiens
aatgttattacttgtaaataa

SEQ ID NO: 2884419 - DNA, 23 bp, Homo sapiens
aatgttgctttaacctgaacctt

SEQ ID NO: 2884420 - DNA, 20 bp, Homo sapiens
aatgttggacacctttaggt

SEQ ID NO: 2884421 - DNA, 21 bp, Homo sapiens
aatgttggacacctttaggtt

SEQ ID NO: 2884422 - DNA, 22 bp, Homo sapiens
aatgttgggactgctaaataaa

SEQ ID NO: 2884423 - DNA, 12 bp, Homo sapiens
aatgttgtacag

SEQ ID NO: 2884424 - DNA, 14 bp, Homo sapiens
aatgttgtagtgtc

SEQ ID NO: 2884425 - DNA, 15 bp, Homo sapiens
aatgttgtgtgttgc

SEQ ID NO: 2884426 - DNA, 16 bp, Homo sapiens
aatgttgtgtgttgca

SEQ ID NO: 2884427 - DNA, 17 bp, Homo sapiens
aatgttgtgtgttgcac

SEQ ID NO: 2884428 - DNA, 21 bp, Homo sapiens
aatgttgtttacaatatagat

SEQ ID NO: 2884429 - DNA, 16 bp, Homo sapiens
aatgtttaaacatttt

SEQ ID NO: 2884430 - DNA, 16 bp, Homo sapiens
aatgtttatacagagt

SEQ ID NO: 2884431 - DNA, 15 bp, Homo sapiens
aatgtttcaaatgca

SEQ ID NO: 2884432 - DNA, 12 bp, Homo sapiens
aatgtttccccc

SEQ ID NO: 2884433 - DNA, 15 bp, Homo sapiens
aatgtttcccccact

SEQ ID NO: 2884434 - DNA, 17 bp, Homo sapiens
aatgtttcccccactcc

SEQ ID NO: 2884435 - DNA, 15 bp, Homo sapiens
aatgtttgtgtctgt

SEQ ID NO: 2884436 - DNA, 18 bp, Homo sapiens
aatgtttgtgtctgtggt

SEQ ID NO: 2884437 - DNA, 19 bp, Homo sapiens
aatgtttgttaaaaataaa

SEQ ID NO: 2884438 - DNA, 17 bp, Homo sapiens
aatgttttaaatgtaca

SEQ ID NO: 2884439 - DNA, 17 bp, Homo sapiens
aatgttttctgcagaaa

SEQ ID NO: 2884440 - DNA, 19 bp, Homo sapiens
aatgttttctgcagaaaaa

SEQ ID NO: 2884441 - DNA, 20 bp, Homo sapiens
aatgttttctgcagaaaaaa

SEQ ID NO: 2884442 - DNA, 17 bp, Homo sapiens
aatgttttctttgcaaa

SEQ ID NO: 2884443 - DNA, 15 bp, Homo sapiens
aatgttttttttcag

SEQ ID NO: 2884444 - DNA, 21 bp, Homo sapiens
aattaaaatggatgccttgaa

SEQ ID NO: 2884445 - DNA, 17 bp, Homo sapiens
aattaaaattttatgac

SEQ ID NO: 2884446 - DNA, 18 bp, Homo sapiens
aattaaaattttatgaca

SEQ ID NO: 2884447 - DNA, 17 bp, Homo sapiens
aattaaacgtaaatgtt

SEQ ID NO: 2884448 - DNA, 13 bp, Homo sapiens
aattaaactccta

SEQ ID NO: 2884449 - DNA, 21 bp, Homo sapiens
aattaactcactatggttttt

SEQ ID NO: 2884450 - DNA, 14 bp, Homo sapiens
aattaactctggac

SEQ ID NO: 2884451 - DNA, 17 bp, Homo sapiens
aattaacttacttccaa

SEQ ID NO: 2884452 - DNA, 14 bp, Homo sapiens
aattaagaaggcaa

SEQ ID NO: 2884453 - DNA, 16 bp, Homo sapiens
aattaagaaggcaaaa

SEQ ID NO: 2884454 - DNA, 23 bp, Homo sapiens
aattaagaaggcaaaaatgtaaa

SEQ ID NO: 2884455 - DNA, 20 bp, Homo sapiens
aattaataaacgaagataaa

SEQ ID NO: 2884456 - DNA, 13 bp, Homo sapiens
aattaatagcttt

SEQ ID NO: 2884457 - DNA, 13 bp, Homo sapiens
aattaatattgta

SEQ ID NO: 2884458 - DNA, 22 bp, Homo sapiens
aattaatatttgtgctttgaaa

SEQ ID NO: 2884459 - DNA, 14 bp, Homo sapiens
aattaatgattctg

SEQ ID NO: 2884460 - DNA, 14 bp, Homo sapiens
aattaatggacagt

SEQ ID NO: 2884461 - DNA, 15 bp, Homo sapiens
aattaattgaatcta

SEQ ID NO: 2884462 - DNA, 15 bp, Homo sapiens
aattaattgtgcctg

SEQ ID NO: 2884463 - DNA, 16 bp, Homo sapiens
aattacaactaagtga

SEQ ID NO: 2884464 - DNA, 17 bp, Homo sapiens
aattacactacaagttt

SEQ ID NO: 2884465 - DNA, 13 bp, Homo sapiens
aattacataagtt

SEQ ID NO: 2884466 - DNA, 14 bp, Homo sapiens
aattaccaagagaa

SEQ ID NO: 2884467 - DNA, 18 bp, Homo sapiens
aattacgataaggaagaa

SEQ ID NO: 2884468 - DNA, 15 bp, Homo sapiens
aattacggtgtacag

SEQ ID NO: 2884469 - DNA, 13 bp, Homo sapiens
aattactcaggaa

SEQ ID NO: 2884470 - DNA, 11 bp, Homo sapiens
aattactccaa

SEQ ID NO: 2884471 - DNA, 16 bp, Homo sapiens
aattactgataaaaat

SEQ ID NO: 2884472 - DNA, 19 bp, Homo sapiens
aattagaaacaccattcat

SEQ ID NO: 2884473 - DNA, 14 bp, Homo sapiens
aattagatgcatgt

SEQ ID NO: 2884474 - DNA, 22 bp, Homo sapiens
aattagatgcatgttgaccatg

SEQ ID NO: 2884475 - DNA, 16 bp, Homo sapiens
aattagatgtttatat

SEQ ID NO: 2884476 - DNA, 21 bp, Homo sapiens
aattaggggcaatagtagaat

SEQ ID NO: 2884477 - DNA, 20 bp, Homo sapiens
aattagtaaaaaatcaatta

SEQ ID NO: 2884478 - DNA, 14 bp, Homo sapiens
aattataaacagca

SEQ ID NO: 2884479 - DNA, 17 bp, Homo sapiens
aattataagaatttcta

SEQ ID NO: 2884480 - DNA, 14 bp, Homo sapiens
aattatactacttt

SEQ ID NO: 2884481 - DNA, 17 bp, Homo sapiens
aattatactttgttgtt

SEQ ID NO: 2884482 - DNA, 19 bp, Homo sapiens
aattatagatgggaatgaa

SEQ ID NO: 2884483 - DNA, 17 bp, Homo sapiens
aattataggaagttctt

SEQ ID NO: 2884484 - DNA, 18 bp, Homo sapiens
aattataggaagttcttt

SEQ ID NO: 2884485 - DNA, 21 bp, Homo sapiens
aattatagtttctgaggcttt

SEQ ID NO: 2884486 - DNA, 13 bp, Homo sapiens
aattatattgtta

SEQ ID NO: 2884487 - DNA, 13 bp, Homo sapiens
aattatatttgtg

SEQ ID NO: 2884488 - DNA, 17 bp, Homo sapiens
aattatgatggaagaca

SEQ ID NO: 2884489 - DNA, 19 bp, Homo sapiens
aattatgcaattcagtgtt

SEQ ID NO: 2884490 - DNA, 17 bp, Homo sapiens
aattatgccttttttga

SEQ ID NO: 2884491 - DNA, 17 bp, Homo sapiens
aattattatcttcttaa

SEQ ID NO: 2884492 - DNA, 23 bp, Homo sapiens
aattattatcttcttaacagttt

SEQ ID NO: 2884493 - DNA, 14 bp, Homo sapiens
aattatttaaatgt

SEQ ID NO: 2884494 - DNA, 17 bp, Homo sapiens
aattattttaaaatatt

SEQ ID NO: 2884495 - DNA, 18 bp, Homo sapiens
aattattttaaaatattt

SEQ ID NO: 2884496 - DNA, 21 bp, Homo sapiens
aattattttaaaatatttaaa

SEQ ID NO: 2884497 - DNA, 20 bp, Homo sapiens
aattatttttaatttaaaaa

SEQ ID NO: 2884498 - DNA, 13 bp, Homo sapiens
aattcaaaaacaa

SEQ ID NO: 2884499 - DNA, 22 bp, Homo sapiens
aattcaaaagttccaagagtct

SEQ ID NO: 2884500 - DNA, 20 bp, Homo sapiens
aattcaaactggggcctcca

SEQ ID NO: 2884501 - DNA, 14 bp, Homo sapiens
aattcacaaacttt

SEQ ID NO: 2884502 - DNA, 19 bp, Homo sapiens
aattcacaaacttttatac

SEQ ID NO: 2884503 - DNA, 20 bp, Homo sapiens
aattcagatgttttacgcaa

SEQ ID NO: 2884504 - DNA, 21 bp, Homo sapiens
aattcagtcttttctctgaaa

SEQ ID NO: 2884505 - DNA, 19 bp, Homo sapiens
aattcagtgtatttcagtt

SEQ ID NO: 2884506 - DNA, 14 bp, Homo sapiens
aattcatactctgt

SEQ ID NO: 2884507 - DNA, 13 bp, Homo sapiens
aattcatctttta

SEQ ID NO: 2884508 - DNA, 14 bp, Homo sapiens
aattcatcttttaa

SEQ ID NO: 2884509 - DNA, 18 bp, Homo sapiens
aattcatcttttaatcat

SEQ ID NO: 2884510 - DNA, 14 bp, Homo sapiens
aattcatgaacttc

SEQ ID NO: 2884511 - DNA, 12 bp, Homo sapiens
aattcatttcta

SEQ ID NO: 2884512 - DNA, 13 bp, Homo sapiens
aattcatttctaa

SEQ ID NO: 2884513 - DNA, 12 bp, Homo sapiens
aattccaaagtc

SEQ ID NO: 2884514 - DNA, 13 bp, Homo sapiens
aattccaaagtct

SEQ ID NO: 2884515 - DNA, 14 bp, Homo sapiens
aattccaagtgtat

SEQ ID NO: 2884516 - DNA, 20 bp, Homo sapiens
aattccaattaaatttattt

SEQ ID NO: 2884517 - DNA, 16 bp, Homo sapiens
aattccacacctttta

SEQ ID NO: 2884518 - DNA, 19 bp, Homo sapiens
aatctgtataaatgtctat

SEQ ID NO: 2884519 - DNA, 17 bp, Homo sapiens
aatgcagttgttgtaca

SEQ ID NO: 2884520 - DNA, 18 bp, Homo sapiens
aatgcataagctttttaa

SEQ ID NO: 2884521 - DNA, 14 bp, Homo sapiens
aatgcatattcaac

SEQ ID NO: 2884522 - DNA, 18 bp, Homo sapiens
aatactgacaatgtattt

SEQ ID NO: 2884523 - DNA, 22 bp, Homo sapiens
aatactgacaatgtattttgga

SEQ ID NO: 2884524 - DNA, 20 bp, Homo sapiens
aatactgatggaagcacaca

SEQ ID NO: 2884525 - DNA, 23 bp, Homo sapiens
aatactgccaaaacatttatgac

SEQ ID NO: 2884526 - DNA, 16 bp, Homo sapiens
aatactgccagatgct

SEQ ID NO: 2884527 - DNA, 19 bp, Homo sapiens
aatactgccagatgctgat

SEQ ID NO: 2884528 - DNA, 19 bp, Homo sapiens
aatactgcttaattgctga

SEQ ID NO: 2884529 - DNA, 15 bp, Homo sapiens
aatactgttttatct

SEQ ID NO: 2884530 - DNA, 15 bp, Homo sapiens
aatacttgaacttgt

SEQ ID NO: 2884531 - DNA, 14 bp, Homo sapiens
aatactttatttct

SEQ ID NO: 2884532 - DNA, 20 bp, Homo sapiens
aatacttttccttaccttta

SEQ ID NO: 2884533 - DNA, 15 bp, Homo sapiens
aagaagcccccagct

SEQ ID NO: 2884534 - DNA, 16 bp, Homo sapiens
aagaagccctgttctc

SEQ ID NO: 2884535 - DNA, 21 bp, Homo sapiens
aagaaggggacaatggcagaa

SEQ ID NO: 2884536 - DNA, 18 bp, Homo sapiens
aagaagtcagagaaaaca

SEQ ID NO: 2884537 - DNA, 20 bp, Homo sapiens
aagaagtcagagaaaacact

SEQ ID NO: 2884538 - DNA, 21 bp, Homo sapiens
aagaagtcagagaaaacactt

SEQ ID NO: 2884539 - DNA, 22 bp, Homo sapiens
aagaagtctgatggtgagcagt

SEQ ID NO: 2884540 - DNA, 17 bp, Homo sapiens
aagaagtctggccattt

SEQ ID NO: 2884541 - DNA, 15 bp, Homo sapiens
aagaagtgaacactt

SEQ ID NO: 2884542 - DNA, 16 bp, Homo sapiens
aagaagtgagtgtttc

SEQ ID NO: 2884543 - DNA, 19 bp, Homo sapiens
aagaagtttgggctaacat

SEQ ID NO: 2884544 - DNA, 18 bp, Homo sapiens
aagaataataaaatactt

SEQ ID NO: 2884545 - DNA, 18 bp, Homo sapiens
aagaataatttatagtaa

SEQ ID NO: 2884546 - DNA, 12 bp, Homo sapiens
aagaatacttga

SEQ ID NO: 2884547 - DNA, 17 bp, Homo sapiens
aagaatacttgaacttg

SEQ ID NO: 2884548 - DNA, 15 bp, Homo sapiens
aagaatagcatctgt

SEQ ID NO: 2884549 - DNA, 23 bp, Homo sapiens
aagaatccctagactttaggctt

SEQ ID NO: 2884550 - DNA, 13 bp, Homo sapiens
aagaatccttttg

SEQ ID NO: 2884551 - DNA, 21 bp, Homo sapiens
aagaatccttttgtagaatga

SEQ ID NO: 2884552 - DNA, 16 bp, Homo sapiens
aagaatcggcatgtat

SEQ ID NO: 2884553 - DNA, 13 bp, Homo sapiens
aagaatgaacaca

SEQ ID NO: 2884554 - DNA, 22 bp, Homo sapiens
aagaatgagcctacgctgaaga

SEQ ID NO: 2884555 - DNA, 16 bp, Homo sapiens
aagaatgagtaatgtg

SEQ ID NO: 2884556 - DNA, 23 bp, Homo sapiens
aagaatgcattgatattgtgaac

SEQ ID NO: 2884557 - DNA, 13 bp, Homo sapiens
aagaatggaaaag

SEQ ID NO: 2884558 - DNA, 14 bp, Homo sapiens
aagaatggtgtgtt

SEQ ID NO: 2884559 - DNA, 16 bp, Homo sapiens
aagaatgtacgtccag

SEQ ID NO: 2884560 - DNA, 22 bp, Homo sapiens
aagaattaaacccacaagctgc

SEQ ID NO: 2884561 - DNA, 20 bp, Homo sapiens
aagaattaccaagagaaggg

SEQ ID NO: 2884562 - DNA, 22 bp, Homo sapiens
aagaatttaaattctttttcaa

SEQ ID NO: 2884563 - DNA, 21 bp, Homo sapiens
aagaatttattgaatatttat

SEQ ID NO: 2884564 - DNA, 17 bp, Homo sapiens
aagaattttaaaaatga

SEQ ID NO: 2884565 - DNA, 20 bp, Homo sapiens
aagaattttcagaccccagc

SEQ ID NO: 2884566 - DNA, 20 bp, Homo sapiens
aagacaaacaccttatttgt

SEQ ID NO: 2884567 - DNA, 15 bp, Homo sapiens
aagacaacattaaaa

SEQ ID NO: 2884568 - DNA, 21 bp, Homo sapiens
aagacaacattaaaacaatat

SEQ ID NO: 2884569 - DNA, 21 bp, Homo sapiens
aagacaaggaaaaaataacaa

SEQ ID NO: 2884570 - DNA, 12 bp, Homo sapiens
aagacaagtgct

SEQ ID NO: 2884571 - DNA, 17 bp, Homo sapiens
aagacaccaaatataac

SEQ ID NO: 2884572 - DNA, 14 bp, Homo sapiens
aagacactgcctgg

SEQ ID NO: 2884573 - DNA, 15 bp, Homo sapiens
aagacactgcctggg

SEQ ID NO: 2884574 - DNA, 16 bp, Homo sapiens
aagacactgcctgggc

SEQ ID NO: 2884575 - DNA, 20 bp, Homo sapiens
aagacaggaaagttcagagt

SEQ ID NO: 2884576 - DNA, 21 bp, Homo sapiens
aagacaggaaagttcagagtt

SEQ ID NO: 2884577 - DNA, 16 bp, Homo sapiens
aagacagggtcttgct

SEQ ID NO: 2884578 - DNA, 21 bp, Homo sapiens
aagacagtgtatgtagaagca

SEQ ID NO: 2884579 - DNA, 23 bp, Homo sapiens
aagacatactccttccatcaaat

SEQ ID NO: 2884580 - DNA, 18 bp, Homo sapiens
aagacatagcatccaagt

SEQ ID NO: 2884581 - DNA, 13 bp, Homo sapiens
aagacatatatta

SEQ ID NO: 2884582 - DNA, 14 bp, Homo sapiens
aagacatatattat

SEQ ID NO: 2884583 - DNA, 22 bp, Homo sapiens
aagacatatattatatatagaa

SEQ ID NO: 2884584 - DNA, 14 bp, Homo sapiens
aagacatgttttag

SEQ ID NO: 2884585 - DNA, 21 bp, Homo sapiens
aagacattaagagaacaaaga

SEQ ID NO: 2884586 - DNA, 13 bp, Homo sapiens
aagtccctcagag

SEQ ID NO: 2884587 - DNA, 15 bp, Homo sapiens
aagtcctaaaagttc

SEQ ID NO: 2884588 - DNA, 17 bp, Homo sapiens
aagtcctgactgggctg

SEQ ID NO: 2884589 - DNA, 14 bp, Homo sapiens
aagtcgaggctgca

SEQ ID NO: 2884590 - DNA, 21 bp, Homo sapiens
aagtctctcattctaggcctc

SEQ ID NO: 2884591 - DNA, 13 bp, Homo sapiens
aagtctctgtgta

SEQ ID NO: 2884592 - DNA, 18 bp, Homo sapiens
aagtctggatctgggacc

SEQ ID NO: 2884593 - DNA, 20 bp, Homo sapiens
aagtctggccattttggaaa

SEQ ID NO: 2884594 - DNA, 12 bp, Homo sapiens
aagtctgtccat

SEQ ID NO: 2884595 - DNA, 22 bp, Homo sapiens
aagtcttaaggacaaagtgcca

SEQ ID NO: 2884596 - DNA, 17 bp, Homo sapiens
aagtctttcaagaatga

SEQ ID NO: 2884597 - DNA, 14 bp, Homo sapiens
aagtcttttgttcg

SEQ ID NO: 2884598 - DNA, 14 bp, Homo sapiens
aagtgaaaatctta

SEQ ID NO: 2884599 - DNA, 14 bp, Homo sapiens
aagtgaaagacatt

SEQ ID NO: 2884600 - DNA, 13 bp, Homo sapiens
aagtgaagactgg

SEQ ID NO: 2884601 - DNA, 16 bp, Homo sapiens
aagtgaatttgcctgt

SEQ ID NO: 2884602 - DNA, 14 bp, Homo sapiens
aagtgacagatgtt

SEQ ID NO: 2884603 - DNA, 15 bp, Homo sapiens
aagtgacagatgtta

SEQ ID NO: 2884604 - DNA, 22 bp, Homo sapiens
aagtgacagatgttatttttgt

SEQ ID NO: 2884605 - DNA, 15 bp, Homo sapiens
aagtgacagggaagc

SEQ ID NO: 2884606 - DNA, 14 bp, Homo sapiens
aagtgaccagggaa

SEQ ID NO: 2884607 - DNA, 19 bp, Homo sapiens
aagtgactaatggcatgag

SEQ ID NO: 2884608 - DNA, 14 bp, Homo sapiens
aagtgactctcctg

SEQ ID NO: 2884609 - DNA, 15 bp, Homo sapiens
aagtgagaaagaaag

SEQ ID NO: 2884610 - DNA, 15 bp, Homo sapiens
aagtgagaagatggt

SEQ ID NO: 2884611 - DNA, 14 bp, Homo sapiens
aagtgagaggggag

SEQ ID NO: 2884612 - DNA, 15 bp, Homo sapiens
aagtgagtactgtta

SEQ ID NO: 2884613 - DNA, 17 bp, Homo sapiens
aagtgagtctggtggag

SEQ ID NO: 2884614 - DNA, 13 bp, Homo sapiens
aagtgagtggcat

SEQ ID NO: 2884615 - DNA, 22 bp, Homo sapiens
aagtgatctacatgaggaactg

SEQ ID NO: 2884616 - DNA, 21 bp, Homo sapiens
aagtgattttatttttgcaaa

SEQ ID NO: 2884617 - DNA, 21 bp, Homo sapiens
aagtgcaatatgggcgggcag

SEQ ID NO: 2884618 - DNA, 14 bp, Homo sapiens
aagtgcatgaaaaa

SEQ ID NO: 2884619 - DNA, 18 bp, Homo sapiens
aagtgcatgaaaaaccat

SEQ ID NO: 2884620 - DNA, 16 bp, Homo sapiens
aagtgcatgctctctg

SEQ ID NO: 2884621 - DNA, 13 bp, Homo sapiens
aagtgccaaagaa

SEQ ID NO: 2884622 - DNA, 14 bp, Homo sapiens
aagtgccaaagaaa

SEQ ID NO: 2884623 - DNA, 15 bp, Homo sapiens
aagtgccaaagaaag

SEQ ID NO: 2884624 - DNA, 15 bp, Homo sapiens
aagtgccgcaaattg

SEQ ID NO: 2884625 - DNA, 16 bp, Homo sapiens
aagtgccgcaaattgt

SEQ ID NO: 2884626 - DNA, 19 bp, Homo sapiens
aagtgccgcaaattgtacc

SEQ ID NO: 2884627 - DNA, 19 bp, Homo sapiens
aagtgcctcaagaggaatg

SEQ ID NO: 2884628 - DNA, 19 bp, Homo sapiens
aagtgctaaggttctaagg

SEQ ID NO: 2884629 - DNA, 20 bp, Homo sapiens
aagtgctaaggttctaaggc

SEQ ID NO: 2884630 - DNA, 21 bp, Homo sapiens
aagtgctaaggttctaaggcc

SEQ ID NO: 2884631 - DNA, 22 bp, Homo sapiens
aagtgctggcaaccactaagaa

SEQ ID NO: 2884632 - DNA, 23 bp, Homo sapiens
aagtgctggcaaccactaagaat

SEQ ID NO: 2884633 - DNA, 13 bp, Homo sapiens
aagtgctgggatt

SEQ ID NO: 2884634 - DNA, 23 bp, Homo sapiens
aagtgcttgcagatcatctgggg

SEQ ID NO: 2884635 - DNA, 13 bp, Homo sapiens
aagtgcttgtgta

SEQ ID NO: 2884636 - DNA, 15 bp, Homo sapiens
aagtggacttctgaa

SEQ ID NO: 2884637 - DNA, 12 bp, Homo sapiens
aagtggcgtgtg

SEQ ID NO: 2884638 - DNA, 14 bp, Homo sapiens
aagtggctgctgac

SEQ ID NO: 2884639 - DNA, 20 bp, Homo sapiens
aagtggcttgtctgcagtca

SEQ ID NO: 2884640 - DNA, 16 bp, Homo sapiens
aagtgggaaagcattt

SEQ ID NO: 2884641 - DNA, 21 bp, Homo sapiens
aagtgggccaggacaggcccg

SEQ ID NO: 2884642 - DNA, 11 bp, Homo sapiens
aagtgggctgg

SEQ ID NO: 2884643 - DNA, 12 bp, Homo sapiens
aagtgggcttga

SEQ ID NO: 2884644 - DNA, 19 bp, Homo sapiens
aagtggggctaaatgaagt

SEQ ID NO: 2884645 - DNA, 13 bp, Homo sapiens
aagtggtgctcag

SEQ ID NO: 2884646 - DNA, 11 bp, Homo sapiens
aagtgtaactg

SEQ ID NO: 2884647 - DNA, 16 bp, Homo sapiens
aagtgtaatagattat

SEQ ID NO: 2884648 - DNA, 20 bp, Homo sapiens
aagtgtacaagttgctttgt

SEQ ID NO: 2884649 - DNA, 19 bp, Homo sapiens
aagtgtgcagccatagttt

SEQ ID NO: 2884650 - DNA, 11 bp, Homo sapiens
aagtgtgcata

SEQ ID NO: 2884651 - DNA, 17 bp, Homo sapiens
aagtgtgcatattgtac

SEQ ID NO: 2884652 - DNA, 19 bp, Homo sapiens
aagtgtgcatattgtacac

SEQ ID NO: 2884653 - DNA, 16 bp, Homo sapiens
aagtgtgtccatcctg

SEQ ID NO: 2884654 - DNA, 18 bp, Homo sapiens
aagtgttcaaattaaaaa

SEQ ID NO: 2884655 - DNA, 16 bp, Homo sapiens
aagtgttcctgtctca

SEQ ID NO: 2884656 - DNA, 22 bp, Homo sapiens
aagttaaaggcagtccagagct

SEQ ID NO: 2884657 - DNA, 15 bp, Homo sapiens
aagttaaatgtatca

SEQ ID NO: 2884658 - DNA, 11 bp, Homo sapiens
aagttaataag

SEQ ID NO: 2884659 - DNA, 17 bp, Homo sapiens
aagttaataagttgatg

SEQ ID NO: 2884660 - DNA, 12 bp, Homo sapiens
aagttaatttaa

SEQ ID NO: 2884661 - DNA, 15 bp, Homo sapiens
aagttacatgcataa

SEQ ID NO: 2884662 - DNA, 16 bp, Homo sapiens
aagttacatgcataaa

SEQ ID NO: 2884663 - DNA, 18 bp, Homo sapiens
aagttacatgcataaaag

SEQ ID NO: 2884664 - DNA, 13 bp, Homo sapiens
aagttactttctt

SEQ ID NO: 2884665 - DNA, 16 bp, Homo sapiens
aagttactttcttaat

SEQ ID NO: 2884666 - DNA, 17 bp, Homo sapiens
aagttagaattccttca

SEQ ID NO: 2884667 - DNA, 22 bp, Homo sapiens
aagttagaattccttcagggtg

SEQ ID NO: 2884668 - DNA, 14 bp, Homo sapiens
aagttatatttcag

SEQ ID NO: 2884669 - DNA, 17 bp, Homo sapiens
aagttatatttcagatg

SEQ ID NO: 2884670 - DNA, 23 bp, Homo sapiens
aagttatatttcagatgtaatgt

SEQ ID NO: 2884671 - DNA, 15 bp, Homo sapiens
aagttattgcagttt

SEQ ID NO: 2884672 - DNA, 16 bp, Homo sapiens
aagttatttaaatctg

SEQ ID NO: 2884673 - DNA, 17 bp, Homo sapiens
aagttcagagttttctg

SEQ ID NO: 2884674 - DNA, 19 bp, Homo sapiens
aagttcagagttttctggg

SEQ ID NO: 2884675 - DNA, 17 bp, Homo sapiens
aagttccagttttgttt

SEQ ID NO: 2884676 - DNA, 18 bp, Homo sapiens
aagttcctctcccttccc

SEQ ID NO: 2884677 - DNA, 12 bp, Homo sapiens
aagttcctgctg

SEQ ID NO: 2884678 - DNA, 13 bp, Homo sapiens
aagttcctgctgc

SEQ ID NO: 2884679 - DNA, 18 bp, Homo sapiens
aagttcgaacatgtttca

SEQ ID NO: 2884680 - DNA, 16 bp, Homo sapiens
aagttctaagattcta

SEQ ID NO: 2884681 - DNA, 20 bp, Homo sapiens
aagttctaagattctaatga

SEQ ID NO: 2884682 - DNA, 17 bp, Homo sapiens
aagttctaagattctga

SEQ ID NO: 2884683 - DNA, 17 bp, Homo sapiens
aagttctaataatttct

SEQ ID NO: 2884684 - DNA, 18 bp, Homo sapiens
aagttctaataatttcta

SEQ ID NO: 2884685 - DNA, 18 bp, Homo sapiens
aagttctccttttgaact

SEQ ID NO: 2884686 - DNA, 13 bp, Homo sapiens
aagttctgctttc

SEQ ID NO: 2884687 - DNA, 20 bp, Homo sapiens
aagttcttttttgtacagta

SEQ ID NO: 2884688 - DNA, 15 bp, Homo sapiens
aagttgcagtctttt

SEQ ID NO: 2884689 - DNA, 15 bp, Homo sapiens
aagttgccattttgt

SEQ ID NO: 2884690 - DNA, 15 bp, Homo sapiens
aagttgctttcctct

SEQ ID NO: 2884691 - DNA, 21 bp, Homo sapiens
aagttgctttgttacaataaa

SEQ ID NO: 2884692 - DNA, 19 bp, Homo sapiens
aagttggggcactgggcgt

SEQ ID NO: 2884693 - DNA, 14 bp, Homo sapiens
aagttgtaaaatgt

SEQ ID NO: 2884694 - DNA, 17 bp, Homo sapiens
aagttgtaaacacagtg

SEQ ID NO: 2884695 - DNA, 16 bp, Homo sapiens
aagttgtacatgaaat

SEQ ID NO: 2884696 - DNA, 15 bp, Homo sapiens
aagtttaactttaaa

SEQ ID NO: 2884697 - DNA, 21 bp, Homo sapiens
aagtttcacaggtcaataaac

SEQ ID NO: 2884698 - DNA, 18 bp, Homo sapiens
aagtttccttccagccca

SEQ ID NO: 2884699 - DNA, 19 bp, Homo sapiens
aagtttccttccagcccag

SEQ ID NO: 2884700 - DNA, 20 bp, Homo sapiens
aagtttccttccagcccaga

SEQ ID NO: 2884701 - DNA, 12 bp, Homo sapiens
aagtttcctttt

SEQ ID NO: 2884702 - DNA, 14 bp, Homo sapiens
aactttaaaactgt

SEQ ID NO: 2884703 - DNA, 23 bp, Homo sapiens
aactttaacaggttttcttctaa

SEQ ID NO: 2884704 - DNA, 20 bp, Homo sapiens
aactttactaagatgacatt

SEQ ID NO: 2884705 - DNA, 13 bp, Homo sapiens
aactttatgtgta

SEQ ID NO: 2884706 - DNA, 14 bp, Homo sapiens
aactttatgtgtaa

SEQ ID NO: 2884707 - DNA, 23 bp, Homo sapiens
aactttattcttgaaagaagaat

SEQ ID NO: 2884708 - DNA, 18 bp, Homo sapiens
aactttgagtacagatac

SEQ ID NO: 2884709 - DNA, 19 bp, Homo sapiens
aactttgcaggcggccctc

SEQ ID NO: 2884710 - DNA, 16 bp, Homo sapiens
aactttgctggaaaat

SEQ ID NO: 2884711 - DNA, 11 bp, Homo sapiens
aactttggaag

SEQ ID NO: 2884712 - DNA, 22 bp, Homo sapiens
aactttggaagcactttttctg

SEQ ID NO: 2884713 - DNA, 15 bp, Homo sapiens
aactttgtaaatatt

SEQ ID NO: 2884714 - DNA, 15 bp, Homo sapiens
aactttgtcagtgtt

SEQ ID NO: 2884715 - DNA, 12 bp, Homo sapiens
aacttttctcag

SEQ ID NO: 2884716 - DNA, 20 bp, Homo sapiens
aacttttcttttggactttt

SEQ ID NO: 2884717 - DNA, 20 bp, Homo sapiens
aacttttgtttaaagcatta

SEQ ID NO: 2884718 - DNA, 13 bp, Homo sapiens
aacttttttccac

SEQ ID NO: 2884719 - DNA, 14 bp, Homo sapiens
aacttttttcttta

SEQ ID NO: 2884720 - DNA, 19 bp, Homo sapiens
aagaaaaaaaaagaattac

SEQ ID NO: 2884721 - DNA, 14 bp, Homo sapiens
aagaaaaaaaaatg

SEQ ID NO: 2884722 - DNA, 15 bp, Homo sapiens
aagaaaaaaaaatgc

SEQ ID NO: 2884723 - DNA, 13 bp, Homo sapiens
aagaaaaaaacca

SEQ ID NO: 2884724 - DNA, 18 bp, Homo sapiens
aagaaaaaaaccaaagta

SEQ ID NO: 2884725 - DNA, 13 bp, Homo sapiens
aagaaaacatcta

SEQ ID NO: 2884726 - DNA, 13 bp, Homo sapiens
aagaaaacatttt

SEQ ID NO: 2884727 - DNA, 22 bp, Homo sapiens
aagaaaacggaaatgtgtggtc

SEQ ID NO: 2884728 - DNA, 12 bp, Homo sapiens
aagaaaactgcg

SEQ ID NO: 2884729 - DNA, 16 bp, Homo sapiens
aagaaaagcctcagct

SEQ ID NO: 2884730 - DNA, 15 bp, Homo sapiens
aagaaaagtgcatat

SEQ ID NO: 2884731 - DNA, 20 bp, Homo sapiens
aagaaaagtgcatatttatc

SEQ ID NO: 2884732 - DNA, 22 bp, Homo sapiens
aagaaaagtgcatatttatcca

SEQ ID NO: 2884733 - DNA, 12 bp, Homo sapiens
aagaaaatgaat

SEQ ID NO: 2884734 - DNA, 22 bp, Homo sapiens
aagaaaatgaatttgactggtt

SEQ ID NO: 2884735 - DNA, 19 bp, Homo sapiens
aagaaaatggaattactcc

SEQ ID NO: 2884736 - DNA, 12 bp, Homo sapiens
aagaaacaaaaa

SEQ ID NO: 2884737 - DNA, 19 bp, Homo sapiens
aagaaacaactctttgaga

SEQ ID NO: 2884738 - DNA, 16 bp, Homo sapiens
aagaaacactgcctgc

SEQ ID NO: 2884739 - DNA, 13 bp, Homo sapiens
aagaaacatttta

SEQ ID NO: 2884740 - DNA, 20 bp, Homo sapiens
aagaaaccaagtgggctggt

SEQ ID NO: 2884741 - DNA, 15 bp, Homo sapiens
aagaaacctactgcc

SEQ ID NO: 2884742 - DNA, 16 bp, Homo sapiens
aagaaacctactgccc

SEQ ID NO: 2884743 - DNA, 21 bp, Homo sapiens
aagaaacctactgcccaggca

SEQ ID NO: 2884744 - DNA, 13 bp, Homo sapiens
aagaaagagagaa

SEQ ID NO: 2884745 - DNA, 17 bp, Homo sapiens
aagaaagatgtatatag

SEQ ID NO: 2884746 - DNA, 22 bp, Homo sapiens
aagaaagattttatacccttga

SEQ ID NO: 2884747 - DNA, 15 bp, Homo sapiens
aagaaaggaacattt

SEQ ID NO: 2884748 - DNA, 20 bp, Homo sapiens
aagaaagggaaactggctga

SEQ ID NO: 2884749 - DNA, 22 bp, Homo sapiens
aagaaagtgttcaaattaaaaa

SEQ ID NO: 2884750 - DNA, 19 bp, Homo sapiens
aagaaagttaggttataag

SEQ ID NO: 2884751 - DNA, 23 bp, Homo sapiens
aagaaataaaaggaagccaaaga

SEQ ID NO: 2884752 - DNA, 15 bp, Homo sapiens
aagaaataataatat

SEQ ID NO: 2884753 - DNA, 13 bp, Homo sapiens
aagaaatattaac

SEQ ID NO: 2884754 - DNA, 23 bp, Homo sapiens
aagaaatatttggatgttaaatt

SEQ ID NO: 2884755 - DNA, 22 bp, Homo sapiens
aagaaatccaatcctagccctc

SEQ ID NO: 2884756 - DNA, 12 bp, Homo sapiens
aagaaatgatgt

SEQ ID NO: 2884757 - DNA, 15 bp, Homo sapiens
aagaaatgatgttgg

SEQ ID NO: 2884758 - DNA, 17 bp, Homo sapiens
aagaaattataaagata

SEQ ID NO: 2884759 - DNA, 17 bp, Homo sapiens
aagaaattcgcatgttt

SEQ ID NO: 2884760 - DNA, 15 bp, Homo sapiens
aagaacagctcatct

SEQ ID NO: 2884761 - DNA, 22 bp, Homo sapiens
aagaacatgcagtttgaaattc

SEQ ID NO: 2884762 - DNA, 11 bp, Homo sapiens
aagaacatgtg

SEQ ID NO: 2884763 - DNA, 14 bp, Homo sapiens
aagaaccatgcagg

SEQ ID NO: 2884764 - DNA, 21 bp, Homo sapiens
aagaaccatgcaggaaggaaa

SEQ ID NO: 2884765 - DNA, 13 bp, Homo sapiens
aagaacgaacaca

SEQ ID NO: 2884766 - DNA, 14 bp, Homo sapiens
aagaactattgtgt

SEQ ID NO: 2884767 - DNA, 18 bp, Homo sapiens
aagaactattgtgttttt

SEQ ID NO: 2884768 - DNA, 20 bp, Homo sapiens
aagaactcatcactgtggct

SEQ ID NO: 2884769 - DNA, 17 bp, Homo sapiens
aagaactgcacatgaag

SEQ ID NO: 2884770 - DNA, 19 bp, Homo sapiens
aagaactgcacatgaagaa

SEQ ID NO: 2884771 - DNA, 23 bp, Homo sapiens
aagaagaacagctgttcctgtgt

SEQ ID NO: 2884772 - DNA, 14 bp, Homo sapiens
aagaagagccacag

SEQ ID NO: 2884773 - DNA, 20 bp, Homo sapiens
aagaagatagtgagatttaa

SEQ ID NO: 2884774 - DNA, 14 bp, Homo sapiens
aagaagatgaatgg

SEQ ID NO: 2884775 - DNA, 18 bp, Homo sapiens
aagaagatgaatggcgtc

SEQ ID NO: 2884776 - DNA, 22 bp, Homo sapiens
aagaagatgatcagtggacagt

SEQ ID NO: 2884777 - DNA, 21 bp, Homo sapiens
aagaagcaattatttaaagaa

SEQ ID NO: 2884778 - DNA, 22 bp, Homo sapiens
aagaagcaattatttaaagaaa

SEQ ID NO: 2884779 - DNA, 18 bp, Homo sapiens
aactccaaaatctggctt

SEQ ID NO: 2884780 - DNA, 21 bp, Homo sapiens
aactccaacctctcggcccca

SEQ ID NO: 2884781 - DNA, 15 bp, Homo sapiens
aactccaggctgggc

SEQ ID NO: 2884782 - DNA, 16 bp, Homo sapiens
aactccagggtcccct

SEQ ID NO: 2884783 - DNA, 16 bp, Homo sapiens
aactcccctgtttcaa

SEQ ID NO: 2884784 - DNA, 17 bp, Homo sapiens
aactcccctgtttcaat

SEQ ID NO: 2884785 - DNA, 13 bp, Homo sapiens
aactccctcctca

SEQ ID NO: 2884786 - DNA, 16 bp, Homo sapiens
aactcccttctgcttg

SEQ ID NO: 2884787 - DNA, 13 bp, Homo sapiens
aactccgagagca

SEQ ID NO: 2884788 - DNA, 17 bp, Homo sapiens
aactcctactgcttcct

SEQ ID NO: 2884789 - DNA, 11 bp, Homo sapiens
aactcctgacc

SEQ ID NO: 2884790 - DNA, 18 bp, Homo sapiens
aactccttccatccttga

SEQ ID NO: 2884791 - DNA, 19 bp, Homo sapiens
aactccttccatccttgac

SEQ ID NO: 2884792 - DNA, 17 bp, Homo sapiens
aactcgcacctgtgctg

SEQ ID NO: 2884793 - DNA, 13 bp, Homo sapiens
aactcgcctcagc

SEQ ID NO: 2884794 - DNA, 19 bp, Homo sapiens
aactcgtatagcatgcatc

SEQ ID NO: 2884795 - DNA, 22 bp, Homo sapiens
aactctaaagccaagcacttta

SEQ ID NO: 2884796 - DNA, 21 bp, Homo sapiens
aactctatcggagaacatgaa

SEQ ID NO: 2884797 - DNA, 14 bp, Homo sapiens
aactctcccctccc

SEQ ID NO: 2884798 - DNA, 15 bp, Homo sapiens
aactctcccctcccc

SEQ ID NO: 2884799 - DNA, 19 bp, Homo sapiens
aactctcccctccccatct

SEQ ID NO: 2884800 - DNA, 16 bp, Homo sapiens
aactctctcccaggac

SEQ ID NO: 2884801 - DNA, 12 bp, Homo sapiens
aactctctgaac

SEQ ID NO: 2884802 - DNA, 16 bp, Homo sapiens
aactctctgtcttctc

SEQ ID NO: 2884803 - DNA, 19 bp, Homo sapiens
aactctctgtcttctctcc

SEQ ID NO: 2884804 - DNA, 20 bp, Homo sapiens
aactctctgtcttctctcca

SEQ ID NO: 2884805 - DNA, 22 bp, Homo sapiens
aactctctgtcttctctccact

SEQ ID NO: 2884806 - DNA, 14 bp, Homo sapiens
aactctcttcttcc

SEQ ID NO: 2884807 - DNA, 13 bp, Homo sapiens
aactctgcggata

SEQ ID NO: 2884808 - DNA, 22 bp, Homo sapiens
aactctgctgtctaacctgtga

SEQ ID NO: 2884809 - DNA, 21 bp, Homo sapiens
aactctggttcttttaaaatt

SEQ ID NO: 2884810 - DNA, 21 bp, Homo sapiens
aactctgtaaaagtgtctgta

SEQ ID NO: 2884811 - DNA, 23 bp, Homo sapiens
aactctgtcttcacctgattcaa

SEQ ID NO: 2884812 - DNA, 19 bp, Homo sapiens
aactctgttgcaagtgcaa

SEQ ID NO: 2884813 - DNA, 16 bp, Homo sapiens
aactcttaactgaaga

SEQ ID NO: 2884814 - DNA, 18 bp, Homo sapiens
aactcttaactgaagaaa

SEQ ID NO: 2884815 - DNA, 19 bp, Homo sapiens
aactcttcaccttggttta

SEQ ID NO: 2884816 - DNA, 20 bp, Homo sapiens
aactcttcagttaattctta

SEQ ID NO: 2884817 - DNA, 21 bp, Homo sapiens
aactcttgtattgctccattt

SEQ ID NO: 2884818 - DNA, 13 bp, Homo sapiens
aactctttcaaaa

SEQ ID NO: 2884819 - DNA, 14 bp, Homo sapiens
aactctttgagaaa

SEQ ID NO: 2884820 - DNA, 20 bp, Homo sapiens
aactgaaaagagagcagaga

SEQ ID NO: 2884821 - DNA, 14 bp, Homo sapiens
aactgaaattacat

SEQ ID NO: 2884822 - DNA, 14 bp, Homo sapiens
aactgaaccaaatt

SEQ ID NO: 2884823 - DNA, 16 bp, Homo sapiens
aactgaactttgaaga

SEQ ID NO: 2884824 - DNA, 15 bp, Homo sapiens
aactgaagctgctgt

SEQ ID NO: 2884825 - DNA, 15 bp, Homo sapiens
aactgaaggagaagg

SEQ ID NO: 2884826 - DNA, 16 bp, Homo sapiens
aactgaatgtttacat

SEQ ID NO: 2884827 - DNA, 20 bp, Homo sapiens
aactgacactcccacccagt

SEQ ID NO: 2884828 - DNA, 14 bp, Homo sapiens
aactgacttaacaa

SEQ ID NO: 2884829 - DNA, 14 bp, Homo sapiens
aactgaggccttgt

SEQ ID NO: 2884830 - DNA, 22 bp, Homo sapiens
aactgaggccttgtgtgtcagg

SEQ ID NO: 2884831 - DNA, 22 bp, Homo sapiens
aactgatagttactgttgtgac

SEQ ID NO: 2884832 - DNA, 14 bp, Homo sapiens
aactgatctattta

SEQ ID NO: 2884833 - DNA, 19 bp, Homo sapiens
aactgattcacatctcatt

SEQ ID NO: 2884834 - DNA, 19 bp, Homo sapiens
aactgattcttatgattac

SEQ ID NO: 2884835 - DNA, 20 bp, Homo sapiens
aactgattttacaaattaat

SEQ ID NO: 2884836 - DNA, 19 bp, Homo sapiens
aactgcacactatttccct

SEQ ID NO: 2884837 - DNA, 20 bp, Homo sapiens
aactgcagcaatctttgaaa

SEQ ID NO: 2884838 - DNA, 14 bp, Homo sapiens
aactgcagggaaaa

SEQ ID NO: 2884839 - DNA, 20 bp, Homo sapiens
aactgcagtcatcaacaatg

SEQ ID NO: 2884840 - DNA, 21 bp, Homo sapiens
aactgcagtcatcaacaatga

SEQ ID NO: 2884841 - DNA, 22 bp, Homo sapiens
aactgcagtcatcaacaatgat

SEQ ID NO: 2884842 - DNA, 13 bp, Homo sapiens
aactgcatctgga

SEQ ID NO: 2884843 - DNA, 20 bp, Homo sapiens
aactgcattgagaactgcat

SEQ ID NO: 2884844 - DNA, 19 bp, Homo sapiens
aactgccataacataccac

SEQ ID NO: 2884845 - DNA, 21 bp, Homo sapiens
aactgcctccttgccagcccc

SEQ ID NO: 2884846 - DNA, 20 bp, Homo sapiens
aactgcctcgaaacacagaa

SEQ ID NO: 2884847 - DNA, 14 bp, Homo sapiens
aactgctggggctg

SEQ ID NO: 2884848 - DNA, 22 bp, Homo sapiens
aactgcttttgcccatataaaa

SEQ ID NO: 2884849 - DNA, 21 bp, Homo sapiens
aactggatgcatcaagaacta

SEQ ID NO: 2884850 - DNA, 13 bp, Homo sapiens
aaataaaggaacc

SEQ ID NO: 2884851 - DNA, 23 bp, Homo sapiens
aaataaaggatgtgattgtggaa

SEQ ID NO: 2884852 - DNA, 20 bp, Homo sapiens
aaataaagtttgcttagaaa

SEQ ID NO: 2884853 - DNA, 16 bp, Homo sapiens
aaataaatgtttcaaa

SEQ ID NO: 2884854 - DNA, 22 bp, Homo sapiens
aaataaatgtttcccccactcc

SEQ ID NO: 2884855 - DNA, 15 bp, Homo sapiens
aaataaattcctaca

SEQ ID NO: 2884856 - DNA, 22 bp, Homo sapiens
aaataaattcctacaacttaat

SEQ ID NO: 2884857 - DNA, 14 bp, Homo sapiens
aaataaattctctc

SEQ ID NO: 2884858 - DNA, 17 bp, Homo sapiens
aaataaatttatatgaa

SEQ ID NO: 2884859 - DNA, 23 bp, Homo sapiens
aaataacccttcaacgtttcttc

SEQ ID NO: 2884860 - DNA, 16 bp, Homo sapiens
aaataactatcaggca

SEQ ID NO: 2884861 - DNA, 19 bp, Homo sapiens
aaataactgaaccaaattg

SEQ ID NO: 2884862 - DNA, 23 bp, Homo sapiens
aaataactgaaccaaattgcact

SEQ ID NO: 2884863 - DNA, 20 bp, Homo sapiens
aaataactggaacaaattat

SEQ ID NO: 2884864 - DNA, 14 bp, Homo sapiens
aaataagaatagaa

SEQ ID NO: 2884865 - DNA, 12 bp, Homo sapiens
aaataagattct

SEQ ID NO: 2884866 - DNA, 20 bp, Homo sapiens
aaataagccccctcaactac

SEQ ID NO: 2884867 - DNA, 16 bp, Homo sapiens
aaataagtcaaaagga

SEQ ID NO: 2884868 - DNA, 11 bp, Homo sapiens
aaataagtttt

SEQ ID NO: 2884869 - DNA, 13 bp, Homo sapiens
aaataagtttttc

SEQ ID NO: 2884870 - DNA, 15 bp, Homo sapiens
aaataatatactttt

SEQ ID NO: 2884871 - DNA, 18 bp, Homo sapiens
aaataatgtaattgtaat

SEQ ID NO: 2884872 - DNA, 17 bp, Homo sapiens
aaataatgtagttttgt

SEQ ID NO: 2884873 - DNA, 22 bp, Homo sapiens
aaataatgtagttttgtttatg

SEQ ID NO: 2884874 - DNA, 13 bp, Homo sapiens
aaataatttccta

SEQ ID NO: 2884875 - DNA, 14 bp, Homo sapiens
aaataatttgaact

SEQ ID NO: 2884876 - DNA, 12 bp, Homo sapiens
aaataattttaa

SEQ ID NO: 2884877 - DNA, 19 bp, Homo sapiens
aaataattttatctctttc

SEQ ID NO: 2884878 - DNA, 15 bp, Homo sapiens
aaatacaaaaatact

SEQ ID NO: 2884879 - DNA, 15 bp, Homo sapiens
aaatacaaatctgta

SEQ ID NO: 2884880 - DNA, 16 bp, Homo sapiens
aaatacaaatctgtat

SEQ ID NO: 2884881 - DNA, 17 bp, Homo sapiens
aaatacaaatctgtata

SEQ ID NO: 2884882 - DNA, 23 bp, Homo sapiens
aaatacaattattgtatattgat

SEQ ID NO: 2884883 - DNA, 14 bp, Homo sapiens
aaatacacatttca

SEQ ID NO: 2884884 - DNA, 23 bp, Homo sapiens
aaatacagtcttccatttgcaag

SEQ ID NO: 2884885 - DNA, 16 bp, Homo sapiens
aaatacataaaacaaa

SEQ ID NO: 2884886 - DNA, 21 bp, Homo sapiens
aaatacatcctttttctgcta

SEQ ID NO: 2884887 - DNA, 14 bp, Homo sapiens
aaatacctttgtag

SEQ ID NO: 2884888 - DNA, 19 bp, Homo sapiens
aaatacgtttgtgtttcta

SEQ ID NO: 2884889 - DNA, 14 bp, Homo sapiens
aaatactcatgtgt

SEQ ID NO: 2884890 - DNA, 16 bp, Homo sapiens
aaatactcatgtgtat

SEQ ID NO: 2884891 - DNA, 14 bp, Homo sapiens
aaatactgacaatg

SEQ ID NO: 2884892 - DNA, 20 bp, Homo sapiens
aaatactgccagatgctgat

SEQ ID NO: 2884893 - DNA, 23 bp, Homo sapiens
aaatactgccagatgctgatgtt

SEQ ID NO: 2884894 - DNA, 14 bp, Homo sapiens
aaatacttttcctt

SEQ ID NO: 2884895 - DNA, 14 bp, Homo sapiens
aaatagaaaagtta

SEQ ID NO: 2884896 - DNA, 15 bp, Homo sapiens
aaatagaaaagttat

SEQ ID NO: 2884897 - DNA, 20 bp, Homo sapiens
aaatagagcttttaaaaatg

SEQ ID NO: 2884898 - DNA, 14 bp, Homo sapiens
aaatagagtgtagt

SEQ ID NO: 2884899 - DNA, 18 bp, Homo sapiens
aaatagagtgtagtttac

SEQ ID NO: 2884900 - DNA, 19 bp, Homo sapiens
aaatagagtttgctattag

SEQ ID NO: 2884901 - DNA, 12 bp, Homo sapiens
aaatagatgttt

SEQ ID NO: 2884902 - DNA, 15 bp, Homo sapiens
aaatagatgttttaa

SEQ ID NO: 2884903 - DNA, 16 bp, Homo sapiens
aaatagattttaagct

SEQ ID NO: 2884904 - DNA, 13 bp, Homo sapiens
aaatagcaaaact

SEQ ID NO: 2884905 - DNA, 15 bp, Homo sapiens
aaatagccaccttga

SEQ ID NO: 2884906 - DNA, 14 bp, Homo sapiens
aaatagccccagac

SEQ ID NO: 2884907 - DNA, 20 bp, Homo sapiens
aaataggattgcttcaatta

SEQ ID NO: 2884908 - DNA, 23 bp, Homo sapiens
aaataggattgcttcaattaaaa

SEQ ID NO: 2884909 - DNA, 16 bp, Homo sapiens
aaatagggtccttgaa

SEQ ID NO: 2884910 - DNA, 15 bp, Homo sapiens
aaatagtagaaaaat

SEQ ID NO: 2884911 - DNA, 19 bp, Homo sapiens
aaatagtagaaaaatcaga

SEQ ID NO: 2884912 - DNA, 15 bp, Homo sapiens
aaatagtgaattata

SEQ ID NO: 2884913 - DNA, 15 bp, Homo sapiens
aaatagtgtctttgt

SEQ ID NO: 2884914 - DNA, 22 bp, Homo sapiens
aaatagttaagacatgatttcc

SEQ ID NO: 2884915 - DNA, 17 bp, Homo sapiens
aaatagttaatatagtc

SEQ ID NO: 2884916 - DNA, 17 bp, Homo sapiens
aaatatacaagctacag

SEQ ID NO: 2884917 - DNA, 15 bp, Homo sapiens
aaatatacccatcag

SEQ ID NO: 2884918 - DNA, 22 bp, Homo sapiens
aaatatactgattttgaaaagt

SEQ ID NO: 2884919 - DNA, 16 bp, Homo sapiens
aaatatactgtaaaga

SEQ ID NO: 2884920 - DNA, 16 bp, Homo sapiens
aaatatagttgtcttt

SEQ ID NO: 2884921 - DNA, 19 bp, Homo sapiens
aaatatagttgtctttctt

SEQ ID NO: 2884922 - DNA, 24 bp, Homo sapiens
aaatatatagcttgaaagcagtta

SEQ ID NO: 2884923 - DNA, 18 bp, Homo sapiens
aaatatcagttactcagc

SEQ ID NO: 2884924 - DNA, 19 bp, Homo sapiens
aaatatccctttttcacat

SEQ ID NO: 2884925 - DNA, 14 bp, Homo sapiens
aaatatcttggcct

SEQ ID NO: 2884926 - DNA, 17 bp, Homo sapiens
aaatatgcagaatctct

SEQ ID NO: 2884927 - DNA, 20 bp, Homo sapiens
aaatatgcctctcctttgta

SEQ ID NO: 2884928 - DNA, 16 bp, Homo sapiens
aaatatgcctttttga

SEQ ID NO: 2884929 - DNA, 13 bp, Homo sapiens
aaatatgctcttt

SEQ ID NO: 2884930 - DNA, 18 bp, Homo sapiens
aaatatgctcttttgttt

SEQ ID NO: 2884931 - DNA, 19 bp, Homo sapiens
aaatatggggatagtctgg

SEQ ID NO: 2884932 - DNA, 22 bp, Homo sapiens
aaatatgtgaaaggaacatttt

SEQ ID NO: 2884933 - DNA, 14 bp, Homo sapiens
aaatattagatgtg

SEQ ID NO: 2884934 - DNA, 20 bp, Homo sapiens
aaatattagatgtgatttaa

SEQ ID NO: 2884935 - DNA, 17 bp, Homo sapiens
aaatattcagaatcttt

SEQ ID NO: 2884936 - DNA, 19 bp, Homo sapiens
aaatattctgtacattttt

SEQ ID NO: 2884937 - DNA, 17 bp, Homo sapiens
aaatattggtttgttat

SEQ ID NO: 2884938 - DNA, 12 bp, Homo sapiens
aaatattgtaaa

SEQ ID NO: 2884939 - DNA, 20 bp, Homo sapiens
aaatattgtaaatgctatta

SEQ ID NO: 2884940 - DNA, 23 bp, Homo sapiens
aacccattaatcttttgtagttt

SEQ ID NO: 2884941 - DNA, 20 bp, Homo sapiens
aacccatttgtctctacttt

SEQ ID NO: 2884942 - DNA, 13 bp, Homo sapiens
aacccattttagt

SEQ ID NO: 2884943 - DNA, 17 bp, Homo sapiens
aaccccacccagctcca

SEQ ID NO: 2884944 - DNA, 13 bp, Homo sapiens
aacccccacacac

SEQ ID NO: 2884945 - DNA, 14 bp, Homo sapiens
aacccccacacaca

SEQ ID NO: 2884946 - DNA, 12 bp, Homo sapiens
aacccccactgg

SEQ ID NO: 2884947 - DNA, 16 bp, Homo sapiens
aacccccactggactg

SEQ ID NO: 2884948 - DNA, 19 bp, Homo sapiens
aacccctagaaaggagaga

SEQ ID NO: 2884949 - DNA, 12 bp, Homo sapiens
aacccctccccc

SEQ ID NO: 2884950 - DNA, 20 bp, Homo sapiens
aacccctccctcttctgccc

SEQ ID NO: 2884951 - DNA, 12 bp, Homo sapiens
aaccccttccca

SEQ ID NO: 2884952 - DNA, 17 bp, Homo sapiens
aacccgacagagggaag

SEQ ID NO: 2884953 - DNA, 20 bp, Homo sapiens
aacccgacagagggaagaaa

SEQ ID NO: 2884954 - DNA, 12 bp, Homo sapiens
aaccctctggaa

SEQ ID NO: 2884955 - DNA, 12 bp, Homo sapiens
aaccctctgtca

SEQ ID NO: 2884956 - DNA, 13 bp, Homo sapiens
aaccctctgtcac

SEQ ID NO: 2884957 - DNA, 13 bp, Homo sapiens
aaccctgtggttg

SEQ ID NO: 2884958 - DNA, 11 bp, Homo sapiens
aacccttctcc

SEQ ID NO: 2884959 - DNA, 18 bp, Homo sapiens
aacccttctcctcttgta

SEQ ID NO: 2884960 - DNA, 21 bp, Homo sapiens
aacccttctcctcttgtaaat

SEQ ID NO: 2884961 - DNA, 17 bp, Homo sapiens
aacccttctgctttcta

SEQ ID NO: 2884962 - DNA, 14 bp, Homo sapiens
aaccgatgctttac

SEQ ID NO: 2884963 - DNA, 15 bp, Homo sapiens
aaccgcaggaagctg

SEQ ID NO: 2884964 - DNA, 16 bp, Homo sapiens
aaccgctttggcctga

SEQ ID NO: 2884965 - DNA, 17 bp, Homo sapiens
aaccgctttggcctgag

SEQ ID NO: 2884966 - DNA, 18 bp, Homo sapiens
aaccgctttggcctgagt

SEQ ID NO: 2884967 - DNA, 13 bp, Homo sapiens
aaccgtttttcaa

SEQ ID NO: 2884968 - DNA, 20 bp, Homo sapiens
aaccgtttttcaagaaaact

SEQ ID NO: 2884969 - DNA, 15 bp, Homo sapiens
aacctaacctgtgtc

SEQ ID NO: 2884970 - DNA, 16 bp, Homo sapiens
aacctaacctgtgtct

SEQ ID NO: 2884971 - DNA, 18 bp, Homo sapiens
aacctacacactgtcatg

SEQ ID NO: 2884972 - DNA, 12 bp, Homo sapiens
aacctacagcat

SEQ ID NO: 2884973 - DNA, 22 bp, Homo sapiens
aacctactgtctaagcagtttt

SEQ ID NO: 2884974 - DNA, 23 bp, Homo sapiens
aacctagaaacctttatccctgc

SEQ ID NO: 2884975 - DNA, 15 bp, Homo sapiens
aacctataagcatga

SEQ ID NO: 2884976 - DNA, 20 bp, Homo sapiens
aacctcaccccgaggccctg

SEQ ID NO: 2884977 - DNA, 21 bp, Homo sapiens
aacctcaccccgaggccctgc

SEQ ID NO: 2884978 - DNA, 22 bp, Homo sapiens
aacctcaccccgaggccctgca

SEQ ID NO: 2884979 - DNA, 12 bp, Homo sapiens
aacctcctctgt

SEQ ID NO: 2884980 - DNA, 13 bp, Homo sapiens
aacctcctggaca

SEQ ID NO: 2884981 - DNA, 16 bp, Homo sapiens
aacctcgagtactgtg

SEQ ID NO: 2884982 - DNA, 13 bp, Homo sapiens
aacctctgcctcc

SEQ ID NO: 2884983 - DNA, 20 bp, Homo sapiens
aacctctgcttcccaggttc

SEQ ID NO: 2884984 - DNA, 12 bp, Homo sapiens
aacctctgttca

SEQ ID NO: 2884985 - DNA, 13 bp, Homo sapiens
aacctctgttcag

SEQ ID NO: 2884986 - DNA, 21 bp, Homo sapiens
aacctgcaaaaaatacttttt

SEQ ID NO: 2884987 - DNA, 17 bp, Homo sapiens
aacctgcacttcatatc

SEQ ID NO: 2884988 - DNA, 19 bp, Homo sapiens
aacctgcctgacatttgga

SEQ ID NO: 2884989 - DNA, 23 bp, Homo sapiens
aacctgcttgggtggagaagcca

SEQ ID NO: 2884990 - DNA, 14 bp, Homo sapiens
aacctggagatatt

SEQ ID NO: 2884991 - DNA, 22 bp, Homo sapiens
aacctgggagagacttggatga

SEQ ID NO: 2884992 - DNA, 19 bp, Homo sapiens
aacctgtagatgcagaaaa

SEQ ID NO: 2884993 - DNA, 18 bp, Homo sapiens
aacctgtaggatcttatt

SEQ ID NO: 2884994 - DNA, 16 bp, Homo sapiens
aacctgtatctttcta

SEQ ID NO: 2884995 - DNA, 15 bp, Homo sapiens
aacctgtccttactc

SEQ ID NO: 2884996 - DNA, 23 bp, Homo sapiens
aacctgtccttactcagagctgc

SEQ ID NO: 2884997 - DNA, 11 bp, Homo sapiens
aacctgtgcct

SEQ ID NO: 2884998 - DNA, 19 bp, Homo sapiens
aacctgtttttttttcatt

SEQ ID NO: 2884999 - DNA, 17 bp, Homo sapiens
aaccttaaaaggtactg

SEQ ID NO: 2885000 - DNA, 17 bp, Homo sapiens
aaccttaaacacccctc

SEQ ID NO: 2885001 - DNA, 20 bp, Homo sapiens
aaccttgccttagaaacaca

SEQ ID NO: 2885002 - DNA, 17 bp, Homo sapiens
aaccttgtttctttctg

SEQ ID NO: 2885003 - DNA, 20 bp, Homo sapiens
aacctttaaaaatgtataat

SEQ ID NO: 2885004 - DNA, 12 bp, Homo sapiens
aacctttctgtg

SEQ ID NO: 2885005 - DNA, 17 bp, Homo sapiens
aacctttgctatgtaag

SEQ ID NO: 2885006 - DNA, 23 bp, Homo sapiens
aaccttttatcaataaagcacta

SEQ ID NO: 2885007 - DNA, 11 bp, Homo sapiens
ataaaaaggca

SEQ ID NO: 2885008 - DNA, 12 bp, Homo sapiens
ataaaaagttaa

SEQ ID NO: 2885009 - DNA, 17 bp, Homo sapiens
ataaaaatcaaacaacc

SEQ ID NO: 2885010 - DNA, 19 bp, Homo sapiens
ataaaaatcagtttcttac

SEQ ID NO: 2885011 - DNA, 12 bp, Homo sapiens
ataaaaatgaca

SEQ ID NO: 2885012 - DNA, 16 bp, Homo sapiens
ataaaacaggtcaata

SEQ ID NO: 2885013 - DNA, 18 bp, Homo sapiens
ataaaacaggtcaataca

SEQ ID NO: 2885014 - DNA, 16 bp, Homo sapiens
ataaaaccaagcctct

SEQ ID NO: 2885015 - DNA, 17 bp, Homo sapiens
ataaaaccaagcctctg

SEQ ID NO: 2885016 - DNA, 15 bp, Homo sapiens
ataaaactggctttg

SEQ ID NO: 2885017 - DNA, 15 bp, Homo sapiens
ataaaaggaagccaa

SEQ ID NO: 2885018 - DNA, 19 bp, Homo sapiens
ataaaagggtcaaacctgt

SEQ ID NO: 2885019 - DNA, 21 bp, Homo sapiens
ataaaagtgattgttggcaca

SEQ ID NO: 2885020 - DNA, 21 bp, Homo sapiens
ataaaagttcctctcccttcc

SEQ ID NO: 2885021 - DNA, 19 bp, Homo sapiens
ataaaagttttacaaaggg

SEQ ID NO: 2885022 - DNA, 13 bp, Homo sapiens
ataaaataatgca

SEQ ID NO: 2885023 - DNA, 13 bp, Homo sapiens
ataaaatactttt

SEQ ID NO: 2885024 - DNA, 20 bp, Homo sapiens
ataaaatagcaatcctaaag

SEQ ID NO: 2885025 - DNA, 21 bp, Homo sapiens
ataaaatatgaagacataaac

SEQ ID NO: 2885026 - DNA, 17 bp, Homo sapiens
ataaaatgatcctgcca

SEQ ID NO: 2885027 - DNA, 18 bp, Homo sapiens
ataaaatgatgttataca

SEQ ID NO: 2885028 - DNA, 15 bp, Homo sapiens
ataaaatgtcttcaa

SEQ ID NO: 2885029 - DNA, 20 bp, Homo sapiens
ataaaatgtcttcaaggctt

SEQ ID NO: 2885030 - DNA, 14 bp, Homo sapiens
ataaaattatagat

SEQ ID NO: 2885031 - DNA, 23 bp, Homo sapiens
ataaaattatagatgggaatgaa

SEQ ID NO: 2885032 - DNA, 14 bp, Homo sapiens
ataaaatttctact

SEQ ID NO: 2885033 - DNA, 17 bp, Homo sapiens
ataaacaaggtcataca

SEQ ID NO: 2885034 - DNA, 13 bp, Homo sapiens
ataaacaatgaaa

SEQ ID NO: 2885035 - DNA, 19 bp, Homo sapiens
ataaacacattaaaagaca

SEQ ID NO: 2885036 - DNA, 19 bp, Homo sapiens
ataaacagacaatatgtga

SEQ ID NO: 2885037 - DNA, 13 bp, Homo sapiens
ataaacagcaggg

SEQ ID NO: 2885038 - DNA, 22 bp, Homo sapiens
ataagtagatctgctttctgtt

SEQ ID NO: 2885039 - DNA, 14 bp, Homo sapiens
ataagtatttctga

SEQ ID NO: 2885040 - DNA, 16 bp, Homo sapiens
ataagtcattgaaatt

SEQ ID NO: 2885041 - DNA, 14 bp, Homo sapiens
ataagtggagaaat

SEQ ID NO: 2885042 - DNA, 20 bp, Homo sapiens
ataagtggagaaatgaaaag

SEQ ID NO: 2885043 - DNA, 15 bp, Homo sapiens
ataagttaaaggcag

SEQ ID NO: 2885044 - DNA, 14 bp, Homo sapiens
ataagttattgcag

SEQ ID NO: 2885045 - DNA, 23 bp, Homo sapiens
ataagttctagttgcttgtaaaa

SEQ ID NO: 2885046 - DNA, 16 bp, Homo sapiens
ataagttgatgttttc

SEQ ID NO: 2885047 - DNA, 14 bp, Homo sapiens
ataagttgctttcc

SEQ ID NO: 2885048 - DNA, 20 bp, Homo sapiens
ataagtttaactttaaaact

SEQ ID NO: 2885049 - DNA, 15 bp, Homo sapiens
ataagtttgaaggaa

SEQ ID NO: 2885050 - DNA, 17 bp, Homo sapiens
ataagtttttctttaat

SEQ ID NO: 2885051 - DNA, 16 bp, Homo sapiens
ataataaaaagaaaga

SEQ ID NO: 2885052 - DNA, 14 bp, Homo sapiens
ataataaaatcaaa

SEQ ID NO: 2885053 - DNA, 18 bp, Homo sapiens
ataataaagtacttgact

SEQ ID NO: 2885054 - DNA, 13 bp, Homo sapiens
ataataaattaaa

SEQ ID NO: 2885055 - DNA, 15 bp, Homo sapiens
ataataacatatata

SEQ ID NO: 2885056 - DNA, 10 bp, Homo sapiens
ataataataa

SEQ ID NO: 2885057 - DNA, 15 bp, Homo sapiens
ataataattgaagaa

SEQ ID NO: 2885058 - DNA, 16 bp, Homo sapiens
ataatagtcaatttct

SEQ ID NO: 2885059 - DNA, 15 bp, Homo sapiens
ataatagttaatgaa

SEQ ID NO: 2885060 - DNA, 14 bp, Homo sapiens
ataatagttttttc

SEQ ID NO: 2885061 - DNA, 14 bp, Homo sapiens
ataatataatgaat

SEQ ID NO: 2885062 - DNA, 13 bp, Homo sapiens
ataatatattttc

SEQ ID NO: 2885063 - DNA, 21 bp, Homo sapiens
ataatatccaggtcaacagaa

SEQ ID NO: 2885064 - DNA, 23 bp, Homo sapiens
ataatatccaggtcaacagaatg

SEQ ID NO: 2885065 - DNA, 18 bp, Homo sapiens
ataatatctaaagttata

SEQ ID NO: 2885066 - DNA, 19 bp, Homo sapiens
ataatatctaaagttatat

SEQ ID NO: 2885067 - DNA, 12 bp, Homo sapiens
ataatatgagaa

SEQ ID NO: 2885068 - DNA, 15 bp, Homo sapiens
ataatatttcttaat

SEQ ID NO: 2885069 - DNA, 18 bp, Homo sapiens
ataatatttcttaatttg

SEQ ID NO: 2885070 - DNA, 21 bp, Homo sapiens
ataatcagcaagaatttgatc

SEQ ID NO: 2885071 - DNA, 23 bp, Homo sapiens
ataatcagtgactgaaaccattt

SEQ ID NO: 2885072 - DNA, 22 bp, Homo sapiens
ataatcattttagaattaaaat

SEQ ID NO: 2885073 - DNA, 23 bp, Homo sapiens
ataatcattttagaattaaaatt

SEQ ID NO: 2885074 - DNA, 13 bp, Homo sapiens
ataatcccagcta

SEQ ID NO: 2885075 - DNA, 15 bp, Homo sapiens
ataatccttctgcaa

SEQ ID NO: 2885076 - DNA, 18 bp, Homo sapiens
ataatcgactcaaaaata

SEQ ID NO: 2885077 - DNA, 22 bp, Homo sapiens
ataatcggcccacagctcccac

SEQ ID NO: 2885078 - DNA, 17 bp, Homo sapiens
ataatctgtacaatgaa

SEQ ID NO: 2885079 - DNA, 18 bp, Homo sapiens
ataatcttaaattttgac

SEQ ID NO: 2885080 - DNA, 17 bp, Homo sapiens
ataatcttttacattga

SEQ ID NO: 2885081 - DNA, 15 bp, Homo sapiens
ataatgaaataatca

SEQ ID NO: 2885082 - DNA, 15 bp, Homo sapiens
ataatgacttttaaa

SEQ ID NO: 2885083 - DNA, 18 bp, Homo sapiens
ataatgcagaagtattct

SEQ ID NO: 2885084 - DNA, 14 bp, Homo sapiens
ataatgcagtatgg

SEQ ID NO: 2885085 - DNA, 18 bp, Homo sapiens
ataatgcagtatggtaca

SEQ ID NO: 2885086 - DNA, 15 bp, Homo sapiens
ataatgccagaatat

SEQ ID NO: 2885087 - DNA, 20 bp, Homo sapiens
ataatgccattttaaggaaa

SEQ ID NO: 2885088 - DNA, 17 bp, Homo sapiens
ataatgctcacttggtc

SEQ ID NO: 2885089 - DNA, 20 bp, Homo sapiens
ataatggacagattaatatt

SEQ ID NO: 2885090 - DNA, 19 bp, Homo sapiens
ataatgggattagaaacaa

SEQ ID NO: 2885091 - DNA, 14 bp, Homo sapiens
ataatgtaattgta

SEQ ID NO: 2885092 - DNA, 16 bp, Homo sapiens
ataatgtgaagtgtta

SEQ ID NO: 2885093 - DNA, 13 bp, Homo sapiens
ataatgtgcctgg

SEQ ID NO: 2885094 - DNA, 22 bp, Homo sapiens
ataatgtgcctggctctgattc

SEQ ID NO: 2885095 - DNA, 15 bp, Homo sapiens
ataatgttccttagt

SEQ ID NO: 2885096 - DNA, 17 bp, Homo sapiens
ataatgttccttagtgg

SEQ ID NO: 2885097 - DNA, 18 bp, Homo sapiens
ataattctatactgttga

SEQ ID NO: 2885098 - DNA, 16 bp, Homo sapiens
ataattcttattttgt

SEQ ID NO: 2885099 - DNA, 18 bp, Homo sapiens
ataattgattaaaatctc

SEQ ID NO: 2885100 - DNA, 13 bp, Homo sapiens
ataattgcattca

SEQ ID NO: 2885101 - DNA, 22 bp, Homo sapiens
ataattgtatcgtatagctgta

SEQ ID NO: 2885102 - DNA, 11 bp, Homo sapiens
ataattgtgac

SEQ ID NO: 2885103 - DNA, 21 bp, Homo sapiens
ataattgtgaccaatacattt

SEQ ID NO: 2885104 - DNA, 22 bp, Homo sapiens
ataattgtgaccaatacatttg

SEQ ID NO: 2885105 - DNA, 12 bp, Homo sapiens
ataattgttgaa

SEQ ID NO: 2885106 - DNA, 18 bp, Homo sapiens
ataatttcagggaaatta

SEQ ID NO: 2885107 - DNA, 20 bp, Homo sapiens
ataatttcagggaaattaat

SEQ ID NO: 2885108 - DNA, 19 bp, Homo sapiens
ataatttgaactttggaac

SEQ ID NO: 2885109 - DNA, 14 bp, Homo sapiens
ataatttgtttaaa

SEQ ID NO: 2885110 - DNA, 20 bp, Homo sapiens
ataatttgtttaaaattctc

SEQ ID NO: 2885111 - DNA, 11 bp, Homo sapiens
ataattttaaa

SEQ ID NO: 2885112 - DNA, 16 bp, Homo sapiens
ataattttttaattat

SEQ ID NO: 2885113 - DNA, 22 bp, Homo sapiens
ataatttttttaaaaaagaaaa

SEQ ID NO: 2885114 - DNA, 18 bp, Homo sapiens
atacaaaaacatacttca

SEQ ID NO: 2885115 - DNA, 23 bp, Homo sapiens
atacaaaaatcagccagacatgg

SEQ ID NO: 2885116 - DNA, 13 bp, Homo sapiens
atacaaaagaatt

SEQ ID NO: 2885117 - DNA, 13 bp, Homo sapiens
atacaaaaggctc

SEQ ID NO: 2885118 - DNA, 17 bp, Homo sapiens
atacaaatctgatggct

SEQ ID NO: 2885119 - DNA, 16 bp, Homo sapiens
atacaaatctgtataa

SEQ ID NO: 2885120 - DNA, 20 bp, Homo sapiens
atacaaatctgtataaatgt

SEQ ID NO: 2885121 - DNA, 14 bp, Homo sapiens
atacaacagtgcta

SEQ ID NO: 2885122 - DNA, 14 bp, Homo sapiens
atacaacctgcttg

SEQ ID NO: 2885123 - DNA, 23 bp, Homo sapiens
atacaagctacagttgtccagat

SEQ ID NO: 2885124 - DNA, 20 bp, Homo sapiens
atacaagtgaacaaaataag

SEQ ID NO: 2885125 - DNA, 11 bp, Homo sapiens
atacaataatg

SEQ ID NO: 2885126 - DNA, 13 bp, Homo sapiens
atacaataatgga

SEQ ID NO: 2885127 - DNA, 15 bp, Homo sapiens
atacaataatggaaa

SEQ ID NO: 2885128 - DNA, 19 bp, Homo sapiens
atacaataatggaaaaaaa

SEQ ID NO: 2885129 - DNA, 18 bp, Homo sapiens
atacaatgtatttattta

SEQ ID NO: 2885130 - DNA, 21 bp, Homo sapiens
atacaatgtatttatttaaaa

SEQ ID NO: 2885131 - DNA, 14 bp, Homo sapiens
atacaattattgta

SEQ ID NO: 2885132 - DNA, 21 bp, Homo sapiens
atacaattattgtatattgat

SEQ ID NO: 2885133 - DNA, 11 bp, Homo sapiens
atacacaaatt

SEQ ID NO: 2885134 - DNA, 21 bp, Homo sapiens
atacacaaggagctttcttgt

SEQ ID NO: 2885135 - DNA, 11 bp, Homo sapiens
atacacacaca

SEQ ID NO: 2885136 - DNA, 16 bp, Homo sapiens
atacacacacacacac

SEQ ID NO: 2885137 - DNA, 21 bp, Homo sapiens
atacacacacacacacagcca

SEQ ID NO: 2885138 - DNA, 22 bp, Homo sapiens
atacacacacacacacagccac

SEQ ID NO: 2885139 - DNA, 23 bp, Homo sapiens
atacacacacacacacagccaca

SEQ ID NO: 2885140 - DNA, 22 bp, Homo sapiens
atacacatctctgtcagtgtga

SEQ ID NO: 2885141 - DNA, 19 bp, Homo sapiens
atacaccagagataatatg

SEQ ID NO: 2885142 - DNA, 22 bp, Homo sapiens
atacaccccctcttctgagcac

SEQ ID NO: 2885143 - DNA, 16 bp, Homo sapiens
atacacttgccctgct

SEQ ID NO: 2885144 - DNA, 15 bp, Homo sapiens
atacagaactctttc

SEQ ID NO: 2885145 - DNA, 20 bp, Homo sapiens
atacagagtaattataggaa

SEQ ID NO: 2885146 - DNA, 23 bp, Homo sapiens
atacagcctgaataaaccaagac

SEQ ID NO: 2885147 - DNA, 18 bp, Homo sapiens
atacaggcccctgggttt

SEQ ID NO: 2885148 - DNA, 17 bp, Homo sapiens
atacagtaactttatgt

SEQ ID NO: 2885149 - DNA, 12 bp, Homo sapiens
atacagtacaca

SEQ ID NO: 2885150 - DNA, 15 bp, Homo sapiens
atacagtcaacaagc

SEQ ID NO: 2885151 - DNA, 20 bp, Homo sapiens
atacagtcttccatttgcaa

SEQ ID NO: 2885152 - DNA, 13 bp, Homo sapiens
atacagtgtacat

SEQ ID NO: 2885153 - DNA, 22 bp, Homo sapiens
atacagtgttttttaggaaaag

SEQ ID NO: 2885154 - DNA, 23 bp, Homo sapiens
atacagtttataaagccaagaat

SEQ ID NO: 2885155 - DNA, 16 bp, Homo sapiens
agttgaaaataaagtg

SEQ ID NO: 2885156 - DNA, 23 bp, Homo sapiens
agttgaaaatcttataatttaaa

SEQ ID NO: 2885157 - DNA, 15 bp, Homo sapiens
agttgaattccaagt

SEQ ID NO: 2885158 - DNA, 17 bp, Homo sapiens
agttgaattccaagtgt

SEQ ID NO: 2885159 - DNA, 17 bp, Homo sapiens
agttgacatgagattta

SEQ ID NO: 2885160 - DNA, 14 bp, Homo sapiens
agttgagagacagt

SEQ ID NO: 2885161 - DNA, 21 bp, Homo sapiens
agttgatatgttttatttcat

SEQ ID NO: 2885162 - DNA, 15 bp, Homo sapiens
agttgatctggaacc

SEQ ID NO: 2885163 - DNA, 17 bp, Homo sapiens
agttgatctggaaccca

SEQ ID NO: 2885164 - DNA, 20 bp, Homo sapiens
agttgatctggaacccagac

SEQ ID NO: 2885165 - DNA, 14 bp, Homo sapiens
agttgatgttttct

SEQ ID NO: 2885166 - DNA, 15 bp, Homo sapiens
agttgatgttttcta

SEQ ID NO: 2885167 - DNA, 16 bp, Homo sapiens
agttgatgttttctaa

SEQ ID NO: 2885168 - DNA, 18 bp, Homo sapiens
agttgatttagtgttttt

SEQ ID NO: 2885169 - DNA, 21 bp, Homo sapiens
agttgattttacaattgaaat

SEQ ID NO: 2885170 - DNA, 23 bp, Homo sapiens
agttgattttacaattgaaatga

SEQ ID NO: 2885171 - DNA, 22 bp, Homo sapiens
agttgcataggtttaataattt

SEQ ID NO: 2885172 - DNA, 17 bp, Homo sapiens
agttgccccgtctctgt

SEQ ID NO: 2885173 - DNA, 19 bp, Homo sapiens
agttgccccgtctctgttc

SEQ ID NO: 2885174 - DNA, 17 bp, Homo sapiens
agttgctcaaagagcct

SEQ ID NO: 2885175 - DNA, 22 bp, Homo sapiens
agttgctggcatgtcttcattg

SEQ ID NO: 2885176 - DNA, 23 bp, Homo sapiens
agttgcttgctaatatttccaga

SEQ ID NO: 2885177 - DNA, 15 bp, Homo sapiens
agttgctttgttaca

SEQ ID NO: 2885178 - DNA, 22 bp, Homo sapiens
agttgctttgttacaataaaac

SEQ ID NO: 2885179 - DNA, 16 bp, Homo sapiens
agttggccctttaata

SEQ ID NO: 2885180 - DNA, 17 bp, Homo sapiens
agttggccctttaatat

SEQ ID NO: 2885181 - DNA, 16 bp, Homo sapiens
agttggcctttttaca

SEQ ID NO: 2885182 - DNA, 18 bp, Homo sapiens
agttggggctcttggctt

SEQ ID NO: 2885183 - DNA, 20 bp, Homo sapiens
agttggtgagaaacctgtat

SEQ ID NO: 2885184 - DNA, 16 bp, Homo sapiens
agttggtttgtgtgat

SEQ ID NO: 2885185 - DNA, 11 bp, Homo sapiens
agttgtacatg

SEQ ID NO: 2885186 - DNA, 13 bp, Homo sapiens
agttgtacatgaa

SEQ ID NO: 2885187 - DNA, 13 bp, Homo sapiens
agttgtacctttt

SEQ ID NO: 2885188 - DNA, 16 bp, Homo sapiens
agttgtagaatgtatt

SEQ ID NO: 2885189 - DNA, 17 bp, Homo sapiens
agttgtagaatgtattg

SEQ ID NO: 2885190 - DNA, 18 bp, Homo sapiens
agttgtagaatgtattgt

SEQ ID NO: 2885191 - DNA, 21 bp, Homo sapiens
agttgtagaatgtattgtacc

SEQ ID NO: 2885192 - DNA, 12 bp, Homo sapiens
agttgtattttg

SEQ ID NO: 2885193 - DNA, 15 bp, Homo sapiens
agttgtcactgcttt

SEQ ID NO: 2885194 - DNA, 21 bp, Homo sapiens
agttgtcctatggacaactta

SEQ ID NO: 2885195 - DNA, 15 bp, Homo sapiens
agtgggacattagta

SEQ ID NO: 2885196 - DNA, 12 bp, Homo sapiens
agtgggagaaaa

SEQ ID NO: 2885197 - DNA, 13 bp, Homo sapiens
agtgggccaggac

SEQ ID NO: 2885198 - DNA, 15 bp, Homo sapiens
agtgggccaggacag

SEQ ID NO: 2885199 - DNA, 20 bp, Homo sapiens
agtgggccaggacaggcccg

SEQ ID NO: 2885200 - DNA, 23 bp, Homo sapiens
agtgggctgcacgctcccctcca

SEQ ID NO: 2885201 - DNA, 20 bp, Homo sapiens
agtggggaccccacccctca

SEQ ID NO: 2885202 - DNA, 15 bp, Homo sapiens
agtggggctctctga

SEQ ID NO: 2885203 - DNA, 17 bp, Homo sapiens
agtggggtagaggaaga

SEQ ID NO: 2885204 - DNA, 20 bp, Homo sapiens
agtggggtcaagctgagctg

SEQ ID NO: 2885205 - DNA, 22 bp, Homo sapiens
agtggggtcaagctgagctggc

SEQ ID NO: 2885206 - DNA, 22 bp, Homo sapiens
agtggggtctccctctcctgcc

SEQ ID NO: 2885207 - DNA, 16 bp, Homo sapiens
agtggggtgaacagct

SEQ ID NO: 2885208 - DNA, 22 bp, Homo sapiens
agtggggttgggggacagcctt

SEQ ID NO: 2885209 - DNA, 21 bp, Homo sapiens
agtggggtttcgcagcctgag

SEQ ID NO: 2885210 - DNA, 15 bp, Homo sapiens
agtgggtaaaattag

SEQ ID NO: 2885211 - DNA, 19 bp, Homo sapiens
agtggtagaggtgtgtgcc

SEQ ID NO: 2885212 - DNA, 14 bp, Homo sapiens
agtggtctcctctc

SEQ ID NO: 2885213 - DNA, 16 bp, Homo sapiens
agtggtctcctctcag

SEQ ID NO: 2885214 - DNA, 21 bp, Homo sapiens
agtggtctctactgtggcaaa

SEQ ID NO: 2885215 - DNA, 14 bp, Homo sapiens
agtggtctgtgtga

SEQ ID NO: 2885216 - DNA, 23 bp, Homo sapiens
agtggtcttaagaaatgtataaa

SEQ ID NO: 2885217 - DNA, 15 bp, Homo sapiens
agtggtgctcagttg

SEQ ID NO: 2885218 - DNA, 20 bp, Homo sapiens
agtggtgctcagttgtagaa

SEQ ID NO: 2885219 - DNA, 15 bp, Homo sapiens
agtggtggcagggcc

SEQ ID NO: 2885220 - DNA, 16 bp, Homo sapiens
agtggtggcagggcct

SEQ ID NO: 2885221 - DNA, 15 bp, Homo sapiens
agtggtgtgatctca

SEQ ID NO: 2885222 - DNA, 18 bp, Homo sapiens
agtggttcagtctagaag

SEQ ID NO: 2885223 - DNA, 18 bp, Homo sapiens
agtgtaaagcattccaac

SEQ ID NO: 2885224 - DNA, 20 bp, Homo sapiens
agtgtaaagcattccaacaa

SEQ ID NO: 2885225 - DNA, 15 bp, Homo sapiens
agtgtaaatgttagt

SEQ ID NO: 2885226 - DNA, 15 bp, Homo sapiens
agtgtacaagttgct

SEQ ID NO: 2885227 - DNA, 16 bp, Homo sapiens
agtgtacaagttgctt

SEQ ID NO: 2885228 - DNA, 18 bp, Homo sapiens
agtgtacaagttgctttg

SEQ ID NO: 2885229 - DNA, 19 bp, Homo sapiens
agtgtacatgtacatagta

SEQ ID NO: 2885230 - DNA, 14 bp, Homo sapiens
agtgtacctcctct

SEQ ID NO: 2885231 - DNA, 21 bp, Homo sapiens
agtgtacctcctctcagtgtt

SEQ ID NO: 2885232 - DNA, 22 bp, Homo sapiens
agtgtacctcctctcagtgttt

SEQ ID NO: 2885233 - DNA, 18 bp, Homo sapiens
agtgtacctgtaaatgtc

SEQ ID NO: 2885234 - DNA, 15 bp, Homo sapiens
agtgtagccaggtcc

SEQ ID NO: 2885235 - DNA, 19 bp, Homo sapiens
agtgtagtttacagaaaaa

SEQ ID NO: 2885236 - DNA, 13 bp, Homo sapiens
agtgtatttcagt

SEQ ID NO: 2885237 - DNA, 15 bp, Homo sapiens
agtgtcaaccagaca

SEQ ID NO: 2885238 - DNA, 20 bp, Homo sapiens
agtgtcacctttcttcttgt

SEQ ID NO: 2885239 - DNA, 12 bp, Homo sapiens
agtgtcatgttt

SEQ ID NO: 2885240 - DNA, 18 bp, Homo sapiens
agtgtccattttgtgaag

SEQ ID NO: 2885241 - DNA, 19 bp, Homo sapiens
agtgtccattttgtgaagc

SEQ ID NO: 2885242 - DNA, 23 bp, Homo sapiens
agtgtccattttgtgaagccctg

SEQ ID NO: 2885243 - DNA, 22 bp, Homo sapiens
agtgtccttggcaggctgattt

SEQ ID NO: 2885244 - DNA, 12 bp, Homo sapiens
agtgtctctgcc

SEQ ID NO: 2885245 - DNA, 16 bp, Homo sapiens
agtgtctctgttttat

SEQ ID NO: 2885246 - DNA, 13 bp, Homo sapiens
agtgtctggctgc

SEQ ID NO: 2885247 - DNA, 14 bp, Homo sapiens
agtgtctggctgca

SEQ ID NO: 2885248 - DNA, 20 bp, Homo sapiens
agtgtctgggtttggcccaa

SEQ ID NO: 2885249 - DNA, 17 bp, Homo sapiens
agtgtcttaaggagact

SEQ ID NO: 2885250 - DNA, 13 bp, Homo sapiens
agtgtctttccac

SEQ ID NO: 2885251 - DNA, 16 bp, Homo sapiens
agtgtctttccactcc

SEQ ID NO: 2885252 - DNA, 16 bp, Homo sapiens
agtgtcttttgacatt

SEQ ID NO: 2885253 - DNA, 13 bp, Homo sapiens
agtgtgaacaaaa

SEQ ID NO: 2885254 - DNA, 22 bp, Homo sapiens
agtgtgaacaaaagatgctctt

SEQ ID NO: 2885255 - DNA, 18 bp, Homo sapiens
agtgtgaagttagaattc

SEQ ID NO: 2885256 - DNA, 21 bp, Homo sapiens
agtgtgaagttagaattcctt

SEQ ID NO: 2885257 - DNA, 18 bp, Homo sapiens
agtgtgaggccagggcag

SEQ ID NO: 2885258 - DNA, 18 bp, Homo sapiens
agtgtgattgggaataaa

SEQ ID NO: 2885259 - DNA, 21 bp, Homo sapiens
agtgtgattgggaataaatat

SEQ ID NO: 2885260 - DNA, 23 bp, Homo sapiens
agtgtgattgggaataaatatgc

SEQ ID NO: 2885261 - DNA, 21 bp, Homo sapiens
agtgtgcagttctagtttgca

SEQ ID NO: 2885262 - DNA, 17 bp, Homo sapiens
agtgtgcatattgtaca

SEQ ID NO: 2885263 - DNA, 13 bp, Homo sapiens
agtgtgcccatct

SEQ ID NO: 2885264 - DNA, 14 bp, Homo sapiens
agtgtggactctgg

SEQ ID NO: 2885265 - DNA, 16 bp, Homo sapiens
agtgtggcagtttggc

SEQ ID NO: 2885266 - DNA, 17 bp, Homo sapiens
agtgtggcagtttggca

SEQ ID NO: 2885267 - DNA, 21 bp, Homo sapiens
agtgtgggactccaggccagc

SEQ ID NO: 2885268 - DNA, 20 bp, Homo sapiens
agtgtgggaggctcctgtta

SEQ ID NO: 2885269 - DNA, 16 bp, Homo sapiens
agtgtgggcgctctcc

SEQ ID NO: 2885270 - DNA, 17 bp, Homo sapiens
agtgtggtcccaacagg

SEQ ID NO: 2885271 - DNA, 16 bp, Homo sapiens
agtgtgtatgccaaga

SEQ ID NO: 2885272 - DNA, 14 bp, Homo sapiens
agtgacctgaggaa

SEQ ID NO: 2885273 - DNA, 15 bp, Homo sapiens
agtgacctgaggaag

SEQ ID NO: 2885274 - DNA, 13 bp, Homo sapiens
agtgactctcctg

SEQ ID NO: 2885275 - DNA, 22 bp, Homo sapiens
agtgactctcctgcctcagcct

SEQ ID NO: 2885276 - DNA, 22 bp, Homo sapiens
agtgactgaaaccattttccca

SEQ ID NO: 2885277 - DNA, 21 bp, Homo sapiens
agtgagacccagccctcatcc

SEQ ID NO: 2885278 - DNA, 13 bp, Homo sapiens
agtgagacccagg

SEQ ID NO: 2885279 - DNA, 14 bp, Homo sapiens
agtgagacccagga

SEQ ID NO: 2885280 - DNA, 13 bp, Homo sapiens
agtgagaccttgt

SEQ ID NO: 2885281 - DNA, 21 bp, Homo sapiens
agtgagagacattaactcatt

SEQ ID NO: 2885282 - DNA, 22 bp, Homo sapiens
agtgagagacattaactcatta

SEQ ID NO: 2885283 - DNA, 14 bp, Homo sapiens
agtgagaggggagg

SEQ ID NO: 2885284 - DNA, 19 bp, Homo sapiens
agtgagatagcattgtgaa

SEQ ID NO: 2885285 - DNA, 19 bp, Homo sapiens
agtgagcccagattgtgcc

SEQ ID NO: 2885286 - DNA, 20 bp, Homo sapiens
agtgagccgcatcttctcca

SEQ ID NO: 2885287 - DNA, 19 bp, Homo sapiens
agtgagcgagtggatgctg

SEQ ID NO: 2885288 - DNA, 21 bp, Homo sapiens
agtgagcgagtggatgctgtg

SEQ ID NO: 2885289 - DNA, 22 bp, Homo sapiens
agtgagcgagtggatgctgtgc

SEQ ID NO: 2885290 - DNA, 23 bp, Homo sapiens
agtgagctgagatcgtgccgtta

SEQ ID NO: 2885291 - DNA, 17 bp, Homo sapiens
agtgagctgtaggtgtg

SEQ ID NO: 2885292 - DNA, 19 bp, Homo sapiens
agtgaggaagccaggtcca

SEQ ID NO: 2885293 - DNA, 14 bp, Homo sapiens
agtgaggagaatga

SEQ ID NO: 2885294 - DNA, 16 bp, Homo sapiens
agtgagggagatccca

SEQ ID NO: 2885295 - DNA, 19 bp, Homo sapiens
agtgagggagggctgtcat

SEQ ID NO: 2885296 - DNA, 15 bp, Homo sapiens
agtgagtactgttaa

SEQ ID NO: 2885297 - DNA, 22 bp, Homo sapiens
agtgagtctggtggaggagctg

SEQ ID NO: 2885298 - DNA, 15 bp, Homo sapiens
agtgagtgtgctgct

SEQ ID NO: 2885299 - DNA, 20 bp, Homo sapiens
agtgatagagctaaccctta

SEQ ID NO: 2885300 - DNA, 16 bp, Homo sapiens
agtgatatttctctag

SEQ ID NO: 2885301 - DNA, 15 bp, Homo sapiens
agtgatcagcaatga

SEQ ID NO: 2885302 - DNA, 15 bp, Homo sapiens
agtgatcctcccacc

SEQ ID NO: 2885303 - DNA, 15 bp, Homo sapiens
agtgatcctgcaagt

SEQ ID NO: 2885304 - DNA, 21 bp, Homo sapiens
agtgatctgtccacctcggcc

SEQ ID NO: 2885305 - DNA, 22 bp, Homo sapiens
agtgatgcctgcccgcaccctg

SEQ ID NO: 2885306 - DNA, 21 bp, Homo sapiens
agtgatgggaaggtttttaag

SEQ ID NO: 2885307 - DNA, 15 bp, Homo sapiens
agtgatgtcatttga

SEQ ID NO: 2885308 - DNA, 20 bp, Homo sapiens
agtgatgtccttaaaatgtg

SEQ ID NO: 2885309 - DNA, 17 bp, Homo sapiens
agtgattcccaactcct

SEQ ID NO: 2885310 - DNA, 19 bp, Homo sapiens
agtgattctcctgcctcag

SEQ ID NO: 2885311 - DNA, 22 bp, Homo sapiens
agtgattctcctgcctcagcct

SEQ ID NO: 2885312 - DNA, 15 bp, Homo sapiens
agtgattgttggcac

SEQ ID NO: 2885313 - DNA, 20 bp, Homo sapiens
agtgatttttatgccacctg

SEQ ID NO: 2885314 - DNA, 12 bp, Homo sapiens
agtgcaaaatgt

SEQ ID NO: 2885315 - DNA, 16 bp, Homo sapiens
agtgcaaaatgtcttg

SEQ ID NO: 2885316 - DNA, 13 bp, Homo sapiens
agtgcaacctctg

SEQ ID NO: 2885317 - DNA, 22 bp, Homo sapiens
agtgcaagactgaattaatgag

SEQ ID NO: 2885318 - DNA, 19 bp, Homo sapiens
agtgcacctgcctcagcta

SEQ ID NO: 2885319 - DNA, 21 bp, Homo sapiens
agtgcacctgcctcagctacc

SEQ ID NO: 2885320 - DNA, 23 bp, Homo sapiens
agtgcactccggcctgggtgaca

SEQ ID NO: 2885321 - DNA, 22 bp, Homo sapiens
agtgcagaatgtaagtgggccc

SEQ ID NO: 2885322 - DNA, 12 bp, Homo sapiens
agtgcagagaaa

SEQ ID NO: 2885323 - DNA, 22 bp, Homo sapiens
agtgcagagaaagaaagggaaa

SEQ ID NO: 2885324 - DNA, 21 bp, Homo sapiens
agtgcagcaggttaagaattt

SEQ ID NO: 2885325 - DNA, 18 bp, Homo sapiens
agtgcagccgtttgagaa

SEQ ID NO: 2885326 - DNA, 17 bp, Homo sapiens
agtgcagctaacatgag

SEQ ID NO: 2885327 - DNA, 16 bp, Homo sapiens
agtgcaggctggccag

SEQ ID NO: 2885328 - DNA, 17 bp, Homo sapiens
agtgcaggctggccagc

SEQ ID NO: 2885329 - DNA, 21 bp, Homo sapiens
agtgcaggctggccagccgct

SEQ ID NO: 2885330 - DNA, 16 bp, Homo sapiens
agtgcagtcctgatca

SEQ ID NO: 2885331 - DNA, 23 bp, Homo sapiens
agtgcagtcctgatcagagccgt

SEQ ID NO: 2885332 - DNA, 21 bp, Homo sapiens
agtgcatagaattctagcttt

SEQ ID NO: 2885333 - DNA, 16 bp, Homo sapiens
agtgcatgacgtttaa

SEQ ID NO: 2885334 - DNA, 20 bp, Homo sapiens
agtgcatgctctctgcagcc

SEQ ID NO: 2885335 - DNA, 20 bp, Homo sapiens
agtgcattttgtttctgtat

SEQ ID NO: 2885336 - DNA, 14 bp, Homo sapiens
agtgccaatgttgt

SEQ ID NO: 2885337 - DNA, 10 bp, Homo sapiens
agtgccaggc

SEQ ID NO: 2885338 - DNA, 23 bp, Homo sapiens
agtgccaggctgcggtgggcagc

SEQ ID NO: 2885339 - DNA, 14 bp, Homo sapiens
agtaagcatttcca

SEQ ID NO: 2885340 - DNA, 18 bp, Homo sapiens
agtaaggagttcatttta

SEQ ID NO: 2885341 - DNA, 14 bp, Homo sapiens
agtaatccacctgc

SEQ ID NO: 2885342 - DNA, 19 bp, Homo sapiens
agtaatctaatatggccac

SEQ ID NO: 2885343 - DNA, 13 bp, Homo sapiens
agtaatctgtgta

SEQ ID NO: 2885344 - DNA, 21 bp, Homo sapiens
agtaatctgtgtacaaagaaa

SEQ ID NO: 2885345 - DNA, 18 bp, Homo sapiens
agtaatgctacgtgtgat

SEQ ID NO: 2885346 - DNA, 21 bp, Homo sapiens
agtaatgctacgtgtgatttt

SEQ ID NO: 2885347 - DNA, 13 bp, Homo sapiens
agtaatgtcttca

SEQ ID NO: 2885348 - DNA, 12 bp, Homo sapiens
agtaattatagg

SEQ ID NO: 2885349 - DNA, 13 bp, Homo sapiens
agtaattatagga

SEQ ID NO: 2885350 - DNA, 14 bp, Homo sapiens
agtaattataggaa

SEQ ID NO: 2885351 - DNA, 20 bp, Homo sapiens
agtaattgacatgtgccagg

SEQ ID NO: 2885352 - DNA, 15 bp, Homo sapiens
agtaattgtgaaaaa

SEQ ID NO: 2885353 - DNA, 19 bp, Homo sapiens
agtacaagctcttgtttct

SEQ ID NO: 2885354 - DNA, 19 bp, Homo sapiens
agtacaccacaagggtcac

SEQ ID NO: 2885355 - DNA, 15 bp, Homo sapiens
agtacactgtgtctc

SEQ ID NO: 2885356 - DNA, 19 bp, Homo sapiens
agtacactgtgtctctatg

SEQ ID NO: 2885357 - DNA, 14 bp, Homo sapiens
agtacagatactgt

SEQ ID NO: 2885358 - DNA, 19 bp, Homo sapiens
agtacagatactgtgagct

SEQ ID NO: 2885359 - DNA, 14 bp, Homo sapiens
agtacaggcagcac

SEQ ID NO: 2885360 - DNA, 17 bp, Homo sapiens
agtacaggcagcacaga

SEQ ID NO: 2885361 - DNA, 18 bp, Homo sapiens
agtacaggcagcacagag

SEQ ID NO: 2885362 - DNA, 19 bp, Homo sapiens
agtacaggcagcacagaga

SEQ ID NO: 2885363 - DNA, 22 bp, Homo sapiens
agtacagtatattcttgtaaat

SEQ ID NO: 2885364 - DNA, 15 bp, Homo sapiens
agtacattgtgccct

SEQ ID NO: 2885365 - DNA, 17 bp, Homo sapiens
agtacattgtgcccttg

SEQ ID NO: 2885366 - DNA, 21 bp, Homo sapiens
agtaccagtgagtggccccac

SEQ ID NO: 2885367 - DNA, 22 bp, Homo sapiens
agtacccatgggaataatagac

SEQ ID NO: 2885368 - DNA, 16 bp, Homo sapiens
agtacctcagcattta

SEQ ID NO: 2885369 - DNA, 14 bp, Homo sapiens
agtaccttgcttct

SEQ ID NO: 2885370 - DNA, 12 bp, Homo sapiens
agtaccttgttt

SEQ ID NO: 2885371 - DNA, 13 bp, Homo sapiens
agtaccttgtttt

SEQ ID NO: 2885372 - DNA, 19 bp, Homo sapiens
agtaccttgttttgccatg

SEQ ID NO: 2885373 - DNA, 18 bp, Homo sapiens
agtactaaggtgactttc

SEQ ID NO: 2885374 - DNA, 19 bp, Homo sapiens
agtactaaggtgactttct

SEQ ID NO: 2885375 - DNA, 23 bp, Homo sapiens
agtactaaggtgactttctgaaa

SEQ ID NO: 2885376 - DNA, 12 bp, Homo sapiens
agtactcacttt

SEQ ID NO: 2885377 - DNA, 18 bp, Homo sapiens
agtactgtcccaggaata

SEQ ID NO: 2885378 - DNA, 21 bp, Homo sapiens
agtacttcagcaagagagaac

SEQ ID NO: 2885379 - DNA, 15 bp, Homo sapiens
agtagaacaaaaact

SEQ ID NO: 2885380 - DNA, 17 bp, Homo sapiens
agtagaagcatgtttgt

SEQ ID NO: 2885381 - DNA, 17 bp, Homo sapiens
agtagacattttaacaa

SEQ ID NO: 2885382 - DNA, 23 bp, Homo sapiens
agtagacattttaacaagaagat

SEQ ID NO: 2885383 - DNA, 22 bp, Homo sapiens
agtagacctctttttcttacca

SEQ ID NO: 2885384 - DNA, 19 bp, Homo sapiens
agtagatctgctttctgtt

SEQ ID NO: 2885385 - DNA, 21 bp, Homo sapiens
agtagatctgctttctgttca

SEQ ID NO: 2885386 - DNA, 17 bp, Homo sapiens
agtagattaaaaattat

SEQ ID NO: 2885387 - DNA, 18 bp, Homo sapiens
agtagattaaaaattata

SEQ ID NO: 2885388 - DNA, 19 bp, Homo sapiens
agtagattaaaaattatag

SEQ ID NO: 2885389 - DNA, 21 bp, Homo sapiens
agtagattcttacaaggccct

SEQ ID NO: 2885390 - DNA, 20 bp, Homo sapiens
agtagatttacagaacaaag

SEQ ID NO: 2885391 - DNA, 13 bp, Homo sapiens
agtagattttctt

SEQ ID NO: 2885392 - DNA, 16 bp, Homo sapiens
agtagattttctttaa

SEQ ID NO: 2885393 - DNA, 23 bp, Homo sapiens
agtagattttctttaaaagaatg

SEQ ID NO: 2885394 - DNA, 19 bp, Homo sapiens
agtagcaccaaataaatta

SEQ ID NO: 2885395 - DNA, 17 bp, Homo sapiens
agtagcactgactattt

SEQ ID NO: 2885396 - DNA, 20 bp, Homo sapiens
agtagccaaagttaaatgta

SEQ ID NO: 2885397 - DNA, 22 bp, Homo sapiens
agtagccatgttaacatgacat

SEQ ID NO: 2885398 - DNA, 17 bp, Homo sapiens
agtagccgagagcctgc

SEQ ID NO: 2885399 - DNA, 18 bp, Homo sapiens
agtagccgagagcctgct

SEQ ID NO: 2885400 - DNA, 15 bp, Homo sapiens
agtagctctcctgac

SEQ ID NO: 2885401 - DNA, 17 bp, Homo sapiens
agtagctgctaccttct

SEQ ID NO: 2885402 - DNA, 17 bp, Homo sapiens
agtagctgggactgcag

SEQ ID NO: 2885403 - DNA, 21 bp, Homo sapiens
agtagctgggatgacaggcgc

SEQ ID NO: 2885404 - DNA, 23 bp, Homo sapiens
agtagctgggattacagatctgc

SEQ ID NO: 2885405 - DNA, 18 bp, Homo sapiens
agtagctgggattttaaa

SEQ ID NO: 2885406 - DNA, 15 bp, Homo sapiens
agtagctgtcagatg

SEQ ID NO: 2885407 - DNA, 22 bp, Homo sapiens
agtaggcatttttaccatcact

SEQ ID NO: 2885408 - DNA, 12 bp, Homo sapiens
agtaggccctgc

SEQ ID NO: 2885409 - DNA, 14 bp, Homo sapiens
agtaggtgatgagt

SEQ ID NO: 2885410 - DNA, 18 bp, Homo sapiens
agtagtaaaaattaaaaa

SEQ ID NO: 2885411 - DNA, 19 bp, Homo sapiens
agtagtacctttcagaact

SEQ ID NO: 2885412 - DNA, 14 bp, Homo sapiens
agtagtgtttggaa

SEQ ID NO: 2885413 - DNA, 13 bp, Homo sapiens
agtataatatttc

SEQ ID NO: 2885414 - DNA, 15 bp, Homo sapiens
agtataatgaacact

SEQ ID NO: 2885415 - DNA, 17 bp, Homo sapiens
agtatatacttttaaat

SEQ ID NO: 2885416 - DNA, 18 bp, Homo sapiens
agtatatgaaatattttg

SEQ ID NO: 2885417 - DNA, 22 bp, Homo sapiens
agtatatgaaatattttgaata

SEQ ID NO: 2885418 - DNA, 13 bp, Homo sapiens
agtatatgtcatt

SEQ ID NO: 2885419 - DNA, 15 bp, Homo sapiens
agtatatgtcattta

SEQ ID NO: 2885420 - DNA, 17 bp, Homo sapiens
agtatatgtcatttact

SEQ ID NO: 2885421 - DNA, 14 bp, Homo sapiens
agtatattatgtat

SEQ ID NO: 2885422 - DNA, 15 bp, Homo sapiens
agtatattatgtatt

SEQ ID NO: 2885423 - DNA, 22 bp, Homo sapiens
agtatcaaatattagatgtgat

SEQ ID NO: 2885424 - DNA, 18 bp, Homo sapiens
agtatcaagtgttctaaa

SEQ ID NO: 2885425 - DNA, 17 bp, Homo sapiens
agtatcaggaatataaa

SEQ ID NO: 2885426 - DNA, 15 bp, Homo sapiens
agtatcatgccctgt

SEQ ID NO: 2885427 - DNA, 14 bp, Homo sapiens
agtatccagacctt

SEQ ID NO: 2885428 - DNA, 21 bp, Homo sapiens
agtccccaggccccaggaagc

SEQ ID NO: 2885429 - DNA, 14 bp, Homo sapiens
agtccctgcctgga

SEQ ID NO: 2885430 - DNA, 23 bp, Homo sapiens
agtccctgcctggaccagcctct

SEQ ID NO: 2885431 - DNA, 17 bp, Homo sapiens
agtccctgggagcaagt

SEQ ID NO: 2885432 - DNA, 17 bp, Homo sapiens
agtccctgggggaagcc

SEQ ID NO: 2885433 - DNA, 13 bp, Homo sapiens
agtcccttcctgc

SEQ ID NO: 2885434 - DNA, 19 bp, Homo sapiens
agtcccttttcattctcct

SEQ ID NO: 2885435 - DNA, 21 bp, Homo sapiens
agtcccttttcattctcctcc

SEQ ID NO: 2885436 - DNA, 23 bp, Homo sapiens
agtccgtgctgacagctgctcct

SEQ ID NO: 2885437 - DNA, 19 bp, Homo sapiens
agtcctaaaagttctcaat

SEQ ID NO: 2885438 - DNA, 20 bp, Homo sapiens
agtcctaaaagttctcaatg

SEQ ID NO: 2885439 - DNA, 21 bp, Homo sapiens
agtcctaagaagtggggcaga

SEQ ID NO: 2885440 - DNA, 23 bp, Homo sapiens
agtcctaagaagtggggcagatg

SEQ ID NO: 2885441 - DNA, 23 bp, Homo sapiens
agtcctagttttcctacttataa

SEQ ID NO: 2885442 - DNA, 14 bp, Homo sapiens
agtcctatggaaac

SEQ ID NO: 2885443 - DNA, 13 bp, Homo sapiens
agtcctcctattc

SEQ ID NO: 2885444 - DNA, 12 bp, Homo sapiens
agtcctctgaat

SEQ ID NO: 2885445 - DNA, 14 bp, Homo sapiens
agtcctctgaatga

SEQ ID NO: 2885446 - DNA, 13 bp, Homo sapiens
agtcctgactggg

SEQ ID NO: 2885447 - DNA, 18 bp, Homo sapiens
agtcctgactgggctggg

SEQ ID NO: 2885448 - DNA, 19 bp, Homo sapiens
agtcctgctggcctgctct

SEQ ID NO: 2885449 - DNA, 21 bp, Homo sapiens
agtcctggagcaatcacagat

SEQ ID NO: 2885450 - DNA, 13 bp, Homo sapiens
agtcctggcccaa

SEQ ID NO: 2885451 - DNA, 19 bp, Homo sapiens
agtcctggtcctggctgca

SEQ ID NO: 2885452 - DNA, 14 bp, Homo sapiens
agtccttaaaaatc

SEQ ID NO: 2885453 - DNA, 21 bp, Homo sapiens
agtccttaaaaatcacactgt

SEQ ID NO: 2885454 - DNA, 22 bp, Homo sapiens
agtccttgaaaatattttttat

SEQ ID NO: 2885455 - DNA, 22 bp, Homo sapiens
agtccttttgtaaagtgaagaa

SEQ ID NO: 2885456 - DNA, 13 bp, Homo sapiens
agtcgcttgccaa

SEQ ID NO: 2885457 - DNA, 16 bp, Homo sapiens
agtcgcttgccaaagc

SEQ ID NO: 2885458 - DNA, 16 bp, Homo sapiens
agtcggaaaagcgtct

SEQ ID NO: 2885459 - DNA, 18 bp, Homo sapiens
agtcggcatgccaggacc

SEQ ID NO: 2885460 - DNA, 17 bp, Homo sapiens
agtcggtgaccccatca

SEQ ID NO: 2885461 - DNA, 16 bp, Homo sapiens
agtctaaactgagctc

SEQ ID NO: 2885462 - DNA, 22 bp, Homo sapiens
agtctaaagatggagtttctaa

SEQ ID NO: 2885463 - DNA, 23 bp, Homo sapiens
agtctaaagatggagtttctaag

SEQ ID NO: 2885464 - DNA, 18 bp, Homo sapiens
agtctaagtaagtgtctg

SEQ ID NO: 2885465 - DNA, 22 bp, Homo sapiens
agtctacaaaaaggtataaata

SEQ ID NO: 2885466 - DNA, 17 bp, Homo sapiens
agtctacgctctccttt

SEQ ID NO: 2885467 - DNA, 19 bp, Homo sapiens
agtctactcttaagccatc

SEQ ID NO: 2885468 - DNA, 21 bp, Homo sapiens
agtctactcttaagccatctt

SEQ ID NO: 2885469 - DNA, 19 bp, Homo sapiens
agtctacttctgtgtctgt

SEQ ID NO: 2885470 - DNA, 17 bp, Homo sapiens
agtctagatggctcctc

SEQ ID NO: 2885471 - DNA, 18 bp, Homo sapiens
agtctagatggctcctct

SEQ ID NO: 2885472 - DNA, 23 bp, Homo sapiens
agtctagatgtttattcttctag

SEQ ID NO: 2885473 - DNA, 14 bp, Homo sapiens
agtctagattcaaa

SEQ ID NO: 2885474 - DNA, 18 bp, Homo sapiens
agtctagattcaaaggtt

SEQ ID NO: 2885475 - DNA, 16 bp, Homo sapiens
agtctagattctctgg

SEQ ID NO: 2885476 - DNA, 19 bp, Homo sapiens
agtctagttattggatcag

SEQ ID NO: 2885477 - DNA, 22 bp, Homo sapiens
agtctatcaaccccagacactg

SEQ ID NO: 2885478 - DNA, 16 bp, Homo sapiens
agtctcaagggtggca

SEQ ID NO: 2885479 - DNA, 18 bp, Homo sapiens
agtctcaagggtggcagg

SEQ ID NO: 2885480 - DNA, 13 bp, Homo sapiens
agtctcaattttg

SEQ ID NO: 2885481 - DNA, 21 bp, Homo sapiens
agtctcaattttgtatttaat

SEQ ID NO: 2885482 - DNA, 14 bp, Homo sapiens
agtctcaggaggag

SEQ ID NO: 2885483 - DNA, 16 bp, Homo sapiens
agtctcaggaggaggc

SEQ ID NO: 2885484 - DNA, 12 bp, Homo sapiens
agtctccagggc

SEQ ID NO: 2885485 - DNA, 15 bp, Homo sapiens
agtctccctcacagc

SEQ ID NO: 2885486 - DNA, 19 bp, Homo sapiens
aggtgcctttcaaatttag

SEQ ID NO: 2885487 - DNA, 18 bp, Homo sapiens
aggtgcggcctgggggga

SEQ ID NO: 2885488 - DNA, 17 bp, Homo sapiens
aggtgctaaaattcaga

SEQ ID NO: 2885489 - DNA, 15 bp, Homo sapiens
aggtgctaaatctgc

SEQ ID NO: 2885490 - DNA, 20 bp, Homo sapiens
aggtgctacacccttttcca

SEQ ID NO: 2885491 - DNA, 17 bp, Homo sapiens
aggtgctgacggccagg

SEQ ID NO: 2885492 - DNA, 20 bp, Homo sapiens
aggtgctgacggccagggag

SEQ ID NO: 2885493 - DNA, 12 bp, Homo sapiens
aggtgctggccc

SEQ ID NO: 2885494 - DNA, 18 bp, Homo sapiens
aggtgctggcccagcatg

SEQ ID NO: 2885495 - DNA, 19 bp, Homo sapiens
aggtgctggcccagcatgg

SEQ ID NO: 2885496 - DNA, 17 bp, Homo sapiens
aggtgctggtagctgag

SEQ ID NO: 2885497 - DNA, 19 bp, Homo sapiens
aggtgctggtagctgaggg

SEQ ID NO: 2885498 - DNA, 21 bp, Homo sapiens
aggtgcttctagttctgccag

SEQ ID NO: 2885499 - DNA, 18 bp, Homo sapiens
aggtggaaaaacatctga

SEQ ID NO: 2885500 - DNA, 11 bp, Homo sapiens
aggtggaagcc

SEQ ID NO: 2885501 - DNA, 17 bp, Homo sapiens
aggtggaagccctcctt

SEQ ID NO: 2885502 - DNA, 19 bp, Homo sapiens
aggtggaagccctccttcc

SEQ ID NO: 2885503 - DNA, 16 bp, Homo sapiens
aggtggacctggcagt

SEQ ID NO: 2885504 - DNA, 18 bp, Homo sapiens
aggtggagagcactagaa

SEQ ID NO: 2885505 - DNA, 15 bp, Homo sapiens
aggtggaggttgcat

SEQ ID NO: 2885506 - DNA, 17 bp, Homo sapiens
aggtggatcacctgagg

SEQ ID NO: 2885507 - DNA, 16 bp, Homo sapiens
aggtggcactagggat

SEQ ID NO: 2885508 - DNA, 18 bp, Homo sapiens
aggtggcactagggatca

SEQ ID NO: 2885509 - DNA, 23 bp, Homo sapiens
aggtggcatcagtgtctttccac

SEQ ID NO: 2885510 - DNA, 19 bp, Homo sapiens
aggtggccgcccctgaggc

SEQ ID NO: 2885511 - DNA, 19 bp, Homo sapiens
aggtggctgacccagtccc

SEQ ID NO: 2885512 - DNA, 23 bp, Homo sapiens
aggtggctgacccagtccctggg

SEQ ID NO: 2885513 - DNA, 19 bp, Homo sapiens
aggtggctgagcccctgtc

SEQ ID NO: 2885514 - DNA, 18 bp, Homo sapiens
aggtggctgcctggagcc

SEQ ID NO: 2885515 - DNA, 12 bp, Homo sapiens
aggtgggagctg

SEQ ID NO: 2885516 - DNA, 13 bp, Homo sapiens
aggtgggagctga

SEQ ID NO: 2885517 - DNA, 14 bp, Homo sapiens
aggtgggaggccag

SEQ ID NO: 2885518 - DNA, 19 bp, Homo sapiens
aggtgggaggccaggcgag

SEQ ID NO: 2885519 - DNA, 18 bp, Homo sapiens
aggtggggagactgggct

SEQ ID NO: 2885520 - DNA, 19 bp, Homo sapiens
aggtggggagactgggctg

SEQ ID NO: 2885521 - DNA, 21 bp, Homo sapiens
aggtggggagactgggctgag

SEQ ID NO: 2885522 - DNA, 22 bp, Homo sapiens
aggtggggtctttgtgagagtg

SEQ ID NO: 2885523 - DNA, 17 bp, Homo sapiens
aggtggggtgatggcca

SEQ ID NO: 2885524 - DNA, 21 bp, Homo sapiens
aggtggggtgatggccagagg

SEQ ID NO: 2885525 - DNA, 19 bp, Homo sapiens
aggtgggtggtgggcttct

SEQ ID NO: 2885526 - DNA, 19 bp, Homo sapiens
aggtgggttttcttcccat

SEQ ID NO: 2885527 - DNA, 20 bp, Homo sapiens
aggtggtagtaaaacacaga

SEQ ID NO: 2885528 - DNA, 20 bp, Homo sapiens
aggtggtgtccttcttcctc

SEQ ID NO: 2885529 - DNA, 13 bp, Homo sapiens
aggtggtgtttct

SEQ ID NO: 2885530 - DNA, 23 bp, Homo sapiens
aggtgtcagccattgcacccagc

SEQ ID NO: 2885531 - DNA, 14 bp, Homo sapiens
aggtgtcaggcccg

SEQ ID NO: 2885532 - DNA, 23 bp, Homo sapiens
aggtgtcaggcccgtcggagctg

SEQ ID NO: 2885533 - DNA, 13 bp, Homo sapiens
aggtgtctggcct

SEQ ID NO: 2885534 - DNA, 16 bp, Homo sapiens
aggtgttactgtaatt

SEQ ID NO: 2885535 - DNA, 14 bp, Homo sapiens
aggtgtttatacag

SEQ ID NO: 2885536 - DNA, 13 bp, Homo sapiens
aggtgttttctgt

SEQ ID NO: 2885537 - DNA, 15 bp, Homo sapiens
aggtgttttctgtgt

SEQ ID NO: 2885538 - DNA, 17 bp, Homo sapiens
aggtgttttctgtgtaa

SEQ ID NO: 2885539 - DNA, 18 bp, Homo sapiens
aggtgttttctgtgtaac

SEQ ID NO: 2885540 - DNA, 19 bp, Homo sapiens
aggtgttttctgtgtaacc

SEQ ID NO: 2885541 - DNA, 22 bp, Homo sapiens
aggttaaaaaaaggcattgttt

SEQ ID NO: 2885542 - DNA, 23 bp, Homo sapiens
aggttaaaaaaatggcagtgatg

SEQ ID NO: 2885543 - DNA, 18 bp, Homo sapiens
aggttaaaggaaaagcac

SEQ ID NO: 2885544 - DNA, 19 bp, Homo sapiens
aggttaaaggaaaagcaca

SEQ ID NO: 2885545 - DNA, 23 bp, Homo sapiens
aggttaatttttccttcctctgt

SEQ ID NO: 2885546 - DNA, 15 bp, Homo sapiens
aggttacaacagatt

SEQ ID NO: 2885547 - DNA, 17 bp, Homo sapiens
aggttaccctgtaacat

SEQ ID NO: 2885548 - DNA, 21 bp, Homo sapiens
aggttaccctgtaacatgcaa

SEQ ID NO: 2885549 - DNA, 13 bp, Homo sapiens
aggttagaagaac

SEQ ID NO: 2885550 - DNA, 15 bp, Homo sapiens
aggttagtgacattt

SEQ ID NO: 2885551 - DNA, 17 bp, Homo sapiens
aggttatatgaatatat

SEQ ID NO: 2885552 - DNA, 12 bp, Homo sapiens
aggttattttat

SEQ ID NO: 2885553 - DNA, 13 bp, Homo sapiens
aggttattttata

SEQ ID NO: 2885554 - DNA, 18 bp, Homo sapiens
aggttattttatatttga

SEQ ID NO: 2885555 - DNA, 18 bp, Homo sapiens
aggttccaactgtatata

SEQ ID NO: 2885556 - DNA, 14 bp, Homo sapiens
aggttcccaagctc

SEQ ID NO: 2885557 - DNA, 15 bp, Homo sapiens
aggttcccaagctca

SEQ ID NO: 2885558 - DNA, 15 bp, Homo sapiens
aggttccccaatcca

SEQ ID NO: 2885559 - DNA, 18 bp, Homo sapiens
aggttccgcttggagcag

SEQ ID NO: 2885560 - DNA, 21 bp, Homo sapiens
aggttccgcttggagcagagg

SEQ ID NO: 2885561 - DNA, 12 bp, Homo sapiens
aggttctaaagt

SEQ ID NO: 2885562 - DNA, 19 bp, Homo sapiens
aggttctaaggcctaggat

SEQ ID NO: 2885563 - DNA, 23 bp, Homo sapiens
aggttcttcccttttacatactg

SEQ ID NO: 2885564 - DNA, 16 bp, Homo sapiens
aggttcttcttcctga

SEQ ID NO: 2885565 - DNA, 21 bp, Homo sapiens
aggttcttcttcctgaagctg

SEQ ID NO: 2885566 - DNA, 16 bp, Homo sapiens
aggttgactcaagttt

SEQ ID NO: 2885567 - DNA, 18 bp, Homo sapiens
aggttgagtgagccggga

SEQ ID NO: 2885568 - DNA, 12 bp, Homo sapiens
aggttgataact

SEQ ID NO: 2885569 - DNA, 14 bp, Homo sapiens
aggttgataacttt

SEQ ID NO: 2885570 - DNA, 16 bp, Homo sapiens
aggttgataactttgc

SEQ ID NO: 2885571 - DNA, 18 bp, Homo sapiens
aggttgataactttgctt

SEQ ID NO: 2885572 - DNA, 17 bp, Homo sapiens
aggttgcagtgagctga

SEQ ID NO: 2885573 - DNA, 20 bp, Homo sapiens
aggttgcattgagctgagat

SEQ ID NO: 2885574 - DNA, 18 bp, Homo sapiens
aggttggaaaagaaatca

SEQ ID NO: 2885575 - DNA, 15 bp, Homo sapiens
aggttggagctttgc

SEQ ID NO: 2885576 - DNA, 17 bp, Homo sapiens
aggttggcttttttccc

SEQ ID NO: 2885577 - DNA, 18 bp, Homo sapiens
aggttgtggggaggctgc

SEQ ID NO: 2885578 - DNA, 19 bp, Homo sapiens
aggttgtggggaggctgca

SEQ ID NO: 2885579 - DNA, 20 bp, Homo sapiens
aggttgtggggaggctgcac

SEQ ID NO: 2885580 - DNA, 20 bp, Homo sapiens
aggttgtttttaaaaccact

SEQ ID NO: 2885581 - DNA, 21 bp, Homo sapiens
aggttgtttttaaaaccacta

SEQ ID NO: 2885582 - DNA, 13 bp, Homo sapiens
aggtttaaagagt

SEQ ID NO: 2885583 - DNA, 14 bp, Homo sapiens
aggtttacagaatt

SEQ ID NO: 2885584 - DNA, 21 bp, Homo sapiens
aggtttaggctggtggcccag

SEQ ID NO: 2885585 - DNA, 20 bp, Homo sapiens
aggcttaataaaaatgacag

SEQ ID NO: 2885586 - DNA, 21 bp, Homo sapiens
aggcttaataaaaatgacaga

SEQ ID NO: 2885587 - DNA, 16 bp, Homo sapiens
aggcttaggcatgttc

SEQ ID NO: 2885588 - DNA, 24 bp, Homo sapiens
aggcttcacgccgggagaagccac

SEQ ID NO: 2885589 - DNA, 14 bp, Homo sapiens
aggcttcctggtga

SEQ ID NO: 2885590 - DNA, 22 bp, Homo sapiens
aggcttcttcagatcagtgctt

SEQ ID NO: 2885591 - DNA, 18 bp, Homo sapiens
aggcttgattccaacagg

SEQ ID NO: 2885592 - DNA, 20 bp, Homo sapiens
aggcttgcctgggctgggca

SEQ ID NO: 2885593 - DNA, 15 bp, Homo sapiens
aggcttgttgtgctt

SEQ ID NO: 2885594 - DNA, 19 bp, Homo sapiens
aggctttaagctccagctt

SEQ ID NO: 2885595 - DNA, 22 bp, Homo sapiens
aggctttcccacttcccaccct

SEQ ID NO: 2885596 - DNA, 14 bp, Homo sapiens
aggctttggcccaa

SEQ ID NO: 2885597 - DNA, 23 bp, Homo sapiens
aggctttggggtcctagcccagt

SEQ ID NO: 2885598 - DNA, 20 bp, Homo sapiens
aggctttgtgatagtgacat

SEQ ID NO: 2885599 - DNA, 17 bp, Homo sapiens
agggaaaatgcagcagg

SEQ ID NO: 2885600 - DNA, 22 bp, Homo sapiens
agggaaaatgcagcagggatgc

SEQ ID NO: 2885601 - DNA, 21 bp, Homo sapiens
agggaaaccagagtctgtatt

SEQ ID NO: 2885602 - DNA, 15 bp, Homo sapiens
agggaaactgtgaat

SEQ ID NO: 2885603 - DNA, 16 bp, Homo sapiens
agggaaactgtgaatg

SEQ ID NO: 2885604 - DNA, 23 bp, Homo sapiens
agggaaactgtgaatgcttctga

SEQ ID NO: 2885605 - DNA, 15 bp, Homo sapiens
agggaacagacagga

SEQ ID NO: 2885606 - DNA, 19 bp, Homo sapiens
agggaacagacaggagaaa

SEQ ID NO: 2885607 - DNA, 21 bp, Homo sapiens
agggaacagacaggagaaatg

SEQ ID NO: 2885608 - DNA, 13 bp, Homo sapiens
agggaacatgcag

SEQ ID NO: 2885609 - DNA, 22 bp, Homo sapiens
agggaacccagctctaatacat

SEQ ID NO: 2885610 - DNA, 14 bp, Homo sapiens
agggaactgcttgc

SEQ ID NO: 2885611 - DNA, 21 bp, Homo sapiens
agggaagctacaggttacaac

SEQ ID NO: 2885612 - DNA, 13 bp, Homo sapiens
agggaaggacaga

SEQ ID NO: 2885613 - DNA, 18 bp, Homo sapiens
agggaaggacagaaagga

SEQ ID NO: 2885614 - DNA, 15 bp, Homo sapiens
agggaaggatcccat

SEQ ID NO: 2885615 - DNA, 23 bp, Homo sapiens
agggaaggatcccatgagctcct

SEQ ID NO: 2885616 - DNA, 16 bp, Homo sapiens
agggaaggatttagga

SEQ ID NO: 2885617 - DNA, 15 bp, Homo sapiens
agggaaggcaaaggc

SEQ ID NO: 2885618 - DNA, 21 bp, Homo sapiens
agggaaggcaaaggcagagga

SEQ ID NO: 2885619 - DNA, 13 bp, Homo sapiens
agggaagggcctg

SEQ ID NO: 2885620 - DNA, 12 bp, Homo sapiens
agggaaggggcc

SEQ ID NO: 2885621 - DNA, 19 bp, Homo sapiens
agggaaggggcctccctcc

SEQ ID NO: 2885622 - DNA, 22 bp, Homo sapiens
agggaatatgcattgtctgcaa

SEQ ID NO: 2885623 - DNA, 16 bp, Homo sapiens
agggaatcctcctcca

SEQ ID NO: 2885624 - DNA, 15 bp, Homo sapiens
agggaatcctgacct

SEQ ID NO: 2885625 - DNA, 20 bp, Homo sapiens
agggacagaaaccaaggccc

SEQ ID NO: 2885626 - DNA, 20 bp, Homo sapiens
agggacagaggccccagcct

SEQ ID NO: 2885627 - DNA, 16 bp, Homo sapiens
agggacataagataaa

SEQ ID NO: 2885628 - DNA, 24 bp, Homo sapiens
agggacatgttttgataaagtagt

SEQ ID NO: 2885629 - DNA, 19 bp, Homo sapiens
agggacccggggtctcctg

SEQ ID NO: 2885630 - DNA, 21 bp, Homo sapiens
agggacccggggtctcctgga

SEQ ID NO: 2885631 - DNA, 13 bp, Homo sapiens
agggacctctccc

SEQ ID NO: 2885632 - DNA, 15 bp, Homo sapiens
agggacctctcccag

SEQ ID NO: 2885633 - DNA, 22 bp, Homo sapiens
agggacgaagaagagccacagt

SEQ ID NO: 2885634 - DNA, 15 bp, Homo sapiens
agggacgcctggggg

SEQ ID NO: 2885635 - DNA, 23 bp, Homo sapiens
agggacgcctgggggtgccagga

SEQ ID NO: 2885636 - DNA, 19 bp, Homo sapiens
agggacggccaagaatgta

SEQ ID NO: 2885637 - DNA, 20 bp, Homo sapiens
agggacggctgtgggaccag

SEQ ID NO: 2885638 - DNA, 15 bp, Homo sapiens
agggactagtgagtc

SEQ ID NO: 2885639 - DNA, 20 bp, Homo sapiens
agggactcggcccagggccg

SEQ ID NO: 2885640 - DNA, 15 bp, Homo sapiens
agggactgctgaccc

SEQ ID NO: 2885641 - DNA, 16 bp, Homo sapiens
agggacttaacttgtt

SEQ ID NO: 2885642 - DNA, 11 bp, Homo sapiens
agggacttttg

SEQ ID NO: 2885643 - DNA, 12 bp, Homo sapiens
agggagaaagga

SEQ ID NO: 2885644 - DNA, 17 bp, Homo sapiens
agggagaagacaacaga

SEQ ID NO: 2885645 - DNA, 21 bp, Homo sapiens
agggagaagacaacagaaaga

SEQ ID NO: 2885646 - DNA, 19 bp, Homo sapiens
agggagacccgtccatttg

SEQ ID NO: 2885647 - DNA, 21 bp, Homo sapiens
agggagacctggacacaggcc

SEQ ID NO: 2885648 - DNA, 20 bp, Homo sapiens
agggagacggtttccaggga

SEQ ID NO: 2885649 - DNA, 15 bp, Homo sapiens
agggagagctgagcc

SEQ ID NO: 2885650 - DNA, 15 bp, Homo sapiens
agggagaggctgtgt

SEQ ID NO: 2885651 - DNA, 21 bp, Homo sapiens
agggagaggctgtgtccctgc

SEQ ID NO: 2885652 - DNA, 22 bp, Homo sapiens
agggagatatttaagtataaaa

SEQ ID NO: 2885653 - DNA, 19 bp, Homo sapiens
agggagatgatccagagac

SEQ ID NO: 2885654 - DNA, 19 bp, Homo sapiens
agggagcaagtccttccct

SEQ ID NO: 2885655 - DNA, 21 bp, Homo sapiens
agggagcaagtccttcccttt

SEQ ID NO: 2885656 - DNA, 21 bp, Homo sapiens
agggagccatggaaggtgcca

SEQ ID NO: 2885657 - DNA, 23 bp, Homo sapiens
agggagccatggaaggtgccaga

SEQ ID NO: 2885658 - DNA, 20 bp, Homo sapiens
agggagcctagaagctggtg

SEQ ID NO: 2885659 - DNA, 18 bp, Homo sapiens
agggagcctttggttctg

SEQ ID NO: 2885660 - DNA, 14 bp, Homo sapiens
agggagcggaaagc

SEQ ID NO: 2885661 - DNA, 21 bp, Homo sapiens
agggagcggccggccagcccc

SEQ ID NO: 2885662 - DNA, 14 bp, Homo sapiens
agggagctgaggcc

SEQ ID NO: 2885663 - DNA, 15 bp, Homo sapiens
agggagctgaggcct

SEQ ID NO: 2885664 - DNA, 18 bp, Homo sapiens
agggagctgaggcctccc

SEQ ID NO: 2885665 - DNA, 20 bp, Homo sapiens
agggagctgaggcctccctt

SEQ ID NO: 2885666 - DNA, 21 bp, Homo sapiens
agggagctgaggcctcccttg

SEQ ID NO: 2885667 - DNA, 12 bp, Homo sapiens
agggaggaggag

SEQ ID NO: 2885668 - DNA, 14 bp, Homo sapiens
agggaggcaagccc

SEQ ID NO: 2885669 - DNA, 15 bp, Homo sapiens
agggaggcaagccct

SEQ ID NO: 2885670 - DNA, 16 bp, Homo sapiens
agggaggcaagccctg

SEQ ID NO: 2885671 - DNA, 17 bp, Homo sapiens
agggaggccatctgggg

SEQ ID NO: 2885672 - DNA, 18 bp, Homo sapiens
agggaggcgggggctgcc

SEQ ID NO: 2885673 - DNA, 23 bp, Homo sapiens
agggaggcgtcttcatctccctg

SEQ ID NO: 2885674 - DNA, 12 bp, Homo sapiens
agggagggagcc

SEQ ID NO: 2885675 - DNA, 13 bp, Homo sapiens
agggagggagcca

SEQ ID NO: 2885676 - DNA, 15 bp, Homo sapiens
agggagggagccatg

SEQ ID NO: 2885677 - DNA, 15 bp, Homo sapiens
agggagggagctgag

SEQ ID NO: 2885678 - DNA, 14 bp, Homo sapiens
agggagggccaggg

SEQ ID NO: 2885679 - DNA, 18 bp, Homo sapiens
agggagggccagggaggc

SEQ ID NO: 2885680 - DNA, 15 bp, Homo sapiens
agggagggctgaccc

SEQ ID NO: 2885681 - DNA, 17 bp, Homo sapiens
agggagggctgacccag

SEQ ID NO: 2885682 - DNA, 18 bp, Homo sapiens
agggaggggccggccctg

SEQ ID NO: 2885683 - DNA, 20 bp, Homo sapiens
agggaggggccggctggcct

SEQ ID NO: 2885684 - DNA, 22 bp, Homo sapiens
agggaggggccggctggcctgg

SEQ ID NO: 2885685 - DNA, 19 bp, Homo sapiens
agggaggggcctaggcctc

SEQ ID NO: 2885686 - DNA, 17 bp, Homo sapiens
agggagggtgagctggt

SEQ ID NO: 2885687 - DNA, 16 bp, Homo sapiens
agggagtctcaggagg

SEQ ID NO: 2885688 - DNA, 15 bp, Homo sapiens
agggagtgcagaaca

SEQ ID NO: 2885689 - DNA, 22 bp, Homo sapiens
agggatctggtcctacccatcc

SEQ ID NO: 2885690 - DNA, 18 bp, Homo sapiens
agggatgcaggctcccct

SEQ ID NO: 2885691 - DNA, 20 bp, Homo sapiens
agggatgcaggctcccctga

SEQ ID NO: 2885692 - DNA, 19 bp, Homo sapiens
agggatgccctggaggtgg

SEQ ID NO: 2885693 - DNA, 21 bp, Homo sapiens
agggatgccctggaggtggct

SEQ ID NO: 2885694 - DNA, 20 bp, Homo sapiens
agggatgtgggaatctccca

SEQ ID NO: 2885695 - DNA, 17 bp, Homo sapiens
agggattacccaagcaa

SEQ ID NO: 2885696 - DNA, 18 bp, Homo sapiens
agggattacccaagcaaa

SEQ ID NO: 2885697 - DNA, 12 bp, Homo sapiens
agggcaagtctt

SEQ ID NO: 2885698 - DNA, 21 bp, Homo sapiens
agggcaattgagggactgagc

SEQ ID NO: 2885699 - DNA, 19 bp, Homo sapiens
agggcacagatgaccaaag

SEQ ID NO: 2885700 - DNA, 16 bp, Homo sapiens
agggcagaggaagaga

SEQ ID NO: 2885701 - DNA, 14 bp, Homo sapiens
agggcagaggctgg

SEQ ID NO: 2885702 - DNA, 12 bp, Homo sapiens
agggcagagtga

SEQ ID NO: 2885703 - DNA, 16 bp, Homo sapiens
agggcagatggacttc

SEQ ID NO: 2885704 - DNA, 15 bp, Homo sapiens
agggcagcagggcta

SEQ ID NO: 2885705 - DNA, 14 bp, Homo sapiens
agggcagccctcca

SEQ ID NO: 2885706 - DNA, 14 bp, Homo sapiens
agggcagcgccagg

SEQ ID NO: 2885707 - DNA, 16 bp, Homo sapiens
agggcagcgccaggct

SEQ ID NO: 2885708 - DNA, 15 bp, Homo sapiens
agggcagctgcctgg

SEQ ID NO: 2885709 - DNA, 12 bp, Homo sapiens
agggcagggccc

SEQ ID NO: 2885710 - DNA, 17 bp, Homo sapiens
agggcagggccccaggc

SEQ ID NO: 2885711 - DNA, 11 bp, Homo sapiens
agggcaggtgg

SEQ ID NO: 2885712 - DNA, 12 bp, Homo sapiens
agggcaggtggg

SEQ ID NO: 2885713 - DNA, 19 bp, Homo sapiens
aggtgaataataaaatcaa

SEQ ID NO: 2885714 - DNA, 17 bp, Homo sapiens
aggtgaatgtcttcctt

SEQ ID NO: 2885715 - DNA, 22 bp, Homo sapiens
aggtgaattaatggacagtctg

SEQ ID NO: 2885716 - DNA, 13 bp, Homo sapiens
aggtgaccgccca

SEQ ID NO: 2885717 - DNA, 21 bp, Homo sapiens
aggtgaggcgttctcctgctt

SEQ ID NO: 2885718 - DNA, 18 bp, Homo sapiens
aggtgagtgtgagggcag

SEQ ID NO: 2885719 - DNA, 19 bp, Homo sapiens
aggtgagtgtgagggcagc

SEQ ID NO: 2885720 - DNA, 15 bp, Homo sapiens
aggtgatcccgtttt

SEQ ID NO: 2885721 - DNA, 13 bp, Homo sapiens
aggtgcagaggaa

SEQ ID NO: 2885722 - DNA, 13 bp, Homo sapiens
aggtgcagccaga

SEQ ID NO: 2885723 - DNA, 15 bp, Homo sapiens
aggtgcagccagagg

SEQ ID NO: 2885724 - DNA, 18 bp, Homo sapiens
aggtgcagccagaggcac

SEQ ID NO: 2885725 - DNA, 16 bp, Homo sapiens
aggtgcatctgcaggc

SEQ ID NO: 2885726 - DNA, 14 bp, Homo sapiens
aggtgccagaagga

SEQ ID NO: 2885727 - DNA, 16 bp, Homo sapiens
aggtgccagaaggaag

SEQ ID NO: 2885728 - DNA, 13 bp, Homo sapiens
aggtgccatgtct

SEQ ID NO: 2885729 - DNA, 11 bp, Homo sapiens
aggtgcctgtg

SEQ ID NO: 2885730 - DNA, 17 bp, Homo sapiens
aggtgcctgtgaggcag

SEQ ID NO: 2885731 - DNA, 21 bp, Homo sapiens
aggtgcctgtgaggcaggggc

SEQ ID NO: 2885732 - DNA, 11 bp, Homo sapiens
aggtgccttct

SEQ ID NO: 2885733 - DNA, 13 bp, Homo sapiens
aggtgccttctta

SEQ ID NO: 2885734 - DNA, 22 bp, Homo sapiens
aggtgccttcttattctcactc

SEQ ID NO: 2885735 - DNA, 16 bp, Homo sapiens
aggtgccttcttcagg

SEQ ID NO: 2885736 - DNA, 18 bp, Homo sapiens
aggtgccttcttcagggc

SEQ ID NO: 2885737 - DNA, 21 bp, Homo sapiens
aggtgccttcttcagggcctg

SEQ ID NO: 2885738 - DNA, 22 bp, Homo sapiens
aggtgccttcttcagggcctgg

SEQ ID NO: 2885739 - DNA, 15 bp, Homo sapiens
aggtgcctttcaaat

SEQ ID NO: 2885740 - DNA, 18 bp, Homo sapiens
aggtgcctttcaaattta

SEQ ID NO: 2885741 - DNA, 18 bp, Homo sapiens
aggccgcggcctccccga

SEQ ID NO: 2885742 - DNA, 17 bp, Homo sapiens
aggccgctgttcaccca

SEQ ID NO: 2885743 - DNA, 17 bp, Homo sapiens
aggccggccctgcccct

SEQ ID NO: 2885744 - DNA, 20 bp, Homo sapiens
aggccggccctgcccctccc

SEQ ID NO: 2885745 - DNA, 22 bp, Homo sapiens
aggccggccctgcccctcccta

SEQ ID NO: 2885746 - DNA, 19 bp, Homo sapiens
aggccggcgagccctgtgg

SEQ ID NO: 2885747 - DNA, 20 bp, Homo sapiens
aggagcttctggggtcccca

SEQ ID NO: 2885748 - DNA, 22 bp, Homo sapiens
aggagcttctggggtccccagg

SEQ ID NO: 2885749 - DNA, 18 bp, Homo sapiens
aggagctttcttgtttct

SEQ ID NO: 2885750 - DNA, 19 bp, Homo sapiens
aggagctttcttgtttctt

SEQ ID NO: 2885751 - DNA, 20 bp, Homo sapiens
aggagctttcttgtttctta

SEQ ID NO: 2885752 - DNA, 15 bp, Homo sapiens
aggaggacaagaccc

SEQ ID NO: 2885753 - DNA, 17 bp, Homo sapiens
aggaggaggattgtgct

SEQ ID NO: 2885754 - DNA, 12 bp, Homo sapiens
aggaggaggctg

SEQ ID NO: 2885755 - DNA, 18 bp, Homo sapiens
aggaggaggctgccctga

SEQ ID NO: 2885756 - DNA, 17 bp, Homo sapiens
aggaggaggtgggggct

SEQ ID NO: 2885757 - DNA, 15 bp, Homo sapiens
aggaggattgtgctg

SEQ ID NO: 2885758 - DNA, 13 bp, Homo sapiens
aggaggccaggcc

SEQ ID NO: 2885759 - DNA, 22 bp, Homo sapiens
aggaggccaggccggcgagccc

SEQ ID NO: 2885760 - DNA, 20 bp, Homo sapiens
aggaggcggcagctcttctg

SEQ ID NO: 2885761 - DNA, 17 bp, Homo sapiens
aggaggctgagacagga

SEQ ID NO: 2885762 - DNA, 17 bp, Homo sapiens
aggaggctgaggcagaa

SEQ ID NO: 2885763 - DNA, 21 bp, Homo sapiens
aggaggctgccctgaggggct

SEQ ID NO: 2885764 - DNA, 23 bp, Homo sapiens
aggaggctgccctgaggggctgg

SEQ ID NO: 2885765 - DNA, 13 bp, Homo sapiens
aggaggctggctt

SEQ ID NO: 2885766 - DNA, 23 bp, Homo sapiens
aggaggctttaagctccagcttt

SEQ ID NO: 2885767 - DNA, 14 bp, Homo sapiens
aggagggagaaagg

SEQ ID NO: 2885768 - DNA, 18 bp, Homo sapiens
aggagggagaaaggagaa

SEQ ID NO: 2885769 - DNA, 17 bp, Homo sapiens
aggagggcgtgactcac

SEQ ID NO: 2885770 - DNA, 17 bp, Homo sapiens
aggaggggaaaaaaatg

SEQ ID NO: 2885771 - DNA, 18 bp, Homo sapiens
aggaggggacgggacaga

SEQ ID NO: 2885772 - DNA, 23 bp, Homo sapiens
aggaggtaaaggatgagggttca

SEQ ID NO: 2885773 - DNA, 18 bp, Homo sapiens
aggaatcttgctccaata

SEQ ID NO: 2885774 - DNA, 16 bp, Homo sapiens
aggaatgaaaaaagct

SEQ ID NO: 2885775 - DNA, 14 bp, Homo sapiens
aggaatgagaagta

SEQ ID NO: 2885776 - DNA, 12 bp, Homo sapiens
aggaatggacag

SEQ ID NO: 2885777 - DNA, 14 bp, Homo sapiens
aggaatgtgtgcct

SEQ ID NO: 2885778 - DNA, 21 bp, Homo sapiens
aggaatgtttcagctgcagtt

SEQ ID NO: 2885779 - DNA, 23 bp, Homo sapiens
aggaattgattgtcagccacctc

SEQ ID NO: 2885780 - DNA, 11 bp, Homo sapiens
aggaatttaaa

SEQ ID NO: 2885781 - DNA, 14 bp, Homo sapiens
aggaatttaaaatt

SEQ ID NO: 2885782 - DNA, 20 bp, Homo sapiens
aggaatttcccaggaccctg

SEQ ID NO: 2885783 - DNA, 13 bp, Homo sapiens
aggaatttgggac

SEQ ID NO: 2885784 - DNA, 15 bp, Homo sapiens
aggacaaaatcacat

SEQ ID NO: 2885785 - DNA, 13 bp, Homo sapiens
aggacaaacagtg

SEQ ID NO: 2885786 - DNA, 14 bp, Homo sapiens
aggacaacgaggaa

SEQ ID NO: 2885787 - DNA, 16 bp, Homo sapiens
aggacaacgaggaagc

SEQ ID NO: 2885788 - DNA, 14 bp, Homo sapiens
aggacaagaccctc

SEQ ID NO: 2885789 - DNA, 23 bp, Homo sapiens
aggacagaaaggagagtggccat

SEQ ID NO: 2885790 - DNA, 22 bp, Homo sapiens
aggacagactggccgggcaggc

SEQ ID NO: 2885791 - DNA, 12 bp, Homo sapiens
aggacagagcca

SEQ ID NO: 2885792 - DNA, 22 bp, Homo sapiens
aggacagcctgtggcggtgcct

SEQ ID NO: 2885793 - DNA, 23 bp, Homo sapiens
aggacagcctgtggcggtgcctg

SEQ ID NO: 2885794 - DNA, 12 bp, Homo sapiens
aggacagctgtc

SEQ ID NO: 2885795 - DNA, 14 bp, Homo sapiens
aggacattccaaga

SEQ ID NO: 2885796 - DNA, 16 bp, Homo sapiens
aggacattccaagaca

SEQ ID NO: 2885797 - DNA, 18 bp, Homo sapiens
aggacattccaagacagt

SEQ ID NO: 2885798 - DNA, 14 bp, Homo sapiens
aggacatttctcta

SEQ ID NO: 2885799 - DNA, 18 bp, Homo sapiens
aggacattttctctttaa

SEQ ID NO: 2885800 - DNA, 18 bp, Homo sapiens
aggaccaacatccagtcc

SEQ ID NO: 2885801 - DNA, 13 bp, Homo sapiens
aggaccagctcag

SEQ ID NO: 2885802 - DNA, 24 bp, Homo sapiens
aggaccagctcaggacagatgcca

SEQ ID NO: 2885803 - DNA, 15 bp, Homo sapiens
aggaccaggacccag

SEQ ID NO: 2885804 - DNA, 18 bp, Homo sapiens
aggaccaggacccaggga

SEQ ID NO: 2885805 - DNA, 21 bp, Homo sapiens
aggaccaggacccagggagag

SEQ ID NO: 2885806 - DNA, 18 bp, Homo sapiens
aggaccaggatccagcct

SEQ ID NO: 2885807 - DNA, 19 bp, Homo sapiens
aggaccagtcaacctgggc

SEQ ID NO: 2885808 - DNA, 12 bp, Homo sapiens
aggacccaagca

SEQ ID NO: 2885809 - DNA, 14 bp, Homo sapiens
agcttagcaggaga

SEQ ID NO: 2885810 - DNA, 22 bp, Homo sapiens
agcttagcaggagaggagagcc

SEQ ID NO: 2885811 - DNA, 23 bp, Homo sapiens
agcttataagagggcatatacag

SEQ ID NO: 2885812 - DNA, 14 bp, Homo sapiens
agcttatctccctg

SEQ ID NO: 2885813 - DNA, 19 bp, Homo sapiens
agcttatctccctgcttca

SEQ ID NO: 2885814 - DNA, 21 bp, Homo sapiens
agcttatctccctgcttcata

SEQ ID NO: 2885815 - DNA, 13 bp, Homo sapiens
agcttatctcttt

SEQ ID NO: 2885816 - DNA, 23 bp, Homo sapiens
agcttatctcttttatatttgta

SEQ ID NO: 2885817 - DNA, 16 bp, Homo sapiens
agcttatggcatctca

SEQ ID NO: 2885818 - DNA, 13 bp, Homo sapiens
agcttcaaaaact

SEQ ID NO: 2885819 - DNA, 18 bp, Homo sapiens
agcttcaccccaatccca

SEQ ID NO: 2885820 - DNA, 20 bp, Homo sapiens
agcttcaccccaatcccagc

SEQ ID NO: 2885821 - DNA, 19 bp, Homo sapiens
agcttcacgattatgacta

SEQ ID NO: 2885822 - DNA, 18 bp, Homo sapiens
agcttcactgtaaaataa

SEQ ID NO: 2885823 - DNA, 16 bp, Homo sapiens
agcttcaggaacctcg

SEQ ID NO: 2885824 - DNA, 19 bp, Homo sapiens
agcttcatggcagaaggca

SEQ ID NO: 2885825 - DNA, 20 bp, Homo sapiens
agcttcccacacctgcctgc

SEQ ID NO: 2885826 - DNA, 17 bp, Homo sapiens
agcttcccctctctcct

SEQ ID NO: 2885827 - DNA, 20 bp, Homo sapiens
agcttcctagcttatctccc

SEQ ID NO: 2885828 - DNA, 14 bp, Homo sapiens
agcttcctccagag

SEQ ID NO: 2885829 - DNA, 20 bp, Homo sapiens
agcttcctgtccccatctgt

SEQ ID NO: 2885830 - DNA, 21 bp, Homo sapiens
agcttcctgtccccatctgtc

SEQ ID NO: 2885831 - DNA, 21 bp, Homo sapiens
agcttctggtgaccttccaag

SEQ ID NO: 2885832 - DNA, 22 bp, Homo sapiens
agcttctggtgaccttccaaga

SEQ ID NO: 2885833 - DNA, 23 bp, Homo sapiens
agcttgaaagcagttaaactgat

SEQ ID NO: 2885834 - DNA, 22 bp, Homo sapiens
agcttgagtctcaagggtggca

SEQ ID NO: 2885835 - DNA, 18 bp, Homo sapiens
agcttgcagtgaagtgtt

SEQ ID NO: 2885836 - DNA, 20 bp, Homo sapiens
agcttgccagggatgggcag

SEQ ID NO: 2885837 - DNA, 21 bp, Homo sapiens
agcttgccagggatgggcagc

SEQ ID NO: 2885838 - DNA, 19 bp, Homo sapiens
agcttgctcttcagtggga

SEQ ID NO: 2885839 - DNA, 17 bp, Homo sapiens
agcttgtggcaagtgaa

SEQ ID NO: 2885840 - DNA, 18 bp, Homo sapiens
agcttgtggcaagtgaat

SEQ ID NO: 2885841 - DNA, 15 bp, Homo sapiens
agctttaaaaagaaa

SEQ ID NO: 2885842 - DNA, 13 bp, Homo sapiens
agctttaaaagaa

SEQ ID NO: 2885843 - DNA, 20 bp, Homo sapiens
agctttactgtggctgtctg

SEQ ID NO: 2885844 - DNA, 16 bp, Homo sapiens
agctttagacagcaga

SEQ ID NO: 2885845 - DNA, 22 bp, Homo sapiens
agctttatttatagaaatgaca

SEQ ID NO: 2885846 - DNA, 23 bp, Homo sapiens
agctttatttttctttaaagcca

SEQ ID NO: 2885847 - DNA, 15 bp, Homo sapiens
agctttccccagccc

SEQ ID NO: 2885848 - DNA, 13 bp, Homo sapiens
agctttcctggaa

SEQ ID NO: 2885849 - DNA, 18 bp, Homo sapiens
agctttctgccttagcct

SEQ ID NO: 2885850 - DNA, 17 bp, Homo sapiens
agctttcttcagctgcc

SEQ ID NO: 2885851 - DNA, 14 bp, Homo sapiens
agctttcttgtttc

SEQ ID NO: 2885852 - DNA, 15 bp, Homo sapiens
agctttcttgtttct

SEQ ID NO: 2885853 - DNA, 22 bp, Homo sapiens
agctttgaggtggaagagggct

SEQ ID NO: 2885854 - DNA, 21 bp, Homo sapiens
agctgctcccacacttgtgcc

SEQ ID NO: 2885855 - DNA, 19 bp, Homo sapiens
agctgctcctagagggagg

SEQ ID NO: 2885856 - DNA, 16 bp, Homo sapiens
agctgctgccactctg

SEQ ID NO: 2885857 - DNA, 18 bp, Homo sapiens
agctgctgccactctgct

SEQ ID NO: 2885858 - DNA, 23 bp, Homo sapiens
agctgctgccactctgctgcctg

SEQ ID NO: 2885859 - DNA, 19 bp, Homo sapiens
agctgctgtgactgtgtcc

SEQ ID NO: 2885860 - DNA, 13 bp, Homo sapiens
agctgctgttgaa

SEQ ID NO: 2885861 - DNA, 18 bp, Homo sapiens
agctggaaacttctgtaa

SEQ ID NO: 2885862 - DNA, 23 bp, Homo sapiens
agctggagatctgaacccagctg

SEQ ID NO: 2885863 - DNA, 23 bp, Homo sapiens
agctggagcccgtgccctaccac

SEQ ID NO: 2885864 - DNA, 16 bp, Homo sapiens
agctggagtgctgctt

SEQ ID NO: 2885865 - DNA, 22 bp, Homo sapiens
agctggagtgctgcttgtgcct

SEQ ID NO: 2885866 - DNA, 20 bp, Homo sapiens
agctggatgatggtcttcag

SEQ ID NO: 2885867 - DNA, 16 bp, Homo sapiens
agctggcagcagagtg

SEQ ID NO: 2885868 - DNA, 18 bp, Homo sapiens
agctggccaaagagcctt

SEQ ID NO: 2885869 - DNA, 19 bp, Homo sapiens
agctggccaaagagccttt

SEQ ID NO: 2885870 - DNA, 22 bp, Homo sapiens
agctggccaaagagcctttcca

SEQ ID NO: 2885871 - DNA, 15 bp, Homo sapiens
agctggcccactgct

SEQ ID NO: 2885872 - DNA, 19 bp, Homo sapiens
agctggcccactgctggct

SEQ ID NO: 2885873 - DNA, 22 bp, Homo sapiens
agctggcccactgctggctgca

SEQ ID NO: 2885874 - DNA, 11 bp, Homo sapiens
agctggcccag

SEQ ID NO: 2885875 - DNA, 19 bp, Homo sapiens
agctggccccgccgcctgg

SEQ ID NO: 2885876 - DNA, 14 bp, Homo sapiens
agctggctggggtg

SEQ ID NO: 2885877 - DNA, 21 bp, Homo sapiens
agctggctggggtggcctgtg

SEQ ID NO: 2885878 - DNA, 21 bp, Homo sapiens
agctgggacaccccgactttt

SEQ ID NO: 2885879 - DNA, 12 bp, Homo sapiens
agctgggaggaa

SEQ ID NO: 2885880 - DNA, 17 bp, Homo sapiens
agctgggatcccacagc

SEQ ID NO: 2885881 - DNA, 18 bp, Homo sapiens
agctgggatcccacagcc

SEQ ID NO: 2885882 - DNA, 12 bp, Homo sapiens
agctgggcccac

SEQ ID NO: 2885883 - DNA, 20 bp, Homo sapiens
agctgggcccacagccccca

SEQ ID NO: 2885884 - DNA, 12 bp, Homo sapiens
agctggggaggt

SEQ ID NO: 2885885 - DNA, 23 bp, Homo sapiens
agctggggaggtgggaggccagg

SEQ ID NO: 2885886 - DNA, 19 bp, Homo sapiens
agctgggggtgggccaggc

SEQ ID NO: 2885887 - DNA, 20 bp, Homo sapiens
agctgggtaatcgatggggg

SEQ ID NO: 2885888 - DNA, 20 bp, Homo sapiens
agctggtaatcttgctctgc

SEQ ID NO: 2885889 - DNA, 23 bp, Homo sapiens
agctggtgccaaatagccccaga

SEQ ID NO: 2885890 - DNA, 15 bp, Homo sapiens
agctggtgcccccag

SEQ ID NO: 2885891 - DNA, 17 bp, Homo sapiens
agctggtgcccccagac

SEQ ID NO: 2885892 - DNA, 23 bp, Homo sapiens
agctggtgcccccagacagctgc

SEQ ID NO: 2885893 - DNA, 15 bp, Homo sapiens
agctggtggacccag

SEQ ID NO: 2885894 - DNA, 20 bp, Homo sapiens
agctggtggatggtgacttt

SEQ ID NO: 2885895 - DNA, 21 bp, Homo sapiens
agctggtggatggtgactttt

SEQ ID NO: 2885896 - DNA, 18 bp, Homo sapiens
agctggtggcctctgcag

SEQ ID NO: 2885897 - DNA, 13 bp, Homo sapiens
agctggtgggaag

SEQ ID NO: 2885898 - DNA, 18 bp, Homo sapiens
agctggtttcctgcccag

SEQ ID NO: 2885899 - DNA, 13 bp, Homo sapiens
agctgtatgattt

SEQ ID NO: 2885900 - DNA, 14 bp, Homo sapiens
agctgtatgatttg

SEQ ID NO: 2885901 - DNA, 16 bp, Homo sapiens
agctgtatgatttgtt

SEQ ID NO: 2885902 - DNA, 20 bp, Homo sapiens
agctgtatgatttgttttga

SEQ ID NO: 2885903 - DNA, 15 bp, Homo sapiens
agctgtattccttta

SEQ ID NO: 2885904 - DNA, 21 bp, Homo sapiens
agctgtccaaaataataacat

SEQ ID NO: 2885905 - DNA, 20 bp, Homo sapiens
agctgtccctgtcaccaagc

SEQ ID NO: 2885906 - DNA, 22 bp, Homo sapiens
agctgtccctgtcaccaagctc

SEQ ID NO: 2885907 - DNA, 19 bp, Homo sapiens
agctgtgcaattactgcct

SEQ ID NO: 2885908 - DNA, 10 bp, Homo sapiens
agctgtgcag

SEQ ID NO: 2885909 - DNA, 18 bp, Homo sapiens
agctgtgcaggtggggag

SEQ ID NO: 2885910 - DNA, 15 bp, Homo sapiens
agctgtggtcccacc

SEQ ID NO: 2885911 - DNA, 21 bp, Homo sapiens
agctgtgtccttgcacctgca

SEQ ID NO: 2885912 - DNA, 16 bp, Homo sapiens
agctgtgtctctgtat

SEQ ID NO: 2885913 - DNA, 22 bp, Homo sapiens
agctgtgtgtgttagcttgtat

SEQ ID NO: 2885914 - DNA, 16 bp, Homo sapiens
agctgtgtgttttcaa

SEQ ID NO: 2885915 - DNA, 21 bp, Homo sapiens
agctgtgtgttttcaatcctt

SEQ ID NO: 2885916 - DNA, 13 bp, Homo sapiens
agctgtgttgaaa

SEQ ID NO: 2885917 - DNA, 20 bp, Homo sapiens
agctgtgttgaaacagaaaa

SEQ ID NO: 2885918 - DNA, 23 bp, Homo sapiens
agctgtgttgttgcttcttgtga

SEQ ID NO: 2885919 - DNA, 18 bp, Homo sapiens
agctgttcagttgccact

SEQ ID NO: 2885920 - DNA, 14 bp, Homo sapiens
agctgttcctgtgt

SEQ ID NO: 2885921 - DNA, 19 bp, Homo sapiens
agctgttcctgttcagtaa

SEQ ID NO: 2885922 - DNA, 22 bp, Homo sapiens
agctgttctcattcctgttctt

SEQ ID NO: 2885923 - DNA, 14 bp, Homo sapiens
agctgttgcaggca

SEQ ID NO: 2885924 - DNA, 15 bp, Homo sapiens
agctgttgcaggcag

SEQ ID NO: 2885925 - DNA, 17 bp, Homo sapiens
agctgttgcaggcagtg

SEQ ID NO: 2885926 - DNA, 18 bp, Homo sapiens
agctgttgcaggcagtgt

SEQ ID NO: 2885927 - DNA, 21 bp, Homo sapiens
agctgttgcaggcagtgtctt

SEQ ID NO: 2885928 - DNA, 22 bp, Homo sapiens
agctgttgcaggcagtgtctta

SEQ ID NO: 2885929 - DNA, 23 bp, Homo sapiens
agctgttgcaggcagtgtcttaa

SEQ ID NO: 2885930 - DNA, 19 bp, Homo sapiens
agctgttgggagaaagcaa

SEQ ID NO: 2885931 - DNA, 15 bp, Homo sapiens
agctgtttacagaca

SEQ ID NO: 2885932 - DNA, 20 bp, Homo sapiens
agcttaagggaatatgcatt

SEQ ID NO: 2885933 - DNA, 22 bp, Homo sapiens
agcttacattgaaaacagatat

SEQ ID NO: 2885934 - DNA, 15 bp, Homo sapiens
agcttagactaaggc

SEQ ID NO: 2885935 - DNA, 14 bp, Homo sapiens
agcttagattctgt

SEQ ID NO: 2885936 - DNA, 17 bp, Homo sapiens
agcttagattttctgta

SEQ ID NO: 2885937 - DNA, 17 bp, Homo sapiens
agctcctcccctgccgc

SEQ ID NO: 2885938 - DNA, 18 bp, Homo sapiens
agctcctcccctgccgcc

SEQ ID NO: 2885939 - DNA, 19 bp, Homo sapiens
agctcctcccctgccgcct

SEQ ID NO: 2885940 - DNA, 23 bp, Homo sapiens
agctcctcccctgccgcctcccg

SEQ ID NO: 2885941 - DNA, 14 bp, Homo sapiens
agctcctcctccct

SEQ ID NO: 2885942 - DNA, 16 bp, Homo sapiens
agctcctctccccagc

SEQ ID NO: 2885943 - DNA, 19 bp, Homo sapiens
agctcctctccccagccca

SEQ ID NO: 2885944 - DNA, 22 bp, Homo sapiens
agctcctctccccagcccagag

SEQ ID NO: 2885945 - DNA, 13 bp, Homo sapiens
agctcctcttcct

SEQ ID NO: 2885946 - DNA, 17 bp, Homo sapiens
agctccttaaggctctt

SEQ ID NO: 2885947 - DNA, 22 bp, Homo sapiens
agctccttaaggctcttttgta

SEQ ID NO: 2885948 - DNA, 12 bp, Homo sapiens
agctccttggga

SEQ ID NO: 2885949 - DNA, 15 bp, Homo sapiens
agctccttgggaggc

SEQ ID NO: 2885950 - DNA, 16 bp, Homo sapiens
agctccttttctgtga

SEQ ID NO: 2885951 - DNA, 16 bp, Homo sapiens
agctcgcagcccccgc

SEQ ID NO: 2885952 - DNA, 23 bp, Homo sapiens
agctcgcagcccccgcgccctcc

SEQ ID NO: 2885953 - DNA, 18 bp, Homo sapiens
agctcgcatccagacagt

SEQ ID NO: 2885954 - DNA, 15 bp, Homo sapiens
agctcgggtctccct

SEQ ID NO: 2885955 - DNA, 16 bp, Homo sapiens
agctctaaaacataga

SEQ ID NO: 2885956 - DNA, 17 bp, Homo sapiens
agctctaagcagccagg

SEQ ID NO: 2885957 - DNA, 21 bp, Homo sapiens
agctctacacaacatgtatgt

SEQ ID NO: 2885958 - DNA, 14 bp, Homo sapiens
agctctagaatctg

SEQ ID NO: 2885959 - DNA, 15 bp, Homo sapiens
agctctagaatctgc

SEQ ID NO: 2885960 - DNA, 23 bp, Homo sapiens
agctctcatctgaggcatccagc

SEQ ID NO: 2885961 - DNA, 14 bp, Homo sapiens
agctctccaggcca

SEQ ID NO: 2885962 - DNA, 13 bp, Homo sapiens
agctctccctctg

SEQ ID NO: 2885963 - DNA, 16 bp, Homo sapiens
agctctccctctggcc

SEQ ID NO: 2885964 - DNA, 17 bp, Homo sapiens
agctctccctctggccc

SEQ ID NO: 2885965 - DNA, 18 bp, Homo sapiens
agctctccctctggccct

SEQ ID NO: 2885966 - DNA, 14 bp, Homo sapiens
agctctcctgactt

SEQ ID NO: 2885967 - DNA, 16 bp, Homo sapiens
agctctgacccacagc

SEQ ID NO: 2885968 - DNA, 21 bp, Homo sapiens
agctctgacccacagcctcca

SEQ ID NO: 2885969 - DNA, 20 bp, Homo sapiens
agctctgaggactgcaccat

SEQ ID NO: 2885970 - DNA, 19 bp, Homo sapiens
agctctgccgtctctggag

SEQ ID NO: 2885971 - DNA, 20 bp, Homo sapiens
agctctgccgtctctggagc

SEQ ID NO: 2885972 - DNA, 12 bp, Homo sapiens
agctctgcctca

SEQ ID NO: 2885973 - DNA, 14 bp, Homo sapiens
agctctgcgccagg

SEQ ID NO: 2885974 - DNA, 17 bp, Homo sapiens
agctctggacagcccca

SEQ ID NO: 2885975 - DNA, 21 bp, Homo sapiens
agctctggacagccccaccct

SEQ ID NO: 2885976 - DNA, 16 bp, Homo sapiens
agctctggacgtgaaa

SEQ ID NO: 2885977 - DNA, 18 bp, Homo sapiens
agctctggcttcctgctg

SEQ ID NO: 2885978 - DNA, 12 bp, Homo sapiens
agctctgtatca

SEQ ID NO: 2885979 - DNA, 22 bp, Homo sapiens
agctctgtatcaggacccagag

SEQ ID NO: 2885980 - DNA, 21 bp, Homo sapiens
agctctgtcctgttaggccaa

SEQ ID NO: 2885981 - DNA, 20 bp, Homo sapiens
agctctgtgggtctctggaa

SEQ ID NO: 2885982 - DNA, 18 bp, Homo sapiens
agctcttcatctgcccaa

SEQ ID NO: 2885983 - DNA, 19 bp, Homo sapiens
agctcttcatctgcccaac

SEQ ID NO: 2885984 - DNA, 23 bp, Homo sapiens
agctcttccatttcgtttagctg

SEQ ID NO: 2885985 - DNA, 20 bp, Homo sapiens
agctcttctgccggccctgg

SEQ ID NO: 2885986 - DNA, 13 bp, Homo sapiens
agctcttctgggc

SEQ ID NO: 2885987 - DNA, 14 bp, Homo sapiens
agctcttctgggca

SEQ ID NO: 2885988 - DNA, 21 bp, Homo sapiens
agctcttctgggcagagcctg

SEQ ID NO: 2885989 - DNA, 22 bp, Homo sapiens
agctcttctgggcagagcctgt

SEQ ID NO: 2885990 - DNA, 21 bp, Homo sapiens
agctcttctgtgccctggctc

SEQ ID NO: 2885991 - DNA, 18 bp, Homo sapiens
agctcttcttaaagtatt

SEQ ID NO: 2885992 - DNA, 14 bp, Homo sapiens
agctcttgctctct

SEQ ID NO: 2885993 - DNA, 16 bp, Homo sapiens
agctcttggctccact

SEQ ID NO: 2885994 - DNA, 14 bp, Homo sapiens
agctcttgggcctg

SEQ ID NO: 2885995 - DNA, 18 bp, Homo sapiens
agctcttgggcctgacct

SEQ ID NO: 2885996 - DNA, 22 bp, Homo sapiens
agctcttgggcctgacctccag

SEQ ID NO: 2885997 - DNA, 15 bp, Homo sapiens
agctcttgggtcaga

SEQ ID NO: 2885998 - DNA, 17 bp, Homo sapiens
agctcttgtttctgttt

SEQ ID NO: 2885999 - DNA, 18 bp, Homo sapiens
agctcttgtttctgttta

SEQ ID NO: 2886000 - DNA, 14 bp, Homo sapiens
agctctttgagata

SEQ ID NO: 2886001 - DNA, 20 bp, Homo sapiens
agctgaaatatgctggctgg

SEQ ID NO: 2886002 - DNA, 23 bp, Homo sapiens
agctgaacaataggctgttccca

SEQ ID NO: 2886003 - DNA, 20 bp, Homo sapiens
agctgaagagttgccccgtc

SEQ ID NO: 2886004 - DNA, 15 bp, Homo sapiens
agctgaatacattct

SEQ ID NO: 2886005 - DNA, 18 bp, Homo sapiens
agctgaatacattctgct

SEQ ID NO: 2886006 - DNA, 12 bp, Homo sapiens
agctgacacaga

SEQ ID NO: 2886007 - DNA, 14 bp, Homo sapiens
agctgaccccctcc

SEQ ID NO: 2886008 - DNA, 15 bp, Homo sapiens
agctgaccccctccc

SEQ ID NO: 2886009 - DNA, 16 bp, Homo sapiens
agctgaccccctcccc

SEQ ID NO: 2886010 - DNA, 19 bp, Homo sapiens
agctgaccccctcccccca

SEQ ID NO: 2886011 - DNA, 17 bp, Homo sapiens
agccacccctcagatgc

SEQ ID NO: 2886012 - DNA, 13 bp, Homo sapiens
agccacccctgag

SEQ ID NO: 2886013 - DNA, 16 bp, Homo sapiens
agccacccctgccact

SEQ ID NO: 2886014 - DNA, 22 bp, Homo sapiens
agccacccctgccactcaccct

SEQ ID NO: 2886015 - DNA, 17 bp, Homo sapiens
agccacccttccctgcc

SEQ ID NO: 2886016 - DNA, 21 bp, Homo sapiens
agccaccgcagctgctgccac

SEQ ID NO: 2886017 - DNA, 23 bp, Homo sapiens
agccaccgcagctgctgccactc

SEQ ID NO: 2886018 - DNA, 11 bp, Homo sapiens
agccacctccc

SEQ ID NO: 2886019 - DNA, 17 bp, Homo sapiens
agccaccttgattttct

SEQ ID NO: 2886020 - DNA, 18 bp, Homo sapiens
agccaccttgattttctt

SEQ ID NO: 2886021 - DNA, 17 bp, Homo sapiens
agccactccccggcatg

SEQ ID NO: 2886022 - DNA, 13 bp, Homo sapiens
agccactcctctg

SEQ ID NO: 2886023 - DNA, 15 bp, Homo sapiens
agccactggaaggag

SEQ ID NO: 2886024 - DNA, 17 bp, Homo sapiens
agccactggaaggagca

SEQ ID NO: 2886025 - DNA, 18 bp, Homo sapiens
agccactggaaggagcac

SEQ ID NO: 2886026 - DNA, 13 bp, Homo sapiens
agccactggaggg

SEQ ID NO: 2886027 - DNA, 20 bp, Homo sapiens
agccacttttagctactgct

SEQ ID NO: 2886028 - DNA, 15 bp, Homo sapiens
agccagaagctgagc

SEQ ID NO: 2886029 - DNA, 11 bp, Homo sapiens
agccagacttg

SEQ ID NO: 2886030 - DNA, 14 bp, Homo sapiens
agccagagaagtga

SEQ ID NO: 2886031 - DNA, 16 bp, Homo sapiens
agccagagaagtgaca

SEQ ID NO: 2886032 - DNA, 14 bp, Homo sapiens
agccagagggtggg

SEQ ID NO: 2886033 - DNA, 13 bp, Homo sapiens
agccagagtggcc

SEQ ID NO: 2886034 - DNA, 23 bp, Homo sapiens
agccagagtggccacggcccagg

SEQ ID NO: 2886035 - DNA, 21 bp, Homo sapiens
agccagattggccaattaaaa

SEQ ID NO: 2886036 - DNA, 18 bp, Homo sapiens
agccagatttgtcttttt

SEQ ID NO: 2886037 - DNA, 23 bp, Homo sapiens
agccagattttttaaaatttata

SEQ ID NO: 2886038 - DNA, 22 bp, Homo sapiens
agccagcaccgccggctttcag

SEQ ID NO: 2886039 - DNA, 22 bp, Homo sapiens
agccagcacttgtccagctgag

SEQ ID NO: 2886040 - DNA, 13 bp, Homo sapiens
agccagccactct

SEQ ID NO: 2886041 - DNA, 14 bp, Homo sapiens
agccagccactcta

SEQ ID NO: 2886042 - DNA, 21 bp, Homo sapiens
agccagccactctaccagtgc

SEQ ID NO: 2886043 - DNA, 19 bp, Homo sapiens
agccagcccgtgtgtataa

SEQ ID NO: 2886044 - DNA, 22 bp, Homo sapiens
agccagccctccctgtcctcct

SEQ ID NO: 2886045 - DNA, 15 bp, Homo sapiens
agccagcggctccaa

SEQ ID NO: 2886046 - DNA, 22 bp, Homo sapiens
agccagcgggaatggcagctgc

SEQ ID NO: 2886047 - DNA, 17 bp, Homo sapiens
agccagcgtcctcctct

SEQ ID NO: 2886048 - DNA, 15 bp, Homo sapiens
agccagctccctcta

SEQ ID NO: 2886049 - DNA, 19 bp, Homo sapiens
agccagctccctctattta

SEQ ID NO: 2886050 - DNA, 22 bp, Homo sapiens
agccagctccctctatttatgt

SEQ ID NO: 2886051 - DNA, 14 bp, Homo sapiens
agccaggagacctg

SEQ ID NO: 2886052 - DNA, 16 bp, Homo sapiens
agccaggagggacctg

SEQ ID NO: 2886053 - DNA, 17 bp, Homo sapiens
agccaggagggacctgc

SEQ ID NO: 2886054 - DNA, 15 bp, Homo sapiens
agccaggccccaggc

SEQ ID NO: 2886055 - DNA, 21 bp, Homo sapiens
agccaggctagctggagcctg

SEQ ID NO: 2886056 - DNA, 15 bp, Homo sapiens
agccaggctgggccg

SEQ ID NO: 2886057 - DNA, 20 bp, Homo sapiens
agccagggggatgccactcc

SEQ ID NO: 2886058 - DNA, 16 bp, Homo sapiens
agccagggtagagcaa

SEQ ID NO: 2886059 - DNA, 20 bp, Homo sapiens
agccagggtagagcaaagga

SEQ ID NO: 2886060 - DNA, 15 bp, Homo sapiens
agccaggtccccctg

SEQ ID NO: 2886061 - DNA, 19 bp, Homo sapiens
agccagtcatcatctcttg

SEQ ID NO: 2886062 - DNA, 15 bp, Homo sapiens
agccagtgaaacact

SEQ ID NO: 2886063 - DNA, 16 bp, Homo sapiens
agccagttaaggaaag

SEQ ID NO: 2886064 - DNA, 17 bp, Homo sapiens
agccagttgtcctatgg

SEQ ID NO: 2886065 - DNA, 21 bp, Homo sapiens
agccagttgtcctatggacaa

SEQ ID NO: 2886066 - DNA, 18 bp, Homo sapiens
agccatagagatatttaa

SEQ ID NO: 2886067 - DNA, 15 bp, Homo sapiens
agccataggtgcagt

SEQ ID NO: 2886068 - DNA, 23 bp, Homo sapiens
agccatagtttgggtatttttgg

SEQ ID NO: 2886069 - DNA, 10 bp, Homo sapiens
agccatatca

SEQ ID NO: 2886070 - DNA, 18 bp, Homo sapiens
agccatatggacactgtg

SEQ ID NO: 2886071 - DNA, 15 bp, Homo sapiens
agccatcaaaatgct

SEQ ID NO: 2886072 - DNA, 15 bp, Homo sapiens
agccatcaagcactt

SEQ ID NO: 2886073 - DNA, 19 bp, Homo sapiens
agccatcagccatggccct

SEQ ID NO: 2886074 - DNA, 16 bp, Homo sapiens
agccatccgcagactg

SEQ ID NO: 2886075 - DNA, 14 bp, Homo sapiens
agccatcttcccgc

SEQ ID NO: 2886076 - DNA, 17 bp, Homo sapiens
agccatcttggcagggt

SEQ ID NO: 2886077 - DNA, 17 bp, Homo sapiens
agccatcttggtaaatt

SEQ ID NO: 2886078 - DNA, 18 bp, Homo sapiens
agccatgctggaaaataa

SEQ ID NO: 2886079 - DNA, 12 bp, Homo sapiens
agccatggaagg

SEQ ID NO: 2886080 - DNA, 23 bp, Homo sapiens
agccatgggcacaaagggcccag

SEQ ID NO: 2886081 - DNA, 14 bp, Homo sapiens
agccatgtacagac

SEQ ID NO: 2886082 - DNA, 23 bp, Homo sapiens
agccatgtacagacagagaatat

SEQ ID NO: 2886083 - DNA, 17 bp, Homo sapiens
agccatgttaacatgac

SEQ ID NO: 2886084 - DNA, 20 bp, Homo sapiens
agccattgcacccagcccag

SEQ ID NO: 2886085 - DNA, 19 bp, Homo sapiens
agccattgtcgtttcattc

SEQ ID NO: 2886086 - DNA, 17 bp, Homo sapiens
agccattgtcttcggaa

SEQ ID NO: 2886087 - DNA, 12 bp, Homo sapiens
agccatttgaga

SEQ ID NO: 2886088 - DNA, 16 bp, Homo sapiens
agcccaaaccttgggc

SEQ ID NO: 2886089 - DNA, 22 bp, Homo sapiens
agcccaaaccttgggccctgga

SEQ ID NO: 2886090 - DNA, 16 bp, Homo sapiens
agcccaaatggctctg

SEQ ID NO: 2886091 - DNA, 21 bp, Homo sapiens
agcccaagggatctggtccta

SEQ ID NO: 2886092 - DNA, 21 bp, Homo sapiens
agcccaatccaggtacgcaca

SEQ ID NO: 2886093 - DNA, 12 bp, Homo sapiens
agcccacagagc

SEQ ID NO: 2886094 - DNA, 15 bp, Homo sapiens
agcccacagagcctg

SEQ ID NO: 2886095 - DNA, 15 bp, Homo sapiens
agcccaccaggagca

SEQ ID NO: 2886096 - DNA, 12 bp, Homo sapiens
agcccacccagc

SEQ ID NO: 2886097 - DNA, 12 bp, Homo sapiens
agcccaccctgc

SEQ ID NO: 2886098 - DNA, 22 bp, Homo sapiens
agcccaccctgctgctggtgca

SEQ ID NO: 2886099 - DNA, 20 bp, Homo sapiens
agccggagggcaccagggac

SEQ ID NO: 2886100 - DNA, 23 bp, Homo sapiens
agccgggaccctcaggtgtagct

SEQ ID NO: 2886101 - DNA, 15 bp, Homo sapiens
agcctaatccctggg

SEQ ID NO: 2886102 - DNA, 17 bp, Homo sapiens
agcctaattgtcacatc

SEQ ID NO: 2886103 - DNA, 18 bp, Homo sapiens
agcctaattgtcacatca

SEQ ID NO: 2886104 - DNA, 13 bp, Homo sapiens
agcctattcctga

SEQ ID NO: 2886105 - DNA, 19 bp, Homo sapiens
agcctcaacctcctgggtt

SEQ ID NO: 2886106 - DNA, 20 bp, Homo sapiens
agcctcaacctcctgggttc

SEQ ID NO: 2886107 - DNA, 21 bp, Homo sapiens
agcctcaaggttttaggttct

SEQ ID NO: 2886108 - DNA, 23 bp, Homo sapiens
agcctcaaggttttaggttctaa

SEQ ID NO: 2886109 - DNA, 15 bp, Homo sapiens
agcctcacagaagaa

SEQ ID NO: 2886110 - DNA, 17 bp, Homo sapiens
agcctcacagatgctgg

SEQ ID NO: 2886111 - DNA, 22 bp, Homo sapiens
agcctcacagatgctggcctct

SEQ ID NO: 2886112 - DNA, 21 bp, Homo sapiens
agcctcacgtatttcacagag

SEQ ID NO: 2886113 - DNA, 23 bp, Homo sapiens
agcctcacgtatttcacagagca

SEQ ID NO: 2886114 - DNA, 16 bp, Homo sapiens
agcctcacttgccctc

SEQ ID NO: 2886115 - DNA, 22 bp, Homo sapiens
agcctcacttttaatgaacaaa

SEQ ID NO: 2886116 - DNA, 13 bp, Homo sapiens
agcctcagaagaa

SEQ ID NO: 2886117 - DNA, 14 bp, Homo sapiens
agcctcagaagaaa

SEQ ID NO: 2886118 - DNA, 20 bp, Homo sapiens
agcctcagcggaccactctt

SEQ ID NO: 2886119 - DNA, 14 bp, Homo sapiens
agcctcatgctctg

SEQ ID NO: 2886120 - DNA, 17 bp, Homo sapiens
agcctcatgctctgatt

SEQ ID NO: 2886121 - DNA, 15 bp, Homo sapiens
agcctcatgttctgt

SEQ ID NO: 2886122 - DNA, 16 bp, Homo sapiens
agcctcatgttctgtg

SEQ ID NO: 2886123 - DNA, 17 bp, Homo sapiens
agcctcatgttctgtgg

SEQ ID NO: 2886124 - DNA, 17 bp, Homo sapiens
agcctccagctgccccg

SEQ ID NO: 2886125 - DNA, 14 bp, Homo sapiens
agcctcccctgcca

SEQ ID NO: 2886126 - DNA, 16 bp, Homo sapiens
agcctcccctgccagg

SEQ ID NO: 2886127 - DNA, 20 bp, Homo sapiens
agcctcccctgccagggcag

SEQ ID NO: 2886128 - DNA, 14 bp, Homo sapiens
agcctccctgaagc

SEQ ID NO: 2886129 - DNA, 13 bp, Homo sapiens
agcctccggaagc

SEQ ID NO: 2886130 - DNA, 15 bp, Homo sapiens
agcctccggaagctg

SEQ ID NO: 2886131 - DNA, 21 bp, Homo sapiens
agcctccggggttcagcctcc

SEQ ID NO: 2886132 - DNA, 23 bp, Homo sapiens
agcctccggggttcagcctcctg

SEQ ID NO: 2886133 - DNA, 14 bp, Homo sapiens
agcctccttctttc

SEQ ID NO: 2886134 - DNA, 22 bp, Homo sapiens
agcctcgaggtgccttcttcag

SEQ ID NO: 2886135 - DNA, 20 bp, Homo sapiens
agcctcgccgtctgtgaatt

SEQ ID NO: 2886136 - DNA, 22 bp, Homo sapiens
agcctctcctccttgggcaggg

SEQ ID NO: 2886137 - DNA, 15 bp, Homo sapiens
agcctctcttcactg

SEQ ID NO: 2886138 - DNA, 15 bp, Homo sapiens
agcctctgctcccca

SEQ ID NO: 2886139 - DNA, 11 bp, Homo sapiens
agcctctggat

SEQ ID NO: 2886140 - DNA, 11 bp, Homo sapiens
agcctctgtcc

SEQ ID NO: 2886141 - DNA, 16 bp, Homo sapiens
agcctctttgtaataa

SEQ ID NO: 2886142 - DNA, 15 bp, Homo sapiens
agcctgaactgaggc

SEQ ID NO: 2886143 - DNA, 19 bp, Homo sapiens
agcctgaccctcatctttc

SEQ ID NO: 2886144 - DNA, 18 bp, Homo sapiens
agcctgactcttcccttc

SEQ ID NO: 2886145 - DNA, 19 bp, Homo sapiens
agcctgagtcacctgcaga

SEQ ID NO: 2886146 - DNA, 13 bp, Homo sapiens
agcctgagtgaca

SEQ ID NO: 2886147 - DNA, 15 bp, Homo sapiens
agcctgagtgacaga

SEQ ID NO: 2886148 - DNA, 18 bp, Homo sapiens
agcctgatgagattttta

SEQ ID NO: 2886149 - DNA, 12 bp, Homo sapiens
agcctgcagagc

SEQ ID NO: 2886150 - DNA, 19 bp, Homo sapiens
agcctgcagggaagcccca

SEQ ID NO: 2886151 - DNA, 15 bp, Homo sapiens
agcctgcattcttaa

SEQ ID NO: 2886152 - DNA, 18 bp, Homo sapiens
agcctgccactcaggccc

SEQ ID NO: 2886153 - DNA, 12 bp, Homo sapiens
agcctgccagca

SEQ ID NO: 2886154 - DNA, 21 bp, Homo sapiens
agcctgcgccaccgcccagag

SEQ ID NO: 2886155 - DNA, 11 bp, Homo sapiens
agacatacata

SEQ ID NO: 2886156 - DNA, 22 bp, Homo sapiens
agacatacatagacatttcaaa

SEQ ID NO: 2886157 - DNA, 17 bp, Homo sapiens
agacatatattatatat

SEQ ID NO: 2886158 - DNA, 19 bp, Homo sapiens
agacatatattatatatag

SEQ ID NO: 2886159 - DNA, 15 bp, Homo sapiens
agacatatttaactg

SEQ ID NO: 2886160 - DNA, 17 bp, Homo sapiens
agacatccttgcagttt

SEQ ID NO: 2886161 - DNA, 23 bp, Homo sapiens
agacatgaaaggttggccttact

SEQ ID NO: 2886162 - DNA, 21 bp, Homo sapiens
agacatgagaaagggagagga

SEQ ID NO: 2886163 - DNA, 15 bp, Homo sapiens
agacatgatttcctt

SEQ ID NO: 2886164 - DNA, 23 bp, Homo sapiens
agacatgccacaaggacttcctg

SEQ ID NO: 2886165 - DNA, 15 bp, Homo sapiens
agacatgtggcagca

SEQ ID NO: 2886166 - DNA, 18 bp, Homo sapiens
agacatgttttccgtgaa

SEQ ID NO: 2886167 - DNA, 20 bp, Homo sapiens
agacattaagagaacaaaga

SEQ ID NO: 2886168 - DNA, 17 bp, Homo sapiens
agacattgtaaataaat

SEQ ID NO: 2886169 - DNA, 15 bp, Homo sapiens
agacatttcaaaatt

SEQ ID NO: 2886170 - DNA, 19 bp, Homo sapiens
agacatttcaaaattaata

SEQ ID NO: 2886171 - DNA, 20 bp, Homo sapiens
agacatttcaaaattaatag

SEQ ID NO: 2886172 - DNA, 14 bp, Homo sapiens
agacatttcctttt

SEQ ID NO: 2886173 - DNA, 22 bp, Homo sapiens
agacatttgtaaatgtaaaact

SEQ ID NO: 2886174 - DNA, 17 bp, Homo sapiens
agacattttaacaagaa

SEQ ID NO: 2886175 - DNA, 22 bp, Homo sapiens
agacatttttccgtttgctttt

SEQ ID NO: 2886176 - DNA, 13 bp, Homo sapiens
agaccagcctggc

SEQ ID NO: 2886177 - DNA, 15 bp, Homo sapiens
agaccagcctggcca

SEQ ID NO: 2886178 - DNA, 13 bp, Homo sapiens
agaccagctcttc

SEQ ID NO: 2886179 - DNA, 15 bp, Homo sapiens
agaccagggagcctt

SEQ ID NO: 2886180 - DNA, 17 bp, Homo sapiens
agaccaggggaccagag

SEQ ID NO: 2886181 - DNA, 20 bp, Homo sapiens
agaccaggggaccagaggga

SEQ ID NO: 2886182 - DNA, 22 bp, Homo sapiens
agaccaggggaccagagggatg

SEQ ID NO: 2886183 - DNA, 13 bp, Homo sapiens
agaccatctccta

SEQ ID NO: 2886184 - DNA, 17 bp, Homo sapiens
agaccatgtcttatctt

SEQ ID NO: 2886185 - DNA, 15 bp, Homo sapiens
agaccatttgtagtg

SEQ ID NO: 2886186 - DNA, 18 bp, Homo sapiens
agaccatttgtagtgagc

SEQ ID NO: 2886187 - DNA, 15 bp, Homo sapiens
agacccaacaatgag

SEQ ID NO: 2886188 - DNA, 16 bp, Homo sapiens
agacccaaggaggaaa

SEQ ID NO: 2886189 - DNA, 17 bp, Homo sapiens
agacccagcccgcggcc

SEQ ID NO: 2886190 - DNA, 22 bp, Homo sapiens
agacccagcccgcggcctggac

SEQ ID NO: 2886191 - DNA, 17 bp, Homo sapiens
agacccagccctcatcc

SEQ ID NO: 2886192 - DNA, 14 bp, Homo sapiens
agacccaggactcc

SEQ ID NO: 2886193 - DNA, 19 bp, Homo sapiens
agacccagggggctgaaac

SEQ ID NO: 2886194 - DNA, 17 bp, Homo sapiens
agacccatctctccctt

SEQ ID NO: 2886195 - DNA, 16 bp, Homo sapiens
agacccattcctattt

SEQ ID NO: 2886196 - DNA, 19 bp, Homo sapiens
agaccccatcttccagcca

SEQ ID NO: 2886197 - DNA, 14 bp, Homo sapiens
agacccccagcact

SEQ ID NO: 2886198 - DNA, 21 bp, Homo sapiens
agaccccggcttcctttccca

SEQ ID NO: 2886199 - DNA, 15 bp, Homo sapiens
agacccgggaaggaa

SEQ ID NO: 2886200 - DNA, 22 bp, Homo sapiens
agacccgggaaggaaggctctc

SEQ ID NO: 2886201 - DNA, 16 bp, Homo sapiens
agaccctaccccacca

SEQ ID NO: 2886202 - DNA, 15 bp, Homo sapiens
agaccctctcaggct

SEQ ID NO: 2886203 - DNA, 19 bp, Homo sapiens
agaccctctcaggctgtcc

SEQ ID NO: 2886204 - DNA, 23 bp, Homo sapiens
agaccctctttcttgtttgtcag

SEQ ID NO: 2886205 - DNA, 20 bp, Homo sapiens
agaccgttataaagtgtgcc

SEQ ID NO: 2886206 - DNA, 16 bp, Homo sapiens
agacctactgttctaa

SEQ ID NO: 2886207 - DNA, 20 bp, Homo sapiens
agacctactgttctaaagct

SEQ ID NO: 2886208 - DNA, 16 bp, Homo sapiens
agacctatgtaagaat

SEQ ID NO: 2886209 - DNA, 15 bp, Homo sapiens
agacctcagggcaca

SEQ ID NO: 2886210 - DNA, 19 bp, Homo sapiens
agacctctatatttgctct

SEQ ID NO: 2886211 - DNA, 12 bp, Homo sapiens
agacctctggat

SEQ ID NO: 2886212 - DNA, 17 bp, Homo sapiens
agacctgagggaccctt

SEQ ID NO: 2886213 - DNA, 18 bp, Homo sapiens
agacctgatcctggaggc

SEQ ID NO: 2886214 - DNA, 19 bp, Homo sapiens
agacctgatcctggaggcc

SEQ ID NO: 2886215 - DNA, 11 bp, Homo sapiens
agacctggcag

SEQ ID NO: 2886216 - DNA, 16 bp, Homo sapiens
agacctggcagctctg

SEQ ID NO: 2886217 - DNA, 17 bp, Homo sapiens
agacctggcagctctgg

SEQ ID NO: 2886218 - DNA, 18 bp, Homo sapiens
agacctggcagctctgga

SEQ ID NO: 2886219 - DNA, 23 bp, Homo sapiens
agacctggcagctctggacagcc

SEQ ID NO: 2886220 - DNA, 19 bp, Homo sapiens
agacctgttagcagacagg

SEQ ID NO: 2886221 - DNA, 22 bp, Homo sapiens
agaccttttggcccaatctctg

SEQ ID NO: 2886222 - DNA, 12 bp, Homo sapiens
agacgagacagg

SEQ ID NO: 2886223 - DNA, 17 bp, Homo sapiens
agacgatgtttatgttc

SEQ ID NO: 2886224 - DNA, 17 bp, Homo sapiens
agacgcaccttgctgca

SEQ ID NO: 2886225 - DNA, 13 bp, Homo sapiens
agacgcctgagga

SEQ ID NO: 2886226 - DNA, 17 bp, Homo sapiens
agacgctaataaaaatt

SEQ ID NO: 2886227 - DNA, 19 bp, Homo sapiens
agacggatggcaggatcca

SEQ ID NO: 2886228 - DNA, 19 bp, Homo sapiens
agacgtctcaagactgaaa

SEQ ID NO: 2886229 - DNA, 15 bp, Homo sapiens
agacgtctggccctg

SEQ ID NO: 2886230 - DNA, 23 bp, Homo sapiens
agacgtgaaaggaatacacttgt

SEQ ID NO: 2886231 - DNA, 18 bp, Homo sapiens
agactagacaccttctgt

SEQ ID NO: 2886232 - DNA, 15 bp, Homo sapiens
agactagcctggcca

SEQ ID NO: 2886233 - DNA, 17 bp, Homo sapiens
agactatttaccaggga

SEQ ID NO: 2886234 - DNA, 15 bp, Homo sapiens
agactcaaatgttct

SEQ ID NO: 2886235 - DNA, 16 bp, Homo sapiens
agactcaaatgttcta

SEQ ID NO: 2886236 - DNA, 15 bp, Homo sapiens
agactcaagacttat

SEQ ID NO: 2886237 - DNA, 14 bp, Homo sapiens
agactcagcctgca

SEQ ID NO: 2886238 - DNA, 17 bp, Homo sapiens
agactcagcctgcagtt

SEQ ID NO: 2886239 - DNA, 19 bp, Homo sapiens
agactcccattcctgaaga

SEQ ID NO: 2886240 - DNA, 23 bp, Homo sapiens
agactcccggggtccccgccctc

SEQ ID NO: 2886241 - DNA, 18 bp, Homo sapiens
agactccctgatcccaga

SEQ ID NO: 2886242 - DNA, 19 bp, Homo sapiens
agactccctgatcccagac

SEQ ID NO: 2886243 - DNA, 23 bp, Homo sapiens
agactcctgactgtctcccggga

SEQ ID NO: 2886244 - DNA, 15 bp, Homo sapiens
agactcggccgcagc

SEQ ID NO: 2886245 - DNA, 18 bp, Homo sapiens
agactcggccgcagcggc

SEQ ID NO: 2886246 - DNA, 20 bp, Homo sapiens
agactctcgcatcttcccaa

SEQ ID NO: 2886247 - DNA, 13 bp, Homo sapiens
agactctgtaacc

SEQ ID NO: 2886248 - DNA, 17 bp, Homo sapiens
agactgagccagattgg

SEQ ID NO: 2886249 - DNA, 13 bp, Homo sapiens
agactgagctctc

SEQ ID NO: 2886250 - DNA, 16 bp, Homo sapiens
agactgagctctccag

SEQ ID NO: 2886251 - DNA, 17 bp, Homo sapiens
agactgagctctccagg

SEQ ID NO: 2886252 - DNA, 14 bp, Homo sapiens
agactgcacccagg

SEQ ID NO: 2886253 - DNA, 15 bp, Homo sapiens
agactgcacccagga

SEQ ID NO: 2886254 - DNA, 16 bp, Homo sapiens
agactgcacccaggag

SEQ ID NO: 2886255 - DNA, 18 bp, Homo sapiens
agactgcacccaggaggg

SEQ ID NO: 2886256 - DNA, 13 bp, Homo sapiens
agactgcctccct

SEQ ID NO: 2886257 - DNA, 15 bp, Homo sapiens
agactgcctccctct

SEQ ID NO: 2886258 - DNA, 16 bp, Homo sapiens
agactgcctccctctc

SEQ ID NO: 2886259 - DNA, 18 bp, Homo sapiens
agactggaacttgaactg

SEQ ID NO: 2886260 - DNA, 20 bp, Homo sapiens
agactggaagctaatttgca

SEQ ID NO: 2886261 - DNA, 21 bp, Homo sapiens
agactggactggaccagacaa

SEQ ID NO: 2886262 - DNA, 19 bp, Homo sapiens
agactggaggtcgaagcaa

SEQ ID NO: 2886263 - DNA, 17 bp, Homo sapiens
agactggatttgcagaa

SEQ ID NO: 2886264 - DNA, 11 bp, Homo sapiens
agactggcagg

SEQ ID NO: 2886265 - DNA, 14 bp, Homo sapiens
agactggcaggcgg

SEQ ID NO: 2886266 - DNA, 15 bp, Homo sapiens
agactggccgggcag

SEQ ID NO: 2886267 - DNA, 17 bp, Homo sapiens
agactggccgggcaggc

SEQ ID NO: 2886268 - DNA, 18 bp, Homo sapiens
agactggcttttattaat

SEQ ID NO: 2886269 - DNA, 22 bp, Homo sapiens
agactggcttttattaatgcac

SEQ ID NO: 2886270 - DNA, 18 bp, Homo sapiens
agactgggctctggctct

SEQ ID NO: 2886271 - DNA, 12 bp, Homo sapiens
agactgggctga

SEQ ID NO: 2886272 - DNA, 14 bp, Homo sapiens
agactgggctgagg

SEQ ID NO: 2886273 - DNA, 16 bp, Homo sapiens
agactgggctgaggga

SEQ ID NO: 2886274 - DNA, 16 bp, Homo sapiens
agactggtaggaggag

SEQ ID NO: 2886275 - DNA, 20 bp, Homo sapiens
agactggtctcgaactcctg

SEQ ID NO: 2886276 - DNA, 18 bp, Homo sapiens
agactgtagcctggatat

SEQ ID NO: 2886277 - DNA, 13 bp, Homo sapiens
agatttgtgaact

SEQ ID NO: 2886278 - DNA, 13 bp, Homo sapiens
agattttattgta

SEQ ID NO: 2886279 - DNA, 13 bp, Homo sapiens
agattttcagagg

SEQ ID NO: 2886280 - DNA, 16 bp, Homo sapiens
agattttcctaaggcc

SEQ ID NO: 2886281 - DNA, 12 bp, Homo sapiens
agattttctggt

SEQ ID NO: 2886282 - DNA, 19 bp, Homo sapiens
agattttctgtaaatgaag

SEQ ID NO: 2886283 - DNA, 16 bp, Homo sapiens
agattttggtaatgat

SEQ ID NO: 2886284 - DNA, 13 bp, Homo sapiens
agatttttgcaat

SEQ ID NO: 2886285 - DNA, 16 bp, Homo sapiens
agattttttcagactt

SEQ ID NO: 2886286 - DNA, 22 bp, Homo sapiens
agattttttcagacttgtcaag

SEQ ID NO: 2886287 - DNA, 14 bp, Homo sapiens
agcaaaaacatgta

SEQ ID NO: 2886288 - DNA, 14 bp, Homo sapiens
agcaaaaatgctaa

SEQ ID NO: 2886289 - DNA, 17 bp, Homo sapiens
agcaaaaatgctaatat

SEQ ID NO: 2886290 - DNA, 16 bp, Homo sapiens
agcaaaacttttaaac

SEQ ID NO: 2886291 - DNA, 18 bp, Homo sapiens
agcaaaatccaaactgct

SEQ ID NO: 2886292 - DNA, 21 bp, Homo sapiens
agcaaaatccttacttccagc

SEQ ID NO: 2886293 - DNA, 14 bp, Homo sapiens
agcaaaccaagaga

SEQ ID NO: 2886294 - DNA, 15 bp, Homo sapiens
agcaaaccaagagat

SEQ ID NO: 2886295 - DNA, 14 bp, Homo sapiens
agcaaactctgctg

SEQ ID NO: 2886296 - DNA, 23 bp, Homo sapiens
agcaaagcatcggtcatgtgtgt

SEQ ID NO: 2886297 - DNA, 19 bp, Homo sapiens
agcaaagcgcccacccagg

SEQ ID NO: 2886298 - DNA, 20 bp, Homo sapiens
agcaaagcgcccacccaggt

SEQ ID NO: 2886299 - DNA, 18 bp, Homo sapiens
agcaaaggagacaaagca

SEQ ID NO: 2886300 - DNA, 23 bp, Homo sapiens
agcaaaggagacaaagcaggagt

SEQ ID NO: 2886301 - DNA, 18 bp, Homo sapiens
agcaaaggatgtgttttc

SEQ ID NO: 2886302 - DNA, 11 bp, Homo sapiens
agcaaaggcag

SEQ ID NO: 2886303 - DNA, 20 bp, Homo sapiens
agcaaaggcagtcccgggag

SEQ ID NO: 2886304 - DNA, 17 bp, Homo sapiens
agcaaagtcacttctcc

SEQ ID NO: 2886305 - DNA, 14 bp, Homo sapiens
agcaaatagcaaat

SEQ ID NO: 2886306 - DNA, 11 bp, Homo sapiens
agcaaatcacc

SEQ ID NO: 2886307 - DNA, 23 bp, Homo sapiens
agcaaatcaccacaaactgtaat

SEQ ID NO: 2886308 - DNA, 20 bp, Homo sapiens
agcaaatcagaaacttgtga

SEQ ID NO: 2886309 - DNA, 20 bp, Homo sapiens
agcaaatctttctgtaaaca

SEQ ID NO: 2886310 - DNA, 13 bp, Homo sapiens
acactggttctca

SEQ ID NO: 2886311 - DNA, 17 bp, Homo sapiens
acactggttctcaatga

SEQ ID NO: 2886312 - DNA, 19 bp, Homo sapiens
acactggttctcaatgaaa

SEQ ID NO: 2886313 - DNA, 17 bp, Homo sapiens
acactgtcatgcttcat

SEQ ID NO: 2886314 - DNA, 22 bp, Homo sapiens
acactgtcccaaggtgaaatga

SEQ ID NO: 2886315 - DNA, 19 bp, Homo sapiens
acactgtgaaaatgtattt

SEQ ID NO: 2886316 - DNA, 17 bp, Homo sapiens
acactgtgacaatgact

SEQ ID NO: 2886317 - DNA, 19 bp, Homo sapiens
acactgtgacaatgactaa

SEQ ID NO: 2886318 - DNA, 20 bp, Homo sapiens
acactgtgcacatctgtgtc

SEQ ID NO: 2886319 - DNA, 21 bp, Homo sapiens
acactgtgcacatctgtgtct

SEQ ID NO: 2886320 - DNA, 15 bp, Homo sapiens
acactgtgtctctat

SEQ ID NO: 2886321 - DNA, 20 bp, Homo sapiens
acactgtgtctctatgtgaa

SEQ ID NO: 2886322 - DNA, 22 bp, Homo sapiens
acactgtgtctctatgtgaata

SEQ ID NO: 2886323 - DNA, 13 bp, Homo sapiens
acacttaacagat

SEQ ID NO: 2886324 - DNA, 17 bp, Homo sapiens
acacttactgtaagaca

SEQ ID NO: 2886325 - DNA, 21 bp, Homo sapiens
acacttactgtaagacattag

SEQ ID NO: 2886326 - DNA, 14 bp, Homo sapiens
acacttcagagtaa

SEQ ID NO: 2886327 - DNA, 13 bp, Homo sapiens
acacttccagtct

SEQ ID NO: 2886328 - DNA, 20 bp, Homo sapiens
acacttccagtctggagagc

SEQ ID NO: 2886329 - DNA, 12 bp, Homo sapiens
acacttctcagg

SEQ ID NO: 2886330 - DNA, 13 bp, Homo sapiens
acacttctcagga

SEQ ID NO: 2886331 - DNA, 16 bp, Homo sapiens
acacttctcaggaaat

SEQ ID NO: 2886332 - DNA, 12 bp, Homo sapiens
acacttctgatc

SEQ ID NO: 2886333 - DNA, 20 bp, Homo sapiens
acacttcttacgcaatgctt

SEQ ID NO: 2886334 - DNA, 18 bp, Homo sapiens
acacttgaacctgggagg

SEQ ID NO: 2886335 - DNA, 13 bp, Homo sapiens
acacttgccctgc

SEQ ID NO: 2886336 - DNA, 15 bp, Homo sapiens
acacttgccctgctc

SEQ ID NO: 2886337 - DNA, 17 bp, Homo sapiens
acacttgccctgctccc

SEQ ID NO: 2886338 - DNA, 20 bp, Homo sapiens
acacttggggagatttgcca

SEQ ID NO: 2886339 - DNA, 19 bp, Homo sapiens
acacttggtgctgggaacc

SEQ ID NO: 2886340 - DNA, 18 bp, Homo sapiens
acactttcctggataaaa

SEQ ID NO: 2886341 - DNA, 14 bp, Homo sapiens
acactttctggaac

SEQ ID NO: 2886342 - DNA, 13 bp, Homo sapiens
acacttttatatt

SEQ ID NO: 2886343 - DNA, 18 bp, Homo sapiens
acacttttatatttgaaa

SEQ ID NO: 2886344 - DNA, 19 bp, Homo sapiens
acacttttatatttgaaaa

SEQ ID NO: 2886345 - DNA, 19 bp, Homo sapiens
acacttttcacctccttca

SEQ ID NO: 2886346 - DNA, 22 bp, Homo sapiens
acacttttttggggatatgctt

SEQ ID NO: 2886347 - DNA, 13 bp, Homo sapiens
acagaaaaagcat

SEQ ID NO: 2886348 - DNA, 22 bp, Homo sapiens
acagaaaaagcatgatgggaaa

SEQ ID NO: 2886349 - DNA, 14 bp, Homo sapiens
acagaaaaataagt

SEQ ID NO: 2886350 - DNA, 16 bp, Homo sapiens
acagaaaatatactgt

SEQ ID NO: 2886351 - DNA, 21 bp, Homo sapiens
acagaaaatatactgtaaaga

SEQ ID NO: 2886352 - DNA, 20 bp, Homo sapiens
acagaaacctttttaaaaat

SEQ ID NO: 2886353 - DNA, 19 bp, Homo sapiens
acagaaatatataaaaata

SEQ ID NO: 2886354 - DNA, 15 bp, Homo sapiens
acagaaatgtttaaa

SEQ ID NO: 2886355 - DNA, 20 bp, Homo sapiens
acagaaatgtttctgtgtca

SEQ ID NO: 2886356 - DNA, 21 bp, Homo sapiens
acagaacacagccaaagtaaa

SEQ ID NO: 2886357 - DNA, 17 bp, Homo sapiens
acagaacatcattagaa

SEQ ID NO: 2886358 - DNA, 18 bp, Homo sapiens
acagaaccagcagaacag

SEQ ID NO: 2886359 - DNA, 20 bp, Homo sapiens
acagaacttcagcattgtaa

SEQ ID NO: 2886360 - DNA, 18 bp, Homo sapiens
acagaagcacatgcacct

SEQ ID NO: 2886361 - DNA, 12 bp, Homo sapiens
acagaagcagct

SEQ ID NO: 2886362 - DNA, 16 bp, Homo sapiens
acagaaggtgaacttt

SEQ ID NO: 2886363 - DNA, 13 bp, Homo sapiens
acagaagtcctgt

SEQ ID NO: 2886364 - DNA, 14 bp, Homo sapiens
acagaagtcctgta

SEQ ID NO: 2886365 - DNA, 15 bp, Homo sapiens
acagaagtcctgtat

SEQ ID NO: 2886366 - DNA, 21 bp, Homo sapiens
acagaagtcctgtatgtctgt

SEQ ID NO: 2886367 - DNA, 18 bp, Homo sapiens
acagaagtgtagtatgct

SEQ ID NO: 2886368 - DNA, 20 bp, Homo sapiens
acagaagtgtagtatgctgt

SEQ ID NO: 2886369 - DNA, 17 bp, Homo sapiens
acagaagtttgcactat

SEQ ID NO: 2886370 - DNA, 15 bp, Homo sapiens
acagaataaaagttc

SEQ ID NO: 2886371 - DNA, 17 bp, Homo sapiens
acagaatgaaaaatgaa

SEQ ID NO: 2886372 - DNA, 20 bp, Homo sapiens
acagacaaaaacagcctcac

SEQ ID NO: 2886373 - DNA, 20 bp, Homo sapiens
acagacaaacttgatttctt

SEQ ID NO: 2886374 - DNA, 15 bp, Homo sapiens
acagacaggagaaat

SEQ ID NO: 2886375 - DNA, 23 bp, Homo sapiens
acagactcttccaccagagcagg

SEQ ID NO: 2886376 - DNA, 14 bp, Homo sapiens
acagagacacctgc

SEQ ID NO: 2886377 - DNA, 11 bp, Homo sapiens
acagagaccta

SEQ ID NO: 2886378 - DNA, 19 bp, Homo sapiens
acagagacctccctgttca

SEQ ID NO: 2886379 - DNA, 13 bp, Homo sapiens
acagagagaaaaa

SEQ ID NO: 2886380 - DNA, 13 bp, Homo sapiens
acagagaggacca

SEQ ID NO: 2886381 - DNA, 17 bp, Homo sapiens
acagagcaaagcgccca

SEQ ID NO: 2886382 - DNA, 12 bp, Homo sapiens
acagagcacgcc

SEQ ID NO: 2886383 - DNA, 13 bp, Homo sapiens
acagagcacgcct

SEQ ID NO: 2886384 - DNA, 15 bp, Homo sapiens
acagagcacgcctgc

SEQ ID NO: 2886385 - DNA, 19 bp, Homo sapiens
acagagcacgcctgccatc

SEQ ID NO: 2886386 - DNA, 14 bp, Homo sapiens
acagagcaggactg

SEQ ID NO: 2886387 - DNA, 17 bp, Homo sapiens
acagagcctcgctctgt

SEQ ID NO: 2886388 - DNA, 19 bp, Homo sapiens
acagagcgagactccatct

SEQ ID NO: 2886389 - DNA, 16 bp, Homo sapiens
acagaggatgagctct

SEQ ID NO: 2886390 - DNA, 17 bp, Homo sapiens
acagaggccccagcctc

SEQ ID NO: 2886391 - DNA, 17 bp, Homo sapiens
acagaggctattgtccc

SEQ ID NO: 2886392 - DNA, 16 bp, Homo sapiens
acagagggaagaaaag

SEQ ID NO: 2886393 - DNA, 20 bp, Homo sapiens
acagagggaagaaaagagct

SEQ ID NO: 2886394 - DNA, 19 bp, Homo sapiens
acagagggtcacagtgttt

SEQ ID NO: 2886395 - DNA, 18 bp, Homo sapiens
acagaggtaaaaaaaaga

SEQ ID NO: 2886396 - DNA, 19 bp, Homo sapiens
acagaggtaaaaaaaagaa

SEQ ID NO: 2886397 - DNA, 16 bp, Homo sapiens
acagaggttgtagtga

SEQ ID NO: 2886398 - DNA, 22 bp, Homo sapiens
acagaggttgtagtgagccaag

SEQ ID NO: 2886399 - DNA, 15 bp, Homo sapiens
acagagtaagacatt

SEQ ID NO: 2886400 - DNA, 16 bp, Homo sapiens
acagagtaagacattg

SEQ ID NO: 2886401 - DNA, 17 bp, Homo sapiens
acagagtaagacattgg

SEQ ID NO: 2886402 - DNA, 16 bp, Homo sapiens
acagagtaattatagg

SEQ ID NO: 2886403 - DNA, 18 bp, Homo sapiens
acagagtgtggactctgg

SEQ ID NO: 2886404 - DNA, 15 bp, Homo sapiens
acagagtgtgttttt

SEQ ID NO: 2886405 - DNA, 16 bp, Homo sapiens
acagagttttttaaac

SEQ ID NO: 2886406 - DNA, 20 bp, Homo sapiens
acagatactgtgagcttaca

SEQ ID NO: 2886407 - DNA, 16 bp, Homo sapiens
acctgccgagagtcca

SEQ ID NO: 2886408 - DNA, 22 bp, Homo sapiens
acctgcctagctcttgggcctg

SEQ ID NO: 2886409 - DNA, 16 bp, Homo sapiens
acctgcctcagctacc

SEQ ID NO: 2886410 - DNA, 14 bp, Homo sapiens
acctgcctggccgg

SEQ ID NO: 2886411 - DNA, 21 bp, Homo sapiens
acctgcctggccggccagcca

SEQ ID NO: 2886412 - DNA, 14 bp, Homo sapiens
acctgcctgtagcc

SEQ ID NO: 2886413 - DNA, 17 bp, Homo sapiens
acctgcgcacaggtggg

SEQ ID NO: 2886414 - DNA, 15 bp, Homo sapiens
acctgcgggtcctca

SEQ ID NO: 2886415 - DNA, 18 bp, Homo sapiens
acctgcgggtcctcagct

SEQ ID NO: 2886416 - DNA, 21 bp, Homo sapiens
acctgcgggtcctcagctgct

SEQ ID NO: 2886417 - DNA, 13 bp, Homo sapiens
acctgctctccgg

SEQ ID NO: 2886418 - DNA, 18 bp, Homo sapiens
acctgcttgggtggagaa

SEQ ID NO: 2886419 - DNA, 20 bp, Homo sapiens
acctgcttgggtggagaagc

SEQ ID NO: 2886420 - DNA, 21 bp, Homo sapiens
acctgcttgggtggagaagcc

SEQ ID NO: 2886421 - DNA, 18 bp, Homo sapiens
acctggcagcaaactgct

SEQ ID NO: 2886422 - DNA, 14 bp, Homo sapiens
acctggcagctctg

SEQ ID NO: 2886423 - DNA, 17 bp, Homo sapiens
acctggcagctctggac

SEQ ID NO: 2886424 - DNA, 21 bp, Homo sapiens
acctggccccatgtctctcag

SEQ ID NO: 2886425 - DNA, 21 bp, Homo sapiens
acctggctttttattgtattt

SEQ ID NO: 2886426 - DNA, 22 bp, Homo sapiens
acctgggagaaatctggcttct

SEQ ID NO: 2886427 - DNA, 23 bp, Homo sapiens
acctgggagagacttggatgagg

SEQ ID NO: 2886428 - DNA, 22 bp, Homo sapiens
acctgggaggcggatgttgaag

SEQ ID NO: 2886429 - DNA, 17 bp, Homo sapiens
acctggtccacagggca

SEQ ID NO: 2886430 - DNA, 20 bp, Homo sapiens
acctggtcctccgcctactg

SEQ ID NO: 2886431 - DNA, 18 bp, Homo sapiens
acctgtaaatgtcctgaa

SEQ ID NO: 2886432 - DNA, 17 bp, Homo sapiens
acctgtaacttttgtaa

SEQ ID NO: 2886433 - DNA, 20 bp, Homo sapiens
acctgtaacttttgtaaata

SEQ ID NO: 2886434 - DNA, 14 bp, Homo sapiens
acctgtaatcccag

SEQ ID NO: 2886435 - DNA, 15 bp, Homo sapiens
acctgtaatcccagc

SEQ ID NO: 2886436 - DNA, 17 bp, Homo sapiens
acctgtagatgcagaaa

SEQ ID NO: 2886437 - DNA, 15 bp, Homo sapiens
acctgtagtcccagc

SEQ ID NO: 2886438 - DNA, 17 bp, Homo sapiens
acctgtataaccctgtt

SEQ ID NO: 2886439 - DNA, 20 bp, Homo sapiens
acctgtataaccctgttaca

SEQ ID NO: 2886440 - DNA, 21 bp, Homo sapiens
acctgtatatttgtaaagcta

SEQ ID NO: 2886441 - DNA, 11 bp, Homo sapiens
acctgtatctt

SEQ ID NO: 2886442 - DNA, 18 bp, Homo sapiens
acctgtatctttctatgc

SEQ ID NO: 2886443 - DNA, 17 bp, Homo sapiens
acctgtatttaaaaata

SEQ ID NO: 2886444 - DNA, 18 bp, Homo sapiens
acctgtatttaaaaatag

SEQ ID NO: 2886445 - DNA, 17 bp, Homo sapiens
acctgtccttactcaga

SEQ ID NO: 2886446 - DNA, 20 bp, Homo sapiens
acctgtccttactcagagct

SEQ ID NO: 2886447 - DNA, 18 bp, Homo sapiens
acctgtcggtggctgcct

SEQ ID NO: 2886448 - DNA, 16 bp, Homo sapiens
acctgtcgtctctccc

SEQ ID NO: 2886449 - DNA, 22 bp, Homo sapiens
acctgtctcctttcaccccagg

SEQ ID NO: 2886450 - DNA, 12 bp, Homo sapiens
acctgtcttgct

SEQ ID NO: 2886451 - DNA, 17 bp, Homo sapiens
acctgtgagcccagctg

SEQ ID NO: 2886452 - DNA, 18 bp, Homo sapiens
acctgtgagcccagctgg

SEQ ID NO: 2886453 - DNA, 23 bp, Homo sapiens
acctgtgcctccctctcctcgga

SEQ ID NO: 2886454 - DNA, 14 bp, Homo sapiens
acctgtgcctcggc

SEQ ID NO: 2886455 - DNA, 15 bp, Homo sapiens
acctgtgcctcggct

SEQ ID NO: 2886456 - DNA, 16 bp, Homo sapiens
acctgtgcctcggctt

SEQ ID NO: 2886457 - DNA, 19 bp, Homo sapiens
acctgtgcttcgggccctt

SEQ ID NO: 2886458 - DNA, 22 bp, Homo sapiens
acctgtgcttcgggcccttccc

SEQ ID NO: 2886459 - DNA, 19 bp, Homo sapiens
acctgtgtccgatgctgga

SEQ ID NO: 2886460 - DNA, 17 bp, Homo sapiens
acctgttcacagaaaaa

SEQ ID NO: 2886461 - DNA, 16 bp, Homo sapiens
acctgttctgtagctt

SEQ ID NO: 2886462 - DNA, 20 bp, Homo sapiens
acctgttgctccaggatgca

SEQ ID NO: 2886463 - DNA, 17 bp, Homo sapiens
acctgtttttttttcat

SEQ ID NO: 2886464 - DNA, 16 bp, Homo sapiens
accttaaaaggtactg

SEQ ID NO: 2886465 - DNA, 15 bp, Homo sapiens
accttaatttaactt

SEQ ID NO: 2886466 - DNA, 17 bp, Homo sapiens
accttaatttaactttc

SEQ ID NO: 2886467 - DNA, 12 bp, Homo sapiens
accttactcagg

SEQ ID NO: 2886468 - DNA, 23 bp, Homo sapiens
accttaggaataatctcctgtta

SEQ ID NO: 2886469 - DNA, 22 bp, Homo sapiens
accttaggcccggagctgcccc

SEQ ID NO: 2886470 - DNA, 22 bp, Homo sapiens
accttagtgtttctgtgcatgg

SEQ ID NO: 2886471 - DNA, 15 bp, Homo sapiens
accttatacatcact

SEQ ID NO: 2886472 - DNA, 22 bp, Homo sapiens
accttatacatcacttcctgtt

SEQ ID NO: 2886473 - DNA, 19 bp, Homo sapiens
accttcaaactagggccaa

SEQ ID NO: 2886474 - DNA, 14 bp, Homo sapiens
accttcaatgaatt

SEQ ID NO: 2886475 - DNA, 22 bp, Homo sapiens
accttcaatgaattaattcaga

SEQ ID NO: 2886476 - DNA, 15 bp, Homo sapiens
accttcagctttatt

SEQ ID NO: 2886477 - DNA, 23 bp, Homo sapiens
accttcagctttatttttcttta

SEQ ID NO: 2886478 - DNA, 16 bp, Homo sapiens
accttcatttcatcct

SEQ ID NO: 2886479 - DNA, 13 bp, Homo sapiens
accttcattttga

SEQ ID NO: 2886480 - DNA, 15 bp, Homo sapiens
accttcattttgagg

SEQ ID NO: 2886481 - DNA, 17 bp, Homo sapiens
accttcattttgagggg

SEQ ID NO: 2886482 - DNA, 19 bp, Homo sapiens
accttcccaaacgcctccc

SEQ ID NO: 2886483 - DNA, 14 bp, Homo sapiens
accttcccacccct

SEQ ID NO: 2886484 - DNA, 17 bp, Homo sapiens
accttcccagctctccc

SEQ ID NO: 2886485 - DNA, 20 bp, Homo sapiens
accttcctcctccccgctcc

SEQ ID NO: 2886486 - DNA, 14 bp, Homo sapiens
accttcgggctgtg

SEQ ID NO: 2886487 - DNA, 16 bp, Homo sapiens
accttcgggctgtgcc

SEQ ID NO: 2886488 - DNA, 22 bp, Homo sapiens
accttctctatggggcatcctc

SEQ ID NO: 2886489 - DNA, 18 bp, Homo sapiens
accttctggcctcccaca

SEQ ID NO: 2886490 - DNA, 13 bp, Homo sapiens
accttctgtgctc

SEQ ID NO: 2886491 - DNA, 19 bp, Homo sapiens
accttcttcagccacctct

SEQ ID NO: 2886492 - DNA, 19 bp, Homo sapiens
accttgactgttgatgtac

SEQ ID NO: 2886493 - DNA, 13 bp, Homo sapiens
accttgaggagaa

SEQ ID NO: 2886494 - DNA, 23 bp, Homo sapiens
accttgattggggaattaaaagt

SEQ ID NO: 2886495 - DNA, 15 bp, Homo sapiens
accttgccttagaaa

SEQ ID NO: 2886496 - DNA, 18 bp, Homo sapiens
accttgccttagaaacac

SEQ ID NO: 2886497 - DNA, 20 bp, Homo sapiens
accttgctagctagccagcc

SEQ ID NO: 2886498 - DNA, 16 bp, Homo sapiens
accttggagcatttat

SEQ ID NO: 2886499 - DNA, 17 bp, Homo sapiens
accttggagcatttatg

SEQ ID NO: 2886500 - DNA, 16 bp, Homo sapiens
accttggcaccagaca

SEQ ID NO: 2886501 - DNA, 17 bp, Homo sapiens
accttggcaccagacac

SEQ ID NO: 2886502 - DNA, 18 bp, Homo sapiens
accttggcaccagacacc

SEQ ID NO: 2886503 - DNA, 21 bp, Homo sapiens
accttggcccaggagctctgc

SEQ ID NO: 2886504 - DNA, 22 bp, Homo sapiens
accttggcccaggagctctgcg

SEQ ID NO: 2886505 - DNA, 15 bp, Homo sapiens
accttgggccctgga

SEQ ID NO: 2886506 - DNA, 21 bp, Homo sapiens
accttgtcaataaaaataaat

SEQ ID NO: 2886507 - DNA, 13 bp, Homo sapiens
accttgtgaggga

SEQ ID NO: 2886508 - DNA, 20 bp, Homo sapiens
accttgtggtctcgatgctg

SEQ ID NO: 2886509 - DNA, 13 bp, Homo sapiens
accttgtgtctgt

SEQ ID NO: 2886510 - DNA, 22 bp, Homo sapiens
accttgttatttctcagacttt

SEQ ID NO: 2886511 - DNA, 15 bp, Homo sapiens
accttgtttgtttta

SEQ ID NO: 2886512 - DNA, 17 bp, Homo sapiens
accttgtttgttttatt

SEQ ID NO: 2886513 - DNA, 13 bp, Homo sapiens
acctttaagaaaa

SEQ ID NO: 2886514 - DNA, 14 bp, Homo sapiens
acctttactttaga

SEQ ID NO: 2886515 - DNA, 17 bp, Homo sapiens
acctttatccctgctta

SEQ ID NO: 2886516 - DNA, 13 bp, Homo sapiens
acctttattcttt

SEQ ID NO: 2886517 - DNA, 14 bp, Homo sapiens
acctttattctttt

SEQ ID NO: 2886518 - DNA, 22 bp, Homo sapiens
acctttattgggtatcaagaca

SEQ ID NO: 2886519 - DNA, 17 bp, Homo sapiens
acctttattttagaatt

SEQ ID NO: 2886520 - DNA, 21 bp, Homo sapiens
acctttcataatctttgcttt

SEQ ID NO: 2886521 - DNA, 21 bp, Homo sapiens
acctttccactcccactgcca

SEQ ID NO: 2886522 - DNA, 17 bp, Homo sapiens
acctttcccactttctt

SEQ ID NO: 2886523 - DNA, 15 bp, Homo sapiens
acctttctccactgg

SEQ ID NO: 2886524 - DNA, 16 bp, Homo sapiens
acctttctgacatcag

SEQ ID NO: 2886525 - DNA, 19 bp, Homo sapiens
acctttctgacatcagcac

SEQ ID NO: 2886526 - DNA, 14 bp, Homo sapiens
acctttgctatgta

SEQ ID NO: 2886527 - DNA, 18 bp, Homo sapiens
acctttgtacagcccaga

SEQ ID NO: 2886528 - DNA, 24 bp, Homo sapiens
acctttgtagttactcaagcagtt

SEQ ID NO: 2886529 - DNA, 12 bp, Homo sapiens
accttttaacac

SEQ ID NO: 2886530 - DNA, 20 bp, Homo sapiens
accttttaacacctgatgtg

SEQ ID NO: 2886531 - DNA, 15 bp, Homo sapiens
accttttatccactt

SEQ ID NO: 2886532 - DNA, 20 bp, Homo sapiens
accttttattgacacagaaa

SEQ ID NO: 2886533 - DNA, 12 bp, Homo sapiens
accttttcttgc

SEQ ID NO: 2886534 - DNA, 14 bp, Homo sapiens
accttttcttgcct

SEQ ID NO: 2886535 - DNA, 12 bp, Homo sapiens
accttttgtttt

SEQ ID NO: 2886536 - DNA, 18 bp, Homo sapiens
accttttgtttttccagt

SEQ ID NO: 2886537 - DNA, 21 bp, Homo sapiens
accttttgtttttccagttcc

SEQ ID NO: 2886538 - DNA, 17 bp, Homo sapiens
acgaacacaagaaaaag

SEQ ID NO: 2886539 - DNA, 15 bp, Homo sapiens
acgaataaacgcaga

SEQ ID NO: 2886540 - DNA, 21 bp, Homo sapiens
acgaataaacgcagaagaggg

SEQ ID NO: 2886541 - DNA, 22 bp, Homo sapiens
acgaatacttttgccctttgat

SEQ ID NO: 2886542 - DNA, 20 bp, Homo sapiens
acgaatcctgctctaaaata

SEQ ID NO: 2886543 - DNA, 18 bp, Homo sapiens
acgaatgcatattcaaca

SEQ ID NO: 2886544 - DNA, 17 bp, Homo sapiens
acgacccttaggccttt

SEQ ID NO: 2886545 - DNA, 21 bp, Homo sapiens
acgacctaggcagtaggccgg

SEQ ID NO: 2886546 - DNA, 16 bp, Homo sapiens
acgactctaaacacac

SEQ ID NO: 2886547 - DNA, 12 bp, Homo sapiens
acgactgtctcc

SEQ ID NO: 2886548 - DNA, 17 bp, Homo sapiens
acgagagcagaggtctc

SEQ ID NO: 2886549 - DNA, 12 bp, Homo sapiens
acgagggctggc

SEQ ID NO: 2886550 - DNA, 17 bp, Homo sapiens
acgagtaagtgaatcct

SEQ ID NO: 2886551 - DNA, 13 bp, Homo sapiens
acgagtgctaagt

SEQ ID NO: 2886552 - DNA, 23 bp, Homo sapiens
acgatatttcgtttggtcttagg

SEQ ID NO: 2886553 - DNA, 18 bp, Homo sapiens
acgatgtggccctggcct

SEQ ID NO: 2886554 - DNA, 19 bp, Homo sapiens
acgatgtggccctggcctg

SEQ ID NO: 2886555 - DNA, 21 bp, Homo sapiens
acgatgtgttgaccggctgcc

SEQ ID NO: 2886556 - DNA, 12 bp, Homo sapiens
acgatgtttatg

SEQ ID NO: 2886557 - DNA, 16 bp, Homo sapiens
acgatgtttatgttct

SEQ ID NO: 2886558 - DNA, 17 bp, Homo sapiens
acgatgtttatgttctt

SEQ ID NO: 2886559 - DNA, 14 bp, Homo sapiens
acgatttaattctc

SEQ ID NO: 2886560 - DNA, 20 bp, Homo sapiens
acgcaaaccaacctttctga

SEQ ID NO: 2886561 - DNA, 13 bp, Homo sapiens
acgcacagacagg

SEQ ID NO: 2886562 - DNA, 13 bp, Homo sapiens
acgcacctcccat

SEQ ID NO: 2886563 - DNA, 14 bp, Homo sapiens
acgcacctgcctca

SEQ ID NO: 2886564 - DNA, 15 bp, Homo sapiens
acgcacctgcctcag

SEQ ID NO: 2886565 - DNA, 16 bp, Homo sapiens
acgcacctgcctcagg

SEQ ID NO: 2886566 - DNA, 18 bp, Homo sapiens
acgcagccggagggaggc

SEQ ID NO: 2886567 - DNA, 14 bp, Homo sapiens
acgcaggccctgtc

SEQ ID NO: 2886568 - DNA, 20 bp, Homo sapiens
acgcaggccctgtccagccc

SEQ ID NO: 2886569 - DNA, 20 bp, Homo sapiens
acgcaggcctccctgcctca

SEQ ID NO: 2886570 - DNA, 20 bp, Homo sapiens
acgccaccctgcccaccccc

SEQ ID NO: 2886571 - DNA, 22 bp, Homo sapiens
acgccagacttcccacggctcc

SEQ ID NO: 2886572 - DNA, 15 bp, Homo sapiens
acgccattctcctgc

SEQ ID NO: 2886573 - DNA, 16 bp, Homo sapiens
acgcccccccccaccc

SEQ ID NO: 2886574 - DNA, 22 bp, Homo sapiens
acgccccgaacctcacctgacc

SEQ ID NO: 2886575 - DNA, 20 bp, Homo sapiens
acgccgccctaaaagcacac

SEQ ID NO: 2886576 - DNA, 18 bp, Homo sapiens
acgccgtctccatggcat

SEQ ID NO: 2886577 - DNA, 13 bp, Homo sapiens
acgcctgaggaac

SEQ ID NO: 2886578 - DNA, 22 bp, Homo sapiens
acgcctgcaaacgctgcctgcc

SEQ ID NO: 2886579 - DNA, 23 bp, Homo sapiens
acgcctgccatcttctccccgag

SEQ ID NO: 2886580 - DNA, 18 bp, Homo sapiens
acgcctgtaatcccagca

SEQ ID NO: 2886581 - DNA, 19 bp, Homo sapiens
acgcctgtaatcccagcag

SEQ ID NO: 2886582 - DNA, 13 bp, Homo sapiens
acgcgcagatgtg

SEQ ID NO: 2886583 - DNA, 15 bp, Homo sapiens
acgcgcccccctccc

SEQ ID NO: 2886584 - DNA, 17 bp, Homo sapiens
acgcgcccccctcccag

SEQ ID NO: 2886585 - DNA, 14 bp, Homo sapiens
acgcggccacctca

SEQ ID NO: 2886586 - DNA, 12 bp, Homo sapiens
acgcgggagcca

SEQ ID NO: 2886587 - DNA, 19 bp, Homo sapiens
acgctaataaaaatttatt

SEQ ID NO: 2886588 - DNA, 14 bp, Homo sapiens
acgctagagcatgc

SEQ ID NO: 2886589 - DNA, 17 bp, Homo sapiens
acgctccagctgccccg

SEQ ID NO: 2886590 - DNA, 17 bp, Homo sapiens
acgctcccctccatccc

SEQ ID NO: 2886591 - DNA, 16 bp, Homo sapiens
acgctgaataaatgtc

SEQ ID NO: 2886592 - DNA, 19 bp, Homo sapiens
acgctgaataaatgtcttt

SEQ ID NO: 2886593 - DNA, 20 bp, Homo sapiens
acgctgtgctggttctgttt

SEQ ID NO: 2886594 - DNA, 11 bp, Homo sapiens
acgctttgatt

SEQ ID NO: 2886595 - DNA, 13 bp, Homo sapiens
acgctttgattca

SEQ ID NO: 2886596 - DNA, 14 bp, Homo sapiens
acgcttttctttgt

SEQ ID NO: 2886597 - DNA, 18 bp, Homo sapiens
acggagccactcctctga

SEQ ID NO: 2886598 - DNA, 19 bp, Homo sapiens
acggagccactcctctgac

SEQ ID NO: 2886599 - DNA, 20 bp, Homo sapiens
acggagccactcctctgact

SEQ ID NO: 2886600 - DNA, 15 bp, Homo sapiens
acggagcccagccct

SEQ ID NO: 2886601 - DNA, 20 bp, Homo sapiens
acggagcccctgaaagcctc

SEQ ID NO: 2886602 - DNA, 23 bp, Homo sapiens
acggaggcaaagctggctcacct

SEQ ID NO: 2886603 - DNA, 18 bp, Homo sapiens
acggaggcatcctaccct

SEQ ID NO: 2886604 - DNA, 23 bp, Homo sapiens
acggatgggccctatgtctcagg

SEQ ID NO: 2886605 - DNA, 12 bp, Homo sapiens
acggattccaaa

SEQ ID NO: 2886606 - DNA, 19 bp, Homo sapiens
acggcaaggctgaggtggc

SEQ ID NO: 2886607 - DNA, 22 bp, Homo sapiens
acggcaggacaacgaggaagcc

SEQ ID NO: 2886608 - DNA, 20 bp, Homo sapiens
acggcaggcgtgtggcagcc

SEQ ID NO: 2886609 - DNA, 13 bp, Homo sapiens
acggccacatcaa

SEQ ID NO: 2886610 - DNA, 23 bp, Homo sapiens
acggccagggagaagctcctctc

SEQ ID NO: 2886611 - DNA, 14 bp, Homo sapiens
acggcccgcagcct

SEQ ID NO: 2886612 - DNA, 16 bp, Homo sapiens
acggcccggcccctca

SEQ ID NO: 2886613 - DNA, 23 bp, Homo sapiens
acggcctatgccccacctgccct

SEQ ID NO: 2886614 - DNA, 18 bp, Homo sapiens
acggctcgatttctccag

SEQ ID NO: 2886615 - DNA, 22 bp, Homo sapiens
acggctggtcactctgccctct

SEQ ID NO: 2886616 - DNA, 23 bp, Homo sapiens
acggctggtcactctgccctctg

SEQ ID NO: 2886617 - DNA, 24 bp, Homo sapiens
acgggatgattgcttgagctcagg

SEQ ID NO: 2886618 - DNA, 20 bp, Homo sapiens
acgggcaagtgagaggggag

SEQ ID NO: 2886619 - DNA, 21 bp, Homo sapiens
acgggcaagtgagaggggagg

SEQ ID NO: 2886620 - DNA, 16 bp, Homo sapiens
acgggcagtagctgtg

SEQ ID NO: 2886621 - DNA, 11 bp, Homo sapiens
acgggccaggc

SEQ ID NO: 2886622 - DNA, 16 bp, Homo sapiens
acggggaccactgggc

SEQ ID NO: 2886623 - DNA, 15 bp, Homo sapiens
actataacaaaaaaa

SEQ ID NO: 2886624 - DNA, 13 bp, Homo sapiens
actataagaactt

SEQ ID NO: 2886625 - DNA, 19 bp, Homo sapiens
actataagaactttgagct

SEQ ID NO: 2886626 - DNA, 18 bp, Homo sapiens
actatataagacattaag

SEQ ID NO: 2886627 - DNA, 21 bp, Homo sapiens
actatataagacattaagaga

SEQ ID NO: 2886628 - DNA, 18 bp, Homo sapiens
actatattatcatgcaaa

SEQ ID NO: 2886629 - DNA, 21 bp, Homo sapiens
actatatttgagcactggtct

SEQ ID NO: 2886630 - DNA, 13 bp, Homo sapiens
actatcaggcaga

SEQ ID NO: 2886631 - DNA, 14 bp, Homo sapiens
actatcaggcagaa

SEQ ID NO: 2886632 - DNA, 16 bp, Homo sapiens
actatcaggcagaaga

SEQ ID NO: 2886633 - DNA, 21 bp, Homo sapiens
actatcaggcagaagaatctt

SEQ ID NO: 2886634 - DNA, 21 bp, Homo sapiens
actatcccctgcgctttgaac

SEQ ID NO: 2886635 - DNA, 13 bp, Homo sapiens
actatctcagaga

SEQ ID NO: 2886636 - DNA, 19 bp, Homo sapiens
actatctgaaaatacattt

SEQ ID NO: 2886637 - DNA, 13 bp, Homo sapiens
actatcttctttg

SEQ ID NO: 2886638 - DNA, 21 bp, Homo sapiens
actatgaccttccaagtttga

SEQ ID NO: 2886639 - DNA, 24 bp, Homo sapiens
actatgaccttccaagtttgactt

SEQ ID NO: 2886640 - DNA, 23 bp, Homo sapiens
actatgcatggtgccccaggacc

SEQ ID NO: 2886641 - DNA, 17 bp, Homo sapiens
actatgtaatgcttatg

SEQ ID NO: 2886642 - DNA, 23 bp, Homo sapiens
actatgtaatgcttatgtgttgc

SEQ ID NO: 2886643 - DNA, 15 bp, Homo sapiens
actatgtatatacat

SEQ ID NO: 2886644 - DNA, 11 bp, Homo sapiens
actatgtgtgt

SEQ ID NO: 2886645 - DNA, 18 bp, Homo sapiens
actatgtgtgttgtttcc

SEQ ID NO: 2886646 - DNA, 22 bp, Homo sapiens
actatgtgtgttgtttccatag

SEQ ID NO: 2886647 - DNA, 22 bp, Homo sapiens
actattaaaaaggtttacagaa

SEQ ID NO: 2886648 - DNA, 17 bp, Homo sapiens
actattagcaagaatca

SEQ ID NO: 2886649 - DNA, 13 bp, Homo sapiens
actattccatgtt

SEQ ID NO: 2886650 - DNA, 14 bp, Homo sapiens
actattccatgttt

SEQ ID NO: 2886651 - DNA, 17 bp, Homo sapiens
actattccatgttttaa

SEQ ID NO: 2886652 - DNA, 18 bp, Homo sapiens
actattccatgttttaaa

SEQ ID NO: 2886653 - DNA, 20 bp, Homo sapiens
actattccccagcagggtct

SEQ ID NO: 2886654 - DNA, 15 bp, Homo sapiens
actatttatctgtgt

SEQ ID NO: 2886655 - DNA, 14 bp, Homo sapiens
actatttcggcctt

SEQ ID NO: 2886656 - DNA, 14 bp, Homo sapiens
actatttgaccccc

SEQ ID NO: 2886657 - DNA, 19 bp, Homo sapiens
actatttgtgactttttaa

SEQ ID NO: 2886658 - DNA, 22 bp, Homo sapiens
actattttcagatgtgaaccat

SEQ ID NO: 2886659 - DNA, 16 bp, Homo sapiens
actattttcatttttg

SEQ ID NO: 2886660 - DNA, 13 bp, Homo sapiens
actcaaaatctgt

SEQ ID NO: 2886661 - DNA, 16 bp, Homo sapiens
actcaaacttctggct

SEQ ID NO: 2886662 - DNA, 17 bp, Homo sapiens
actcaaacttctggctc

SEQ ID NO: 2886663 - DNA, 20 bp, Homo sapiens
actcaaagtttcagagacca

SEQ ID NO: 2886664 - DNA, 19 bp, Homo sapiens
actcaaatcgaatagggaa

SEQ ID NO: 2886665 - DNA, 18 bp, Homo sapiens
actcaaatgctcagacca

SEQ ID NO: 2886666 - DNA, 16 bp, Homo sapiens
actcaacatgagtcaa

SEQ ID NO: 2886667 - DNA, 19 bp, Homo sapiens
actcaacatgagtcaagag

SEQ ID NO: 2886668 - DNA, 23 bp, Homo sapiens
actcaaccttaagacctactgtt

SEQ ID NO: 2886669 - DNA, 13 bp, Homo sapiens
actcaatgggaga

SEQ ID NO: 2886670 - DNA, 23 bp, Homo sapiens
actcaatgggagaatcagcagaa

SEQ ID NO: 2886671 - DNA, 21 bp, Homo sapiens
actcaatgttactatctgctt

SEQ ID NO: 2886672 - DNA, 15 bp, Homo sapiens
actcacccttcctgg

SEQ ID NO: 2886673 - DNA, 17 bp, Homo sapiens
actcacccttcctggcc

SEQ ID NO: 2886674 - DNA, 18 bp, Homo sapiens
actcacccttcctggccc

SEQ ID NO: 2886675 - DNA, 19 bp, Homo sapiens
actcacccttcctggccca

SEQ ID NO: 2886676 - DNA, 22 bp, Homo sapiens
actcacccttcctggcccaggc

SEQ ID NO: 2886677 - DNA, 11 bp, Homo sapiens
actcacctctg

SEQ ID NO: 2886678 - DNA, 14 bp, Homo sapiens
actcacctctgcct

SEQ ID NO: 2886679 - DNA, 15 bp, Homo sapiens
actcacctctgcctc

SEQ ID NO: 2886680 - DNA, 19 bp, Homo sapiens
actcactgaagcccagacc

SEQ ID NO: 2886681 - DNA, 15 bp, Homo sapiens
actcactggcagccc

SEQ ID NO: 2886682 - DNA, 17 bp, Homo sapiens
actcactggcagcccca

SEQ ID NO: 2886683 - DNA, 19 bp, Homo sapiens
actcacttgatgtttcctg

SEQ ID NO: 2886684 - DNA, 23 bp, Homo sapiens
actcacttgatgtttcctggaag

SEQ ID NO: 2886685 - DNA, 11 bp, Homo sapiens
actcagagctg

SEQ ID NO: 2886686 - DNA, 13 bp, Homo sapiens
actcagagctgcg

SEQ ID NO: 2886687 - DNA, 22 bp, Homo sapiens
actcagagttctatactgtaaa

SEQ ID NO: 2886688 - DNA, 21 bp, Homo sapiens
actcagatggaaccgcaggaa

SEQ ID NO: 2886689 - DNA, 22 bp, Homo sapiens
actcagatggaaccgcaggaag

SEQ ID NO: 2886690 - DNA, 23 bp, Homo sapiens
actcagatggaaccgcaggaagc

SEQ ID NO: 2886691 - DNA, 15 bp, Homo sapiens
actcagcacaaggcc

SEQ ID NO: 2886692 - DNA, 15 bp, Homo sapiens
actcagcagaggcag

SEQ ID NO: 2886693 - DNA, 15 bp, Homo sapiens
actcagcagcagaga

SEQ ID NO: 2886694 - DNA, 21 bp, Homo sapiens
actcagcagcagagagccctg

SEQ ID NO: 2886695 - DNA, 15 bp, Homo sapiens
actcagcagccctcc

SEQ ID NO: 2886696 - DNA, 17 bp, Homo sapiens
actcagcagccctcctc

SEQ ID NO: 2886697 - DNA, 22 bp, Homo sapiens
actcagcagccctcctcacccc

SEQ ID NO: 2886698 - DNA, 14 bp, Homo sapiens
actcagccaagcac

SEQ ID NO: 2886699 - DNA, 17 bp, Homo sapiens
actcagccaagcacagt

SEQ ID NO: 2886700 - DNA, 23 bp, Homo sapiens
actcagccaagcacagtggtggc

SEQ ID NO: 2886701 - DNA, 16 bp, Homo sapiens
actcagcccctacccc

SEQ ID NO: 2886702 - DNA, 20 bp, Homo sapiens
actcagcccctacccctgcc

SEQ ID NO: 2886703 - DNA, 22 bp, Homo sapiens
actcagcccctacccctgccct

SEQ ID NO: 2886704 - DNA, 17 bp, Homo sapiens
actcagccctcattggc

SEQ ID NO: 2886705 - DNA, 16 bp, Homo sapiens
actcagccctgggccc

SEQ ID NO: 2886706 - DNA, 15 bp, Homo sapiens
actcagcctgcagtt

SEQ ID NO: 2886707 - DNA, 14 bp, Homo sapiens
actcagctccgtga

SEQ ID NO: 2886708 - DNA, 12 bp, Homo sapiens
actcagctctgt

SEQ ID NO: 2886709 - DNA, 13 bp, Homo sapiens
actcagctctgtc

SEQ ID NO: 2886710 - DNA, 14 bp, Homo sapiens
actcagctctgtct

SEQ ID NO: 2886711 - DNA, 15 bp, Homo sapiens
actcagctctgtctg

SEQ ID NO: 2886712 - DNA, 22 bp, Homo sapiens
actcagctcttggctccactgg

SEQ ID NO: 2886713 - DNA, 13 bp, Homo sapiens
actcaggaagaac

SEQ ID NO: 2886714 - DNA, 14 bp, Homo sapiens
actcaggaggctga

SEQ ID NO: 2886715 - DNA, 18 bp, Homo sapiens
actcaggaggctgagaca

SEQ ID NO: 2886716 - DNA, 21 bp, Homo sapiens
actcaggaggctgagacagga

SEQ ID NO: 2886717 - DNA, 17 bp, Homo sapiens
actcaggcccaaagcct

SEQ ID NO: 2886718 - DNA, 20 bp, Homo sapiens
actcagggcagcgccaggct

SEQ ID NO: 2886719 - DNA, 14 bp, Homo sapiens
actcagggcagctg

SEQ ID NO: 2886720 - DNA, 19 bp, Homo sapiens
actcaggggtcactgaggc

SEQ ID NO: 2886721 - DNA, 13 bp, Homo sapiens
actcaggtgcaca

SEQ ID NO: 2886722 - DNA, 22 bp, Homo sapiens
actcaggttcacagcagctttg

SEQ ID NO: 2886723 - DNA, 12 bp, Homo sapiens
actcagtgcaga

SEQ ID NO: 2886724 - DNA, 14 bp, Homo sapiens
actcagtttcatat

SEQ ID NO: 2886725 - DNA, 13 bp, Homo sapiens
actcagttttctt

SEQ ID NO: 2886726 - DNA, 23 bp, Homo sapiens
actcataatctataaacaatgaa

SEQ ID NO: 2886727 - DNA, 13 bp, Homo sapiens
actcatagttttt

SEQ ID NO: 2886728 - DNA, 13 bp, Homo sapiens
actcatcatttgt

SEQ ID NO: 2886729 - DNA, 17 bp, Homo sapiens
actcatcctgaacagca

SEQ ID NO: 2886730 - DNA, 20 bp, Homo sapiens
actcatctttagagcaacag

SEQ ID NO: 2886731 - DNA, 24 bp, Homo sapiens
actcatctttatcctaaaaatctg

SEQ ID NO: 2886732 - DNA, 16 bp, Homo sapiens
actcatgcctctgagc

SEQ ID NO: 2886733 - DNA, 15 bp, Homo sapiens
actcatgtgactctt

SEQ ID NO: 2886734 - DNA, 17 bp, Homo sapiens
actcatgtgactctttc

SEQ ID NO: 2886735 - DNA, 10 bp, Homo sapiens
actcatgtgt

SEQ ID NO: 2886736 - DNA, 11 bp, Homo sapiens
actcatgtgta

SEQ ID NO: 2886737 - DNA, 21 bp, Homo sapiens
actcatgtgtatgggcaaaaa

SEQ ID NO: 2886738 - DNA, 14 bp, Homo sapiens
actcattagactgg

SEQ ID NO: 2886739 - DNA, 21 bp, Homo sapiens
actcattcaaaagttgaaatt

SEQ ID NO: 2886740 - DNA, 19 bp, Homo sapiens
actcattctgaaggagccc

SEQ ID NO: 2886741 - DNA, 18 bp, Homo sapiens
actcattgctgagcctct

SEQ ID NO: 2886742 - DNA, 22 bp, Homo sapiens
actcattgctgagcctctgctc

SEQ ID NO: 2886743 - DNA, 19 bp, Homo sapiens
actccaaaaagacaagtgc

SEQ ID NO: 2886744 - DNA, 20 bp, Homo sapiens
actccaaaaagacaagtgct

SEQ ID NO: 2886745 - DNA, 20 bp, Homo sapiens
actccaacctaacctgtgtc

SEQ ID NO: 2886746 - DNA, 21 bp, Homo sapiens
actccaacctaacctgtgtct

SEQ ID NO: 2886747 - DNA, 22 bp, Homo sapiens
actccaagccccctggcagctg

SEQ ID NO: 2886748 - DNA, 15 bp, Homo sapiens
actccaccaacccat

SEQ ID NO: 2886749 - DNA, 13 bp, Homo sapiens
actccaccttccc

SEQ ID NO: 2886750 - DNA, 20 bp, Homo sapiens
actccagaattacccttcct

SEQ ID NO: 2886751 - DNA, 22 bp, Homo sapiens
actccagaattacccttcctca

SEQ ID NO: 2886752 - DNA, 11 bp, Homo sapiens
actccagagaa

SEQ ID NO: 2886753 - DNA, 11 bp, Homo sapiens
actccagcctg

SEQ ID NO: 2886754 - DNA, 18 bp, Homo sapiens
actccagcctgagtgaca

SEQ ID NO: 2886755 - DNA, 18 bp, Homo sapiens
actccagcctgggtcaca

SEQ ID NO: 2886756 - DNA, 23 bp, Homo sapiens
actccagcctgggtcacagagtg

SEQ ID NO: 2886757 - DNA, 15 bp, Homo sapiens
actccagcctgggtg

SEQ ID NO: 2886758 - DNA, 18 bp, Homo sapiens
actccagctggtgccccc

SEQ ID NO: 2886759 - DNA, 17 bp, Homo sapiens
acggggaccactgggcc

SEQ ID NO: 2886760 - DNA, 18 bp, Homo sapiens
acggggaccactgggccc

SEQ ID NO: 2886761 - DNA, 12 bp, Homo sapiens
acggggagaaaa

SEQ ID NO: 2886762 - DNA, 15 bp, Homo sapiens
acgggggctgtgact

SEQ ID NO: 2886763 - DNA, 23 bp, Homo sapiens
acgggtgcccgtaatcccagcta

SEQ ID NO: 2886764 - DNA, 23 bp, Homo sapiens
acggtgacagtgacgtgactcag

SEQ ID NO: 2886765 - DNA, 17 bp, Homo sapiens
acggtgttttgccatgt

SEQ ID NO: 2886766 - DNA, 15 bp, Homo sapiens
acggtttctgttctg

SEQ ID NO: 2886767 - DNA, 18 bp, Homo sapiens
acgtaaaatttacagtca

SEQ ID NO: 2886768 - DNA, 13 bp, Homo sapiens
acgtaagcactgt

SEQ ID NO: 2886769 - DNA, 17 bp, Homo sapiens
acgtactacttgtttca

SEQ ID NO: 2886770 - DNA, 24 bp, Homo sapiens
acgtagcttctaccatgaacagaa

SEQ ID NO: 2886771 - DNA, 13 bp, Homo sapiens
acgtatgcatgtg

SEQ ID NO: 2886772 - DNA, 15 bp, Homo sapiens
acgtatgcatttttt

SEQ ID NO: 2886773 - DNA, 21 bp, Homo sapiens
acgtatgcatttttttagttt

SEQ ID NO: 2886774 - DNA, 21 bp, Homo sapiens
acgtatgtatttcattgctgt

SEQ ID NO: 2886775 - DNA, 17 bp, Homo sapiens
acgtatttcacagagca

SEQ ID NO: 2886776 - DNA, 17 bp, Homo sapiens
acgtcacccaaaagcac

SEQ ID NO: 2886777 - DNA, 21 bp, Homo sapiens
acgtcacgtgtagtgtccatt

SEQ ID NO: 2886778 - DNA, 17 bp, Homo sapiens
acgtcagacttggctca

SEQ ID NO: 2886779 - DNA, 18 bp, Homo sapiens
acgtcagacttggctcag

SEQ ID NO: 2886780 - DNA, 21 bp, Homo sapiens
acgtccacgcggccacctcac

SEQ ID NO: 2886781 - DNA, 14 bp, Homo sapiens
acgtccatctctct

SEQ ID NO: 2886782 - DNA, 19 bp, Homo sapiens
acgtccatctctctccctt

SEQ ID NO: 2886783 - DNA, 18 bp, Homo sapiens
acgtcccagcggcctcag

SEQ ID NO: 2886784 - DNA, 21 bp, Homo sapiens
acgtcccagcggcctcagggt

SEQ ID NO: 2886785 - DNA, 11 bp, Homo sapiens
acgtctagcct

SEQ ID NO: 2886786 - DNA, 13 bp, Homo sapiens
acgtctcccagat

SEQ ID NO: 2886787 - DNA, 12 bp, Homo sapiens
acgtctctctgc

SEQ ID NO: 2886788 - DNA, 14 bp, Homo sapiens
acgtctctctgcct

SEQ ID NO: 2886789 - DNA, 19 bp, Homo sapiens
acgtctctctgcctgctgg

SEQ ID NO: 2886790 - DNA, 23 bp, Homo sapiens
acgtctctctgcctgctgggctc

SEQ ID NO: 2886791 - DNA, 14 bp, Homo sapiens
acgtctggccctgg

SEQ ID NO: 2886792 - DNA, 23 bp, Homo sapiens
acgtctggccctggcgggtggct

SEQ ID NO: 2886793 - DNA, 13 bp, Homo sapiens
acgtgacacaaac

SEQ ID NO: 2886794 - DNA, 20 bp, Homo sapiens
acgtgacacaaacacacaca

SEQ ID NO: 2886795 - DNA, 21 bp, Homo sapiens
acgtgacacaaacacacacaa

SEQ ID NO: 2886796 - DNA, 14 bp, Homo sapiens
acgtgactgcccca

SEQ ID NO: 2886797 - DNA, 20 bp, Homo sapiens
acgtgatcctctcacctcag

SEQ ID NO: 2886798 - DNA, 13 bp, Homo sapiens
acgtgcactgtga

SEQ ID NO: 2886799 - DNA, 15 bp, Homo sapiens
acgtgcactgtgaat

SEQ ID NO: 2886800 - DNA, 22 bp, Homo sapiens
acgtgcgctgggcacttccctg

SEQ ID NO: 2886801 - DNA, 23 bp, Homo sapiens
acgtgcgctgggcacttccctgc

SEQ ID NO: 2886802 - DNA, 15 bp, Homo sapiens
acgtgctggccttgg

SEQ ID NO: 2886803 - DNA, 13 bp, Homo sapiens
acgtggagacagc

SEQ ID NO: 2886804 - DNA, 14 bp, Homo sapiens
acgtggctcagcca

SEQ ID NO: 2886805 - DNA, 17 bp, Homo sapiens
acgtggctcagccagca

SEQ ID NO: 2886806 - DNA, 19 bp, Homo sapiens
acgtggctcagccagcact

SEQ ID NO: 2886807 - DNA, 22 bp, Homo sapiens
acgtgtaaatgaagatctttat

SEQ ID NO: 2886808 - DNA, 11 bp, Homo sapiens
acgtgtagtgt

SEQ ID NO: 2886809 - DNA, 16 bp, Homo sapiens
acgtgtagtgtccatt

SEQ ID NO: 2886810 - DNA, 17 bp, Homo sapiens
acgtgtgaaatctgtct

SEQ ID NO: 2886811 - DNA, 15 bp, Homo sapiens
acgtgtgatttttct

SEQ ID NO: 2886812 - DNA, 23 bp, Homo sapiens
acgtgtggttcatccatcatctg

SEQ ID NO: 2886813 - DNA, 19 bp, Homo sapiens
acgtgttaattataaacag

SEQ ID NO: 2886814 - DNA, 16 bp, Homo sapiens
acgtgtttgtgctgtg

SEQ ID NO: 2886815 - DNA, 16 bp, Homo sapiens
acgttaaaagtgtaca

SEQ ID NO: 2886816 - DNA, 13 bp, Homo sapiens
acgttcagggagg

SEQ ID NO: 2886817 - DNA, 16 bp, Homo sapiens
acgttcagggaggggc

SEQ ID NO: 2886818 - DNA, 18 bp, Homo sapiens
acgttccttactgcagaa

SEQ ID NO: 2886819 - DNA, 21 bp, Homo sapiens
acgttccttactgcagaatag

SEQ ID NO: 2886820 - DNA, 18 bp, Homo sapiens
acgtttacaagccccccc

SEQ ID NO: 2886821 - DNA, 13 bp, Homo sapiens
acgtttcttcccc

SEQ ID NO: 2886822 - DNA, 15 bp, Homo sapiens
acgtttgcaccgcct

SEQ ID NO: 2886823 - DNA, 13 bp, Homo sapiens
acgtttgtgcaga

SEQ ID NO: 2886824 - DNA, 15 bp, Homo sapiens
acgtttgtgcagaat

SEQ ID NO: 2886825 - DNA, 17 bp, Homo sapiens
acgttttagaaaatttt

SEQ ID NO: 2886826 - DNA, 16 bp, Homo sapiens
acgtttttaataggat

SEQ ID NO: 2886827 - DNA, 13 bp, Homo sapiens
acgttttttcttc

SEQ ID NO: 2886828 - DNA, 12 bp, Homo sapiens
actaaactcatt

SEQ ID NO: 2886829 - DNA, 16 bp, Homo sapiens
actaaactcatttata

SEQ ID NO: 2886830 - DNA, 20 bp, Homo sapiens
actaaagaagatctgtaatt

SEQ ID NO: 2886831 - DNA, 11 bp, Homo sapiens
actaaagcaat

SEQ ID NO: 2886832 - DNA, 17 bp, Homo sapiens
actaaagccaaacatat

SEQ ID NO: 2886833 - DNA, 22 bp, Homo sapiens
actaaaggtggccacaaattct

SEQ ID NO: 2886834 - DNA, 15 bp, Homo sapiens
actaaatgtgtacac

SEQ ID NO: 2886835 - DNA, 19 bp, Homo sapiens
actaactgctgattttgac

SEQ ID NO: 2886836 - DNA, 22 bp, Homo sapiens
actaagcagaggaggggccgct

SEQ ID NO: 2886837 - DNA, 13 bp, Homo sapiens
actaagccaagct

SEQ ID NO: 2886838 - DNA, 19 bp, Homo sapiens
actaagccaagctgtgttc

SEQ ID NO: 2886839 - DNA, 14 bp, Homo sapiens
actaagccaggagg

SEQ ID NO: 2886840 - DNA, 22 bp, Homo sapiens
actaagttattgttaattatgt

SEQ ID NO: 2886841 - DNA, 15 bp, Homo sapiens
actaagttattttat

SEQ ID NO: 2886842 - DNA, 16 bp, Homo sapiens
actaagttattttatg

SEQ ID NO: 2886843 - DNA, 17 bp, Homo sapiens
actaagttattttatga

SEQ ID NO: 2886844 - DNA, 22 bp, Homo sapiens
actaagttattttatgacatga

SEQ ID NO: 2886845 - DNA, 19 bp, Homo sapiens
actaatattttatgtgaga

SEQ ID NO: 2886846 - DNA, 14 bp, Homo sapiens
actaatctttctgc

SEQ ID NO: 2886847 - DNA, 18 bp, Homo sapiens
actaatgaattgaaattt

SEQ ID NO: 2886848 - DNA, 13 bp, Homo sapiens
actaatggcatga

SEQ ID NO: 2886849 - DNA, 16 bp, Homo sapiens
actaatggcatgagaa

SEQ ID NO: 2886850 - DNA, 21 bp, Homo sapiens
actaatggcatgagaaataca

SEQ ID NO: 2886851 - DNA, 21 bp, Homo sapiens
actaatgttagaattgatttc

SEQ ID NO: 2886852 - DNA, 16 bp, Homo sapiens
actaattgtataacag

SEQ ID NO: 2886853 - DNA, 17 bp, Homo sapiens
actaattgtataacagg

SEQ ID NO: 2886854 - DNA, 20 bp, Homo sapiens
actaatttcaaaatgctttt

SEQ ID NO: 2886855 - DNA, 15 bp, Homo sapiens
actaattttacatgt

SEQ ID NO: 2886856 - DNA, 13 bp, Homo sapiens
actacaccacaca

SEQ ID NO: 2886857 - DNA, 23 bp, Homo sapiens
actacaccacacacaacagccaa

SEQ ID NO: 2886858 - DNA, 23 bp, Homo sapiens
actacaccatgtttgagctcaga

SEQ ID NO: 2886859 - DNA, 23 bp, Homo sapiens
actacagaaatgaggaggatgct

SEQ ID NO: 2886860 - DNA, 15 bp, Homo sapiens
actacagtcaggaaa

SEQ ID NO: 2886861 - DNA, 16 bp, Homo sapiens
actacattttgctctg

SEQ ID NO: 2886862 - DNA, 18 bp, Homo sapiens
actacattttgctctgtg

SEQ ID NO: 2886863 - DNA, 14 bp, Homo sapiens
actacattttttca

SEQ ID NO: 2886864 - DNA, 22 bp, Homo sapiens
actacctagaagtaagaagagg

SEQ ID NO: 2886865 - DNA, 18 bp, Homo sapiens
actacctgtatttaaaaa

SEQ ID NO: 2886866 - DNA, 22 bp, Homo sapiens
actacctgtatttaaaaataga

SEQ ID NO: 2886867 - DNA, 17 bp, Homo sapiens
actaccttgaaaataag

SEQ ID NO: 2886868 - DNA, 20 bp, Homo sapiens
actactgctaccacaactat

SEQ ID NO: 2886869 - DNA, 12 bp, Homo sapiens
actagacaagcc

SEQ ID NO: 2886870 - DNA, 12 bp, Homo sapiens
actagagaaggg

SEQ ID NO: 2886871 - DNA, 20 bp, Homo sapiens
actagagggacctctcccag

SEQ ID NO: 2886872 - DNA, 13 bp, Homo sapiens
actagcctggcca

SEQ ID NO: 2886873 - DNA, 23 bp, Homo sapiens
actagctagaagtgggccaggac

SEQ ID NO: 2886874 - DNA, 14 bp, Homo sapiens
actagggagccatg

SEQ ID NO: 2886875 - DNA, 18 bp, Homo sapiens
actagggagccatgtttc

SEQ ID NO: 2886876 - DNA, 19 bp, Homo sapiens
actagggagccatttgaga

SEQ ID NO: 2886877 - DNA, 16 bp, Homo sapiens
actagggatccctcat

SEQ ID NO: 2886878 - DNA, 19 bp, Homo sapiens
actagggatccctcatctg

SEQ ID NO: 2886879 - DNA, 21 bp, Homo sapiens
actagggcctcggaggctcct

SEQ ID NO: 2886880 - DNA, 22 bp, Homo sapiens
actagggcctcggaggctcctc

SEQ ID NO: 2886881 - DNA, 16 bp, Homo sapiens
actagggttttggcct

SEQ ID NO: 2886882 - DNA, 22 bp, Homo sapiens
actaggtgcccagaatgaggct

SEQ ID NO: 2886883 - DNA, 13 bp, Homo sapiens
actaggtgccttt

SEQ ID NO: 2886884 - DNA, 14 bp, Homo sapiens
actagtagttctct

SEQ ID NO: 2886885 - DNA, 19 bp, Homo sapiens
actagtgagtcagcacctt

SEQ ID NO: 2886886 - DNA, 23 bp, Homo sapiens
actagtgtccgcataagaaaaag

SEQ ID NO: 2886887 - DNA, 18 bp, Homo sapiens
actagttacacatcttca

SEQ ID NO: 2886888 - DNA, 22 bp, Homo sapiens
actagttacacatcttcaacag

SEQ ID NO: 2886889 - DNA, 17 bp, Homo sapiens
actagttgtgaccttag

SEQ ID NO: 2886890 - DNA, 20 bp, Homo sapiens
actagttgtgaccttagtgt

SEQ ID NO: 2886891 - DNA, 22 bp, Homo sapiens
actagttttaaaaacctgtgtt

SEQ ID NO: 2886892 - DNA, 18 bp, Homo sapiens
actataaagctgttattc

SEQ ID NO: 2886893 - DNA, 17 bp, Homo sapiens
actataaatacaaatct

SEQ ID NO: 2886894 - DNA, 14 bp, Homo sapiens
actataacaaaaaa

SEQ ID NO: 2886895 - DNA, 17 bp, Homo sapiens
actctttgctttgtagt

SEQ ID NO: 2886896 - DNA, 17 bp, Homo sapiens
actgaaaaaatactacc

SEQ ID NO: 2886897 - DNA, 13 bp, Homo sapiens
actgaaaaagcaa

SEQ ID NO: 2886898 - DNA, 15 bp, Homo sapiens
actgaaaacctctcc

SEQ ID NO: 2886899 - DNA, 13 bp, Homo sapiens
actgaaaaggaaa

SEQ ID NO: 2886900 - DNA, 15 bp, Homo sapiens
actgaaaccattttc

SEQ ID NO: 2886901 - DNA, 13 bp, Homo sapiens
actgaaagaagaa

SEQ ID NO: 2886902 - DNA, 14 bp, Homo sapiens
actgaaatctgtca

SEQ ID NO: 2886903 - DNA, 17 bp, Homo sapiens
actgaaatctgtcaaga

SEQ ID NO: 2886904 - DNA, 18 bp, Homo sapiens
actgaaatcttgtaagta

SEQ ID NO: 2886905 - DNA, 20 bp, Homo sapiens
actgaaccaaattgcactga

SEQ ID NO: 2886906 - DNA, 14 bp, Homo sapiens
actgaaccagccac

SEQ ID NO: 2886907 - DNA, 21 bp, Homo sapiens
actgaagatttatttttaata

SEQ ID NO: 2886908 - DNA, 23 bp, Homo sapiens
actgaagcgaacatcttcatata

SEQ ID NO: 2886909 - DNA, 13 bp, Homo sapiens
actgaagctgctg

SEQ ID NO: 2886910 - DNA, 18 bp, Homo sapiens
actgaagctgctgtaact

SEQ ID NO: 2886911 - DNA, 13 bp, Homo sapiens
actgaaggagaag

SEQ ID NO: 2886912 - DNA, 19 bp, Homo sapiens
actgaagtagtgtgcagtt

SEQ ID NO: 2886913 - DNA, 21 bp, Homo sapiens
actgaagtttttgaaatacct

SEQ ID NO: 2886914 - DNA, 18 bp, Homo sapiens
actgaatcaggaaactca

SEQ ID NO: 2886915 - DNA, 21 bp, Homo sapiens
actgaatgaaacccccacaca

SEQ ID NO: 2886916 - DNA, 22 bp, Homo sapiens
actgaatgaaacccccacacac

SEQ ID NO: 2886917 - DNA, 20 bp, Homo sapiens
actgaatgggatcatgaaag

SEQ ID NO: 2886918 - DNA, 15 bp, Homo sapiens
actgaattaaacatg

SEQ ID NO: 2886919 - DNA, 17 bp, Homo sapiens
actgaattgtccccagt

SEQ ID NO: 2886920 - DNA, 16 bp, Homo sapiens
actgaatttctttgat

SEQ ID NO: 2886921 - DNA, 19 bp, Homo sapiens
actgaatttctttgattta

SEQ ID NO: 2886922 - DNA, 22 bp, Homo sapiens
actgaatttctttgatttaact

SEQ ID NO: 2886923 - DNA, 23 bp, Homo sapiens
actgacatgattagcagaagaaa

SEQ ID NO: 2886924 - DNA, 15 bp, Homo sapiens
actgacattgctcca

SEQ ID NO: 2886925 - DNA, 17 bp, Homo sapiens
actgacctggtccacag

SEQ ID NO: 2886926 - DNA, 18 bp, Homo sapiens
actgactaaccattgatg

SEQ ID NO: 2886927 - DNA, 17 bp, Homo sapiens
actgactgaactagagc

SEQ ID NO: 2886928 - DNA, 13 bp, Homo sapiens
actgacttaggtt

SEQ ID NO: 2886929 - DNA, 19 bp, Homo sapiens
actgagataccagcgagga

SEQ ID NO: 2886930 - DNA, 14 bp, Homo sapiens
actgagatttctta

SEQ ID NO: 2886931 - DNA, 19 bp, Homo sapiens
actgagatttcttaaatct

SEQ ID NO: 2886932 - DNA, 12 bp, Homo sapiens
actgagcatcac

SEQ ID NO: 2886933 - DNA, 18 bp, Homo sapiens
actgagcgaggaaaaaca

SEQ ID NO: 2886934 - DNA, 23 bp, Homo sapiens
actgagcgaggaaaaacaacaaa

SEQ ID NO: 2886935 - DNA, 15 bp, Homo sapiens
actgagcgcaagcca

SEQ ID NO: 2886936 - DNA, 21 bp, Homo sapiens
actgagcgcaagccacagcct

SEQ ID NO: 2886937 - DNA, 19 bp, Homo sapiens
actgagcggccgcagagac

SEQ ID NO: 2886938 - DNA, 22 bp, Homo sapiens
actgagcggccgcagagactgg

SEQ ID NO: 2886939 - DNA, 15 bp, Homo sapiens
actgagctctccagg

SEQ ID NO: 2886940 - DNA, 18 bp, Homo sapiens
actgagctctccaggcca

SEQ ID NO: 2886941 - DNA, 17 bp, Homo sapiens
actgagcttggaagctt

SEQ ID NO: 2886942 - DNA, 12 bp, Homo sapiens
actgaggcaggg

SEQ ID NO: 2886943 - DNA, 15 bp, Homo sapiens
actgaggcagggaag

SEQ ID NO: 2886944 - DNA, 19 bp, Homo sapiens
actgaggcctgagacccag

SEQ ID NO: 2886945 - DNA, 14 bp, Homo sapiens
actgaggccttgtg

SEQ ID NO: 2886946 - DNA, 15 bp, Homo sapiens
actgaggccttgtgt

SEQ ID NO: 2886947 - DNA, 20 bp, Homo sapiens
actgagtccctggcaagact

SEQ ID NO: 2886948 - DNA, 14 bp, Homo sapiens
actgagtgaaggaa

SEQ ID NO: 2886949 - DNA, 23 bp, Homo sapiens
actgagtgactctatatagctga

SEQ ID NO: 2886950 - DNA, 23 bp, Homo sapiens
actgagtgtgggagtgcagagaa

SEQ ID NO: 2886951 - DNA, 13 bp, Homo sapiens
actgagtttctat

SEQ ID NO: 2886952 - DNA, 14 bp, Homo sapiens
actgagtttctatt

SEQ ID NO: 2886953 - DNA, 18 bp, Homo sapiens
actgataaaaatgatatt

SEQ ID NO: 2886954 - DNA, 18 bp, Homo sapiens
actgatagttactgttgt

SEQ ID NO: 2886955 - DNA, 18 bp, Homo sapiens
actgatcaggacctccaa

SEQ ID NO: 2886956 - DNA, 16 bp, Homo sapiens
actgatccagccctga

SEQ ID NO: 2886957 - DNA, 13 bp, Homo sapiens
actgatccctggc

SEQ ID NO: 2886958 - DNA, 16 bp, Homo sapiens
actgatgcaaggatta

SEQ ID NO: 2886959 - DNA, 22 bp, Homo sapiens
actgatgccaaggggctgagtg

SEQ ID NO: 2886960 - DNA, 12 bp, Homo sapiens
actgatgctgcc

SEQ ID NO: 2886961 - DNA, 14 bp, Homo sapiens
actgatgctgcccc

SEQ ID NO: 2886962 - DNA, 18 bp, Homo sapiens
actgatggaagcacacaa

SEQ ID NO: 2886963 - DNA, 22 bp, Homo sapiens
actgatgtagaaggcaggattt

SEQ ID NO: 2886964 - DNA, 20 bp, Homo sapiens
actgattcacatctcatttt

SEQ ID NO: 2886965 - DNA, 13 bp, Homo sapiens
actgattgtttca

SEQ ID NO: 2886966 - DNA, 22 bp, Homo sapiens
actgatttgcaataaaaatgat

SEQ ID NO: 2886967 - DNA, 16 bp, Homo sapiens
actgattttacaaatt

SEQ ID NO: 2886968 - DNA, 15 bp, Homo sapiens
actgattttgaaaag

SEQ ID NO: 2886969 - DNA, 13 bp, Homo sapiens
actgcaaatgtgc

SEQ ID NO: 2886970 - DNA, 15 bp, Homo sapiens
actgcaacctctgcc

SEQ ID NO: 2886971 - DNA, 22 bp, Homo sapiens
actgcaacttaacttaaaattg

SEQ ID NO: 2886972 - DNA, 17 bp, Homo sapiens
actgcaagctccaactc

SEQ ID NO: 2886973 - DNA, 22 bp, Homo sapiens
actgcaagtccttttgtaaagt

SEQ ID NO: 2886974 - DNA, 22 bp, Homo sapiens
actgcacaataaaaccaagcct

SEQ ID NO: 2886975 - DNA, 17 bp, Homo sapiens
actgcacatgaagaaat

SEQ ID NO: 2886976 - DNA, 22 bp, Homo sapiens
actgcacccacctacttagata

SEQ ID NO: 2886977 - DNA, 14 bp, Homo sapiens
actgcactccagcc

SEQ ID NO: 2886978 - DNA, 17 bp, Homo sapiens
actgcactccagcctgg

SEQ ID NO: 2886979 - DNA, 21 bp, Homo sapiens
actgcagcctcaacctcctgg

SEQ ID NO: 2886980 - DNA, 21 bp, Homo sapiens
actgcaggccccgcttgtcca

SEQ ID NO: 2886981 - DNA, 23 bp, Homo sapiens
actgcagggaaaattatttgcat

SEQ ID NO: 2886982 - DNA, 21 bp, Homo sapiens
actgcaggggttatgtggaag

SEQ ID NO: 2886983 - DNA, 23 bp, Homo sapiens
actgcagtcatcaacaatgatta

SEQ ID NO: 2886984 - DNA, 14 bp, Homo sapiens
actgcatacaatct

SEQ ID NO: 2886985 - DNA, 21 bp, Homo sapiens
actgcatggagacgcatttcg

SEQ ID NO: 2886986 - DNA, 21 bp, Homo sapiens
actgcatgtggcttctctgtc

SEQ ID NO: 2886987 - DNA, 22 bp, Homo sapiens
actgcatgtggcttctctgtct

SEQ ID NO: 2886988 - DNA, 23 bp, Homo sapiens
actgccacgtgccttaggaatac

SEQ ID NO: 2886989 - DNA, 14 bp, Homo sapiens
actgccagatgctg

SEQ ID NO: 2886990 - DNA, 22 bp, Homo sapiens
actgccagatgctgatgttcag

SEQ ID NO: 2886991 - DNA, 23 bp, Homo sapiens
actgccaggattttgtattgcca

SEQ ID NO: 2886992 - DNA, 15 bp, Homo sapiens
actgccatcaaactg

SEQ ID NO: 2886993 - DNA, 18 bp, Homo sapiens
actgccattacccagtgc

SEQ ID NO: 2886994 - DNA, 11 bp, Homo sapiens
actgcccagcc

SEQ ID NO: 2886995 - DNA, 22 bp, Homo sapiens
actgcccagccactccaagccc

SEQ ID NO: 2886996 - DNA, 13 bp, Homo sapiens
actgccctctgaa

SEQ ID NO: 2886997 - DNA, 23 bp, Homo sapiens
actgcctcccccgaatgcatttg

SEQ ID NO: 2886998 - DNA, 10 bp, Homo sapiens
actgcctcct

SEQ ID NO: 2886999 - DNA, 11 bp, Homo sapiens
actgcctcctc

SEQ ID NO: 2887000 - DNA, 13 bp, Homo sapiens
actgcctcctccc

SEQ ID NO: 2887001 - DNA, 15 bp, Homo sapiens
actgcctgaataaag

SEQ ID NO: 2887002 - DNA, 20 bp, Homo sapiens
actgcctggattccatttat

SEQ ID NO: 2887003 - DNA, 11 bp, Homo sapiens
actgcctgggc

SEQ ID NO: 2887004 - DNA, 16 bp, Homo sapiens
actgcctttggcagag

SEQ ID NO: 2887005 - DNA, 17 bp, Homo sapiens
actgctaaataaaattt

SEQ ID NO: 2887006 - DNA, 14 bp, Homo sapiens
actgctacacttct

SEQ ID NO: 2887007 - DNA, 16 bp, Homo sapiens
actgctacacttctga

SEQ ID NO: 2887008 - DNA, 16 bp, Homo sapiens
actgctaccttcctag

SEQ ID NO: 2887009 - DNA, 19 bp, Homo sapiens
actgctacttgctctgctc

SEQ ID NO: 2887010 - DNA, 20 bp, Homo sapiens
actgctacttgctctgctct

SEQ ID NO: 2887011 - DNA, 22 bp, Homo sapiens
actgctgagatacatacagaat

SEQ ID NO: 2887012 - DNA, 19 bp, Homo sapiens
actgctgatgctgaaataa

SEQ ID NO: 2887013 - DNA, 22 bp, Homo sapiens
actgctgatgctgaaataaact

SEQ ID NO: 2887014 - DNA, 15 bp, Homo sapiens
actgctgccttaccc

SEQ ID NO: 2887015 - DNA, 13 bp, Homo sapiens
actgctgctactg

SEQ ID NO: 2887016 - DNA, 19 bp, Homo sapiens
actgctgctactgcccctc

SEQ ID NO: 2887017 - DNA, 22 bp, Homo sapiens
actgctgctactgcccctctcc

SEQ ID NO: 2887018 - DNA, 13 bp, Homo sapiens
actgctgctcctc

SEQ ID NO: 2887019 - DNA, 16 bp, Homo sapiens
actgctgctcctcttt

SEQ ID NO: 2887020 - DNA, 12 bp, Homo sapiens
actgctgctgtg

SEQ ID NO: 2887021 - DNA, 14 bp, Homo sapiens
actgctgctgtgct

SEQ ID NO: 2887022 - DNA, 12 bp, Homo sapiens
actgctggctca

SEQ ID NO: 2887023 - DNA, 12 bp, Homo sapiens
actgctggggct

SEQ ID NO: 2887024 - DNA, 16 bp, Homo sapiens
actgctggggctggtg

SEQ ID NO: 2887025 - DNA, 17 bp, Homo sapiens
actgctggggctggtga

SEQ ID NO: 2887026 - DNA, 22 bp, Homo sapiens
actgctggggctggtgaggccg

SEQ ID NO: 2887027 - DNA, 22 bp, Homo sapiens
actgctgtaaataaatgcttta

SEQ ID NO: 2887028 - DNA, 16 bp, Homo sapiens
actgcttaattgctga

SEQ ID NO: 2887029 - DNA, 15 bp, Homo sapiens
actgcttctcggcca

SEQ ID NO: 2887030 - DNA, 15 bp, Homo sapiens
actgcttgaggaaaa

SEQ ID NO: 2887031 - DNA, 21 bp, Homo sapiens
actgcttgcttacaatcttta

SEQ ID NO: 2887032 - DNA, 13 bp, Homo sapiens
agaatactgccaa

SEQ ID NO: 2887033 - DNA, 22 bp, Homo sapiens
agaatactgccaaaacatttat

SEQ ID NO: 2887034 - DNA, 19 bp, Homo sapiens
agaatactgcttgcttaca

SEQ ID NO: 2887035 - DNA, 15 bp, Homo sapiens
agaatacttgaactt

SEQ ID NO: 2887036 - DNA, 22 bp, Homo sapiens
agaatagaaataaaggatgtga

SEQ ID NO: 2887037 - DNA, 16 bp, Homo sapiens
agaatagagctgccac

SEQ ID NO: 2887038 - DNA, 19 bp, Homo sapiens
agaatagcatctgtacaaa

SEQ ID NO: 2887039 - DNA, 21 bp, Homo sapiens
agaatagccacatttggaata

SEQ ID NO: 2887040 - DNA, 15 bp, Homo sapiens
agaatataacatgaa

SEQ ID NO: 2887041 - DNA, 16 bp, Homo sapiens
agaatataacatgaaa

SEQ ID NO: 2887042 - DNA, 13 bp, Homo sapiens
agaatatgataaa

SEQ ID NO: 2887043 - DNA, 19 bp, Homo sapiens
agaatattagctttactgt

SEQ ID NO: 2887044 - DNA, 23 bp, Homo sapiens
agaatattagctttactgtttgt

SEQ ID NO: 2887045 - DNA, 14 bp, Homo sapiens
agaatcacttgaac

SEQ ID NO: 2887046 - DNA, 16 bp, Homo sapiens
agaatccacatttcta

SEQ ID NO: 2887047 - DNA, 18 bp, Homo sapiens
agaatcccaaatttgatt

SEQ ID NO: 2887048 - DNA, 19 bp, Homo sapiens
agaatcccaaatttgattg

SEQ ID NO: 2887049 - DNA, 16 bp, Homo sapiens
agaatccctagacttt

SEQ ID NO: 2887050 - DNA, 19 bp, Homo sapiens
agaatccctctacatggac

SEQ ID NO: 2887051 - DNA, 14 bp, Homo sapiens
agaatcctgcttta

SEQ ID NO: 2887052 - DNA, 13 bp, Homo sapiens
agaatcctgggcc

SEQ ID NO: 2887053 - DNA, 16 bp, Homo sapiens
agaatctaaagccagt

SEQ ID NO: 2887054 - DNA, 13 bp, Homo sapiens
agaatctctttcg

SEQ ID NO: 2887055 - DNA, 20 bp, Homo sapiens
agaatcttggtttgccttcc

SEQ ID NO: 2887056 - DNA, 13 bp, Homo sapiens
agaatctttcttc

SEQ ID NO: 2887057 - DNA, 12 bp, Homo sapiens
agaatgaaagag

SEQ ID NO: 2887058 - DNA, 12 bp, Homo sapiens
agaatgaggctg

SEQ ID NO: 2887059 - DNA, 16 bp, Homo sapiens
agaatgcagcccacca

SEQ ID NO: 2887060 - DNA, 19 bp, Homo sapiens
agaatgcagcccaccagga

SEQ ID NO: 2887061 - DNA, 21 bp, Homo sapiens
agaatgcagcccaccaggagc

SEQ ID NO: 2887062 - DNA, 17 bp, Homo sapiens
agaatgcatctcatcaa

SEQ ID NO: 2887063 - DNA, 13 bp, Homo sapiens
agaatgcattgat

SEQ ID NO: 2887064 - DNA, 20 bp, Homo sapiens
agaatgcattgatattgtga

SEQ ID NO: 2887065 - DNA, 15 bp, Homo sapiens
agaatgctgtacatc

SEQ ID NO: 2887066 - DNA, 13 bp, Homo sapiens
agaatggaaaaga

SEQ ID NO: 2887067 - DNA, 23 bp, Homo sapiens
agaatggaaaccacaacttttaa

SEQ ID NO: 2887068 - DNA, 16 bp, Homo sapiens
agaatggaagcctgaa

SEQ ID NO: 2887069 - DNA, 18 bp, Homo sapiens
agaatgggaaagagaaag

SEQ ID NO: 2887070 - DNA, 23 bp, Homo sapiens
agaatgggaaagagaaagagaca

SEQ ID NO: 2887071 - DNA, 23 bp, Homo sapiens
agaatgggggctttcggggaggg

SEQ ID NO: 2887072 - DNA, 23 bp, Homo sapiens
agaatggtttttgttgagtctct

SEQ ID NO: 2887073 - DNA, 16 bp, Homo sapiens
agaatgtaaagcttgt

SEQ ID NO: 2887074 - DNA, 16 bp, Homo sapiens
agaatgtattgtacct

SEQ ID NO: 2887075 - DNA, 14 bp, Homo sapiens
agaatgttaagact

SEQ ID NO: 2887076 - DNA, 19 bp, Homo sapiens
agaatgttaagacttgaca

SEQ ID NO: 2887077 - DNA, 16 bp, Homo sapiens
agaatgttagagcaca

SEQ ID NO: 2887078 - DNA, 17 bp, Homo sapiens
agaattaagctgtgcaa

SEQ ID NO: 2887079 - DNA, 18 bp, Homo sapiens
agaattaatggtcatttg

SEQ ID NO: 2887080 - DNA, 18 bp, Homo sapiens
agaattaccaagagaagg

SEQ ID NO: 2887081 - DNA, 19 bp, Homo sapiens
agaattaccaagagaaggg

SEQ ID NO: 2887082 - DNA, 20 bp, Homo sapiens
agaattagatttctatagga

SEQ ID NO: 2887083 - DNA, 11 bp, Homo sapiens
agaattagctt

SEQ ID NO: 2887084 - DNA, 12 bp, Homo sapiens
agaattccttca

SEQ ID NO: 2887085 - DNA, 18 bp, Homo sapiens
agaattccttcagggtga

SEQ ID NO: 2887086 - DNA, 14 bp, Homo sapiens
agaattctagcttt

SEQ ID NO: 2887087 - DNA, 17 bp, Homo sapiens
agaattctggtcctgtt

SEQ ID NO: 2887088 - DNA, 17 bp, Homo sapiens
agaattcttacatgttt

SEQ ID NO: 2887089 - DNA, 23 bp, Homo sapiens
agaattcttacatgttttctttg

SEQ ID NO: 2887090 - DNA, 15 bp, Homo sapiens
agaattgaaacactt

SEQ ID NO: 2887091 - DNA, 16 bp, Homo sapiens
agaattgaacccagga

SEQ ID NO: 2887092 - DNA, 22 bp, Homo sapiens
agaattgaacccaggaggtgga

SEQ ID NO: 2887093 - DNA, 19 bp, Homo sapiens
agaattgaattctggaaac

SEQ ID NO: 2887094 - DNA, 15 bp, Homo sapiens
agaattgattcatgt

SEQ ID NO: 2887095 - DNA, 21 bp, Homo sapiens
agaattgccaatcttgtttta

SEQ ID NO: 2887096 - DNA, 20 bp, Homo sapiens
agaatttaaattctttttca

SEQ ID NO: 2887097 - DNA, 20 bp, Homo sapiens
agaatttaatttttaaaaga

SEQ ID NO: 2887098 - DNA, 17 bp, Homo sapiens
agaatttgagtgctctg

SEQ ID NO: 2887099 - DNA, 18 bp, Homo sapiens
agaatttgagtgctctga

SEQ ID NO: 2887100 - DNA, 18 bp, Homo sapiens
agaattttaaaaatgaat

SEQ ID NO: 2887101 - DNA, 19 bp, Homo sapiens
agaattttaaaaatgaatc

SEQ ID NO: 2887102 - DNA, 20 bp, Homo sapiens
agaattttaaaaatgaatcc

SEQ ID NO: 2887103 - DNA, 14 bp, Homo sapiens
agaattttttttgt

SEQ ID NO: 2887104 - DNA, 17 bp, Homo sapiens
agacaaaaacagcctca

SEQ ID NO: 2887105 - DNA, 18 bp, Homo sapiens
agacaaagcaggagtgga

SEQ ID NO: 2887106 - DNA, 14 bp, Homo sapiens
agacaaatactcat

SEQ ID NO: 2887107 - DNA, 17 bp, Homo sapiens
agacaaatactcatgtg

SEQ ID NO: 2887108 - DNA, 12 bp, Homo sapiens
agacaaatattt

SEQ ID NO: 2887109 - DNA, 15 bp, Homo sapiens
agacaaatatttgga

SEQ ID NO: 2887110 - DNA, 22 bp, Homo sapiens
agacaaattcaccttcacttag

SEQ ID NO: 2887111 - DNA, 17 bp, Homo sapiens
agacaaattctgtttct

SEQ ID NO: 2887112 - DNA, 18 bp, Homo sapiens
agacaaattctgtttctt

SEQ ID NO: 2887113 - DNA, 12 bp, Homo sapiens
agacaagatggc

SEQ ID NO: 2887114 - DNA, 17 bp, Homo sapiens
agacaagccagaacttg

SEQ ID NO: 2887115 - DNA, 19 bp, Homo sapiens
agacaaggaaaaaataaca

SEQ ID NO: 2887116 - DNA, 22 bp, Homo sapiens
agacaatcacgggcggtcctgc

SEQ ID NO: 2887117 - DNA, 23 bp, Homo sapiens
agacaatcacgggcggtcctgca

SEQ ID NO: 2887118 - DNA, 19 bp, Homo sapiens
agacaatcactgaaacaaa

SEQ ID NO: 2887119 - DNA, 13 bp, Homo sapiens
agacaatgtctgc

SEQ ID NO: 2887120 - DNA, 12 bp, Homo sapiens
agacaatgttgt

SEQ ID NO: 2887121 - DNA, 18 bp, Homo sapiens
agacaattctttatacaa

SEQ ID NO: 2887122 - DNA, 13 bp, Homo sapiens
agacacagatgtt

SEQ ID NO: 2887123 - DNA, 16 bp, Homo sapiens
agacaccaaagttcta

SEQ ID NO: 2887124 - DNA, 21 bp, Homo sapiens
agacaccatcttttgtgagat

SEQ ID NO: 2887125 - DNA, 12 bp, Homo sapiens
agacacccagga

SEQ ID NO: 2887126 - DNA, 13 bp, Homo sapiens
agacacccaggac

SEQ ID NO: 2887127 - DNA, 15 bp, Homo sapiens
agacacccaggactt

SEQ ID NO: 2887128 - DNA, 16 bp, Homo sapiens
agacacccaggactta

SEQ ID NO: 2887129 - DNA, 21 bp, Homo sapiens
agacaccctcaacctcttctg

SEQ ID NO: 2887130 - DNA, 14 bp, Homo sapiens
agacaccctggcag

SEQ ID NO: 2887131 - DNA, 19 bp, Homo sapiens
agacaccgttcattcaggc

SEQ ID NO: 2887132 - DNA, 14 bp, Homo sapiens
agacacctgcacct

SEQ ID NO: 2887133 - DNA, 17 bp, Homo sapiens
agacacctgcacctccc

SEQ ID NO: 2887134 - DNA, 21 bp, Homo sapiens
agacacctgcacctcccccca

SEQ ID NO: 2887135 - DNA, 14 bp, Homo sapiens
agacacctggttgc

SEQ ID NO: 2887136 - DNA, 17 bp, Homo sapiens
agacacctgttcacaga

SEQ ID NO: 2887137 - DNA, 21 bp, Homo sapiens
agacacctgttcacagaaaaa

SEQ ID NO: 2887138 - DNA, 21 bp, Homo sapiens
agacaccttcattttgagggg

SEQ ID NO: 2887139 - DNA, 13 bp, Homo sapiens
agacaccttctgt

SEQ ID NO: 2887140 - DNA, 16 bp, Homo sapiens
agacacgctcttctat

SEQ ID NO: 2887141 - DNA, 23 bp, Homo sapiens
agacactccccgaagtcttttgt

SEQ ID NO: 2887142 - DNA, 12 bp, Homo sapiens
agacactgcctg

SEQ ID NO: 2887143 - DNA, 20 bp, Homo sapiens
agacacttctaaatgaagtg

SEQ ID NO: 2887144 - DNA, 17 bp, Homo sapiens
agacagaaccttgttat

SEQ ID NO: 2887145 - DNA, 18 bp, Homo sapiens
agacagaaccttgttatt

SEQ ID NO: 2887146 - DNA, 12 bp, Homo sapiens
agacagaagtgt

SEQ ID NO: 2887147 - DNA, 15 bp, Homo sapiens
agacagaccctctgc

SEQ ID NO: 2887148 - DNA, 18 bp, Homo sapiens
agacagagaatatgtctg

SEQ ID NO: 2887149 - DNA, 21 bp, Homo sapiens
agacagagaatatgtctgctc

SEQ ID NO: 2887150 - DNA, 11 bp, Homo sapiens
agacagagtct

SEQ ID NO: 2887151 - DNA, 23 bp, Homo sapiens
agacagagtctcgctctgtcgcc

SEQ ID NO: 2887152 - DNA, 19 bp, Homo sapiens
agacagatcactcctggag

SEQ ID NO: 2887153 - DNA, 24 bp, Homo sapiens
agacagccacttttagctactgct

SEQ ID NO: 2887154 - DNA, 17 bp, Homo sapiens
agacagccccctgcccc

SEQ ID NO: 2887155 - DNA, 22 bp, Homo sapiens
agacagccttcacttttctgag

SEQ ID NO: 2887156 - DNA, 17 bp, Homo sapiens
agacagctccaccctgg

SEQ ID NO: 2887157 - DNA, 13 bp, Homo sapiens
agacagctgctca

SEQ ID NO: 2887158 - DNA, 17 bp, Homo sapiens
agaacagtgtttgattt

SEQ ID NO: 2887159 - DNA, 20 bp, Homo sapiens
agaacagtgtttgattttta

SEQ ID NO: 2887160 - DNA, 17 bp, Homo sapiens
agaacataaaggtaaaa

SEQ ID NO: 2887161 - DNA, 20 bp, Homo sapiens
agaacataaaggtaaaacaa

SEQ ID NO: 2887162 - DNA, 14 bp, Homo sapiens
agaacatcattaga

SEQ ID NO: 2887163 - DNA, 16 bp, Homo sapiens
agaacatcattagaac

SEQ ID NO: 2887164 - DNA, 18 bp, Homo sapiens
agaacatcattagaacaa

SEQ ID NO: 2887165 - DNA, 20 bp, Homo sapiens
agaacatcattagaacaaag

SEQ ID NO: 2887166 - DNA, 18 bp, Homo sapiens
agaacatccctgccagct

SEQ ID NO: 2887167 - DNA, 14 bp, Homo sapiens
agaacatgaatcaa

SEQ ID NO: 2887168 - DNA, 17 bp, Homo sapiens
agaacatgaatcaaaag

SEQ ID NO: 2887169 - DNA, 13 bp, Homo sapiens
agaacatgcagtt

SEQ ID NO: 2887170 - DNA, 18 bp, Homo sapiens
agaacatgcagtttgaaa

SEQ ID NO: 2887171 - DNA, 20 bp, Homo sapiens
agaacatggtgtgtgtctct

SEQ ID NO: 2887172 - DNA, 13 bp, Homo sapiens
agaacatgtgaga

SEQ ID NO: 2887173 - DNA, 22 bp, Homo sapiens
agaaccaccccggccccctgcc

SEQ ID NO: 2887174 - DNA, 23 bp, Homo sapiens
agaaccactgacccaaatgaatt

SEQ ID NO: 2887175 - DNA, 23 bp, Homo sapiens
agaaccactgtctagagcaactt

SEQ ID NO: 2887176 - DNA, 12 bp, Homo sapiens
agaaccagcaga

SEQ ID NO: 2887177 - DNA, 14 bp, Homo sapiens
agaaccatgcagga

SEQ ID NO: 2887178 - DNA, 19 bp, Homo sapiens
agaacccttctgctttcta

SEQ ID NO: 2887179 - DNA, 16 bp, Homo sapiens
agaacctaactgtatc

SEQ ID NO: 2887180 - DNA, 19 bp, Homo sapiens
agaacctaactgtatcttg

SEQ ID NO: 2887181 - DNA, 20 bp, Homo sapiens
agaacctaactgtatcttga

SEQ ID NO: 2887182 - DNA, 21 bp, Homo sapiens
agaacctaactgtatcttgag

SEQ ID NO: 2887183 - DNA, 21 bp, Homo sapiens
agaacctcacgcacctcccat

SEQ ID NO: 2887184 - DNA, 12 bp, Homo sapiens
agaaccttctct

SEQ ID NO: 2887185 - DNA, 18 bp, Homo sapiens
agaaccttctctatgggg

SEQ ID NO: 2887186 - DNA, 14 bp, Homo sapiens
agaacctttctgtg

SEQ ID NO: 2887187 - DNA, 18 bp, Homo sapiens
agaacgagcctggaagca

SEQ ID NO: 2887188 - DNA, 17 bp, Homo sapiens
agaacgtggctctgctg

SEQ ID NO: 2887189 - DNA, 17 bp, Homo sapiens
agaactattttattcta

SEQ ID NO: 2887190 - DNA, 19 bp, Homo sapiens
agaactcaaatggggccag

SEQ ID NO: 2887191 - DNA, 16 bp, Homo sapiens
agaactcactggggcc

SEQ ID NO: 2887192 - DNA, 13 bp, Homo sapiens
agaactgaaaaga

SEQ ID NO: 2887193 - DNA, 14 bp, Homo sapiens
agaactgaaaagag

SEQ ID NO: 2887194 - DNA, 17 bp, Homo sapiens
agaactgaaaagagagc

SEQ ID NO: 2887195 - DNA, 12 bp, Homo sapiens
agaactgatttt

SEQ ID NO: 2887196 - DNA, 15 bp, Homo sapiens
agaactgcacatgaa

SEQ ID NO: 2887197 - DNA, 22 bp, Homo sapiens
agaactgcctttggcagagttc

SEQ ID NO: 2887198 - DNA, 15 bp, Homo sapiens
agaactgctaccttc

SEQ ID NO: 2887199 - DNA, 12 bp, Homo sapiens
agaactgctggg

SEQ ID NO: 2887200 - DNA, 16 bp, Homo sapiens
agaactgctggggctg

SEQ ID NO: 2887201 - DNA, 19 bp, Homo sapiens
agaactggttcttgccttc

SEQ ID NO: 2887202 - DNA, 14 bp, Homo sapiens
agaactgtactgtt

SEQ ID NO: 2887203 - DNA, 18 bp, Homo sapiens
agaactgtactgttttct

SEQ ID NO: 2887204 - DNA, 16 bp, Homo sapiens
agaactgtcggaggaa

SEQ ID NO: 2887205 - DNA, 23 bp, Homo sapiens
agaactgtcggaggaaagacaac

SEQ ID NO: 2887206 - DNA, 15 bp, Homo sapiens
agaactttgagctac

SEQ ID NO: 2887207 - DNA, 20 bp, Homo sapiens
agaactttgcatagcagctg

SEQ ID NO: 2887208 - DNA, 12 bp, Homo sapiens
agaagaaaacaa

SEQ ID NO: 2887209 - DNA, 20 bp, Homo sapiens
agaagaaaatggaaccaggc

SEQ ID NO: 2887210 - DNA, 22 bp, Homo sapiens
agaagaaaatggaaccaggctt

SEQ ID NO: 2887211 - DNA, 13 bp, Homo sapiens
agaagaaaatttg

SEQ ID NO: 2887212 - DNA, 15 bp, Homo sapiens
agaagaatctttctt

SEQ ID NO: 2887213 - DNA, 17 bp, Homo sapiens
agaagaattgaacccag

SEQ ID NO: 2887214 - DNA, 22 bp, Homo sapiens
agaagaattttcagaccccagc

SEQ ID NO: 2887215 - DNA, 14 bp, Homo sapiens
agaagacaacagaa

SEQ ID NO: 2887216 - DNA, 16 bp, Homo sapiens
agaagacatgttttag

SEQ ID NO: 2887217 - DNA, 21 bp, Homo sapiens
agaagactgtgcggcacagga

SEQ ID NO: 2887218 - DNA, 15 bp, Homo sapiens
agaagagaggggaag

SEQ ID NO: 2887219 - DNA, 21 bp, Homo sapiens
agaagagccaagagtccagga

SEQ ID NO: 2887220 - DNA, 13 bp, Homo sapiens
agaagaggagcct

SEQ ID NO: 2887221 - DNA, 19 bp, Homo sapiens
agaagaggagcctcagaag

SEQ ID NO: 2887222 - DNA, 14 bp, Homo sapiens
agaagataacattt

SEQ ID NO: 2887223 - DNA, 19 bp, Homo sapiens
agaagataacattttcaat

SEQ ID NO: 2887224 - DNA, 20 bp, Homo sapiens
agaagatatattaaatgtag

SEQ ID NO: 2887225 - DNA, 15 bp, Homo sapiens
agaagcaagaaagaa

SEQ ID NO: 2887226 - DNA, 21 bp, Homo sapiens
agaagcaataataaagtactt

SEQ ID NO: 2887227 - DNA, 16 bp, Homo sapiens
agaagcactttgattg

SEQ ID NO: 2887228 - DNA, 14 bp, Homo sapiens
agaagcagtgagcc

SEQ ID NO: 2887229 - DNA, 17 bp, Homo sapiens
agaagcagtgagccgca

SEQ ID NO: 2887230 - DNA, 17 bp, Homo sapiens
agaagcatgaagtctta

SEQ ID NO: 2887231 - DNA, 18 bp, Homo sapiens
agaagccacccttccctg

SEQ ID NO: 2887232 - DNA, 13 bp, Homo sapiens
agaagccagaggg

SEQ ID NO: 2887233 - DNA, 13 bp, Homo sapiens
agaagccaggaat

SEQ ID NO: 2887234 - DNA, 10 bp, Homo sapiens
agaagccatt

SEQ ID NO: 2887235 - DNA, 22 bp, Homo sapiens
agaagcccagctctgggaactg

SEQ ID NO: 2887236 - DNA, 19 bp, Homo sapiens
agaagccctgttctcgttg

SEQ ID NO: 2887237 - DNA, 19 bp, Homo sapiens
agaagcctccttacattaa

SEQ ID NO: 2887238 - DNA, 21 bp, Homo sapiens
agaagctataaattcctcttt

SEQ ID NO: 2887239 - DNA, 18 bp, Homo sapiens
agaagctcctctccccag

SEQ ID NO: 2887240 - DNA, 19 bp, Homo sapiens
agaagcttcatgccaggtt

SEQ ID NO: 2887241 - DNA, 13 bp, Homo sapiens
agaaggaaagcat

SEQ ID NO: 2887242 - DNA, 23 bp, Homo sapiens
agaaggaaagctttggcagtgtt

SEQ ID NO: 2887243 - DNA, 22 bp, Homo sapiens
agaaggaaggagactcacctct

SEQ ID NO: 2887244 - DNA, 20 bp, Homo sapiens
agaaggaatggtgcgtggct

SEQ ID NO: 2887245 - DNA, 15 bp, Homo sapiens
agaaggacattttct

SEQ ID NO: 2887246 - DNA, 21 bp, Homo sapiens
agaaggacattttctctttaa

SEQ ID NO: 2887247 - DNA, 17 bp, Homo sapiens
agaaggatgtacatttc

SEQ ID NO: 2887248 - DNA, 18 bp, Homo sapiens
agaaggcaacttgaagaa

SEQ ID NO: 2887249 - DNA, 20 bp, Homo sapiens
agaaggcaacttgaagaaac

SEQ ID NO: 2887250 - DNA, 13 bp, Homo sapiens
agaaggcctcccc

SEQ ID NO: 2887251 - DNA, 15 bp, Homo sapiens
agaaggcctcccctg

SEQ ID NO: 2887252 - DNA, 19 bp, Homo sapiens
agaaggcctcccctgagga

SEQ ID NO: 2887253 - DNA, 17 bp, Homo sapiens
agaagggctcctgcagg

SEQ ID NO: 2887254 - DNA, 16 bp, Homo sapiens
agaagggctgaataaa

SEQ ID NO: 2887255 - DNA, 14 bp, Homo sapiens
agaaggtgaacttt

SEQ ID NO: 2887256 - DNA, 21 bp, Homo sapiens
agaaggtgcctcaagaatttc

SEQ ID NO: 2887257 - DNA, 17 bp, Homo sapiens
agaaggtggacctggca

SEQ ID NO: 2887258 - DNA, 20 bp, Homo sapiens
agaaggtggacctggcagtg

SEQ ID NO: 2887259 - DNA, 20 bp, Homo sapiens
agaaggttaccaagaagcct

SEQ ID NO: 2887260 - DNA, 17 bp, Homo sapiens
agaaggtttgtgttttt

SEQ ID NO: 2887261 - DNA, 19 bp, Homo sapiens
agaagtaactcccactcct

SEQ ID NO: 2887262 - DNA, 14 bp, Homo sapiens
agaagtaacttatt

SEQ ID NO: 2887263 - DNA, 22 bp, Homo sapiens
agaagtaacttattttgtacta

SEQ ID NO: 2887264 - DNA, 14 bp, Homo sapiens
agaagtactttgtg

SEQ ID NO: 2887265 - DNA, 18 bp, Homo sapiens
agaagtactttgtgctga

SEQ ID NO: 2887266 - DNA, 19 bp, Homo sapiens
agaagtagattaagagcca

SEQ ID NO: 2887267 - DNA, 20 bp, Homo sapiens
agaagtagattaagagccat

SEQ ID NO: 2887268 - DNA, 23 bp, Homo sapiens
agaagtattcttttcaattatat

SEQ ID NO: 2887269 - DNA, 21 bp, Homo sapiens
agaagtcctgtatgtctgtca

SEQ ID NO: 2887270 - DNA, 16 bp, Homo sapiens
agaagtctttcaagaa

SEQ ID NO: 2887271 - DNA, 17 bp, Homo sapiens
agaagtgacagggaagc

SEQ ID NO: 2887272 - DNA, 19 bp, Homo sapiens
agaagtgacagggaagcta

SEQ ID NO: 2887273 - DNA, 18 bp, Homo sapiens
agaagtgagaataggcag

SEQ ID NO: 2887274 - DNA, 17 bp, Homo sapiens
agaagtgagtgtttcta

SEQ ID NO: 2887275 - DNA, 16 bp, Homo sapiens
agaagtgcaaaggtgt

SEQ ID NO: 2887276 - DNA, 18 bp, Homo sapiens
agaagtgttgtaaaagat

SEQ ID NO: 2887277 - DNA, 16 bp, Homo sapiens
agaagttaaaaaacag

SEQ ID NO: 2887278 - DNA, 19 bp, Homo sapiens
agaagttgtggatttcagt

SEQ ID NO: 2887279 - DNA, 14 bp, Homo sapiens
agaagttgtttgtc

SEQ ID NO: 2887280 - DNA, 13 bp, Homo sapiens
agaagtttgcact

SEQ ID NO: 2887281 - DNA, 20 bp, Homo sapiens
agaagtttgggctaacattt

SEQ ID NO: 2887282 - DNA, 22 bp, Homo sapiens
agaagtttgggctaacatttag

SEQ ID NO: 2887283 - DNA, 16 bp, Homo sapiens
agaagttttaaatttt

SEQ ID NO: 2887284 - DNA, 11 bp, Homo sapiens
agaataaaagc

SEQ ID NO: 2887285 - DNA, 18 bp, Homo sapiens
agaataaaagttcctctc

SEQ ID NO: 2887286 - DNA, 12 bp, Homo sapiens
agaataagttat

SEQ ID NO: 2887287 - DNA, 13 bp, Homo sapiens
agaataatttata

SEQ ID NO: 2887288 - DNA, 16 bp, Homo sapiens
agaataatttatagta

SEQ ID NO: 2887289 - DNA, 12 bp, Homo sapiens
agaaaaagaaca

SEQ ID NO: 2887290 - DNA, 18 bp, Homo sapiens
agaaaaagaacatgcagt

SEQ ID NO: 2887291 - DNA, 22 bp, Homo sapiens
agaaaaagaacatgcagtttga

SEQ ID NO: 2887292 - DNA, 19 bp, Homo sapiens
agaaaaataaaaatctctt

SEQ ID NO: 2887293 - DNA, 16 bp, Homo sapiens
agaaaaatatgtacca

SEQ ID NO: 2887294 - DNA, 13 bp, Homo sapiens
agaaaaatgatgt

SEQ ID NO: 2887295 - DNA, 13 bp, Homo sapiens
agaaaacaaaact

SEQ ID NO: 2887296 - DNA, 21 bp, Homo sapiens
agaaaacaaaactgcatttca

SEQ ID NO: 2887297 - DNA, 16 bp, Homo sapiens
agaaaacaagcaagtt

SEQ ID NO: 2887298 - DNA, 21 bp, Homo sapiens
agaaaacaagcaagttctgag

SEQ ID NO: 2887299 - DNA, 17 bp, Homo sapiens
agaaaacacttgtaagt

SEQ ID NO: 2887300 - DNA, 13 bp, Homo sapiens
agaaaaccacccc

SEQ ID NO: 2887301 - DNA, 17 bp, Homo sapiens
agaaaacccaagttttt

SEQ ID NO: 2887302 - DNA, 21 bp, Homo sapiens
agaaaactcaaagaatgtgta

SEQ ID NO: 2887303 - DNA, 11 bp, Homo sapiens
agaaaactctt

SEQ ID NO: 2887304 - DNA, 22 bp, Homo sapiens
agaaaactggaaatctggattt

SEQ ID NO: 2887305 - DNA, 22 bp, Homo sapiens
agaaaagaggagaggaaaacta

SEQ ID NO: 2887306 - DNA, 15 bp, Homo sapiens
agaaaagcacctgcc

SEQ ID NO: 2887307 - DNA, 18 bp, Homo sapiens
agaaaagcacctgccgac

SEQ ID NO: 2887308 - DNA, 16 bp, Homo sapiens
agaaaagccgaaaggg

SEQ ID NO: 2887309 - DNA, 21 bp, Homo sapiens
agaaaagtgcatatttatcca

SEQ ID NO: 2887310 - DNA, 13 bp, Homo sapiens
agaaaagttatta

SEQ ID NO: 2887311 - DNA, 13 bp, Homo sapiens
agaaaataaaaag

SEQ ID NO: 2887312 - DNA, 16 bp, Homo sapiens
agaaaataaaaagtta

SEQ ID NO: 2887313 - DNA, 17 bp, Homo sapiens
agaaaataaaaagttaa

SEQ ID NO: 2887314 - DNA, 11 bp, Homo sapiens
agaaaatatac

SEQ ID NO: 2887315 - DNA, 16 bp, Homo sapiens
agaaaatatactgtaa

SEQ ID NO: 2887316 - DNA, 18 bp, Homo sapiens
agaaaatatactgtaaag

SEQ ID NO: 2887317 - DNA, 15 bp, Homo sapiens
agaaaatatatgtat

SEQ ID NO: 2887318 - DNA, 23 bp, Homo sapiens
agaaaatatatgtatttttatat

SEQ ID NO: 2887319 - DNA, 19 bp, Homo sapiens
agaaaatgagaaaggacag

SEQ ID NO: 2887320 - DNA, 17 bp, Homo sapiens
agaaaatgcaccaaata

SEQ ID NO: 2887321 - DNA, 20 bp, Homo sapiens
agaaaatggaaccaggcttg

SEQ ID NO: 2887322 - DNA, 22 bp, Homo sapiens
agaaaatggaaccaggcttgga

SEQ ID NO: 2887323 - DNA, 17 bp, Homo sapiens
agaaaatggaattactc

SEQ ID NO: 2887324 - DNA, 18 bp, Homo sapiens
agaaaatggaattactcc

SEQ ID NO: 2887325 - DNA, 14 bp, Homo sapiens
agaaaatgtgtctg

SEQ ID NO: 2887326 - DNA, 21 bp, Homo sapiens
agaaaatttgccaatctttcc

SEQ ID NO: 2887327 - DNA, 11 bp, Homo sapiens
agaaaatttta

SEQ ID NO: 2887328 - DNA, 20 bp, Homo sapiens
agaaacaactctttgagaaa

SEQ ID NO: 2887329 - DNA, 14 bp, Homo sapiens
agaaacaatgaatg

SEQ ID NO: 2887330 - DNA, 12 bp, Homo sapiens
agaaacaatgtt

SEQ ID NO: 2887331 - DNA, 15 bp, Homo sapiens
agaaacaatttgact

SEQ ID NO: 2887332 - DNA, 15 bp, Homo sapiens
agaaacacactgagg

SEQ ID NO: 2887333 - DNA, 16 bp, Homo sapiens
agaaacactgcctgcc

SEQ ID NO: 2887334 - DNA, 14 bp, Homo sapiens
agaaacacttgaac

SEQ ID NO: 2887335 - DNA, 21 bp, Homo sapiens
agaaacagggacaaagaaatc

SEQ ID NO: 2887336 - DNA, 21 bp, Homo sapiens
agaaacagtgtttgccctttg

SEQ ID NO: 2887337 - DNA, 14 bp, Homo sapiens
agaaacatcagtta

SEQ ID NO: 2887338 - DNA, 21 bp, Homo sapiens
agaaacatcagttactctgaa

SEQ ID NO: 2887339 - DNA, 23 bp, Homo sapiens
agaaacatcagttactctgaagg

SEQ ID NO: 2887340 - DNA, 16 bp, Homo sapiens
agaaaccaagtgggct

SEQ ID NO: 2887341 - DNA, 15 bp, Homo sapiens
agaaacccagactga

SEQ ID NO: 2887342 - DNA, 21 bp, Homo sapiens
agaaacccgacagagggaaga

SEQ ID NO: 2887343 - DNA, 14 bp, Homo sapiens
agaaaccctgtctc

SEQ ID NO: 2887344 - DNA, 12 bp, Homo sapiens
agaaacctgtat

SEQ ID NO: 2887345 - DNA, 13 bp, Homo sapiens
agaaacctgtatc

SEQ ID NO: 2887346 - DNA, 14 bp, Homo sapiens
agaaacctgtatct

SEQ ID NO: 2887347 - DNA, 19 bp, Homo sapiens
agaaacctgtatctttcta

SEQ ID NO: 2887348 - DNA, 20 bp, Homo sapiens
agaaacctgtatctttctat

SEQ ID NO: 2887349 - DNA, 18 bp, Homo sapiens
agaaacctgttgaagatt

SEQ ID NO: 2887350 - DNA, 21 bp, Homo sapiens
agaaacctttatccctgctta

SEQ ID NO: 2887351 - DNA, 19 bp, Homo sapiens
agaaacgcaacaagaaact

SEQ ID NO: 2887352 - DNA, 15 bp, Homo sapiens
agaaacgtccatctc

SEQ ID NO: 2887353 - DNA, 16 bp, Homo sapiens
agaaacgtccatctct

SEQ ID NO: 2887354 - DNA, 18 bp, Homo sapiens
agaaactataaagtttta

SEQ ID NO: 2887355 - DNA, 14 bp, Homo sapiens
agaaactgatgcca

SEQ ID NO: 2887356 - DNA, 21 bp, Homo sapiens
agaaacttaaattttagttct

SEQ ID NO: 2887357 - DNA, 23 bp, Homo sapiens
agaaacttcagcaagctagaact

SEQ ID NO: 2887358 - DNA, 14 bp, Homo sapiens
agaaacttccaaat

SEQ ID NO: 2887359 - DNA, 13 bp, Homo sapiens
agaaacttgtgaa

SEQ ID NO: 2887360 - DNA, 21 bp, Homo sapiens
agaaactttgagtacagatac

SEQ ID NO: 2887361 - DNA, 13 bp, Homo sapiens
agaaagaaacact

SEQ ID NO: 2887362 - DNA, 18 bp, Homo sapiens
agaaagaaagggaaactg

SEQ ID NO: 2887363 - DNA, 18 bp, Homo sapiens
agaaagacatctttctct

SEQ ID NO: 2887364 - DNA, 15 bp, Homo sapiens
agaaagagagaaaat

SEQ ID NO: 2887365 - DNA, 22 bp, Homo sapiens
agaaagagagaaaataaaaagt

SEQ ID NO: 2887366 - DNA, 12 bp, Homo sapiens
agaaagagctac

SEQ ID NO: 2887367 - DNA, 14 bp, Homo sapiens
agaaagaggggcct

SEQ ID NO: 2887368 - DNA, 15 bp, Homo sapiens
agaaagagtttgaaa

SEQ ID NO: 2887369 - DNA, 12 bp, Homo sapiens
agaaagatgtat

SEQ ID NO: 2887370 - DNA, 20 bp, Homo sapiens
agaaagatgtatataggtgt

SEQ ID NO: 2887371 - DNA, 21 bp, Homo sapiens
agaaagcacaatttaaaacaa

SEQ ID NO: 2887372 - DNA, 22 bp, Homo sapiens
agaaagcacaatttaaaacaat

SEQ ID NO: 2887373 - DNA, 19 bp, Homo sapiens
agaaagcacttaaacagaa

SEQ ID NO: 2887374 - DNA, 17 bp, Homo sapiens
agaaagcccacctgggc

SEQ ID NO: 2887375 - DNA, 13 bp, Homo sapiens
agaaagccttctt

SEQ ID NO: 2887376 - DNA, 15 bp, Homo sapiens
agaaagccttctttt

SEQ ID NO: 2887377 - DNA, 23 bp, Homo sapiens
agaaaggaaatgagatgacagta

SEQ ID NO: 2887378 - DNA, 14 bp, Homo sapiens
agaaaggactctgg

SEQ ID NO: 2887379 - DNA, 18 bp, Homo sapiens
agaaagggagagaaaact

SEQ ID NO: 2887380 - DNA, 19 bp, Homo sapiens
agaaagggagaggaagaga

SEQ ID NO: 2887381 - DNA, 20 bp, Homo sapiens
agaaagggagaggaagagaa

SEQ ID NO: 2887382 - DNA, 20 bp, Homo sapiens
agaaagggcaacaataaaat

SEQ ID NO: 2887383 - DNA, 15 bp, Homo sapiens
agaaaggggagccca

SEQ ID NO: 2887384 - DNA, 17 bp, Homo sapiens
agaaaggggagcccact

SEQ ID NO: 2887385 - DNA, 14 bp, Homo sapiens
agaaagggtgtttt

SEQ ID NO: 2887386 - DNA, 16 bp, Homo sapiens
agaaagtaagcatttc

SEQ ID NO: 2887387 - DNA, 20 bp, Homo sapiens
agaaagtggaaaacaaggaa

SEQ ID NO: 2887388 - DNA, 20 bp, Homo sapiens
agaaagtggtcttaagaaat

SEQ ID NO: 2887389 - DNA, 21 bp, Homo sapiens
agaaagtttgtaaaaatatac

SEQ ID NO: 2887390 - DNA, 17 bp, Homo sapiens
agaaataaaaggaagcc

SEQ ID NO: 2887391 - DNA, 17 bp, Homo sapiens
agaaataaattcctaaa

SEQ ID NO: 2887392 - DNA, 14 bp, Homo sapiens
agaaatacaaaaat

SEQ ID NO: 2887393 - DNA, 23 bp, Homo sapiens
agaaatacaaaaatactcagata

SEQ ID NO: 2887394 - DNA, 13 bp, Homo sapiens
agaaatctgtcct

SEQ ID NO: 2887395 - DNA, 18 bp, Homo sapiens
agaaatgaaataaaatgg

SEQ ID NO: 2887396 - DNA, 11 bp, Homo sapiens
agaaatgccaa

SEQ ID NO: 2887397 - DNA, 13 bp, Homo sapiens
agaaatgctgttc

SEQ ID NO: 2887398 - DNA, 15 bp, Homo sapiens
agaaatggacaaaga

SEQ ID NO: 2887399 - DNA, 17 bp, Homo sapiens
agaaatggtttcctctg

SEQ ID NO: 2887400 - DNA, 19 bp, Homo sapiens
agaaatggtttcctctgga

SEQ ID NO: 2887401 - DNA, 20 bp, Homo sapiens
agaaatggtttcctctggat

SEQ ID NO: 2887402 - DNA, 13 bp, Homo sapiens
agaaatgtaatgc

SEQ ID NO: 2887403 - DNA, 14 bp, Homo sapiens
agaaatgtattttg

SEQ ID NO: 2887404 - DNA, 21 bp, Homo sapiens
agaaatgtattttgaaaacac

SEQ ID NO: 2887405 - DNA, 17 bp, Homo sapiens
agaaattatctttagtt

SEQ ID NO: 2887406 - DNA, 19 bp, Homo sapiens
agaaattcgcatgtttaat

SEQ ID NO: 2887407 - DNA, 14 bp, Homo sapiens
agaaattgcctatc

SEQ ID NO: 2887408 - DNA, 21 bp, Homo sapiens
agaaatttaattcatgtttct

SEQ ID NO: 2887409 - DNA, 22 bp, Homo sapiens
agaaatttaattcatgtttctt

SEQ ID NO: 2887410 - DNA, 14 bp, Homo sapiens
agaaatttggcatt

SEQ ID NO: 2887411 - DNA, 17 bp, Homo sapiens
agaaatttttcagatgc

SEQ ID NO: 2887412 - DNA, 15 bp, Homo sapiens
agaacaaaaactatt

SEQ ID NO: 2887413 - DNA, 16 bp, Homo sapiens
agaacaaaaactatta

SEQ ID NO: 2887414 - DNA, 19 bp, Homo sapiens
agaacaaaacctcttctgt

SEQ ID NO: 2887415 - DNA, 20 bp, Homo sapiens
agaacaaagtaaaagtagtg

SEQ ID NO: 2887416 - DNA, 17 bp, Homo sapiens
agaacaatctggatttc

SEQ ID NO: 2887417 - DNA, 14 bp, Homo sapiens
agaacacgcgtatt

SEQ ID NO: 2887418 - DNA, 18 bp, Homo sapiens
agaacagcagactcagct

SEQ ID NO: 2887419 - DNA, 14 bp, Homo sapiens
agaacagccatttt

SEQ ID NO: 2887420 - DNA, 19 bp, Homo sapiens
agaacagggaaaataggca

SEQ ID NO: 2887421 - DNA, 23 bp, Homo sapiens
agaacaggtgttggtgacaattg

SEQ ID NO: 2887422 - DNA, 21 bp, Homo sapiens
acttgaactgattcacatctc

SEQ ID NO: 2887423 - DNA, 18 bp, Homo sapiens
acttgaacttcacctgca

SEQ ID NO: 2887424 - DNA, 12 bp, Homo sapiens
acttgaacttgt

SEQ ID NO: 2887425 - DNA, 12 bp, Homo sapiens
acttgaagaaac

SEQ ID NO: 2887426 - DNA, 14 bp, Homo sapiens
acttgaagtaacta

SEQ ID NO: 2887427 - DNA, 20 bp, Homo sapiens
acttgaagtaactataacaa

SEQ ID NO: 2887428 - DNA, 14 bp, Homo sapiens
acttgacagtggaa

SEQ ID NO: 2887429 - DNA, 22 bp, Homo sapiens
acttgaggtggcctccttgctt

SEQ ID NO: 2887430 - DNA, 17 bp, Homo sapiens
acttgatgtttcctgga

SEQ ID NO: 2887431 - DNA, 12 bp, Homo sapiens
acttgcagagga

SEQ ID NO: 2887432 - DNA, 19 bp, Homo sapiens
acttgcatccaactccagg

SEQ ID NO: 2887433 - DNA, 12 bp, Homo sapiens
acttgcatgtcc

SEQ ID NO: 2887434 - DNA, 19 bp, Homo sapiens
acttgcatgtcccatcacg

SEQ ID NO: 2887435 - DNA, 16 bp, Homo sapiens
acttgccagggctctg

SEQ ID NO: 2887436 - DNA, 21 bp, Homo sapiens
acttgccatgtgactctggct

SEQ ID NO: 2887437 - DNA, 12 bp, Homo sapiens
acttgccatgtt

SEQ ID NO: 2887438 - DNA, 12 bp, Homo sapiens
acttgccctgct

SEQ ID NO: 2887439 - DNA, 13 bp, Homo sapiens
acttgccctgctc

SEQ ID NO: 2887440 - DNA, 15 bp, Homo sapiens
acttgccctgctccc

SEQ ID NO: 2887441 - DNA, 18 bp, Homo sapiens
acttgccctgctccctct

SEQ ID NO: 2887442 - DNA, 12 bp, Homo sapiens
acttgcctgggt

SEQ ID NO: 2887443 - DNA, 18 bp, Homo sapiens
acttgctactcatggcaa

SEQ ID NO: 2887444 - DNA, 19 bp, Homo sapiens
acttgctgtcccttggaac

SEQ ID NO: 2887445 - DNA, 19 bp, Homo sapiens
acttgcttatcaacttcct

SEQ ID NO: 2887446 - DNA, 21 bp, Homo sapiens
acttgcttatcaacttcctaa

SEQ ID NO: 2887447 - DNA, 14 bp, Homo sapiens
acttgcttattaca

SEQ ID NO: 2887448 - DNA, 20 bp, Homo sapiens
acttgcttattacatttaaa

SEQ ID NO: 2887449 - DNA, 15 bp, Homo sapiens
acttgcttgccaact

SEQ ID NO: 2887450 - DNA, 15 bp, Homo sapiens
acttgctttcttctt

SEQ ID NO: 2887451 - DNA, 14 bp, Homo sapiens
acttggaaaaagaa

SEQ ID NO: 2887452 - DNA, 18 bp, Homo sapiens
acttggaaatgacacaga

SEQ ID NO: 2887453 - DNA, 19 bp, Homo sapiens
acttggagaatactgccaa

SEQ ID NO: 2887454 - DNA, 18 bp, Homo sapiens
acttggatgaggagtggt

SEQ ID NO: 2887455 - DNA, 23 bp, Homo sapiens
acttggccagttttctgttcagc

SEQ ID NO: 2887456 - DNA, 13 bp, Homo sapiens
acttgggagcctg

SEQ ID NO: 2887457 - DNA, 14 bp, Homo sapiens
acttgggagcctga

SEQ ID NO: 2887458 - DNA, 17 bp, Homo sapiens
acttgggattctgactc

SEQ ID NO: 2887459 - DNA, 19 bp, Homo sapiens
acttgggggttcaggcccg

SEQ ID NO: 2887460 - DNA, 21 bp, Homo sapiens
acttggtacagttgcaggagc

SEQ ID NO: 2887461 - DNA, 19 bp, Homo sapiens
acttggtccaactgcaact

SEQ ID NO: 2887462 - DNA, 20 bp, Homo sapiens
acttggtccaactgcaactc

SEQ ID NO: 2887463 - DNA, 15 bp, Homo sapiens
acttgtaaagctaga

SEQ ID NO: 2887464 - DNA, 18 bp, Homo sapiens
acttgtaaaggaatttaa

SEQ ID NO: 2887465 - DNA, 18 bp, Homo sapiens
acttgtaatttttttaat

SEQ ID NO: 2887466 - DNA, 11 bp, Homo sapiens
acttgtatctg

SEQ ID NO: 2887467 - DNA, 16 bp, Homo sapiens
acttgtatctgaagac

SEQ ID NO: 2887468 - DNA, 15 bp, Homo sapiens
acttgtcaaagaagg

SEQ ID NO: 2887469 - DNA, 16 bp, Homo sapiens
acttgtcaaagaaggt

SEQ ID NO: 2887470 - DNA, 16 bp, Homo sapiens
acttgtcacttgcatg

SEQ ID NO: 2887471 - DNA, 17 bp, Homo sapiens
acttgtcttgctcttag

SEQ ID NO: 2887472 - DNA, 17 bp, Homo sapiens
acttgtgattatttatt

SEQ ID NO: 2887473 - DNA, 20 bp, Homo sapiens
acttgtgattatttattatt

SEQ ID NO: 2887474 - DNA, 19 bp, Homo sapiens
acttgttcatttctgtctc

SEQ ID NO: 2887475 - DNA, 15 bp, Homo sapiens
actttaaaaatcagt

SEQ ID NO: 2887476 - DNA, 12 bp, Homo sapiens
actttaaaactg

SEQ ID NO: 2887477 - DNA, 15 bp, Homo sapiens
actttacactcggct

SEQ ID NO: 2887478 - DNA, 18 bp, Homo sapiens
actttactaagatgacat

SEQ ID NO: 2887479 - DNA, 15 bp, Homo sapiens
actttagaatgagag

SEQ ID NO: 2887480 - DNA, 17 bp, Homo sapiens
actttaggctttcagct

SEQ ID NO: 2887481 - DNA, 18 bp, Homo sapiens
actttaggctttcagctt

SEQ ID NO: 2887482 - DNA, 19 bp, Homo sapiens
actttagtgtattttctgt

SEQ ID NO: 2887483 - DNA, 14 bp, Homo sapiens
actttatcaattaa

SEQ ID NO: 2887484 - DNA, 18 bp, Homo sapiens
actttatgtagagaaaag

SEQ ID NO: 2887485 - DNA, 13 bp, Homo sapiens
actttatgtgtaa

SEQ ID NO: 2887486 - DNA, 13 bp, Homo sapiens
actttatgttcta

SEQ ID NO: 2887487 - DNA, 19 bp, Homo sapiens
actttattcttgaaagaag

SEQ ID NO: 2887488 - DNA, 13 bp, Homo sapiens
actttattgcaat

SEQ ID NO: 2887489 - DNA, 15 bp, Homo sapiens
actttattgcaatgc

SEQ ID NO: 2887490 - DNA, 17 bp, Homo sapiens
actttattgcaatgcag

SEQ ID NO: 2887491 - DNA, 21 bp, Homo sapiens
actttattggagcattgatct

SEQ ID NO: 2887492 - DNA, 14 bp, Homo sapiens
actttattgtagaa

SEQ ID NO: 2887493 - DNA, 12 bp, Homo sapiens
actttatttctg

SEQ ID NO: 2887494 - DNA, 22 bp, Homo sapiens
actttatttctgagcaaagcat

SEQ ID NO: 2887495 - DNA, 20 bp, Homo sapiens
actttcaaaagagtagaaag

SEQ ID NO: 2887496 - DNA, 17 bp, Homo sapiens
actttcaaagacaatca

SEQ ID NO: 2887497 - DNA, 18 bp, Homo sapiens
actttcctcttcctgcct

SEQ ID NO: 2887498 - DNA, 15 bp, Homo sapiens
actttcctggataaa

SEQ ID NO: 2887499 - DNA, 22 bp, Homo sapiens
actttcctggataaaaaagaaa

SEQ ID NO: 2887500 - DNA, 17 bp, Homo sapiens
actttcctggatgtctg

SEQ ID NO: 2887501 - DNA, 15 bp, Homo sapiens
actttccttctctgt

SEQ ID NO: 2887502 - DNA, 14 bp, Homo sapiens
actttctcttgttt

SEQ ID NO: 2887503 - DNA, 20 bp, Homo sapiens
actttcttatccaacttttt

SEQ ID NO: 2887504 - DNA, 20 bp, Homo sapiens
actttcttctgaatatttta

SEQ ID NO: 2887505 - DNA, 14 bp, Homo sapiens
actttgaataaaga

SEQ ID NO: 2887506 - DNA, 18 bp, Homo sapiens
actttgaataaagaatac

SEQ ID NO: 2887507 - DNA, 21 bp, Homo sapiens
actttgaataaagaatacttg

SEQ ID NO: 2887508 - DNA, 17 bp, Homo sapiens
actttgagtacagatac

SEQ ID NO: 2887509 - DNA, 15 bp, Homo sapiens
actttgatgtgtttt

SEQ ID NO: 2887510 - DNA, 14 bp, Homo sapiens
actttgattctgat

SEQ ID NO: 2887511 - DNA, 19 bp, Homo sapiens
actttgcaggcggccctca

SEQ ID NO: 2887512 - DNA, 20 bp, Homo sapiens
actttgcaggcggccctcag

SEQ ID NO: 2887513 - DNA, 23 bp, Homo sapiens
actttgcaggcggccctcagtgc

SEQ ID NO: 2887514 - DNA, 14 bp, Homo sapiens
actttggaagcact

SEQ ID NO: 2887515 - DNA, 15 bp, Homo sapiens
actttgggaggccaa

SEQ ID NO: 2887516 - DNA, 19 bp, Homo sapiens
actttgggtttttaactca

SEQ ID NO: 2887517 - DNA, 21 bp, Homo sapiens
actttgggtttttaactcatc

SEQ ID NO: 2887518 - DNA, 12 bp, Homo sapiens
actttgtaaata

SEQ ID NO: 2887519 - DNA, 13 bp, Homo sapiens
actttgtaaattc

SEQ ID NO: 2887520 - DNA, 19 bp, Homo sapiens
actttgtatgtcatttcct

SEQ ID NO: 2887521 - DNA, 22 bp, Homo sapiens
actttgtatgtcatttccttca

SEQ ID NO: 2887522 - DNA, 14 bp, Homo sapiens
actttgtcagtgtt

SEQ ID NO: 2887523 - DNA, 22 bp, Homo sapiens
actttgtcagtgttgcctcttg

SEQ ID NO: 2887524 - DNA, 15 bp, Homo sapiens
actttgttgttttta

SEQ ID NO: 2887525 - DNA, 14 bp, Homo sapiens
actttgtttttcca

SEQ ID NO: 2887526 - DNA, 18 bp, Homo sapiens
acttttaaaactttgcca

SEQ ID NO: 2887527 - DNA, 13 bp, Homo sapiens
acttttaaaataa

SEQ ID NO: 2887528 - DNA, 18 bp, Homo sapiens
acttttaaaataaattct

SEQ ID NO: 2887529 - DNA, 19 bp, Homo sapiens
acttttaaaataaattctc

SEQ ID NO: 2887530 - DNA, 20 bp, Homo sapiens
acttttaaccaaacaattat

SEQ ID NO: 2887531 - DNA, 15 bp, Homo sapiens
acttttacttgttca

SEQ ID NO: 2887532 - DNA, 22 bp, Homo sapiens
acttttcacctccttcaattcc

SEQ ID NO: 2887533 - DNA, 10 bp, Homo sapiens
acttttcatt

SEQ ID NO: 2887534 - DNA, 14 bp, Homo sapiens
acttttcattctct

SEQ ID NO: 2887535 - DNA, 20 bp, Homo sapiens
acttttcattctcttttaat

SEQ ID NO: 2887536 - DNA, 17 bp, Homo sapiens
acttttcattgcaaagt

SEQ ID NO: 2887537 - DNA, 10 bp, Homo sapiens
acttttctag

SEQ ID NO: 2887538 - DNA, 17 bp, Homo sapiens
acttttctagttaactt

SEQ ID NO: 2887539 - DNA, 13 bp, Homo sapiens
acttttgaatgtc

SEQ ID NO: 2887540 - DNA, 17 bp, Homo sapiens
acttttgtaaaatcaaa

SEQ ID NO: 2887541 - DNA, 13 bp, Homo sapiens
acttttgttctct

SEQ ID NO: 2887542 - DNA, 18 bp, Homo sapiens
acttttgttctcttctgc

SEQ ID NO: 2887543 - DNA, 12 bp, Homo sapiens
acttttgtttaa

SEQ ID NO: 2887544 - DNA, 14 bp, Homo sapiens
actttttaaacagt

SEQ ID NO: 2887545 - DNA, 22 bp, Homo sapiens
actttttaaagaagtgcatgaa

SEQ ID NO: 2887546 - DNA, 11 bp, Homo sapiens
actttttacaa

SEQ ID NO: 2887547 - DNA, 17 bp, Homo sapiens
actttttagtaatttct

SEQ ID NO: 2887548 - DNA, 17 bp, Homo sapiens
actttttattgccttct

SEQ ID NO: 2887549 - DNA, 18 bp, Homo sapiens
actttttattgccttctc

SEQ ID NO: 2887550 - DNA, 17 bp, Homo sapiens
actttttggtaatatat

SEQ ID NO: 2887551 - DNA, 13 bp, Homo sapiens
actttttgtgaag

SEQ ID NO: 2887552 - DNA, 16 bp, Homo sapiens
actttttgttccagag

SEQ ID NO: 2887553 - DNA, 18 bp, Homo sapiens
actttttgttccagagct

SEQ ID NO: 2887554 - DNA, 16 bp, Homo sapiens
acttttttaaatattt

SEQ ID NO: 2887555 - DNA, 14 bp, Homo sapiens
acttttttctgcct

SEQ ID NO: 2887556 - DNA, 21 bp, Homo sapiens
acttttttggggatatgctta

SEQ ID NO: 2887557 - DNA, 22 bp, Homo sapiens
agaaaaaaaaatgccataatac

SEQ ID NO: 2887558 - DNA, 18 bp, Homo sapiens
agaaaaaaaatagacttt

SEQ ID NO: 2887559 - DNA, 15 bp, Homo sapiens
agaaaaaaaccaaag

SEQ ID NO: 2887560 - DNA, 16 bp, Homo sapiens
actgcttggagctgag

SEQ ID NO: 2887561 - DNA, 14 bp, Homo sapiens
actgcttggccaga

SEQ ID NO: 2887562 - DNA, 15 bp, Homo sapiens
actgcttttggcctg

SEQ ID NO: 2887563 - DNA, 22 bp, Homo sapiens
actggaacactagacaagccag

SEQ ID NO: 2887564 - DNA, 17 bp, Homo sapiens
actggaacttgaactga

SEQ ID NO: 2887565 - DNA, 15 bp, Homo sapiens
actggaaggagcaca

SEQ ID NO: 2887566 - DNA, 13 bp, Homo sapiens
actggacagcttg

SEQ ID NO: 2887567 - DNA, 16 bp, Homo sapiens
actggactccggccct

SEQ ID NO: 2887568 - DNA, 15 bp, Homo sapiens
actggagagtggcaa

SEQ ID NO: 2887569 - DNA, 16 bp, Homo sapiens
actggagcaccaggca

SEQ ID NO: 2887570 - DNA, 16 bp, Homo sapiens
actggaggagagaaga

SEQ ID NO: 2887571 - DNA, 18 bp, Homo sapiens
actggaggagagaagaat

SEQ ID NO: 2887572 - DNA, 22 bp, Homo sapiens
actggaggggtcatccttgccc

SEQ ID NO: 2887573 - DNA, 13 bp, Homo sapiens
actggagttctat

SEQ ID NO: 2887574 - DNA, 15 bp, Homo sapiens
actggagttctatgc

SEQ ID NO: 2887575 - DNA, 19 bp, Homo sapiens
actggagttctatgctctc

SEQ ID NO: 2887576 - DNA, 18 bp, Homo sapiens
actggatcccatcaaaga

SEQ ID NO: 2887577 - DNA, 19 bp, Homo sapiens
actggatcccatcaaagaa

SEQ ID NO: 2887578 - DNA, 19 bp, Homo sapiens
actggatgcatcaagaact

SEQ ID NO: 2887579 - DNA, 11 bp, Homo sapiens
actggcaggcg

SEQ ID NO: 2887580 - DNA, 13 bp, Homo sapiens
actggcattttat

SEQ ID NO: 2887581 - DNA, 22 bp, Homo sapiens
actggccatttgccaattttcc

SEQ ID NO: 2887582 - DNA, 14 bp, Homo sapiens
actggccccacagg

SEQ ID NO: 2887583 - DNA, 13 bp, Homo sapiens
actggccgtggct

SEQ ID NO: 2887584 - DNA, 20 bp, Homo sapiens
actggcctaggggccagggc

SEQ ID NO: 2887585 - DNA, 13 bp, Homo sapiens
actggcgccttct

SEQ ID NO: 2887586 - DNA, 20 bp, Homo sapiens
actggcgtggattaaactta

SEQ ID NO: 2887587 - DNA, 12 bp, Homo sapiens
actggctcatgc

SEQ ID NO: 2887588 - DNA, 16 bp, Homo sapiens
actggctcctctgtgg

SEQ ID NO: 2887589 - DNA, 21 bp, Homo sapiens
actggctgtgtgaccttaggc

SEQ ID NO: 2887590 - DNA, 13 bp, Homo sapiens
actggcttgtaca

SEQ ID NO: 2887591 - DNA, 14 bp, Homo sapiens
actggcttgtacat

SEQ ID NO: 2887592 - DNA, 16 bp, Homo sapiens
actggctttggcttct

SEQ ID NO: 2887593 - DNA, 14 bp, Homo sapiens
actggcttttatta

SEQ ID NO: 2887594 - DNA, 23 bp, Homo sapiens
actggcttttattaatgcacttt

SEQ ID NO: 2887595 - DNA, 12 bp, Homo sapiens
actgggagccta

SEQ ID NO: 2887596 - DNA, 14 bp, Homo sapiens
actgggcccaggca

SEQ ID NO: 2887597 - DNA, 12 bp, Homo sapiens
actgggccctga

SEQ ID NO: 2887598 - DNA, 17 bp, Homo sapiens
actgggccctgagtctg

SEQ ID NO: 2887599 - DNA, 14 bp, Homo sapiens
actgggctctggct

SEQ ID NO: 2887600 - DNA, 14 bp, Homo sapiens
actggggcaggggc

SEQ ID NO: 2887601 - DNA, 16 bp, Homo sapiens
actggggcaggggccg

SEQ ID NO: 2887602 - DNA, 22 bp, Homo sapiens
actggggctggggaaggaagcc

SEQ ID NO: 2887603 - DNA, 16 bp, Homo sapiens
actgggtctgacctgg

SEQ ID NO: 2887604 - DNA, 18 bp, Homo sapiens
actgggtctgacctggtg

SEQ ID NO: 2887605 - DNA, 18 bp, Homo sapiens
actgggtggtggcctggt

SEQ ID NO: 2887606 - DNA, 22 bp, Homo sapiens
actgggtggtggcctggtccct

SEQ ID NO: 2887607 - DNA, 16 bp, Homo sapiens
actggtaattgtacaa

SEQ ID NO: 2887608 - DNA, 17 bp, Homo sapiens
actggtaggaggaggca

SEQ ID NO: 2887609 - DNA, 23 bp, Homo sapiens
actggtaggaggaggcatggaaa

SEQ ID NO: 2887610 - DNA, 22 bp, Homo sapiens
actggtatatacgtgtggttca

SEQ ID NO: 2887611 - DNA, 17 bp, Homo sapiens
actggtatgaataattg

SEQ ID NO: 2887612 - DNA, 21 bp, Homo sapiens
actggtctcacagtctaagta

SEQ ID NO: 2887613 - DNA, 13 bp, Homo sapiens
actggtgcacttt

SEQ ID NO: 2887614 - DNA, 20 bp, Homo sapiens
actggtgcactttgtaaatt

SEQ ID NO: 2887615 - DNA, 21 bp, Homo sapiens
actggtgcactttgtaaattc

SEQ ID NO: 2887616 - DNA, 17 bp, Homo sapiens
actggtggtttttgctc

SEQ ID NO: 2887617 - DNA, 20 bp, Homo sapiens
actggtgtaatctcaatgca

SEQ ID NO: 2887618 - DNA, 20 bp, Homo sapiens
actggtgtcaccctttgcct

SEQ ID NO: 2887619 - DNA, 14 bp, Homo sapiens
actggttctcaatg

SEQ ID NO: 2887620 - DNA, 13 bp, Homo sapiens
actggttcttgcc

SEQ ID NO: 2887621 - DNA, 20 bp, Homo sapiens
actggttcttgccttcccct

SEQ ID NO: 2887622 - DNA, 21 bp, Homo sapiens
actggttcttgccttcccctt

SEQ ID NO: 2887623 - DNA, 18 bp, Homo sapiens
actggtttgtatgatgta

SEQ ID NO: 2887624 - DNA, 14 bp, Homo sapiens
actgtaaagaaaga

SEQ ID NO: 2887625 - DNA, 16 bp, Homo sapiens
actgtaaagaaagaga

SEQ ID NO: 2887626 - DNA, 18 bp, Homo sapiens
actgtaaagaaagagaga

SEQ ID NO: 2887627 - DNA, 20 bp, Homo sapiens
actgtaaagaaagagagaaa

SEQ ID NO: 2887628 - DNA, 22 bp, Homo sapiens
actgtaaagaaagagagaaaat

SEQ ID NO: 2887629 - DNA, 14 bp, Homo sapiens
actgtaaagcaaat

SEQ ID NO: 2887630 - DNA, 23 bp, Homo sapiens
actgtaaaggcaagccagcatgt

SEQ ID NO: 2887631 - DNA, 11 bp, Homo sapiens
actgtaaatca

SEQ ID NO: 2887632 - DNA, 16 bp, Homo sapiens
actgtaactgattaca

SEQ ID NO: 2887633 - DNA, 22 bp, Homo sapiens
actgtaagaataatttatagta

SEQ ID NO: 2887634 - DNA, 13 bp, Homo sapiens
actgtaagacatt

SEQ ID NO: 2887635 - DNA, 17 bp, Homo sapiens
actgtacaataaaaaca

SEQ ID NO: 2887636 - DNA, 14 bp, Homo sapiens
actgtacagttttg

SEQ ID NO: 2887637 - DNA, 22 bp, Homo sapiens
actgtagcctcgccgtctgtga

SEQ ID NO: 2887638 - DNA, 21 bp, Homo sapiens
actgtagggaaaaaaatgctt

SEQ ID NO: 2887639 - DNA, 18 bp, Homo sapiens
actgtaggttatttaaaa

SEQ ID NO: 2887640 - DNA, 19 bp, Homo sapiens
actgtataccgatcaggaa

SEQ ID NO: 2887641 - DNA, 15 bp, Homo sapiens
actgtattattgcaa

SEQ ID NO: 2887642 - DNA, 15 bp, Homo sapiens
actgtatttaaggaa

SEQ ID NO: 2887643 - DNA, 16 bp, Homo sapiens
actgtatttgtgacta

SEQ ID NO: 2887644 - DNA, 22 bp, Homo sapiens
actgtatttgtgactaattgta

SEQ ID NO: 2887645 - DNA, 23 bp, Homo sapiens
actgtatttgtgactaattgtat

SEQ ID NO: 2887646 - DNA, 21 bp, Homo sapiens
actgtattttgtattgtttca

SEQ ID NO: 2887647 - DNA, 14 bp, Homo sapiens
actgtcactcattg

SEQ ID NO: 2887648 - DNA, 14 bp, Homo sapiens
actgtcagggaggg

SEQ ID NO: 2887649 - DNA, 15 bp, Homo sapiens
actgtcagggagggc

SEQ ID NO: 2887650 - DNA, 18 bp, Homo sapiens
actgtcagggagggccag

SEQ ID NO: 2887651 - DNA, 22 bp, Homo sapiens
actgtccaggtaggaaacaatt

SEQ ID NO: 2887652 - DNA, 17 bp, Homo sapiens
actgtcccacttctcat

SEQ ID NO: 2887653 - DNA, 17 bp, Homo sapiens
actgtccctcctggtgt

SEQ ID NO: 2887654 - DNA, 23 bp, Homo sapiens
actgtccctctcagtgccttctc

SEQ ID NO: 2887655 - DNA, 15 bp, Homo sapiens
actgtccctgctttc

SEQ ID NO: 2887656 - DNA, 17 bp, Homo sapiens
actgtccctgctttctg

SEQ ID NO: 2887657 - DNA, 20 bp, Homo sapiens
actgtccctgctttctggta

SEQ ID NO: 2887658 - DNA, 21 bp, Homo sapiens
actgtccctgctttctggtat

SEQ ID NO: 2887659 - DNA, 16 bp, Homo sapiens
actgtcggaggaaaga

SEQ ID NO: 2887660 - DNA, 18 bp, Homo sapiens
actgtctaagcagttttg

SEQ ID NO: 2887661 - DNA, 22 bp, Homo sapiens
actgtctaagcagttttgtaaa

SEQ ID NO: 2887662 - DNA, 22 bp, Homo sapiens
actgtctatctctaataaaaac

SEQ ID NO: 2887663 - DNA, 12 bp, Homo sapiens
actgtctcactg

SEQ ID NO: 2887664 - DNA, 15 bp, Homo sapiens
actgtctgagagttt

SEQ ID NO: 2887665 - DNA, 20 bp, Homo sapiens
actgtctgagagtttagttg

SEQ ID NO: 2887666 - DNA, 16 bp, Homo sapiens
actgtctgctgatata

SEQ ID NO: 2887667 - DNA, 23 bp, Homo sapiens
actgtctgtgtttttttggcagt

SEQ ID NO: 2887668 - DNA, 17 bp, Homo sapiens
actgtcttccctctcta

SEQ ID NO: 2887669 - DNA, 23 bp, Homo sapiens
actgtcttttaaaaaacaaaaag

SEQ ID NO: 2887670 - DNA, 20 bp, Homo sapiens
actgtcttttctattaatca

SEQ ID NO: 2887671 - DNA, 16 bp, Homo sapiens
actgtgaaggaccctt

SEQ ID NO: 2887672 - DNA, 22 bp, Homo sapiens
actgtgaagttacatgcataaa

SEQ ID NO: 2887673 - DNA, 20 bp, Homo sapiens
actgtgaataataaatacac

SEQ ID NO: 2887674 - DNA, 17 bp, Homo sapiens
actgtgaatcctggcaa

SEQ ID NO: 2887675 - DNA, 18 bp, Homo sapiens
actgtgaatcctggcaag

SEQ ID NO: 2887676 - DNA, 11 bp, Homo sapiens
actgtgaatgc

SEQ ID NO: 2887677 - DNA, 20 bp, Homo sapiens
actgtgaatgcttctgattt

SEQ ID NO: 2887678 - DNA, 15 bp, Homo sapiens
actgtgagactgtat

SEQ ID NO: 2887679 - DNA, 15 bp, Homo sapiens
actgtgagcttacat

SEQ ID NO: 2887680 - DNA, 23 bp, Homo sapiens
actgtgatgaagccgaccttaga

SEQ ID NO: 2887681 - DNA, 16 bp, Homo sapiens
actgtgattactcttt

SEQ ID NO: 2887682 - DNA, 22 bp, Homo sapiens
actgtgattactctttgctttg

SEQ ID NO: 2887683 - DNA, 18 bp, Homo sapiens
actgtgcaccaagcagga

SEQ ID NO: 2887684 - DNA, 15 bp, Homo sapiens
actgtgcatgtgcgt

SEQ ID NO: 2887685 - DNA, 17 bp, Homo sapiens
actgtggaagtccctca

SEQ ID NO: 2887686 - DNA, 16 bp, Homo sapiens
actgtggagactttct

SEQ ID NO: 2887687 - DNA, 19 bp, Homo sapiens
actgtggagactttctgtt

SEQ ID NO: 2887688 - DNA, 17 bp, Homo sapiens
actgtggcaaacaaaac

SEQ ID NO: 2887689 - DNA, 20 bp, Homo sapiens
actgtggccgttatctggaa

SEQ ID NO: 2887690 - DNA, 20 bp, Homo sapiens
actgtgggaaggccagctgc

SEQ ID NO: 2887691 - DNA, 17 bp, Homo sapiens
actgtgggcaatttaga

SEQ ID NO: 2887692 - DNA, 18 bp, Homo sapiens
actgtgggcaatttagaa

SEQ ID NO: 2887693 - DNA, 20 bp, Homo sapiens
actgtgggcaatttagaaaa

SEQ ID NO: 2887694 - DNA, 15 bp, Homo sapiens
actgtgggtgtgtga

SEQ ID NO: 2887695 - DNA, 12 bp, Homo sapiens
actgtgtctcta

SEQ ID NO: 2887696 - DNA, 19 bp, Homo sapiens
actccagctggtgccccca

SEQ ID NO: 2887697 - DNA, 19 bp, Homo sapiens
actccaggcccaaggctcc

SEQ ID NO: 2887698 - DNA, 16 bp, Homo sapiens
actccaggctgggctg

SEQ ID NO: 2887699 - DNA, 18 bp, Homo sapiens
actccaggcttgattcca

SEQ ID NO: 2887700 - DNA, 17 bp, Homo sapiens
actccagggtcccctgc

SEQ ID NO: 2887701 - DNA, 21 bp, Homo sapiens
actccagggtcccctgccacc

SEQ ID NO: 2887702 - DNA, 22 bp, Homo sapiens
actccataccccgccaaggaaa

SEQ ID NO: 2887703 - DNA, 14 bp, Homo sapiens
actccatcagctta

SEQ ID NO: 2887704 - DNA, 16 bp, Homo sapiens
actccatctctcatcc

SEQ ID NO: 2887705 - DNA, 12 bp, Homo sapiens
actccattgtcg

SEQ ID NO: 2887706 - DNA, 19 bp, Homo sapiens
actcccacccagtctctgc

SEQ ID NO: 2887707 - DNA, 12 bp, Homo sapiens
actcccactcct

SEQ ID NO: 2887708 - DNA, 13 bp, Homo sapiens
actcccactccta

SEQ ID NO: 2887709 - DNA, 17 bp, Homo sapiens
actcccagacacccacc

SEQ ID NO: 2887710 - DNA, 20 bp, Homo sapiens
actcccattcctgaagaacc

SEQ ID NO: 2887711 - DNA, 21 bp, Homo sapiens
actcccattttggtgtgcatc

SEQ ID NO: 2887712 - DNA, 17 bp, Homo sapiens
actcccccaaccaagga

SEQ ID NO: 2887713 - DNA, 20 bp, Homo sapiens
actcccccaaccaaggaagg

SEQ ID NO: 2887714 - DNA, 22 bp, Homo sapiens
actcccccaaccaaggaaggag

SEQ ID NO: 2887715 - DNA, 12 bp, Homo sapiens
actcccccagga

SEQ ID NO: 2887716 - DNA, 14 bp, Homo sapiens
actccccgaagtct

SEQ ID NO: 2887717 - DNA, 16 bp, Homo sapiens
actccccgaagtcttt

SEQ ID NO: 2887718 - DNA, 17 bp, Homo sapiens
actcccctttcttccaa

SEQ ID NO: 2887719 - DNA, 19 bp, Homo sapiens
actcccgccccgggctggc

SEQ ID NO: 2887720 - DNA, 19 bp, Homo sapiens
actccctacactgatgcaa

SEQ ID NO: 2887721 - DNA, 15 bp, Homo sapiens
actccctaggcccaa

SEQ ID NO: 2887722 - DNA, 14 bp, Homo sapiens
actccctccagcac

SEQ ID NO: 2887723 - DNA, 15 bp, Homo sapiens
actccctccagcaca

SEQ ID NO: 2887724 - DNA, 14 bp, Homo sapiens
actccctccccacc

SEQ ID NO: 2887725 - DNA, 15 bp, Homo sapiens
actccctccccaccc

SEQ ID NO: 2887726 - DNA, 23 bp, Homo sapiens
actccctccccacccaagagagg

SEQ ID NO: 2887727 - DNA, 15 bp, Homo sapiens
actccctcctcacac

SEQ ID NO: 2887728 - DNA, 21 bp, Homo sapiens
actccctcctcacactccaga

SEQ ID NO: 2887729 - DNA, 15 bp, Homo sapiens
actccctggccttgc

SEQ ID NO: 2887730 - DNA, 15 bp, Homo sapiens
actcccttcccataa

SEQ ID NO: 2887731 - DNA, 14 bp, Homo sapiens
actcccttgggctc

SEQ ID NO: 2887732 - DNA, 15 bp, Homo sapiens
actcccttgtgttcc

SEQ ID NO: 2887733 - DNA, 16 bp, Homo sapiens
actcccttgtgttcct

SEQ ID NO: 2887734 - DNA, 19 bp, Homo sapiens
actcccttgtgttccttct

SEQ ID NO: 2887735 - DNA, 20 bp, Homo sapiens
actcccttgtgttccttctg

SEQ ID NO: 2887736 - DNA, 21 bp, Homo sapiens
actccgagagcagtgggcagg

SEQ ID NO: 2887737 - DNA, 16 bp, Homo sapiens
actccgtgaggctgct

SEQ ID NO: 2887738 - DNA, 18 bp, Homo sapiens
actccgtgaggctgctgc

SEQ ID NO: 2887739 - DNA, 23 bp, Homo sapiens
actcctaatcaagagtctctcca

SEQ ID NO: 2887740 - DNA, 14 bp, Homo sapiens
actcctactgcttc

SEQ ID NO: 2887741 - DNA, 18 bp, Homo sapiens
actcctccccaccctcct

SEQ ID NO: 2887742 - DNA, 23 bp, Homo sapiens
actcctccccaccctcctggcct

SEQ ID NO: 2887743 - DNA, 11 bp, Homo sapiens
actcctccctc

SEQ ID NO: 2887744 - DNA, 15 bp, Homo sapiens
actcctcctagccac

SEQ ID NO: 2887745 - DNA, 16 bp, Homo sapiens
actcctcctgccagct

SEQ ID NO: 2887746 - DNA, 21 bp, Homo sapiens
actcctctcaactgcctcagc

SEQ ID NO: 2887747 - DNA, 14 bp, Homo sapiens
actcctctgactca

SEQ ID NO: 2887748 - DNA, 23 bp, Homo sapiens
actcctgaagggaaggcaaaggc

SEQ ID NO: 2887749 - DNA, 17 bp, Homo sapiens
actcctgaggacagctg

SEQ ID NO: 2887750 - DNA, 20 bp, Homo sapiens
actcctgaggacagctgtcc

SEQ ID NO: 2887751 - DNA, 22 bp, Homo sapiens
actcctgcattgttctttgcca

SEQ ID NO: 2887752 - DNA, 12 bp, Homo sapiens
actcctgccagc

SEQ ID NO: 2887753 - DNA, 12 bp, Homo sapiens
actcctggcctc

SEQ ID NO: 2887754 - DNA, 22 bp, Homo sapiens
actcctggcctcaagccatctt

SEQ ID NO: 2887755 - DNA, 17 bp, Homo sapiens
actccttgcatcaaggg

SEQ ID NO: 2887756 - DNA, 19 bp, Homo sapiens
actccttgcatcaaggggt

SEQ ID NO: 2887757 - DNA, 21 bp, Homo sapiens
actccttttggtgtgttggac

SEQ ID NO: 2887758 - DNA, 18 bp, Homo sapiens
actcgagcccacccagca

SEQ ID NO: 2887759 - DNA, 19 bp, Homo sapiens
actcgattcatattgaata

SEQ ID NO: 2887760 - DNA, 17 bp, Homo sapiens
actcgcaggaccaaggg

SEQ ID NO: 2887761 - DNA, 20 bp, Homo sapiens
actcgcaggaccaagggggc

SEQ ID NO: 2887762 - DNA, 15 bp, Homo sapiens
actcgccatctcctg

SEQ ID NO: 2887763 - DNA, 18 bp, Homo sapiens
actcgccatctcctgggc

SEQ ID NO: 2887764 - DNA, 19 bp, Homo sapiens
actcgccatctcctgggcc

SEQ ID NO: 2887765 - DNA, 15 bp, Homo sapiens
actcggcccagggcc

SEQ ID NO: 2887766 - DNA, 18 bp, Homo sapiens
actctaaacccacatatt

SEQ ID NO: 2887767 - DNA, 16 bp, Homo sapiens
actctaattggtcatt

SEQ ID NO: 2887768 - DNA, 12 bp, Homo sapiens
actctacattta

SEQ ID NO: 2887769 - DNA, 13 bp, Homo sapiens
actctacatttaa

SEQ ID NO: 2887770 - DNA, 17 bp, Homo sapiens
actctaccagtgcaggc

SEQ ID NO: 2887771 - DNA, 21 bp, Homo sapiens
actctagatacctaaaacata

SEQ ID NO: 2887772 - DNA, 22 bp, Homo sapiens
actctagatgaagttttacatt

SEQ ID NO: 2887773 - DNA, 14 bp, Homo sapiens
actctatcaaatgt

SEQ ID NO: 2887774 - DNA, 17 bp, Homo sapiens
actctcagtctctgagc

SEQ ID NO: 2887775 - DNA, 16 bp, Homo sapiens
actctcattccccagg

SEQ ID NO: 2887776 - DNA, 16 bp, Homo sapiens
actctccaatgttcta

SEQ ID NO: 2887777 - DNA, 12 bp, Homo sapiens
actctcccctcc

SEQ ID NO: 2887778 - DNA, 22 bp, Homo sapiens
actctcccctccccatctgtgt

SEQ ID NO: 2887779 - DNA, 13 bp, Homo sapiens
actctcctgcctc

SEQ ID NO: 2887780 - DNA, 13 bp, Homo sapiens
actctccttgcag

SEQ ID NO: 2887781 - DNA, 15 bp, Homo sapiens
actctccttgcagtt

SEQ ID NO: 2887782 - DNA, 16 bp, Homo sapiens
actctccttgcagttc

SEQ ID NO: 2887783 - DNA, 13 bp, Homo sapiens
actctcctttgat

SEQ ID NO: 2887784 - DNA, 17 bp, Homo sapiens
actctcgcatcttccca

SEQ ID NO: 2887785 - DNA, 12 bp, Homo sapiens
actctctgagct

SEQ ID NO: 2887786 - DNA, 12 bp, Homo sapiens
actctcttccct

SEQ ID NO: 2887787 - DNA, 16 bp, Homo sapiens
actctgaaatgaagat

SEQ ID NO: 2887788 - DNA, 12 bp, Homo sapiens
actctgaagctg

SEQ ID NO: 2887789 - DNA, 20 bp, Homo sapiens
actctgaagggcatcatgca

SEQ ID NO: 2887790 - DNA, 21 bp, Homo sapiens
actctgaagggcatcatgcat

SEQ ID NO: 2887791 - DNA, 14 bp, Homo sapiens
actctgatagaatt

SEQ ID NO: 2887792 - DNA, 19 bp, Homo sapiens
actctgcaagtgtctggag

SEQ ID NO: 2887793 - DNA, 19 bp, Homo sapiens
actctgcacatgtcttgta

SEQ ID NO: 2887794 - DNA, 20 bp, Homo sapiens
actctgccccccccccccat

SEQ ID NO: 2887795 - DNA, 15 bp, Homo sapiens
actctgccctctgct

SEQ ID NO: 2887796 - DNA, 16 bp, Homo sapiens
actctgccctctgctg

SEQ ID NO: 2887797 - DNA, 19 bp, Homo sapiens
actctgccctctgctgctg

SEQ ID NO: 2887798 - DNA, 12 bp, Homo sapiens
actctgcctaga

SEQ ID NO: 2887799 - DNA, 19 bp, Homo sapiens
actctgcggcccgggccga

SEQ ID NO: 2887800 - DNA, 13 bp, Homo sapiens
actctgctgcctg

SEQ ID NO: 2887801 - DNA, 22 bp, Homo sapiens
actctgctgtctaacctgtgac

SEQ ID NO: 2887802 - DNA, 20 bp, Homo sapiens
actctggaccaaggagcatc

SEQ ID NO: 2887803 - DNA, 15 bp, Homo sapiens
actctggacctctct

SEQ ID NO: 2887804 - DNA, 23 bp, Homo sapiens
actctggagcaacctactgtcta

SEQ ID NO: 2887805 - DNA, 20 bp, Homo sapiens
actctggcggtggccacagc

SEQ ID NO: 2887806 - DNA, 11 bp, Homo sapiens
actctgggcag

SEQ ID NO: 2887807 - DNA, 19 bp, Homo sapiens
actctggtggcacaggagt

SEQ ID NO: 2887808 - DNA, 15 bp, Homo sapiens
actctgtaaaagtgt

SEQ ID NO: 2887809 - DNA, 17 bp, Homo sapiens
actctgtaaaagtgtct

SEQ ID NO: 2887810 - DNA, 18 bp, Homo sapiens
actctgtcttcacctgat

SEQ ID NO: 2887811 - DNA, 22 bp, Homo sapiens
actctgtcttcacctgattcaa

SEQ ID NO: 2887812 - DNA, 16 bp, Homo sapiens
actctgttatttagac

SEQ ID NO: 2887813 - DNA, 22 bp, Homo sapiens
actctgttccttcacatcctgt

SEQ ID NO: 2887814 - DNA, 19 bp, Homo sapiens
actctgttgaatatttagc

SEQ ID NO: 2887815 - DNA, 22 bp, Homo sapiens
actctgttgatctacccgtgcc

SEQ ID NO: 2887816 - DNA, 12 bp, Homo sapiens
actctgttgcct

SEQ ID NO: 2887817 - DNA, 20 bp, Homo sapiens
actctgttgcctcctctctc

SEQ ID NO: 2887818 - DNA, 21 bp, Homo sapiens
actctgttgcctcctctctcc

SEQ ID NO: 2887819 - DNA, 19 bp, Homo sapiens
actcttaactgaagaaaga

SEQ ID NO: 2887820 - DNA, 15 bp, Homo sapiens
actcttaagcaatgg

SEQ ID NO: 2887821 - DNA, 22 bp, Homo sapiens
actcttaagccatcttggtaaa

SEQ ID NO: 2887822 - DNA, 17 bp, Homo sapiens
actcttcagttaattct

SEQ ID NO: 2887823 - DNA, 17 bp, Homo sapiens
actcttccaccagagca

SEQ ID NO: 2887824 - DNA, 21 bp, Homo sapiens
actcttccaccagagcagggg

SEQ ID NO: 2887825 - DNA, 21 bp, Homo sapiens
actcttctctccaaggaaatc

SEQ ID NO: 2887826 - DNA, 18 bp, Homo sapiens
actcttgaagtccaggac

SEQ ID NO: 2887827 - DNA, 14 bp, Homo sapiens
actcttggagcctg

SEQ ID NO: 2887828 - DNA, 19 bp, Homo sapiens
actcttgtattgctccatt

SEQ ID NO: 2887829 - DNA, 17 bp, Homo sapiens
actctttacccttgagc

SEQ ID NO: 2887830 - DNA, 19 bp, Homo sapiens
actctttacccttgagccc

SEQ ID NO: 2887831 - DNA, 15 bp, Homo sapiens
actctttatgcttgc

SEQ ID NO: 2887832 - DNA, 11 bp, Homo sapiens
actctttcaaa

SEQ ID NO: 2887833 - DNA, 20 bp, Homo sapiens
actgtgtctctgaattcctg

SEQ ID NO: 2887834 - DNA, 15 bp, Homo sapiens
actgtgtgtgtgaat

SEQ ID NO: 2887835 - DNA, 18 bp, Homo sapiens
actgtgttcacacttttc

SEQ ID NO: 2887836 - DNA, 16 bp, Homo sapiens
actgtgtttctgtgct

SEQ ID NO: 2887837 - DNA, 17 bp, Homo sapiens
actgtgtttctgtgctc

SEQ ID NO: 2887838 - DNA, 17 bp, Homo sapiens
actgtgttttataaaat

SEQ ID NO: 2887839 - DNA, 19 bp, Homo sapiens
actgtgttttataaaatag

SEQ ID NO: 2887840 - DNA, 21 bp, Homo sapiens
actgttatcagtaatgctaaa

SEQ ID NO: 2887841 - DNA, 14 bp, Homo sapiens
actgttatttaatt

SEQ ID NO: 2887842 - DNA, 15 bp, Homo sapiens
actgttccccctgtg

SEQ ID NO: 2887843 - DNA, 16 bp, Homo sapiens
actgttccctgaggtg

SEQ ID NO: 2887844 - DNA, 13 bp, Homo sapiens
actgttctaaagc

SEQ ID NO: 2887845 - DNA, 16 bp, Homo sapiens
actgttctaaagctct

SEQ ID NO: 2887846 - DNA, 20 bp, Homo sapiens
actgttgataattcttattt

SEQ ID NO: 2887847 - DNA, 22 bp, Homo sapiens
actgttgataattcttattttg

SEQ ID NO: 2887848 - DNA, 15 bp, Homo sapiens
actgttgatgtactg

SEQ ID NO: 2887849 - DNA, 16 bp, Homo sapiens
actgttgcacttttga

SEQ ID NO: 2887850 - DNA, 21 bp, Homo sapiens
actgttgcagtggcctggccg

SEQ ID NO: 2887851 - DNA, 16 bp, Homo sapiens
actgttgtgacctgaa

SEQ ID NO: 2887852 - DNA, 21 bp, Homo sapiens
actgtttcactgaaatgtttg

SEQ ID NO: 2887853 - DNA, 12 bp, Homo sapiens
actgtttgttat

SEQ ID NO: 2887854 - DNA, 20 bp, Homo sapiens
actgtttgtttttaaaaagc

SEQ ID NO: 2887855 - DNA, 21 bp, Homo sapiens
actgtttttccatagttttga

SEQ ID NO: 2887856 - DNA, 23 bp, Homo sapiens
actgttttttgttttttgtttga

SEQ ID NO: 2887857 - DNA, 14 bp, Homo sapiens
acttaaacagcttt

SEQ ID NO: 2887858 - DNA, 10 bp, Homo sapiens
acttaaacat

SEQ ID NO: 2887859 - DNA, 11 bp, Homo sapiens
acttaaagatt

SEQ ID NO: 2887860 - DNA, 19 bp, Homo sapiens
acttaaatggaaaaaatga

SEQ ID NO: 2887861 - DNA, 14 bp, Homo sapiens
acttaacagatgca

SEQ ID NO: 2887862 - DNA, 21 bp, Homo sapiens
acttaacagatgcaatgtgct

SEQ ID NO: 2887863 - DNA, 17 bp, Homo sapiens
acttaagggagaaaaaa

SEQ ID NO: 2887864 - DNA, 21 bp, Homo sapiens
acttaaggtgaagtgaggaca

SEQ ID NO: 2887865 - DNA, 21 bp, Homo sapiens
acttaagtttgtaagacagtg

SEQ ID NO: 2887866 - DNA, 15 bp, Homo sapiens
acttaataaaacatt

SEQ ID NO: 2887867 - DNA, 17 bp, Homo sapiens
acttaatactaccttga

SEQ ID NO: 2887868 - DNA, 19 bp, Homo sapiens
acttaatactaccttgaaa

SEQ ID NO: 2887869 - DNA, 21 bp, Homo sapiens
acttaatactaccttgaaaat

SEQ ID NO: 2887870 - DNA, 19 bp, Homo sapiens
acttaatattagcttgctt

SEQ ID NO: 2887871 - DNA, 12 bp, Homo sapiens
acttaatggaaa

SEQ ID NO: 2887872 - DNA, 16 bp, Homo sapiens
acttacaaaaatggga

SEQ ID NO: 2887873 - DNA, 21 bp, Homo sapiens
acttacaaaaatgggaaaaat

SEQ ID NO: 2887874 - DNA, 20 bp, Homo sapiens
acttacatgttcccaaaaca

SEQ ID NO: 2887875 - DNA, 21 bp, Homo sapiens
acttacatgttcccaaaacaa

SEQ ID NO: 2887876 - DNA, 22 bp, Homo sapiens
acttacatgttcccaaaacaat

SEQ ID NO: 2887877 - DNA, 16 bp, Homo sapiens
acttaccgccctgcgg

SEQ ID NO: 2887878 - DNA, 13 bp, Homo sapiens
acttactctaaga

SEQ ID NO: 2887879 - DNA, 14 bp, Homo sapiens
acttactctaagat

SEQ ID NO: 2887880 - DNA, 22 bp, Homo sapiens
acttactgctatctactaagtt

SEQ ID NO: 2887881 - DNA, 14 bp, Homo sapiens
acttagaggaaaat

SEQ ID NO: 2887882 - DNA, 17 bp, Homo sapiens
acttagccgactgcgct

SEQ ID NO: 2887883 - DNA, 12 bp, Homo sapiens
acttagcctgag

SEQ ID NO: 2887884 - DNA, 15 bp, Homo sapiens
acttagcctgagtca

SEQ ID NO: 2887885 - DNA, 22 bp, Homo sapiens
acttaggactacattttgctct

SEQ ID NO: 2887886 - DNA, 20 bp, Homo sapiens
acttagtagattaaaaatta

SEQ ID NO: 2887887 - DNA, 17 bp, Homo sapiens
acttataattttcctaa

SEQ ID NO: 2887888 - DNA, 22 bp, Homo sapiens
acttatcatccacattgtttta

SEQ ID NO: 2887889 - DNA, 17 bp, Homo sapiens
acttatccctgcccatt

SEQ ID NO: 2887890 - DNA, 14 bp, Homo sapiens
acttatgaatgttt

SEQ ID NO: 2887891 - DNA, 15 bp, Homo sapiens
acttatgaatgtttc

SEQ ID NO: 2887892 - DNA, 21 bp, Homo sapiens
acttattaacaattaggcaga

SEQ ID NO: 2887893 - DNA, 20 bp, Homo sapiens
acttattcttttataataat

SEQ ID NO: 2887894 - DNA, 18 bp, Homo sapiens
acttattgcctgggcagt

SEQ ID NO: 2887895 - DNA, 21 bp, Homo sapiens
acttattgcctgggcagtgcc

SEQ ID NO: 2887896 - DNA, 19 bp, Homo sapiens
acttattgtggataacaaa

SEQ ID NO: 2887897 - DNA, 22 bp, Homo sapiens
acttattgtggataacaaagat

SEQ ID NO: 2887898 - DNA, 18 bp, Homo sapiens
acttatttaaaaatattt

SEQ ID NO: 2887899 - DNA, 20 bp, Homo sapiens
acttatttaaaaatatttca

SEQ ID NO: 2887900 - DNA, 22 bp, Homo sapiens
acttatttaaaaatatttcaga

SEQ ID NO: 2887901 - DNA, 15 bp, Homo sapiens
acttatttatatgaa

SEQ ID NO: 2887902 - DNA, 23 bp, Homo sapiens
acttcaaaaatgttaaaccctta

SEQ ID NO: 2887903 - DNA, 15 bp, Homo sapiens
acttcaaaagctttt

SEQ ID NO: 2887904 - DNA, 19 bp, Homo sapiens
acttcaaaagtattttcct

SEQ ID NO: 2887905 - DNA, 21 bp, Homo sapiens
acttcaaaagtattttcctgt

SEQ ID NO: 2887906 - DNA, 16 bp, Homo sapiens
acttcaaagcaagctg

SEQ ID NO: 2887907 - DNA, 23 bp, Homo sapiens
acttcaaggtgacagaaggacca

SEQ ID NO: 2887908 - DNA, 16 bp, Homo sapiens
acttcacactgcaaga

SEQ ID NO: 2887909 - DNA, 22 bp, Homo sapiens
acttcacagtgacactggacca

SEQ ID NO: 2887910 - DNA, 18 bp, Homo sapiens
acttcagcaagagagaac

SEQ ID NO: 2887911 - DNA, 20 bp, Homo sapiens
acttcaggtggagagcacta

SEQ ID NO: 2887912 - DNA, 20 bp, Homo sapiens
acttcaggtgtgactctagc

SEQ ID NO: 2887913 - DNA, 13 bp, Homo sapiens
acttcataaaact

SEQ ID NO: 2887914 - DNA, 17 bp, Homo sapiens
acttcatattaatataa

SEQ ID NO: 2887915 - DNA, 15 bp, Homo sapiens
acttcatcaaacatg

SEQ ID NO: 2887916 - DNA, 20 bp, Homo sapiens
acttcatcaaacatgggttt

SEQ ID NO: 2887917 - DNA, 20 bp, Homo sapiens
acttcatcgacttagcctga

SEQ ID NO: 2887918 - DNA, 19 bp, Homo sapiens
acttcattttcagagtgac

SEQ ID NO: 2887919 - DNA, 15 bp, Homo sapiens
acttccaaagaatgt

SEQ ID NO: 2887920 - DNA, 24 bp, Homo sapiens
acttccaaagactccctccatagc

SEQ ID NO: 2887921 - DNA, 19 bp, Homo sapiens
acttccagcaaaatccaaa

SEQ ID NO: 2887922 - DNA, 21 bp, Homo sapiens
acttccagcaaaatccaaact

SEQ ID NO: 2887923 - DNA, 17 bp, Homo sapiens
acttccatggccctcat

SEQ ID NO: 2887924 - DNA, 20 bp, Homo sapiens
acttccatggccctcattaa

SEQ ID NO: 2887925 - DNA, 13 bp, Homo sapiens
acttcccaccctg

SEQ ID NO: 2887926 - DNA, 15 bp, Homo sapiens
acttccccaccccta

SEQ ID NO: 2887927 - DNA, 16 bp, Homo sapiens
acttcccccaccctgg

SEQ ID NO: 2887928 - DNA, 14 bp, Homo sapiens
acttcccctatgga

SEQ ID NO: 2887929 - DNA, 17 bp, Homo sapiens
acttccctaacacttac

SEQ ID NO: 2887930 - DNA, 15 bp, Homo sapiens
acttccctcttgaaa

SEQ ID NO: 2887931 - DNA, 15 bp, Homo sapiens
acttccctgttcttt

SEQ ID NO: 2887932 - DNA, 12 bp, Homo sapiens
acttcctcccct

SEQ ID NO: 2887933 - DNA, 20 bp, Homo sapiens
acttcctctccacaggagcc

SEQ ID NO: 2887934 - DNA, 12 bp, Homo sapiens
acttcctgtact

SEQ ID NO: 2887935 - DNA, 16 bp, Homo sapiens
acttcctgtgcctttc

SEQ ID NO: 2887936 - DNA, 17 bp, Homo sapiens
acttcgcatcaaaagac

SEQ ID NO: 2887937 - DNA, 20 bp, Homo sapiens
acttcgcatcaaaagacaat

SEQ ID NO: 2887938 - DNA, 15 bp, Homo sapiens
acttcggccagagct

SEQ ID NO: 2887939 - DNA, 12 bp, Homo sapiens
acttctatattt

SEQ ID NO: 2887940 - DNA, 13 bp, Homo sapiens
acttctatatttt

SEQ ID NO: 2887941 - DNA, 16 bp, Homo sapiens
acttctatattttaat

SEQ ID NO: 2887942 - DNA, 17 bp, Homo sapiens
acttctatattttaata

SEQ ID NO: 2887943 - DNA, 21 bp, Homo sapiens
acttctatattttaatagaaa

SEQ ID NO: 2887944 - DNA, 14 bp, Homo sapiens
acttctcaggaaat

SEQ ID NO: 2887945 - DNA, 15 bp, Homo sapiens
acttctcatcacaca

SEQ ID NO: 2887946 - DNA, 18 bp, Homo sapiens
acttctcatcacacacat

SEQ ID NO: 2887947 - DNA, 10 bp, Homo sapiens
acttctctgg

SEQ ID NO: 2887948 - DNA, 20 bp, Homo sapiens
acttctgaagagaccactca

SEQ ID NO: 2887949 - DNA, 18 bp, Homo sapiens
acttctgcattcctgtaa

SEQ ID NO: 2887950 - DNA, 21 bp, Homo sapiens
acttctggggccacctctgga

SEQ ID NO: 2887951 - DNA, 17 bp, Homo sapiens
acttctgggtcaatgga

SEQ ID NO: 2887952 - DNA, 16 bp, Homo sapiens
acttctggtcccctgt

SEQ ID NO: 2887953 - DNA, 18 bp, Homo sapiens
acttctgtgtctgtcacc

SEQ ID NO: 2887954 - DNA, 21 bp, Homo sapiens
acttctgtttgatcactgtga

SEQ ID NO: 2887955 - DNA, 23 bp, Homo sapiens
acttctgtttgatcactgtgaac

SEQ ID NO: 2887956 - DNA, 17 bp, Homo sapiens
acttcttatggaattga

SEQ ID NO: 2887957 - DNA, 21 bp, Homo sapiens
acttcttatggaattgatttg

SEQ ID NO: 2887958 - DNA, 22 bp, Homo sapiens
acttcttccatccaaagaatta

SEQ ID NO: 2887959 - DNA, 12 bp, Homo sapiens
acttcttgaagg

SEQ ID NO: 2887960 - DNA, 16 bp, Homo sapiens
acttcttgaaggtgct

SEQ ID NO: 2887961 - DNA, 16 bp, Homo sapiens
acttcttgccctgggg

SEQ ID NO: 2887962 - DNA, 20 bp, Homo sapiens
acttctttatactctcttcc

SEQ ID NO: 2887963 - DNA, 23 bp, Homo sapiens
acttctttatactctcttccctt

SEQ ID NO: 2887964 - DNA, 15 bp, Homo sapiens
acttctttcagcaga

SEQ ID NO: 2887965 - DNA, 22 bp, Homo sapiens
acttcttttataactagtcctt

SEQ ID NO: 2887966 - DNA, 11 bp, Homo sapiens
acttcttttca

SEQ ID NO: 2887967 - DNA, 20 bp, Homo sapiens
acttgaaatacgtttgtgtt

SEQ ID NO: 2887968 - DNA, 13 bp, Homo sapiens
acttgaactgatt

SEQ ID NO: 2887969 - DNA, 18 bp, Homo sapiens
ctacgtgtgatttttctg

SEQ ID NO: 2887970 - DNA, 21 bp, Homo sapiens
ctactcagaaatggacaaaga

SEQ ID NO: 2887971 - DNA, 18 bp, Homo sapiens
ctactcagcagccctcct

SEQ ID NO: 2887972 - DNA, 20 bp, Homo sapiens
ctactcagcagccctcctca

SEQ ID NO: 2887973 - DNA, 17 bp, Homo sapiens
ctactcagcatttgatt

SEQ ID NO: 2887974 - DNA, 17 bp, Homo sapiens
ctactcccagacaccca

SEQ ID NO: 2887975 - DNA, 17 bp, Homo sapiens
ctactctccccacgagg

SEQ ID NO: 2887976 - DNA, 23 bp, Homo sapiens
ctactctccccacgagggctggc

SEQ ID NO: 2887977 - DNA, 22 bp, Homo sapiens
ctactctgagacaaaagaaaaa

SEQ ID NO: 2887978 - DNA, 12 bp, Homo sapiens
ctactctgtgta

SEQ ID NO: 2887979 - DNA, 13 bp, Homo sapiens
ctactctgtgtaa

SEQ ID NO: 2887980 - DNA, 15 bp, Homo sapiens
ctactctgttccttc

SEQ ID NO: 2887981 - DNA, 16 bp, Homo sapiens
ctactctgttccttca

SEQ ID NO: 2887982 - DNA, 21 bp, Homo sapiens
ctactcttaatgatgttatct

SEQ ID NO: 2887983 - DNA, 21 bp, Homo sapiens
ctactcttccaggactctctg

SEQ ID NO: 2887984 - DNA, 14 bp, Homo sapiens
ctactgaaccagcc

SEQ ID NO: 2887985 - DNA, 16 bp, Homo sapiens
ctactgaaccagccac

SEQ ID NO: 2887986 - DNA, 22 bp, Homo sapiens
ctactgactgatgacaaaccca

SEQ ID NO: 2887987 - DNA, 17 bp, Homo sapiens
ctactgagtaaacccta

SEQ ID NO: 2887988 - DNA, 16 bp, Homo sapiens
ctactgattgtttcat

SEQ ID NO: 2887989 - DNA, 17 bp, Homo sapiens
ctactgattgtttcatt

SEQ ID NO: 2887990 - DNA, 21 bp, Homo sapiens
ctactgcccaggcactgcaaa

SEQ ID NO: 2887991 - DNA, 21 bp, Homo sapiens
ctactgccgtcagtgctgtgc

SEQ ID NO: 2887992 - DNA, 17 bp, Homo sapiens
ctactgcttcctctgaa

SEQ ID NO: 2887993 - DNA, 16 bp, Homo sapiens
ctactggggaggctga

SEQ ID NO: 2887994 - DNA, 23 bp, Homo sapiens
ctactggtgtaatctcaatgcaa

SEQ ID NO: 2887995 - DNA, 22 bp, Homo sapiens
ctactgtaataaagatgattgt

SEQ ID NO: 2887996 - DNA, 19 bp, Homo sapiens
ctactgtagaactgatttt

SEQ ID NO: 2887997 - DNA, 15 bp, Homo sapiens
ctactgtagaagaag

SEQ ID NO: 2887998 - DNA, 16 bp, Homo sapiens
ctactgtagaagaagt

SEQ ID NO: 2887999 - DNA, 20 bp, Homo sapiens
ctactgtagatttgtatcct

SEQ ID NO: 2888000 - DNA, 17 bp, Homo sapiens
ctactgtgtgtgtgaat

SEQ ID NO: 2888001 - DNA, 23 bp, Homo sapiens
ctactgttatcagtaatgctaaa

SEQ ID NO: 2888002 - DNA, 14 bp, Homo sapiens
ctactgttctaaag

SEQ ID NO: 2888003 - DNA, 22 bp, Homo sapiens
ctactgttctaaagctctgaca

SEQ ID NO: 2888004 - DNA, 16 bp, Homo sapiens
ctacttagatatttca

SEQ ID NO: 2888005 - DNA, 19 bp, Homo sapiens
ctacttagatatttcatgt

SEQ ID NO: 2888006 - DNA, 15 bp, Homo sapiens
ctacttagctggcca

SEQ ID NO: 2888007 - DNA, 19 bp, Homo sapiens
ctacttctctctgtatttt

SEQ ID NO: 2888008 - DNA, 18 bp, Homo sapiens
ctacttctgtgtctgtca

SEQ ID NO: 2888009 - DNA, 18 bp, Homo sapiens
ctacttgattttattgta

SEQ ID NO: 2888010 - DNA, 17 bp, Homo sapiens
ctacttgctctgctcta

SEQ ID NO: 2888011 - DNA, 21 bp, Homo sapiens
ctacttgcttattacatttaa

SEQ ID NO: 2888012 - DNA, 22 bp, Homo sapiens
ctacttgcttattacatttaaa

SEQ ID NO: 2888013 - DNA, 15 bp, Homo sapiens
ctacttgggagcctg

SEQ ID NO: 2888014 - DNA, 17 bp, Homo sapiens
ctacttgtgtttttccc

SEQ ID NO: 2888015 - DNA, 16 bp, Homo sapiens
ctacttgttcatttgg

SEQ ID NO: 2888016 - DNA, 15 bp, Homo sapiens
ctactttaagtgata

SEQ ID NO: 2888017 - DNA, 14 bp, Homo sapiens
ctactttctcttgt

SEQ ID NO: 2888018 - DNA, 16 bp, Homo sapiens
ctactttctcttgttt

SEQ ID NO: 2888019 - DNA, 17 bp, Homo sapiens
ctactttctcttgttta

SEQ ID NO: 2888020 - DNA, 19 bp, Homo sapiens
ctactttctcttgtttaaa

SEQ ID NO: 2888021 - DNA, 14 bp, Homo sapiens
ctactttgtccttt

SEQ ID NO: 2888022 - DNA, 20 bp, Homo sapiens
ctactttgttaggattttca

SEQ ID NO: 2888023 - DNA, 18 bp, Homo sapiens
ctacttttttcattttgt

SEQ ID NO: 2888024 - DNA, 18 bp, Homo sapiens
ctagaaaaggcattttgg

SEQ ID NO: 2888025 - DNA, 12 bp, Homo sapiens
ctagaaaccttt

SEQ ID NO: 2888026 - DNA, 16 bp, Homo sapiens
ctagaaacttccaaat

SEQ ID NO: 2888027 - DNA, 22 bp, Homo sapiens
ctagaaagcatccattaattaa

SEQ ID NO: 2888028 - DNA, 20 bp, Homo sapiens
ctagaaattgacacaagtgg

SEQ ID NO: 2888029 - DNA, 13 bp, Homo sapiens
ctagaaatttttc

SEQ ID NO: 2888030 - DNA, 23 bp, Homo sapiens
ctagaaatttttcagatgcttct

SEQ ID NO: 2888031 - DNA, 18 bp, Homo sapiens
ctagaacatccctgccag

SEQ ID NO: 2888032 - DNA, 18 bp, Homo sapiens
ctagaagataacattttc

SEQ ID NO: 2888033 - DNA, 20 bp, Homo sapiens
ctagaagataacattttcaa

SEQ ID NO: 2888034 - DNA, 16 bp, Homo sapiens
ctagaagtaagaagag

SEQ ID NO: 2888035 - DNA, 21 bp, Homo sapiens
ctagaagtaagaagaggagcc

SEQ ID NO: 2888036 - DNA, 16 bp, Homo sapiens
ctagaatcctgcttta

SEQ ID NO: 2888037 - DNA, 19 bp, Homo sapiens
ctagaatctgcaattcaaa

SEQ ID NO: 2888038 - DNA, 13 bp, Homo sapiens
ctagaatctttat

SEQ ID NO: 2888039 - DNA, 21 bp, Homo sapiens
ctagacatggaggttctaagg

SEQ ID NO: 2888040 - DNA, 23 bp, Homo sapiens
ctagacattgcaattttgcatag

SEQ ID NO: 2888041 - DNA, 17 bp, Homo sapiens
ctagaccgttataaagt

SEQ ID NO: 2888042 - DNA, 21 bp, Homo sapiens
ctagactcccggggtccccgc

SEQ ID NO: 2888043 - DNA, 20 bp, Homo sapiens
ctagactttaaatttaaagt

SEQ ID NO: 2888044 - DNA, 10 bp, Homo sapiens
ctagagaagg

SEQ ID NO: 2888045 - DNA, 19 bp, Homo sapiens
ctagagacagtgatgcctg

SEQ ID NO: 2888046 - DNA, 21 bp, Homo sapiens
ctagagagaaaaagaaagaac

SEQ ID NO: 2888047 - DNA, 22 bp, Homo sapiens
ctagagagggaggcaagccctg

SEQ ID NO: 2888048 - DNA, 17 bp, Homo sapiens
ctagagatatggcagcg

SEQ ID NO: 2888049 - DNA, 14 bp, Homo sapiens
ctagagcactgcca

SEQ ID NO: 2888050 - DNA, 15 bp, Homo sapiens
ctagagcactgccac

SEQ ID NO: 2888051 - DNA, 18 bp, Homo sapiens
ctagagcactgccaccag

SEQ ID NO: 2888052 - DNA, 16 bp, Homo sapiens
ctagagcgcggctggc

SEQ ID NO: 2888053 - DNA, 21 bp, Homo sapiens
ctagaggagacagcctgtctc

SEQ ID NO: 2888054 - DNA, 22 bp, Homo sapiens
ctagaggagacagcctgtctct

SEQ ID NO: 2888055 - DNA, 14 bp, Homo sapiens
ctagagggacctct

SEQ ID NO: 2888056 - DNA, 15 bp, Homo sapiens
ctagagggaggggcc

SEQ ID NO: 2888057 - DNA, 21 bp, Homo sapiens
ctagagggaggggcctaggcc

SEQ ID NO: 2888058 - DNA, 18 bp, Homo sapiens
ctagagttttatagcctg

SEQ ID NO: 2888059 - DNA, 14 bp, Homo sapiens
ctagatattttcct

SEQ ID NO: 2888060 - DNA, 15 bp, Homo sapiens
ctagatcagatgctc

SEQ ID NO: 2888061 - DNA, 18 bp, Homo sapiens
ctagatcagatgctccaa

SEQ ID NO: 2888062 - DNA, 15 bp, Homo sapiens
ctagatcataaggct

SEQ ID NO: 2888063 - DNA, 18 bp, Homo sapiens
ctagatcataaggcttca

SEQ ID NO: 2888064 - DNA, 22 bp, Homo sapiens
ctagatcataaggcttcaaaat

SEQ ID NO: 2888065 - DNA, 14 bp, Homo sapiens
ctagatcatttgtt

SEQ ID NO: 2888066 - DNA, 19 bp, Homo sapiens
ctagatcctgggtttccat

SEQ ID NO: 2888067 - DNA, 13 bp, Homo sapiens
ctagatgacctca

SEQ ID NO: 2888068 - DNA, 21 bp, Homo sapiens
ctagatgctttcctaaatcag

SEQ ID NO: 2888069 - DNA, 15 bp, Homo sapiens
ctagatggctcctct

SEQ ID NO: 2888070 - DNA, 21 bp, Homo sapiens
ctagatgtttattcttctaga

SEQ ID NO: 2888071 - DNA, 18 bp, Homo sapiens
ctagattatatcaaagta

SEQ ID NO: 2888072 - DNA, 15 bp, Homo sapiens
ctagattcaaaggtt

SEQ ID NO: 2888073 - DNA, 22 bp, Homo sapiens
ctagattccattggtccaagat

SEQ ID NO: 2888074 - DNA, 20 bp, Homo sapiens
ctagattctacatattcttt

SEQ ID NO: 2888075 - DNA, 14 bp, Homo sapiens
ctagcaccatggca

SEQ ID NO: 2888076 - DNA, 18 bp, Homo sapiens
ctagcacctgccagggag

SEQ ID NO: 2888077 - DNA, 22 bp, Homo sapiens
ctagcagcaccgttctgtgcac

SEQ ID NO: 2888078 - DNA, 19 bp, Homo sapiens
ctagcagcccaccctgctg

SEQ ID NO: 2888079 - DNA, 23 bp, Homo sapiens
ctagcagcccaccctgctgctgg

SEQ ID NO: 2888080 - DNA, 12 bp, Homo sapiens
ctagcaggcccc

SEQ ID NO: 2888081 - DNA, 15 bp, Homo sapiens
ctagcccctggggtg

SEQ ID NO: 2888082 - DNA, 21 bp, Homo sapiens
ctagccctctccctctaggct

SEQ ID NO: 2888083 - DNA, 13 bp, Homo sapiens
ctagccgctgccc

SEQ ID NO: 2888084 - DNA, 14 bp, Homo sapiens
ctagccgctgccct

SEQ ID NO: 2888085 - DNA, 15 bp, Homo sapiens
ctagccgctgccctg

SEQ ID NO: 2888086 - DNA, 22 bp, Homo sapiens
ctagccgctgccctgggtcctg

SEQ ID NO: 2888087 - DNA, 13 bp, Homo sapiens
ctagcctccacca

SEQ ID NO: 2888088 - DNA, 17 bp, Homo sapiens
ctagcctccaccatccc

SEQ ID NO: 2888089 - DNA, 20 bp, Homo sapiens
ctagcctggggcttgaattt

SEQ ID NO: 2888090 - DNA, 22 bp, Homo sapiens
ctagcgcgttgcctgtcgcttt

SEQ ID NO: 2888091 - DNA, 19 bp, Homo sapiens
ctagctagaagtgggccag

SEQ ID NO: 2888092 - DNA, 21 bp, Homo sapiens
ctagctatttctatgtatgtg

SEQ ID NO: 2888093 - DNA, 17 bp, Homo sapiens
ctagctcctcctcctgg

SEQ ID NO: 2888094 - DNA, 19 bp, Homo sapiens
ctagctctatgtttacaaa

SEQ ID NO: 2888095 - DNA, 13 bp, Homo sapiens
ctagctcttgggc

SEQ ID NO: 2888096 - DNA, 17 bp, Homo sapiens
ctagctcttgggcctga

SEQ ID NO: 2888097 - DNA, 20 bp, Homo sapiens
ctagctcttgggcctgacct

SEQ ID NO: 2888098 - DNA, 23 bp, Homo sapiens
ctagctcttgggcctgacctcca

SEQ ID NO: 2888099 - DNA, 12 bp, Homo sapiens
ctagctctttga

SEQ ID NO: 2888100 - DNA, 16 bp, Homo sapiens
ctagctgctacaaaga

SEQ ID NO: 2888101 - DNA, 20 bp, Homo sapiens
ctagctgggggtgggccagg

SEQ ID NO: 2888102 - DNA, 21 bp, Homo sapiens
ctagctttcctttacagctgt

SEQ ID NO: 2888103 - DNA, 15 bp, Homo sapiens
ctaggaactcagtgc

SEQ ID NO: 2888104 - DNA, 14 bp, Homo sapiens
ctaagtttctaaga

SEQ ID NO: 2888105 - DNA, 21 bp, Homo sapiens
ctaagtttctaagattctaaa

SEQ ID NO: 2888106 - DNA, 23 bp, Homo sapiens
ctaatatcaaatgcagtatattt

SEQ ID NO: 2888107 - DNA, 19 bp, Homo sapiens
ctaatatccaacacaacta

SEQ ID NO: 2888108 - DNA, 16 bp, Homo sapiens
ctaatattaaaagtca

SEQ ID NO: 2888109 - DNA, 14 bp, Homo sapiens
ctaatattttatgt

SEQ ID NO: 2888110 - DNA, 14 bp, Homo sapiens
ctaatattttattt

SEQ ID NO: 2888111 - DNA, 18 bp, Homo sapiens
ctaatcaagagtctctcc

SEQ ID NO: 2888112 - DNA, 23 bp, Homo sapiens
ctaatcaagagtctctccagcct

SEQ ID NO: 2888113 - DNA, 16 bp, Homo sapiens
ctaatcacatgtgctg

SEQ ID NO: 2888114 - DNA, 21 bp, Homo sapiens
ctaatcataacatagttgaaa

SEQ ID NO: 2888115 - DNA, 15 bp, Homo sapiens
ctaatccaacccatg

SEQ ID NO: 2888116 - DNA, 23 bp, Homo sapiens
ctaatccaggcagatccaggact

SEQ ID NO: 2888117 - DNA, 21 bp, Homo sapiens
ctaatccctgggcattgcttt

SEQ ID NO: 2888118 - DNA, 15 bp, Homo sapiens
ctaatcctttaatga

SEQ ID NO: 2888119 - DNA, 21 bp, Homo sapiens
ctaatcttaaatcagaataaa

SEQ ID NO: 2888120 - DNA, 13 bp, Homo sapiens
ctaatgaattgaa

SEQ ID NO: 2888121 - DNA, 17 bp, Homo sapiens
ctaatgaggagagaaaa

SEQ ID NO: 2888122 - DNA, 18 bp, Homo sapiens
ctaatgaggagagaaaat

SEQ ID NO: 2888123 - DNA, 21 bp, Homo sapiens
ctaatgaggagagaaaatata

SEQ ID NO: 2888124 - DNA, 17 bp, Homo sapiens
ctaatgcctttcatctt

SEQ ID NO: 2888125 - DNA, 14 bp, Homo sapiens
ctaatgctctgaaa

SEQ ID NO: 2888126 - DNA, 21 bp, Homo sapiens
ctaatgcttgccaagaaatcg

SEQ ID NO: 2888127 - DNA, 16 bp, Homo sapiens
ctaatgcttgtttatg

SEQ ID NO: 2888128 - DNA, 17 bp, Homo sapiens
ctaatgcttgtttatga

SEQ ID NO: 2888129 - DNA, 16 bp, Homo sapiens
ctaatggcatgagaaa

SEQ ID NO: 2888130 - DNA, 22 bp, Homo sapiens
ctaatgtgagtgtgaagctttg

SEQ ID NO: 2888131 - DNA, 21 bp, Homo sapiens
ctaatgttagaattgatttcc

SEQ ID NO: 2888132 - DNA, 22 bp, Homo sapiens
ctaatgttagaattgatttcca

SEQ ID NO: 2888133 - DNA, 22 bp, Homo sapiens
ctaattacgataaggaagaaac

SEQ ID NO: 2888134 - DNA, 16 bp, Homo sapiens
ctaattcatcttttaa

SEQ ID NO: 2888135 - DNA, 17 bp, Homo sapiens
ctaattccacacctttt

SEQ ID NO: 2888136 - DNA, 16 bp, Homo sapiens
ctaattcttctgtcct

SEQ ID NO: 2888137 - DNA, 12 bp, Homo sapiens
ctaattgacttt

SEQ ID NO: 2888138 - DNA, 13 bp, Homo sapiens
ctaattgacttta

SEQ ID NO: 2888139 - DNA, 20 bp, Homo sapiens
ctaattgactttagaaagct

SEQ ID NO: 2888140 - DNA, 15 bp, Homo sapiens
ctaattgctgttgaa

SEQ ID NO: 2888141 - DNA, 19 bp, Homo sapiens
ctaattgctgttgaaagca

SEQ ID NO: 2888142 - DNA, 17 bp, Homo sapiens
ctaattggtcattccta

SEQ ID NO: 2888143 - DNA, 14 bp, Homo sapiens
ctaatttgcattaa

SEQ ID NO: 2888144 - DNA, 18 bp, Homo sapiens
ctaatttggtttttactc

SEQ ID NO: 2888145 - DNA, 14 bp, Homo sapiens
ctaattttgtgctc

SEQ ID NO: 2888146 - DNA, 16 bp, Homo sapiens
ctaattttgtgctctt

SEQ ID NO: 2888147 - DNA, 20 bp, Homo sapiens
ctaattttgtgctctttcct

SEQ ID NO: 2888148 - DNA, 22 bp, Homo sapiens
ctaattttgtgctctttcctgc

SEQ ID NO: 2888149 - DNA, 14 bp, Homo sapiens
ctaatttttgtaat

SEQ ID NO: 2888150 - DNA, 14 bp, Homo sapiens
ctaatttttgtatt

SEQ ID NO: 2888151 - DNA, 19 bp, Homo sapiens
ctaatttttgtattatttt

SEQ ID NO: 2888152 - DNA, 15 bp, Homo sapiens
ctaatttttgtattt

SEQ ID NO: 2888153 - DNA, 16 bp, Homo sapiens
ctaatttttttgtatt

SEQ ID NO: 2888154 - DNA, 22 bp, Homo sapiens
ctaatttttttttatttttagt

SEQ ID NO: 2888155 - DNA, 21 bp, Homo sapiens
ctacaaaaaggtataaataat

SEQ ID NO: 2888156 - DNA, 18 bp, Homo sapiens
ctacaaaacgcgcagatg

SEQ ID NO: 2888157 - DNA, 16 bp, Homo sapiens
ctacaaaataaagctg

SEQ ID NO: 2888158 - DNA, 21 bp, Homo sapiens
ctacaaaataaagctgttctc

SEQ ID NO: 2888159 - DNA, 14 bp, Homo sapiens
ctacaaagaagaca

SEQ ID NO: 2888160 - DNA, 15 bp, Homo sapiens
ctacaaagaagacat

SEQ ID NO: 2888161 - DNA, 16 bp, Homo sapiens
ctacaaagaagacatg

SEQ ID NO: 2888162 - DNA, 22 bp, Homo sapiens
ctacaaccaggtcttgacctga

SEQ ID NO: 2888163 - DNA, 18 bp, Homo sapiens
ctacacaacatgtatgtg

SEQ ID NO: 2888164 - DNA, 12 bp, Homo sapiens
ctacaccacaca

SEQ ID NO: 2888165 - DNA, 19 bp, Homo sapiens
ctacaccacacacaacagc

SEQ ID NO: 2888166 - DNA, 11 bp, Homo sapiens
ctacacctgga

SEQ ID NO: 2888167 - DNA, 20 bp, Homo sapiens
ctacaccttgcttttttact

SEQ ID NO: 2888168 - DNA, 23 bp, Homo sapiens
ctacacgagatacagaattttat

SEQ ID NO: 2888169 - DNA, 13 bp, Homo sapiens
ctacagaaaataa

SEQ ID NO: 2888170 - DNA, 15 bp, Homo sapiens
ctacagaaagcacaa

SEQ ID NO: 2888171 - DNA, 16 bp, Homo sapiens
ctacagagcttccctg

SEQ ID NO: 2888172 - DNA, 18 bp, Homo sapiens
ctacagagcttccctgac

SEQ ID NO: 2888173 - DNA, 20 bp, Homo sapiens
ctacagagcttccctgactc

SEQ ID NO: 2888174 - DNA, 22 bp, Homo sapiens
ctacagatagagagttgttgtg

SEQ ID NO: 2888175 - DNA, 17 bp, Homo sapiens
ctacaggaggaacagtg

SEQ ID NO: 2888176 - DNA, 20 bp, Homo sapiens
ctacaggttacaacagattt

SEQ ID NO: 2888177 - DNA, 14 bp, Homo sapiens
ctacagtcaggaaa

SEQ ID NO: 2888178 - DNA, 21 bp, Homo sapiens
ctacagtcaggaaaggaatca

SEQ ID NO: 2888179 - DNA, 18 bp, Homo sapiens
ctacatcttttttcacaa

SEQ ID NO: 2888180 - DNA, 22 bp, Homo sapiens
ctacatgacgggttgtgagact

SEQ ID NO: 2888181 - DNA, 19 bp, Homo sapiens
ctacatgatgctaaaggct

SEQ ID NO: 2888182 - DNA, 14 bp, Homo sapiens
ctacattttttcat

SEQ ID NO: 2888183 - DNA, 16 bp, Homo sapiens
ctacattttttcatca

SEQ ID NO: 2888184 - DNA, 18 bp, Homo sapiens
ctaccaaggcatatcatg

SEQ ID NO: 2888185 - DNA, 20 bp, Homo sapiens
ctaccacacatctgtggaga

SEQ ID NO: 2888186 - DNA, 14 bp, Homo sapiens
ctaccacctcccca

SEQ ID NO: 2888187 - DNA, 16 bp, Homo sapiens
ctaccacctccccagc

SEQ ID NO: 2888188 - DNA, 18 bp, Homo sapiens
ctaccagataactgagga

SEQ ID NO: 2888189 - DNA, 15 bp, Homo sapiens
ctaccaggcaaattc

SEQ ID NO: 2888190 - DNA, 23 bp, Homo sapiens
ctaccagtgcaggctggccagcc

SEQ ID NO: 2888191 - DNA, 18 bp, Homo sapiens
ctacccagcgtggcctcc

SEQ ID NO: 2888192 - DNA, 15 bp, Homo sapiens
ctacccatccccgca

SEQ ID NO: 2888193 - DNA, 14 bp, Homo sapiens
ctaccccaccacga

SEQ ID NO: 2888194 - DNA, 22 bp, Homo sapiens
ctacccccagaggccttggcca

SEQ ID NO: 2888195 - DNA, 17 bp, Homo sapiens
ctacccccagctgtgct

SEQ ID NO: 2888196 - DNA, 13 bp, Homo sapiens
ctaccccctcatc

SEQ ID NO: 2888197 - DNA, 17 bp, Homo sapiens
ctaccccctcatccccc

SEQ ID NO: 2888198 - DNA, 14 bp, Homo sapiens
ctaccccctgtgcc

SEQ ID NO: 2888199 - DNA, 13 bp, Homo sapiens
ctacccctgccct

SEQ ID NO: 2888200 - DNA, 15 bp, Homo sapiens
ctacccgtgcctggg

SEQ ID NO: 2888201 - DNA, 17 bp, Homo sapiens
ctacccgtgcctgggcc

SEQ ID NO: 2888202 - DNA, 11 bp, Homo sapiens
ctaccctcacc

SEQ ID NO: 2888203 - DNA, 14 bp, Homo sapiens
ctaccctcaccctt

SEQ ID NO: 2888204 - DNA, 13 bp, Homo sapiens
ctaccctgagatc

SEQ ID NO: 2888205 - DNA, 19 bp, Homo sapiens
ctaccctgagatctgcaca

SEQ ID NO: 2888206 - DNA, 16 bp, Homo sapiens
ctaccgatggtcccag

SEQ ID NO: 2888207 - DNA, 13 bp, Homo sapiens
ctaccgcatggca

SEQ ID NO: 2888208 - DNA, 16 bp, Homo sapiens
ctaccgcatggcagct

SEQ ID NO: 2888209 - DNA, 17 bp, Homo sapiens
ctaccgcatggcagctg

SEQ ID NO: 2888210 - DNA, 18 bp, Homo sapiens
ctaccgcatggcagctgg

SEQ ID NO: 2888211 - DNA, 20 bp, Homo sapiens
ctaccgcatggcagctgggc

SEQ ID NO: 2888212 - DNA, 19 bp, Homo sapiens
ctaccggggaccgggaccc

SEQ ID NO: 2888213 - DNA, 19 bp, Homo sapiens
ctaccgggttctcctgatt

SEQ ID NO: 2888214 - DNA, 18 bp, Homo sapiens
ctacctaagaatttcact

SEQ ID NO: 2888215 - DNA, 23 bp, Homo sapiens
ctacctacgtttgcaccgcctgc

SEQ ID NO: 2888216 - DNA, 12 bp, Homo sapiens
ctacctagaagt

SEQ ID NO: 2888217 - DNA, 13 bp, Homo sapiens
ctacctatattcc

SEQ ID NO: 2888218 - DNA, 15 bp, Homo sapiens
ctacctatattcctt

SEQ ID NO: 2888219 - DNA, 13 bp, Homo sapiens
ctacctcagcctc

SEQ ID NO: 2888220 - DNA, 19 bp, Homo sapiens
ctacctcagcctcctgggt

SEQ ID NO: 2888221 - DNA, 13 bp, Homo sapiens
ctacctccctccc

SEQ ID NO: 2888222 - DNA, 13 bp, Homo sapiens
ctacctctctgtc

SEQ ID NO: 2888223 - DNA, 20 bp, Homo sapiens
ctacctctctgtcccttgct

SEQ ID NO: 2888224 - DNA, 16 bp, Homo sapiens
ctacctgagcattcag

SEQ ID NO: 2888225 - DNA, 12 bp, Homo sapiens
ctacctgggacc

SEQ ID NO: 2888226 - DNA, 15 bp, Homo sapiens
ctacctgttctgtag

SEQ ID NO: 2888227 - DNA, 16 bp, Homo sapiens
ctaccttccccagact

SEQ ID NO: 2888228 - DNA, 18 bp, Homo sapiens
ctaccttccccagacttg

SEQ ID NO: 2888229 - DNA, 22 bp, Homo sapiens
ctaccttccccagacttgcact

SEQ ID NO: 2888230 - DNA, 18 bp, Homo sapiens
ctaccttgctagctagcc

SEQ ID NO: 2888231 - DNA, 19 bp, Homo sapiens
ctaccttgtgagggagaga

SEQ ID NO: 2888232 - DNA, 21 bp, Homo sapiens
ctaccttttgataaaatgttc

SEQ ID NO: 2888233 - DNA, 22 bp, Homo sapiens
ctacctttttataatgcacaac

SEQ ID NO: 2888234 - DNA, 22 bp, Homo sapiens
ctacgctgaagatggcatcctg

SEQ ID NO: 2888235 - DNA, 12 bp, Homo sapiens
ctacgtgcctcc

SEQ ID NO: 2888236 - DNA, 13 bp, Homo sapiens
ctacgtgcctccc

SEQ ID NO: 2888237 - DNA, 19 bp, Homo sapiens
ctacgtgtgaaatctgtct

SEQ ID NO: 2888238 - DNA, 20 bp, Homo sapiens
ctacgtgtgaaatctgtctt

SEQ ID NO: 2888239 - DNA, 21 bp, Homo sapiens
ctacgtgtgaaatctgtcttt

SEQ ID NO: 2888240 - DNA, 22 bp, Homo sapiens
ctacgtgtgaaatctgtctttg

SEQ ID NO: 2888241 - DNA, 14 bp, Homo sapiens
ctaggaagaatttt

SEQ ID NO: 2888242 - DNA, 21 bp, Homo sapiens
ctaggaagaattttaaaaatg

SEQ ID NO: 2888243 - DNA, 19 bp, Homo sapiens
ctaggaagagcaggactcc

SEQ ID NO: 2888244 - DNA, 17 bp, Homo sapiens
ctaggacttcaaattgg

SEQ ID NO: 2888245 - DNA, 15 bp, Homo sapiens
ctaggagctgggagg

SEQ ID NO: 2888246 - DNA, 19 bp, Homo sapiens
ctaggagctgggaggaaaa

SEQ ID NO: 2888247 - DNA, 22 bp, Homo sapiens
ctaggatgtgcattctccagcc

SEQ ID NO: 2888248 - DNA, 17 bp, Homo sapiens
ctaggattccccctgcc

SEQ ID NO: 2888249 - DNA, 13 bp, Homo sapiens
ctaggcaacatag

SEQ ID NO: 2888250 - DNA, 21 bp, Homo sapiens
ctaggcactgtagttctaaga

SEQ ID NO: 2888251 - DNA, 14 bp, Homo sapiens
ctaggccactcctc

SEQ ID NO: 2888252 - DNA, 15 bp, Homo sapiens
ctaggccactcctcc

SEQ ID NO: 2888253 - DNA, 18 bp, Homo sapiens
ctaggccatcaccaacca

SEQ ID NO: 2888254 - DNA, 13 bp, Homo sapiens
ctaggcctcagcc

SEQ ID NO: 2888255 - DNA, 16 bp, Homo sapiens
ctaggcctcagccaga

SEQ ID NO: 2888256 - DNA, 18 bp, Homo sapiens
ctaggcctcctggcccag

SEQ ID NO: 2888257 - DNA, 19 bp, Homo sapiens
ctaggcctcctggcccagg

SEQ ID NO: 2888258 - DNA, 13 bp, Homo sapiens
ctaggctaggacg

SEQ ID NO: 2888259 - DNA, 13 bp, Homo sapiens
ctaggctctgcct

SEQ ID NO: 2888260 - DNA, 14 bp, Homo sapiens
ctaggctctgcctt

SEQ ID NO: 2888261 - DNA, 21 bp, Homo sapiens
ctaggcttaatacctgggtga

SEQ ID NO: 2888262 - DNA, 14 bp, Homo sapiens
ctagggagccatgt

SEQ ID NO: 2888263 - DNA, 17 bp, Homo sapiens
ctagggagccatttgag

SEQ ID NO: 2888264 - DNA, 18 bp, Homo sapiens
ctagggagccatttgaga

SEQ ID NO: 2888265 - DNA, 17 bp, Homo sapiens
ctagggaggaccaaagg

SEQ ID NO: 2888266 - DNA, 13 bp, Homo sapiens
ctagggatccctc

SEQ ID NO: 2888267 - DNA, 20 bp, Homo sapiens
ctagggcagggtgggagccg

SEQ ID NO: 2888268 - DNA, 14 bp, Homo sapiens
ctagggctgggaaa

SEQ ID NO: 2888269 - DNA, 16 bp, Homo sapiens
ctagggctgggaaaca

SEQ ID NO: 2888270 - DNA, 20 bp, Homo sapiens
ctagggctgggaaacactcc

SEQ ID NO: 2888271 - DNA, 16 bp, Homo sapiens
ctaggggcttggtcct

SEQ ID NO: 2888272 - DNA, 20 bp, Homo sapiens
ctagggtgggaaggggctag

SEQ ID NO: 2888273 - DNA, 15 bp, Homo sapiens
ctagggtggggagag

SEQ ID NO: 2888274 - DNA, 19 bp, Homo sapiens
ctagggttttggcctgcct

SEQ ID NO: 2888275 - DNA, 20 bp, Homo sapiens
ctaggtatcattcaactctc

SEQ ID NO: 2888276 - DNA, 18 bp, Homo sapiens
ctaggtgcagctcctcag

SEQ ID NO: 2888277 - DNA, 15 bp, Homo sapiens
ctaggttgtttttaa

SEQ ID NO: 2888278 - DNA, 16 bp, Homo sapiens
ctaggttgtttttaaa

SEQ ID NO: 2888279 - DNA, 13 bp, Homo sapiens
ctaggtttcaaag

SEQ ID NO: 2888280 - DNA, 14 bp, Homo sapiens
ctagtaactgctgt

SEQ ID NO: 2888281 - DNA, 18 bp, Homo sapiens
ctagtaagcatctacttc

SEQ ID NO: 2888282 - DNA, 19 bp, Homo sapiens
ctagtacataattgattaa

SEQ ID NO: 2888283 - DNA, 20 bp, Homo sapiens
ctagtacataattgattaaa

SEQ ID NO: 2888284 - DNA, 15 bp, Homo sapiens
ctagtagaacaatgt

SEQ ID NO: 2888285 - DNA, 14 bp, Homo sapiens
ctagtagttaaaaa

SEQ ID NO: 2888286 - DNA, 13 bp, Homo sapiens
ctagtatgtcttg

SEQ ID NO: 2888287 - DNA, 15 bp, Homo sapiens
ctagtcaagctcctc

SEQ ID NO: 2888288 - DNA, 16 bp, Homo sapiens
ctagtcaagctcctcc

SEQ ID NO: 2888289 - DNA, 19 bp, Homo sapiens
ctagtcaagctcctcctcc

SEQ ID NO: 2888290 - DNA, 22 bp, Homo sapiens
ctagtcaagctcctcctccctg

SEQ ID NO: 2888291 - DNA, 23 bp, Homo sapiens
ctagtcaagctcctcctccctgc

SEQ ID NO: 2888292 - DNA, 20 bp, Homo sapiens
ctagtcaatcaagtctgttt

SEQ ID NO: 2888293 - DNA, 22 bp, Homo sapiens
ctagtcaccgacagcggccttg

SEQ ID NO: 2888294 - DNA, 18 bp, Homo sapiens
ctagtcagagagagtgtt

SEQ ID NO: 2888295 - DNA, 21 bp, Homo sapiens
ctagtcccccaaagggcctcc

SEQ ID NO: 2888296 - DNA, 14 bp, Homo sapiens
ctagtcgggcaggg

SEQ ID NO: 2888297 - DNA, 16 bp, Homo sapiens
ctagtctcctttgaag

SEQ ID NO: 2888298 - DNA, 17 bp, Homo sapiens
ctagtgaaggcttctct

SEQ ID NO: 2888299 - DNA, 21 bp, Homo sapiens
ctagtgaagtggcctcttgga

SEQ ID NO: 2888300 - DNA, 15 bp, Homo sapiens
ctagtgagtcagcac

SEQ ID NO: 2888301 - DNA, 16 bp, Homo sapiens
ctagtgccccagactg

SEQ ID NO: 2888302 - DNA, 21 bp, Homo sapiens
ctagtgccccagactgagctc

SEQ ID NO: 2888303 - DNA, 15 bp, Homo sapiens
ctagtgccttgccca

SEQ ID NO: 2888304 - DNA, 16 bp, Homo sapiens
ctagtgccttgcccac

SEQ ID NO: 2888305 - DNA, 21 bp, Homo sapiens
ctagtgctttccttttttaaa

SEQ ID NO: 2888306 - DNA, 14 bp, Homo sapiens
ctagtggcttgtcc

SEQ ID NO: 2888307 - DNA, 17 bp, Homo sapiens
ctagtggggtctccctc

SEQ ID NO: 2888308 - DNA, 19 bp, Homo sapiens
ctagtggggtctccctctc

SEQ ID NO: 2888309 - DNA, 22 bp, Homo sapiens
ctagtggggtctccctctcctg

SEQ ID NO: 2888310 - DNA, 20 bp, Homo sapiens
ctagtggggtgaacagctgg

SEQ ID NO: 2888311 - DNA, 23 bp, Homo sapiens
ctagtggggtgaacagctggtgc

SEQ ID NO: 2888312 - DNA, 20 bp, Homo sapiens
ctagtggtgtcatttttgaa

SEQ ID NO: 2888313 - DNA, 21 bp, Homo sapiens
ctagtggtgtcatttttgaat

SEQ ID NO: 2888314 - DNA, 20 bp, Homo sapiens
ctagtgtccgcataagaaaa

SEQ ID NO: 2888315 - DNA, 15 bp, Homo sapiens
ctagttctgccagga

SEQ ID NO: 2888316 - DNA, 16 bp, Homo sapiens
ctagttctgccaggag

SEQ ID NO: 2888317 - DNA, 18 bp, Homo sapiens
ctagttggtgagaaacct

SEQ ID NO: 2888318 - DNA, 13 bp, Homo sapiens
ctagtttcctgcc

SEQ ID NO: 2888319 - DNA, 14 bp, Homo sapiens
ctagtttcctgcct

SEQ ID NO: 2888320 - DNA, 18 bp, Homo sapiens
ctagtttgggaggagcag

SEQ ID NO: 2888321 - DNA, 16 bp, Homo sapiens
ctagtttgtttagtta

SEQ ID NO: 2888322 - DNA, 16 bp, Homo sapiens
ctataaaatgtcttca

SEQ ID NO: 2888323 - DNA, 16 bp, Homo sapiens
ctataaacaattacat

SEQ ID NO: 2888324 - DNA, 19 bp, Homo sapiens
ctataaagctagatgcttt

SEQ ID NO: 2888325 - DNA, 12 bp, Homo sapiens
ctataaagctgt

SEQ ID NO: 2888326 - DNA, 19 bp, Homo sapiens
ctataaagctgttattctt

SEQ ID NO: 2888327 - DNA, 15 bp, Homo sapiens
ctataaatacaaatc

SEQ ID NO: 2888328 - DNA, 16 bp, Homo sapiens
ctataaatacaaatct

SEQ ID NO: 2888329 - DNA, 22 bp, Homo sapiens
ctataaattcctctttgctttg

SEQ ID NO: 2888330 - DNA, 23 bp, Homo sapiens
ctataaattcctctttgctttgc

SEQ ID NO: 2888331 - DNA, 18 bp, Homo sapiens
ctataaatttactctgtt

SEQ ID NO: 2888332 - DNA, 16 bp, Homo sapiens
ctataaattttttgaa

SEQ ID NO: 2888333 - DNA, 19 bp, Homo sapiens
ctataaattttttgaaaca

SEQ ID NO: 2888334 - DNA, 23 bp, Homo sapiens
ctataaattttttgaaacacaat

SEQ ID NO: 2888335 - DNA, 12 bp, Homo sapiens
ctataacaaaaa

SEQ ID NO: 2888336 - DNA, 20 bp, Homo sapiens
ctataacacctgccaccact

SEQ ID NO: 2888337 - DNA, 13 bp, Homo sapiens
ctataacagaaag

SEQ ID NO: 2888338 - DNA, 22 bp, Homo sapiens
ctataacagaaagtttgtaaaa

SEQ ID NO: 2888339 - DNA, 14 bp, Homo sapiens
ctataagaaaaagg

SEQ ID NO: 2888340 - DNA, 15 bp, Homo sapiens
ctataagaaaaagga

SEQ ID NO: 2888341 - DNA, 18 bp, Homo sapiens
ctataatcattagtttta

SEQ ID NO: 2888342 - DNA, 21 bp, Homo sapiens
ctataatcattagttttagag

SEQ ID NO: 2888343 - DNA, 14 bp, Homo sapiens
ctataatcccagct

SEQ ID NO: 2888344 - DNA, 21 bp, Homo sapiens
ctataattctatactgttgat

SEQ ID NO: 2888345 - DNA, 19 bp, Homo sapiens
ctatacgcagcgtgcttta

SEQ ID NO: 2888346 - DNA, 17 bp, Homo sapiens
ctatagaccaaaaggag

SEQ ID NO: 2888347 - DNA, 18 bp, Homo sapiens
ctatagaccaaaaggaga

SEQ ID NO: 2888348 - DNA, 15 bp, Homo sapiens
ctatagcattttgct

SEQ ID NO: 2888349 - DNA, 12 bp, Homo sapiens
ctataggaaagt

SEQ ID NO: 2888350 - DNA, 15 bp, Homo sapiens
ctataggaaagtctg

SEQ ID NO: 2888351 - DNA, 14 bp, Homo sapiens
ctatagtactttat

SEQ ID NO: 2888352 - DNA, 12 bp, Homo sapiens
ctatagtatttg

SEQ ID NO: 2888353 - DNA, 15 bp, Homo sapiens
ctatagtatttgatt

SEQ ID NO: 2888354 - DNA, 14 bp, Homo sapiens
ctatagttctagac

SEQ ID NO: 2888355 - DNA, 13 bp, Homo sapiens
ctatataagacat

SEQ ID NO: 2888356 - DNA, 17 bp, Homo sapiens
ctatatgattaaagaaa

SEQ ID NO: 2888357 - DNA, 15 bp, Homo sapiens
ctatatgcacccctg

SEQ ID NO: 2888358 - DNA, 16 bp, Homo sapiens
ctatatgcacccctgg

SEQ ID NO: 2888359 - DNA, 14 bp, Homo sapiens
ctatatgtacttgt

SEQ ID NO: 2888360 - DNA, 21 bp, Homo sapiens
ctatatgtacttgtcaaagaa

SEQ ID NO: 2888361 - DNA, 18 bp, Homo sapiens
ctatattgattgtccttt

SEQ ID NO: 2888362 - DNA, 19 bp, Homo sapiens
ctatattgatttaaaagtg

SEQ ID NO: 2888363 - DNA, 19 bp, Homo sapiens
ctatattgcccaggctggt

SEQ ID NO: 2888364 - DNA, 20 bp, Homo sapiens
ctatatttgagcactggtct

SEQ ID NO: 2888365 - DNA, 12 bp, Homo sapiens
ctatatttgggc

SEQ ID NO: 2888366 - DNA, 16 bp, Homo sapiens
ctatattttaatagaa

SEQ ID NO: 2888367 - DNA, 19 bp, Homo sapiens
ctatcaacaataaaatttt

SEQ ID NO: 2888368 - DNA, 23 bp, Homo sapiens
cctctggctggctaactggaagc

SEQ ID NO: 2888369 - DNA, 20 bp, Homo sapiens
cctctgggtcagtggtccac

SEQ ID NO: 2888370 - DNA, 17 bp, Homo sapiens
cctctgtcacccagtct

SEQ ID NO: 2888371 - DNA, 15 bp, Homo sapiens
cctctgtccacttgt

SEQ ID NO: 2888372 - DNA, 20 bp, Homo sapiens
cctctgtccaggcactgaga

SEQ ID NO: 2888373 - DNA, 16 bp, Homo sapiens
cctctgtccccacgag

SEQ ID NO: 2888374 - DNA, 18 bp, Homo sapiens
cctctgtccccacgaggg

SEQ ID NO: 2888375 - DNA, 20 bp, Homo sapiens
cctctgtccccacgagggga

SEQ ID NO: 2888376 - DNA, 14 bp, Homo sapiens
cctctgtccccagg

SEQ ID NO: 2888377 - DNA, 23 bp, Homo sapiens
cctctgtccccaggcctggctcc

SEQ ID NO: 2888378 - DNA, 17 bp, Homo sapiens
cctctgtcctagactcc

SEQ ID NO: 2888379 - DNA, 17 bp, Homo sapiens
cctctgtctagcatgcc

SEQ ID NO: 2888380 - DNA, 20 bp, Homo sapiens
cctctgtcttcagcaccctc

SEQ ID NO: 2888381 - DNA, 23 bp, Homo sapiens
cctctgtcttctctatcctctct

SEQ ID NO: 2888382 - DNA, 16 bp, Homo sapiens
cctctgtcttctggac

SEQ ID NO: 2888383 - DNA, 14 bp, Homo sapiens
cctctgtgccttct

SEQ ID NO: 2888384 - DNA, 18 bp, Homo sapiens
cctctgtgtagccgccct

SEQ ID NO: 2888385 - DNA, 19 bp, Homo sapiens
cctctgtgtgctcctcctt

SEQ ID NO: 2888386 - DNA, 23 bp, Homo sapiens
cctcttaaggaaaccactgtaca

SEQ ID NO: 2888387 - DNA, 19 bp, Homo sapiens
cctcttacggtagttagga

SEQ ID NO: 2888388 - DNA, 12 bp, Homo sapiens
cctcttagcctc

SEQ ID NO: 2888389 - DNA, 19 bp, Homo sapiens
cctcttagcctctggatct

SEQ ID NO: 2888390 - DNA, 22 bp, Homo sapiens
cctcttcatctgtgtagctgct

SEQ ID NO: 2888391 - DNA, 16 bp, Homo sapiens
ctaaagtgctgggatt

SEQ ID NO: 2888392 - DNA, 14 bp, Homo sapiens
ctaaagttatattt

SEQ ID NO: 2888393 - DNA, 11 bp, Homo sapiens
ctaaagttcta

SEQ ID NO: 2888394 - DNA, 17 bp, Homo sapiens
ctaaagttctaagattc

SEQ ID NO: 2888395 - DNA, 20 bp, Homo sapiens
ctaaagttctaagattctga

SEQ ID NO: 2888396 - DNA, 17 bp, Homo sapiens
ctaaagttttcttccca

SEQ ID NO: 2888397 - DNA, 18 bp, Homo sapiens
ctaaataagaaaataaca

SEQ ID NO: 2888398 - DNA, 21 bp, Homo sapiens
ctaaataatcttactctagat

SEQ ID NO: 2888399 - DNA, 19 bp, Homo sapiens
ctaaatagatacttttgat

SEQ ID NO: 2888400 - DNA, 18 bp, Homo sapiens
ctaaataggatcctggag

SEQ ID NO: 2888401 - DNA, 23 bp, Homo sapiens
ctaaatatgaatgaatgggatat

SEQ ID NO: 2888402 - DNA, 20 bp, Homo sapiens
ctaaatattatgagatgctg

SEQ ID NO: 2888403 - DNA, 16 bp, Homo sapiens
ctaaatatttcttttt

SEQ ID NO: 2888404 - DNA, 14 bp, Homo sapiens
ctaaatattttcaa

SEQ ID NO: 2888405 - DNA, 19 bp, Homo sapiens
ctaaatattttcaagaaaa

SEQ ID NO: 2888406 - DNA, 13 bp, Homo sapiens
ctaaatgaagtgc

SEQ ID NO: 2888407 - DNA, 15 bp, Homo sapiens
ctaaatgcccagttc

SEQ ID NO: 2888408 - DNA, 18 bp, Homo sapiens
ctaaatgtaacagtctga

SEQ ID NO: 2888409 - DNA, 11 bp, Homo sapiens
ctaaatgtgta

SEQ ID NO: 2888410 - DNA, 13 bp, Homo sapiens
ctaaatgtgtaca

SEQ ID NO: 2888411 - DNA, 12 bp, Homo sapiens
ctaaattgaata

SEQ ID NO: 2888412 - DNA, 15 bp, Homo sapiens
ctaaatttgcatgaa

SEQ ID NO: 2888413 - DNA, 15 bp, Homo sapiens
ctaaattttctgaaa

SEQ ID NO: 2888414 - DNA, 15 bp, Homo sapiens
ctaacatgttatcaa

SEQ ID NO: 2888415 - DNA, 18 bp, Homo sapiens
ctaaccaaagagtctctg

SEQ ID NO: 2888416 - DNA, 19 bp, Homo sapiens
ctaaccaaagagtctctgg

SEQ ID NO: 2888417 - DNA, 21 bp, Homo sapiens
ctaaccaaagagtctctggct

SEQ ID NO: 2888418 - DNA, 17 bp, Homo sapiens
ctaaccacattttagga

SEQ ID NO: 2888419 - DNA, 21 bp, Homo sapiens
ctaacccccagcccacagagc

SEQ ID NO: 2888420 - DNA, 22 bp, Homo sapiens
ctaacccccagcccacagagcc

SEQ ID NO: 2888421 - DNA, 14 bp, Homo sapiens
ctaacccctttcct

SEQ ID NO: 2888422 - DNA, 15 bp, Homo sapiens
ctaaccctctgtcac

SEQ ID NO: 2888423 - DNA, 13 bp, Homo sapiens
ctaacctgacaga

SEQ ID NO: 2888424 - DNA, 19 bp, Homo sapiens
ctaacctgccgagagtcca

SEQ ID NO: 2888425 - DNA, 13 bp, Homo sapiens
ctaacctgtgtct

SEQ ID NO: 2888426 - DNA, 15 bp, Homo sapiens
ctaacgttttttctt

SEQ ID NO: 2888427 - DNA, 18 bp, Homo sapiens
ctaactactgtagaagaa

SEQ ID NO: 2888428 - DNA, 21 bp, Homo sapiens
ctaactagacaccaaagttct

SEQ ID NO: 2888429 - DNA, 19 bp, Homo sapiens
ctaactcagaaacatcagt

SEQ ID NO: 2888430 - DNA, 14 bp, Homo sapiens
ctaactccagtgaa

SEQ ID NO: 2888431 - DNA, 13 bp, Homo sapiens
ctaactccctcct

SEQ ID NO: 2888432 - DNA, 14 bp, Homo sapiens
ctaactccgagagc

SEQ ID NO: 2888433 - DNA, 17 bp, Homo sapiens
ctaactgaactttgaag

SEQ ID NO: 2888434 - DNA, 13 bp, Homo sapiens
ctaactggaagca

SEQ ID NO: 2888435 - DNA, 15 bp, Homo sapiens
ctaactgtaaatcat

SEQ ID NO: 2888436 - DNA, 13 bp, Homo sapiens
ctaactgtatctt

SEQ ID NO: 2888437 - DNA, 18 bp, Homo sapiens
ctaacttaagaaataaat

SEQ ID NO: 2888438 - DNA, 15 bp, Homo sapiens
ctaacttattgcctg

SEQ ID NO: 2888439 - DNA, 17 bp, Homo sapiens
ctaacttcctgtgcctt

SEQ ID NO: 2888440 - DNA, 21 bp, Homo sapiens
ctaacttcctgtgcctttcct

SEQ ID NO: 2888441 - DNA, 19 bp, Homo sapiens
ctaacttttcaatgacatt

SEQ ID NO: 2888442 - DNA, 14 bp, Homo sapiens
ctaagaacctggaa

SEQ ID NO: 2888443 - DNA, 15 bp, Homo sapiens
ctaagaacctggaac

SEQ ID NO: 2888444 - DNA, 17 bp, Homo sapiens
ctaagaattcaaactgg

SEQ ID NO: 2888445 - DNA, 22 bp, Homo sapiens
ctaagaatttcactgtctttta

SEQ ID NO: 2888446 - DNA, 15 bp, Homo sapiens
ctaagactcccgccc

SEQ ID NO: 2888447 - DNA, 22 bp, Homo sapiens
ctaagacttactctaagatctt

SEQ ID NO: 2888448 - DNA, 16 bp, Homo sapiens
ctaagagctagcgctg

SEQ ID NO: 2888449 - DNA, 16 bp, Homo sapiens
ctaagaggtttttcct

SEQ ID NO: 2888450 - DNA, 12 bp, Homo sapiens
ctaagatcttag

SEQ ID NO: 2888451 - DNA, 14 bp, Homo sapiens
ctaagatcttagat

SEQ ID NO: 2888452 - DNA, 12 bp, Homo sapiens
ctaagatgacat

SEQ ID NO: 2888453 - DNA, 18 bp, Homo sapiens
ctaagatgacattgctaa

SEQ ID NO: 2888454 - DNA, 20 bp, Homo sapiens
ctaagatgtgatattctaag

SEQ ID NO: 2888455 - DNA, 11 bp, Homo sapiens
ctaagattcta

SEQ ID NO: 2888456 - DNA, 13 bp, Homo sapiens
ctaagattctaat

SEQ ID NO: 2888457 - DNA, 15 bp, Homo sapiens
ctaagattctaatga

SEQ ID NO: 2888458 - DNA, 15 bp, Homo sapiens
ctaagattctagatc

SEQ ID NO: 2888459 - DNA, 18 bp, Homo sapiens
ctaagattctagatcaga

SEQ ID NO: 2888460 - DNA, 19 bp, Homo sapiens
ctaagattctgattttagg

SEQ ID NO: 2888461 - DNA, 13 bp, Homo sapiens
ctaagcagaggag

SEQ ID NO: 2888462 - DNA, 18 bp, Homo sapiens
ctaagcagaggaggggcc

SEQ ID NO: 2888463 - DNA, 13 bp, Homo sapiens
ctaagcagccagg

SEQ ID NO: 2888464 - DNA, 18 bp, Homo sapiens
ctaagcagccaggaggga

SEQ ID NO: 2888465 - DNA, 17 bp, Homo sapiens
ctaagcagttttgtaaa

SEQ ID NO: 2888466 - DNA, 18 bp, Homo sapiens
ctaagcagttttgtaaat

SEQ ID NO: 2888467 - DNA, 13 bp, Homo sapiens
ctaagcatctaag

SEQ ID NO: 2888468 - DNA, 15 bp, Homo sapiens
ctaagccaagctgtg

SEQ ID NO: 2888469 - DNA, 16 bp, Homo sapiens
ctaagccaagctgtgt

SEQ ID NO: 2888470 - DNA, 15 bp, Homo sapiens
ctaagccaggaggct

SEQ ID NO: 2888471 - DNA, 16 bp, Homo sapiens
ctaagcccatgggaca

SEQ ID NO: 2888472 - DNA, 17 bp, Homo sapiens
ctaagcctgaaggggcg

SEQ ID NO: 2888473 - DNA, 20 bp, Homo sapiens
ctaagcctgaaggggcgtct

SEQ ID NO: 2888474 - DNA, 13 bp, Homo sapiens
ctaagcctgtggc

SEQ ID NO: 2888475 - DNA, 15 bp, Homo sapiens
ctaagcctgtggctg

SEQ ID NO: 2888476 - DNA, 22 bp, Homo sapiens
ctaagcgcacattcatgtgggc

SEQ ID NO: 2888477 - DNA, 21 bp, Homo sapiens
ctaagcttcactgtaaaataa

SEQ ID NO: 2888478 - DNA, 18 bp, Homo sapiens
ctaaggaagtatcagcac

SEQ ID NO: 2888479 - DNA, 19 bp, Homo sapiens
ctaaggacatttcccaggg

SEQ ID NO: 2888480 - DNA, 20 bp, Homo sapiens
ctaaggacctgaaattccaa

SEQ ID NO: 2888481 - DNA, 14 bp, Homo sapiens
ctaaggactttttc

SEQ ID NO: 2888482 - DNA, 20 bp, Homo sapiens
ctaaggagcgctagtgcctt

SEQ ID NO: 2888483 - DNA, 21 bp, Homo sapiens
ctaaggaggggaaaaaaatgt

SEQ ID NO: 2888484 - DNA, 23 bp, Homo sapiens
ctaaggaggggaaaaaaatgttg

SEQ ID NO: 2888485 - DNA, 14 bp, Homo sapiens
ctaaggagttaaat

SEQ ID NO: 2888486 - DNA, 20 bp, Homo sapiens
ctaaggcatgtgtgaaacat

SEQ ID NO: 2888487 - DNA, 12 bp, Homo sapiens
ctaaggccactg

SEQ ID NO: 2888488 - DNA, 23 bp, Homo sapiens
ctaaggccactgttttaaaagat

SEQ ID NO: 2888489 - DNA, 19 bp, Homo sapiens
ctaaggcctaggattctaa

SEQ ID NO: 2888490 - DNA, 14 bp, Homo sapiens
ctaaggctctgaga

SEQ ID NO: 2888491 - DNA, 15 bp, Homo sapiens
ctaaggctctgagag

SEQ ID NO: 2888492 - DNA, 23 bp, Homo sapiens
ctaaggctctgagagtctagatt

SEQ ID NO: 2888493 - DNA, 15 bp, Homo sapiens
ctaaggctgtttgct

SEQ ID NO: 2888494 - DNA, 22 bp, Homo sapiens
ctaagggtagaaaactccaggg

SEQ ID NO: 2888495 - DNA, 21 bp, Homo sapiens
ctaagggtcgaaagctctaga

SEQ ID NO: 2888496 - DNA, 23 bp, Homo sapiens
ctaagggtcgaaagctctagaat

SEQ ID NO: 2888497 - DNA, 11 bp, Homo sapiens
ctaaggttcta

SEQ ID NO: 2888498 - DNA, 15 bp, Homo sapiens
ctaagtaagtgtctg

SEQ ID NO: 2888499 - DNA, 23 bp, Homo sapiens
ctaagtcgttgagggaatgacac

SEQ ID NO: 2888500 - DNA, 17 bp, Homo sapiens
ctaagttaatttaaagt

SEQ ID NO: 2888501 - DNA, 14 bp, Homo sapiens
ctaagttattgtta

SEQ ID NO: 2888502 - DNA, 17 bp, Homo sapiens
ctaagttattttatgac

SEQ ID NO: 2888503 - DNA, 14 bp, Homo sapiens
ctaagtttcctttt

SEQ ID NO: 2888504 - DNA, 15 bp, Homo sapiens
ctaagtttcctttta

SEQ ID NO: 2888505 - DNA, 15 bp, Homo sapiens
ctcggggtccagtgc

SEQ ID NO: 2888506 - DNA, 17 bp, Homo sapiens
ctcggggtccagtgcat

SEQ ID NO: 2888507 - DNA, 13 bp, Homo sapiens
ctcggtgctccat

SEQ ID NO: 2888508 - DNA, 22 bp, Homo sapiens
ctcggttaagtacccgaggcct

SEQ ID NO: 2888509 - DNA, 23 bp, Homo sapiens
ctcggttaagtacccgaggcctc

SEQ ID NO: 2888510 - DNA, 14 bp, Homo sapiens
ctcgtatagcatgc

SEQ ID NO: 2888511 - DNA, 22 bp, Homo sapiens
ctcgtcctccccctgccagtgc

SEQ ID NO: 2888512 - DNA, 16 bp, Homo sapiens
ctcgtcttcagctgca

SEQ ID NO: 2888513 - DNA, 17 bp, Homo sapiens
ctcgtcttcagctgcat

SEQ ID NO: 2888514 - DNA, 15 bp, Homo sapiens
ctcgtgccagcagcc

SEQ ID NO: 2888515 - DNA, 18 bp, Homo sapiens
ctcgtgccagcagcctcg

SEQ ID NO: 2888516 - DNA, 15 bp, Homo sapiens
ctcgtgtctggcaca

SEQ ID NO: 2888517 - DNA, 21 bp, Homo sapiens
ctcgttgccctaattcatctt

SEQ ID NO: 2888518 - DNA, 22 bp, Homo sapiens
ctcgttgccctaattcatcttt

SEQ ID NO: 2888519 - DNA, 19 bp, Homo sapiens
ctcgtttcaaaaacacagt

SEQ ID NO: 2888520 - DNA, 17 bp, Homo sapiens
ctcgtttgatagtgctt

SEQ ID NO: 2888521 - DNA, 12 bp, Homo sapiens
ctcgtttgtgat

SEQ ID NO: 2888522 - DNA, 19 bp, Homo sapiens
ctctaaaaagaagccacag

SEQ ID NO: 2888523 - DNA, 18 bp, Homo sapiens
ctctaaaacatagactga

SEQ ID NO: 2888524 - DNA, 23 bp, Homo sapiens
ctctaaaacatagactgaagatt

SEQ ID NO: 2888525 - DNA, 19 bp, Homo sapiens
ctctaaacccacatattga

SEQ ID NO: 2888526 - DNA, 13 bp, Homo sapiens
ctctaacccagtg

SEQ ID NO: 2888527 - DNA, 18 bp, Homo sapiens
ctctaactccctcctcac

SEQ ID NO: 2888528 - DNA, 14 bp, Homo sapiens
ctctaagatcttag

SEQ ID NO: 2888529 - DNA, 16 bp, Homo sapiens
ctctaagcagccagga

SEQ ID NO: 2888530 - DNA, 15 bp, Homo sapiens
ctctaatacattcca

SEQ ID NO: 2888531 - DNA, 16 bp, Homo sapiens
ctctaatgccaagtta

SEQ ID NO: 2888532 - DNA, 15 bp, Homo sapiens
ctctacacaacatgt

SEQ ID NO: 2888533 - DNA, 16 bp, Homo sapiens
ctctacacaacatgta

SEQ ID NO: 2888534 - DNA, 22 bp, Homo sapiens
ctctacagagcttccctgactc

SEQ ID NO: 2888535 - DNA, 20 bp, Homo sapiens
ctctaccagataactgagga

SEQ ID NO: 2888536 - DNA, 16 bp, Homo sapiens
ctctctgggcctcaga

SEQ ID NO: 2888537 - DNA, 20 bp, Homo sapiens
ctctctgggcctcagaggcc

SEQ ID NO: 2888538 - DNA, 19 bp, Homo sapiens
ctctctggtcttttttccc

SEQ ID NO: 2888539 - DNA, 17 bp, Homo sapiens
ctctctgtattttttct

SEQ ID NO: 2888540 - DNA, 18 bp, Homo sapiens
ctctctgtcccttgctgt

SEQ ID NO: 2888541 - DNA, 23 bp, Homo sapiens
ctctctgtcccttgctgtatgct

SEQ ID NO: 2888542 - DNA, 16 bp, Homo sapiens
ctctctgtcttctctc

SEQ ID NO: 2888543 - DNA, 21 bp, Homo sapiens
ctctctgtctttttccttcct

SEQ ID NO: 2888544 - DNA, 15 bp, Homo sapiens
ctctctgtggggctg

SEQ ID NO: 2888545 - DNA, 23 bp, Homo sapiens
ctctctgtggggctgaattgcca

SEQ ID NO: 2888546 - DNA, 14 bp, Homo sapiens
ctctcttcactgct

SEQ ID NO: 2888547 - DNA, 12 bp, Homo sapiens
ctctcttccctt

SEQ ID NO: 2888548 - DNA, 16 bp, Homo sapiens
ctctcttccgggagct

SEQ ID NO: 2888549 - DNA, 23 bp, Homo sapiens
ctctcttggaattagatgtttat

SEQ ID NO: 2888550 - DNA, 14 bp, Homo sapiens
ctctcttgtcacat

SEQ ID NO: 2888551 - DNA, 15 bp, Homo sapiens
ctctcttgtcacatg

SEQ ID NO: 2888552 - DNA, 17 bp, Homo sapiens
ctctcttgtcacatgga

SEQ ID NO: 2888553 - DNA, 20 bp, Homo sapiens
ctctcttgtgacgtgcactg

SEQ ID NO: 2888554 - DNA, 21 bp, Homo sapiens
ctctcttgtgacgtgcactgt

SEQ ID NO: 2888555 - DNA, 22 bp, Homo sapiens
ctctcttgtgacgtgcactgtg

SEQ ID NO: 2888556 - DNA, 11 bp, Homo sapiens
ctctctttctc

SEQ ID NO: 2888557 - DNA, 16 bp, Homo sapiens
ctctcttttcctctct

SEQ ID NO: 2888558 - DNA, 18 bp, Homo sapiens
ctctcttttcctctctgt

SEQ ID NO: 2888559 - DNA, 20 bp, Homo sapiens
ctctcttttcctctctgtct

SEQ ID NO: 2888560 - DNA, 9 bp, Homo sapiens
ctctgaaac

SEQ ID NO: 2888561 - DNA, 15 bp, Homo sapiens
ctctgaaacagctgc

SEQ ID NO: 2888562 - DNA, 16 bp, Homo sapiens
ctctgaaacagctgcc

SEQ ID NO: 2888563 - DNA, 20 bp, Homo sapiens
ctctgaaacagctgccttag

SEQ ID NO: 2888564 - DNA, 13 bp, Homo sapiens
ctctgaagagtgg

SEQ ID NO: 2888565 - DNA, 23 bp, Homo sapiens
ctctgaagagtgggtttcacaag

SEQ ID NO: 2888566 - DNA, 23 bp, Homo sapiens
ctctgaagggcatcatgcatctt

SEQ ID NO: 2888567 - DNA, 15 bp, Homo sapiens
ctctgacaaagccca

SEQ ID NO: 2888568 - DNA, 17 bp, Homo sapiens
ctctgacagcagcctgt

SEQ ID NO: 2888569 - DNA, 18 bp, Homo sapiens
ctctgacagcagcctgtg

SEQ ID NO: 2888570 - DNA, 20 bp, Homo sapiens
ctctgacagcagcctgtgag

SEQ ID NO: 2888571 - DNA, 23 bp, Homo sapiens
ctctgacattatgtggttttaga

SEQ ID NO: 2888572 - DNA, 21 bp, Homo sapiens
ctctgacccacagcctccaag

SEQ ID NO: 2888573 - DNA, 12 bp, Homo sapiens
ctctgaccctgg

SEQ ID NO: 2888574 - DNA, 14 bp, Homo sapiens
ctctgaccctgggc

SEQ ID NO: 2888575 - DNA, 19 bp, Homo sapiens
ctctgaccgaaacagcgct

SEQ ID NO: 2888576 - DNA, 22 bp, Homo sapiens
ctctgaccgaaacagcgctggg

SEQ ID NO: 2888577 - DNA, 20 bp, Homo sapiens
ctctgactcagggctcctgg

SEQ ID NO: 2888578 - DNA, 13 bp, Homo sapiens
ctctgagagtcta

SEQ ID NO: 2888579 - DNA, 16 bp, Homo sapiens
ctctgagagtctagat

SEQ ID NO: 2888580 - DNA, 17 bp, Homo sapiens
ctctgagagtctagatt

SEQ ID NO: 2888581 - DNA, 17 bp, Homo sapiens
ctctgaggactgcacca

SEQ ID NO: 2888582 - DNA, 14 bp, Homo sapiens
ctctgaggcctcac

SEQ ID NO: 2888583 - DNA, 15 bp, Homo sapiens
ctctgaggcctcact

SEQ ID NO: 2888584 - DNA, 19 bp, Homo sapiens
ctctgagtacattgtgccc

SEQ ID NO: 2888585 - DNA, 15 bp, Homo sapiens
ctctgagtcctggcc

SEQ ID NO: 2888586 - DNA, 17 bp, Homo sapiens
ctctgagtgtctctgcc

SEQ ID NO: 2888587 - DNA, 19 bp, Homo sapiens
ctctgagtgtctctgcctg

SEQ ID NO: 2888588 - DNA, 21 bp, Homo sapiens
ctctgagtgtctctgcctgga

SEQ ID NO: 2888589 - DNA, 21 bp, Homo sapiens
ctctgatccctctacagagct

SEQ ID NO: 2888590 - DNA, 22 bp, Homo sapiens
ctctgatccctctacagagctt

SEQ ID NO: 2888591 - DNA, 15 bp, Homo sapiens
ctctgcacatgtctt

SEQ ID NO: 2888592 - DNA, 16 bp, Homo sapiens
ctctgcacccagaaca

SEQ ID NO: 2888593 - DNA, 17 bp, Homo sapiens
ctctgcagacttcccag

SEQ ID NO: 2888594 - DNA, 16 bp, Homo sapiens
ctctgcagccagccca

SEQ ID NO: 2888595 - DNA, 19 bp, Homo sapiens
ctctgcaggcttaataaaa

SEQ ID NO: 2888596 - DNA, 23 bp, Homo sapiens
ctctgcaggcttaataaaaatga

SEQ ID NO: 2888597 - DNA, 16 bp, Homo sapiens
ctctgcatttttctgc

SEQ ID NO: 2888598 - DNA, 21 bp, Homo sapiens
ctctgccccatcctccagcag

SEQ ID NO: 2888599 - DNA, 20 bp, Homo sapiens
ctctgcccgggagctcagga

SEQ ID NO: 2888600 - DNA, 12 bp, Homo sapiens
ctctgccctctg

SEQ ID NO: 2888601 - DNA, 13 bp, Homo sapiens
ctctgccctctgc

SEQ ID NO: 2888602 - DNA, 16 bp, Homo sapiens
ctctgccctctgctgc

SEQ ID NO: 2888603 - DNA, 17 bp, Homo sapiens
ctctgccctctgctgct

SEQ ID NO: 2888604 - DNA, 15 bp, Homo sapiens
ctctgccgctacctc

SEQ ID NO: 2888605 - DNA, 19 bp, Homo sapiens
ctctgccgctacctccctc

SEQ ID NO: 2888606 - DNA, 15 bp, Homo sapiens
ctctgccgtctctgg

SEQ ID NO: 2888607 - DNA, 16 bp, Homo sapiens
ctctgccgtctctgga

SEQ ID NO: 2888608 - DNA, 18 bp, Homo sapiens
ctctgccgtctctggagc

SEQ ID NO: 2888609 - DNA, 14 bp, Homo sapiens
ctctgcctcatcct

SEQ ID NO: 2888610 - DNA, 16 bp, Homo sapiens
ctctgcctcccaggtt

SEQ ID NO: 2888611 - DNA, 14 bp, Homo sapiens
ctctgcctcctccc

SEQ ID NO: 2888612 - DNA, 16 bp, Homo sapiens
ctctgcctcctcccca

SEQ ID NO: 2888613 - DNA, 14 bp, Homo sapiens
ctctgcctgcactc

SEQ ID NO: 2888614 - DNA, 13 bp, Homo sapiens
ctctgcctgctgg

SEQ ID NO: 2888615 - DNA, 10 bp, Homo sapiens
ctctgcctgg

SEQ ID NO: 2888616 - DNA, 13 bp, Homo sapiens
ctctgcctgggac

SEQ ID NO: 2888617 - DNA, 20 bp, Homo sapiens
ctctgccttcgaggtcagag

SEQ ID NO: 2888618 - DNA, 15 bp, Homo sapiens
ctctgccttgccttt

SEQ ID NO: 2888619 - DNA, 15 bp, Homo sapiens
ctctgcctttgagtg

SEQ ID NO: 2888620 - DNA, 21 bp, Homo sapiens
ctctgcctttgagtgtgggac

SEQ ID NO: 2888621 - DNA, 14 bp, Homo sapiens
ctctgcgccaggca

SEQ ID NO: 2888622 - DNA, 15 bp, Homo sapiens
ctctgcgccaggcag

SEQ ID NO: 2888623 - DNA, 18 bp, Homo sapiens
ctctgcgccaggcagagc

SEQ ID NO: 2888624 - DNA, 18 bp, Homo sapiens
ctctgcggatagcatttg

SEQ ID NO: 2888625 - DNA, 15 bp, Homo sapiens
ctctgctcacagaag

SEQ ID NO: 2888626 - DNA, 14 bp, Homo sapiens
ctctgctccacctt

SEQ ID NO: 2888627 - DNA, 18 bp, Homo sapiens
ctctgctccacctttcag

SEQ ID NO: 2888628 - DNA, 13 bp, Homo sapiens
ctctgctccagca

SEQ ID NO: 2888629 - DNA, 13 bp, Homo sapiens
ctctgctcgcctt

SEQ ID NO: 2888630 - DNA, 15 bp, Homo sapiens
ctctgctcgccttag

SEQ ID NO: 2888631 - DNA, 13 bp, Homo sapiens
ctctgctctgcgt

SEQ ID NO: 2888632 - DNA, 14 bp, Homo sapiens
ctctgctgctgccc

SEQ ID NO: 2888633 - DNA, 14 bp, Homo sapiens
ctctgctggccgga

SEQ ID NO: 2888634 - DNA, 13 bp, Homo sapiens
ctctgctggtctc

SEQ ID NO: 2888635 - DNA, 16 bp, Homo sapiens
ctctgctggtctctgg

SEQ ID NO: 2888636 - DNA, 17 bp, Homo sapiens
ctctgctggtctctggc

SEQ ID NO: 2888637 - DNA, 19 bp, Homo sapiens
ctctgctggtctctggctc

SEQ ID NO: 2888638 - DNA, 20 bp, Homo sapiens
ctctgctggtctctggctct

SEQ ID NO: 2888639 - DNA, 21 bp, Homo sapiens
ctctgcttaccgttcaagagg

SEQ ID NO: 2888640 - DNA, 22 bp, Homo sapiens
ctctgcttctcggggtccagtg

SEQ ID NO: 2888641 - DNA, 18 bp, Homo sapiens
ctctgctttctgatgttg

SEQ ID NO: 2888642 - DNA, 14 bp, Homo sapiens
ctctggaaagaaac

SEQ ID NO: 2888643 - DNA, 18 bp, Homo sapiens
ctctggacctctcttgtg

SEQ ID NO: 2888644 - DNA, 17 bp, Homo sapiens
ctctggacgtgaaatac

SEQ ID NO: 2888645 - DNA, 12 bp, Homo sapiens
ctctggagcccc

SEQ ID NO: 2888646 - DNA, 13 bp, Homo sapiens
ctctggagcccct

SEQ ID NO: 2888647 - DNA, 15 bp, Homo sapiens
ctctggagcccctcc

SEQ ID NO: 2888648 - DNA, 21 bp, Homo sapiens
ctctggagtgcccccagccca

SEQ ID NO: 2888649 - DNA, 12 bp, Homo sapiens
ctctggagtggc

SEQ ID NO: 2888650 - DNA, 16 bp, Homo sapiens
ctctggagtggccact

SEQ ID NO: 2888651 - DNA, 22 bp, Homo sapiens
ctctggatctagaagggaccat

SEQ ID NO: 2888652 - DNA, 20 bp, Homo sapiens
ctccctgcatctgaccagca

SEQ ID NO: 2888653 - DNA, 23 bp, Homo sapiens
ctccctgcatctgaccagcagcg

SEQ ID NO: 2888654 - DNA, 18 bp, Homo sapiens
ctccctgccatccccctc

SEQ ID NO: 2888655 - DNA, 19 bp, Homo sapiens
ctccctgccgcctcaatgt

SEQ ID NO: 2888656 - DNA, 10 bp, Homo sapiens
ctccctgcct

SEQ ID NO: 2888657 - DNA, 20 bp, Homo sapiens
ctccctgcctcacatctccc

SEQ ID NO: 2888658 - DNA, 20 bp, Homo sapiens
ctccctgcctccacccacag

SEQ ID NO: 2888659 - DNA, 14 bp, Homo sapiens
ctccctgcctccag

SEQ ID NO: 2888660 - DNA, 15 bp, Homo sapiens
ctccctgcgcttcct

SEQ ID NO: 2888661 - DNA, 18 bp, Homo sapiens
ctccctggccttgcccgt

SEQ ID NO: 2888662 - DNA, 18 bp, Homo sapiens
ctccctggctgcagcctc

SEQ ID NO: 2888663 - DNA, 12 bp, Homo sapiens
ctccctgggcct

SEQ ID NO: 2888664 - DNA, 13 bp, Homo sapiens
ctccctgtcctcc

SEQ ID NO: 2888665 - DNA, 16 bp, Homo sapiens
ctccctgtcctcctcg

SEQ ID NO: 2888666 - DNA, 16 bp, Homo sapiens
ctccctgttccccaga

SEQ ID NO: 2888667 - DNA, 15 bp, Homo sapiens
ctcccttacccatct

SEQ ID NO: 2888668 - DNA, 23 bp, Homo sapiens
ctcccttacccatcttgcttcca

SEQ ID NO: 2888669 - DNA, 14 bp, Homo sapiens
ctcccttcccagtg

SEQ ID NO: 2888670 - DNA, 16 bp, Homo sapiens
ctcccttcccagtggg

SEQ ID NO: 2888671 - DNA, 15 bp, Homo sapiens
ctcccttcccttccc

SEQ ID NO: 2888672 - DNA, 16 bp, Homo sapiens
ctcccttcgctctgct

SEQ ID NO: 2888673 - DNA, 15 bp, Homo sapiens
ctcccttctgctact

SEQ ID NO: 2888674 - DNA, 20 bp, Homo sapiens
ctcccttgagtaggccctgc

SEQ ID NO: 2888675 - DNA, 18 bp, Homo sapiens
ctcccttgggctccctgt

SEQ ID NO: 2888676 - DNA, 16 bp, Homo sapiens
ctcccttgtgttcctt

SEQ ID NO: 2888677 - DNA, 22 bp, Homo sapiens
ctcccttgtgttccttctgtga

SEQ ID NO: 2888678 - DNA, 16 bp, Homo sapiens
ctccgacctctctcag

SEQ ID NO: 2888679 - DNA, 14 bp, Homo sapiens
ctccgagagcagtg

SEQ ID NO: 2888680 - DNA, 17 bp, Homo sapiens
ctccgaggactggactg

SEQ ID NO: 2888681 - DNA, 14 bp, Homo sapiens
ctccgatgcctggc

SEQ ID NO: 2888682 - DNA, 21 bp, Homo sapiens
ctccgatgcctggcctgccag

SEQ ID NO: 2888683 - DNA, 22 bp, Homo sapiens
ctccgcacacctctggctgtct

SEQ ID NO: 2888684 - DNA, 15 bp, Homo sapiens
ctccgcacctgaccg

SEQ ID NO: 2888685 - DNA, 22 bp, Homo sapiens
ctccgcacctgaccgctgccca

SEQ ID NO: 2888686 - DNA, 23 bp, Homo sapiens
ctccgcacctgaccgctgcccag

SEQ ID NO: 2888687 - DNA, 14 bp, Homo sapiens
ctccgcctactgtc

SEQ ID NO: 2888688 - DNA, 17 bp, Homo sapiens
ctccgcctactgtccct

SEQ ID NO: 2888689 - DNA, 14 bp, Homo sapiens
ctccgcctccacac

SEQ ID NO: 2888690 - DNA, 14 bp, Homo sapiens
ctccgctgcctgga

SEQ ID NO: 2888691 - DNA, 17 bp, Homo sapiens
ctccgcttatcctgcta

SEQ ID NO: 2888692 - DNA, 21 bp, Homo sapiens
ctccggccctcctaccctgcg

SEQ ID NO: 2888693 - DNA, 15 bp, Homo sapiens
ctccgggcaggggag

SEQ ID NO: 2888694 - DNA, 19 bp, Homo sapiens
ctccgtccctctgtccact

SEQ ID NO: 2888695 - DNA, 13 bp, Homo sapiens
ctccgtctctgtc

SEQ ID NO: 2888696 - DNA, 22 bp, Homo sapiens
ctccgtcttagaagtggaccag

SEQ ID NO: 2888697 - DNA, 17 bp, Homo sapiens
ctccgtgaggctgctgc

SEQ ID NO: 2888698 - DNA, 18 bp, Homo sapiens
ctccgtgaggctgctgcc

SEQ ID NO: 2888699 - DNA, 21 bp, Homo sapiens
ctccgtgaggctgctgccatc

SEQ ID NO: 2888700 - DNA, 17 bp, Homo sapiens
ctccgtggactgcagtc

SEQ ID NO: 2888701 - DNA, 22 bp, Homo sapiens
ctccgtggccccgccctcaggc

SEQ ID NO: 2888702 - DNA, 21 bp, Homo sapiens
ctcctaaagctgaatcccggc

SEQ ID NO: 2888703 - DNA, 19 bp, Homo sapiens
ctcctaatcaagagtctct

SEQ ID NO: 2888704 - DNA, 23 bp, Homo sapiens
ctcctaatcaagagtctctccag

SEQ ID NO: 2888705 - DNA, 15 bp, Homo sapiens
ctcctaatgctctga

SEQ ID NO: 2888706 - DNA, 21 bp, Homo sapiens
ctcctacctcagcctcctggg

SEQ ID NO: 2888707 - DNA, 18 bp, Homo sapiens
ctcctactctgtgtaaat

SEQ ID NO: 2888708 - DNA, 18 bp, Homo sapiens
ctcctagagggaggggcc

SEQ ID NO: 2888709 - DNA, 23 bp, Homo sapiens
ctcctagagggaggggcctaggc

SEQ ID NO: 2888710 - DNA, 16 bp, Homo sapiens
ctcctagccacccacc

SEQ ID NO: 2888711 - DNA, 20 bp, Homo sapiens
ctcctaggcccttggggtgg

SEQ ID NO: 2888712 - DNA, 22 bp, Homo sapiens
ctcctaggggcttggtcctagg

SEQ ID NO: 2888713 - DNA, 14 bp, Homo sapiens
ctcctatatatttc

SEQ ID NO: 2888714 - DNA, 18 bp, Homo sapiens
ctcctatatatttctatt

SEQ ID NO: 2888715 - DNA, 19 bp, Homo sapiens
ctcctcacaccccagcacc

SEQ ID NO: 2888716 - DNA, 15 bp, Homo sapiens
ctcctcaccccgtct

SEQ ID NO: 2888717 - DNA, 15 bp, Homo sapiens
ctcctcactccctag

SEQ ID NO: 2888718 - DNA, 21 bp, Homo sapiens
ctcctcactcccttcccataa

SEQ ID NO: 2888719 - DNA, 21 bp, Homo sapiens
ctcctcaggcacacagctact

SEQ ID NO: 2888720 - DNA, 16 bp, Homo sapiens
ctcctcattcagacca

SEQ ID NO: 2888721 - DNA, 21 bp, Homo sapiens
ctcctccaccaccgcccgtct

SEQ ID NO: 2888722 - DNA, 13 bp, Homo sapiens
ctcctccagggcc

SEQ ID NO: 2888723 - DNA, 13 bp, Homo sapiens
ctcctccagggtg

SEQ ID NO: 2888724 - DNA, 15 bp, Homo sapiens
ctcctccatgggaga

SEQ ID NO: 2888725 - DNA, 18 bp, Homo sapiens
ctcctccatgggagaaaa

SEQ ID NO: 2888726 - DNA, 13 bp, Homo sapiens
ctcctcccagtgc

SEQ ID NO: 2888727 - DNA, 14 bp, Homo sapiens
ctcctcccagtgcc

SEQ ID NO: 2888728 - DNA, 18 bp, Homo sapiens
ctcctccccaccctcctg

SEQ ID NO: 2888729 - DNA, 19 bp, Homo sapiens
ctcctccccaccctcctgg

SEQ ID NO: 2888730 - DNA, 22 bp, Homo sapiens
ctcctccccgctccgtctctgt

SEQ ID NO: 2888731 - DNA, 15 bp, Homo sapiens
ctcctcccctactct

SEQ ID NO: 2888732 - DNA, 14 bp, Homo sapiens
ctcctcccctgccg

SEQ ID NO: 2888733 - DNA, 18 bp, Homo sapiens
ctcctcccctgccgcctc

SEQ ID NO: 2888734 - DNA, 10 bp, Homo sapiens
ctcctccctc

SEQ ID NO: 2888735 - DNA, 16 bp, Homo sapiens
ctcctccctctgcctc

SEQ ID NO: 2888736 - DNA, 17 bp, Homo sapiens
ctcctccctctgcctca

SEQ ID NO: 2888737 - DNA, 23 bp, Homo sapiens
ctcctccctgcatctgaccagca

SEQ ID NO: 2888738 - DNA, 19 bp, Homo sapiens
ctcctccctgttattttca

SEQ ID NO: 2888739 - DNA, 14 bp, Homo sapiens
ctcctccgtggcac

SEQ ID NO: 2888740 - DNA, 12 bp, Homo sapiens
ctcctcctagcc

SEQ ID NO: 2888741 - DNA, 13 bp, Homo sapiens
ctcctcctccctg

SEQ ID NO: 2888742 - DNA, 15 bp, Homo sapiens
ctcctcctcctccct

SEQ ID NO: 2888743 - DNA, 17 bp, Homo sapiens
ctcctcctgccagctct

SEQ ID NO: 2888744 - DNA, 17 bp, Homo sapiens
ctcctcgagatcccaac

SEQ ID NO: 2888745 - DNA, 21 bp, Homo sapiens
ctcctcgagatcccaacactg

SEQ ID NO: 2888746 - DNA, 15 bp, Homo sapiens
ctcctcgcaagctgg

SEQ ID NO: 2888747 - DNA, 16 bp, Homo sapiens
ctcctcgcaagctggg

SEQ ID NO: 2888748 - DNA, 19 bp, Homo sapiens
ctcctcgttggttcatgtg

SEQ ID NO: 2888749 - DNA, 15 bp, Homo sapiens
ctcctctacctctct

SEQ ID NO: 2888750 - DNA, 14 bp, Homo sapiens
ctcctctatttctt

SEQ ID NO: 2888751 - DNA, 19 bp, Homo sapiens
ctcctctcaactgcctcag

SEQ ID NO: 2888752 - DNA, 14 bp, Homo sapiens
ctcctctcagcttc

SEQ ID NO: 2888753 - DNA, 13 bp, Homo sapiens
ctcctctcagtac

SEQ ID NO: 2888754 - DNA, 14 bp, Homo sapiens
ctcctctcagtgtt

SEQ ID NO: 2888755 - DNA, 14 bp, Homo sapiens
ctcctctccatgca

SEQ ID NO: 2888756 - DNA, 15 bp, Homo sapiens
ctcctctccatgcaa

SEQ ID NO: 2888757 - DNA, 23 bp, Homo sapiens
ctcctctccccagcccagagaca

SEQ ID NO: 2888758 - DNA, 14 bp, Homo sapiens
ctcctctctccctg

SEQ ID NO: 2888759 - DNA, 17 bp, Homo sapiens
ctcctctctccctgcct

SEQ ID NO: 2888760 - DNA, 15 bp, Homo sapiens
ctcctctgaaacagc

SEQ ID NO: 2888761 - DNA, 17 bp, Homo sapiens
ctcctctgaaacagctg

SEQ ID NO: 2888762 - DNA, 19 bp, Homo sapiens
ctcctctgaaacagctgcc

SEQ ID NO: 2888763 - DNA, 21 bp, Homo sapiens
ctcctctgaaacagctgcctt

SEQ ID NO: 2888764 - DNA, 22 bp, Homo sapiens
ctcctctgaaacagctgcctta

SEQ ID NO: 2888765 - DNA, 23 bp, Homo sapiens
ctcctctgaaacagctgccttag

SEQ ID NO: 2888766 - DNA, 20 bp, Homo sapiens
ctcctctgactcagggctcc

SEQ ID NO: 2888767 - DNA, 16 bp, Homo sapiens
ctcctctgccacctcc

SEQ ID NO: 2888768 - DNA, 22 bp, Homo sapiens
ctcctctgcccgggagctcagg

SEQ ID NO: 2888769 - DNA, 12 bp, Homo sapiens
ctcctctgtgaa

SEQ ID NO: 2888770 - DNA, 18 bp, Homo sapiens
ctcctctgtgaagcattc

SEQ ID NO: 2888771 - DNA, 13 bp, Homo sapiens
ctcctcttgtaaa

SEQ ID NO: 2888772 - DNA, 20 bp, Homo sapiens
ctcctcttgtaaataaagcc

SEQ ID NO: 2888773 - DNA, 21 bp, Homo sapiens
ctcctcttgtaaataaagccc

SEQ ID NO: 2888774 - DNA, 21 bp, Homo sapiens
ctcctgaaatgccaagtgcct

SEQ ID NO: 2888775 - DNA, 16 bp, Homo sapiens
ctcctgaagggaaggc

SEQ ID NO: 2888776 - DNA, 23 bp, Homo sapiens
ctcctgaagggaaggcaaaggca

SEQ ID NO: 2888777 - DNA, 15 bp, Homo sapiens
ctcctgacctcaagt

SEQ ID NO: 2888778 - DNA, 18 bp, Homo sapiens
ctcctgacctcaagtgat

SEQ ID NO: 2888779 - DNA, 18 bp, Homo sapiens
ctcctgacctcatgatcc

SEQ ID NO: 2888780 - DNA, 21 bp, Homo sapiens
ctcctgacttcaggtgatcca

SEQ ID NO: 2888781 - DNA, 20 bp, Homo sapiens
ctcctgagaaaaaaggttcc

SEQ ID NO: 2888782 - DNA, 13 bp, Homo sapiens
ctcctgagctagg

SEQ ID NO: 2888783 - DNA, 14 bp, Homo sapiens
ctcctgaggacagc

SEQ ID NO: 2888784 - DNA, 17 bp, Homo sapiens
ctcctgaggacagctgt

SEQ ID NO: 2888785 - DNA, 19 bp, Homo sapiens
ctcctgagttcaagcgatt

SEQ ID NO: 2888786 - DNA, 20 bp, Homo sapiens
ctcctgatttgagtttcctt

SEQ ID NO: 2888787 - DNA, 14 bp, Homo sapiens
ctcctgccaaggag

SEQ ID NO: 2888788 - DNA, 12 bp, Homo sapiens
ctcctgccagcc

SEQ ID NO: 2888789 - DNA, 15 bp, Homo sapiens
ctccatttctttctt

SEQ ID NO: 2888790 - DNA, 17 bp, Homo sapiens
ctccatttctttcttcc

SEQ ID NO: 2888791 - DNA, 20 bp, Homo sapiens
ctccatttgtcatcgttccc

SEQ ID NO: 2888792 - DNA, 23 bp, Homo sapiens
ctccatttgtcatcgttccccac

SEQ ID NO: 2888793 - DNA, 22 bp, Homo sapiens
ctcccaaagtgctgagattaca

SEQ ID NO: 2888794 - DNA, 15 bp, Homo sapiens
ctcccaaagtgctgg

SEQ ID NO: 2888795 - DNA, 17 bp, Homo sapiens
ctcccaaagtgctggga

SEQ ID NO: 2888796 - DNA, 22 bp, Homo sapiens
ctcccaaagtgctgggattaca

SEQ ID NO: 2888797 - DNA, 22 bp, Homo sapiens
ctcccaaagtgctgggattata

SEQ ID NO: 2888798 - DNA, 19 bp, Homo sapiens
ctcccaacgctgaagcggt

SEQ ID NO: 2888799 - DNA, 22 bp, Homo sapiens
ctcccaacgctgaagcggtcag

SEQ ID NO: 2888800 - DNA, 23 bp, Homo sapiens
ctcccaacgtgctgggattacag

SEQ ID NO: 2888801 - DNA, 15 bp, Homo sapiens
ctcccaactcccttc

SEQ ID NO: 2888802 - DNA, 17 bp, Homo sapiens
ctcccaactcccttctg

SEQ ID NO: 2888803 - DNA, 20 bp, Homo sapiens
ctcccaactcccttctgctt

SEQ ID NO: 2888804 - DNA, 15 bp, Homo sapiens
ctcccaagctggctg

SEQ ID NO: 2888805 - DNA, 19 bp, Homo sapiens
ctcccaagctggctggggt

SEQ ID NO: 2888806 - DNA, 20 bp, Homo sapiens
ctcccacaagtatatacttt

SEQ ID NO: 2888807 - DNA, 16 bp, Homo sapiens
ctcccacacttgtgcc

SEQ ID NO: 2888808 - DNA, 19 bp, Homo sapiens
ctcccacacttgtgccagc

SEQ ID NO: 2888809 - DNA, 14 bp, Homo sapiens
ctcccaccacccca

SEQ ID NO: 2888810 - DNA, 23 bp, Homo sapiens
ctcccaccccacccccttcagtg

SEQ ID NO: 2888811 - DNA, 15 bp, Homo sapiens
ctcccaccccctccc

SEQ ID NO: 2888812 - DNA, 15 bp, Homo sapiens
ctcccaccctaaggg

SEQ ID NO: 2888813 - DNA, 22 bp, Homo sapiens
ctcccaccctaagggcagccct

SEQ ID NO: 2888814 - DNA, 22 bp, Homo sapiens
ctcccacgggacctggggcttt

SEQ ID NO: 2888815 - DNA, 23 bp, Homo sapiens
ctcccactggggtccagggagca

SEQ ID NO: 2888816 - DNA, 21 bp, Homo sapiens
ctcccagacttgtttcctgtg

SEQ ID NO: 2888817 - DNA, 22 bp, Homo sapiens
ctcccagagtgctgggattaca

SEQ ID NO: 2888818 - DNA, 22 bp, Homo sapiens
ctcccagcaatcgcatcccggc

SEQ ID NO: 2888819 - DNA, 22 bp, Homo sapiens
ctcccaggacctcggatgacca

SEQ ID NO: 2888820 - DNA, 12 bp, Homo sapiens
ctcccaggctct

SEQ ID NO: 2888821 - DNA, 13 bp, Homo sapiens
ctcccaggctctc

SEQ ID NO: 2888822 - DNA, 14 bp, Homo sapiens
ctcccagtgccttc

SEQ ID NO: 2888823 - DNA, 23 bp, Homo sapiens
ctcccatcccctccctccttcac

SEQ ID NO: 2888824 - DNA, 14 bp, Homo sapiens
ctcccatcccgctt

SEQ ID NO: 2888825 - DNA, 16 bp, Homo sapiens
ctcccattcctgaaga

SEQ ID NO: 2888826 - DNA, 22 bp, Homo sapiens
ctcccattgtccctctgcccca

SEQ ID NO: 2888827 - DNA, 21 bp, Homo sapiens
ctcccatttcaggaatttaaa

SEQ ID NO: 2888828 - DNA, 23 bp, Homo sapiens
ctccccaaagccactggaaggag

SEQ ID NO: 2888829 - DNA, 13 bp, Homo sapiens
ctccccaactccc

SEQ ID NO: 2888830 - DNA, 13 bp, Homo sapiens
ctccccaatccat

SEQ ID NO: 2888831 - DNA, 22 bp, Homo sapiens
ctccccaatgagacttgccttc

SEQ ID NO: 2888832 - DNA, 22 bp, Homo sapiens
ctccccaccagagctgcctccc

SEQ ID NO: 2888833 - DNA, 15 bp, Homo sapiens
ctccccacccaagag

SEQ ID NO: 2888834 - DNA, 19 bp, Homo sapiens
ctccccacccaagagagga

SEQ ID NO: 2888835 - DNA, 12 bp, Homo sapiens
ctccccacccct

SEQ ID NO: 2888836 - DNA, 16 bp, Homo sapiens
ctccccaccctcctgg

SEQ ID NO: 2888837 - DNA, 15 bp, Homo sapiens
ctccccacgagggct

SEQ ID NO: 2888838 - DNA, 13 bp, Homo sapiens
ctccccagcccag

SEQ ID NO: 2888839 - DNA, 14 bp, Homo sapiens
ctccccagcccaga

SEQ ID NO: 2888840 - DNA, 16 bp, Homo sapiens
ctccccagcccagaga

SEQ ID NO: 2888841 - DNA, 11 bp, Homo sapiens
ctccccagggg

SEQ ID NO: 2888842 - DNA, 22 bp, Homo sapiens
ctccccatctcggggctgctgt

SEQ ID NO: 2888843 - DNA, 14 bp, Homo sapiens
ctccccatctgtgt

SEQ ID NO: 2888844 - DNA, 15 bp, Homo sapiens
ctccccatctgtgtt

SEQ ID NO: 2888845 - DNA, 17 bp, Homo sapiens
ctccccatctgtgttct

SEQ ID NO: 2888846 - DNA, 13 bp, Homo sapiens
ctcccccaaccaa

SEQ ID NO: 2888847 - DNA, 19 bp, Homo sapiens
ctcccccaaccaaggaagg

SEQ ID NO: 2888848 - DNA, 21 bp, Homo sapiens
ctcccccaaccaaggaaggag

SEQ ID NO: 2888849 - DNA, 19 bp, Homo sapiens
ctcccccaccccctcccca

SEQ ID NO: 2888850 - DNA, 13 bp, Homo sapiens
ctcccccacgtct

SEQ ID NO: 2888851 - DNA, 13 bp, Homo sapiens
ctcccccagcaga

SEQ ID NO: 2888852 - DNA, 21 bp, Homo sapiens
ctcccccataaaatgatcctg

SEQ ID NO: 2888853 - DNA, 16 bp, Homo sapiens
ctcccccatagcaccc

SEQ ID NO: 2888854 - DNA, 14 bp, Homo sapiens
ctccccccaatccc

SEQ ID NO: 2888855 - DNA, 13 bp, Homo sapiens
ctcccccccatgc

SEQ ID NO: 2888856 - DNA, 15 bp, Homo sapiens
ctcccccccatgcac

SEQ ID NO: 2888857 - DNA, 13 bp, Homo sapiens
ctccccctcctga

SEQ ID NO: 2888858 - DNA, 12 bp, Homo sapiens
ctccccctctgc

SEQ ID NO: 2888859 - DNA, 15 bp, Homo sapiens
ctccccctctgcttc

SEQ ID NO: 2888860 - DNA, 17 bp, Homo sapiens
ctccccctctgcttctc

SEQ ID NO: 2888861 - DNA, 16 bp, Homo sapiens
ctccccgaggctgccc

SEQ ID NO: 2888862 - DNA, 19 bp, Homo sapiens
ctccccgaggctgccccag

SEQ ID NO: 2888863 - DNA, 20 bp, Homo sapiens
ctccccgctccgtctctgtc

SEQ ID NO: 2888864 - DNA, 17 bp, Homo sapiens
ctcccctatccacccag

SEQ ID NO: 2888865 - DNA, 18 bp, Homo sapiens
ctcccctatccacccagc

SEQ ID NO: 2888866 - DNA, 11 bp, Homo sapiens
ctcccctcaga

SEQ ID NO: 2888867 - DNA, 13 bp, Homo sapiens
ctcccctcagagc

SEQ ID NO: 2888868 - DNA, 13 bp, Homo sapiens
ctcccctcagagt

SEQ ID NO: 2888869 - DNA, 16 bp, Homo sapiens
ctcccctcagagtgca

SEQ ID NO: 2888870 - DNA, 20 bp, Homo sapiens
ctcccctccccatctgtgtt

SEQ ID NO: 2888871 - DNA, 16 bp, Homo sapiens
ctcccctgacctgtga

SEQ ID NO: 2888872 - DNA, 22 bp, Homo sapiens
ctcccctgacctgtgagcccag

SEQ ID NO: 2888873 - DNA, 11 bp, Homo sapiens
ctcccctgagg

SEQ ID NO: 2888874 - DNA, 15 bp, Homo sapiens
ctcccctgccagggc

SEQ ID NO: 2888875 - DNA, 12 bp, Homo sapiens
ctcccctgccgc

SEQ ID NO: 2888876 - DNA, 21 bp, Homo sapiens
ctccccttgcccttcctgacc

SEQ ID NO: 2888877 - DNA, 14 bp, Homo sapiens
ctccccttttctat

SEQ ID NO: 2888878 - DNA, 19 bp, Homo sapiens
ctccccttttctatgttgc

SEQ ID NO: 2888879 - DNA, 20 bp, Homo sapiens
ctcccgggaagcatcctccc

SEQ ID NO: 2888880 - DNA, 23 bp, Homo sapiens
ctcccgggaagcatcctccccac

SEQ ID NO: 2888881 - DNA, 21 bp, Homo sapiens
ctcccgggttcacgccattct

SEQ ID NO: 2888882 - DNA, 13 bp, Homo sapiens
ctccctacactga

SEQ ID NO: 2888883 - DNA, 13 bp, Homo sapiens
ctccctaccacct

SEQ ID NO: 2888884 - DNA, 14 bp, Homo sapiens
ctccctaccacctc

SEQ ID NO: 2888885 - DNA, 18 bp, Homo sapiens
ctccctaccttgcctcct

SEQ ID NO: 2888886 - DNA, 13 bp, Homo sapiens
ctccctagatcca

SEQ ID NO: 2888887 - DNA, 16 bp, Homo sapiens
ctccctagatccaggc

SEQ ID NO: 2888888 - DNA, 12 bp, Homo sapiens
ctccctaggccc

SEQ ID NO: 2888889 - DNA, 21 bp, Homo sapiens
ctccctatactgcttggagct

SEQ ID NO: 2888890 - DNA, 14 bp, Homo sapiens
ctccctcaacccca

SEQ ID NO: 2888891 - DNA, 14 bp, Homo sapiens
ctccctccactcct

SEQ ID NO: 2888892 - DNA, 14 bp, Homo sapiens
ctccctccagcaca

SEQ ID NO: 2888893 - DNA, 16 bp, Homo sapiens
ctccctccagcacaaa

SEQ ID NO: 2888894 - DNA, 14 bp, Homo sapiens
ctccctccccaccc

SEQ ID NO: 2888895 - DNA, 15 bp, Homo sapiens
ctccctccccaccca

SEQ ID NO: 2888896 - DNA, 14 bp, Homo sapiens
ctccctcccttcct

SEQ ID NO: 2888897 - DNA, 18 bp, Homo sapiens
ctccctccgactccagat

SEQ ID NO: 2888898 - DNA, 14 bp, Homo sapiens
ctccctccgcctcc

SEQ ID NO: 2888899 - DNA, 17 bp, Homo sapiens
ctccctccggcttgacc

SEQ ID NO: 2888900 - DNA, 14 bp, Homo sapiens
ctccctcctcacac

SEQ ID NO: 2888901 - DNA, 18 bp, Homo sapiens
ctccctcctcacactcca

SEQ ID NO: 2888902 - DNA, 19 bp, Homo sapiens
ctccctcctcacactccag

SEQ ID NO: 2888903 - DNA, 17 bp, Homo sapiens
ctccctcctcactccct

SEQ ID NO: 2888904 - DNA, 21 bp, Homo sapiens
ctccctcctggagctctgtgg

SEQ ID NO: 2888905 - DNA, 19 bp, Homo sapiens
ctccctcgtcttcagctgc

SEQ ID NO: 2888906 - DNA, 20 bp, Homo sapiens
ctccctctactgggagccta

SEQ ID NO: 2888907 - DNA, 20 bp, Homo sapiens
ctccctctaggctctgcctt

SEQ ID NO: 2888908 - DNA, 16 bp, Homo sapiens
ctccctctcactgtct

SEQ ID NO: 2888909 - DNA, 13 bp, Homo sapiens
ctccctctcctgc

SEQ ID NO: 2888910 - DNA, 15 bp, Homo sapiens
ctccctctcctgcct

SEQ ID NO: 2888911 - DNA, 17 bp, Homo sapiens
ctccctctcctgcctac

SEQ ID NO: 2888912 - DNA, 15 bp, Homo sapiens
ctccctctctgtgca

SEQ ID NO: 2888913 - DNA, 14 bp, Homo sapiens
ctccctctcttccg

SEQ ID NO: 2888914 - DNA, 18 bp, Homo sapiens
ctccctctcttccgggag

SEQ ID NO: 2888915 - DNA, 20 bp, Homo sapiens
ctccctctcttccgggagct

SEQ ID NO: 2888916 - DNA, 18 bp, Homo sapiens
ctccctctggccctgcct

SEQ ID NO: 2888917 - DNA, 14 bp, Homo sapiens
ctccctcttctttc

SEQ ID NO: 2888918 - DNA, 13 bp, Homo sapiens
ctccctctttcta

SEQ ID NO: 2888919 - DNA, 16 bp, Homo sapiens
ctccctctttctagcc

SEQ ID NO: 2888920 - DNA, 17 bp, Homo sapiens
ctccctctttctagcct

SEQ ID NO: 2888921 - DNA, 16 bp, Homo sapiens
ctccctctttttctct

SEQ ID NO: 2888922 - DNA, 20 bp, Homo sapiens
ctccctgaaacactgcttct

SEQ ID NO: 2888923 - DNA, 17 bp, Homo sapiens
ctccctgatcccagacc

SEQ ID NO: 2888924 - DNA, 20 bp, Homo sapiens
ctccctgcactccctcctgg

SEQ ID NO: 2888925 - DNA, 22 bp, Homo sapiens
ctccctgcactccctcctggag

SEQ ID NO: 2888926 - DNA, 22 bp, Homo sapiens
ctcaatgtacatagaccctctt

SEQ ID NO: 2888927 - DNA, 19 bp, Homo sapiens
ctcaatgttactatctgct

SEQ ID NO: 2888928 - DNA, 16 bp, Homo sapiens
ctcaatttctgaacac

SEQ ID NO: 2888929 - DNA, 21 bp, Homo sapiens
ctcaattttgtatttaatgat

SEQ ID NO: 2888930 - DNA, 16 bp, Homo sapiens
ctcacaacctgaacct

SEQ ID NO: 2888931 - DNA, 19 bp, Homo sapiens
ctcacaactccttccatcc

SEQ ID NO: 2888932 - DNA, 21 bp, Homo sapiens
ctcacaccctaccttccccag

SEQ ID NO: 2888933 - DNA, 22 bp, Homo sapiens
ctcacacctgtaatcccagcac

SEQ ID NO: 2888934 - DNA, 13 bp, Homo sapiens
ctcacactccaga

SEQ ID NO: 2888935 - DNA, 14 bp, Homo sapiens
ctcacactccagaa

SEQ ID NO: 2888936 - DNA, 23 bp, Homo sapiens
ctcacagaagggtgtggcatttg

SEQ ID NO: 2888937 - DNA, 16 bp, Homo sapiens
ctcacagactcttcca

SEQ ID NO: 2888938 - DNA, 22 bp, Homo sapiens
ctcacagactcttccaccagag

SEQ ID NO: 2888939 - DNA, 17 bp, Homo sapiens
ctcacagatgctggcct

SEQ ID NO: 2888940 - DNA, 12 bp, Homo sapiens
ctcacagtgaca

SEQ ID NO: 2888941 - DNA, 23 bp, Homo sapiens
ctcacagtgacaccatttgtcct

SEQ ID NO: 2888942 - DNA, 13 bp, Homo sapiens
ctcacagttcctc

SEQ ID NO: 2888943 - DNA, 17 bp, Homo sapiens
ctcacagttcctcgccc

SEQ ID NO: 2888944 - DNA, 21 bp, Homo sapiens
ctcacatagccaactctccca

SEQ ID NO: 2888945 - DNA, 14 bp, Homo sapiens
ctcacatctccctt

SEQ ID NO: 2888946 - DNA, 17 bp, Homo sapiens
ctcacatctcccttcca

SEQ ID NO: 2888947 - DNA, 12 bp, Homo sapiens
ctcaccaccccc

SEQ ID NO: 2888948 - DNA, 15 bp, Homo sapiens
ctcaccacccccact

SEQ ID NO: 2888949 - DNA, 16 bp, Homo sapiens
ctcaccacccccactg

SEQ ID NO: 2888950 - DNA, 11 bp, Homo sapiens
ctcaccagctg

SEQ ID NO: 2888951 - DNA, 20 bp, Homo sapiens
ctcaccccacaatttcttta

SEQ ID NO: 2888952 - DNA, 13 bp, Homo sapiens
ctcaccccagctc

SEQ ID NO: 2888953 - DNA, 16 bp, Homo sapiens
ctcaccccgaggccct

SEQ ID NO: 2888954 - DNA, 19 bp, Homo sapiens
ctcaccccgaggccctgca

SEQ ID NO: 2888955 - DNA, 21 bp, Homo sapiens
ctcaccccgaggccctgcatg

SEQ ID NO: 2888956 - DNA, 22 bp, Homo sapiens
ctcaccccgaggccctgcatgg

SEQ ID NO: 2888957 - DNA, 13 bp, Homo sapiens
ctcaccctctgtc

SEQ ID NO: 2888958 - DNA, 14 bp, Homo sapiens
ctcaccctctgtcc

SEQ ID NO: 2888959 - DNA, 15 bp, Homo sapiens
ctcaccctctgtccc

SEQ ID NO: 2888960 - DNA, 22 bp, Homo sapiens
ctcacccttcctggcccaggcc

SEQ ID NO: 2888961 - DNA, 13 bp, Homo sapiens
ctcacctctgcct

SEQ ID NO: 2888962 - DNA, 14 bp, Homo sapiens
ctcacctctgcctc

SEQ ID NO: 2888963 - DNA, 18 bp, Homo sapiens
ctcacctctgcctcaatg

SEQ ID NO: 2888964 - DNA, 12 bp, Homo sapiens
ctcacctggggt

SEQ ID NO: 2888965 - DNA, 14 bp, Homo sapiens
ctcacctggtcctc

SEQ ID NO: 2888966 - DNA, 23 bp, Homo sapiens
ctcacctggtcctccgcctactg

SEQ ID NO: 2888967 - DNA, 16 bp, Homo sapiens
ctcacctggttgaccc

SEQ ID NO: 2888968 - DNA, 17 bp, Homo sapiens
ctcacctgttgcttaca

SEQ ID NO: 2888969 - DNA, 20 bp, Homo sapiens
ctcacctgttgcttacaatt

SEQ ID NO: 2888970 - DNA, 21 bp, Homo sapiens
ctcaccttctgagtacagagt

SEQ ID NO: 2888971 - DNA, 19 bp, Homo sapiens
ctcacctttctccactggg

SEQ ID NO: 2888972 - DNA, 16 bp, Homo sapiens
ctcacgcacctcccat

SEQ ID NO: 2888973 - DNA, 15 bp, Homo sapiens
ctcacgccccgctgt

SEQ ID NO: 2888974 - DNA, 21 bp, Homo sapiens
ctcacgtatttcacagagcac

SEQ ID NO: 2888975 - DNA, 16 bp, Homo sapiens
ctcacgtgagagtgtc

SEQ ID NO: 2888976 - DNA, 16 bp, Homo sapiens
ctcacgtgcaggacag

SEQ ID NO: 2888977 - DNA, 17 bp, Homo sapiens
ctcactaatttttgtat

SEQ ID NO: 2888978 - DNA, 23 bp, Homo sapiens
ctcactaatttttgtattatttt

SEQ ID NO: 2888979 - DNA, 15 bp, Homo sapiens
ctcactatggttttt

SEQ ID NO: 2888980 - DNA, 16 bp, Homo sapiens
ctcactatgtttctca

SEQ ID NO: 2888981 - DNA, 15 bp, Homo sapiens
ctcactcagctctga

SEQ ID NO: 2888982 - DNA, 14 bp, Homo sapiens
ctcactccaccacc

SEQ ID NO: 2888983 - DNA, 17 bp, Homo sapiens
ctcactccaccacccaa

SEQ ID NO: 2888984 - DNA, 20 bp, Homo sapiens
ctcactccaccacccaaaag

SEQ ID NO: 2888985 - DNA, 14 bp, Homo sapiens
ctcactccctaggc

SEQ ID NO: 2888986 - DNA, 15 bp, Homo sapiens
ctcactcccttccca

SEQ ID NO: 2888987 - DNA, 17 bp, Homo sapiens
ctcactctgttgcccag

SEQ ID NO: 2888988 - DNA, 22 bp, Homo sapiens
ctcactgaactccttccccact

SEQ ID NO: 2888989 - DNA, 18 bp, Homo sapiens
ctcactgcaaccttcacc

SEQ ID NO: 2888990 - DNA, 22 bp, Homo sapiens
ctcactgcagcctcaacctcct

SEQ ID NO: 2888991 - DNA, 13 bp, Homo sapiens
ctcactggggcct

SEQ ID NO: 2888992 - DNA, 18 bp, Homo sapiens
ctcactggggcctacagc

SEQ ID NO: 2888993 - DNA, 21 bp, Homo sapiens
ctcacttctagatctcagcca

SEQ ID NO: 2888994 - DNA, 22 bp, Homo sapiens
ctcacttgatgtttcctggaag

SEQ ID NO: 2888995 - DNA, 20 bp, Homo sapiens
ctcacttggtctgccaggcc

SEQ ID NO: 2888996 - DNA, 21 bp, Homo sapiens
ctcacttttaatgaacaaatg

SEQ ID NO: 2888997 - DNA, 22 bp, Homo sapiens
ctcacttttaatgaacaaatgg

SEQ ID NO: 2888998 - DNA, 16 bp, Homo sapiens
ctcacttttcacttgt

SEQ ID NO: 2888999 - DNA, 18 bp, Homo sapiens
ctcacttttcacttgtct

SEQ ID NO: 2889000 - DNA, 22 bp, Homo sapiens
ctcacttttcacttgtcttgct

SEQ ID NO: 2889001 - DNA, 11 bp, Homo sapiens
ctcagaagaaa

SEQ ID NO: 2889002 - DNA, 17 bp, Homo sapiens
ctcagaagagcagcttc

SEQ ID NO: 2889003 - DNA, 15 bp, Homo sapiens
ctcagaagcctcgac

SEQ ID NO: 2889004 - DNA, 15 bp, Homo sapiens
ctcagaagcctctgg

SEQ ID NO: 2889005 - DNA, 17 bp, Homo sapiens
ctcagaagcctctgggt

SEQ ID NO: 2889006 - DNA, 17 bp, Homo sapiens
ctcagaaggaatggtgc

SEQ ID NO: 2889007 - DNA, 18 bp, Homo sapiens
ctcagaaggaatggtgcg

SEQ ID NO: 2889008 - DNA, 21 bp, Homo sapiens
ctcagaaggaatggtgcgtgg

SEQ ID NO: 2889009 - DNA, 22 bp, Homo sapiens
ctcagaagggagctagccagag

SEQ ID NO: 2889010 - DNA, 13 bp, Homo sapiens
ctcagacattggc

SEQ ID NO: 2889011 - DNA, 16 bp, Homo sapiens
ctcagacccccactct

SEQ ID NO: 2889012 - DNA, 22 bp, Homo sapiens
ctcagacccccactctcattcc

SEQ ID NO: 2889013 - DNA, 16 bp, Homo sapiens
ctcagacgtgtgacct

SEQ ID NO: 2889014 - DNA, 23 bp, Homo sapiens
ctcagacgtgtgacctccatact

SEQ ID NO: 2889015 - DNA, 18 bp, Homo sapiens
ctcagactgcacccagga

SEQ ID NO: 2889016 - DNA, 17 bp, Homo sapiens
ctcagactttggaaaat

SEQ ID NO: 2889017 - DNA, 22 bp, Homo sapiens
ctcagactttggaaaatgcatt

SEQ ID NO: 2889018 - DNA, 17 bp, Homo sapiens
ctcagagaaaagagatt

SEQ ID NO: 2889019 - DNA, 19 bp, Homo sapiens
ctcagagaaccagtgcaga

SEQ ID NO: 2889020 - DNA, 18 bp, Homo sapiens
ctcagagagtacactgtg

SEQ ID NO: 2889021 - DNA, 19 bp, Homo sapiens
ctcagagagtacactgtgt

SEQ ID NO: 2889022 - DNA, 22 bp, Homo sapiens
ctcagagagtacactgtgtctc

SEQ ID NO: 2889023 - DNA, 19 bp, Homo sapiens
ctcagagccaagggggcag

SEQ ID NO: 2889024 - DNA, 12 bp, Homo sapiens
ctcagagcccat

SEQ ID NO: 2889025 - DNA, 12 bp, Homo sapiens
ctcagagctgcg

SEQ ID NO: 2889026 - DNA, 13 bp, Homo sapiens
ctcagagctgcgg

SEQ ID NO: 2889027 - DNA, 14 bp, Homo sapiens
ctcagagctgcggg

SEQ ID NO: 2889028 - DNA, 16 bp, Homo sapiens
ctcagagctgcgggct

SEQ ID NO: 2889029 - DNA, 22 bp, Homo sapiens
ctcagagctgcgggctgagggc

SEQ ID NO: 2889030 - DNA, 17 bp, Homo sapiens
ctcagaggcgcactgtg

SEQ ID NO: 2889031 - DNA, 18 bp, Homo sapiens
ctcagaggcgcactgtga

SEQ ID NO: 2889032 - DNA, 19 bp, Homo sapiens
ctcagaggcgcactgtgac

SEQ ID NO: 2889033 - DNA, 21 bp, Homo sapiens
ctccagcacaaacacaaggtc

SEQ ID NO: 2889034 - DNA, 21 bp, Homo sapiens
ctccagccatcaagagactga

SEQ ID NO: 2889035 - DNA, 19 bp, Homo sapiens
ctccagcccctttccaaaa

SEQ ID NO: 2889036 - DNA, 23 bp, Homo sapiens
ctccagcccgagtggtctcctct

SEQ ID NO: 2889037 - DNA, 14 bp, Homo sapiens
ctccagcctcacag

SEQ ID NO: 2889038 - DNA, 15 bp, Homo sapiens
ctccagcctcacaga

SEQ ID NO: 2889039 - DNA, 22 bp, Homo sapiens
ctccagcctcacagatgctggc

SEQ ID NO: 2889040 - DNA, 20 bp, Homo sapiens
ctccagcctgggaggcacag

SEQ ID NO: 2889041 - DNA, 21 bp, Homo sapiens
ctccagcctgggtcacagagt

SEQ ID NO: 2889042 - DNA, 21 bp, Homo sapiens
ctccagcgatggtgctgccca

SEQ ID NO: 2889043 - DNA, 14 bp, Homo sapiens
ctccagctcagcag

SEQ ID NO: 2889044 - DNA, 15 bp, Homo sapiens
ctccagctcatatgc

SEQ ID NO: 2889045 - DNA, 13 bp, Homo sapiens
ctccagctgcccc

SEQ ID NO: 2889046 - DNA, 14 bp, Homo sapiens
ctccagctgccccg

SEQ ID NO: 2889047 - DNA, 12 bp, Homo sapiens
ctccagctggtg

SEQ ID NO: 2889048 - DNA, 15 bp, Homo sapiens
ctccagctggtgccc

SEQ ID NO: 2889049 - DNA, 20 bp, Homo sapiens
ctccagctggtgcccccaga

SEQ ID NO: 2889050 - DNA, 17 bp, Homo sapiens
ctccagctgtcagcctg

SEQ ID NO: 2889051 - DNA, 18 bp, Homo sapiens
ctccagctgtcagcctgg

SEQ ID NO: 2889052 - DNA, 19 bp, Homo sapiens
ctccagctgtcagcctggt

SEQ ID NO: 2889053 - DNA, 17 bp, Homo sapiens
ctccaggccagctcctt

SEQ ID NO: 2889054 - DNA, 22 bp, Homo sapiens
ctccaggccagctccttttctg

SEQ ID NO: 2889055 - DNA, 12 bp, Homo sapiens
ctccaggcccaa

SEQ ID NO: 2889056 - DNA, 16 bp, Homo sapiens
ctccaggcccaaggct

SEQ ID NO: 2889057 - DNA, 15 bp, Homo sapiens
ctccaggcccgtctg

SEQ ID NO: 2889058 - DNA, 18 bp, Homo sapiens
ctccaggcccgtctgtcc

SEQ ID NO: 2889059 - DNA, 19 bp, Homo sapiens
ctccaggcccgtctgtcca

SEQ ID NO: 2889060 - DNA, 20 bp, Homo sapiens
ctccaggcccgtctgtccat

SEQ ID NO: 2889061 - DNA, 19 bp, Homo sapiens
ctccagggccacgtgccag

SEQ ID NO: 2889062 - DNA, 16 bp, Homo sapiens
ctccagggtgtgtgct

SEQ ID NO: 2889063 - DNA, 17 bp, Homo sapiens
ctccaggtaccttgacc

SEQ ID NO: 2889064 - DNA, 20 bp, Homo sapiens
ctccaggtaccttgaccttt

SEQ ID NO: 2889065 - DNA, 14 bp, Homo sapiens
ctccaggtgcagag

SEQ ID NO: 2889066 - DNA, 18 bp, Homo sapiens
ctccaggtgcagaggtac

SEQ ID NO: 2889067 - DNA, 13 bp, Homo sapiens
ctccagtcctgct

SEQ ID NO: 2889068 - DNA, 17 bp, Homo sapiens
ctccagtcctgctggcc

SEQ ID NO: 2889069 - DNA, 20 bp, Homo sapiens
ctccagtcctgctggcctgc

SEQ ID NO: 2889070 - DNA, 12 bp, Homo sapiens
ctccagtgcagt

SEQ ID NO: 2889071 - DNA, 15 bp, Homo sapiens
ctccagtgcagtcca

SEQ ID NO: 2889072 - DNA, 22 bp, Homo sapiens
ctccataagtggagaaatgaaa

SEQ ID NO: 2889073 - DNA, 22 bp, Homo sapiens
ctccataagtttaactttaaaa

SEQ ID NO: 2889074 - DNA, 19 bp, Homo sapiens
ctccatactgggctaagga

SEQ ID NO: 2889075 - DNA, 12 bp, Homo sapiens
ctccatactttg

SEQ ID NO: 2889076 - DNA, 15 bp, Homo sapiens
ctccatactttggat

SEQ ID NO: 2889077 - DNA, 17 bp, Homo sapiens
ctccatagctgggaaac

SEQ ID NO: 2889078 - DNA, 21 bp, Homo sapiens
ctccatagtttggcatttgca

SEQ ID NO: 2889079 - DNA, 19 bp, Homo sapiens
ctccatcacaaccagattt

SEQ ID NO: 2889080 - DNA, 16 bp, Homo sapiens
ctccatccatctgtcc

SEQ ID NO: 2889081 - DNA, 19 bp, Homo sapiens
ctccatccccatcggccct

SEQ ID NO: 2889082 - DNA, 22 bp, Homo sapiens
ctccatccccatcggccctgtc

SEQ ID NO: 2889083 - DNA, 17 bp, Homo sapiens
ctccatctccgcctcca

SEQ ID NO: 2889084 - DNA, 18 bp, Homo sapiens
ctccatctccgcctccac

SEQ ID NO: 2889085 - DNA, 19 bp, Homo sapiens
ctccatctccgcctccaca

SEQ ID NO: 2889086 - DNA, 23 bp, Homo sapiens
ctccatctctttaaaaacaaaca

SEQ ID NO: 2889087 - DNA, 19 bp, Homo sapiens
ctccatcttcagcttcttc

SEQ ID NO: 2889088 - DNA, 16 bp, Homo sapiens
ctccatgcaagtgctg

SEQ ID NO: 2889089 - DNA, 23 bp, Homo sapiens
ctccatgcaagtgctgtttgggc

SEQ ID NO: 2889090 - DNA, 17 bp, Homo sapiens
ctccatggttctcaatt

SEQ ID NO: 2889091 - DNA, 21 bp, Homo sapiens
ctccatgtagaataaatgaag

SEQ ID NO: 2889092 - DNA, 20 bp, Homo sapiens
ctccatgttggtcaggctgg

SEQ ID NO: 2889093 - DNA, 19 bp, Homo sapiens
ctccatgtttccaccaaat

SEQ ID NO: 2889094 - DNA, 18 bp, Homo sapiens
ctccattcaatttcaggc

SEQ ID NO: 2889095 - DNA, 21 bp, Homo sapiens
ctccattcaatttcaggctcc

SEQ ID NO: 2889096 - DNA, 14 bp, Homo sapiens
ctccattcctgctc

SEQ ID NO: 2889097 - DNA, 22 bp, Homo sapiens
ctccattcctgctctcccactg

SEQ ID NO: 2889098 - DNA, 13 bp, Homo sapiens
ctgcaagcagaac

SEQ ID NO: 2889099 - DNA, 22 bp, Homo sapiens
ctgcaagcccacctcggccctc

SEQ ID NO: 2889100 - DNA, 19 bp, Homo sapiens
ctgcaaggacattcttgta

SEQ ID NO: 2889101 - DNA, 23 bp, Homo sapiens
ctgcaaggtttaggctggtggcc

SEQ ID NO: 2889102 - DNA, 15 bp, Homo sapiens
ctgcaagtccttttg

SEQ ID NO: 2889103 - DNA, 18 bp, Homo sapiens
ctgcaagtccttttgtaa

SEQ ID NO: 2889104 - DNA, 21 bp, Homo sapiens
ctgcaagtccttttgtaaagt

SEQ ID NO: 2889105 - DNA, 18 bp, Homo sapiens
ctgcaagtgtctggagcg

SEQ ID NO: 2889106 - DNA, 20 bp, Homo sapiens
ctgcaataaattatggctct

SEQ ID NO: 2889107 - DNA, 21 bp, Homo sapiens
ctgcaatgactgtggagttcc

SEQ ID NO: 2889108 - DNA, 21 bp, Homo sapiens
ctgcaattcaaaagttccaag

SEQ ID NO: 2889109 - DNA, 24 bp, Homo sapiens
ctgcaattcaaaagttccaagagt

SEQ ID NO: 2889110 - DNA, 15 bp, Homo sapiens
ctgcaatttctacta

SEQ ID NO: 2889111 - DNA, 17 bp, Homo sapiens
ctgcacagattcccagg

SEQ ID NO: 2889112 - DNA, 18 bp, Homo sapiens
ctgcacagattcccaggc

SEQ ID NO: 2889113 - DNA, 19 bp, Homo sapiens
ctgcacagattcccaggcc

SEQ ID NO: 2889114 - DNA, 23 bp, Homo sapiens
ctgcacagggtttggcccaagtt

SEQ ID NO: 2889115 - DNA, 16 bp, Homo sapiens
ctgcacaggtctctgt

SEQ ID NO: 2889116 - DNA, 17 bp, Homo sapiens
ctgcacaggtctctgtt

SEQ ID NO: 2889117 - DNA, 19 bp, Homo sapiens
ctgcacaggtctctgttta

SEQ ID NO: 2889118 - DNA, 13 bp, Homo sapiens
ctgcacagtcaga

SEQ ID NO: 2889119 - DNA, 18 bp, Homo sapiens
ctgcacagtcagaaggac

SEQ ID NO: 2889120 - DNA, 23 bp, Homo sapiens
ctgcacagtcagaaggacggcag

SEQ ID NO: 2889121 - DNA, 16 bp, Homo sapiens
ctgcacatagcagact

SEQ ID NO: 2889122 - DNA, 13 bp, Homo sapiens
ctgcacatgaaga

SEQ ID NO: 2889123 - DNA, 22 bp, Homo sapiens
ctgcacatgaatcccacccaca

SEQ ID NO: 2889124 - DNA, 21 bp, Homo sapiens
ctgcacattaaggagaaatct

SEQ ID NO: 2889125 - DNA, 17 bp, Homo sapiens
ctgcacccccctgggct

SEQ ID NO: 2889126 - DNA, 21 bp, Homo sapiens
ctgcaccctcttctcctctgg

SEQ ID NO: 2889127 - DNA, 16 bp, Homo sapiens
ctgcaccgaccccggg

SEQ ID NO: 2889128 - DNA, 18 bp, Homo sapiens
ctgcaccggggcctgggc

SEQ ID NO: 2889129 - DNA, 17 bp, Homo sapiens
ctgcacctccccccact

SEQ ID NO: 2889130 - DNA, 21 bp, Homo sapiens
ctgcacctccccccactgcag

SEQ ID NO: 2889131 - DNA, 17 bp, Homo sapiens
ctgcacgctcccctcca

SEQ ID NO: 2889132 - DNA, 21 bp, Homo sapiens
ctgcactccagatatgtgcca

SEQ ID NO: 2889133 - DNA, 12 bp, Homo sapiens
ctgcactccagc

SEQ ID NO: 2889134 - DNA, 16 bp, Homo sapiens
ctgcactccagcctgg

SEQ ID NO: 2889135 - DNA, 20 bp, Homo sapiens
ctgcactccctcctggagct

SEQ ID NO: 2889136 - DNA, 21 bp, Homo sapiens
ctgcactccctcctggagctc

SEQ ID NO: 2889137 - DNA, 13 bp, Homo sapiens
ctgcactccctgg

SEQ ID NO: 2889138 - DNA, 14 bp, Homo sapiens
ctgcactccctggc

SEQ ID NO: 2889139 - DNA, 16 bp, Homo sapiens
ctgcactccctggcct

SEQ ID NO: 2889140 - DNA, 18 bp, Homo sapiens
ctgcactccctggccttg

SEQ ID NO: 2889141 - DNA, 15 bp, Homo sapiens
ctgcactcctcaggg

SEQ ID NO: 2889142 - DNA, 15 bp, Homo sapiens
ctgcactgatgctgc

SEQ ID NO: 2889143 - DNA, 15 bp, Homo sapiens
ctgcactggagccac

SEQ ID NO: 2889144 - DNA, 22 bp, Homo sapiens
ctgcactttgggtttttaactc

SEQ ID NO: 2889145 - DNA, 23 bp, Homo sapiens
ctgcagaacgtattggtccagct

SEQ ID NO: 2889146 - DNA, 15 bp, Homo sapiens
ctgcagaagcaaggg

SEQ ID NO: 2889147 - DNA, 22 bp, Homo sapiens
ctgcagaatttgggttctgcct

SEQ ID NO: 2889148 - DNA, 18 bp, Homo sapiens
ctgcagacgtctgccttg

SEQ ID NO: 2889149 - DNA, 23 bp, Homo sapiens
ctgcagacgtctgccttggcatc

SEQ ID NO: 2889150 - DNA, 16 bp, Homo sapiens
ctgcagacgtctggcc

SEQ ID NO: 2889151 - DNA, 14 bp, Homo sapiens
ctgcagacttccca

SEQ ID NO: 2889152 - DNA, 18 bp, Homo sapiens
ctgcagacttcccagcta

SEQ ID NO: 2889153 - DNA, 14 bp, Homo sapiens
ctgcagagatattt

SEQ ID NO: 2889154 - DNA, 18 bp, Homo sapiens
ctgcagagcagtgggcct

SEQ ID NO: 2889155 - DNA, 23 bp, Homo sapiens
ctgcagagctgcgggctgggtgt

SEQ ID NO: 2889156 - DNA, 18 bp, Homo sapiens
ctgcagatagaaagcatt

SEQ ID NO: 2889157 - DNA, 21 bp, Homo sapiens
ctgcagcacatgcgggctcgc

SEQ ID NO: 2889158 - DNA, 22 bp, Homo sapiens
ctgcagcacatgcgggctcgcc

SEQ ID NO: 2889159 - DNA, 23 bp, Homo sapiens
ctgcagcacattgataagatggt

SEQ ID NO: 2889160 - DNA, 18 bp, Homo sapiens
ctgcagcaccgaggggcc

SEQ ID NO: 2889161 - DNA, 16 bp, Homo sapiens
ctgcagccaggccact

SEQ ID NO: 2889162 - DNA, 17 bp, Homo sapiens
ctgcagccaggccactg

SEQ ID NO: 2889163 - DNA, 22 bp, Homo sapiens
ctgcagccaggccactggcccc

SEQ ID NO: 2889164 - DNA, 16 bp, Homo sapiens
ctgcagccaggcctcg

SEQ ID NO: 2889165 - DNA, 19 bp, Homo sapiens
ctgcagccaggcctcgcct

SEQ ID NO: 2889166 - DNA, 20 bp, Homo sapiens
ctgcagccaggcctcgcctg

SEQ ID NO: 2889167 - DNA, 21 bp, Homo sapiens
ctgcagcctcaacctcctggg

SEQ ID NO: 2889168 - DNA, 16 bp, Homo sapiens
ctgcagcctccggggt

SEQ ID NO: 2889169 - DNA, 17 bp, Homo sapiens
ctgcagcctccggggtt

SEQ ID NO: 2889170 - DNA, 21 bp, Homo sapiens
ctgcagccttgaactctgggc

SEQ ID NO: 2889171 - DNA, 15 bp, Homo sapiens
ctgcagctagtccta

SEQ ID NO: 2889172 - DNA, 17 bp, Homo sapiens
ctgcaggaaatggctgt

SEQ ID NO: 2889173 - DNA, 15 bp, Homo sapiens
ctgcaggacctgcct

SEQ ID NO: 2889174 - DNA, 16 bp, Homo sapiens
ctgcaggacctgcctg

SEQ ID NO: 2889175 - DNA, 22 bp, Homo sapiens
ctgcaggacctgcctgtagccc

SEQ ID NO: 2889176 - DNA, 19 bp, Homo sapiens
ctgcaggacttgagaagac

SEQ ID NO: 2889177 - DNA, 18 bp, Homo sapiens
ctgcaggagcagggcggc

SEQ ID NO: 2889178 - DNA, 13 bp, Homo sapiens
ctgcaggagggca

SEQ ID NO: 2889179 - DNA, 18 bp, Homo sapiens
ctgcaggccaggccagct

SEQ ID NO: 2889180 - DNA, 18 bp, Homo sapiens
ctgcaggctgcaggaggg

SEQ ID NO: 2889181 - DNA, 23 bp, Homo sapiens
ctgcaggcttaataaaaatgaca

SEQ ID NO: 2889182 - DNA, 23 bp, Homo sapiens
ctgcagggaaaattatttgcata

SEQ ID NO: 2889183 - DNA, 19 bp, Homo sapiens
ctgcagggccatggctcag

SEQ ID NO: 2889184 - DNA, 23 bp, Homo sapiens
ctgcagggccatggctcagggtg

SEQ ID NO: 2889185 - DNA, 19 bp, Homo sapiens
ctgcagggccgcgagaggc

SEQ ID NO: 2889186 - DNA, 20 bp, Homo sapiens
ctgcagggccgcgagaggcc

SEQ ID NO: 2889187 - DNA, 23 bp, Homo sapiens
ctgcagggccgcgagaggccgag

SEQ ID NO: 2889188 - DNA, 23 bp, Homo sapiens
ctgcaggggttgagagctttctg

SEQ ID NO: 2889189 - DNA, 17 bp, Homo sapiens
ctgcaggtgagcagaca

SEQ ID NO: 2889190 - DNA, 20 bp, Homo sapiens
ctgcaggttcttcttcctga

SEQ ID NO: 2889191 - DNA, 13 bp, Homo sapiens
ctgcagtcagccc

SEQ ID NO: 2889192 - DNA, 15 bp, Homo sapiens
ctgcagtcagccctg

SEQ ID NO: 2889193 - DNA, 22 bp, Homo sapiens
ctgcagtcatcttgaccaagca

SEQ ID NO: 2889194 - DNA, 15 bp, Homo sapiens
ctgcagtcgcttgcc

SEQ ID NO: 2889195 - DNA, 22 bp, Homo sapiens
ctgcagtcgcttgccaaagcag

SEQ ID NO: 2889196 - DNA, 9 bp, Homo sapiens
ctgcagtgc

SEQ ID NO: 2889197 - DNA, 11 bp, Homo sapiens
ctgcagtgcca

SEQ ID NO: 2889198 - DNA, 14 bp, Homo sapiens
ctgcagtgccagct

SEQ ID NO: 2889199 - DNA, 18 bp, Homo sapiens
ctgcagtgccagctccct

SEQ ID NO: 2889200 - DNA, 20 bp, Homo sapiens
ctgcataagtgaaaatctta

SEQ ID NO: 2889201 - DNA, 21 bp, Homo sapiens
ctgcatccgtagttccctgaa

SEQ ID NO: 2889202 - DNA, 19 bp, Homo sapiens
ctgcatctaagcatctggg

SEQ ID NO: 2889203 - DNA, 18 bp, Homo sapiens
ctgcatctaagcccatgg

SEQ ID NO: 2889204 - DNA, 16 bp, Homo sapiens
ctgcatctgaccagca

SEQ ID NO: 2889205 - DNA, 18 bp, Homo sapiens
ctgcatctgaccagcagc

SEQ ID NO: 2889206 - DNA, 20 bp, Homo sapiens
ctgcatctgaccagcagcgc

SEQ ID NO: 2889207 - DNA, 21 bp, Homo sapiens
ctgcatctgaccagcagcgcc

SEQ ID NO: 2889208 - DNA, 16 bp, Homo sapiens
ctgcatcttggggaca

SEQ ID NO: 2889209 - DNA, 18 bp, Homo sapiens
ctgcatgtaaaatcttca

SEQ ID NO: 2889210 - DNA, 20 bp, Homo sapiens
ctgcatgtaaaatcttcagc

SEQ ID NO: 2889211 - DNA, 21 bp, Homo sapiens
ctgcatgtaaaatcttcagct

SEQ ID NO: 2889212 - DNA, 21 bp, Homo sapiens
ctgcatgtaaacacgcctgca

SEQ ID NO: 2889213 - DNA, 14 bp, Homo sapiens
ctgcatgtggcttc

SEQ ID NO: 2889214 - DNA, 16 bp, Homo sapiens
ctgcatgtggcttctc

SEQ ID NO: 2889215 - DNA, 24 bp, Homo sapiens
ctgcatgtggcttctctgtctctg

SEQ ID NO: 2889216 - DNA, 22 bp, Homo sapiens
ctgcatgtgtatatatgtcaaa

SEQ ID NO: 2889217 - DNA, 23 bp, Homo sapiens
ctgcatgtgtatatatgtcaaat

SEQ ID NO: 2889218 - DNA, 16 bp, Homo sapiens
ctgcatgtttgctgtt

SEQ ID NO: 2889219 - DNA, 15 bp, Homo sapiens
ctgcattagaaatga

SEQ ID NO: 2889220 - DNA, 13 bp, Homo sapiens
ctgcattcctgta

SEQ ID NO: 2889221 - DNA, 22 bp, Homo sapiens
ctgcattcctgtaacttttaat

SEQ ID NO: 2889222 - DNA, 19 bp, Homo sapiens
ctgcattcctttttcttca

SEQ ID NO: 2889223 - DNA, 14 bp, Homo sapiens
ctgcattcttaaca

SEQ ID NO: 2889224 - DNA, 20 bp, Homo sapiens
ctgcattcttaacaaactct

SEQ ID NO: 2889225 - DNA, 17 bp, Homo sapiens
ctgcattgcccagtctt

SEQ ID NO: 2889226 - DNA, 22 bp, Homo sapiens
ctgcattgccgaagtccagctt

SEQ ID NO: 2889227 - DNA, 19 bp, Homo sapiens
ctgcatttttaaaggacaa

SEQ ID NO: 2889228 - DNA, 23 bp, Homo sapiens
ctgcatttttaaaggacaaacag

SEQ ID NO: 2889229 - DNA, 15 bp, Homo sapiens
ctgcatttttctgca

SEQ ID NO: 2889230 - DNA, 16 bp, Homo sapiens
ctgccaaaatgctcta

SEQ ID NO: 2889231 - DNA, 22 bp, Homo sapiens
ctgccaaaatgctctagtgcct

SEQ ID NO: 2889232 - DNA, 22 bp, Homo sapiens
ctcctgccagcccggctcggcc

SEQ ID NO: 2889233 - DNA, 12 bp, Homo sapiens
ctcctgccagct

SEQ ID NO: 2889234 - DNA, 15 bp, Homo sapiens
ctcctgcccagccac

SEQ ID NO: 2889235 - DNA, 14 bp, Homo sapiens
ctcctgcccaggag

SEQ ID NO: 2889236 - DNA, 15 bp, Homo sapiens
ctcctgcccaggaga

SEQ ID NO: 2889237 - DNA, 17 bp, Homo sapiens
ctcctgcccaggagagc

SEQ ID NO: 2889238 - DNA, 20 bp, Homo sapiens
ctcctgcccaggagagccag

SEQ ID NO: 2889239 - DNA, 20 bp, Homo sapiens
ctcctgcccgcagacctctg

SEQ ID NO: 2889240 - DNA, 14 bp, Homo sapiens
ctcctgcctcagcc

SEQ ID NO: 2889241 - DNA, 15 bp, Homo sapiens
ctcctgcctcagcct

SEQ ID NO: 2889242 - DNA, 16 bp, Homo sapiens
ctcctgcctcagcctc

SEQ ID NO: 2889243 - DNA, 21 bp, Homo sapiens
ctcctgcctcagcctcctgag

SEQ ID NO: 2889244 - DNA, 16 bp, Homo sapiens
ctcctgcctcagcctt

SEQ ID NO: 2889245 - DNA, 17 bp, Homo sapiens
ctcctgcctcagccttc

SEQ ID NO: 2889246 - DNA, 15 bp, Homo sapiens
ctcctgcctcctcag

SEQ ID NO: 2889247 - DNA, 20 bp, Homo sapiens
ctcctgccttcctcctgggc

SEQ ID NO: 2889248 - DNA, 18 bp, Homo sapiens
ctcctgctactctgttcc

SEQ ID NO: 2889249 - DNA, 14 bp, Homo sapiens
ctcctgctctgcac

SEQ ID NO: 2889250 - DNA, 17 bp, Homo sapiens
ctcctgctgtctacctc

SEQ ID NO: 2889251 - DNA, 18 bp, Homo sapiens
ctcctggacattttttca

SEQ ID NO: 2889252 - DNA, 17 bp, Homo sapiens
ctcctggaccttgacag

SEQ ID NO: 2889253 - DNA, 21 bp, Homo sapiens
ctcctggaccttgacagagca

SEQ ID NO: 2889254 - DNA, 22 bp, Homo sapiens
ctcctggaccttgacagagcag

SEQ ID NO: 2889255 - DNA, 22 bp, Homo sapiens
ctcctggactggttatcttgtt

SEQ ID NO: 2889256 - DNA, 20 bp, Homo sapiens
ctcctggagcagaaagtgcc

SEQ ID NO: 2889257 - DNA, 21 bp, Homo sapiens
ctcctggagcagaaagtgcct

SEQ ID NO: 2889258 - DNA, 17 bp, Homo sapiens
ctcctggagctctgtgg

SEQ ID NO: 2889259 - DNA, 17 bp, Homo sapiens
ctcctggagggcgccca

SEQ ID NO: 2889260 - DNA, 18 bp, Homo sapiens
ctcctggagggcgcccag

SEQ ID NO: 2889261 - DNA, 19 bp, Homo sapiens
ctcctggagggcgcccagc

SEQ ID NO: 2889262 - DNA, 22 bp, Homo sapiens
ctcctggagggcgcccagcagc

SEQ ID NO: 2889263 - DNA, 14 bp, Homo sapiens
ctcctggcctcaga

SEQ ID NO: 2889264 - DNA, 15 bp, Homo sapiens
ctcctggctcaggcc

SEQ ID NO: 2889265 - DNA, 19 bp, Homo sapiens
ctcctggctcaggcccagc

SEQ ID NO: 2889266 - DNA, 15 bp, Homo sapiens
ctcctgggccctctc

SEQ ID NO: 2889267 - DNA, 17 bp, Homo sapiens
ctcctgggccctctctg

SEQ ID NO: 2889268 - DNA, 20 bp, Homo sapiens
ctcctggggagaaagagggg

SEQ ID NO: 2889269 - DNA, 21 bp, Homo sapiens
ctcctggggagaaagaggggc

SEQ ID NO: 2889270 - DNA, 23 bp, Homo sapiens
ctcctggggagaaagaggggcct

SEQ ID NO: 2889271 - DNA, 22 bp, Homo sapiens
ctcctggggccaggccgggcct

SEQ ID NO: 2889272 - DNA, 17 bp, Homo sapiens
ctggttggcatttgctg

SEQ ID NO: 2889273 - DNA, 18 bp, Homo sapiens
ctggttgtcacctatgag

SEQ ID NO: 2889274 - DNA, 13 bp, Homo sapiens
ctggtttcctgcc

SEQ ID NO: 2889275 - DNA, 21 bp, Homo sapiens
ctggtttcctgcccagcctgg

SEQ ID NO: 2889276 - DNA, 13 bp, Homo sapiens
ctggtttgttctg

SEQ ID NO: 2889277 - DNA, 17 bp, Homo sapiens
ctggtttgttctgactt

SEQ ID NO: 2889278 - DNA, 22 bp, Homo sapiens
ctggttttcgtcatcttccctg

SEQ ID NO: 2889279 - DNA, 13 bp, Homo sapiens
ctgtaaaagtgtc

SEQ ID NO: 2889280 - DNA, 14 bp, Homo sapiens
ctgtaaagaaagag

SEQ ID NO: 2889281 - DNA, 19 bp, Homo sapiens
ctgtaaagaaagagagaaa

SEQ ID NO: 2889282 - DNA, 22 bp, Homo sapiens
ctgtaaagaaagagagaaaata

SEQ ID NO: 2889283 - DNA, 13 bp, Homo sapiens
ctgtaaatacatc

SEQ ID NO: 2889284 - DNA, 21 bp, Homo sapiens
ctgtaaatacatcctttttct

SEQ ID NO: 2889285 - DNA, 14 bp, Homo sapiens
ctgtaaatatgttt

SEQ ID NO: 2889286 - DNA, 20 bp, Homo sapiens
ctgtaaatgtcctgaatcca

SEQ ID NO: 2889287 - DNA, 12 bp, Homo sapiens
ctgtaaatgtga

SEQ ID NO: 2889288 - DNA, 16 bp, Homo sapiens
ctgtaacaagccagat

SEQ ID NO: 2889289 - DNA, 19 bp, Homo sapiens
ctgtaacctcttcagaggc

SEQ ID NO: 2889290 - DNA, 20 bp, Homo sapiens
ctgtaacctcttcagaggcc

SEQ ID NO: 2889291 - DNA, 15 bp, Homo sapiens
ctgtaagaaaatgct

SEQ ID NO: 2889292 - DNA, 19 bp, Homo sapiens
ctgtaagaataatttatag

SEQ ID NO: 2889293 - DNA, 14 bp, Homo sapiens
ctgtaaggctctag

SEQ ID NO: 2889294 - DNA, 20 bp, Homo sapiens
ctgtaaggctctagatcata

SEQ ID NO: 2889295 - DNA, 22 bp, Homo sapiens
ctgtaaggctctagatcataag

SEQ ID NO: 2889296 - DNA, 22 bp, Homo sapiens
ctgtaaggggcagcagttgagg

SEQ ID NO: 2889297 - DNA, 19 bp, Homo sapiens
ctgtaatcccagctactca

SEQ ID NO: 2889298 - DNA, 19 bp, Homo sapiens
ctgtaatgttaaactcttt

SEQ ID NO: 2889299 - DNA, 23 bp, Homo sapiens
ctgtaatttttattttcaccctc

SEQ ID NO: 2889300 - DNA, 14 bp, Homo sapiens
ctgtacaaaatggt

SEQ ID NO: 2889301 - DNA, 13 bp, Homo sapiens
ctgtacagtctgt

SEQ ID NO: 2889302 - DNA, 14 bp, Homo sapiens
ctgtacagtctgtc

SEQ ID NO: 2889303 - DNA, 15 bp, Homo sapiens
ctgtacagtctgtct

SEQ ID NO: 2889304 - DNA, 19 bp, Homo sapiens
ctgtacagtctgtcttctg

SEQ ID NO: 2889305 - DNA, 13 bp, Homo sapiens
ctgtacagttttg

SEQ ID NO: 2889306 - DNA, 17 bp, Homo sapiens
ctgtacagttttgtgga

SEQ ID NO: 2889307 - DNA, 21 bp, Homo sapiens
ctgtacagttttgtggactga

SEQ ID NO: 2889308 - DNA, 21 bp, Homo sapiens
ctgtacatgacatcaaaatga

SEQ ID NO: 2889309 - DNA, 15 bp, Homo sapiens
ctgtacctgttcctc

SEQ ID NO: 2889310 - DNA, 21 bp, Homo sapiens
ctgtacctgttccttagacct

SEQ ID NO: 2889311 - DNA, 15 bp, Homo sapiens
ctgtactcttagatg

SEQ ID NO: 2889312 - DNA, 19 bp, Homo sapiens
ctgtactgttactgggccc

SEQ ID NO: 2889313 - DNA, 22 bp, Homo sapiens
ctgtactgttactgggccctga

SEQ ID NO: 2889314 - DNA, 20 bp, Homo sapiens
ctgtagaatagcctgtggcc

SEQ ID NO: 2889315 - DNA, 14 bp, Homo sapiens
ctgtagagacttcc

SEQ ID NO: 2889316 - DNA, 18 bp, Homo sapiens
ctgtagagacttccgtca

SEQ ID NO: 2889317 - DNA, 19 bp, Homo sapiens
ctgtagatgcagaaaaaga

SEQ ID NO: 2889318 - DNA, 22 bp, Homo sapiens
ctgtagatgcagaaaaagaaaa

SEQ ID NO: 2889319 - DNA, 18 bp, Homo sapiens
ctgtagccccagtgacag

SEQ ID NO: 2889320 - DNA, 21 bp, Homo sapiens
ctgtagccccagtgacagcta

SEQ ID NO: 2889321 - DNA, 19 bp, Homo sapiens
ctgtaggatctaaggctgt

SEQ ID NO: 2889322 - DNA, 15 bp, Homo sapiens
ctgtaggcagaggct

SEQ ID NO: 2889323 - DNA, 23 bp, Homo sapiens
ctgtagggaaaaaaatgcttctt

SEQ ID NO: 2889324 - DNA, 18 bp, Homo sapiens
ctgtagtaaactatttat

SEQ ID NO: 2889325 - DNA, 19 bp, Homo sapiens
ctgtagtaaactatttatc

SEQ ID NO: 2889326 - DNA, 22 bp, Homo sapiens
ctgtagtgagatagcattgtga

SEQ ID NO: 2889327 - DNA, 16 bp, Homo sapiens
ctgtagttctaagact

SEQ ID NO: 2889328 - DNA, 17 bp, Homo sapiens
ctgtataaatgtctatt

SEQ ID NO: 2889329 - DNA, 19 bp, Homo sapiens
ctgtataaatgtctattat

SEQ ID NO: 2889330 - DNA, 18 bp, Homo sapiens
ctgtataaccctgttaca

SEQ ID NO: 2889331 - DNA, 20 bp, Homo sapiens
ctgtataagtagatctgctt

SEQ ID NO: 2889332 - DNA, 22 bp, Homo sapiens
ctgtataagtagatctgctttc

SEQ ID NO: 2889333 - DNA, 22 bp, Homo sapiens
ctgtatataaacgtgtcccgag

SEQ ID NO: 2889334 - DNA, 14 bp, Homo sapiens
ctgtatatactttt

SEQ ID NO: 2889335 - DNA, 20 bp, Homo sapiens
ctgtatatgattctctgtgg

SEQ ID NO: 2889336 - DNA, 22 bp, Homo sapiens
ctgtatatgattctctgtggtt

SEQ ID NO: 2889337 - DNA, 18 bp, Homo sapiens
ctgtatattgggctcaga

SEQ ID NO: 2889338 - DNA, 20 bp, Homo sapiens
ctgtatcctccctggcagac

SEQ ID NO: 2889339 - DNA, 22 bp, Homo sapiens
ctgtatgaatattttatattaa

SEQ ID NO: 2889340 - DNA, 15 bp, Homo sapiens
ctgtatgatttgttt

SEQ ID NO: 2889341 - DNA, 15 bp, Homo sapiens
ctgtatgctgatcat

SEQ ID NO: 2889342 - DNA, 22 bp, Homo sapiens
ctgtatgctgatcatcgccaga

SEQ ID NO: 2889343 - DNA, 13 bp, Homo sapiens
ctgtatgttgtcc

SEQ ID NO: 2889344 - DNA, 15 bp, Homo sapiens
ctgtattaagccact

SEQ ID NO: 2889345 - DNA, 22 bp, Homo sapiens
ctgtattcatgaatcttgagag

SEQ ID NO: 2889346 - DNA, 12 bp, Homo sapiens
ctgtattgaatc

SEQ ID NO: 2889347 - DNA, 20 bp, Homo sapiens
ctgtattgaatcatgtagta

SEQ ID NO: 2889348 - DNA, 21 bp, Homo sapiens
ctgtattgaatcatgtagtat

SEQ ID NO: 2889349 - DNA, 17 bp, Homo sapiens
ctgtatttaaaaataga

SEQ ID NO: 2889350 - DNA, 21 bp, Homo sapiens
ctgccaatctgtacaaaatgg

SEQ ID NO: 2889351 - DNA, 18 bp, Homo sapiens
ctgccaccaaatctgtct

SEQ ID NO: 2889352 - DNA, 16 bp, Homo sapiens
ctgccaccagcatcca

SEQ ID NO: 2889353 - DNA, 14 bp, Homo sapiens
ctgccacccacctc

SEQ ID NO: 2889354 - DNA, 15 bp, Homo sapiens
ctgccacccacctcc

SEQ ID NO: 2889355 - DNA, 22 bp, Homo sapiens
ctgccacccacctccctgcctc

SEQ ID NO: 2889356 - DNA, 21 bp, Homo sapiens
ctgccaccctgccccttgcca

SEQ ID NO: 2889357 - DNA, 16 bp, Homo sapiens
ctgccaccgactgccc

SEQ ID NO: 2889358 - DNA, 11 bp, Homo sapiens
ctgccacctcc

SEQ ID NO: 2889359 - DNA, 12 bp, Homo sapiens
ctgccacctccc

SEQ ID NO: 2889360 - DNA, 21 bp, Homo sapiens
ctgccacgtgccttaggaata

SEQ ID NO: 2889361 - DNA, 19 bp, Homo sapiens
ctgccactcacccttcctg

SEQ ID NO: 2889362 - DNA, 20 bp, Homo sapiens
ctgccactcacccttcctgg

SEQ ID NO: 2889363 - DNA, 21 bp, Homo sapiens
ctgccactcacccttcctggc

SEQ ID NO: 2889364 - DNA, 14 bp, Homo sapiens
ctgccagagaaagt

SEQ ID NO: 2889365 - DNA, 14 bp, Homo sapiens
ctgccagatgctga

SEQ ID NO: 2889366 - DNA, 16 bp, Homo sapiens
ctgccagatgctgatg

SEQ ID NO: 2889367 - DNA, 20 bp, Homo sapiens
ctgccagcatttcccttcct

SEQ ID NO: 2889368 - DNA, 23 bp, Homo sapiens
ctgccagcccggctcggcccagc

SEQ ID NO: 2889369 - DNA, 14 bp, Homo sapiens
ctgccagctctgtc

SEQ ID NO: 2889370 - DNA, 23 bp, Homo sapiens
ctgccagctctgtcaccctggcc

SEQ ID NO: 2889371 - DNA, 16 bp, Homo sapiens
ctgccagctgcactga

SEQ ID NO: 2889372 - DNA, 11 bp, Homo sapiens
ctgccaggaga

SEQ ID NO: 2889373 - DNA, 16 bp, Homo sapiens
ctgccaggagacaggt

SEQ ID NO: 2889374 - DNA, 21 bp, Homo sapiens
ctgccaggcccccaagcctgc

SEQ ID NO: 2889375 - DNA, 20 bp, Homo sapiens
ctgccaggcccccaccacac

SEQ ID NO: 2889376 - DNA, 21 bp, Homo sapiens
ctgccaggcccccaccacaca

SEQ ID NO: 2889377 - DNA, 16 bp, Homo sapiens
ctgccagggcagggcc

SEQ ID NO: 2889378 - DNA, 14 bp, Homo sapiens
ctgccagggcttcc

SEQ ID NO: 2889379 - DNA, 22 bp, Homo sapiens
ctgccagtcgggagagccaggc

SEQ ID NO: 2889380 - DNA, 12 bp, Homo sapiens
ctgccagtgcct

SEQ ID NO: 2889381 - DNA, 13 bp, Homo sapiens
ctgccatccccct

SEQ ID NO: 2889382 - DNA, 14 bp, Homo sapiens
ctgccatccccctc

SEQ ID NO: 2889383 - DNA, 16 bp, Homo sapiens
ctgccatccccctctc

SEQ ID NO: 2889384 - DNA, 19 bp, Homo sapiens
ctgccatcttagtttggat

SEQ ID NO: 2889385 - DNA, 21 bp, Homo sapiens
ctgccatcttctccccgaggc

SEQ ID NO: 2889386 - DNA, 21 bp, Homo sapiens
ctgccatgcaccaggactggc

SEQ ID NO: 2889387 - DNA, 17 bp, Homo sapiens
ctgccattacccagtgc

SEQ ID NO: 2889388 - DNA, 20 bp, Homo sapiens
ctgcccaacccttccctcac

SEQ ID NO: 2889389 - DNA, 22 bp, Homo sapiens
ctgcccaagtgaccagggaagt

SEQ ID NO: 2889390 - DNA, 21 bp, Homo sapiens
ctgcccacctcagcctcccaa

SEQ ID NO: 2889391 - DNA, 14 bp, Homo sapiens
ctgcccacctctct

SEQ ID NO: 2889392 - DNA, 13 bp, Homo sapiens
ctgcccacctgcc

SEQ ID NO: 2889393 - DNA, 15 bp, Homo sapiens
ctgcccacctgcctg

SEQ ID NO: 2889394 - DNA, 17 bp, Homo sapiens
ctgcccacctgcctggc

SEQ ID NO: 2889395 - DNA, 20 bp, Homo sapiens
ctgcccacctgcctggccgg

SEQ ID NO: 2889396 - DNA, 16 bp, Homo sapiens
ctgcccactgctgcag

SEQ ID NO: 2889397 - DNA, 13 bp, Homo sapiens
ctgcccagccact

SEQ ID NO: 2889398 - DNA, 13 bp, Homo sapiens
ctgcccagcctca

SEQ ID NO: 2889399 - DNA, 16 bp, Homo sapiens
ctgcccagcctcaatg

SEQ ID NO: 2889400 - DNA, 11 bp, Homo sapiens
ctgcccaggag

SEQ ID NO: 2889401 - DNA, 19 bp, Homo sapiens
ctgcccaggagagccagcc

SEQ ID NO: 2889402 - DNA, 23 bp, Homo sapiens
ctgcccaggagagccagccctcc

SEQ ID NO: 2889403 - DNA, 22 bp, Homo sapiens
ctgcccagggtcagtgtatcta

SEQ ID NO: 2889404 - DNA, 15 bp, Homo sapiens
ctgcccaggtggggt

SEQ ID NO: 2889405 - DNA, 19 bp, Homo sapiens
ctgcccatgagcaagccta

SEQ ID NO: 2889406 - DNA, 19 bp, Homo sapiens
ctgcccattctgccctgtg

SEQ ID NO: 2889407 - DNA, 23 bp, Homo sapiens
ctgcccattctgccctgtgggac

SEQ ID NO: 2889408 - DNA, 22 bp, Homo sapiens
ctgcccatttcgtgagccccat

SEQ ID NO: 2889409 - DNA, 14 bp, Homo sapiens
ctgccccaactcct

SEQ ID NO: 2889410 - DNA, 20 bp, Homo sapiens
ctgccccaactcctggaagc

SEQ ID NO: 2889411 - DNA, 23 bp, Homo sapiens
ctgccccacccctccccattagc

SEQ ID NO: 2889412 - DNA, 11 bp, Homo sapiens
ctgccccagcc

SEQ ID NO: 2889413 - DNA, 13 bp, Homo sapiens
ctgccccagccaa

SEQ ID NO: 2889414 - DNA, 14 bp, Homo sapiens
ctgccccagccaga

SEQ ID NO: 2889415 - DNA, 19 bp, Homo sapiens
ctgccccaggccggagccc

SEQ ID NO: 2889416 - DNA, 21 bp, Homo sapiens
ctgccccatcctccagcaggg

SEQ ID NO: 2889417 - DNA, 16 bp, Homo sapiens
ctgccccatctgggga

SEQ ID NO: 2889418 - DNA, 16 bp, Homo sapiens
ctgccccatgaagcca

SEQ ID NO: 2889419 - DNA, 14 bp, Homo sapiens
ctgccccccagggc

SEQ ID NO: 2889420 - DNA, 15 bp, Homo sapiens
ctgccccccagggct

SEQ ID NO: 2889421 - DNA, 19 bp, Homo sapiens
ctgccccccagggctagtg

SEQ ID NO: 2889422 - DNA, 13 bp, Homo sapiens
ctgccccctcagg

SEQ ID NO: 2889423 - DNA, 21 bp, Homo sapiens
ctgcccctaaagatgggagga

SEQ ID NO: 2889424 - DNA, 11 bp, Homo sapiens
ctgcccctccc

SEQ ID NO: 2889425 - DNA, 14 bp, Homo sapiens
ctgcccctccctgc

SEQ ID NO: 2889426 - DNA, 19 bp, Homo sapiens
ctgcccctccctgcctcca

SEQ ID NO: 2889427 - DNA, 12 bp, Homo sapiens
ctgcccctcctg

SEQ ID NO: 2889428 - DNA, 13 bp, Homo sapiens
ctgcccctcctgg

SEQ ID NO: 2889429 - DNA, 14 bp, Homo sapiens
ctgcccctcctgga

SEQ ID NO: 2889430 - DNA, 13 bp, Homo sapiens
ctgcccctctctg

SEQ ID NO: 2889431 - DNA, 16 bp, Homo sapiens
ctgcccgcaccctggc

SEQ ID NO: 2889432 - DNA, 21 bp, Homo sapiens
ctgcccgcaccctggcctggt

SEQ ID NO: 2889433 - DNA, 17 bp, Homo sapiens
ctgcccgcagacctctg

SEQ ID NO: 2889434 - DNA, 22 bp, Homo sapiens
ctgcccgccacatggtgtggcc

SEQ ID NO: 2889435 - DNA, 13 bp, Homo sapiens
ctgcccgcctgcc

SEQ ID NO: 2889436 - DNA, 15 bp, Homo sapiens
ctgcccgcctgccca

SEQ ID NO: 2889437 - DNA, 20 bp, Homo sapiens
ctgcccgcctgcccacctgc

SEQ ID NO: 2889438 - DNA, 22 bp, Homo sapiens
ctgcccgcctgcccacctgcct

SEQ ID NO: 2889439 - DNA, 15 bp, Homo sapiens
ctgcccggcgcctgc

SEQ ID NO: 2889440 - DNA, 18 bp, Homo sapiens
ctgcccggctacatcagc

SEQ ID NO: 2889441 - DNA, 18 bp, Homo sapiens
ctgcccgtaaacacgcct

SEQ ID NO: 2889442 - DNA, 19 bp, Homo sapiens
ctgcccgtaaacacgcctg

SEQ ID NO: 2889443 - DNA, 21 bp, Homo sapiens
ctgcccgtaaacacgcctgca

SEQ ID NO: 2889444 - DNA, 14 bp, Homo sapiens
ctgccctcccctct

SEQ ID NO: 2889445 - DNA, 16 bp, Homo sapiens
ctgccctcccgcacct

SEQ ID NO: 2889446 - DNA, 18 bp, Homo sapiens
ctgccctccctcagccgt

SEQ ID NO: 2889447 - DNA, 11 bp, Homo sapiens
ctgccctcctc

SEQ ID NO: 2889448 - DNA, 16 bp, Homo sapiens
ctgccctctgctgctg

SEQ ID NO: 2889449 - DNA, 18 bp, Homo sapiens
ctgccctctgctgctgcc

SEQ ID NO: 2889450 - DNA, 13 bp, Homo sapiens
ctgccctgagggg

SEQ ID NO: 2889451 - DNA, 12 bp, Homo sapiens
ctgccctgccca

SEQ ID NO: 2889452 - DNA, 16 bp, Homo sapiens
ctgccctgcccaagtg

SEQ ID NO: 2889453 - DNA, 11 bp, Homo sapiens
ctgccctgcta

SEQ ID NO: 2889454 - DNA, 20 bp, Homo sapiens
ctgccctgctatttcaggcc

SEQ ID NO: 2889455 - DNA, 14 bp, Homo sapiens
ctgccctgctccta

SEQ ID NO: 2889456 - DNA, 16 bp, Homo sapiens
ctgccctgggtcctgc

SEQ ID NO: 2889457 - DNA, 20 bp, Homo sapiens
ctgccctgggtcctgcctgc

SEQ ID NO: 2889458 - DNA, 17 bp, Homo sapiens
ctgccctgtgccgcact

SEQ ID NO: 2889459 - DNA, 11 bp, Homo sapiens
ctgccctgtgg

SEQ ID NO: 2889460 - DNA, 22 bp, Homo sapiens
ctgccctgtgggaccccaggcc

SEQ ID NO: 2889461 - DNA, 18 bp, Homo sapiens
ctgcccttccgcagtgtg

SEQ ID NO: 2889462 - DNA, 12 bp, Homo sapiens
ctgcccttgggc

SEQ ID NO: 2889463 - DNA, 20 bp, Homo sapiens
ctgcccttggtttctggggg

SEQ ID NO: 2889464 - DNA, 14 bp, Homo sapiens
ctgcccttttcctg

SEQ ID NO: 2889465 - DNA, 20 bp, Homo sapiens
ctgcccttttcctgggcctt

SEQ ID NO: 2889466 - DNA, 16 bp, Homo sapiens
ctgccgagacagaccc

SEQ ID NO: 2889467 - DNA, 17 bp, Homo sapiens
ctgccgcaccccagagt

SEQ ID NO: 2889468 - DNA, 20 bp, Homo sapiens
ctgccgccgcccgctgggga

SEQ ID NO: 2889469 - DNA, 15 bp, Homo sapiens
ctgccggacacagca

SEQ ID NO: 2889470 - DNA, 22 bp, Homo sapiens
ctgccggacacagcaccgtgcc

SEQ ID NO: 2889471 - DNA, 17 bp, Homo sapiens
ctgccggagaggaagag

SEQ ID NO: 2889472 - DNA, 15 bp, Homo sapiens
ctgccggccctgggg

SEQ ID NO: 2889473 - DNA, 21 bp, Homo sapiens
ctgccggtaaacacgcctgca

SEQ ID NO: 2889474 - DNA, 15 bp, Homo sapiens
ctgccgtctctggag

SEQ ID NO: 2889475 - DNA, 15 bp, Homo sapiens
ctgcctaagacatgt

SEQ ID NO: 2889476 - DNA, 15 bp, Homo sapiens
ctgcctaaggaagct

SEQ ID NO: 2889477 - DNA, 19 bp, Homo sapiens
ctgcctaaggccctttgtg

SEQ ID NO: 2889478 - DNA, 16 bp, Homo sapiens
ctgcctaagtggctgc

SEQ ID NO: 2889479 - DNA, 20 bp, Homo sapiens
ctgcctaagtggctgctgac

SEQ ID NO: 2889480 - DNA, 23 bp, Homo sapiens
ctgcctagctcttgggcctgacc

SEQ ID NO: 2889481 - DNA, 11 bp, Homo sapiens
ctgcctataaa

SEQ ID NO: 2889482 - DNA, 24 bp, Homo sapiens
ctgcctcaatgtgaatcagaccct

SEQ ID NO: 2889483 - DNA, 16 bp, Homo sapiens
ctgcctcacatctccc

SEQ ID NO: 2889484 - DNA, 19 bp, Homo sapiens
ctgcctcacatctcccttc

SEQ ID NO: 2889485 - DNA, 14 bp, Homo sapiens
ctgcctcagcctcc

SEQ ID NO: 2889486 - DNA, 23 bp, Homo sapiens
ctgcctcagcctccccagtagct

SEQ ID NO: 2889487 - DNA, 12 bp, Homo sapiens
ctgcctcagctc

SEQ ID NO: 2889488 - DNA, 16 bp, Homo sapiens
ctgcctcagctcagct

SEQ ID NO: 2889489 - DNA, 10 bp, Homo sapiens
ctgcctcagg

SEQ ID NO: 2889490 - DNA, 15 bp, Homo sapiens
ctgcctcaggcactc

SEQ ID NO: 2889491 - DNA, 17 bp, Homo sapiens
ctgcctcaggcactctc

SEQ ID NO: 2889492 - DNA, 12 bp, Homo sapiens
ctgcctcatcct

SEQ ID NO: 2889493 - DNA, 20 bp, Homo sapiens
ctgcctcatcctcctcctca

SEQ ID NO: 2889494 - DNA, 15 bp, Homo sapiens
ctgcctccagctgtc

SEQ ID NO: 2889495 - DNA, 17 bp, Homo sapiens
ctgcctccagctgtcag

SEQ ID NO: 2889496 - DNA, 18 bp, Homo sapiens
ctgcctccagctgtcagc

SEQ ID NO: 2889497 - DNA, 13 bp, Homo sapiens
ctgcctcccccga

SEQ ID NO: 2889498 - DNA, 17 bp, Homo sapiens
ctgcctccctctcttcc

SEQ ID NO: 2889499 - DNA, 19 bp, Homo sapiens
ctgcctccctctcttccgg

SEQ ID NO: 2889500 - DNA, 15 bp, Homo sapiens
ctgcctcctcagctt

SEQ ID NO: 2889501 - DNA, 23 bp, Homo sapiens
ctgcctcctcagctttgcttcat

SEQ ID NO: 2889502 - DNA, 12 bp, Homo sapiens
ctgcctcctccc

SEQ ID NO: 2889503 - DNA, 15 bp, Homo sapiens
ctgcctcctccctgg

SEQ ID NO: 2889504 - DNA, 12 bp, Homo sapiens
ctgcctcctggc

SEQ ID NO: 2889505 - DNA, 15 bp, Homo sapiens
ctgcctccttgccag

SEQ ID NO: 2889506 - DNA, 15 bp, Homo sapiens
ctgcctcgaaacaca

SEQ ID NO: 2889507 - DNA, 18 bp, Homo sapiens
ctgcctcgaaacacagaa

SEQ ID NO: 2889508 - DNA, 16 bp, Homo sapiens
ctgcctcgagggccgc

SEQ ID NO: 2889509 - DNA, 19 bp, Homo sapiens
ctgcctcgagggccgcctg

SEQ ID NO: 2889510 - DNA, 22 bp, Homo sapiens
ctgcctcgagggccgcctgcct

SEQ ID NO: 2889511 - DNA, 18 bp, Homo sapiens
ctgcctcgcccccacttt

SEQ ID NO: 2889512 - DNA, 19 bp, Homo sapiens
ctgcctcggttgattgtgc

SEQ ID NO: 2889513 - DNA, 21 bp, Homo sapiens
ctgcctcggttgattgtgcat

SEQ ID NO: 2889514 - DNA, 14 bp, Homo sapiens
ctgcctctaactcc

SEQ ID NO: 2889515 - DNA, 17 bp, Homo sapiens
ctgcctctaactccctc

SEQ ID NO: 2889516 - DNA, 19 bp, Homo sapiens
ctgcctctgacagcagcct

SEQ ID NO: 2889517 - DNA, 22 bp, Homo sapiens
ctgcctcttctgggagggcagc

SEQ ID NO: 2889518 - DNA, 18 bp, Homo sapiens
ctgcctgaataaagagcc

SEQ ID NO: 2889519 - DNA, 20 bp, Homo sapiens
ctgcctgacatttggagtgt

SEQ ID NO: 2889520 - DNA, 16 bp, Homo sapiens
ctgcctgagtattact

SEQ ID NO: 2889521 - DNA, 13 bp, Homo sapiens
ctgcctgcactcc

SEQ ID NO: 2889522 - DNA, 21 bp, Homo sapiens
ctgcctgcactccctggcctt

SEQ ID NO: 2889523 - DNA, 23 bp, Homo sapiens
ctgcctgcactccctggccttgc

SEQ ID NO: 2889524 - DNA, 12 bp, Homo sapiens
ctgcctgcagca

SEQ ID NO: 2889525 - DNA, 13 bp, Homo sapiens
ctgcctgcagcac

SEQ ID NO: 2889526 - DNA, 17 bp, Homo sapiens
ctgcctgcagcacatgc

SEQ ID NO: 2889527 - DNA, 18 bp, Homo sapiens
ctgcctgcagcacatgcg

SEQ ID NO: 2889528 - DNA, 23 bp, Homo sapiens
ctgcctgcagtattacagaggtc

SEQ ID NO: 2889529 - DNA, 16 bp, Homo sapiens
ctgcctgccagctgca

SEQ ID NO: 2889530 - DNA, 20 bp, Homo sapiens
ctgcctgccagctgcactga

SEQ ID NO: 2889531 - DNA, 14 bp, Homo sapiens
ctgcctgctgggct

SEQ ID NO: 2889532 - DNA, 16 bp, Homo sapiens
ctgcctgctgggctct

SEQ ID NO: 2889533 - DNA, 14 bp, Homo sapiens
ctgcctgctgtgga

SEQ ID NO: 2889534 - DNA, 18 bp, Homo sapiens
ctgcctggaacaccagca

SEQ ID NO: 2889535 - DNA, 20 bp, Homo sapiens
ctgcctggattccatttatg

SEQ ID NO: 2889536 - DNA, 11 bp, Homo sapiens
ctgcctggcca

SEQ ID NO: 2889537 - DNA, 15 bp, Homo sapiens
ctgcctggccaggcc

SEQ ID NO: 2889538 - DNA, 22 bp, Homo sapiens
ctgcctggccaggccctgggtc

SEQ ID NO: 2889539 - DNA, 12 bp, Homo sapiens
ctgcctggccat

SEQ ID NO: 2889540 - DNA, 13 bp, Homo sapiens
ctgcctggccatg

SEQ ID NO: 2889541 - DNA, 17 bp, Homo sapiens
ctgcctggccggccagc

SEQ ID NO: 2889542 - DNA, 22 bp, Homo sapiens
ctgcctggccggccagccagcc

SEQ ID NO: 2889543 - DNA, 14 bp, Homo sapiens
ctgcctgggtaggc

SEQ ID NO: 2889544 - DNA, 17 bp, Homo sapiens
ctgcctgggtaggcccc

SEQ ID NO: 2889545 - DNA, 19 bp, Homo sapiens
ctgcctgggtaggccccac

SEQ ID NO: 2889546 - DNA, 22 bp, Homo sapiens
ctgcctgggtaggccccacaag

SEQ ID NO: 2889547 - DNA, 18 bp, Homo sapiens
ctgcctgtacagaagaaa

SEQ ID NO: 2889548 - DNA, 20 bp, Homo sapiens
ctgcctgtagcccactctgc

SEQ ID NO: 2889549 - DNA, 22 bp, Homo sapiens
ctgcctgtagcccactctgctc

SEQ ID NO: 2889550 - DNA, 23 bp, Homo sapiens
ctgcctgtagcccactctgctcg

SEQ ID NO: 2889551 - DNA, 17 bp, Homo sapiens
ctgcctgtcctagtctc

SEQ ID NO: 2889552 - DNA, 21 bp, Homo sapiens
ctgcctgtcctagtctccttt

SEQ ID NO: 2889553 - DNA, 15 bp, Homo sapiens
ctgcctgtctccatg

SEQ ID NO: 2889554 - DNA, 20 bp, Homo sapiens
ctgccttacccgccatacat

SEQ ID NO: 2889555 - DNA, 18 bp, Homo sapiens
ctgccttagcctaccatg

SEQ ID NO: 2889556 - DNA, 23 bp, Homo sapiens
ctgccttattacataactgatct

SEQ ID NO: 2889557 - DNA, 21 bp, Homo sapiens
ctgccttcactgtgctccaac

SEQ ID NO: 2889558 - DNA, 13 bp, Homo sapiens
ctgccttccagcc

SEQ ID NO: 2889559 - DNA, 17 bp, Homo sapiens
ctgccttccagcccaga

SEQ ID NO: 2889560 - DNA, 14 bp, Homo sapiens
ctgccttctcaggg

SEQ ID NO: 2889561 - DNA, 23 bp, Homo sapiens
ctgccttgaaatacctgtttctt

SEQ ID NO: 2889562 - DNA, 12 bp, Homo sapiens
ctgccttgcctt

SEQ ID NO: 2889563 - DNA, 18 bp, Homo sapiens
ctgcctttgatcacagga

SEQ ID NO: 2889564 - DNA, 20 bp, Homo sapiens
ctgcctttgcctccagaagc

SEQ ID NO: 2889565 - DNA, 18 bp, Homo sapiens
ctgcctttggcagagttc

SEQ ID NO: 2889566 - DNA, 12 bp, Homo sapiens
ctgcgcagggtg

SEQ ID NO: 2889567 - DNA, 23 bp, Homo sapiens
ctgcgcagggtggtggtattctg

SEQ ID NO: 2889568 - DNA, 18 bp, Homo sapiens
ctgcgcatgttttcttca

SEQ ID NO: 2889569 - DNA, 15 bp, Homo sapiens
ctgcgccaggcagag

SEQ ID NO: 2889570 - DNA, 23 bp, Homo sapiens
ctgcgccaggcagagctgagggc

SEQ ID NO: 2889571 - DNA, 20 bp, Homo sapiens
ctgcgccccgcctgacctgg

SEQ ID NO: 2889572 - DNA, 13 bp, Homo sapiens
ctgcgcctcaggc

SEQ ID NO: 2889573 - DNA, 18 bp, Homo sapiens
ctgcgctcggcaggaagg

SEQ ID NO: 2889574 - DNA, 21 bp, Homo sapiens
ctgcgctcggcaggaaggagc

SEQ ID NO: 2889575 - DNA, 21 bp, Homo sapiens
ctgcgcttcctgagcagtccc

SEQ ID NO: 2889576 - DNA, 20 bp, Homo sapiens
ctgcgctttgaacgtgccag

SEQ ID NO: 2889577 - DNA, 21 bp, Homo sapiens
ctgcgctttgaacgtgccagc

SEQ ID NO: 2889578 - DNA, 22 bp, Homo sapiens
ctgcgctttgaacgtgccagca

SEQ ID NO: 2889579 - DNA, 23 bp, Homo sapiens
ctgcgctttgaacgtgccagcag

SEQ ID NO: 2889580 - DNA, 19 bp, Homo sapiens
ctgcggacaccgtggcctg

SEQ ID NO: 2889581 - DNA, 22 bp, Homo sapiens
ctgcggacaccgtggcctgggc

SEQ ID NO: 2889582 - DNA, 14 bp, Homo sapiens
ctgcggcatcagat

SEQ ID NO: 2889583 - DNA, 23 bp, Homo sapiens
ctgcggcgcgggcccctcacctg

SEQ ID NO: 2889584 - DNA, 21 bp, Homo sapiens
ctgcgggctgagggcatctct

SEQ ID NO: 2889585 - DNA, 18 bp, Homo sapiens
ctgcgggtcctcagctgc

SEQ ID NO: 2889586 - DNA, 20 bp, Homo sapiens
ctgcgggtcctcagctgctc

SEQ ID NO: 2889587 - DNA, 23 bp, Homo sapiens
ctgcgggtgaacaaagcagccac

SEQ ID NO: 2889588 - DNA, 22 bp, Homo sapiens
ctgcggtagatgggagggaggc

SEQ ID NO: 2889589 - DNA, 17 bp, Homo sapiens
ctgcgtccaccaggcct

SEQ ID NO: 2889590 - DNA, 18 bp, Homo sapiens
ctgcgtccaccaggcctc

SEQ ID NO: 2889591 - DNA, 23 bp, Homo sapiens
ctgcgtccaccaggcctcactgg

SEQ ID NO: 2889592 - DNA, 18 bp, Homo sapiens
ctgcgtctccatatgtgt

SEQ ID NO: 2889593 - DNA, 19 bp, Homo sapiens
ctgcgtgtcacctgtgctt

SEQ ID NO: 2889594 - DNA, 14 bp, Homo sapiens
ctgctaatgagact

SEQ ID NO: 2889595 - DNA, 19 bp, Homo sapiens
ctgctacctttcaaagctt

SEQ ID NO: 2889596 - DNA, 22 bp, Homo sapiens
ctgctactctgttccttcacat

SEQ ID NO: 2889597 - DNA, 12 bp, Homo sapiens
ctgctactgccc

SEQ ID NO: 2889598 - DNA, 16 bp, Homo sapiens
ctgctacttgctctgc

SEQ ID NO: 2889599 - DNA, 17 bp, Homo sapiens
ctgctagagcagacagg

SEQ ID NO: 2889600 - DNA, 16 bp, Homo sapiens
ctgctagcaaatggca

SEQ ID NO: 2889601 - DNA, 14 bp, Homo sapiens
ctgctagcaggccc

SEQ ID NO: 2889602 - DNA, 15 bp, Homo sapiens
ctgctagcaggcccc

SEQ ID NO: 2889603 - DNA, 18 bp, Homo sapiens
ctgctagcaggcccccta

SEQ ID NO: 2889604 - DNA, 21 bp, Homo sapiens
ctgctaggggaaggactggcc

SEQ ID NO: 2889605 - DNA, 16 bp, Homo sapiens
ctgctatttcaggccc

SEQ ID NO: 2889606 - DNA, 18 bp, Homo sapiens
ctgctatttcaggccctc

SEQ ID NO: 2889607 - DNA, 23 bp, Homo sapiens
ctgctatttcaggccctcagctg

SEQ ID NO: 2889608 - DNA, 18 bp, Homo sapiens
ctgctcactttaaacctg

SEQ ID NO: 2889609 - DNA, 13 bp, Homo sapiens
ctgctcagctctg

SEQ ID NO: 2889610 - DNA, 15 bp, Homo sapiens
ctgctcagctctggt

SEQ ID NO: 2889611 - DNA, 23 bp, Homo sapiens
ctgctcagctctggtccaggccc

SEQ ID NO: 2889612 - DNA, 16 bp, Homo sapiens
ctgctcatcattctct

SEQ ID NO: 2889613 - DNA, 19 bp, Homo sapiens
ctgctcattccacactgtt

SEQ ID NO: 2889614 - DNA, 22 bp, Homo sapiens
ctgctcccacacttgtgccagc

SEQ ID NO: 2889615 - DNA, 23 bp, Homo sapiens
ctgctcccacacttgtgccagcc

SEQ ID NO: 2889616 - DNA, 20 bp, Homo sapiens
ctgctccccacccctaccga

SEQ ID NO: 2889617 - DNA, 16 bp, Homo sapiens
ctgctccccaggggag

SEQ ID NO: 2889618 - DNA, 13 bp, Homo sapiens
ctgctcccccacc

SEQ ID NO: 2889619 - DNA, 17 bp, Homo sapiens
ctgctcccccaccccct

SEQ ID NO: 2889620 - DNA, 23 bp, Homo sapiens
ctgctcccccaccccctccccag

SEQ ID NO: 2889621 - DNA, 21 bp, Homo sapiens
ctgctcccctctgcacggacc

SEQ ID NO: 2889622 - DNA, 16 bp, Homo sapiens
ctgctccctctccccc

SEQ ID NO: 2889623 - DNA, 16 bp, Homo sapiens
ctgctcccttcgctct

SEQ ID NO: 2889624 - DNA, 20 bp, Homo sapiens
ctgctcccttcgctctgctg

SEQ ID NO: 2889625 - DNA, 20 bp, Homo sapiens
ctgctccgtggactgcagtc

SEQ ID NO: 2889626 - DNA, 13 bp, Homo sapiens
ctgctcctaaggg

SEQ ID NO: 2889627 - DNA, 22 bp, Homo sapiens
ctgctcctagagggaggggcct

SEQ ID NO: 2889628 - DNA, 11 bp, Homo sapiens
ctgctcctcca

SEQ ID NO: 2889629 - DNA, 12 bp, Homo sapiens
ctgctcctccag

SEQ ID NO: 2889630 - DNA, 22 bp, Homo sapiens
ctgctcctccagggccacgtgc

SEQ ID NO: 2889631 - DNA, 18 bp, Homo sapiens
ctgctcctctttcccctc

SEQ ID NO: 2889632 - DNA, 20 bp, Homo sapiens
ctgctccttagctgccaagc

SEQ ID NO: 2889633 - DNA, 18 bp, Homo sapiens
ctgctcgcccaggaaggc

SEQ ID NO: 2889634 - DNA, 20 bp, Homo sapiens
ctgctcttacttcccccacc

SEQ ID NO: 2889635 - DNA, 23 bp, Homo sapiens
ctgctcttacttcccccaccctg

SEQ ID NO: 2889636 - DNA, 18 bp, Homo sapiens
ctgctcttcaagaaacag

SEQ ID NO: 2889637 - DNA, 14 bp, Homo sapiens
ctgctcttttacta

SEQ ID NO: 2889638 - DNA, 15 bp, Homo sapiens
ctgctcttttgtctc

SEQ ID NO: 2889639 - DNA, 18 bp, Homo sapiens
ctgctgaagacttgcccc

SEQ ID NO: 2889640 - DNA, 16 bp, Homo sapiens
ctgctgacctccacag

SEQ ID NO: 2889641 - DNA, 19 bp, Homo sapiens
ctgctgagatacatacaga

SEQ ID NO: 2889642 - DNA, 20 bp, Homo sapiens
ctgctgagatacatacagaa

SEQ ID NO: 2889643 - DNA, 15 bp, Homo sapiens
ctgctgatgcgctgg

SEQ ID NO: 2889644 - DNA, 17 bp, Homo sapiens
ctgctgatgcgctggga

SEQ ID NO: 2889645 - DNA, 22 bp, Homo sapiens
ctgctgccaccaaatctgtcta

SEQ ID NO: 2889646 - DNA, 17 bp, Homo sapiens
ctgctgccactctgctg

SEQ ID NO: 2889647 - DNA, 18 bp, Homo sapiens
ctgctgccactctgctgc

SEQ ID NO: 2889648 - DNA, 15 bp, Homo sapiens
ctgctgccatccatg

SEQ ID NO: 2889649 - DNA, 18 bp, Homo sapiens
ctgctgccatccatgtgc

SEQ ID NO: 2889650 - DNA, 12 bp, Homo sapiens
ctgctgcccctc

SEQ ID NO: 2889651 - DNA, 15 bp, Homo sapiens
ctgctgcccctccct

SEQ ID NO: 2889652 - DNA, 16 bp, Homo sapiens
ctgctgcccctccctg

SEQ ID NO: 2889653 - DNA, 22 bp, Homo sapiens
ctgctgcccctccctgcctcca

SEQ ID NO: 2889654 - DNA, 15 bp, Homo sapiens
ctgctgcctcagctc

SEQ ID NO: 2889655 - DNA, 14 bp, Homo sapiens
ctgctgcctgtaca

SEQ ID NO: 2889656 - DNA, 21 bp, Homo sapiens
ctgctgctcattccacactgt

SEQ ID NO: 2889657 - DNA, 23 bp, Homo sapiens
ctgctgctcattccacactgttg

SEQ ID NO: 2889658 - DNA, 13 bp, Homo sapiens
ctgctgctcccca

SEQ ID NO: 2889659 - DNA, 16 bp, Homo sapiens
ctgctgctccccaccc

SEQ ID NO: 2889660 - DNA, 13 bp, Homo sapiens
ctgctgctgcccg

SEQ ID NO: 2889661 - DNA, 13 bp, Homo sapiens
ctgctgctgctca

SEQ ID NO: 2889662 - DNA, 15 bp, Homo sapiens
ctgctgcttcctaac

SEQ ID NO: 2889663 - DNA, 13 bp, Homo sapiens
ctgctgcttcttg

SEQ ID NO: 2889664 - DNA, 18 bp, Homo sapiens
ctgctgcttcttgcttcc

SEQ ID NO: 2889665 - DNA, 22 bp, Homo sapiens
ctgctgctttgttgttctgcct

SEQ ID NO: 2889666 - DNA, 16 bp, Homo sapiens
ctgctggccggagcaa

SEQ ID NO: 2889667 - DNA, 13 bp, Homo sapiens
ctgctggcctgct

SEQ ID NO: 2889668 - DNA, 12 bp, Homo sapiens
ctgctgggctct

SEQ ID NO: 2889669 - DNA, 13 bp, Homo sapiens
ctgctgggctctt

SEQ ID NO: 2889670 - DNA, 20 bp, Homo sapiens
ctgctggggtctcaggtcca

SEQ ID NO: 2889671 - DNA, 22 bp, Homo sapiens
ctgctgtacaagatgtagcacc

SEQ ID NO: 2889672 - DNA, 18 bp, Homo sapiens
ctgctgtcacctctccca

SEQ ID NO: 2889673 - DNA, 16 bp, Homo sapiens
ctgctgtcctggtggc

SEQ ID NO: 2889674 - DNA, 18 bp, Homo sapiens
ctgctgtcctggtggctg

SEQ ID NO: 2889675 - DNA, 10 bp, Homo sapiens
ctgctgtctc

SEQ ID NO: 2889676 - DNA, 12 bp, Homo sapiens
ctgctgtctctt

SEQ ID NO: 2889677 - DNA, 15 bp, Homo sapiens
ctgctgtgactgtgt

SEQ ID NO: 2889678 - DNA, 11 bp, Homo sapiens
ctgctgtgcaa

SEQ ID NO: 2889679 - DNA, 17 bp, Homo sapiens
ctgctgtgcgtggaaaa

SEQ ID NO: 2889680 - DNA, 19 bp, Homo sapiens
ctgctgtgcgtggaaaaag

SEQ ID NO: 2889681 - DNA, 15 bp, Homo sapiens
ctgctgtggaaagga

SEQ ID NO: 2889682 - DNA, 16 bp, Homo sapiens
ctgcttaattgctgat

SEQ ID NO: 2889683 - DNA, 16 bp, Homo sapiens
ctgcttagaacccttc

SEQ ID NO: 2889684 - DNA, 19 bp, Homo sapiens
ctgcttagaacccttctgc

SEQ ID NO: 2889685 - DNA, 16 bp, Homo sapiens
ctgcttatctgaaact

SEQ ID NO: 2889686 - DNA, 22 bp, Homo sapiens
ctgcttatgatgggctccccag

SEQ ID NO: 2889687 - DNA, 21 bp, Homo sapiens
ctgcttcagatgtggagccag

SEQ ID NO: 2889688 - DNA, 20 bp, Homo sapiens
ctgcttcatatctctccctt

SEQ ID NO: 2889689 - DNA, 23 bp, Homo sapiens
ctgcttcatatctctcccttctt

SEQ ID NO: 2889690 - DNA, 15 bp, Homo sapiens
ctgcttccaggctgg

SEQ ID NO: 2889691 - DNA, 19 bp, Homo sapiens
ctgcttccatggcttcctg

SEQ ID NO: 2889692 - DNA, 21 bp, Homo sapiens
ctgcttccatggcttcctgag

SEQ ID NO: 2889693 - DNA, 12 bp, Homo sapiens
ctgcttcccagg

SEQ ID NO: 2889694 - DNA, 17 bp, Homo sapiens
ctgcttcccatgcctgc

SEQ ID NO: 2889695 - DNA, 17 bp, Homo sapiens
ctgcttctcggccagcc

SEQ ID NO: 2889696 - DNA, 19 bp, Homo sapiens
ctgcttctcggccagcccg

SEQ ID NO: 2889697 - DNA, 22 bp, Homo sapiens
ctgcttctcttttcctcgcaga

SEQ ID NO: 2889698 - DNA, 19 bp, Homo sapiens
ctgcttctgacataatcca

SEQ ID NO: 2889699 - DNA, 12 bp, Homo sapiens
ctgcttctggcg

SEQ ID NO: 2889700 - DNA, 15 bp, Homo sapiens
ctgcttcttgcttcc

SEQ ID NO: 2889701 - DNA, 12 bp, Homo sapiens
ctgcttgaggaa

SEQ ID NO: 2889702 - DNA, 21 bp, Homo sapiens
ctgcttgatgggattctggac

SEQ ID NO: 2889703 - DNA, 22 bp, Homo sapiens
ctggagtgcccccagcccagag

SEQ ID NO: 2889704 - DNA, 14 bp, Homo sapiens
ctggagtgctgctt

SEQ ID NO: 2889705 - DNA, 15 bp, Homo sapiens
ctggagtgctgcttg

SEQ ID NO: 2889706 - DNA, 23 bp, Homo sapiens
ctggagtgctgcttgtgcctccc

SEQ ID NO: 2889707 - DNA, 14 bp, Homo sapiens
ctggagtggccact

SEQ ID NO: 2889708 - DNA, 23 bp, Homo sapiens
ctggagtggccactaagcagagg

SEQ ID NO: 2889709 - DNA, 24 bp, Homo sapiens
ctggagtggccactaagcagagga

SEQ ID NO: 2889710 - DNA, 20 bp, Homo sapiens
ctggagtggctcgccaggcc

SEQ ID NO: 2889711 - DNA, 15 bp, Homo sapiens
ctggagtgtgtcaga

SEQ ID NO: 2889712 - DNA, 17 bp, Homo sapiens
ctggagtgtgtcagagc

SEQ ID NO: 2889713 - DNA, 23 bp, Homo sapiens
ctggagtgtgtcagagcccaggg

SEQ ID NO: 2889714 - DNA, 18 bp, Homo sapiens
ctggagttgatctggaac

SEQ ID NO: 2889715 - DNA, 14 bp, Homo sapiens
ctggagttgcattg

SEQ ID NO: 2889716 - DNA, 23 bp, Homo sapiens
ctggagttggggctcttggcttt

SEQ ID NO: 2889717 - DNA, 18 bp, Homo sapiens
ctggagtttcatgtacaa

SEQ ID NO: 2889718 - DNA, 20 bp, Homo sapiens
ctggagtttgggatccctgt

SEQ ID NO: 2889719 - DNA, 13 bp, Homo sapiens
ctggatagccttg

SEQ ID NO: 2889720 - DNA, 13 bp, Homo sapiens
ctggatcagtcct

SEQ ID NO: 2889721 - DNA, 17 bp, Homo sapiens
ctggatcagtcctttga

SEQ ID NO: 2889722 - DNA, 17 bp, Homo sapiens
ctggatcccatcaaaga

SEQ ID NO: 2889723 - DNA, 23 bp, Homo sapiens
ctggatcccgttcagaaaaccac

SEQ ID NO: 2889724 - DNA, 15 bp, Homo sapiens
ctggatcctgaaata

SEQ ID NO: 2889725 - DNA, 20 bp, Homo sapiens
ctggatgatggtcttcagcc

SEQ ID NO: 2889726 - DNA, 16 bp, Homo sapiens
ctggatgccttccccc

SEQ ID NO: 2889727 - DNA, 19 bp, Homo sapiens
ctggatgtctgccaatttt

SEQ ID NO: 2889728 - DNA, 15 bp, Homo sapiens
ctggatgtttggaaa

SEQ ID NO: 2889729 - DNA, 15 bp, Homo sapiens
ctggatttgcagaag

SEQ ID NO: 2889730 - DNA, 18 bp, Homo sapiens
ctggatttgcagaagttt

SEQ ID NO: 2889731 - DNA, 18 bp, Homo sapiens
ctggcaaacatgtgcaac

SEQ ID NO: 2889732 - DNA, 15 bp, Homo sapiens
ctggcaacacagagg

SEQ ID NO: 2889733 - DNA, 16 bp, Homo sapiens
ctggcaacacagaggc

SEQ ID NO: 2889734 - DNA, 21 bp, Homo sapiens
ctggcacagcctggctgtggc

SEQ ID NO: 2889735 - DNA, 12 bp, Homo sapiens
ctggcagctcag

SEQ ID NO: 2889736 - DNA, 17 bp, Homo sapiens
ctggcagctcagcttcc

SEQ ID NO: 2889737 - DNA, 12 bp, Homo sapiens
ctggcagctctg

SEQ ID NO: 2889738 - DNA, 15 bp, Homo sapiens
ctggcagctgcccct

SEQ ID NO: 2889739 - DNA, 15 bp, Homo sapiens
ctggcagggggcatg

SEQ ID NO: 2889740 - DNA, 21 bp, Homo sapiens
ctggcagggggtgaaggcagg

SEQ ID NO: 2889741 - DNA, 18 bp, Homo sapiens
ctggcagggtgggatgga

SEQ ID NO: 2889742 - DNA, 18 bp, Homo sapiens
ctggcagtcgcacacaca

SEQ ID NO: 2889743 - DNA, 16 bp, Homo sapiens
ctggcataaatctgaa

SEQ ID NO: 2889744 - DNA, 13 bp, Homo sapiens
ctggcatctgtgc

SEQ ID NO: 2889745 - DNA, 13 bp, Homo sapiens
ctggcatctgtgt

SEQ ID NO: 2889746 - DNA, 19 bp, Homo sapiens
ctggcattactcagcagga

SEQ ID NO: 2889747 - DNA, 21 bp, Homo sapiens
ctggcattatgtccactgtgt

SEQ ID NO: 2889748 - DNA, 20 bp, Homo sapiens
ctggcattctacacctggac

SEQ ID NO: 2889749 - DNA, 17 bp, Homo sapiens
ctggcattttatagaca

SEQ ID NO: 2889750 - DNA, 18 bp, Homo sapiens
ctggcatttttagctcct

SEQ ID NO: 2889751 - DNA, 21 bp, Homo sapiens
ctggccaaagagcctttccaa

SEQ ID NO: 2889752 - DNA, 18 bp, Homo sapiens
ctggccaacatggcgaaa

SEQ ID NO: 2889753 - DNA, 17 bp, Homo sapiens
ctggccaaggagaggag

SEQ ID NO: 2889754 - DNA, 13 bp, Homo sapiens
ctggccagacaca

SEQ ID NO: 2889755 - DNA, 17 bp, Homo sapiens
ctggccagacacaggcc

SEQ ID NO: 2889756 - DNA, 18 bp, Homo sapiens
ctggccagacacaggccc

SEQ ID NO: 2889757 - DNA, 17 bp, Homo sapiens
ctggccagatttcctca

SEQ ID NO: 2889758 - DNA, 14 bp, Homo sapiens
ctggccagccgctc

SEQ ID NO: 2889759 - DNA, 22 bp, Homo sapiens
ctggccagccgctctcctgcca

SEQ ID NO: 2889760 - DNA, 13 bp, Homo sapiens
ctggccaggccct

SEQ ID NO: 2889761 - DNA, 18 bp, Homo sapiens
ctggccagtcctggtcct

SEQ ID NO: 2889762 - DNA, 22 bp, Homo sapiens
ctggccagtcctggtcctggct

SEQ ID NO: 2889763 - DNA, 23 bp, Homo sapiens
ctggccagtcctggtcctggctg

SEQ ID NO: 2889764 - DNA, 14 bp, Homo sapiens
ctggccagtcttcc

SEQ ID NO: 2889765 - DNA, 17 bp, Homo sapiens
ctggccagtcttcctct

SEQ ID NO: 2889766 - DNA, 23 bp, Homo sapiens
ctggccagtgctgcccatgagca

SEQ ID NO: 2889767 - DNA, 15 bp, Homo sapiens
ctggccatgctgtcc

SEQ ID NO: 2889768 - DNA, 17 bp, Homo sapiens
ctggccatgctgtccct

SEQ ID NO: 2889769 - DNA, 18 bp, Homo sapiens
ctggccatgctgtccctg

SEQ ID NO: 2889770 - DNA, 22 bp, Homo sapiens
ctggccatttggccccagggga

SEQ ID NO: 2889771 - DNA, 17 bp, Homo sapiens
ctggcccacccagtcca

SEQ ID NO: 2889772 - DNA, 12 bp, Homo sapiens
ctggcccaggcc

SEQ ID NO: 2889773 - DNA, 13 bp, Homo sapiens
ctggcccagggcc

SEQ ID NO: 2889774 - DNA, 14 bp, Homo sapiens
ctggcccagggccc

SEQ ID NO: 2889775 - DNA, 17 bp, Homo sapiens
ctggcccagggcccaga

SEQ ID NO: 2889776 - DNA, 20 bp, Homo sapiens
ctggcccagggcccagagcc

SEQ ID NO: 2889777 - DNA, 22 bp, Homo sapiens
ctggcccagggcccagagccca

SEQ ID NO: 2889778 - DNA, 23 bp, Homo sapiens
ctggcccagggcccagagcccag

SEQ ID NO: 2889779 - DNA, 22 bp, Homo sapiens
ctggcccagggggcctggagca

SEQ ID NO: 2889780 - DNA, 15 bp, Homo sapiens
ctggccccagagatg

SEQ ID NO: 2889781 - DNA, 17 bp, Homo sapiens
ctggccccatggtcagc

SEQ ID NO: 2889782 - DNA, 19 bp, Homo sapiens
ctggccccatgtctctcag

SEQ ID NO: 2889783 - DNA, 21 bp, Homo sapiens
ctggccccatgtctctcagaa

SEQ ID NO: 2889784 - DNA, 14 bp, Homo sapiens
ctggccccgccgcc

SEQ ID NO: 2889785 - DNA, 15 bp, Homo sapiens
ctggccccgcctgcc

SEQ ID NO: 2889786 - DNA, 22 bp, Homo sapiens
ctggcccctgagatctctgcag

SEQ ID NO: 2889787 - DNA, 15 bp, Homo sapiens
ctggcccgtgacaga

SEQ ID NO: 2889788 - DNA, 20 bp, Homo sapiens
ctggccctggcgggtggctg

SEQ ID NO: 2889789 - DNA, 21 bp, Homo sapiens
ctggccctggcgggtggctgc

SEQ ID NO: 2889790 - DNA, 21 bp, Homo sapiens
ctggccctgtgcagaccttac

SEQ ID NO: 2889791 - DNA, 15 bp, Homo sapiens
ctggccctgttctcc

SEQ ID NO: 2889792 - DNA, 23 bp, Homo sapiens
ctggccgagtccaagctgggaga

SEQ ID NO: 2889793 - DNA, 14 bp, Homo sapiens
ctggccggccagcc

SEQ ID NO: 2889794 - DNA, 15 bp, Homo sapiens
ctggccggccagcca

SEQ ID NO: 2889795 - DNA, 21 bp, Homo sapiens
ctggccggccagccagccact

SEQ ID NO: 2889796 - DNA, 23 bp, Homo sapiens
ctggccggccagccagccactct

SEQ ID NO: 2889797 - DNA, 12 bp, Homo sapiens
ctggccgggcag

SEQ ID NO: 2889798 - DNA, 13 bp, Homo sapiens
ctggccgggcagg

SEQ ID NO: 2889799 - DNA, 15 bp, Homo sapiens
ctggccgggcaggcg

SEQ ID NO: 2889800 - DNA, 19 bp, Homo sapiens
ctggccgggtcaccctgtg

SEQ ID NO: 2889801 - DNA, 13 bp, Homo sapiens
ctggcctagactt

SEQ ID NO: 2889802 - DNA, 22 bp, Homo sapiens
ctggcctcagactgcacccagg

SEQ ID NO: 2889803 - DNA, 14 bp, Homo sapiens
ctggcctcccacag

SEQ ID NO: 2889804 - DNA, 20 bp, Homo sapiens
ctggcctccctccgtccctc

SEQ ID NO: 2889805 - DNA, 16 bp, Homo sapiens
ctggcctctaggtaac

SEQ ID NO: 2889806 - DNA, 15 bp, Homo sapiens
ctggcctctgtgcct

SEQ ID NO: 2889807 - DNA, 16 bp, Homo sapiens
ctggcctctgtgcctt

SEQ ID NO: 2889808 - DNA, 14 bp, Homo sapiens
ctggcctcttggca

SEQ ID NO: 2889809 - DNA, 23 bp, Homo sapiens
ctggcctcttggcacctgcctag

SEQ ID NO: 2889810 - DNA, 15 bp, Homo sapiens
ctggcctgctgggct

SEQ ID NO: 2889811 - DNA, 13 bp, Homo sapiens
ctggcctggcaca

SEQ ID NO: 2889812 - DNA, 14 bp, Homo sapiens
ctggcctggcacac

SEQ ID NO: 2889813 - DNA, 17 bp, Homo sapiens
ctggcctggcacacatc

SEQ ID NO: 2889814 - DNA, 12 bp, Homo sapiens
ctggcctggcag

SEQ ID NO: 2889815 - DNA, 13 bp, Homo sapiens
ctggccttgcccg

SEQ ID NO: 2889816 - DNA, 21 bp, Homo sapiens
ctggccttgtcctcagccagt

SEQ ID NO: 2889817 - DNA, 16 bp, Homo sapiens
ctggcgacactcaggg

SEQ ID NO: 2889818 - DNA, 19 bp, Homo sapiens
ctggcgacactcagggcag

SEQ ID NO: 2889819 - DNA, 20 bp, Homo sapiens
ctggcgacactcagggcagc

SEQ ID NO: 2889820 - DNA, 20 bp, Homo sapiens
ctggcgacagttttccttct

SEQ ID NO: 2889821 - DNA, 18 bp, Homo sapiens
ctggcgagcccttagcct

SEQ ID NO: 2889822 - DNA, 12 bp, Homo sapiens
ctggcgccttct

SEQ ID NO: 2889823 - DNA, 17 bp, Homo sapiens
ctggcgctgtgctagct

SEQ ID NO: 2889824 - DNA, 17 bp, Homo sapiens
ctggcggctactcagca

SEQ ID NO: 2889825 - DNA, 18 bp, Homo sapiens
ctggcggctactcagcag

SEQ ID NO: 2889826 - DNA, 22 bp, Homo sapiens
ctggcggctactcagcagccct

SEQ ID NO: 2889827 - DNA, 17 bp, Homo sapiens
ctggcgggtggctgcaa

SEQ ID NO: 2889828 - DNA, 13 bp, Homo sapiens
ctggcggtggcca

SEQ ID NO: 2889829 - DNA, 21 bp, Homo sapiens
ctggctaacagtctagtgcaa

SEQ ID NO: 2889830 - DNA, 21 bp, Homo sapiens
ctggctacagtaccatgcctc

SEQ ID NO: 2889831 - DNA, 18 bp, Homo sapiens
ctggctagagggcccaaa

SEQ ID NO: 2889832 - DNA, 22 bp, Homo sapiens
ctggctagagggcccaaagctt

SEQ ID NO: 2889833 - DNA, 20 bp, Homo sapiens
ctggctcacgccccgctgtg

SEQ ID NO: 2889834 - DNA, 12 bp, Homo sapiens
ctggctcagctg

SEQ ID NO: 2889835 - DNA, 15 bp, Homo sapiens
ctggctcaggcccag

SEQ ID NO: 2889836 - DNA, 11 bp, Homo sapiens
ctggctcatgc

SEQ ID NO: 2889837 - DNA, 15 bp, Homo sapiens
ctggctcatgcccct

SEQ ID NO: 2889838 - DNA, 20 bp, Homo sapiens
ctggctccagatgcagggca

SEQ ID NO: 2889839 - DNA, 15 bp, Homo sapiens
ctggctccaggcaga

SEQ ID NO: 2889840 - DNA, 13 bp, Homo sapiens
ctggctccccgag

SEQ ID NO: 2889841 - DNA, 12 bp, Homo sapiens
ctggctccctct

SEQ ID NO: 2889842 - DNA, 16 bp, Homo sapiens
ctggctcctctgtggt

SEQ ID NO: 2889843 - DNA, 18 bp, Homo sapiens
ctggctcctctgtggtgt

SEQ ID NO: 2889844 - DNA, 20 bp, Homo sapiens
ctggctctcccatttcctga

SEQ ID NO: 2889845 - DNA, 17 bp, Homo sapiens
ctggctgaacagtgctc

SEQ ID NO: 2889846 - DNA, 21 bp, Homo sapiens
ctggctgaacagtgctctgcc

SEQ ID NO: 2889847 - DNA, 14 bp, Homo sapiens
ctggctgcactctt

SEQ ID NO: 2889848 - DNA, 18 bp, Homo sapiens
ctggctgcagcctccggg

SEQ ID NO: 2889849 - DNA, 21 bp, Homo sapiens
ctggctgcttgcagccaggag

SEQ ID NO: 2889850 - DNA, 23 bp, Homo sapiens
ctggctgggacgtggctcagcca

SEQ ID NO: 2889851 - DNA, 16 bp, Homo sapiens
ctggctggttccatct

SEQ ID NO: 2889852 - DNA, 19 bp, Homo sapiens
ctggctgtcagtatgacat

SEQ ID NO: 2889853 - DNA, 19 bp, Homo sapiens
ctggctgtgaatgccaaag

SEQ ID NO: 2889854 - DNA, 19 bp, Homo sapiens
ctggctgtgtaaccttggg

SEQ ID NO: 2889855 - DNA, 15 bp, Homo sapiens
ctggcttcactctcc

SEQ ID NO: 2889856 - DNA, 12 bp, Homo sapiens
ctggcttctggc

SEQ ID NO: 2889857 - DNA, 17 bp, Homo sapiens
ctggcttctggccagga

SEQ ID NO: 2889858 - DNA, 19 bp, Homo sapiens
ctggcttctggccaggaag

SEQ ID NO: 2889859 - DNA, 16 bp, Homo sapiens
ctggcttgggcagcat

SEQ ID NO: 2889860 - DNA, 19 bp, Homo sapiens
ctggcttgtaactccacca

SEQ ID NO: 2889861 - DNA, 20 bp, Homo sapiens
ctggcttgtaactccaccaa

SEQ ID NO: 2889862 - DNA, 13 bp, Homo sapiens
ctggcttgtacat

SEQ ID NO: 2889863 - DNA, 14 bp, Homo sapiens
ctggcttgtacatt

SEQ ID NO: 2889864 - DNA, 16 bp, Homo sapiens
ctggcttgtacatttt

SEQ ID NO: 2889865 - DNA, 17 bp, Homo sapiens
ctggcttgttgtaaagc

SEQ ID NO: 2889866 - DNA, 13 bp, Homo sapiens
ctggcttgtttat

SEQ ID NO: 2889867 - DNA, 20 bp, Homo sapiens
ctggctttggaatagatgga

SEQ ID NO: 2889868 - DNA, 22 bp, Homo sapiens
ctggcttttattaatgcacttt

SEQ ID NO: 2889869 - DNA, 15 bp, Homo sapiens
ctggctttttaactc

SEQ ID NO: 2889870 - DNA, 21 bp, Homo sapiens
ctggcttttttttttcttttg

SEQ ID NO: 2889871 - DNA, 17 bp, Homo sapiens
ctgggaaacactccttg

SEQ ID NO: 2889872 - DNA, 19 bp, Homo sapiens
ctgggaaacactccttgca

SEQ ID NO: 2889873 - DNA, 23 bp, Homo sapiens
ctgggaaaccccttctctgtgac

SEQ ID NO: 2889874 - DNA, 14 bp, Homo sapiens
ctgggaagctggag

SEQ ID NO: 2889875 - DNA, 15 bp, Homo sapiens
ctgggaagctggagt

SEQ ID NO: 2889876 - DNA, 18 bp, Homo sapiens
ctgggaagggagagggcc

SEQ ID NO: 2889877 - DNA, 19 bp, Homo sapiens
ctgggacacttaacagatg

SEQ ID NO: 2889878 - DNA, 19 bp, Homo sapiens
ctgggacatcaggagactg

SEQ ID NO: 2889879 - DNA, 21 bp, Homo sapiens
ctgggacatcaggagactggg

SEQ ID NO: 2889880 - DNA, 23 bp, Homo sapiens
ctgggacctgatttattgaaatt

SEQ ID NO: 2889881 - DNA, 18 bp, Homo sapiens
ctgggagaaatctggctt

SEQ ID NO: 2889882 - DNA, 19 bp, Homo sapiens
ctgggagcctacccacccc

SEQ ID NO: 2889883 - DNA, 13 bp, Homo sapiens
ctgggaggaaaag

SEQ ID NO: 2889884 - DNA, 24 bp, Homo sapiens
ctgggaggatcctgagctgctgtt

SEQ ID NO: 2889885 - DNA, 14 bp, Homo sapiens
ctgggaggctgcag

SEQ ID NO: 2889886 - DNA, 18 bp, Homo sapiens
ctgggaggctgcagccag

SEQ ID NO: 2889887 - DNA, 19 bp, Homo sapiens
ctgggaggctgcagccagg

SEQ ID NO: 2889888 - DNA, 20 bp, Homo sapiens
ctgggaggctgcagccaggc

SEQ ID NO: 2889889 - DNA, 15 bp, Homo sapiens
ctgggagggcagcag

SEQ ID NO: 2889890 - DNA, 17 bp, Homo sapiens
ctgggagggcagcaggg

SEQ ID NO: 2889891 - DNA, 22 bp, Homo sapiens
ctgggagggcagcagggctacc

SEQ ID NO: 2889892 - DNA, 23 bp, Homo sapiens
ctgggagttgatcgcctttccca

SEQ ID NO: 2889893 - DNA, 15 bp, Homo sapiens
ctgggatcacaggtg

SEQ ID NO: 2889894 - DNA, 21 bp, Homo sapiens
ctgggatggtgggcttcaggg

SEQ ID NO: 2889895 - DNA, 21 bp, Homo sapiens
ctgggattacagccgtgagcc

SEQ ID NO: 2889896 - DNA, 15 bp, Homo sapiens
ctgggattacaggca

SEQ ID NO: 2889897 - DNA, 22 bp, Homo sapiens
ctgggattacaggcatgtgcca

SEQ ID NO: 2889898 - DNA, 22 bp, Homo sapiens
ctgggattacaggcgtgagcca

SEQ ID NO: 2889899 - DNA, 17 bp, Homo sapiens
ctgggattataggcatg

SEQ ID NO: 2889900 - DNA, 17 bp, Homo sapiens
ctgggattttaaactag

SEQ ID NO: 2889901 - DNA, 23 bp, Homo sapiens
ctgggattttaaactagatgacc

SEQ ID NO: 2889902 - DNA, 15 bp, Homo sapiens
ctgtcttgctcctgg

SEQ ID NO: 2889903 - DNA, 17 bp, Homo sapiens
ctgtcttgctcctgggg

SEQ ID NO: 2889904 - DNA, 19 bp, Homo sapiens
ctgtcttgctcctggggag

SEQ ID NO: 2889905 - DNA, 19 bp, Homo sapiens
ctgtctttcctaagacctg

SEQ ID NO: 2889906 - DNA, 20 bp, Homo sapiens
ctgtctttcctaagacctgg

SEQ ID NO: 2889907 - DNA, 23 bp, Homo sapiens
ctgtctttctgagcacactttag

SEQ ID NO: 2889908 - DNA, 14 bp, Homo sapiens
ctgtctttgcgggg

SEQ ID NO: 2889909 - DNA, 20 bp, Homo sapiens
ctgtctttgcggggcctgtc

SEQ ID NO: 2889910 - DNA, 21 bp, Homo sapiens
ctgtctttgtggactgtgggt

SEQ ID NO: 2889911 - DNA, 19 bp, Homo sapiens
ctgtcttttctattaatca

SEQ ID NO: 2889912 - DNA, 15 bp, Homo sapiens
ctgtctttttccttc

SEQ ID NO: 2889913 - DNA, 18 bp, Homo sapiens
ctgtctttttccttcctg

SEQ ID NO: 2889914 - DNA, 19 bp, Homo sapiens
ctgtctttttccttcctga

SEQ ID NO: 2889915 - DNA, 21 bp, Homo sapiens
ctgtctttttccttcctgaga

SEQ ID NO: 2889916 - DNA, 23 bp, Homo sapiens
ctgtctttttccttcctgagaaa

SEQ ID NO: 2889917 - DNA, 12 bp, Homo sapiens
ctgtgaaatagt

SEQ ID NO: 2889918 - DNA, 21 bp, Homo sapiens
ctgtgaaccaacccccatctc

SEQ ID NO: 2889919 - DNA, 22 bp, Homo sapiens
ctgtgaaccaacccccatctcc

SEQ ID NO: 2889920 - DNA, 21 bp, Homo sapiens
ctgtgaactatcccctgcgct

SEQ ID NO: 2889921 - DNA, 15 bp, Homo sapiens
ctgtgaactgaaatt

SEQ ID NO: 2889922 - DNA, 14 bp, Homo sapiens
ctgtgaaggaccct

SEQ ID NO: 2889923 - DNA, 24 bp, Homo sapiens
ctgtgaagtccttcacctcactga

SEQ ID NO: 2889924 - DNA, 17 bp, Homo sapiens
ctgtgaagttacatgca

SEQ ID NO: 2889925 - DNA, 22 bp, Homo sapiens
ctgtgaagttacatgcataaaa

SEQ ID NO: 2889926 - DNA, 15 bp, Homo sapiens
ctgtgaataaaaaga

SEQ ID NO: 2889927 - DNA, 18 bp, Homo sapiens
ctgtgaatccatgggtct

SEQ ID NO: 2889928 - DNA, 23 bp, Homo sapiens
ctgtgaatccatgggtctggcta

SEQ ID NO: 2889929 - DNA, 16 bp, Homo sapiens
ctgtgaatcctggcaa

SEQ ID NO: 2889930 - DNA, 18 bp, Homo sapiens
ctgtgaatcctggcaaga

SEQ ID NO: 2889931 - DNA, 13 bp, Homo sapiens
ctgtgaatgcttc

SEQ ID NO: 2889932 - DNA, 12 bp, Homo sapiens
ctgtgacaatga

SEQ ID NO: 2889933 - DNA, 14 bp, Homo sapiens
ctgtgacaatgact

SEQ ID NO: 2889934 - DNA, 16 bp, Homo sapiens
ctgtgacaatgactaa

SEQ ID NO: 2889935 - DNA, 19 bp, Homo sapiens
ctgtgacaatgactaagcc

SEQ ID NO: 2889936 - DNA, 20 bp, Homo sapiens
ctgtgacaatgactaagcca

SEQ ID NO: 2889937 - DNA, 21 bp, Homo sapiens
ctgtgacaatgactaagccaa

SEQ ID NO: 2889938 - DNA, 23 bp, Homo sapiens
ctgtgacaatgactaagccaagc

SEQ ID NO: 2889939 - DNA, 17 bp, Homo sapiens
ctgtgacacactacacc

SEQ ID NO: 2889940 - DNA, 15 bp, Homo sapiens
ctgtgacattgctgg

SEQ ID NO: 2889941 - DNA, 15 bp, Homo sapiens
ctgtgaccaatgtct

SEQ ID NO: 2889942 - DNA, 16 bp, Homo sapiens
ctgtgaccaatgtctt

SEQ ID NO: 2889943 - DNA, 9 bp, Homo sapiens
cttcagggc

SEQ ID NO: 2889944 - DNA, 14 bp, Homo sapiens
cttcagggcaggtg

SEQ ID NO: 2889945 - DNA, 15 bp, Homo sapiens
cttcagggcaggtgg

SEQ ID NO: 2889946 - DNA, 10 bp, Homo sapiens
cttcaggtcc

SEQ ID NO: 2889947 - DNA, 19 bp, Homo sapiens
cttcaggtggagagcacta

SEQ ID NO: 2889948 - DNA, 21 bp, Homo sapiens
cttcaggtggagagcactaga

SEQ ID NO: 2889949 - DNA, 20 bp, Homo sapiens
cttcaggtgtgactctagca

SEQ ID NO: 2889950 - DNA, 20 bp, Homo sapiens
cttcagtaacccccactgga

SEQ ID NO: 2889951 - DNA, 17 bp, Homo sapiens
cttcagtcttaatactt

SEQ ID NO: 2889952 - DNA, 19 bp, Homo sapiens
cttcagtgcatctgggaag

SEQ ID NO: 2889953 - DNA, 13 bp, Homo sapiens
cttcagtgcccac

SEQ ID NO: 2889954 - DNA, 23 bp, Homo sapiens
cttcagtggaacacaaatgaaaa

SEQ ID NO: 2889955 - DNA, 13 bp, Homo sapiens
cttcagtgggaga

SEQ ID NO: 2889956 - DNA, 19 bp, Homo sapiens
cttcagttattggtggaat

SEQ ID NO: 2889957 - DNA, 10 bp, Homo sapiens
cttcatacac

SEQ ID NO: 2889958 - DNA, 22 bp, Homo sapiens
cttcatacagggatggtgttca

SEQ ID NO: 2889959 - DNA, 18 bp, Homo sapiens
cttcataccgcctcgtgc

SEQ ID NO: 2889960 - DNA, 15 bp, Homo sapiens
cttcatagaaacctc

SEQ ID NO: 2889961 - DNA, 16 bp, Homo sapiens
cttcatatctctccct

SEQ ID NO: 2889962 - DNA, 17 bp, Homo sapiens
cttcatatctctccctt

SEQ ID NO: 2889963 - DNA, 16 bp, Homo sapiens
cttcatattaatataa

SEQ ID NO: 2889964 - DNA, 19 bp, Homo sapiens
cttcatcattccctctcat

SEQ ID NO: 2889965 - DNA, 20 bp, Homo sapiens
cttcatctcccacctagcag

SEQ ID NO: 2889966 - DNA, 15 bp, Homo sapiens
cttcatctccctgcc

SEQ ID NO: 2889967 - DNA, 16 bp, Homo sapiens
cttcatctccctgcca

SEQ ID NO: 2889968 - DNA, 23 bp, Homo sapiens
cttcatctccctgccatccccct

SEQ ID NO: 2889969 - DNA, 14 bp, Homo sapiens
cttcatctgcccaa

SEQ ID NO: 2889970 - DNA, 20 bp, Homo sapiens
cttcatctggctgcctttgc

SEQ ID NO: 2889971 - DNA, 12 bp, Homo sapiens
cttcatcttccc

SEQ ID NO: 2889972 - DNA, 12 bp, Homo sapiens
cttcatgctttt

SEQ ID NO: 2889973 - DNA, 15 bp, Homo sapiens
cttcatggcagaagg

SEQ ID NO: 2889974 - DNA, 22 bp, Homo sapiens
cttcatgtttttcacctataaa

SEQ ID NO: 2889975 - DNA, 14 bp, Homo sapiens
cttcattaaatgtt

SEQ ID NO: 2889976 - DNA, 15 bp, Homo sapiens
cttcattcgtatgtt

SEQ ID NO: 2889977 - DNA, 18 bp, Homo sapiens
cttcattgatttcctgtg

SEQ ID NO: 2889978 - DNA, 20 bp, Homo sapiens
cttcattgatttcctgtgtc

SEQ ID NO: 2889979 - DNA, 21 bp, Homo sapiens
cttcattgatttcctgtgtca

SEQ ID NO: 2889980 - DNA, 18 bp, Homo sapiens
cttcatttcatcctgttg

SEQ ID NO: 2889981 - DNA, 19 bp, Homo sapiens
cttcatttcatcctgttgg

SEQ ID NO: 2889982 - DNA, 19 bp, Homo sapiens
cttcattttcagagtgaca

SEQ ID NO: 2889983 - DNA, 18 bp, Homo sapiens
cttcattttgaggggagg

SEQ ID NO: 2889984 - DNA, 14 bp, Homo sapiens
cttccaaagaatgt

SEQ ID NO: 2889985 - DNA, 18 bp, Homo sapiens
cttccaacaggagctggg

SEQ ID NO: 2889986 - DNA, 20 bp, Homo sapiens
cttccaagtttgacttgtat

SEQ ID NO: 2889987 - DNA, 14 bp, Homo sapiens
cttccaccagagca

SEQ ID NO: 2889988 - DNA, 16 bp, Homo sapiens
cttccaccagagcagg

SEQ ID NO: 2889989 - DNA, 24 bp, Homo sapiens
cttccaccagagcaggggctgctg

SEQ ID NO: 2889990 - DNA, 22 bp, Homo sapiens
cttccacctcacaactccttcc

SEQ ID NO: 2889991 - DNA, 15 bp, Homo sapiens
cttccactgagggca

SEQ ID NO: 2889992 - DNA, 18 bp, Homo sapiens
cttccactgagggcagtc

SEQ ID NO: 2889993 - DNA, 16 bp, Homo sapiens
cttccagaaaacaaaa

SEQ ID NO: 2889994 - DNA, 15 bp, Homo sapiens
cttccagaagtgtga

SEQ ID NO: 2889995 - DNA, 16 bp, Homo sapiens
cttccagaagtgtgat

SEQ ID NO: 2889996 - DNA, 17 bp, Homo sapiens
cttccagagctctgacc

SEQ ID NO: 2889997 - DNA, 12 bp, Homo sapiens
cttccagcaaaa

SEQ ID NO: 2889998 - DNA, 14 bp, Homo sapiens
cttccagcaaaatc

SEQ ID NO: 2889999 - DNA, 19 bp, Homo sapiens
cttccaggactctctgctt

SEQ ID NO: 2890000 - DNA, 22 bp, Homo sapiens
cttccaggagccaccttgccac

SEQ ID NO: 2890001 - DNA, 16 bp, Homo sapiens
cttccaggtgcccagc

SEQ ID NO: 2890002 - DNA, 22 bp, Homo sapiens
cttccaggtgttactgtaattc

SEQ ID NO: 2890003 - DNA, 19 bp, Homo sapiens
cttccagtctggagagctg

SEQ ID NO: 2890004 - DNA, 12 bp, Homo sapiens
cttccagtggga

SEQ ID NO: 2890005 - DNA, 17 bp, Homo sapiens
cttccatgattctattt

SEQ ID NO: 2890006 - DNA, 21 bp, Homo sapiens
cttccattcagttttatttat

SEQ ID NO: 2890007 - DNA, 14 bp, Homo sapiens
cttccatttgcaag

SEQ ID NO: 2890008 - DNA, 15 bp, Homo sapiens
cttcccaacttccct

SEQ ID NO: 2890009 - DNA, 23 bp, Homo sapiens
cttcccaaggtacagctgtatat

SEQ ID NO: 2890010 - DNA, 16 bp, Homo sapiens
cttcccacacctgcct

SEQ ID NO: 2890011 - DNA, 17 bp, Homo sapiens
cttcccacacctgcctg

SEQ ID NO: 2890012 - DNA, 18 bp, Homo sapiens
cttcccacacctgcctgc

SEQ ID NO: 2890013 - DNA, 13 bp, Homo sapiens
cttcccagagaga

SEQ ID NO: 2890014 - DNA, 23 bp, Homo sapiens
cttcccaggatctgctccaacag

SEQ ID NO: 2890015 - DNA, 14 bp, Homo sapiens
cttcccagtgggct

SEQ ID NO: 2890016 - DNA, 11 bp, Homo sapiens
cttcccatcac

SEQ ID NO: 2890017 - DNA, 18 bp, Homo sapiens
cttcccatcactggagca

SEQ ID NO: 2890018 - DNA, 12 bp, Homo sapiens
cttccccagact

SEQ ID NO: 2890019 - DNA, 17 bp, Homo sapiens
cttccccagacttgcac

SEQ ID NO: 2890020 - DNA, 20 bp, Homo sapiens
cttccccagacttgcactgg

SEQ ID NO: 2890021 - DNA, 13 bp, Homo sapiens
cttcccctatgat

SEQ ID NO: 2890022 - DNA, 19 bp, Homo sapiens
cttcccctcccccactcct

SEQ ID NO: 2890023 - DNA, 21 bp, Homo sapiens
cttcccctcccccactcctct

SEQ ID NO: 2890024 - DNA, 20 bp, Homo sapiens
cttcccctctctcctcctgc

SEQ ID NO: 2890025 - DNA, 13 bp, Homo sapiens
cttccccttccct

SEQ ID NO: 2890026 - DNA, 17 bp, Homo sapiens
cttccccttgaacctca

SEQ ID NO: 2890027 - DNA, 19 bp, Homo sapiens
cttccccttgaacctcatt

SEQ ID NO: 2890028 - DNA, 14 bp, Homo sapiens
cttccccttgtccc

SEQ ID NO: 2890029 - DNA, 16 bp, Homo sapiens
cttccccttgtccctg

SEQ ID NO: 2890030 - DNA, 19 bp, Homo sapiens
cttccccttgtccctgggg

SEQ ID NO: 2890031 - DNA, 16 bp, Homo sapiens
cttcccgcctcagcct

SEQ ID NO: 2890032 - DNA, 17 bp, Homo sapiens
cttcccgcctcagcctc

SEQ ID NO: 2890033 - DNA, 11 bp, Homo sapiens
cttccctcacc

SEQ ID NO: 2890034 - DNA, 17 bp, Homo sapiens
cttccctcacccctgac

SEQ ID NO: 2890035 - DNA, 17 bp, Homo sapiens
cttccctcaccttggca

SEQ ID NO: 2890036 - DNA, 14 bp, Homo sapiens
cttccctcttccct

SEQ ID NO: 2890037 - DNA, 13 bp, Homo sapiens
cttccctgactca

SEQ ID NO: 2890038 - DNA, 20 bp, Homo sapiens
cttccctgactcattctgaa

SEQ ID NO: 2890039 - DNA, 10 bp, Homo sapiens
cttccctgcc

SEQ ID NO: 2890040 - DNA, 11 bp, Homo sapiens
cttccctgccc

SEQ ID NO: 2890041 - DNA, 11 bp, Homo sapiens
cttccctggct

SEQ ID NO: 2890042 - DNA, 12 bp, Homo sapiens
cttccctgtccc

SEQ ID NO: 2890043 - DNA, 12 bp, Homo sapiens
cttccctgttct

SEQ ID NO: 2890044 - DNA, 16 bp, Homo sapiens
cttcccttccctcacc

SEQ ID NO: 2890045 - DNA, 20 bp, Homo sapiens
cttcccttttaaacacattt

SEQ ID NO: 2890046 - DNA, 14 bp, Homo sapiens
cttcccttttacat

SEQ ID NO: 2890047 - DNA, 15 bp, Homo sapiens
cttccgcagtgtggc

SEQ ID NO: 2890048 - DNA, 17 bp, Homo sapiens
cttccgcagtgtggcca

SEQ ID NO: 2890049 - DNA, 18 bp, Homo sapiens
cttccgcatcctagtctc

SEQ ID NO: 2890050 - DNA, 13 bp, Homo sapiens
cttccgggagctg

SEQ ID NO: 2890051 - DNA, 23 bp, Homo sapiens
cttccgggagctggtgacagcct

SEQ ID NO: 2890052 - DNA, 15 bp, Homo sapiens
cttcctaacttattg

SEQ ID NO: 2890053 - DNA, 15 bp, Homo sapiens
cttcctaagcctgtg

SEQ ID NO: 2890054 - DNA, 15 bp, Homo sapiens
cttcctacctatccc

SEQ ID NO: 2890055 - DNA, 19 bp, Homo sapiens
cttcctagcttatctccct

SEQ ID NO: 2890056 - DNA, 18 bp, Homo sapiens
cttcctatatgcacttat

SEQ ID NO: 2890057 - DNA, 18 bp, Homo sapiens
cttcctatttctagggct

SEQ ID NO: 2890058 - DNA, 23 bp, Homo sapiens
cttcctatttctagggctgggaa

SEQ ID NO: 2890059 - DNA, 13 bp, Homo sapiens
cttcctcaagtct

SEQ ID NO: 2890060 - DNA, 16 bp, Homo sapiens
cttcctcactgcccaa

SEQ ID NO: 2890061 - DNA, 15 bp, Homo sapiens
cttcctcatctgtgc

SEQ ID NO: 2890062 - DNA, 16 bp, Homo sapiens
cttcctcatctgtgcc

SEQ ID NO: 2890063 - DNA, 17 bp, Homo sapiens
cttcctcatctgtgcct

SEQ ID NO: 2890064 - DNA, 19 bp, Homo sapiens
cttcctcatctgtgcctgt

SEQ ID NO: 2890065 - DNA, 20 bp, Homo sapiens
cttcctcatctgtgcctgtc

SEQ ID NO: 2890066 - DNA, 16 bp, Homo sapiens
cttcctccagaagcct

SEQ ID NO: 2890067 - DNA, 20 bp, Homo sapiens
cttcctccagtctgttctca

SEQ ID NO: 2890068 - DNA, 21 bp, Homo sapiens
cttcctccgaggccagtacct

SEQ ID NO: 2890069 - DNA, 15 bp, Homo sapiens
cttcctcctccacca

SEQ ID NO: 2890070 - DNA, 22 bp, Homo sapiens
cttcctcctgggccctctctgc

SEQ ID NO: 2890071 - DNA, 16 bp, Homo sapiens
cttcctctccacagga

SEQ ID NO: 2890072 - DNA, 12 bp, Homo sapiens
cttcctctcctt

SEQ ID NO: 2890073 - DNA, 16 bp, Homo sapiens
cttcctctctccagat

SEQ ID NO: 2890074 - DNA, 15 bp, Homo sapiens
cttcctcttggctga

SEQ ID NO: 2890075 - DNA, 21 bp, Homo sapiens
cttcctgagaaagcccacctg

SEQ ID NO: 2890076 - DNA, 23 bp, Homo sapiens
cttcctgagaaagcccacctggg

SEQ ID NO: 2890077 - DNA, 14 bp, Homo sapiens
cttctttccagtat

SEQ ID NO: 2890078 - DNA, 19 bp, Homo sapiens
cttctttggacttctgaag

SEQ ID NO: 2890079 - DNA, 21 bp, Homo sapiens
cttctttgtggtctttttcct

SEQ ID NO: 2890080 - DNA, 15 bp, Homo sapiens
cttcttttaaaaata

SEQ ID NO: 2890081 - DNA, 16 bp, Homo sapiens
cttcttttcacattct

SEQ ID NO: 2890082 - DNA, 18 bp, Homo sapiens
cttgaaaaaaaatagatg

SEQ ID NO: 2890083 - DNA, 22 bp, Homo sapiens
cttgaaaaagatccaagctcct

SEQ ID NO: 2890084 - DNA, 11 bp, Homo sapiens
cttgaaaacaa

SEQ ID NO: 2890085 - DNA, 16 bp, Homo sapiens
cttgaaaacaaacaaa

SEQ ID NO: 2890086 - DNA, 13 bp, Homo sapiens
cttgaaacctgat

SEQ ID NO: 2890087 - DNA, 13 bp, Homo sapiens
cttgaaaggggaa

SEQ ID NO: 2890088 - DNA, 23 bp, Homo sapiens
cttgaaatacgtttgtgtttcta

SEQ ID NO: 2890089 - DNA, 21 bp, Homo sapiens
cttgaaattaagaaggcaaaa

SEQ ID NO: 2890090 - DNA, 14 bp, Homo sapiens
cttgaacaaaaagt

SEQ ID NO: 2890091 - DNA, 20 bp, Homo sapiens
cttgaacccgggaggcagag

SEQ ID NO: 2890092 - DNA, 14 bp, Homo sapiens
cttgaacctgggaa

SEQ ID NO: 2890093 - DNA, 15 bp, Homo sapiens
cttgaacctgggagg

SEQ ID NO: 2890094 - DNA, 16 bp, Homo sapiens
cttgaacctgggaggt

SEQ ID NO: 2890095 - DNA, 23 bp, Homo sapiens
cttgaactcctgacgtcaagtga

SEQ ID NO: 2890096 - DNA, 19 bp, Homo sapiens
cttgaactgagcttggaag

SEQ ID NO: 2890097 - DNA, 13 bp, Homo sapiens
cttgaactgggcg

SEQ ID NO: 2890098 - DNA, 14 bp, Homo sapiens
cttgaactgggctc

SEQ ID NO: 2890099 - DNA, 24 bp, Homo sapiens
cttgaacttcacctgcaaagctct

SEQ ID NO: 2890100 - DNA, 23 bp, Homo sapiens
cttgaactttcctggatgtctga

SEQ ID NO: 2890101 - DNA, 15 bp, Homo sapiens
cttgaagacagagca

SEQ ID NO: 2890102 - DNA, 16 bp, Homo sapiens
cttgaagacagagcaa

SEQ ID NO: 2890103 - DNA, 14 bp, Homo sapiens
cttgaagggccaga

SEQ ID NO: 2890104 - DNA, 17 bp, Homo sapiens
cttgaagggccagagcc

SEQ ID NO: 2890105 - DNA, 23 bp, Homo sapiens
cttgaagtccaggactgggtctg

SEQ ID NO: 2890106 - DNA, 17 bp, Homo sapiens
cttgaagtcctggcttc

SEQ ID NO: 2890107 - DNA, 18 bp, Homo sapiens
cttgaagtcctggcttca

SEQ ID NO: 2890108 - DNA, 20 bp, Homo sapiens
cttgaagtcctggcttcagg

SEQ ID NO: 2890109 - DNA, 18 bp, Homo sapiens
cttgaatggagctggtga

SEQ ID NO: 2890110 - DNA, 20 bp, Homo sapiens
cttgaatgtggcttgagaaa

SEQ ID NO: 2890111 - DNA, 17 bp, Homo sapiens
cttgaattgtaactgtt

SEQ ID NO: 2890112 - DNA, 22 bp, Homo sapiens
cttgaattgtaactgttcttga

SEQ ID NO: 2890113 - DNA, 16 bp, Homo sapiens
cttgaatttgcatgtc

SEQ ID NO: 2890114 - DNA, 18 bp, Homo sapiens
cttgaatttgcatgtcta

SEQ ID NO: 2890115 - DNA, 19 bp, Homo sapiens
cttgaatttgcatgtctaa

SEQ ID NO: 2890116 - DNA, 22 bp, Homo sapiens
cttgacaaagtcaagccacatg

SEQ ID NO: 2890117 - DNA, 14 bp, Homo sapiens
cttgacaactggca

SEQ ID NO: 2890118 - DNA, 13 bp, Homo sapiens
cttgacagtctga

SEQ ID NO: 2890119 - DNA, 18 bp, Homo sapiens
cttgaccaagcaggaagc

SEQ ID NO: 2890120 - DNA, 17 bp, Homo sapiens
cttgaccattggctgcg

SEQ ID NO: 2890121 - DNA, 13 bp, Homo sapiens
cttgaccctgagc

SEQ ID NO: 2890122 - DNA, 14 bp, Homo sapiens
cttgaccctgagct

SEQ ID NO: 2890123 - DNA, 15 bp, Homo sapiens
cttgaccctgagctg

SEQ ID NO: 2890124 - DNA, 21 bp, Homo sapiens
cttgactgaagcgaacatctt

SEQ ID NO: 2890125 - DNA, 19 bp, Homo sapiens
cttgacttcagttattggt

SEQ ID NO: 2890126 - DNA, 17 bp, Homo sapiens
cttgactttggctgatt

SEQ ID NO: 2890127 - DNA, 22 bp, Homo sapiens
cttgagaaatatggacacttaa

SEQ ID NO: 2890128 - DNA, 17 bp, Homo sapiens
cttgagacacggagccc

SEQ ID NO: 2890129 - DNA, 18 bp, Homo sapiens
cttgagacctcagccatg

SEQ ID NO: 2890130 - DNA, 14 bp, Homo sapiens
cttgagagagaaat

SEQ ID NO: 2890131 - DNA, 16 bp, Homo sapiens
cttgctgactctctga

SEQ ID NO: 2890132 - DNA, 17 bp, Homo sapiens
cttgctgcagtgtccag

SEQ ID NO: 2890133 - DNA, 20 bp, Homo sapiens
cttgctgccaagtcctgcct

SEQ ID NO: 2890134 - DNA, 22 bp, Homo sapiens
cttgctgccaagtcctgccttt

SEQ ID NO: 2890135 - DNA, 13 bp, Homo sapiens
cttgctgtagaga

SEQ ID NO: 2890136 - DNA, 17 bp, Homo sapiens
cttgctgtagagacttc

SEQ ID NO: 2890137 - DNA, 18 bp, Homo sapiens
cttgctgtagagacttcc

SEQ ID NO: 2890138 - DNA, 20 bp, Homo sapiens
cttgctgttgacatatttaa

SEQ ID NO: 2890139 - DNA, 18 bp, Homo sapiens
cttgcttacaatctttat

SEQ ID NO: 2890140 - DNA, 22 bp, Homo sapiens
cttgcttaccttgactgttgat

SEQ ID NO: 2890141 - DNA, 24 bp, Homo sapiens
cttgcttaccttgactgttgatgt

SEQ ID NO: 2890142 - DNA, 15 bp, Homo sapiens
cttgcttccaagacc

SEQ ID NO: 2890143 - DNA, 14 bp, Homo sapiens
cttgcttcttactg

SEQ ID NO: 2890144 - DNA, 15 bp, Homo sapiens
cttgcttcttactga

SEQ ID NO: 2890145 - DNA, 19 bp, Homo sapiens
cttgcttcttactgataat

SEQ ID NO: 2890146 - DNA, 20 bp, Homo sapiens
cttgcttgattgtatggtgg

SEQ ID NO: 2890147 - DNA, 12 bp, Homo sapiens
cttgcttgcctg

SEQ ID NO: 2890148 - DNA, 13 bp, Homo sapiens
cttgcttgttaca

SEQ ID NO: 2890149 - DNA, 20 bp, Homo sapiens
cttgcttttttgaaagatgc

SEQ ID NO: 2890150 - DNA, 14 bp, Homo sapiens
cttggaaataaacc

SEQ ID NO: 2890151 - DNA, 17 bp, Homo sapiens
cttggaactgtcccagc

SEQ ID NO: 2890152 - DNA, 15 bp, Homo sapiens
cttggaagcttctgg

SEQ ID NO: 2890153 - DNA, 18 bp, Homo sapiens
cttggaattagatgttta

SEQ ID NO: 2890154 - DNA, 13 bp, Homo sapiens
cttggacactgta

SEQ ID NO: 2890155 - DNA, 18 bp, Homo sapiens
cttggagatctttgcttc

SEQ ID NO: 2890156 - DNA, 14 bp, Homo sapiens
cttggagcatttat

SEQ ID NO: 2890157 - DNA, 15 bp, Homo sapiens
cttggagcctgcaga

SEQ ID NO: 2890158 - DNA, 20 bp, Homo sapiens
cttggagcctgcagagctgc

SEQ ID NO: 2890159 - DNA, 14 bp, Homo sapiens
cttggagctgagca

SEQ ID NO: 2890160 - DNA, 12 bp, Homo sapiens
cttggaggacag

SEQ ID NO: 2890161 - DNA, 16 bp, Homo sapiens
cttggaggacagtggg

SEQ ID NO: 2890162 - DNA, 14 bp, Homo sapiens
cttggataccagct

SEQ ID NO: 2890163 - DNA, 21 bp, Homo sapiens
cttggataccagctcagggga

SEQ ID NO: 2890164 - DNA, 14 bp, Homo sapiens
cttggatcccaaag

SEQ ID NO: 2890165 - DNA, 18 bp, Homo sapiens
cttggattccctctgcct

SEQ ID NO: 2890166 - DNA, 15 bp, Homo sapiens
cttggcaactttctt

SEQ ID NO: 2890167 - DNA, 23 bp, Homo sapiens
cttggcacatagtgggccttcat

SEQ ID NO: 2890168 - DNA, 21 bp, Homo sapiens
cttggcaccagacacccagga

SEQ ID NO: 2890169 - DNA, 15 bp, Homo sapiens
cttggcacctgccta

SEQ ID NO: 2890170 - DNA, 17 bp, Homo sapiens
cttggcacctgcctagc

SEQ ID NO: 2890171 - DNA, 18 bp, Homo sapiens
cttggcacctgcctagct

SEQ ID NO: 2890172 - DNA, 18 bp, Homo sapiens
cttggcagcacctgtctc

SEQ ID NO: 2890173 - DNA, 19 bp, Homo sapiens
cttggcagcacctgtctcc

SEQ ID NO: 2890174 - DNA, 16 bp, Homo sapiens
cttggccaagagaagg

SEQ ID NO: 2890175 - DNA, 14 bp, Homo sapiens
cagcagcagagagc

SEQ ID NO: 2890176 - DNA, 18 bp, Homo sapiens
cagcagcatcccagcctt

SEQ ID NO: 2890177 - DNA, 12 bp, Homo sapiens
cagcagccctcc

SEQ ID NO: 2890178 - DNA, 11 bp, Homo sapiens
cagcagcctgc

SEQ ID NO: 2890179 - DNA, 14 bp, Homo sapiens
cagcagcctgccag

SEQ ID NO: 2890180 - DNA, 15 bp, Homo sapiens
cagcagcctgccagc

SEQ ID NO: 2890181 - DNA, 21 bp, Homo sapiens
cagcagcctggggctggcctc

SEQ ID NO: 2890182 - DNA, 14 bp, Homo sapiens
cagcagcctgtgag

SEQ ID NO: 2890183 - DNA, 17 bp, Homo sapiens
cagcagcgcgcaggcct

SEQ ID NO: 2890184 - DNA, 18 bp, Homo sapiens
cagcagcgcgcaggcctg

SEQ ID NO: 2890185 - DNA, 19 bp, Homo sapiens
cagcagcgcgcaggcctgc

SEQ ID NO: 2890186 - DNA, 16 bp, Homo sapiens
cagcaggcatggcttc

SEQ ID NO: 2890187 - DNA, 14 bp, Homo sapiens
cagcaggcctccct

SEQ ID NO: 2890188 - DNA, 23 bp, Homo sapiens
cagcagggaaaatgcagcaggga

SEQ ID NO: 2890189 - DNA, 24 bp, Homo sapiens
cagcagggaaaatgcagcagggat

SEQ ID NO: 2890190 - DNA, 16 bp, Homo sapiens
cagcagggatgccctg

SEQ ID NO: 2890191 - DNA, 20 bp, Homo sapiens
cagcagggtcttttcatctg

SEQ ID NO: 2890192 - DNA, 16 bp, Homo sapiens
cagcagggtttgagca

SEQ ID NO: 2890193 - DNA, 19 bp, Homo sapiens
cagcaggtgcggcgcgcac

SEQ ID NO: 2890194 - DNA, 13 bp, Homo sapiens
cagcagtagacat

SEQ ID NO: 2890195 - DNA, 14 bp, Homo sapiens
cagcagtagacatt

SEQ ID NO: 2890196 - DNA, 15 bp, Homo sapiens
cagcagtctctgcct

SEQ ID NO: 2890197 - DNA, 17 bp, Homo sapiens
cagcagttgactcagag

SEQ ID NO: 2890198 - DNA, 17 bp, Homo sapiens
cagcagtttgggaggtc

SEQ ID NO: 2890199 - DNA, 22 bp, Homo sapiens
cagcataggtatgcttactatg

SEQ ID NO: 2890200 - DNA, 20 bp, Homo sapiens
cagcatatatagtatttaat

SEQ ID NO: 2890201 - DNA, 22 bp, Homo sapiens
cagcatcaaacatgaaaacatt

SEQ ID NO: 2890202 - DNA, 16 bp, Homo sapiens
cagcatcacctgcctg

SEQ ID NO: 2890203 - DNA, 14 bp, Homo sapiens
cagcatcccagcct

SEQ ID NO: 2890204 - DNA, 20 bp, Homo sapiens
cagcatccccttgaactctt

SEQ ID NO: 2890205 - DNA, 17 bp, Homo sapiens
cagcatccgcaggtgct

SEQ ID NO: 2890206 - DNA, 22 bp, Homo sapiens
cagcatcggacaagacccccag

SEQ ID NO: 2890207 - DNA, 15 bp, Homo sapiens
cagcatctgaccatc

SEQ ID NO: 2890208 - DNA, 16 bp, Homo sapiens
cagcatctgaccatct

SEQ ID NO: 2890209 - DNA, 18 bp, Homo sapiens
cagcatctgaccatctgt

SEQ ID NO: 2890210 - DNA, 20 bp, Homo sapiens
cagcatctgaccatctgtga

SEQ ID NO: 2890211 - DNA, 21 bp, Homo sapiens
cagcatcttaccttcatatgc

SEQ ID NO: 2890212 - DNA, 15 bp, Homo sapiens
cagcatggcactccc

SEQ ID NO: 2890213 - DNA, 18 bp, Homo sapiens
cagcatggcactccctcc

SEQ ID NO: 2890214 - DNA, 22 bp, Homo sapiens
cagcatggcactccctccagca

SEQ ID NO: 2890215 - DNA, 20 bp, Homo sapiens
cagcatgttttctgctttaa

SEQ ID NO: 2890216 - DNA, 15 bp, Homo sapiens
cagcattccatgacc

SEQ ID NO: 2890217 - DNA, 15 bp, Homo sapiens
cagcattctcagcca

SEQ ID NO: 2890218 - DNA, 20 bp, Homo sapiens
cagcattctcaggcaccagt

SEQ ID NO: 2890219 - DNA, 13 bp, Homo sapiens
cagcattgctttc

SEQ ID NO: 2890220 - DNA, 16 bp, Homo sapiens
cagcattgctttctga

SEQ ID NO: 2890221 - DNA, 19 bp, Homo sapiens
cagcattgttgagctgtca

SEQ ID NO: 2890222 - DNA, 21 bp, Homo sapiens
cagcatttagctggccacatg

SEQ ID NO: 2890223 - DNA, 23 bp, Homo sapiens
cagcatttccacaccaagcagca

SEQ ID NO: 2890224 - DNA, 16 bp, Homo sapiens
cagccaaacagtatga

SEQ ID NO: 2890225 - DNA, 13 bp, Homo sapiens
cagccaacagcta

SEQ ID NO: 2890226 - DNA, 15 bp, Homo sapiens
cagccaacagctaca

SEQ ID NO: 2890227 - DNA, 22 bp, Homo sapiens
cagccaactagcccctggggtg

SEQ ID NO: 2890228 - DNA, 17 bp, Homo sapiens
cagccaagcacagtggt

SEQ ID NO: 2890229 - DNA, 13 bp, Homo sapiens
cagccaatctgga

SEQ ID NO: 2890230 - DNA, 17 bp, Homo sapiens
cagccaatttgtctcct

SEQ ID NO: 2890231 - DNA, 22 bp, Homo sapiens
cagccacacacacagaaaatat

SEQ ID NO: 2890232 - DNA, 13 bp, Homo sapiens
cagccacaccact

SEQ ID NO: 2890233 - DNA, 22 bp, Homo sapiens
cagccacacgcaggcggccagg

SEQ ID NO: 2890234 - DNA, 23 bp, Homo sapiens
cagccacacgcaggcggccaggg

SEQ ID NO: 2890235 - DNA, 23 bp, Homo sapiens
cagccacagtttcctcatctgtc

SEQ ID NO: 2890236 - DNA, 12 bp, Homo sapiens
cagccacccctg

SEQ ID NO: 2890237 - DNA, 15 bp, Homo sapiens
cagccacccctgcca

SEQ ID NO: 2890238 - DNA, 18 bp, Homo sapiens
cagccacccctgccactc

SEQ ID NO: 2890239 - DNA, 16 bp, Homo sapiens
cagccacctaaacggt

SEQ ID NO: 2890240 - DNA, 10 bp, Homo sapiens
cagccacctc

SEQ ID NO: 2890241 - DNA, 17 bp, Homo sapiens
cagccacctccctctgc

SEQ ID NO: 2890242 - DNA, 18 bp, Homo sapiens
cagccacgaggtgcaaca

SEQ ID NO: 2890243 - DNA, 16 bp, Homo sapiens
cagccactccaagccc

SEQ ID NO: 2890244 - DNA, 20 bp, Homo sapiens
cagccactccaagccccctg

SEQ ID NO: 2890245 - DNA, 20 bp, Homo sapiens
cagccacttttagctactgc

SEQ ID NO: 2890246 - DNA, 20 bp, Homo sapiens
cagccagaacgtggctctgc

SEQ ID NO: 2890247 - DNA, 13 bp, Homo sapiens
cagccagaggcac

SEQ ID NO: 2890248 - DNA, 22 bp, Homo sapiens
cagccagatggactccagcctg

SEQ ID NO: 2890249 - DNA, 14 bp, Homo sapiens
cagccagccactct

SEQ ID NO: 2890250 - DNA, 17 bp, Homo sapiens
cagccagcccagcccag

SEQ ID NO: 2890251 - DNA, 22 bp, Homo sapiens
cagccaggagaaggtcagcgag

SEQ ID NO: 2890252 - DNA, 15 bp, Homo sapiens
cagccaggccccagg

SEQ ID NO: 2890253 - DNA, 11 bp, Homo sapiens
cagccaggcct

SEQ ID NO: 2890254 - DNA, 16 bp, Homo sapiens
cagccaggcctcgcct

SEQ ID NO: 2890255 - DNA, 19 bp, Homo sapiens
cagccaggcctcgcctgcc

SEQ ID NO: 2890256 - DNA, 15 bp, Homo sapiens
cagccaggctgggcc

SEQ ID NO: 2890257 - DNA, 16 bp, Homo sapiens
cagccagtgacctgag

SEQ ID NO: 2890258 - DNA, 20 bp, Homo sapiens
cagccagttttactgtgatt

SEQ ID NO: 2890259 - DNA, 22 bp, Homo sapiens
cagccatagtttgggtattttt

SEQ ID NO: 2890260 - DNA, 23 bp, Homo sapiens
cagccatgagaacaaaacctctt

SEQ ID NO: 2890261 - DNA, 22 bp, Homo sapiens
cagccatgaggagttgctgttt

SEQ ID NO: 2890262 - DNA, 22 bp, Homo sapiens
cagccatgcgcgcgctctctct

SEQ ID NO: 2890263 - DNA, 13 bp, Homo sapiens
cagccatggccct

SEQ ID NO: 2890264 - DNA, 19 bp, Homo sapiens
cagccatgtctgtgctgtg

SEQ ID NO: 2890265 - DNA, 21 bp, Homo sapiens
cagccattgcacccagcccag

SEQ ID NO: 2890266 - DNA, 21 bp, Homo sapiens
cagccatttttcaatttttct

SEQ ID NO: 2890267 - DNA, 16 bp, Homo sapiens
cagcccaaaccttggg

SEQ ID NO: 2890268 - DNA, 13 bp, Homo sapiens
cagcccaacagca

SEQ ID NO: 2890269 - DNA, 13 bp, Homo sapiens
cagcccaatccag

SEQ ID NO: 2890270 - DNA, 17 bp, Homo sapiens
cagcccaatccaggtac

SEQ ID NO: 2890271 - DNA, 13 bp, Homo sapiens
cagcccacagagc

SEQ ID NO: 2890272 - DNA, 15 bp, Homo sapiens
cagcccacagagcct

SEQ ID NO: 2890273 - DNA, 21 bp, Homo sapiens
cagcccaccaggagcacctgg

SEQ ID NO: 2890274 - DNA, 17 bp, Homo sapiens
cagcccacgtcacgtgt

SEQ ID NO: 2890275 - DNA, 12 bp, Homo sapiens
cagcccagagac

SEQ ID NO: 2890276 - DNA, 21 bp, Homo sapiens
cagcccagagacatacttgaa

SEQ ID NO: 2890277 - DNA, 13 bp, Homo sapiens
cagcccagagccc

SEQ ID NO: 2890278 - DNA, 16 bp, Homo sapiens
cagcccagagcccggt

SEQ ID NO: 2890279 - DNA, 20 bp, Homo sapiens
cagcccagaggccaacactg

SEQ ID NO: 2890280 - DNA, 23 bp, Homo sapiens
cagcccagcatttcccgaaggcc

SEQ ID NO: 2890281 - DNA, 13 bp, Homo sapiens
cagcccagcccag

SEQ ID NO: 2890282 - DNA, 17 bp, Homo sapiens
cagcccagttcccgtga

SEQ ID NO: 2890283 - DNA, 23 bp, Homo sapiens
cagcccatccatagtaactgaca

SEQ ID NO: 2890284 - DNA, 21 bp, Homo sapiens
cagcccattctctctcctgtc

SEQ ID NO: 2890285 - DNA, 23 bp, Homo sapiens
cagcccattctctctcctgtcca

SEQ ID NO: 2890286 - DNA, 13 bp, Homo sapiens
cagcccatttctc

SEQ ID NO: 2890287 - DNA, 17 bp, Homo sapiens
cagcccatttctccaga

SEQ ID NO: 2890288 - DNA, 18 bp, Homo sapiens
cagcccatttctccagaa

SEQ ID NO: 2890289 - DNA, 14 bp, Homo sapiens
cagccccagcacca

SEQ ID NO: 2890290 - DNA, 20 bp, Homo sapiens
cagccccatctgtgcattct

SEQ ID NO: 2890291 - DNA, 17 bp, Homo sapiens
cagcccccacatcctgt

SEQ ID NO: 2890292 - DNA, 17 bp, Homo sapiens
cagcccccgggacaccg

SEQ ID NO: 2890293 - DNA, 24 bp, Homo sapiens
cagccccgcgtggaactcgtgtct

SEQ ID NO: 2890294 - DNA, 17 bp, Homo sapiens
cagccccgctcccacct

SEQ ID NO: 2890295 - DNA, 12 bp, Homo sapiens
cagcccctaccc

SEQ ID NO: 2890296 - DNA, 22 bp, Homo sapiens
cagcccctacccctgccctgct

SEQ ID NO: 2890297 - DNA, 15 bp, Homo sapiens
cagcccctccatctg

SEQ ID NO: 2890298 - DNA, 17 bp, Homo sapiens
cagcccctccatctgta

SEQ ID NO: 2890299 - DNA, 13 bp, Homo sapiens
cagcccctcctct

SEQ ID NO: 2890300 - DNA, 14 bp, Homo sapiens
cagcccctcctctg

SEQ ID NO: 2890301 - DNA, 16 bp, Homo sapiens
cagcccctcctctgcc

SEQ ID NO: 2890302 - DNA, 17 bp, Homo sapiens
cagcccctcctctgcca

SEQ ID NO: 2890303 - DNA, 14 bp, Homo sapiens
cagcccctgcagac

SEQ ID NO: 2890304 - DNA, 22 bp, Homo sapiens
cagcccctgcagacgtctggcc

SEQ ID NO: 2890305 - DNA, 19 bp, Homo sapiens
cagcccctgctgtgtgggt

SEQ ID NO: 2890306 - DNA, 18 bp, Homo sapiens
cacttcctctccacagga

SEQ ID NO: 2890307 - DNA, 21 bp, Homo sapiens
cacttcctctccacaggagcc

SEQ ID NO: 2890308 - DNA, 22 bp, Homo sapiens
cacttcctctccacaggagcct

SEQ ID NO: 2890309 - DNA, 21 bp, Homo sapiens
cacttctagatctcagccatt

SEQ ID NO: 2890310 - DNA, 21 bp, Homo sapiens
cacttctcatcacacacatgg

SEQ ID NO: 2890311 - DNA, 13 bp, Homo sapiens
cacttctccaaga

SEQ ID NO: 2890312 - DNA, 21 bp, Homo sapiens
cacttctctgggtcccggggt

SEQ ID NO: 2890313 - DNA, 19 bp, Homo sapiens
cacttctggtcaatcaaca

SEQ ID NO: 2890314 - DNA, 19 bp, Homo sapiens
cacttctggtcccctgtgg

SEQ ID NO: 2890315 - DNA, 16 bp, Homo sapiens
cacttctttatactct

SEQ ID NO: 2890316 - DNA, 22 bp, Homo sapiens
cacttctttatactctcttccc

SEQ ID NO: 2890317 - DNA, 18 bp, Homo sapiens
cacttctttgcagagcct

SEQ ID NO: 2890318 - DNA, 15 bp, Homo sapiens
cacttcttttataac

SEQ ID NO: 2890319 - DNA, 19 bp, Homo sapiens
cacttgaaagattttattg

SEQ ID NO: 2890320 - DNA, 17 bp, Homo sapiens
cacttgaatccattgaa

SEQ ID NO: 2890321 - DNA, 22 bp, Homo sapiens
cacttgatgtttcctggaagca

SEQ ID NO: 2890322 - DNA, 23 bp, Homo sapiens
cacttgatgtttcctggaagcag

SEQ ID NO: 2890323 - DNA, 15 bp, Homo sapiens
cacttgattcataaa

SEQ ID NO: 2890324 - DNA, 13 bp, Homo sapiens
cacttgcagagga

SEQ ID NO: 2890325 - DNA, 14 bp, Homo sapiens
cacttgcagaggag

SEQ ID NO: 2890326 - DNA, 19 bp, Homo sapiens
cacttgcagaggagcccag

SEQ ID NO: 2890327 - DNA, 22 bp, Homo sapiens
cacttgccagggctctgggggc

SEQ ID NO: 2890328 - DNA, 14 bp, Homo sapiens
cacttgccctgctc

SEQ ID NO: 2890329 - DNA, 12 bp, Homo sapiens
cacttgcctggg

SEQ ID NO: 2890330 - DNA, 13 bp, Homo sapiens
cacttgcctgggt

SEQ ID NO: 2890331 - DNA, 14 bp, Homo sapiens
cacttggaaaggtt

SEQ ID NO: 2890332 - DNA, 19 bp, Homo sapiens
cacttggggagatttgcca

SEQ ID NO: 2890333 - DNA, 16 bp, Homo sapiens
cacttggtctgccagg

SEQ ID NO: 2890334 - DNA, 17 bp, Homo sapiens
cacttggtgctgggaac

SEQ ID NO: 2890335 - DNA, 13 bp, Homo sapiens
cacttgtatatac

SEQ ID NO: 2890336 - DNA, 20 bp, Homo sapiens
cacttgtccccaaatccgaa

SEQ ID NO: 2890337 - DNA, 14 bp, Homo sapiens
cacttgtcttgctc

SEQ ID NO: 2890338 - DNA, 15 bp, Homo sapiens
cacttgtcttgctct

SEQ ID NO: 2890339 - DNA, 14 bp, Homo sapiens
cacttgtgccagcc

SEQ ID NO: 2890340 - DNA, 17 bp, Homo sapiens
cacttgtgccagcccgg

SEQ ID NO: 2890341 - DNA, 15 bp, Homo sapiens
cacttgtgggtcctg

SEQ ID NO: 2890342 - DNA, 23 bp, Homo sapiens
cactttagaaagccagcacctgg

SEQ ID NO: 2890343 - DNA, 14 bp, Homo sapiens
cactttcatttttg

SEQ ID NO: 2890344 - DNA, 21 bp, Homo sapiens
cactttccaccaactttttcc

SEQ ID NO: 2890345 - DNA, 13 bp, Homo sapiens
cactttcccaccc

SEQ ID NO: 2890346 - DNA, 18 bp, Homo sapiens
cactttccttctctgtaa

SEQ ID NO: 2890347 - DNA, 20 bp, Homo sapiens
cactttctatcctctgtaaa

SEQ ID NO: 2890348 - DNA, 20 bp, Homo sapiens
cactttgttggcccttccag

SEQ ID NO: 2890349 - DNA, 23 bp, Homo sapiens
cagatgaatgtatttatttggga

SEQ ID NO: 2890350 - DNA, 18 bp, Homo sapiens
cagatgaccaaagtccct

SEQ ID NO: 2890351 - DNA, 19 bp, Homo sapiens
cagatgatgctttggaaga

SEQ ID NO: 2890352 - DNA, 16 bp, Homo sapiens
cagatgcaaagaggca

SEQ ID NO: 2890353 - DNA, 23 bp, Homo sapiens
cagatgcaaagaggcaagaggct

SEQ ID NO: 2890354 - DNA, 14 bp, Homo sapiens
cagatgcaatgact

SEQ ID NO: 2890355 - DNA, 15 bp, Homo sapiens
cagatgcaatgtgct

SEQ ID NO: 2890356 - DNA, 16 bp, Homo sapiens
cagatgcagctcaaga

SEQ ID NO: 2890357 - DNA, 14 bp, Homo sapiens
cagatgcagggcag

SEQ ID NO: 2890358 - DNA, 21 bp, Homo sapiens
cagatgcggggacaggctgga

SEQ ID NO: 2890359 - DNA, 21 bp, Homo sapiens
cagatgcgtcccaagatgttg

SEQ ID NO: 2890360 - DNA, 11 bp, Homo sapiens
cagatgctcaa

SEQ ID NO: 2890361 - DNA, 18 bp, Homo sapiens
cagatgctccaagattct

SEQ ID NO: 2890362 - DNA, 19 bp, Homo sapiens
cagatgctccaagattcta

SEQ ID NO: 2890363 - DNA, 15 bp, Homo sapiens
cagatgctgagccat

SEQ ID NO: 2890364 - DNA, 13 bp, Homo sapiens
cagatgctgatgt

SEQ ID NO: 2890365 - DNA, 14 bp, Homo sapiens
cagatgctgatgtt

SEQ ID NO: 2890366 - DNA, 15 bp, Homo sapiens
cagatgctgatgttc

SEQ ID NO: 2890367 - DNA, 18 bp, Homo sapiens
cagatgctgatgttcagt

SEQ ID NO: 2890368 - DNA, 21 bp, Homo sapiens
cagatgctgatgttcagtgta

SEQ ID NO: 2890369 - DNA, 12 bp, Homo sapiens
cagatgctggcc

SEQ ID NO: 2890370 - DNA, 13 bp, Homo sapiens
cagatgctggcct

SEQ ID NO: 2890371 - DNA, 18 bp, Homo sapiens
cagatgctggcctcttgg

SEQ ID NO: 2890372 - DNA, 20 bp, Homo sapiens
cagatgctggcctcttggca

SEQ ID NO: 2890373 - DNA, 22 bp, Homo sapiens
cagatggaaccgcaggaagctg

SEQ ID NO: 2890374 - DNA, 18 bp, Homo sapiens
cagatggacgcaggccct

SEQ ID NO: 2890375 - DNA, 19 bp, Homo sapiens
cagatggacgcaggccctg

SEQ ID NO: 2890376 - DNA, 22 bp, Homo sapiens
cagatggattgataattgcatt

SEQ ID NO: 2890377 - DNA, 23 bp, Homo sapiens
cagatggattgataattgcattc

SEQ ID NO: 2890378 - DNA, 15 bp, Homo sapiens
cagatggcagggctg

SEQ ID NO: 2890379 - DNA, 19 bp, Homo sapiens
cagatggcagggctgagga

SEQ ID NO: 2890380 - DNA, 17 bp, Homo sapiens
cagatggccactgctct

SEQ ID NO: 2890381 - DNA, 19 bp, Homo sapiens
cagatggtttccacattta

SEQ ID NO: 2890382 - DNA, 12 bp, Homo sapiens
cagatgtaatgt

SEQ ID NO: 2890383 - DNA, 16 bp, Homo sapiens
cagatgtaatgttttc

SEQ ID NO: 2890384 - DNA, 20 bp, Homo sapiens
cagatgtccctgaagtcttg

SEQ ID NO: 2890385 - DNA, 17 bp, Homo sapiens
cagatgtgcagcagatt

SEQ ID NO: 2890386 - DNA, 19 bp, Homo sapiens
cagatgtgcagcagattgg

SEQ ID NO: 2890387 - DNA, 17 bp, Homo sapiens
cagatgtggagccaggc

SEQ ID NO: 2890388 - DNA, 19 bp, Homo sapiens
cagatgtggggctgagctg

SEQ ID NO: 2890389 - DNA, 15 bp, Homo sapiens
cagatgttatttttg

SEQ ID NO: 2890390 - DNA, 22 bp, Homo sapiens
cagatgttcggtttttttcctg

SEQ ID NO: 2890391 - DNA, 17 bp, Homo sapiens
cagatgttgaattcttt

SEQ ID NO: 2890392 - DNA, 15 bp, Homo sapiens
cagatgtttccagac

SEQ ID NO: 2890393 - DNA, 16 bp, Homo sapiens
cagatgtttccagact

SEQ ID NO: 2890394 - DNA, 22 bp, Homo sapiens
cagattatctatttgtgtgtgt

SEQ ID NO: 2890395 - DNA, 21 bp, Homo sapiens
cagattatgtattaacttgta

SEQ ID NO: 2890396 - DNA, 22 bp, Homo sapiens
cagattatgtattaacttgtag

SEQ ID NO: 2890397 - DNA, 14 bp, Homo sapiens
cagattattaaaat

SEQ ID NO: 2890398 - DNA, 13 bp, Homo sapiens
cagattattttgg

SEQ ID NO: 2890399 - DNA, 16 bp, Homo sapiens
cagattattttggaaa

SEQ ID NO: 2890400 - DNA, 14 bp, Homo sapiens
cagattcccactgc

SEQ ID NO: 2890401 - DNA, 14 bp, Homo sapiens
cagattcccaggcc

SEQ ID NO: 2890402 - DNA, 15 bp, Homo sapiens
cagattcccaggcca

SEQ ID NO: 2890403 - DNA, 16 bp, Homo sapiens
cagattcccaggccag

SEQ ID NO: 2890404 - DNA, 20 bp, Homo sapiens
cagattcccaggccagggct

SEQ ID NO: 2890405 - DNA, 21 bp, Homo sapiens
cagattcccaggccagggctg

SEQ ID NO: 2890406 - DNA, 22 bp, Homo sapiens
cagattcccaggccagggctgg

SEQ ID NO: 2890407 - DNA, 13 bp, Homo sapiens
cagattcccttcc

SEQ ID NO: 2890408 - DNA, 18 bp, Homo sapiens
cagattgcagttctgatt

SEQ ID NO: 2890409 - DNA, 16 bp, Homo sapiens
cagattgcatgtgact

SEQ ID NO: 2890410 - DNA, 17 bp, Homo sapiens
cagattggccaattaaa

SEQ ID NO: 2890411 - DNA, 15 bp, Homo sapiens
cagattgtcttaatt

SEQ ID NO: 2890412 - DNA, 16 bp, Homo sapiens
cagattgtttctatac

SEQ ID NO: 2890413 - DNA, 17 bp, Homo sapiens
cagattgtttctataca

SEQ ID NO: 2890414 - DNA, 22 bp, Homo sapiens
cagatttagtgaaagctagaga

SEQ ID NO: 2890415 - DNA, 15 bp, Homo sapiens
cagatttgaggctgg

SEQ ID NO: 2890416 - DNA, 18 bp, Homo sapiens
cagatttgaggctggttt

SEQ ID NO: 2890417 - DNA, 15 bp, Homo sapiens
cagatttgtgaactc

SEQ ID NO: 2890418 - DNA, 16 bp, Homo sapiens
cagatttgtgaactca

SEQ ID NO: 2890419 - DNA, 22 bp, Homo sapiens
cagatttgtggggacctcagcc

SEQ ID NO: 2890420 - DNA, 23 bp, Homo sapiens
cagatttgtggggacctcagcct

SEQ ID NO: 2890421 - DNA, 13 bp, Homo sapiens
cagattttatatt

SEQ ID NO: 2890422 - DNA, 18 bp, Homo sapiens
cagattttatattttcta

SEQ ID NO: 2890423 - DNA, 21 bp, Homo sapiens
cagattttatattttctattt

SEQ ID NO: 2890424 - DNA, 23 bp, Homo sapiens
cagattttggggttgtgttgtca

SEQ ID NO: 2890425 - DNA, 22 bp, Homo sapiens
cagcaaaatccaaactgctgtc

SEQ ID NO: 2890426 - DNA, 22 bp, Homo sapiens
cagcaaaatccttacttccagc

SEQ ID NO: 2890427 - DNA, 13 bp, Homo sapiens
cagcaaacacaat

SEQ ID NO: 2890428 - DNA, 15 bp, Homo sapiens
cagcaaacacaataa

SEQ ID NO: 2890429 - DNA, 16 bp, Homo sapiens
cagcaaacacaataag

SEQ ID NO: 2890430 - DNA, 18 bp, Homo sapiens
cagcaaacacaataagag

SEQ ID NO: 2890431 - DNA, 15 bp, Homo sapiens
cagcaaatagcaaat

SEQ ID NO: 2890432 - DNA, 16 bp, Homo sapiens
cagcaaattccagatt

SEQ ID NO: 2890433 - DNA, 19 bp, Homo sapiens
cagcaacaaaatcatggct

SEQ ID NO: 2890434 - DNA, 19 bp, Homo sapiens
cagcaacaaccatctcatc

SEQ ID NO: 2890435 - DNA, 14 bp, Homo sapiens
cagcaacagcctac

SEQ ID NO: 2890436 - DNA, 17 bp, Homo sapiens
cagcaaccccaggctga

SEQ ID NO: 2890437 - DNA, 14 bp, Homo sapiens
cagcaagaaaaaaa

SEQ ID NO: 2890438 - DNA, 17 bp, Homo sapiens
cagcaagaaaaaaaaat

SEQ ID NO: 2890439 - DNA, 17 bp, Homo sapiens
cagcaagagagaaccta

SEQ ID NO: 2890440 - DNA, 21 bp, Homo sapiens
cagcaagtcccagacaaggag

SEQ ID NO: 2890441 - DNA, 22 bp, Homo sapiens
cagcaagtcccagacaaggaga

SEQ ID NO: 2890442 - DNA, 13 bp, Homo sapiens
cagcacaaacaca

SEQ ID NO: 2890443 - DNA, 16 bp, Homo sapiens
cagcacaaacacaagg

SEQ ID NO: 2890444 - DNA, 22 bp, Homo sapiens
cagcacaaggccttgcctggcc

SEQ ID NO: 2890445 - DNA, 14 bp, Homo sapiens
cagcacacagggca

SEQ ID NO: 2890446 - DNA, 18 bp, Homo sapiens
cagcacacagggcagtga

SEQ ID NO: 2890447 - DNA, 19 bp, Homo sapiens
cagcacacagggcagtgag

SEQ ID NO: 2890448 - DNA, 13 bp, Homo sapiens
cagcacagccaac

SEQ ID NO: 2890449 - DNA, 11 bp, Homo sapiens
cagcacagctc

SEQ ID NO: 2890450 - DNA, 18 bp, Homo sapiens
cagcacagctcctcccct

SEQ ID NO: 2890451 - DNA, 22 bp, Homo sapiens
cagcacagctcctcccctgccg

SEQ ID NO: 2890452 - DNA, 15 bp, Homo sapiens
cagcacatcacctct

SEQ ID NO: 2890453 - DNA, 20 bp, Homo sapiens
cagcacatgcgggctcgccc

SEQ ID NO: 2890454 - DNA, 13 bp, Homo sapiens
cagcaccaccagg

SEQ ID NO: 2890455 - DNA, 22 bp, Homo sapiens
cagcaccaccaggtctcccggg

SEQ ID NO: 2890456 - DNA, 22 bp, Homo sapiens
cagcacccagtcctctgcctcc

SEQ ID NO: 2890457 - DNA, 15 bp, Homo sapiens
cagcaccgaggggcc

SEQ ID NO: 2890458 - DNA, 22 bp, Homo sapiens
cagcaccgccggctttcagggc

SEQ ID NO: 2890459 - DNA, 17 bp, Homo sapiens
cagcaccgtgccaaccc

SEQ ID NO: 2890460 - DNA, 16 bp, Homo sapiens
cagcaccgttctgtgc

SEQ ID NO: 2890461 - DNA, 17 bp, Homo sapiens
cagcacctcagcctgca

SEQ ID NO: 2890462 - DNA, 13 bp, Homo sapiens
cagcacctgtctc

SEQ ID NO: 2890463 - DNA, 18 bp, Homo sapiens
cagcaccttggcccagga

SEQ ID NO: 2890464 - DNA, 19 bp, Homo sapiens
cagcaccttggcccaggag

SEQ ID NO: 2890465 - DNA, 16 bp, Homo sapiens
cagcaccttgtgcctg

SEQ ID NO: 2890466 - DNA, 17 bp, Homo sapiens
cagcaccttgtgcctgg

SEQ ID NO: 2890467 - DNA, 19 bp, Homo sapiens
cagcaccttgtgcctgggg

SEQ ID NO: 2890468 - DNA, 20 bp, Homo sapiens
cagcaccttgtgcctggggt

SEQ ID NO: 2890469 - DNA, 19 bp, Homo sapiens
cagcacggcccggcccctc

SEQ ID NO: 2890470 - DNA, 23 bp, Homo sapiens
cagcacggcccggcccctcaccc

SEQ ID NO: 2890471 - DNA, 14 bp, Homo sapiens
cagcactgctgcct

SEQ ID NO: 2890472 - DNA, 15 bp, Homo sapiens
cagcactgctgcctc

SEQ ID NO: 2890473 - DNA, 18 bp, Homo sapiens
cagcactgcttgaggaaa

SEQ ID NO: 2890474 - DNA, 19 bp, Homo sapiens
cagcactgcttgaggaaaa

SEQ ID NO: 2890475 - DNA, 13 bp, Homo sapiens
cagcacttattta

SEQ ID NO: 2890476 - DNA, 23 bp, Homo sapiens
cagcacttgggggttcaggcccg

SEQ ID NO: 2890477 - DNA, 13 bp, Homo sapiens
cagcacttgtata

SEQ ID NO: 2890478 - DNA, 19 bp, Homo sapiens
cagcactttaccagaggca

SEQ ID NO: 2890479 - DNA, 15 bp, Homo sapiens
cagcactttgggagg

SEQ ID NO: 2890480 - DNA, 19 bp, Homo sapiens
cagcactttgggaggctga

SEQ ID NO: 2890481 - DNA, 19 bp, Homo sapiens
cagcagaacagccattttt

SEQ ID NO: 2890482 - DNA, 15 bp, Homo sapiens
cagcagactcagctc

SEQ ID NO: 2890483 - DNA, 17 bp, Homo sapiens
cagcagactcagctctg

SEQ ID NO: 2890484 - DNA, 18 bp, Homo sapiens
cagcagactcagctctga

SEQ ID NO: 2890485 - DNA, 16 bp, Homo sapiens
cacgcacctccacgcc

SEQ ID NO: 2890486 - DNA, 19 bp, Homo sapiens
cacgcacctcccatcctaa

SEQ ID NO: 2890487 - DNA, 19 bp, Homo sapiens
cacgcacctgtagtcccag

SEQ ID NO: 2890488 - DNA, 12 bp, Homo sapiens
cacgcaggaagc

SEQ ID NO: 2890489 - DNA, 17 bp, Homo sapiens
cacgcaggcggccaggg

SEQ ID NO: 2890490 - DNA, 11 bp, Homo sapiens
cacgccacccc

SEQ ID NO: 2890491 - DNA, 13 bp, Homo sapiens
cacgccactgcct

SEQ ID NO: 2890492 - DNA, 15 bp, Homo sapiens
cacgccattctcctg

SEQ ID NO: 2890493 - DNA, 23 bp, Homo sapiens
cacgccattctcctgcctcagcc

SEQ ID NO: 2890494 - DNA, 19 bp, Homo sapiens
cacgccattgtactccagc

SEQ ID NO: 2890495 - DNA, 23 bp, Homo sapiens
cacgccattgtactccagcctgg

SEQ ID NO: 2890496 - DNA, 15 bp, Homo sapiens
cacgcctcccactgg

SEQ ID NO: 2890497 - DNA, 16 bp, Homo sapiens
cacgcctcccactggg

SEQ ID NO: 2890498 - DNA, 17 bp, Homo sapiens
cacgcctgcaaacgctg

SEQ ID NO: 2890499 - DNA, 17 bp, Homo sapiens
cacgcctgtaatcccag

SEQ ID NO: 2890500 - DNA, 18 bp, Homo sapiens
cacgcctgtaatcccagc

SEQ ID NO: 2890501 - DNA, 20 bp, Homo sapiens
cacgcctgtaatcccagcac

SEQ ID NO: 2890502 - DNA, 14 bp, Homo sapiens
cacgctccagctgc

SEQ ID NO: 2890503 - DNA, 19 bp, Homo sapiens
cacgctccagctgccccgg

SEQ ID NO: 2890504 - DNA, 12 bp, Homo sapiens
cacgctcccctc

SEQ ID NO: 2890505 - DNA, 13 bp, Homo sapiens
cacgctcccctcc

SEQ ID NO: 2890506 - DNA, 19 bp, Homo sapiens
cacgctcccctccatcccc

SEQ ID NO: 2890507 - DNA, 18 bp, Homo sapiens
cacggagccactcctctg

SEQ ID NO: 2890508 - DNA, 21 bp, Homo sapiens
cacggagccactcctctgact

SEQ ID NO: 2890509 - DNA, 23 bp, Homo sapiens
cacggagccactcctctgactca

SEQ ID NO: 2890510 - DNA, 19 bp, Homo sapiens
cacggagcccagccctccc

SEQ ID NO: 2890511 - DNA, 13 bp, Homo sapiens
cacggccagaagt

SEQ ID NO: 2890512 - DNA, 15 bp, Homo sapiens
cacggcccagggagg

SEQ ID NO: 2890513 - DNA, 21 bp, Homo sapiens
cacggccccgaagggccccca

SEQ ID NO: 2890514 - DNA, 23 bp, Homo sapiens
cacggcccggcccctcaccctct

SEQ ID NO: 2890515 - DNA, 12 bp, Homo sapiens
cacggctggtca

SEQ ID NO: 2890516 - DNA, 20 bp, Homo sapiens
cacggctggtcactctgccc

SEQ ID NO: 2890517 - DNA, 22 bp, Homo sapiens
cacggctggtcactctgccctc

SEQ ID NO: 2890518 - DNA, 19 bp, Homo sapiens
cacgggcggtcctgcacag

SEQ ID NO: 2890519 - DNA, 22 bp, Homo sapiens
cacggggaccactgggcccctc

SEQ ID NO: 2890520 - DNA, 17 bp, Homo sapiens
cacggtgactctgtcca

SEQ ID NO: 2890521 - DNA, 17 bp, Homo sapiens
cacggttcaatggtaga

SEQ ID NO: 2890522 - DNA, 23 bp, Homo sapiens
cacggtttcgaagtcattaaact

SEQ ID NO: 2890523 - DNA, 15 bp, Homo sapiens
cacgtattccccttc

SEQ ID NO: 2890524 - DNA, 17 bp, Homo sapiens
cacgtatttcacagagc

SEQ ID NO: 2890525 - DNA, 22 bp, Homo sapiens
cacgtccacgcggccacctcac

SEQ ID NO: 2890526 - DNA, 14 bp, Homo sapiens
cacgtctctctgcc

SEQ ID NO: 2890527 - DNA, 16 bp, Homo sapiens
cacgtctctctgcctg

SEQ ID NO: 2890528 - DNA, 19 bp, Homo sapiens
cacgtctctctgcctgctg

SEQ ID NO: 2890529 - DNA, 18 bp, Homo sapiens
cacgtctgtaatcccagc

SEQ ID NO: 2890530 - DNA, 13 bp, Homo sapiens
cacgtcttcctcc

SEQ ID NO: 2890531 - DNA, 21 bp, Homo sapiens
cacgtgcaggacagctcttga

SEQ ID NO: 2890532 - DNA, 15 bp, Homo sapiens
cacgtgccaggcccg

SEQ ID NO: 2890533 - DNA, 16 bp, Homo sapiens
cacgtgccaggcccgg

SEQ ID NO: 2890534 - DNA, 15 bp, Homo sapiens
cacgtgccttaggaa

SEQ ID NO: 2890535 - DNA, 17 bp, Homo sapiens
cacgtgccttaggaata

SEQ ID NO: 2890536 - DNA, 16 bp, Homo sapiens
cacgtgtactggctcc

SEQ ID NO: 2890537 - DNA, 18 bp, Homo sapiens
cacgtgtactggctcctc

SEQ ID NO: 2890538 - DNA, 15 bp, Homo sapiens
cacgtgtcctgtagt

SEQ ID NO: 2890539 - DNA, 16 bp, Homo sapiens
cacgtgtcctgtagtt

SEQ ID NO: 2890540 - DNA, 19 bp, Homo sapiens
cacgtgtgggccgtggctt

SEQ ID NO: 2890541 - DNA, 18 bp, Homo sapiens
cacgttatggtgtttctc

SEQ ID NO: 2890542 - DNA, 19 bp, Homo sapiens
cacgttccttactgcagaa

SEQ ID NO: 2890543 - DNA, 20 bp, Homo sapiens
cacgtttaatcccagcactt

SEQ ID NO: 2890544 - DNA, 21 bp, Homo sapiens
cactaaaagtgtgtgaaacct

SEQ ID NO: 2890545 - DNA, 22 bp, Homo sapiens
cactaaaagtgtgtgaaaccta

SEQ ID NO: 2890546 - DNA, 14 bp, Homo sapiens
cactaagcagagga

SEQ ID NO: 2890547 - DNA, 20 bp, Homo sapiens
caccgggcatgtctgcctgg

SEQ ID NO: 2890548 - DNA, 24 bp, Homo sapiens
caccgggcatgtctgcctggagtg

SEQ ID NO: 2890549 - DNA, 13 bp, Homo sapiens
caccgggctgcag

SEQ ID NO: 2890550 - DNA, 17 bp, Homo sapiens
caccgggctgcaggtgc

SEQ ID NO: 2890551 - DNA, 18 bp, Homo sapiens
caccgggctgcaggtgct

SEQ ID NO: 2890552 - DNA, 16 bp, Homo sapiens
caccggggcaagaggg

SEQ ID NO: 2890553 - DNA, 14 bp, Homo sapiens
caccgggggtggct

SEQ ID NO: 2890554 - DNA, 22 bp, Homo sapiens
caccgtgccaaccccacccagc

SEQ ID NO: 2890555 - DNA, 23 bp, Homo sapiens
caccgtgccaaccccacccagct

SEQ ID NO: 2890556 - DNA, 16 bp, Homo sapiens
caccgtggcctgggct

SEQ ID NO: 2890557 - DNA, 15 bp, Homo sapiens
caccgtggctaagag

SEQ ID NO: 2890558 - DNA, 18 bp, Homo sapiens
caccgtgggctccctgac

SEQ ID NO: 2890559 - DNA, 14 bp, Homo sapiens
caccgttcattcag

SEQ ID NO: 2890560 - DNA, 15 bp, Homo sapiens
caccgttctgtgcac

SEQ ID NO: 2890561 - DNA, 22 bp, Homo sapiens
cacctaaaaccagttttgctgc

SEQ ID NO: 2890562 - DNA, 15 bp, Homo sapiens
cacctaaccctctgt

SEQ ID NO: 2890563 - DNA, 16 bp, Homo sapiens
cacctaaccctctgtc

SEQ ID NO: 2890564 - DNA, 17 bp, Homo sapiens
cacctaaccctctgtca

SEQ ID NO: 2890565 - DNA, 20 bp, Homo sapiens
cacctaatccaggcagatcc

SEQ ID NO: 2890566 - DNA, 21 bp, Homo sapiens
cacctaatccaggcagatcca

SEQ ID NO: 2890567 - DNA, 18 bp, Homo sapiens
cacctaccgagttcaagt

SEQ ID NO: 2890568 - DNA, 18 bp, Homo sapiens
cacctaggccactcctcc

SEQ ID NO: 2890569 - DNA, 19 bp, Homo sapiens
cacctaggccactcctcca

SEQ ID NO: 2890570 - DNA, 12 bp, Homo sapiens
cacctagtgccc

SEQ ID NO: 2890571 - DNA, 16 bp, Homo sapiens
cacctagtgccccaga

SEQ ID NO: 2890572 - DNA, 18 bp, Homo sapiens
cacctagtgccccagact

SEQ ID NO: 2890573 - DNA, 14 bp, Homo sapiens
cacctatctcagcc

SEQ ID NO: 2890574 - DNA, 15 bp, Homo sapiens
cacctcacaactcct

SEQ ID NO: 2890575 - DNA, 18 bp, Homo sapiens
cacctcacaactccttcc

SEQ ID NO: 2890576 - DNA, 13 bp, Homo sapiens
cacctcaccctct

SEQ ID NO: 2890577 - DNA, 15 bp, Homo sapiens
cacctcaccctctcc

SEQ ID NO: 2890578 - DNA, 14 bp, Homo sapiens
cacctcagcctgca

SEQ ID NO: 2890579 - DNA, 17 bp, Homo sapiens
cacctcagcctgcacag

SEQ ID NO: 2890580 - DNA, 15 bp, Homo sapiens
cacctcagccttgga

SEQ ID NO: 2890581 - DNA, 13 bp, Homo sapiens
cacctcatgagtc

SEQ ID NO: 2890582 - DNA, 14 bp, Homo sapiens
cacctcattctgaa

SEQ ID NO: 2890583 - DNA, 16 bp, Homo sapiens
cacctccacatcctcc

SEQ ID NO: 2890584 - DNA, 14 bp, Homo sapiens
cacctccacgccac

SEQ ID NO: 2890585 - DNA, 18 bp, Homo sapiens
cacctccacgccactgcc

SEQ ID NO: 2890586 - DNA, 13 bp, Homo sapiens
cacctccatatca

SEQ ID NO: 2890587 - DNA, 18 bp, Homo sapiens
cacctccccccactgcag

SEQ ID NO: 2890588 - DNA, 21 bp, Homo sapiens
cacctccccccactgcaggcc

SEQ ID NO: 2890589 - DNA, 22 bp, Homo sapiens
cacctccccccactgcaggccc

SEQ ID NO: 2890590 - DNA, 20 bp, Homo sapiens
cacctcccctatccacccag

SEQ ID NO: 2890591 - DNA, 20 bp, Homo sapiens
cacctccctatactgcttgg

SEQ ID NO: 2890592 - DNA, 21 bp, Homo sapiens
cacctcggccctccctgcgct

SEQ ID NO: 2890593 - DNA, 12 bp, Homo sapiens
cacctctctttt

SEQ ID NO: 2890594 - DNA, 17 bp, Homo sapiens
cacctctcttttcctct

SEQ ID NO: 2890595 - DNA, 21 bp, Homo sapiens
cacctctcttttcctctctgt

SEQ ID NO: 2890596 - DNA, 22 bp, Homo sapiens
cacctctcttttcctctctgtc

SEQ ID NO: 2890597 - DNA, 18 bp, Homo sapiens
cacctctgagccggaggg

SEQ ID NO: 2890598 - DNA, 13 bp, Homo sapiens
cacctctgcctca

SEQ ID NO: 2890599 - DNA, 11 bp, Homo sapiens
cacctctgctc

SEQ ID NO: 2890600 - DNA, 14 bp, Homo sapiens
cacctgaaagcctg

SEQ ID NO: 2890601 - DNA, 15 bp, Homo sapiens
cacctgaaagcctgt

SEQ ID NO: 2890602 - DNA, 15 bp, Homo sapiens
cacctgaaccccaga

SEQ ID NO: 2890603 - DNA, 16 bp, Homo sapiens
cacctgaaccccagag

SEQ ID NO: 2890604 - DNA, 19 bp, Homo sapiens
cacctgaaccccagaggca

SEQ ID NO: 2890605 - DNA, 22 bp, Homo sapiens
cacctgaccgctgcccaggtgg

SEQ ID NO: 2890606 - DNA, 20 bp, Homo sapiens
cacctgagcaggacctctga

SEQ ID NO: 2890607 - DNA, 11 bp, Homo sapiens
cacctgaggtc

SEQ ID NO: 2890608 - DNA, 11 bp, Homo sapiens
cacctgatgtg

SEQ ID NO: 2890609 - DNA, 16 bp, Homo sapiens
cacctgatgtgtacat

SEQ ID NO: 2890610 - DNA, 15 bp, Homo sapiens
cacctgccaccctgg

SEQ ID NO: 2890611 - DNA, 20 bp, Homo sapiens
cacctgccaccctgggcctg

SEQ ID NO: 2890612 - DNA, 23 bp, Homo sapiens
cacctgccaccctgggcctggca

SEQ ID NO: 2890613 - DNA, 15 bp, Homo sapiens
cacctgccccaactc

SEQ ID NO: 2890614 - DNA, 18 bp, Homo sapiens
cacctgcctagctcttgg

SEQ ID NO: 2890615 - DNA, 20 bp, Homo sapiens
cacctgcctagctcttgggc

SEQ ID NO: 2890616 - DNA, 23 bp, Homo sapiens
cacctgcctagctcttgggcctg

SEQ ID NO: 2890617 - DNA, 13 bp, Homo sapiens
cacctgcctcagg

SEQ ID NO: 2890618 - DNA, 14 bp, Homo sapiens
cacctgcctcagga

SEQ ID NO: 2890619 - DNA, 23 bp, Homo sapiens
cacctgcctcggcctcccaaagt

SEQ ID NO: 2890620 - DNA, 11 bp, Homo sapiens
cacctgcctgg

SEQ ID NO: 2890621 - DNA, 13 bp, Homo sapiens
cacctgcctggcc

SEQ ID NO: 2890622 - DNA, 14 bp, Homo sapiens
cacctgcctggccg

SEQ ID NO: 2890623 - DNA, 23 bp, Homo sapiens
cacctgcctgttaggagaagctg

SEQ ID NO: 2890624 - DNA, 15 bp, Homo sapiens
cacctgcgcacaggt

SEQ ID NO: 2890625 - DNA, 12 bp, Homo sapiens
cacctggacccc

SEQ ID NO: 2890626 - DNA, 20 bp, Homo sapiens
cacaggcacattaactgttg

SEQ ID NO: 2890627 - DNA, 13 bp, Homo sapiens
cacaggccctccc

SEQ ID NO: 2890628 - DNA, 22 bp, Homo sapiens
cacagggactgaaaacctctcc

SEQ ID NO: 2890629 - DNA, 23 bp, Homo sapiens
cacagggcaaaatcgccataggc

SEQ ID NO: 2890630 - DNA, 20 bp, Homo sapiens
cacaggtcaggggtgacaca

SEQ ID NO: 2890631 - DNA, 14 bp, Homo sapiens
cacaggtctagact

SEQ ID NO: 2890632 - DNA, 14 bp, Homo sapiens
cacaggtctttcct

SEQ ID NO: 2890633 - DNA, 20 bp, Homo sapiens
cacaggtgcgggaccatctg

SEQ ID NO: 2890634 - DNA, 21 bp, Homo sapiens
cacaggtgcgggaccatctga

SEQ ID NO: 2890635 - DNA, 18 bp, Homo sapiens
cacaggtggtgtcactgt

SEQ ID NO: 2890636 - DNA, 13 bp, Homo sapiens
cacaggtgtcagc

SEQ ID NO: 2890637 - DNA, 16 bp, Homo sapiens
cacaggtgtcagccat

SEQ ID NO: 2890638 - DNA, 15 bp, Homo sapiens
cacaggtttgtttct

SEQ ID NO: 2890639 - DNA, 15 bp, Homo sapiens
cacagtcagaaggac

SEQ ID NO: 2890640 - DNA, 17 bp, Homo sapiens
cacagtgaaggctgtcc

SEQ ID NO: 2890641 - DNA, 22 bp, Homo sapiens
cacagtgaaggctgtccttacc

SEQ ID NO: 2890642 - DNA, 20 bp, Homo sapiens
cacagtgacaccatttgtcc

SEQ ID NO: 2890643 - DNA, 21 bp, Homo sapiens
cacagtgagagtactcacttt

SEQ ID NO: 2890644 - DNA, 19 bp, Homo sapiens
cacagtgagggagatccca

SEQ ID NO: 2890645 - DNA, 22 bp, Homo sapiens
cacagtgctttccgtggcactg

SEQ ID NO: 2890646 - DNA, 17 bp, Homo sapiens
cacagtggctcacgcct

SEQ ID NO: 2890647 - DNA, 17 bp, Homo sapiens
cacagtggtggcagggc

SEQ ID NO: 2890648 - DNA, 22 bp, Homo sapiens
cacagtgtttttgtaaagtgtg

SEQ ID NO: 2890649 - DNA, 23 bp, Homo sapiens
cacagtgtttttgtaaagtgtgg

SEQ ID NO: 2890650 - DNA, 21 bp, Homo sapiens
cacagtttcctcatctgtcca

SEQ ID NO: 2890651 - DNA, 19 bp, Homo sapiens
cacagtttcttccattccc

SEQ ID NO: 2890652 - DNA, 18 bp, Homo sapiens
cacagtttcttctgtaaa

SEQ ID NO: 2890653 - DNA, 12 bp, Homo sapiens
cacagtttgaac

SEQ ID NO: 2890654 - DNA, 23 bp, Homo sapiens
cacataaaaaagaagcactttga

SEQ ID NO: 2890655 - DNA, 12 bp, Homo sapiens
cacataaaactt

SEQ ID NO: 2890656 - DNA, 15 bp, Homo sapiens
cacatacaaaagaat

SEQ ID NO: 2890657 - DNA, 15 bp, Homo sapiens
cacatagccaactct

SEQ ID NO: 2890658 - DNA, 13 bp, Homo sapiens
cacatatgagggg

SEQ ID NO: 2890659 - DNA, 20 bp, Homo sapiens
cacatatgcaccttgtgtct

SEQ ID NO: 2890660 - DNA, 23 bp, Homo sapiens
cacatattaagaatagtctctgg

SEQ ID NO: 2890661 - DNA, 13 bp, Homo sapiens
cacatattgaaaa

SEQ ID NO: 2890662 - DNA, 18 bp, Homo sapiens
cacatcaagcatcattgt

SEQ ID NO: 2890663 - DNA, 14 bp, Homo sapiens
cacatcacaccact

SEQ ID NO: 2890664 - DNA, 16 bp, Homo sapiens
cacatcacatttaaat

SEQ ID NO: 2890665 - DNA, 16 bp, Homo sapiens
cacatcaccaggtgca

SEQ ID NO: 2890666 - DNA, 18 bp, Homo sapiens
cacatcacctctttgccc

SEQ ID NO: 2890667 - DNA, 16 bp, Homo sapiens
cacatcagcatgtttt

SEQ ID NO: 2890668 - DNA, 21 bp, Homo sapiens
cacatcagcatgttttctgct

SEQ ID NO: 2890669 - DNA, 19 bp, Homo sapiens
cacatcatttgggatacca

SEQ ID NO: 2890670 - DNA, 19 bp, Homo sapiens
cacatccccagagcccagc

SEQ ID NO: 2890671 - DNA, 17 bp, Homo sapiens
cacatcctgtgtttcta

SEQ ID NO: 2890672 - DNA, 13 bp, Homo sapiens
cacatctaagcct

SEQ ID NO: 2890673 - DNA, 22 bp, Homo sapiens
cacatctcccccatagcaccct

SEQ ID NO: 2890674 - DNA, 13 bp, Homo sapiens
cacatctcccttc

SEQ ID NO: 2890675 - DNA, 15 bp, Homo sapiens
cacatctgggtgccc

SEQ ID NO: 2890676 - DNA, 18 bp, Homo sapiens
cacatctgggtgccctga

SEQ ID NO: 2890677 - DNA, 18 bp, Homo sapiens
cacatctgtcctgacaga

SEQ ID NO: 2890678 - DNA, 15 bp, Homo sapiens
cacatctgtggagat

SEQ ID NO: 2890679 - DNA, 19 bp, Homo sapiens
cacatctgtgtctctggaa

SEQ ID NO: 2890680 - DNA, 23 bp, Homo sapiens
cacatctgtgtcttgtttggaat

SEQ ID NO: 2890681 - DNA, 21 bp, Homo sapiens
cacatctttcctcaagtatct

SEQ ID NO: 2890682 - DNA, 23 bp, Homo sapiens
cacatgaaacattattttaattg

SEQ ID NO: 2890683 - DNA, 15 bp, Homo sapiens
cacatgaacagcttg

SEQ ID NO: 2890684 - DNA, 22 bp, Homo sapiens
cacatgaacagcttgccaggga

SEQ ID NO: 2890685 - DNA, 14 bp, Homo sapiens
cacatgaagaaata

SEQ ID NO: 2890686 - DNA, 22 bp, Homo sapiens
cacatgaagaaatactgcactt

SEQ ID NO: 2890687 - DNA, 14 bp, Homo sapiens
cacatgattctcct

SEQ ID NO: 2890688 - DNA, 16 bp, Homo sapiens
cacatgcatacacaca

SEQ ID NO: 2890689 - DNA, 16 bp, Homo sapiens
cacatgccccaggctc

SEQ ID NO: 2890690 - DNA, 13 bp, Homo sapiens
cacatgccttgca

SEQ ID NO: 2890691 - DNA, 21 bp, Homo sapiens
cacatgcgggctcgcccatac

SEQ ID NO: 2890692 - DNA, 20 bp, Homo sapiens
cacatgcttgaatggagctg

SEQ ID NO: 2890693 - DNA, 18 bp, Homo sapiens
cacatgcttttcttccta

SEQ ID NO: 2890694 - DNA, 19 bp, Homo sapiens
cacatggaatctacatgtg

SEQ ID NO: 2890695 - DNA, 12 bp, Homo sapiens
cacatggagctc

SEQ ID NO: 2890696 - DNA, 15 bp, Homo sapiens
cacatggcctatgca

SEQ ID NO: 2890697 - DNA, 22 bp, Homo sapiens
cacatggtgacttttgaaaaga

SEQ ID NO: 2890698 - DNA, 15 bp, Homo sapiens
cacatggtgtggcca

SEQ ID NO: 2890699 - DNA, 16 bp, Homo sapiens
cacatggtgtggccat

SEQ ID NO: 2890700 - DNA, 17 bp, Homo sapiens
cacatggtgtggccatc

SEQ ID NO: 2890701 - DNA, 16 bp, Homo sapiens
cacatgtccagcacct

SEQ ID NO: 2890702 - DNA, 21 bp, Homo sapiens
cacattaaaagacaaatatgt

SEQ ID NO: 2890703 - DNA, 13 bp, Homo sapiens
cacattaactgtt

SEQ ID NO: 2890704 - DNA, 11 bp, Homo sapiens
cacattcccct

SEQ ID NO: 2890705 - DNA, 15 bp, Homo sapiens
cacattcccctgggg

SEQ ID NO: 2890706 - DNA, 17 bp, Homo sapiens
cacattcccctggggac

SEQ ID NO: 2890707 - DNA, 24 bp, Homo sapiens
cacattgaatcatgtaggatcttg

SEQ ID NO: 2890708 - DNA, 16 bp, Homo sapiens
cacattgttattttca

SEQ ID NO: 2890709 - DNA, 17 bp, Homo sapiens
cacattgttattttcag

SEQ ID NO: 2890710 - DNA, 18 bp, Homo sapiens
cacattgttttaaaaaga

SEQ ID NO: 2890711 - DNA, 12 bp, Homo sapiens
cacatttacata

SEQ ID NO: 2890712 - DNA, 16 bp, Homo sapiens
cacatttcacattgaa

SEQ ID NO: 2890713 - DNA, 18 bp, Homo sapiens
cacatttcctatcctggt

SEQ ID NO: 2890714 - DNA, 21 bp, Homo sapiens
cacatttcctctgttcttttc

SEQ ID NO: 2890715 - DNA, 17 bp, Homo sapiens
cacatttggaatacttt

SEQ ID NO: 2890716 - DNA, 15 bp, Homo sapiens
cacatttggaatgca

SEQ ID NO: 2890717 - DNA, 19 bp, Homo sapiens
cacatttggaatgcacaca

SEQ ID NO: 2890718 - DNA, 20 bp, Homo sapiens
cacatttgtgccgacactgt

SEQ ID NO: 2890719 - DNA, 13 bp, Homo sapiens
cacattttaacag

SEQ ID NO: 2890720 - DNA, 20 bp, Homo sapiens
cacattttgacacaatgttg

SEQ ID NO: 2890721 - DNA, 12 bp, Homo sapiens
cacattttgtat

SEQ ID NO: 2890722 - DNA, 13 bp, Homo sapiens
cacattttgtata

SEQ ID NO: 2890723 - DNA, 21 bp, Homo sapiens
cacattttgtataattgtatc

SEQ ID NO: 2890724 - DNA, 18 bp, Homo sapiens
caagtcaggccaggtggg

SEQ ID NO: 2890725 - DNA, 19 bp, Homo sapiens
caagtcaggccaggtgggc

SEQ ID NO: 2890726 - DNA, 17 bp, Homo sapiens
caagtcccagacaagga

SEQ ID NO: 2890727 - DNA, 19 bp, Homo sapiens
caagtcctagctcctcctc

SEQ ID NO: 2890728 - DNA, 14 bp, Homo sapiens
caagtcctgccttt

SEQ ID NO: 2890729 - DNA, 15 bp, Homo sapiens
caagtcctgcctttg

SEQ ID NO: 2890730 - DNA, 15 bp, Homo sapiens
caagtccttttgtaa

SEQ ID NO: 2890731 - DNA, 18 bp, Homo sapiens
caagtctggatctgggac

SEQ ID NO: 2890732 - DNA, 14 bp, Homo sapiens
caagtcttaacaaa

SEQ ID NO: 2890733 - DNA, 19 bp, Homo sapiens
caagtgaatttttctctaa

SEQ ID NO: 2890734 - DNA, 13 bp, Homo sapiens
caagtgaccaggg

SEQ ID NO: 2890735 - DNA, 19 bp, Homo sapiens
caagtgactctcctgcctc

SEQ ID NO: 2890736 - DNA, 22 bp, Homo sapiens
caagtgactctcctgcctcagc

SEQ ID NO: 2890737 - DNA, 16 bp, Homo sapiens
caagtgagaggggagg

SEQ ID NO: 2890738 - DNA, 17 bp, Homo sapiens
caagtgagaggggaggg

SEQ ID NO: 2890739 - DNA, 20 bp, Homo sapiens
caagtgagaggggagggagg

SEQ ID NO: 2890740 - DNA, 21 bp, Homo sapiens
caagtgagaggggagggaggg

SEQ ID NO: 2890741 - DNA, 21 bp, Homo sapiens
caagtgagtctggtggaggag

SEQ ID NO: 2890742 - DNA, 10 bp, Homo sapiens
caagtgagtg

SEQ ID NO: 2890743 - DNA, 18 bp, Homo sapiens
caagtgccgcaaattgta

SEQ ID NO: 2890744 - DNA, 14 bp, Homo sapiens
caagtgcctgctta

SEQ ID NO: 2890745 - DNA, 14 bp, Homo sapiens
caagtgctatttca

SEQ ID NO: 2890746 - DNA, 14 bp, Homo sapiens
caagtgctggccca

SEQ ID NO: 2890747 - DNA, 22 bp, Homo sapiens
caagtggaccttaggccttcct

SEQ ID NO: 2890748 - DNA, 23 bp, Homo sapiens
caagtggactcagggcagcgcca

SEQ ID NO: 2890749 - DNA, 19 bp, Homo sapiens
caagtggatgggaatttgt

SEQ ID NO: 2890750 - DNA, 21 bp, Homo sapiens
caagtggatgggaatttgtca

SEQ ID NO: 2890751 - DNA, 23 bp, Homo sapiens
caagtggatgggaatttgtcagc

SEQ ID NO: 2890752 - DNA, 22 bp, Homo sapiens
caagtgggagatgaaaacctgc

SEQ ID NO: 2890753 - DNA, 23 bp, Homo sapiens
caagtgggctggtattctctcta

SEQ ID NO: 2890754 - DNA, 18 bp, Homo sapiens
caagtggtggtaaccctg

SEQ ID NO: 2890755 - DNA, 20 bp, Homo sapiens
caagtggtggtaaccctggt

SEQ ID NO: 2890756 - DNA, 18 bp, Homo sapiens
caagtgtattttaaaata

SEQ ID NO: 2890757 - DNA, 20 bp, Homo sapiens
caagtgtattttaaaataga

SEQ ID NO: 2890758 - DNA, 15 bp, Homo sapiens
caagtgtctggagcg

SEQ ID NO: 2890759 - DNA, 22 bp, Homo sapiens
caagtgtgtgccaccatgcctc

SEQ ID NO: 2890760 - DNA, 14 bp, Homo sapiens
caagtgttctaaaa

SEQ ID NO: 2890761 - DNA, 23 bp, Homo sapiens
caagtgttttactatctcactgc

SEQ ID NO: 2890762 - DNA, 22 bp, Homo sapiens
caagttaaggtatctggtatct

SEQ ID NO: 2890763 - DNA, 21 bp, Homo sapiens
caagttcaagggctctttctc

SEQ ID NO: 2890764 - DNA, 14 bp, Homo sapiens
caagttccagtgca

SEQ ID NO: 2890765 - DNA, 15 bp, Homo sapiens
caagttccagtgcag

SEQ ID NO: 2890766 - DNA, 18 bp, Homo sapiens
caagttggatgcggccat

SEQ ID NO: 2890767 - DNA, 12 bp, Homo sapiens
caagttgtttaa

SEQ ID NO: 2890768 - DNA, 14 bp, Homo sapiens
caagttgtttaact

SEQ ID NO: 2890769 - DNA, 13 bp, Homo sapiens
caagtttataagc

SEQ ID NO: 2890770 - DNA, 17 bp, Homo sapiens
caagttttcttccatga

SEQ ID NO: 2890771 - DNA, 17 bp, Homo sapiens
caataaaaataaatcta

SEQ ID NO: 2890772 - DNA, 14 bp, Homo sapiens
caataaaacattaa

SEQ ID NO: 2890773 - DNA, 16 bp, Homo sapiens
caataaaaccaagcct

SEQ ID NO: 2890774 - DNA, 17 bp, Homo sapiens
caataaaaccaagcctc

SEQ ID NO: 2890775 - DNA, 22 bp, Homo sapiens
caataaaactaaatgtgtacac

SEQ ID NO: 2890776 - DNA, 20 bp, Homo sapiens
caataaaatttttttaaagt

SEQ ID NO: 2890777 - DNA, 18 bp, Homo sapiens
caataaaattttttttca

SEQ ID NO: 2890778 - DNA, 14 bp, Homo sapiens
caataaactggtat

SEQ ID NO: 2890779 - DNA, 22 bp, Homo sapiens
caataaactggtatgaataatt

SEQ ID NO: 2890780 - DNA, 13 bp, Homo sapiens
caataaacttgta

SEQ ID NO: 2890781 - DNA, 14 bp, Homo sapiens
caataaatatttgt

SEQ ID NO: 2890782 - DNA, 14 bp, Homo sapiens
caataaatccacac

SEQ ID NO: 2890783 - DNA, 15 bp, Homo sapiens
caataaatgtctgtt

SEQ ID NO: 2890784 - DNA, 22 bp, Homo sapiens
caataagagtctccttctcttc

SEQ ID NO: 2890785 - DNA, 13 bp, Homo sapiens
caataataaagta

SEQ ID NO: 2890786 - DNA, 15 bp, Homo sapiens
caataataaagtact

SEQ ID NO: 2890787 - DNA, 14 bp, Homo sapiens
caataatatatttt

SEQ ID NO: 2890788 - DNA, 16 bp, Homo sapiens
caataatatattttct

SEQ ID NO: 2890789 - DNA, 17 bp, Homo sapiens
caataatatattttctg

SEQ ID NO: 2890790 - DNA, 13 bp, Homo sapiens
caataatgcagta

SEQ ID NO: 2890791 - DNA, 17 bp, Homo sapiens
caataatgcagtatggt

SEQ ID NO: 2890792 - DNA, 20 bp, Homo sapiens
caataatgcagtatggtaca

SEQ ID NO: 2890793 - DNA, 19 bp, Homo sapiens
caatacagtacaggcagca

SEQ ID NO: 2890794 - DNA, 22 bp, Homo sapiens
caatacgggagtgacccagcta

SEQ ID NO: 2890795 - DNA, 19 bp, Homo sapiens
caatacgtttgtgcagaat

SEQ ID NO: 2890796 - DNA, 11 bp, Homo sapiens
caatactgctt

SEQ ID NO: 2890797 - DNA, 12 bp, Homo sapiens
caatagaaacaa

SEQ ID NO: 2890798 - DNA, 22 bp, Homo sapiens
caatagagggccacggggaggc

SEQ ID NO: 2890799 - DNA, 19 bp, Homo sapiens
caatagcaacgtagcttct

SEQ ID NO: 2890800 - DNA, 17 bp, Homo sapiens
caatagctccaagctgt

SEQ ID NO: 2890801 - DNA, 12 bp, Homo sapiens
caatagctgccc

SEQ ID NO: 2890802 - DNA, 19 bp, Homo sapiens
caataggcaaaagtgtaac

SEQ ID NO: 2890803 - DNA, 15 bp, Homo sapiens
caataggctgttccc

SEQ ID NO: 2890804 - DNA, 22 bp, Homo sapiens
caatataaaaggcaaatgtgta

SEQ ID NO: 2890805 - DNA, 22 bp, Homo sapiens
caatatagaaaaataaaaatct

SEQ ID NO: 2890806 - DNA, 12 bp, Homo sapiens
caatatatgtat

SEQ ID NO: 2890807 - DNA, 14 bp, Homo sapiens
caatatcagacttt

SEQ ID NO: 2890808 - DNA, 12 bp, Homo sapiens
caatatcctttg

SEQ ID NO: 2890809 - DNA, 23 bp, Homo sapiens
caatatctgaagccctcccaggt

SEQ ID NO: 2890810 - DNA, 13 bp, Homo sapiens
caatatgaagtta

SEQ ID NO: 2890811 - DNA, 16 bp, Homo sapiens
caatatgtgagtgcct

SEQ ID NO: 2890812 - DNA, 17 bp, Homo sapiens
caatatgtgagtgcctt

SEQ ID NO: 2890813 - DNA, 22 bp, Homo sapiens
caatatgtgagtgccttttgca

SEQ ID NO: 2890814 - DNA, 15 bp, Homo sapiens
caatattaaatctgc

SEQ ID NO: 2890815 - DNA, 23 bp, Homo sapiens
caatattaccttaagatttttct

SEQ ID NO: 2890816 - DNA, 15 bp, Homo sapiens
caatattgaactttt

SEQ ID NO: 2890817 - DNA, 14 bp, Homo sapiens
caatattgactttg

SEQ ID NO: 2890818 - DNA, 16 bp, Homo sapiens
caatattgactttgtc

SEQ ID NO: 2890819 - DNA, 18 bp, Homo sapiens
caatatttgctaaacatt

SEQ ID NO: 2890820 - DNA, 17 bp, Homo sapiens
caatcaacctgcacttc

SEQ ID NO: 2890821 - DNA, 15 bp, Homo sapiens
caatcaatttaaatt

SEQ ID NO: 2890822 - DNA, 23 bp, Homo sapiens
caatcacgggcggtcctgcacag

SEQ ID NO: 2890823 - DNA, 11 bp, Homo sapiens
caatcactgtc

SEQ ID NO: 2890824 - DNA, 15 bp, Homo sapiens
caatcactgtcctcc

SEQ ID NO: 2890825 - DNA, 18 bp, Homo sapiens
caatcagctccttcctgg

SEQ ID NO: 2890826 - DNA, 15 bp, Homo sapiens
caatccaaatgcatt

SEQ ID NO: 2890827 - DNA, 18 bp, Homo sapiens
caatccagatggtgggat

SEQ ID NO: 2890828 - DNA, 16 bp, Homo sapiens
caatccaggtacgcac

SEQ ID NO: 2890829 - DNA, 20 bp, Homo sapiens
caatccaggtacgcacagac

SEQ ID NO: 2890830 - DNA, 21 bp, Homo sapiens
caatccaggtacgcacagaca

SEQ ID NO: 2890831 - DNA, 15 bp, Homo sapiens
caatccatccatgta

SEQ ID NO: 2890832 - DNA, 21 bp, Homo sapiens
caatccatcgtattaaaaaac

SEQ ID NO: 2890833 - DNA, 20 bp, Homo sapiens
caatccctcaccttctgagt

SEQ ID NO: 2890834 - DNA, 12 bp, Homo sapiens
caatcctccccg

SEQ ID NO: 2890835 - DNA, 23 bp, Homo sapiens
caatcggtgtgtagtgatgtttc

SEQ ID NO: 2890836 - DNA, 20 bp, Homo sapiens
caatctcgtcaggctgccag

SEQ ID NO: 2890837 - DNA, 16 bp, Homo sapiens
caatctcgtttagtgc

SEQ ID NO: 2890838 - DNA, 21 bp, Homo sapiens
caatctcttgctgttaaatca

SEQ ID NO: 2890839 - DNA, 19 bp, Homo sapiens
caatctgacattctcagga

SEQ ID NO: 2890840 - DNA, 13 bp, Homo sapiens
caatctgaccctt

SEQ ID NO: 2890841 - DNA, 18 bp, Homo sapiens
caatctgtaaaactaaga

SEQ ID NO: 2890842 - DNA, 18 bp, Homo sapiens
caatctgtacaaaatggt

SEQ ID NO: 2890843 - DNA, 19 bp, Homo sapiens
caatcttgttttaagcaaa

SEQ ID NO: 2890844 - DNA, 16 bp, Homo sapiens
caatctttgaaagact

SEQ ID NO: 2890845 - DNA, 15 bp, Homo sapiens
caatgaaaaaatgta

SEQ ID NO: 2890846 - DNA, 22 bp, Homo sapiens
caatgaaatatgtgaagcccag

SEQ ID NO: 2890847 - DNA, 19 bp, Homo sapiens
caatgaaatattgctgtat

SEQ ID NO: 2890848 - DNA, 19 bp, Homo sapiens
caatgaaatgctctccttt

SEQ ID NO: 2890849 - DNA, 15 bp, Homo sapiens
caatgaattaattca

SEQ ID NO: 2890850 - DNA, 20 bp, Homo sapiens
caatgactaagccaagctgt

SEQ ID NO: 2890851 - DNA, 17 bp, Homo sapiens
caatgagacttgccttc

SEQ ID NO: 2890852 - DNA, 15 bp, Homo sapiens
caagcagcaaaatcc

SEQ ID NO: 2890853 - DNA, 12 bp, Homo sapiens
caagcaggaagc

SEQ ID NO: 2890854 - DNA, 17 bp, Homo sapiens
caagcaggaagctcaga

SEQ ID NO: 2890855 - DNA, 16 bp, Homo sapiens
caagcagtgcctgcct

SEQ ID NO: 2890856 - DNA, 23 bp, Homo sapiens
caagcatcattgtccccatgcaa

SEQ ID NO: 2890857 - DNA, 15 bp, Homo sapiens
caagcatcctcagaa

SEQ ID NO: 2890858 - DNA, 20 bp, Homo sapiens
caagcatgcttgtgaaaatg

SEQ ID NO: 2890859 - DNA, 19 bp, Homo sapiens
caagcattagattcctttc

SEQ ID NO: 2890860 - DNA, 15 bp, Homo sapiens
caagccaaccttagc

SEQ ID NO: 2890861 - DNA, 18 bp, Homo sapiens
caagccaagcagccaagc

SEQ ID NO: 2890862 - DNA, 19 bp, Homo sapiens
caagccaagcagccaagct

SEQ ID NO: 2890863 - DNA, 15 bp, Homo sapiens
caagccaccgcagct

SEQ ID NO: 2890864 - DNA, 17 bp, Homo sapiens
caagccaccgcagctgc

SEQ ID NO: 2890865 - DNA, 15 bp, Homo sapiens
caagccagatttttt

SEQ ID NO: 2890866 - DNA, 23 bp, Homo sapiens
caagccatggagtgagacccagg

SEQ ID NO: 2890867 - DNA, 14 bp, Homo sapiens
caagcccagtgacc

SEQ ID NO: 2890868 - DNA, 20 bp, Homo sapiens
caagcccagttcagcttggg

SEQ ID NO: 2890869 - DNA, 13 bp, Homo sapiens
caagccccatcct

SEQ ID NO: 2890870 - DNA, 17 bp, Homo sapiens
caagcccccccttccac

SEQ ID NO: 2890871 - DNA, 18 bp, Homo sapiens
caagcccccccttccact

SEQ ID NO: 2890872 - DNA, 20 bp, Homo sapiens
caagccccctggcagctgcc

SEQ ID NO: 2890873 - DNA, 21 bp, Homo sapiens
caagccccctggcagctgccc

SEQ ID NO: 2890874 - DNA, 22 bp, Homo sapiens
caagccccctggcagctgcccc

SEQ ID NO: 2890875 - DNA, 23 bp, Homo sapiens
caagccccctggcagctgcccct

SEQ ID NO: 2890876 - DNA, 21 bp, Homo sapiens
caagcccctgctccagaagat

SEQ ID NO: 2890877 - DNA, 18 bp, Homo sapiens
caagcctgtaatcccagc

SEQ ID NO: 2890878 - DNA, 21 bp, Homo sapiens
caagcctgtgcaaaaaaatta

SEQ ID NO: 2890879 - DNA, 17 bp, Homo sapiens
caagcgaggtcaacaga

SEQ ID NO: 2890880 - DNA, 20 bp, Homo sapiens
caagcgaggtcaacagagaa

SEQ ID NO: 2890881 - DNA, 18 bp, Homo sapiens
caagcgattctcctgcct

SEQ ID NO: 2890882 - DNA, 20 bp, Homo sapiens
caagcgattctcctgcctca

SEQ ID NO: 2890883 - DNA, 22 bp, Homo sapiens
caagctaagcactgccactggg

SEQ ID NO: 2890884 - DNA, 22 bp, Homo sapiens
caagctcacagttcctcgccct

SEQ ID NO: 2890885 - DNA, 17 bp, Homo sapiens
caagctccttgggaggc

SEQ ID NO: 2890886 - DNA, 17 bp, Homo sapiens
caagctctagtgggaag

SEQ ID NO: 2890887 - DNA, 16 bp, Homo sapiens
caagctgcctctgaca

SEQ ID NO: 2890888 - DNA, 19 bp, Homo sapiens
caagctggtggcctctgca

SEQ ID NO: 2890889 - DNA, 16 bp, Homo sapiens
caagctgtatcactgc

SEQ ID NO: 2890890 - DNA, 18 bp, Homo sapiens
caagctgtgagacagtgg

SEQ ID NO: 2890891 - DNA, 23 bp, Homo sapiens
caagctgtgagacagtgggaaat

SEQ ID NO: 2890892 - DNA, 14 bp, Homo sapiens
caagctgtgttact

SEQ ID NO: 2890893 - DNA, 21 bp, Homo sapiens
caagctgtgttacttgaagta

SEQ ID NO: 2890894 - DNA, 16 bp, Homo sapiens
caagctgtgttcatcc

SEQ ID NO: 2890895 - DNA, 22 bp, Homo sapiens
caagctgtgttcatccagctac

SEQ ID NO: 2890896 - DNA, 19 bp, Homo sapiens
caagcttattctttccttc

SEQ ID NO: 2890897 - DNA, 23 bp, Homo sapiens
caagcttatttagcacattttga

SEQ ID NO: 2890898 - DNA, 20 bp, Homo sapiens
caagctttcaaacatgttga

SEQ ID NO: 2890899 - DNA, 18 bp, Homo sapiens
caaggaaaaaataacaat

SEQ ID NO: 2890900 - DNA, 20 bp, Homo sapiens
caaggaaaaaataacaatga

SEQ ID NO: 2890901 - DNA, 13 bp, Homo sapiens
caaggaaagggca

SEQ ID NO: 2890902 - DNA, 13 bp, Homo sapiens
caaggaaggactt

SEQ ID NO: 2890903 - DNA, 11 bp, Homo sapiens
caaggaaggag

SEQ ID NO: 2890904 - DNA, 12 bp, Homo sapiens
caaggaaggagc

SEQ ID NO: 2890905 - DNA, 16 bp, Homo sapiens
caaggaaggagcccct

SEQ ID NO: 2890906 - DNA, 14 bp, Homo sapiens
caaggacagacagc

SEQ ID NO: 2890907 - DNA, 18 bp, Homo sapiens
caaggacagacagcaggc

SEQ ID NO: 2890908 - DNA, 16 bp, Homo sapiens
caaggacattcttgta

SEQ ID NO: 2890909 - DNA, 22 bp, Homo sapiens
caaggactaatccaatacctct

SEQ ID NO: 2890910 - DNA, 18 bp, Homo sapiens
caaggacttccacatttt

SEQ ID NO: 2890911 - DNA, 14 bp, Homo sapiens
caaggacttcctgt

SEQ ID NO: 2890912 - DNA, 19 bp, Homo sapiens
caaggacttcctgtccagc

SEQ ID NO: 2890913 - DNA, 21 bp, Homo sapiens
caaggacttcctgtccagctc

SEQ ID NO: 2890914 - DNA, 19 bp, Homo sapiens
caaggactttccaaatcca

SEQ ID NO: 2890915 - DNA, 13 bp, Homo sapiens
caaggagagcgga

SEQ ID NO: 2890916 - DNA, 17 bp, Homo sapiens
caaggagagcggaggag

SEQ ID NO: 2890917 - DNA, 16 bp, Homo sapiens
caaggagcagagaggt

SEQ ID NO: 2890918 - DNA, 13 bp, Homo sapiens
caaggagctgcta

SEQ ID NO: 2890919 - DNA, 22 bp, Homo sapiens
caaggagctgctatagcctggg

SEQ ID NO: 2890920 - DNA, 12 bp, Homo sapiens
caaggagggaga

SEQ ID NO: 2890921 - DNA, 18 bp, Homo sapiens
caaggattacagaaactg

SEQ ID NO: 2890922 - DNA, 16 bp, Homo sapiens
caaggcactctagatt

SEQ ID NO: 2890923 - DNA, 19 bp, Homo sapiens
caaggcactctagattcca

SEQ ID NO: 2890924 - DNA, 16 bp, Homo sapiens
caaggcaggcctttcc

SEQ ID NO: 2890925 - DNA, 19 bp, Homo sapiens
caaggcaggcctttcctac

SEQ ID NO: 2890926 - DNA, 23 bp, Homo sapiens
caaggccatccttccctgtctgc

SEQ ID NO: 2890927 - DNA, 13 bp, Homo sapiens
caaggccctttcc

SEQ ID NO: 2890928 - DNA, 19 bp, Homo sapiens
caaggccctttcctttgga

SEQ ID NO: 2890929 - DNA, 15 bp, Homo sapiens
caaggccgcggccca

SEQ ID NO: 2890930 - DNA, 16 bp, Homo sapiens
caaggcctcggcagaa

SEQ ID NO: 2890931 - DNA, 14 bp, Homo sapiens
caaggcctggtctg

SEQ ID NO: 2890932 - DNA, 17 bp, Homo sapiens
caaggcctggtctggga

SEQ ID NO: 2890933 - DNA, 18 bp, Homo sapiens
caaggccttgcctggcct

SEQ ID NO: 2890934 - DNA, 21 bp, Homo sapiens
caaggcggtggacttgaactt

SEQ ID NO: 2890935 - DNA, 16 bp, Homo sapiens
caaggctaattggaaa

SEQ ID NO: 2890936 - DNA, 17 bp, Homo sapiens
caaggctcatctttctg

SEQ ID NO: 2890937 - DNA, 21 bp, Homo sapiens
caaggctcttctccttggagg

SEQ ID NO: 2890938 - DNA, 15 bp, Homo sapiens
caaggctgaggtggc

SEQ ID NO: 2890939 - DNA, 18 bp, Homo sapiens
caaggctgttgcatgggc

SEQ ID NO: 2890940 - DNA, 19 bp, Homo sapiens
caagggacaggaaggtctg

SEQ ID NO: 2890941 - DNA, 21 bp, Homo sapiens
caagggagaagacaacagaaa

SEQ ID NO: 2890942 - DNA, 16 bp, Homo sapiens
caagggaggcagtggc

SEQ ID NO: 2890943 - DNA, 15 bp, Homo sapiens
caagggcccagagtg

SEQ ID NO: 2890944 - DNA, 18 bp, Homo sapiens
caaggggaatcagaactc

SEQ ID NO: 2890945 - DNA, 22 bp, Homo sapiens
caaggggcttcaggtccaggct

SEQ ID NO: 2890946 - DNA, 16 bp, Homo sapiens
caagggggaaggctgc

SEQ ID NO: 2890947 - DNA, 13 bp, Homo sapiens
caagggtctcctt

SEQ ID NO: 2890948 - DNA, 21 bp, Homo sapiens
caagggttgcttctgagtggt

SEQ ID NO: 2890949 - DNA, 18 bp, Homo sapiens
caaggtacagctgtatat

SEQ ID NO: 2890950 - DNA, 17 bp, Homo sapiens
caaggtcatggccacac

SEQ ID NO: 2890951 - DNA, 22 bp, Homo sapiens
caaggtcatggccacactgtga

SEQ ID NO: 2890952 - DNA, 20 bp, Homo sapiens
caaggtcctctgtcagtcac

SEQ ID NO: 2890953 - DNA, 21 bp, Homo sapiens
caaggtctcacactcctcctg

SEQ ID NO: 2890954 - DNA, 24 bp, Homo sapiens
caaggtctcacactcctcctgcca

SEQ ID NO: 2890955 - DNA, 18 bp, Homo sapiens
caaggtgaaatgaagcaa

SEQ ID NO: 2890956 - DNA, 14 bp, Homo sapiens
caaggtgacagaag

SEQ ID NO: 2890957 - DNA, 22 bp, Homo sapiens
caaggtgcatatagaaaacaaa

SEQ ID NO: 2890958 - DNA, 19 bp, Homo sapiens
caaggtgtccctgccttca

SEQ ID NO: 2890959 - DNA, 13 bp, Homo sapiens
caaggttctaacc

SEQ ID NO: 2890960 - DNA, 21 bp, Homo sapiens
caaggtttaaagagtctagat

SEQ ID NO: 2890961 - DNA, 20 bp, Homo sapiens
caaggtttcctttcagccct

SEQ ID NO: 2890962 - DNA, 21 bp, Homo sapiens
caaggttttaggttctaaagt

SEQ ID NO: 2890963 - DNA, 14 bp, Homo sapiens
caagtaaaagaaaa

SEQ ID NO: 2890964 - DNA, 15 bp, Homo sapiens
caagtaaaagaaaag

SEQ ID NO: 2890965 - DNA, 20 bp, Homo sapiens
caagtaagagactcagcctg

SEQ ID NO: 2890966 - DNA, 22 bp, Homo sapiens
caagtaagagactcagcctgca

SEQ ID NO: 2890967 - DNA, 16 bp, Homo sapiens
caagtaagaggctgga

SEQ ID NO: 2890968 - DNA, 11 bp, Homo sapiens
caagtaattgt

SEQ ID NO: 2890969 - DNA, 23 bp, Homo sapiens
caagtaattgtgaaaaagttaaa

SEQ ID NO: 2890970 - DNA, 13 bp, Homo sapiens
caagtactgctgt

SEQ ID NO: 2890971 - DNA, 19 bp, Homo sapiens
caagtagaacaaaaactat

SEQ ID NO: 2890972 - DNA, 16 bp, Homo sapiens
caagtagaatctcagt

SEQ ID NO: 2890973 - DNA, 14 bp, Homo sapiens
caagtagctgctac

SEQ ID NO: 2890974 - DNA, 12 bp, Homo sapiens
caagtataatta

SEQ ID NO: 2890975 - DNA, 20 bp, Homo sapiens
caagtatatacttttaaatt

SEQ ID NO: 2890976 - DNA, 23 bp, Homo sapiens
caagtatatacttttaaattatg

SEQ ID NO: 2890977 - DNA, 18 bp, Homo sapiens
caagtatatgtcatttac

SEQ ID NO: 2890978 - DNA, 22 bp, Homo sapiens
caagtatttgggaagtgaagac

SEQ ID NO: 2890979 - DNA, 16 bp, Homo sapiens
caagtattttatattt

SEQ ID NO: 2890980 - DNA, 15 bp, Homo sapiens
caagtcaggccaggt

SEQ ID NO: 2890981 - DNA, 17 bp, Homo sapiens
caagtcaggccaggtgg

SEQ ID NO: 2890982 - DNA, 16 bp, Homo sapiens
caaattctatttgtct

SEQ ID NO: 2890983 - DNA, 15 bp, Homo sapiens
caaattctgtttctt

SEQ ID NO: 2890984 - DNA, 16 bp, Homo sapiens
caaattcttttgaatt

SEQ ID NO: 2890985 - DNA, 21 bp, Homo sapiens
caaattcttttgaattgttac

SEQ ID NO: 2890986 - DNA, 23 bp, Homo sapiens
caaattgagacagtgcacatgaa

SEQ ID NO: 2890987 - DNA, 20 bp, Homo sapiens
caaattgcactgaagttttt

SEQ ID NO: 2890988 - DNA, 21 bp, Homo sapiens
caaatttactgtcttaaatca

SEQ ID NO: 2890989 - DNA, 19 bp, Homo sapiens
caaattttcactgctgctc

SEQ ID NO: 2890990 - DNA, 19 bp, Homo sapiens
caaattttgaggtctttta

SEQ ID NO: 2890991 - DNA, 13 bp, Homo sapiens
caacaaaaaaagt

SEQ ID NO: 2890992 - DNA, 19 bp, Homo sapiens
caacaaaaaaagtttgtta

SEQ ID NO: 2890993 - DNA, 15 bp, Homo sapiens
caacaaaaggaagac

SEQ ID NO: 2890994 - DNA, 19 bp, Homo sapiens
caacaaaatcatggcttag

SEQ ID NO: 2890995 - DNA, 12 bp, Homo sapiens
caacaaaggaag

SEQ ID NO: 2890996 - DNA, 22 bp, Homo sapiens
caacaaaggattaattgctgca

SEQ ID NO: 2890997 - DNA, 14 bp, Homo sapiens
caacaaataattta

SEQ ID NO: 2890998 - DNA, 15 bp, Homo sapiens
caacaaataatttaa

SEQ ID NO: 2890999 - DNA, 16 bp, Homo sapiens
caacaaataatttaag

SEQ ID NO: 2891000 - DNA, 17 bp, Homo sapiens
caacaacaacaataata

SEQ ID NO: 2891001 - DNA, 18 bp, Homo sapiens
caacaaccaccaccttat

SEQ ID NO: 2891002 - DNA, 13 bp, Homo sapiens
caacaagaatgca

SEQ ID NO: 2891003 - DNA, 17 bp, Homo sapiens
caacaaggacaacttta

SEQ ID NO: 2891004 - DNA, 19 bp, Homo sapiens
caacaaggttatatgaata

SEQ ID NO: 2891005 - DNA, 16 bp, Homo sapiens
caacaataaaattttt

SEQ ID NO: 2891006 - DNA, 12 bp, Homo sapiens
caacaataataa

SEQ ID NO: 2891007 - DNA, 13 bp, Homo sapiens
caacaataataaa

SEQ ID NO: 2891008 - DNA, 15 bp, Homo sapiens
caacaatcctagtgc

SEQ ID NO: 2891009 - DNA, 13 bp, Homo sapiens
caacaattagagg

SEQ ID NO: 2891010 - DNA, 21 bp, Homo sapiens
caacaatttgggcttcctgtt

SEQ ID NO: 2891011 - DNA, 12 bp, Homo sapiens
caacacaagaaa

SEQ ID NO: 2891012 - DNA, 16 bp, Homo sapiens
caacacactgccttat

SEQ ID NO: 2891013 - DNA, 14 bp, Homo sapiens
caacacagaggcag

SEQ ID NO: 2891014 - DNA, 15 bp, Homo sapiens
caacacagcctgggc

SEQ ID NO: 2891015 - DNA, 12 bp, Homo sapiens
caacacattttt

SEQ ID NO: 2891016 - DNA, 13 bp, Homo sapiens
caacacatttttg

SEQ ID NO: 2891017 - DNA, 13 bp, Homo sapiens
caacaccaagcac

SEQ ID NO: 2891018 - DNA, 21 bp, Homo sapiens
caacaccaccgagctctgtgg

SEQ ID NO: 2891019 - DNA, 18 bp, Homo sapiens
caacaccccgcctgcctc

SEQ ID NO: 2891020 - DNA, 15 bp, Homo sapiens
caacacgcacctgcc

SEQ ID NO: 2891021 - DNA, 23 bp, Homo sapiens
caacactgaaaaaatactaccta

SEQ ID NO: 2891022 - DNA, 19 bp, Homo sapiens
caacactgtgggtgtgtga

SEQ ID NO: 2891023 - DNA, 15 bp, Homo sapiens
caacagaaagaggga

SEQ ID NO: 2891024 - DNA, 22 bp, Homo sapiens
caacagaatgaaaaatgaaaga

SEQ ID NO: 2891025 - DNA, 17 bp, Homo sapiens
caacagagaaggcagga

SEQ ID NO: 2891026 - DNA, 18 bp, Homo sapiens
caacagagaaggcaggaa

SEQ ID NO: 2891027 - DNA, 14 bp, Homo sapiens
caacagatctggaa

SEQ ID NO: 2891028 - DNA, 15 bp, Homo sapiens
caacagatttgtgaa

SEQ ID NO: 2891029 - DNA, 23 bp, Homo sapiens
caacagatttgtgaactcagcca

SEQ ID NO: 2891030 - DNA, 11 bp, Homo sapiens
caacagcactt

SEQ ID NO: 2891031 - DNA, 16 bp, Homo sapiens
caacagctacaacagc

SEQ ID NO: 2891032 - DNA, 21 bp, Homo sapiens
caacagctacaacagcctcac

SEQ ID NO: 2891033 - DNA, 19 bp, Homo sapiens
caacagcttttcccaggag

SEQ ID NO: 2891034 - DNA, 21 bp, Homo sapiens
caacaggagctgggatcctaa

SEQ ID NO: 2891035 - DNA, 20 bp, Homo sapiens
caacaggcttatgaatatat

SEQ ID NO: 2891036 - DNA, 16 bp, Homo sapiens
caacagtcatgtttta

SEQ ID NO: 2891037 - DNA, 23 bp, Homo sapiens
caacagtgtgaagttagaattcc

SEQ ID NO: 2891038 - DNA, 14 bp, Homo sapiens
caacagttccttca

SEQ ID NO: 2891039 - DNA, 20 bp, Homo sapiens
caacataaaactcttttgac

SEQ ID NO: 2891040 - DNA, 18 bp, Homo sapiens
caacatcccattgccctg

SEQ ID NO: 2891041 - DNA, 15 bp, Homo sapiens
caacatgagtcaaga

SEQ ID NO: 2891042 - DNA, 13 bp, Homo sapiens
caacatggagaaa

SEQ ID NO: 2891043 - DNA, 15 bp, Homo sapiens
caacatggcttctcc

SEQ ID NO: 2891044 - DNA, 16 bp, Homo sapiens
caacatggcttctcct

SEQ ID NO: 2891045 - DNA, 20 bp, Homo sapiens
caacatgtatctgtctactt

SEQ ID NO: 2891046 - DNA, 22 bp, Homo sapiens
caacatgtatctgtctactttc

SEQ ID NO: 2891047 - DNA, 18 bp, Homo sapiens
caacattgccttgcattt

SEQ ID NO: 2891048 - DNA, 22 bp, Homo sapiens
caacattgccttgcatttgtac

SEQ ID NO: 2891049 - DNA, 10 bp, Homo sapiens
caacattgtg

SEQ ID NO: 2891050 - DNA, 22 bp, Homo sapiens
caacatttatatattgtctgta

SEQ ID NO: 2891051 - DNA, 22 bp, Homo sapiens
caacatttccaaaagtggctag

SEQ ID NO: 2891052 - DNA, 19 bp, Homo sapiens
caacattttgagaacaaag

SEQ ID NO: 2891053 - DNA, 19 bp, Homo sapiens
caaccaaaagggaaaaaat

SEQ ID NO: 2891054 - DNA, 21 bp, Homo sapiens
caaccaaaagggaaaaaataa

SEQ ID NO: 2891055 - DNA, 22 bp, Homo sapiens
caaccaaaagggaaaaaataaa

SEQ ID NO: 2891056 - DNA, 15 bp, Homo sapiens
caaccaaggaaggag

SEQ ID NO: 2891057 - DNA, 16 bp, Homo sapiens
caaccaatgtagaaag

SEQ ID NO: 2891058 - DNA, 13 bp, Homo sapiens
caaccagacagag

SEQ ID NO: 2891059 - DNA, 15 bp, Homo sapiens
caaccagacagaggg

SEQ ID NO: 2891060 - DNA, 18 bp, Homo sapiens
caaccaggctcctgtgat

SEQ ID NO: 2891061 - DNA, 21 bp, Homo sapiens
caaccatttttagaaggaaaa

SEQ ID NO: 2891062 - DNA, 13 bp, Homo sapiens
caacccactgccc

SEQ ID NO: 2891063 - DNA, 17 bp, Homo sapiens
caaccccaagccagccc

SEQ ID NO: 2891064 - DNA, 18 bp, Homo sapiens
caaccccacccagctcca

SEQ ID NO: 2891065 - DNA, 16 bp, Homo sapiens
caaccccagacactgg

SEQ ID NO: 2891066 - DNA, 15 bp, Homo sapiens
caaccccagatgccc

SEQ ID NO: 2891067 - DNA, 13 bp, Homo sapiens
caaccccaggctg

SEQ ID NO: 2891068 - DNA, 14 bp, Homo sapiens
caacccccagcccc

SEQ ID NO: 2891069 - DNA, 15 bp, Homo sapiens
caacccccagccccc

SEQ ID NO: 2891070 - DNA, 13 bp, Homo sapiens
caacccccatctc

SEQ ID NO: 2891071 - DNA, 18 bp, Homo sapiens
caacccccatctccctag

SEQ ID NO: 2891072 - DNA, 13 bp, Homo sapiens
caacccctccccc

SEQ ID NO: 2891073 - DNA, 13 bp, Homo sapiens
caaccctgaagca

SEQ ID NO: 2891074 - DNA, 17 bp, Homo sapiens
caacccttccctcacct

SEQ ID NO: 2891075 - DNA, 18 bp, Homo sapiens
caacccttccctcacctt

SEQ ID NO: 2891076 - DNA, 23 bp, Homo sapiens
caacccttctcctcttgtaaata

SEQ ID NO: 2891077 - DNA, 22 bp, Homo sapiens
caaccgagagaatgctgacctg

SEQ ID NO: 2891078 - DNA, 18 bp, Homo sapiens
caaccgttggaaacataa

SEQ ID NO: 2891079 - DNA, 16 bp, Homo sapiens
caacctagaaaccttt

SEQ ID NO: 2891080 - DNA, 21 bp, Homo sapiens
caacctctcggccccatcgcc

SEQ ID NO: 2891081 - DNA, 15 bp, Homo sapiens
caacctctgcctccc

SEQ ID NO: 2891082 - DNA, 16 bp, Homo sapiens
caacctcttctggctc

SEQ ID NO: 2891083 - DNA, 13 bp, Homo sapiens
caacctgaaccta

SEQ ID NO: 2891084 - DNA, 23 bp, Homo sapiens
caacctgaaggtcccctggcagt

SEQ ID NO: 2891085 - DNA, 15 bp, Homo sapiens
caacctgaccaacat

SEQ ID NO: 2891086 - DNA, 21 bp, Homo sapiens
caacctgaccaacatggagaa

SEQ ID NO: 2891087 - DNA, 17 bp, Homo sapiens
caacctgcaaagatctg

SEQ ID NO: 2891088 - DNA, 18 bp, Homo sapiens
caaccttagatgttctaa

SEQ ID NO: 2891089 - DNA, 16 bp, Homo sapiens
caacctttattctttt

SEQ ID NO: 2891090 - DNA, 15 bp, Homo sapiens
caacgaggaagccct

SEQ ID NO: 2891091 - DNA, 22 bp, Homo sapiens
caacgccgccttggccttgcag

SEQ ID NO: 2891092 - DNA, 14 bp, Homo sapiens
caacgccgtgggct

SEQ ID NO: 2891093 - DNA, 22 bp, Homo sapiens
caacgctgaagcggtcagactg

SEQ ID NO: 2891094 - DNA, 20 bp, Homo sapiens
caacggaggcctgcgaccct

SEQ ID NO: 2891095 - DNA, 23 bp, Homo sapiens
caacggtctcctgactggtgctg

SEQ ID NO: 2891096 - DNA, 22 bp, Homo sapiens
caactacccaaaacaagcctgg

SEQ ID NO: 2891097 - DNA, 13 bp, Homo sapiens
caactatcaaaat

SEQ ID NO: 2891098 - DNA, 14 bp, Homo sapiens
caactattttcaga

SEQ ID NO: 2891099 - DNA, 17 bp, Homo sapiens
caactattttcagatgt

SEQ ID NO: 2891100 - DNA, 22 bp, Homo sapiens
caactccaacctctcggcccca

SEQ ID NO: 2891101 - DNA, 16 bp, Homo sapiens
caactccactcactga

SEQ ID NO: 2891102 - DNA, 16 bp, Homo sapiens
caactcgtatagcatg

SEQ ID NO: 2891103 - DNA, 24 bp, Homo sapiens
caactctcccctgacctgtgagcc

SEQ ID NO: 2891104 - DNA, 16 bp, Homo sapiens
caactctggctccagg

SEQ ID NO: 2891105 - DNA, 13 bp, Homo sapiens
caactctgtcccc

SEQ ID NO: 2891106 - DNA, 14 bp, Homo sapiens
caactcttgtattg

SEQ ID NO: 2891107 - DNA, 15 bp, Homo sapiens
caactctttgagaaa

SEQ ID NO: 2891108 - DNA, 16 bp, Homo sapiens
caactgaatacttgaa

SEQ ID NO: 2891109 - DNA, 17 bp, Homo sapiens
caactgacattgctcca

SEQ ID NO: 2891110 - DNA, 14 bp, Homo sapiens
caactgcctccttg

SEQ ID NO: 2891111 - DNA, 21 bp, Homo sapiens
caactgcctccttgccagccc

SEQ ID NO: 2891112 - DNA, 17 bp, Homo sapiens
caactgctcagctctgg

SEQ ID NO: 2891113 - DNA, 19 bp, Homo sapiens
caactggatgcatcaagaa

SEQ ID NO: 2891114 - DNA, 19 bp, Homo sapiens
caactggggggaccaaata

SEQ ID NO: 2891115 - DNA, 20 bp, Homo sapiens
caactggggggaccaaatag

SEQ ID NO: 2891116 - DNA, 14 bp, Homo sapiens
caactgtaaagcaa

SEQ ID NO: 2891117 - DNA, 17 bp, Homo sapiens
caactgtggtagctcca

SEQ ID NO: 2891118 - DNA, 22 bp, Homo sapiens
caactgtggtagctccagcgat

SEQ ID NO: 2891119 - DNA, 18 bp, Homo sapiens
caactgtgtctctgaatt

SEQ ID NO: 2891120 - DNA, 21 bp, Homo sapiens
caacttaaagtgaattgtctt

SEQ ID NO: 2891121 - DNA, 15 bp, Homo sapiens
caacttaataaaaac

SEQ ID NO: 2891122 - DNA, 16 bp, Homo sapiens
caacttatttaaaaat

SEQ ID NO: 2891123 - DNA, 17 bp, Homo sapiens
caacttatttaaaaata

SEQ ID NO: 2891124 - DNA, 21 bp, Homo sapiens
caacttatttaaaaatatttc

SEQ ID NO: 2891125 - DNA, 17 bp, Homo sapiens
caacttccctgttcttt

SEQ ID NO: 2891126 - DNA, 22 bp, Homo sapiens
caacttctgcctcccatgctta

SEQ ID NO: 2891127 - DNA, 20 bp, Homo sapiens
caacttgaacttcacctgca

SEQ ID NO: 2891128 - DNA, 12 bp, Homo sapiens
caacttgaagaa

SEQ ID NO: 2891129 - DNA, 14 bp, Homo sapiens
caacttgaagaaac

SEQ ID NO: 2891130 - DNA, 22 bp, Homo sapiens
caacttgagcctgtgaccttgg

SEQ ID NO: 2891131 - DNA, 20 bp, Homo sapiens
caacttggaaaaagaaagaa

SEQ ID NO: 2891132 - DNA, 22 bp, Homo sapiens
caacttggaagatctacctgca

SEQ ID NO: 2891133 - DNA, 13 bp, Homo sapiens
caacttggatcat

SEQ ID NO: 2891134 - DNA, 24 bp, Homo sapiens
caacttgtcacccaaagcctgtcc

SEQ ID NO: 2891135 - DNA, 16 bp, Homo sapiens
caactttaagaggaca

SEQ ID NO: 2891136 - DNA, 15 bp, Homo sapiens
caactttcatttgaa

SEQ ID NO: 2891137 - DNA, 23 bp, Homo sapiens
caactttgaataaagaatacttg

SEQ ID NO: 2891138 - DNA, 16 bp, Homo sapiens
caactttttattgcct

SEQ ID NO: 2891139 - DNA, 19 bp, Homo sapiens
caactttttattgccttct

SEQ ID NO: 2891140 - DNA, 20 bp, Homo sapiens
caactttttattgccttctc

SEQ ID NO: 2891141 - DNA, 21 bp, Homo sapiens
caactttttattgccttctca

SEQ ID NO: 2891142 - DNA, 12 bp, Homo sapiens
caagaaaactca

SEQ ID NO: 2891143 - DNA, 18 bp, Homo sapiens
caagaaaactcaaagaat

SEQ ID NO: 2891144 - DNA, 14 bp, Homo sapiens
caagaaaactggaa

SEQ ID NO: 2891145 - DNA, 18 bp, Homo sapiens
caagaaaactggaaatct

SEQ ID NO: 2891146 - DNA, 16 bp, Homo sapiens
caagaaacactgcctg

SEQ ID NO: 2891147 - DNA, 19 bp, Homo sapiens
caagaaaccaagtgggctg

SEQ ID NO: 2891148 - DNA, 15 bp, Homo sapiens
caagaaactttggaa

SEQ ID NO: 2891149 - DNA, 16 bp, Homo sapiens
caagaaactttggaag

SEQ ID NO: 2891150 - DNA, 15 bp, Homo sapiens
caagaaagaaacccg

SEQ ID NO: 2891151 - DNA, 14 bp, Homo sapiens
caagaaagatgtat

SEQ ID NO: 2891152 - DNA, 21 bp, Homo sapiens
caagaaataaaaggaagccaa

SEQ ID NO: 2891153 - DNA, 21 bp, Homo sapiens
caagaaatcgccttatgagaa

SEQ ID NO: 2891154 - DNA, 23 bp, Homo sapiens
caagaaatcgccttatgagaaca

SEQ ID NO: 2891155 - DNA, 20 bp, Homo sapiens
caagaagataggctctcagt

SEQ ID NO: 2891156 - DNA, 18 bp, Homo sapiens
caagaagcaattatttaa

SEQ ID NO: 2891157 - DNA, 19 bp, Homo sapiens
caagaagttaaaaaacagc

SEQ ID NO: 2891158 - DNA, 23 bp, Homo sapiens
caagaagttaaaaaacagctgca

SEQ ID NO: 2891159 - DNA, 23 bp, Homo sapiens
caagaatagcatctgtacaaagg

SEQ ID NO: 2891160 - DNA, 14 bp, Homo sapiens
caagaatcagaaga

SEQ ID NO: 2891161 - DNA, 19 bp, Homo sapiens
caagaatcagaagaaaggc

SEQ ID NO: 2891162 - DNA, 22 bp, Homo sapiens
caagaatgatgcctttcaggtc

SEQ ID NO: 2891163 - DNA, 12 bp, Homo sapiens
caagacaagacc

SEQ ID NO: 2891164 - DNA, 15 bp, Homo sapiens
caagacacagcaggg

SEQ ID NO: 2891165 - DNA, 13 bp, Homo sapiens
caagacagatttt

SEQ ID NO: 2891166 - DNA, 18 bp, Homo sapiens
caagacagattttcggaa

SEQ ID NO: 2891167 - DNA, 22 bp, Homo sapiens
caagacagattttcggaacaca

SEQ ID NO: 2891168 - DNA, 13 bp, Homo sapiens
caagacagccttc

SEQ ID NO: 2891169 - DNA, 15 bp, Homo sapiens
caagacagccttcac

SEQ ID NO: 2891170 - DNA, 19 bp, Homo sapiens
caagaccaccacttcgaaa

SEQ ID NO: 2891171 - DNA, 14 bp, Homo sapiens
caagaccagcctgt

SEQ ID NO: 2891172 - DNA, 13 bp, Homo sapiens
caagacccccagc

SEQ ID NO: 2891173 - DNA, 13 bp, Homo sapiens
caagaccctctca

SEQ ID NO: 2891174 - DNA, 17 bp, Homo sapiens
caagaccctctcaggct

SEQ ID NO: 2891175 - DNA, 16 bp, Homo sapiens
caagacctcagggcac

SEQ ID NO: 2891176 - DNA, 23 bp, Homo sapiens
caagacctcagggcacaaagatg

SEQ ID NO: 2891177 - DNA, 17 bp, Homo sapiens
caagactgaagatggct

SEQ ID NO: 2891178 - DNA, 22 bp, Homo sapiens
caagactgaagatggcttttcc

SEQ ID NO: 2891179 - DNA, 23 bp, Homo sapiens
caagactgaagatggcttttcct

SEQ ID NO: 2891180 - DNA, 15 bp, Homo sapiens
caagactgcctccct

SEQ ID NO: 2891181 - DNA, 17 bp, Homo sapiens
caagactgcctccctct

SEQ ID NO: 2891182 - DNA, 12 bp, Homo sapiens
caagactgggct

SEQ ID NO: 2891183 - DNA, 19 bp, Homo sapiens
caagacttatggaacaggg

SEQ ID NO: 2891184 - DNA, 21 bp, Homo sapiens
caagacttcagattcagccga

SEQ ID NO: 2891185 - DNA, 12 bp, Homo sapiens
caagagaagggg

SEQ ID NO: 2891186 - DNA, 23 bp, Homo sapiens
caagagaaggtggacctggcagt

SEQ ID NO: 2891187 - DNA, 12 bp, Homo sapiens
caagagagaacc

SEQ ID NO: 2891188 - DNA, 12 bp, Homo sapiens
caagagaggaag

SEQ ID NO: 2891189 - DNA, 16 bp, Homo sapiens
caagagattgctaatt

SEQ ID NO: 2891190 - DNA, 21 bp, Homo sapiens
caagagcaaaactccgtctca

SEQ ID NO: 2891191 - DNA, 19 bp, Homo sapiens
caagagcccgtgccacccc

SEQ ID NO: 2891192 - DNA, 18 bp, Homo sapiens
caagagcttccagagctc

SEQ ID NO: 2891193 - DNA, 19 bp, Homo sapiens
caagagcttccagagctct

SEQ ID NO: 2891194 - DNA, 22 bp, Homo sapiens
caagaggaaaagctgtaagaaa

SEQ ID NO: 2891195 - DNA, 11 bp, Homo sapiens
caagaggctga

SEQ ID NO: 2891196 - DNA, 16 bp, Homo sapiens
caagaggctgcagcca

SEQ ID NO: 2891197 - DNA, 17 bp, Homo sapiens
caagagggacgcctggg

SEQ ID NO: 2891198 - DNA, 22 bp, Homo sapiens
caagagggtcctttagtacctg

SEQ ID NO: 2891199 - DNA, 22 bp, Homo sapiens
caagagggttcacacagcccag

SEQ ID NO: 2891200 - DNA, 22 bp, Homo sapiens
caagagtagttatataattgtt

SEQ ID NO: 2891201 - DNA, 15 bp, Homo sapiens
caagagtctaaagat

SEQ ID NO: 2891202 - DNA, 20 bp, Homo sapiens
caagagtctaatagtctttg

SEQ ID NO: 2891203 - DNA, 14 bp, Homo sapiens
caagagtctctcca

SEQ ID NO: 2891204 - DNA, 18 bp, Homo sapiens
caagagtctctccagcct

SEQ ID NO: 2891205 - DNA, 17 bp, Homo sapiens
caagataaagaaaaatg

SEQ ID NO: 2891206 - DNA, 19 bp, Homo sapiens
caagatccaaatgctgtgc

SEQ ID NO: 2891207 - DNA, 22 bp, Homo sapiens
caagatgctggatgtctgccaa

SEQ ID NO: 2891208 - DNA, 13 bp, Homo sapiens
caagatgggacag

SEQ ID NO: 2891209 - DNA, 18 bp, Homo sapiens
caagatgggacagcaaca

SEQ ID NO: 2891210 - DNA, 15 bp, Homo sapiens
caagatgtagcacct

SEQ ID NO: 2891211 - DNA, 22 bp, Homo sapiens
caagatgtagcaccttttctcc

SEQ ID NO: 2891212 - DNA, 13 bp, Homo sapiens
caagattcccaga

SEQ ID NO: 2891213 - DNA, 14 bp, Homo sapiens
caagattcccagag

SEQ ID NO: 2891214 - DNA, 16 bp, Homo sapiens
caagattcccagagac

SEQ ID NO: 2891215 - DNA, 17 bp, Homo sapiens
caagattcccagagaca

SEQ ID NO: 2891216 - DNA, 19 bp, Homo sapiens
caagattcccagagacagg

SEQ ID NO: 2891217 - DNA, 19 bp, Homo sapiens
caagattccggatcctaag

SEQ ID NO: 2891218 - DNA, 12 bp, Homo sapiens
caagattctaga

SEQ ID NO: 2891219 - DNA, 14 bp, Homo sapiens
caagattggaaaga

SEQ ID NO: 2891220 - DNA, 18 bp, Homo sapiens
caagattggaaagacagg

SEQ ID NO: 2891221 - DNA, 21 bp, Homo sapiens
caagattttagggcttttatt

SEQ ID NO: 2891222 - DNA, 17 bp, Homo sapiens
caagattttccacaaga

SEQ ID NO: 2891223 - DNA, 16 bp, Homo sapiens
caagattttgaaggaa

SEQ ID NO: 2891224 - DNA, 14 bp, Homo sapiens
caagcaaaatcatg

SEQ ID NO: 2891225 - DNA, 17 bp, Homo sapiens
caagcaaggatatcaga

SEQ ID NO: 2891226 - DNA, 22 bp, Homo sapiens
caagcaatcctcctacctcagc

SEQ ID NO: 2891227 - DNA, 20 bp, Homo sapiens
caagcacagtggtggcaggg

SEQ ID NO: 2891228 - DNA, 17 bp, Homo sapiens
caagcactaaacaaaga

SEQ ID NO: 2891229 - DNA, 18 bp, Homo sapiens
attttcccatcatccttt

SEQ ID NO: 2891230 - DNA, 15 bp, Homo sapiens
attttcctaaggcca

SEQ ID NO: 2891231 - DNA, 15 bp, Homo sapiens
attttcctccaaagt

SEQ ID NO: 2891232 - DNA, 16 bp, Homo sapiens
attttccttccatgct

SEQ ID NO: 2891233 - DNA, 18 bp, Homo sapiens
attttctataatttaaat

SEQ ID NO: 2891234 - DNA, 13 bp, Homo sapiens
attttctatttct

SEQ ID NO: 2891235 - DNA, 16 bp, Homo sapiens
attttctattttaaga

SEQ ID NO: 2891236 - DNA, 23 bp, Homo sapiens
attttctattttaagactgattt

SEQ ID NO: 2891237 - DNA, 18 bp, Homo sapiens
attttctccacaacactg

SEQ ID NO: 2891238 - DNA, 16 bp, Homo sapiens
attttctctgtacttt

SEQ ID NO: 2891239 - DNA, 17 bp, Homo sapiens
attttctgggtgaaaga

SEQ ID NO: 2891240 - DNA, 21 bp, Homo sapiens
attttctgtgtaagcttttaa

SEQ ID NO: 2891241 - DNA, 23 bp, Homo sapiens
attttctgttcatagatattgga

SEQ ID NO: 2891242 - DNA, 15 bp, Homo sapiens
attttcttaaccagt

SEQ ID NO: 2891243 - DNA, 14 bp, Homo sapiens
attttcttgtcaat

SEQ ID NO: 2891244 - DNA, 17 bp, Homo sapiens
attttctttctagtttg

SEQ ID NO: 2891245 - DNA, 13 bp, Homo sapiens
attttcttttctt

SEQ ID NO: 2891246 - DNA, 12 bp, Homo sapiens
attttctttttg

SEQ ID NO: 2891247 - DNA, 21 bp, Homo sapiens
attttctttttgtttcactgg

SEQ ID NO: 2891248 - DNA, 22 bp, Homo sapiens
attttctttttgtttcactgga

SEQ ID NO: 2891249 - DNA, 15 bp, Homo sapiens
attttgaaaagtatc

SEQ ID NO: 2891250 - DNA, 12 bp, Homo sapiens
attttgaaatga

SEQ ID NO: 2891251 - DNA, 16 bp, Homo sapiens
attttgaaatgaactt

SEQ ID NO: 2891252 - DNA, 20 bp, Homo sapiens
attttgaaatgaactttgtc

SEQ ID NO: 2891253 - DNA, 13 bp, Homo sapiens
attttgaaggaaa

SEQ ID NO: 2891254 - DNA, 18 bp, Homo sapiens
attttgaatcaataatat

SEQ ID NO: 2891255 - DNA, 12 bp, Homo sapiens
attttgaatgtg

SEQ ID NO: 2891256 - DNA, 14 bp, Homo sapiens
attttgaatgtgat

SEQ ID NO: 2891257 - DNA, 15 bp, Homo sapiens
attttgaatgtgatc

SEQ ID NO: 2891258 - DNA, 12 bp, Homo sapiens
attttgacaaca

SEQ ID NO: 2891259 - DNA, 18 bp, Homo sapiens
attttgacggacactgtg

SEQ ID NO: 2891260 - DNA, 19 bp, Homo sapiens
attttgacttagtaacttt

SEQ ID NO: 2891261 - DNA, 19 bp, Homo sapiens
attttgagaacaaagatga

SEQ ID NO: 2891262 - DNA, 19 bp, Homo sapiens
attttgagaactccagctg

SEQ ID NO: 2891263 - DNA, 19 bp, Homo sapiens
attttgagggtgtaaccag

SEQ ID NO: 2891264 - DNA, 13 bp, Homo sapiens
attttgagtttca

SEQ ID NO: 2891265 - DNA, 19 bp, Homo sapiens
attttgagtttcagctgga

SEQ ID NO: 2891266 - DNA, 21 bp, Homo sapiens
attttgcaaacactgtgatta

SEQ ID NO: 2891267 - DNA, 22 bp, Homo sapiens
attttgcccttccatagcctaa

SEQ ID NO: 2891268 - DNA, 19 bp, Homo sapiens
attttgctatcaacaataa

SEQ ID NO: 2891269 - DNA, 19 bp, Homo sapiens
attttgctctgtgaactat

SEQ ID NO: 2891270 - DNA, 14 bp, Homo sapiens
attttggaagacat

SEQ ID NO: 2891271 - DNA, 17 bp, Homo sapiens
attttggaagacatata

SEQ ID NO: 2891272 - DNA, 20 bp, Homo sapiens
attttggaagacatatatta

SEQ ID NO: 2891273 - DNA, 13 bp, Homo sapiens
attttggaattgg

SEQ ID NO: 2891274 - DNA, 22 bp, Homo sapiens
attttggagagtttcctgaaac

SEQ ID NO: 2891275 - DNA, 18 bp, Homo sapiens
attttggcatctgcaaag

SEQ ID NO: 2891276 - DNA, 19 bp, Homo sapiens
attttgggttcaggcctgg

SEQ ID NO: 2891277 - DNA, 13 bp, Homo sapiens
attttggtaatga

SEQ ID NO: 2891278 - DNA, 13 bp, Homo sapiens
attttggtgtgca

SEQ ID NO: 2891279 - DNA, 12 bp, Homo sapiens
attttgtaatga

SEQ ID NO: 2891280 - DNA, 19 bp, Homo sapiens
attttgtaggttattttat

SEQ ID NO: 2891281 - DNA, 21 bp, Homo sapiens
attttgtatctttttgaaaat

SEQ ID NO: 2891282 - DNA, 14 bp, Homo sapiens
attttgtattgcca

SEQ ID NO: 2891283 - DNA, 15 bp, Homo sapiens
attttgtattgccat

SEQ ID NO: 2891284 - DNA, 12 bp, Homo sapiens
attttgtatttt

SEQ ID NO: 2891285 - DNA, 20 bp, Homo sapiens
attttgtcacagctcttgtt

SEQ ID NO: 2891286 - DNA, 21 bp, Homo sapiens
attttgtccaagttcacagta

SEQ ID NO: 2891287 - DNA, 16 bp, Homo sapiens
attttgtgtacagtaa

SEQ ID NO: 2891288 - DNA, 17 bp, Homo sapiens
attttgtttaaaaaatc

SEQ ID NO: 2891289 - DNA, 16 bp, Homo sapiens
attttgtttctgtata

SEQ ID NO: 2891290 - DNA, 19 bp, Homo sapiens
atttttaaaaaatattttc

SEQ ID NO: 2891291 - DNA, 13 bp, Homo sapiens
atttttaaaagat

SEQ ID NO: 2891292 - DNA, 18 bp, Homo sapiens
atttttaaaatatgtttt

SEQ ID NO: 2891293 - DNA, 15 bp, Homo sapiens
atttttaaaatgaat

SEQ ID NO: 2891294 - DNA, 14 bp, Homo sapiens
atttttaaagcatg

SEQ ID NO: 2891295 - DNA, 23 bp, Homo sapiens
atttttaaaggacaaacagtgaa

SEQ ID NO: 2891296 - DNA, 12 bp, Homo sapiens
atttttaaataa

SEQ ID NO: 2891297 - DNA, 13 bp, Homo sapiens
atttttaaatgtg

SEQ ID NO: 2891298 - DNA, 12 bp, Homo sapiens
atttttaaattc

SEQ ID NO: 2891299 - DNA, 15 bp, Homo sapiens
atttttaaattttct

SEQ ID NO: 2891300 - DNA, 13 bp, Homo sapiens
atttttaactgta

SEQ ID NO: 2891301 - DNA, 16 bp, Homo sapiens
atttttaatcatgaaa

SEQ ID NO: 2891302 - DNA, 18 bp, Homo sapiens
atttttaattaaaaacta

SEQ ID NO: 2891303 - DNA, 13 bp, Homo sapiens
atttttagaagga

SEQ ID NO: 2891304 - DNA, 14 bp, Homo sapiens
atttttagagcatt

SEQ ID NO: 2891305 - DNA, 21 bp, Homo sapiens
atttttagatagttagaacct

SEQ ID NO: 2891306 - DNA, 21 bp, Homo sapiens
atttttagattggttctgttt

SEQ ID NO: 2891307 - DNA, 22 bp, Homo sapiens
atttttagattggttctgtttt

SEQ ID NO: 2891308 - DNA, 22 bp, Homo sapiens
atttttatatctatatgtactt

SEQ ID NO: 2891309 - DNA, 14 bp, Homo sapiens
atttttatcatgaa

SEQ ID NO: 2891310 - DNA, 19 bp, Homo sapiens
atttttatctttcgtgata

SEQ ID NO: 2891311 - DNA, 11 bp, Homo sapiens
atttttattca

SEQ ID NO: 2891312 - DNA, 14 bp, Homo sapiens
atttttatttcaaa

SEQ ID NO: 2891313 - DNA, 22 bp, Homo sapiens
atttttcaaccccaccctgttt

SEQ ID NO: 2891314 - DNA, 13 bp, Homo sapiens
atttttcaacttt

SEQ ID NO: 2891315 - DNA, 14 bp, Homo sapiens
atttttcagatgct

SEQ ID NO: 2891316 - DNA, 18 bp, Homo sapiens
atttttcagatgcttctg

SEQ ID NO: 2891317 - DNA, 21 bp, Homo sapiens
atttttccacactatgtgtgt

SEQ ID NO: 2891318 - DNA, 13 bp, Homo sapiens
atttttccctccg

SEQ ID NO: 2891319 - DNA, 17 bp, Homo sapiens
atttttccgtttgcttt

SEQ ID NO: 2891320 - DNA, 22 bp, Homo sapiens
atttttccttcctctgtaagat

SEQ ID NO: 2891321 - DNA, 23 bp, Homo sapiens
atttttctctccctctttttctc

SEQ ID NO: 2891322 - DNA, 13 bp, Homo sapiens
atttttctgcaga

SEQ ID NO: 2891323 - DNA, 21 bp, Homo sapiens
atttttctggaggttgataac

SEQ ID NO: 2891324 - DNA, 11 bp, Homo sapiens
atttttgcaaa

SEQ ID NO: 2891325 - DNA, 19 bp, Homo sapiens
atttttgcaaaataagttt

SEQ ID NO: 2891326 - DNA, 18 bp, Homo sapiens
atttttggagtttaccac

SEQ ID NO: 2891327 - DNA, 13 bp, Homo sapiens
atttttgtatcta

SEQ ID NO: 2891328 - DNA, 22 bp, Homo sapiens
atttttgtgattttgtgattga

SEQ ID NO: 2891329 - DNA, 16 bp, Homo sapiens
atttttgtgtatccag

SEQ ID NO: 2891330 - DNA, 21 bp, Homo sapiens
atttttgtttttggtttctta

SEQ ID NO: 2891331 - DNA, 16 bp, Homo sapiens
attttttaaggaaaca

SEQ ID NO: 2891332 - DNA, 13 bp, Homo sapiens
attttttgaaaca

SEQ ID NO: 2891333 - DNA, 17 bp, Homo sapiens
attttttggtacaaaaa

SEQ ID NO: 2891334 - DNA, 12 bp, Homo sapiens
attttttgttga

SEQ ID NO: 2891335 - DNA, 14 bp, Homo sapiens
atttttttaactgt

SEQ ID NO: 2891336 - DNA, 18 bp, Homo sapiens
atttttttaactgtgata

SEQ ID NO: 2891337 - DNA, 14 bp, Homo sapiens
atttttttagtttg

SEQ ID NO: 2891338 - DNA, 17 bp, Homo sapiens
atttttttctctctgga

SEQ ID NO: 2891339 - DNA, 14 bp, Homo sapiens
atttttttgtattt

SEQ ID NO: 2891340 - DNA, 15 bp, Homo sapiens
attttttttaaacaa

SEQ ID NO: 2891341 - DNA, 20 bp, Homo sapiens
attttttttaagttcacttt

SEQ ID NO: 2891342 - DNA, 21 bp, Homo sapiens
attttttttaagttcactttt

SEQ ID NO: 2891343 - DNA, 15 bp, Homo sapiens
attttttttcatgtt

SEQ ID NO: 2891344 - DNA, 14 bp, Homo sapiens
attttttttggttg

SEQ ID NO: 2891345 - DNA, 22 bp, Homo sapiens
attttttttggttgtttgctgt

SEQ ID NO: 2891346 - DNA, 15 bp, Homo sapiens
caaaaaaaaaaagat

SEQ ID NO: 2891347 - DNA, 12 bp, Homo sapiens
caaaaaaaggaa

SEQ ID NO: 2891348 - DNA, 15 bp, Homo sapiens
caaaaaaaggaaaaa

SEQ ID NO: 2891349 - DNA, 17 bp, Homo sapiens
caaaaaaaggaaaaata

SEQ ID NO: 2891350 - DNA, 20 bp, Homo sapiens
caaaaaaaggaaaaataatc

SEQ ID NO: 2891351 - DNA, 22 bp, Homo sapiens
caaaaaaaggaaaaataatcaa

SEQ ID NO: 2891352 - DNA, 20 bp, Homo sapiens
caaaaaaagtttgttacttt

SEQ ID NO: 2891353 - DNA, 21 bp, Homo sapiens
caaaaaaagtttgttactttg

SEQ ID NO: 2891354 - DNA, 13 bp, Homo sapiens
caaaaaaatactg

SEQ ID NO: 2891355 - DNA, 18 bp, Homo sapiens
caaaaaagtccaatttta

SEQ ID NO: 2891356 - DNA, 12 bp, Homo sapiens
caaaaaatgagc

SEQ ID NO: 2891357 - DNA, 15 bp, Homo sapiens
caaaaaatgttttaa

SEQ ID NO: 2891358 - DNA, 19 bp, Homo sapiens
caaaaacaagactgcctcc

SEQ ID NO: 2891359 - DNA, 22 bp, Homo sapiens
caaaaacatgtatgtgcatttc

SEQ ID NO: 2891360 - DNA, 19 bp, Homo sapiens
caaaaactgcgtcttggat

SEQ ID NO: 2891361 - DNA, 13 bp, Homo sapiens
caaaaagaaatga

SEQ ID NO: 2891362 - DNA, 16 bp, Homo sapiens
caaaaaggactggaaa

SEQ ID NO: 2891363 - DNA, 23 bp, Homo sapiens
caaaaagtaaagtaatgcatttg

SEQ ID NO: 2891364 - DNA, 14 bp, Homo sapiens
caaaaataaattta

SEQ ID NO: 2891365 - DNA, 16 bp, Homo sapiens
caaaaataatttattt

SEQ ID NO: 2891366 - DNA, 23 bp, Homo sapiens
caaaaatataaaatatgaagaca

SEQ ID NO: 2891367 - DNA, 13 bp, Homo sapiens
atttctctgtgta

SEQ ID NO: 2891368 - DNA, 14 bp, Homo sapiens
atttctctgtgtat

SEQ ID NO: 2891369 - DNA, 17 bp, Homo sapiens
atttctctttttgaaaa

SEQ ID NO: 2891370 - DNA, 18 bp, Homo sapiens
atttctctttttgaaaaa

SEQ ID NO: 2891371 - DNA, 18 bp, Homo sapiens
atttctgagcaaagcatc

SEQ ID NO: 2891372 - DNA, 22 bp, Homo sapiens
atttctgcacaggtctctgttt

SEQ ID NO: 2891373 - DNA, 21 bp, Homo sapiens
atttctgtaggagcaacttct

SEQ ID NO: 2891374 - DNA, 16 bp, Homo sapiens
atttctgtgggagaat

SEQ ID NO: 2891375 - DNA, 13 bp, Homo sapiens
atttctgtgtcta

SEQ ID NO: 2891376 - DNA, 14 bp, Homo sapiens
atttcttaaacact

SEQ ID NO: 2891377 - DNA, 14 bp, Homo sapiens
atttcttaaatctt

SEQ ID NO: 2891378 - DNA, 17 bp, Homo sapiens
atttcttaaatctttct

SEQ ID NO: 2891379 - DNA, 14 bp, Homo sapiens
atttcttaatttgg

SEQ ID NO: 2891380 - DNA, 19 bp, Homo sapiens
atttcttcgttctttttaa

SEQ ID NO: 2891381 - DNA, 16 bp, Homo sapiens
atttcttctagaagat

SEQ ID NO: 2891382 - DNA, 20 bp, Homo sapiens
atttcttgaggtaaaagcat

SEQ ID NO: 2891383 - DNA, 11 bp, Homo sapiens
atttcttgctt

SEQ ID NO: 2891384 - DNA, 15 bp, Homo sapiens
atttctttaaaaaag

SEQ ID NO: 2891385 - DNA, 15 bp, Homo sapiens
atttctttatataag

SEQ ID NO: 2891386 - DNA, 15 bp, Homo sapiens
atttctttgcctgtt

SEQ ID NO: 2891387 - DNA, 23 bp, Homo sapiens
atttctttgcctgttcagttaca

SEQ ID NO: 2891388 - DNA, 17 bp, Homo sapiens
atttctttgctgtaaga

SEQ ID NO: 2891389 - DNA, 16 bp, Homo sapiens
atttcttttcttcctg

SEQ ID NO: 2891390 - DNA, 18 bp, Homo sapiens
atttctttttaattattt

SEQ ID NO: 2891391 - DNA, 19 bp, Homo sapiens
atttctttttaattatttt

SEQ ID NO: 2891392 - DNA, 11 bp, Homo sapiens
atttgaaagaa

SEQ ID NO: 2891393 - DNA, 14 bp, Homo sapiens
atttgaaagaaagg

SEQ ID NO: 2891394 - DNA, 17 bp, Homo sapiens
atttgaagatctgattt

SEQ ID NO: 2891395 - DNA, 17 bp, Homo sapiens
atttgaagcagctctgc

SEQ ID NO: 2891396 - DNA, 18 bp, Homo sapiens
atttgaagcagctctgcc

SEQ ID NO: 2891397 - DNA, 13 bp, Homo sapiens
atttgaagtgtaa

SEQ ID NO: 2891398 - DNA, 14 bp, Homo sapiens
atttgaatcaatgt

SEQ ID NO: 2891399 - DNA, 17 bp, Homo sapiens
atttgaatgggtccatt

SEQ ID NO: 2891400 - DNA, 18 bp, Homo sapiens
atttgaatgtatgcttca

SEQ ID NO: 2891401 - DNA, 21 bp, Homo sapiens
atttgaatgtatgcttcatac

SEQ ID NO: 2891402 - DNA, 11 bp, Homo sapiens
atttgaattgg

SEQ ID NO: 2891403 - DNA, 17 bp, Homo sapiens
atttgaattggcctgaa

SEQ ID NO: 2891404 - DNA, 14 bp, Homo sapiens
atttgacagacatc

SEQ ID NO: 2891405 - DNA, 18 bp, Homo sapiens
atttgacagacatccttg

SEQ ID NO: 2891406 - DNA, 19 bp, Homo sapiens
atttgacagacatccttgc

SEQ ID NO: 2891407 - DNA, 14 bp, Homo sapiens
atttgactaatttt

SEQ ID NO: 2891408 - DNA, 15 bp, Homo sapiens
atttgactaatttta

SEQ ID NO: 2891409 - DNA, 18 bp, Homo sapiens
atttgactttaatttatg

SEQ ID NO: 2891410 - DNA, 20 bp, Homo sapiens
atttgaggatttagaagtgt

SEQ ID NO: 2891411 - DNA, 22 bp, Homo sapiens
atttgaggggaaaacaccataa

SEQ ID NO: 2891412 - DNA, 13 bp, Homo sapiens
atttgagtttcct

SEQ ID NO: 2891413 - DNA, 17 bp, Homo sapiens
atttgagtttcctttaa

SEQ ID NO: 2891414 - DNA, 15 bp, Homo sapiens
atttgataacatttt

SEQ ID NO: 2891415 - DNA, 23 bp, Homo sapiens
atttgatcacttaaaacttttaa

SEQ ID NO: 2891416 - DNA, 23 bp, Homo sapiens
atttgatgctgtttgacaaagtt

SEQ ID NO: 2891417 - DNA, 12 bp, Homo sapiens
atttgatgtctt

SEQ ID NO: 2891418 - DNA, 14 bp, Homo sapiens
atttgattaacatt

SEQ ID NO: 2891419 - DNA, 20 bp, Homo sapiens
atttgattcaaaatatttaa

SEQ ID NO: 2891420 - DNA, 22 bp, Homo sapiens
atttgatttcgatgtacagtct

SEQ ID NO: 2891421 - DNA, 15 bp, Homo sapiens
atttgcaaagtactg

SEQ ID NO: 2891422 - DNA, 19 bp, Homo sapiens
atttgcaaagtactgtaag

SEQ ID NO: 2891423 - DNA, 18 bp, Homo sapiens
atttgcaatgggatgtat

SEQ ID NO: 2891424 - DNA, 21 bp, Homo sapiens
atttgcactggagttctatgc

SEQ ID NO: 2891425 - DNA, 21 bp, Homo sapiens
atttgcaggatttttagagca

SEQ ID NO: 2891426 - DNA, 18 bp, Homo sapiens
atttgcatgaaagcacaa

SEQ ID NO: 2891427 - DNA, 14 bp, Homo sapiens
atttgcatgtctaa

SEQ ID NO: 2891428 - DNA, 16 bp, Homo sapiens
atttgcattgaacaca

SEQ ID NO: 2891429 - DNA, 20 bp, Homo sapiens
atttagaacgagcctggaag

SEQ ID NO: 2891430 - DNA, 19 bp, Homo sapiens
atttagaagcctgacaact

SEQ ID NO: 2891431 - DNA, 14 bp, Homo sapiens
atttagaagtgtca

SEQ ID NO: 2891432 - DNA, 19 bp, Homo sapiens
atttagaatggttgagtta

SEQ ID NO: 2891433 - DNA, 21 bp, Homo sapiens
atttagagcaatgcattctgg

SEQ ID NO: 2891434 - DNA, 17 bp, Homo sapiens
atttagatttatcactt

SEQ ID NO: 2891435 - DNA, 18 bp, Homo sapiens
atttagcaatgctgtgaa

SEQ ID NO: 2891436 - DNA, 20 bp, Homo sapiens
atttagcaatgctgtgaata

SEQ ID NO: 2891437 - DNA, 22 bp, Homo sapiens
atttagccaggacctgccaatg

SEQ ID NO: 2891438 - DNA, 23 bp, Homo sapiens
atttagctaaacggattccaaag

SEQ ID NO: 2891439 - DNA, 14 bp, Homo sapiens
atttagtaaatgtt

SEQ ID NO: 2891440 - DNA, 15 bp, Homo sapiens
atttagtaaatgtta

SEQ ID NO: 2891441 - DNA, 13 bp, Homo sapiens
atttagtctcttt

SEQ ID NO: 2891442 - DNA, 16 bp, Homo sapiens
atttagtctctttatt

SEQ ID NO: 2891443 - DNA, 21 bp, Homo sapiens
atttataaacagacaatatgt

SEQ ID NO: 2891444 - DNA, 16 bp, Homo sapiens
atttataaggttttaa

SEQ ID NO: 2891445 - DNA, 15 bp, Homo sapiens
atttatacatacaga

SEQ ID NO: 2891446 - DNA, 19 bp, Homo sapiens
atttataccattataccag

SEQ ID NO: 2891447 - DNA, 14 bp, Homo sapiens
atttatagaaatga

SEQ ID NO: 2891448 - DNA, 16 bp, Homo sapiens
atttatagaaatgaca

SEQ ID NO: 2891449 - DNA, 19 bp, Homo sapiens
atttatatacaacctgctt

SEQ ID NO: 2891450 - DNA, 15 bp, Homo sapiens
atttatatattgtct

SEQ ID NO: 2891451 - DNA, 21 bp, Homo sapiens
atttatatattgtctgtaaaa

SEQ ID NO: 2891452 - DNA, 15 bp, Homo sapiens
atttatatcacatgt

SEQ ID NO: 2891453 - DNA, 13 bp, Homo sapiens
atttatatgaagc

SEQ ID NO: 2891454 - DNA, 18 bp, Homo sapiens
atttatatgaagcaagct

SEQ ID NO: 2891455 - DNA, 19 bp, Homo sapiens
atttatatgaagcaagctg

SEQ ID NO: 2891456 - DNA, 16 bp, Homo sapiens
atttatatgtacatga

SEQ ID NO: 2891457 - DNA, 16 bp, Homo sapiens
atttatatgtactgtt

SEQ ID NO: 2891458 - DNA, 16 bp, Homo sapiens
atttatattcatcaaa

SEQ ID NO: 2891459 - DNA, 21 bp, Homo sapiens
atttatattgtaaatattgtg

SEQ ID NO: 2891460 - DNA, 17 bp, Homo sapiens
atttatcaaatcagtca

SEQ ID NO: 2891461 - DNA, 19 bp, Homo sapiens
atttatccaaaatgtgtat

SEQ ID NO: 2891462 - DNA, 18 bp, Homo sapiens
atttatcctcacataaaa

SEQ ID NO: 2891463 - DNA, 14 bp, Homo sapiens
atttatgaatataa

SEQ ID NO: 2891464 - DNA, 14 bp, Homo sapiens
atttatgaccagag

SEQ ID NO: 2891465 - DNA, 15 bp, Homo sapiens
atttatgaccagagc

SEQ ID NO: 2891466 - DNA, 19 bp, Homo sapiens
atttatgaccagagcaaaa

SEQ ID NO: 2891467 - DNA, 20 bp, Homo sapiens
atttatggccgtatcaaatg

SEQ ID NO: 2891468 - DNA, 16 bp, Homo sapiens
atttatgggcccctgg

SEQ ID NO: 2891469 - DNA, 16 bp, Homo sapiens
atttattaattgcttt

SEQ ID NO: 2891470 - DNA, 18 bp, Homo sapiens
atttattaattgctttga

SEQ ID NO: 2891471 - DNA, 19 bp, Homo sapiens
atttattactaacctccct

SEQ ID NO: 2891472 - DNA, 19 bp, Homo sapiens
atttattatcgcatacaga

SEQ ID NO: 2891473 - DNA, 18 bp, Homo sapiens
atttattctacttttaaa

SEQ ID NO: 2891474 - DNA, 17 bp, Homo sapiens
atttattgcacattgtt

SEQ ID NO: 2891475 - DNA, 14 bp, Homo sapiens
atttatttaaaaga

SEQ ID NO: 2891476 - DNA, 23 bp, Homo sapiens
atttatttacagatgaatgtatt

SEQ ID NO: 2891477 - DNA, 15 bp, Homo sapiens
atttatttatgtact

SEQ ID NO: 2891478 - DNA, 16 bp, Homo sapiens
atttatttatgtactt

SEQ ID NO: 2891479 - DNA, 20 bp, Homo sapiens
atttattttatgagaaatgt

SEQ ID NO: 2891480 - DNA, 16 bp, Homo sapiens
cattttggaaagcaag

SEQ ID NO: 2891481 - DNA, 22 bp, Homo sapiens
cattttggagagtttcctgaaa

SEQ ID NO: 2891482 - DNA, 16 bp, Homo sapiens
cattttggatgtcatt

SEQ ID NO: 2891483 - DNA, 14 bp, Homo sapiens
cattttggatttct

SEQ ID NO: 2891484 - DNA, 17 bp, Homo sapiens
cattttggatttcttta

SEQ ID NO: 2891485 - DNA, 20 bp, Homo sapiens
cattttggcatctgcaaagg

SEQ ID NO: 2891486 - DNA, 16 bp, Homo sapiens
cattttggttcttctc

SEQ ID NO: 2891487 - DNA, 18 bp, Homo sapiens
cattttgtataattgtat

SEQ ID NO: 2891488 - DNA, 12 bp, Homo sapiens
catttttaaagg

SEQ ID NO: 2891489 - DNA, 15 bp, Homo sapiens
catttttaaaggaca

SEQ ID NO: 2891490 - DNA, 21 bp, Homo sapiens
catttttaaaggacaaacagt

SEQ ID NO: 2891491 - DNA, 22 bp, Homo sapiens
catttttaaaggacaaacagtg

SEQ ID NO: 2891492 - DNA, 14 bp, Homo sapiens
catttttaaatgtg

SEQ ID NO: 2891493 - DNA, 18 bp, Homo sapiens
catttttaaatgtgtttt

SEQ ID NO: 2891494 - DNA, 15 bp, Homo sapiens
catttttaatcatga

SEQ ID NO: 2891495 - DNA, 19 bp, Homo sapiens
catttttaatcatgaaatt

SEQ ID NO: 2891496 - DNA, 18 bp, Homo sapiens
catttttaccatcactga

SEQ ID NO: 2891497 - DNA, 19 bp, Homo sapiens
catttttagattggttctg

SEQ ID NO: 2891498 - DNA, 16 bp, Homo sapiens
catttttagtttaaaa

SEQ ID NO: 2891499 - DNA, 20 bp, Homo sapiens
catttttcaactttgaataa

SEQ ID NO: 2891500 - DNA, 16 bp, Homo sapiens
catttttccgtaaaaa

SEQ ID NO: 2891501 - DNA, 19 bp, Homo sapiens
catttttccgtttgctttt

SEQ ID NO: 2891502 - DNA, 14 bp, Homo sapiens
catttttcttccag

SEQ ID NO: 2891503 - DNA, 17 bp, Homo sapiens
catttttcttccaggat

SEQ ID NO: 2891504 - DNA, 22 bp, Homo sapiens
catttttgtgggggctagaaaa

SEQ ID NO: 2891505 - DNA, 23 bp, Homo sapiens
catttttgtttttggtttcttat

SEQ ID NO: 2891506 - DNA, 19 bp, Homo sapiens
cattttttgctataatcat

SEQ ID NO: 2891507 - DNA, 16 bp, Homo sapiens
catttttttctctctg

SEQ ID NO: 2891508 - DNA, 21 bp, Homo sapiens
catttttttctctctggagcc

SEQ ID NO: 2891509 - DNA, 11 bp, Homo sapiens
ccaaaactgtg

SEQ ID NO: 2891510 - DNA, 23 bp, Homo sapiens
ccaaaaggagagattattaaatc

SEQ ID NO: 2891511 - DNA, 14 bp, Homo sapiens
ccaaaagggaaaaa

SEQ ID NO: 2891512 - DNA, 21 bp, Homo sapiens
ccaaaagggaaaaaataaaaa

SEQ ID NO: 2891513 - DNA, 22 bp, Homo sapiens
ccaaaagtcaaaaggtgcctgt

SEQ ID NO: 2891514 - DNA, 15 bp, Homo sapiens
ccaaaagtggcctct

SEQ ID NO: 2891515 - DNA, 18 bp, Homo sapiens
ccaaaagtggcctctttg

SEQ ID NO: 2891516 - DNA, 21 bp, Homo sapiens
ccaaaagtggcctctttgtct

SEQ ID NO: 2891517 - DNA, 17 bp, Homo sapiens
ccaaaagttacatgttt

SEQ ID NO: 2891518 - DNA, 16 bp, Homo sapiens
ccaaaatctcaagaaa

SEQ ID NO: 2891519 - DNA, 13 bp, Homo sapiens
ccaaacagcaaac

SEQ ID NO: 2891520 - DNA, 13 bp, Homo sapiens
ccaaacccctaga

SEQ ID NO: 2891521 - DNA, 21 bp, Homo sapiens
ccaaacccctagagacagtga

SEQ ID NO: 2891522 - DNA, 17 bp, Homo sapiens
ccaaacctctgttcagt

SEQ ID NO: 2891523 - DNA, 21 bp, Homo sapiens
ccaaacctctgttcagtgtaa

SEQ ID NO: 2891524 - DNA, 15 bp, Homo sapiens
ccaaactgctgtctc

SEQ ID NO: 2891525 - DNA, 11 bp, Homo sapiens
ccaaagaatgt

SEQ ID NO: 2891526 - DNA, 18 bp, Homo sapiens
ccaaagaatgttagagca

SEQ ID NO: 2891527 - DNA, 22 bp, Homo sapiens
ccaaagagtagaattgcattga

SEQ ID NO: 2891528 - DNA, 17 bp, Homo sapiens
ccaaagagtctctggct

SEQ ID NO: 2891529 - DNA, 15 bp, Homo sapiens
ccaaagccagagtgg

SEQ ID NO: 2891530 - DNA, 21 bp, Homo sapiens
ccaaagccattctccccctct

SEQ ID NO: 2891531 - DNA, 18 bp, Homo sapiens
ccaaagcctgtcccagga

SEQ ID NO: 2891532 - DNA, 17 bp, Homo sapiens
ccaaagcgaattttaaa

SEQ ID NO: 2891533 - DNA, 22 bp, Homo sapiens
ccaaagcgatcatgtcagttgg

SEQ ID NO: 2891534 - DNA, 15 bp, Homo sapiens
ccaaagctgagcctg

SEQ ID NO: 2891535 - DNA, 21 bp, Homo sapiens
ccaaagctgagcctgcaggga

SEQ ID NO: 2891536 - DNA, 20 bp, Homo sapiens
ccaaaggggacccctatgaa

SEQ ID NO: 2891537 - DNA, 23 bp, Homo sapiens
ccaaaggtttttaaagtaaatct

SEQ ID NO: 2891538 - DNA, 16 bp, Homo sapiens
ccaaagtcccttcctg

SEQ ID NO: 2891539 - DNA, 21 bp, Homo sapiens
ccaaagtcccttcctgcttcc

SEQ ID NO: 2891540 - DNA, 14 bp, Homo sapiens
ccaaagtctaaact

SEQ ID NO: 2891541 - DNA, 16 bp, Homo sapiens
ccaaagtctctaattc

SEQ ID NO: 2891542 - DNA, 22 bp, Homo sapiens
ccaaagtgctgggattacaggg

SEQ ID NO: 2891543 - DNA, 19 bp, Homo sapiens
ccaaagtgtcttttgacat

SEQ ID NO: 2891544 - DNA, 11 bp, Homo sapiens
ccaaagttcta

SEQ ID NO: 2891545 - DNA, 19 bp, Homo sapiens
ccaaagttctaataatttc

SEQ ID NO: 2891546 - DNA, 16 bp, Homo sapiens
ccaaatacacatttca

SEQ ID NO: 2891547 - DNA, 21 bp, Homo sapiens
ccaaatacgaagccctcttgc

SEQ ID NO: 2891548 - DNA, 17 bp, Homo sapiens
ccaaatagccaccttga

SEQ ID NO: 2891549 - DNA, 21 bp, Homo sapiens
ccaaatagccaccttgatttt

SEQ ID NO: 2891550 - DNA, 17 bp, Homo sapiens
ccaaatagccccagact

SEQ ID NO: 2891551 - DNA, 20 bp, Homo sapiens
ccaaatagccccagactggg

SEQ ID NO: 2891552 - DNA, 19 bp, Homo sapiens
ccaaatatgttaaagttta

SEQ ID NO: 2891553 - DNA, 22 bp, Homo sapiens
ccaaatcaaaagactttttcct

SEQ ID NO: 2891554 - DNA, 20 bp, Homo sapiens
ccaaatcaataagaaggtag

SEQ ID NO: 2891555 - DNA, 24 bp, Homo sapiens
ccaaatccgaacctcctctgtgaa

SEQ ID NO: 2891556 - DNA, 21 bp, Homo sapiens
ccaaatccttagatctggcat

SEQ ID NO: 2891557 - DNA, 13 bp, Homo sapiens
ccaaatccttccc

SEQ ID NO: 2891558 - DNA, 15 bp, Homo sapiens
ccaaatctgtcctct

SEQ ID NO: 2891559 - DNA, 22 bp, Homo sapiens
ccaaatgagggtcttggttcca

SEQ ID NO: 2891560 - DNA, 19 bp, Homo sapiens
ccaaatgatagaactgtac

SEQ ID NO: 2891561 - DNA, 16 bp, Homo sapiens
ccaaattaaaaatttt

SEQ ID NO: 2891562 - DNA, 23 bp, Homo sapiens
ccaaattgcactgaagtttttga

SEQ ID NO: 2891563 - DNA, 18 bp, Homo sapiens
ccaaatttaagactctcg

SEQ ID NO: 2891564 - DNA, 15 bp, Homo sapiens
ccaaatttgattgat

SEQ ID NO: 2891565 - DNA, 20 bp, Homo sapiens
ccaaatttgattgatttgaa

SEQ ID NO: 2891566 - DNA, 22 bp, Homo sapiens
ccaacaatcctagtgctttcct

SEQ ID NO: 2891567 - DNA, 15 bp, Homo sapiens
ccaacaccccatatg

SEQ ID NO: 2891568 - DNA, 15 bp, Homo sapiens
ccaacaccccgcctg

SEQ ID NO: 2891569 - DNA, 18 bp, Homo sapiens
ccaacaccccgcctgcct

SEQ ID NO: 2891570 - DNA, 17 bp, Homo sapiens
ccaacacgcacctgcct

SEQ ID NO: 2891571 - DNA, 20 bp, Homo sapiens
ccaacacgcacctgcctcag

SEQ ID NO: 2891572 - DNA, 13 bp, Homo sapiens
ccaacacgcagga

SEQ ID NO: 2891573 - DNA, 16 bp, Homo sapiens
ccaacagctacaacag

SEQ ID NO: 2891574 - DNA, 23 bp, Homo sapiens
ccaacaggagctgggatcctaag

SEQ ID NO: 2891575 - DNA, 19 bp, Homo sapiens
ccaacaggaggacaattca

SEQ ID NO: 2891576 - DNA, 15 bp, Homo sapiens
ccaacagtcatgttt

SEQ ID NO: 2891577 - DNA, 19 bp, Homo sapiens
ccaccaggagcacctggac

SEQ ID NO: 2891578 - DNA, 17 bp, Homo sapiens
ccaccaggcctcactgg

SEQ ID NO: 2891579 - DNA, 18 bp, Homo sapiens
ccaccaggtctcccggga

SEQ ID NO: 2891580 - DNA, 16 bp, Homo sapiens
ccacccaacctgtcct

SEQ ID NO: 2891581 - DNA, 17 bp, Homo sapiens
ccacccaacctgtcctt

SEQ ID NO: 2891582 - DNA, 18 bp, Homo sapiens
ccacccaacctgtcctta

SEQ ID NO: 2891583 - DNA, 14 bp, Homo sapiens
ccacccaagtatac

SEQ ID NO: 2891584 - DNA, 17 bp, Homo sapiens
ccacccacctccctgcc

SEQ ID NO: 2891585 - DNA, 11 bp, Homo sapiens
ccacccagccc

SEQ ID NO: 2891586 - DNA, 13 bp, Homo sapiens
ccacccagcccat

SEQ ID NO: 2891587 - DNA, 18 bp, Homo sapiens
ccacccaggtcccccgac

SEQ ID NO: 2891588 - DNA, 15 bp, Homo sapiens
ccacccagtctctgc

SEQ ID NO: 2891589 - DNA, 17 bp, Homo sapiens
ccaccccacccccttca

SEQ ID NO: 2891590 - DNA, 16 bp, Homo sapiens
ccaccccagcacagct

SEQ ID NO: 2891591 - DNA, 18 bp, Homo sapiens
ccaccccagcacagctcc

SEQ ID NO: 2891592 - DNA, 14 bp, Homo sapiens
ccaccccagccccc

SEQ ID NO: 2891593 - DNA, 12 bp, Homo sapiens
ccacccccagcc

SEQ ID NO: 2891594 - DNA, 19 bp, Homo sapiens
ccacccccaggacccctga

SEQ ID NO: 2891595 - DNA, 20 bp, Homo sapiens
ccacccccgggatcctgccc

SEQ ID NO: 2891596 - DNA, 23 bp, Homo sapiens
ccacccccgggatcctgccccca

SEQ ID NO: 2891597 - DNA, 19 bp, Homo sapiens
ccaccccctccccaaagcc

SEQ ID NO: 2891598 - DNA, 17 bp, Homo sapiens
ccaccccctccccaggg

SEQ ID NO: 2891599 - DNA, 19 bp, Homo sapiens
ccaccccctccccagggga

SEQ ID NO: 2891600 - DNA, 18 bp, Homo sapiens
ccacccccttcagtgccc

SEQ ID NO: 2891601 - DNA, 20 bp, Homo sapiens
ccacccctaccgatggtccc

SEQ ID NO: 2891602 - DNA, 15 bp, Homo sapiens
ccacccctcatcagg

SEQ ID NO: 2891603 - DNA, 15 bp, Homo sapiens
ccacccctgccactc

SEQ ID NO: 2891604 - DNA, 20 bp, Homo sapiens
ccacccctgggggctctcat

SEQ ID NO: 2891605 - DNA, 21 bp, Homo sapiens
ccacccggtggttcttcctgt

SEQ ID NO: 2891606 - DNA, 23 bp, Homo sapiens
ccaccctacttcattttcagagt

SEQ ID NO: 2891607 - DNA, 18 bp, Homo sapiens
ccaccctagcctccacca

SEQ ID NO: 2891608 - DNA, 23 bp, Homo sapiens
ccaccctcctggcctcagactgc

SEQ ID NO: 2891609 - DNA, 21 bp, Homo sapiens
ccaccctgcccacccccggga

SEQ ID NO: 2891610 - DNA, 13 bp, Homo sapiens
ccaccctgcccct

SEQ ID NO: 2891611 - DNA, 15 bp, Homo sapiens
ccaccctgctgctgg

SEQ ID NO: 2891612 - DNA, 20 bp, Homo sapiens
ccaccctggccgagtccaag

SEQ ID NO: 2891613 - DNA, 21 bp, Homo sapiens
ccaccctggccgagtccaagc

SEQ ID NO: 2891614 - DNA, 12 bp, Homo sapiens
ccaccctgggac

SEQ ID NO: 2891615 - DNA, 21 bp, Homo sapiens
ccaccctgggtttggcccctg

SEQ ID NO: 2891616 - DNA, 22 bp, Homo sapiens
ccaccctgggtttggcccctgg

SEQ ID NO: 2891617 - DNA, 12 bp, Homo sapiens
ccaccctgtggc

SEQ ID NO: 2891618 - DNA, 13 bp, Homo sapiens
ccacccttccctg

SEQ ID NO: 2891619 - DNA, 13 bp, Homo sapiens
ccaccgactgccc

SEQ ID NO: 2891620 - DNA, 14 bp, Homo sapiens
ccaccgactgccca

SEQ ID NO: 2891621 - DNA, 22 bp, Homo sapiens
ccaccgagctctgtgggaaaaa

SEQ ID NO: 2891622 - DNA, 15 bp, Homo sapiens
ccaccgcagctgctg

SEQ ID NO: 2891623 - DNA, 19 bp, Homo sapiens
ccaccgcagctgctgccac

SEQ ID NO: 2891624 - DNA, 21 bp, Homo sapiens
ccaccgcagctgctgccactc

SEQ ID NO: 2891625 - DNA, 22 bp, Homo sapiens
ccaccgcagctgctgccactct

SEQ ID NO: 2891626 - DNA, 12 bp, Homo sapiens
ccaccgccgggg

SEQ ID NO: 2891627 - DNA, 19 bp, Homo sapiens
ccaccgccggggtcctggg

SEQ ID NO: 2891628 - DNA, 20 bp, Homo sapiens
ccaccggatgctgtgcctgg

SEQ ID NO: 2891629 - DNA, 13 bp, Homo sapiens
ccaccgggctgca

SEQ ID NO: 2891630 - DNA, 16 bp, Homo sapiens
ccaccgggctgcaggt

SEQ ID NO: 2891631 - DNA, 21 bp, Homo sapiens
ccaccgggctgcaggtgctgc

SEQ ID NO: 2891632 - DNA, 14 bp, Homo sapiens
ccaccgttcagtca

SEQ ID NO: 2891633 - DNA, 16 bp, Homo sapiens
ccacctaggccactcc

SEQ ID NO: 2891634 - DNA, 16 bp, Homo sapiens
ccacctagtgccccag

SEQ ID NO: 2891635 - DNA, 18 bp, Homo sapiens
ccacctagtgccccagac

SEQ ID NO: 2891636 - DNA, 23 bp, Homo sapiens
catgtttaattgtgatatttgac

SEQ ID NO: 2891637 - DNA, 10 bp, Homo sapiens
catgtttctt

SEQ ID NO: 2891638 - DNA, 16 bp, Homo sapiens
catgtttgagctcaga

SEQ ID NO: 2891639 - DNA, 20 bp, Homo sapiens
catgtttgagctcagacccc

SEQ ID NO: 2891640 - DNA, 23 bp, Homo sapiens
catgttttaaatgtacagtttgg

SEQ ID NO: 2891641 - DNA, 16 bp, Homo sapiens
catgttttaacaaaaa

SEQ ID NO: 2891642 - DNA, 17 bp, Homo sapiens
catgttttaacaaaaac

SEQ ID NO: 2891643 - DNA, 17 bp, Homo sapiens
catgttttccattgttt

SEQ ID NO: 2891644 - DNA, 14 bp, Homo sapiens
catgttttccgtga

SEQ ID NO: 2891645 - DNA, 15 bp, Homo sapiens
catgttttctgcttt

SEQ ID NO: 2891646 - DNA, 20 bp, Homo sapiens
catgttttctgctttaaatt

SEQ ID NO: 2891647 - DNA, 17 bp, Homo sapiens
catgttttgataaagta

SEQ ID NO: 2891648 - DNA, 18 bp, Homo sapiens
catgttttgataaagtag

SEQ ID NO: 2891649 - DNA, 13 bp, Homo sapiens
catgtttttgcca

SEQ ID NO: 2891650 - DNA, 15 bp, Homo sapiens
catgtttttgccaaa

SEQ ID NO: 2891651 - DNA, 19 bp, Homo sapiens
cattaaaaacatagaaaaa

SEQ ID NO: 2891652 - DNA, 18 bp, Homo sapiens
cattaaaataaaccaaat

SEQ ID NO: 2891653 - DNA, 13 bp, Homo sapiens
cattaaaataact

SEQ ID NO: 2891654 - DNA, 16 bp, Homo sapiens
cattaaaataactatc

SEQ ID NO: 2891655 - DNA, 11 bp, Homo sapiens
cattaaaattg

SEQ ID NO: 2891656 - DNA, 13 bp, Homo sapiens
cattaaacttgaa

SEQ ID NO: 2891657 - DNA, 15 bp, Homo sapiens
cattaaacttgaagc

SEQ ID NO: 2891658 - DNA, 23 bp, Homo sapiens
cattaaatattctgtacattttt

SEQ ID NO: 2891659 - DNA, 18 bp, Homo sapiens
cattaaattcacaaactt

SEQ ID NO: 2891660 - DNA, 16 bp, Homo sapiens
cattaaccgatgcttt

SEQ ID NO: 2891661 - DNA, 17 bp, Homo sapiens
cattaaccgatgcttta

SEQ ID NO: 2891662 - DNA, 18 bp, Homo sapiens
cattaaccgatgctttac

SEQ ID NO: 2891663 - DNA, 19 bp, Homo sapiens
cattaagagaacaaagagt

SEQ ID NO: 2891664 - DNA, 14 bp, Homo sapiens
cattaatgcccagc

SEQ ID NO: 2891665 - DNA, 16 bp, Homo sapiens
cattaatgcccagcca

SEQ ID NO: 2891666 - DNA, 20 bp, Homo sapiens
cattaattattattgctgtt

SEQ ID NO: 2891667 - DNA, 19 bp, Homo sapiens
cattaattgttccttgctt

SEQ ID NO: 2891668 - DNA, 13 bp, Homo sapiens
cattacaaatctt

SEQ ID NO: 2891669 - DNA, 15 bp, Homo sapiens
cattactataagaac

SEQ ID NO: 2891670 - DNA, 15 bp, Homo sapiens
cattacttgtataaa

SEQ ID NO: 2891671 - DNA, 19 bp, Homo sapiens
cattagaagacaattgaca

SEQ ID NO: 2891672 - DNA, 21 bp, Homo sapiens
cattagattcctttcctgtgt

SEQ ID NO: 2891673 - DNA, 17 bp, Homo sapiens
cattagggatgcctcct

SEQ ID NO: 2891674 - DNA, 21 bp, Homo sapiens
cattagtacacagcaccagaa

SEQ ID NO: 2891675 - DNA, 13 bp, Homo sapiens
cattagttttaga

SEQ ID NO: 2891676 - DNA, 13 bp, Homo sapiens
cattataaattct

SEQ ID NO: 2891677 - DNA, 13 bp, Homo sapiens
cattatagcgcct

SEQ ID NO: 2891678 - DNA, 14 bp, Homo sapiens
cattatagcgcctg

SEQ ID NO: 2891679 - DNA, 16 bp, Homo sapiens
cattatagcgcctgta

SEQ ID NO: 2891680 - DNA, 20 bp, Homo sapiens
cattatagcgcctgtataag

SEQ ID NO: 2891681 - DNA, 22 bp, Homo sapiens
cattatcaaaagtgatcagcaa

SEQ ID NO: 2891682 - DNA, 18 bp, Homo sapiens
cattatcatgtgtaatca

SEQ ID NO: 2891683 - DNA, 15 bp, Homo sapiens
cattatcttttggct

SEQ ID NO: 2891684 - DNA, 23 bp, Homo sapiens
cattatcttttggctctgaagaa

SEQ ID NO: 2891685 - DNA, 17 bp, Homo sapiens
cattatgtccactgtgt

SEQ ID NO: 2891686 - DNA, 20 bp, Homo sapiens
cattatgtccactgtgtata

SEQ ID NO: 2891687 - DNA, 21 bp, Homo sapiens
cattattattactttttaaaa

SEQ ID NO: 2891688 - DNA, 12 bp, Homo sapiens
cattattctcat

SEQ ID NO: 2891689 - DNA, 20 bp, Homo sapiens
cattatttgagtttgacatt

SEQ ID NO: 2891690 - DNA, 17 bp, Homo sapiens
cattatttgataacatt

SEQ ID NO: 2891691 - DNA, 17 bp, Homo sapiens
cattcaagtgtaaaata

SEQ ID NO: 2891692 - DNA, 21 bp, Homo sapiens
cattcaagtgtaaaatatttt

SEQ ID NO: 2891693 - DNA, 22 bp, Homo sapiens
cattcacagttctttgggccag

SEQ ID NO: 2891694 - DNA, 12 bp, Homo sapiens
cattcacatttc

SEQ ID NO: 2891695 - DNA, 16 bp, Homo sapiens
cattcacctgccccaa

SEQ ID NO: 2891696 - DNA, 13 bp, Homo sapiens
cattcaggaaaac

SEQ ID NO: 2891697 - DNA, 23 bp, Homo sapiens
cattcaggaaaactgacagagga

SEQ ID NO: 2891698 - DNA, 19 bp, Homo sapiens
cattcatatcctccgccct

SEQ ID NO: 2891699 - DNA, 18 bp, Homo sapiens
cattcatcttgtgtttta

SEQ ID NO: 2891700 - DNA, 17 bp, Homo sapiens
cattcattttatattga

SEQ ID NO: 2891701 - DNA, 15 bp, Homo sapiens
cattcattttgtgta

SEQ ID NO: 2891702 - DNA, 19 bp, Homo sapiens
cattccaaaggggacccct

SEQ ID NO: 2891703 - DNA, 14 bp, Homo sapiens
cattccaacaaagg

SEQ ID NO: 2891704 - DNA, 21 bp, Homo sapiens
cattccaagaatagcatctgt

SEQ ID NO: 2891705 - DNA, 18 bp, Homo sapiens
cattccaagactctagag

SEQ ID NO: 2891706 - DNA, 13 bp, Homo sapiens
cattccacaggac

SEQ ID NO: 2891707 - DNA, 13 bp, Homo sapiens
cattccacaggat

SEQ ID NO: 2891708 - DNA, 12 bp, Homo sapiens
cattccagagtt

SEQ ID NO: 2891709 - DNA, 12 bp, Homo sapiens
cattcccactgc

SEQ ID NO: 2891710 - DNA, 17 bp, Homo sapiens
cattccctgagtcacca

SEQ ID NO: 2891711 - DNA, 18 bp, Homo sapiens
cattccctgagtcaccag

SEQ ID NO: 2891712 - DNA, 20 bp, Homo sapiens
cattccctgagtcaccagga

SEQ ID NO: 2891713 - DNA, 16 bp, Homo sapiens
cattccgttgtctgtg

SEQ ID NO: 2891714 - DNA, 16 bp, Homo sapiens
cattcctcagggacag

SEQ ID NO: 2891715 - DNA, 21 bp, Homo sapiens
cattcctgaagaaccagtccc

SEQ ID NO: 2891716 - DNA, 19 bp, Homo sapiens
cattcctgtaacttttaat

SEQ ID NO: 2891717 - DNA, 22 bp, Homo sapiens
cattctaactcatatgttccca

SEQ ID NO: 2891718 - DNA, 22 bp, Homo sapiens
cattctacacagagcaggactg

SEQ ID NO: 2891719 - DNA, 16 bp, Homo sapiens
cattctacacctggac

SEQ ID NO: 2891720 - DNA, 18 bp, Homo sapiens
cattctacacctggacca

SEQ ID NO: 2891721 - DNA, 23 bp, Homo sapiens
cattctacttgcttattacattt

SEQ ID NO: 2891722 - DNA, 23 bp, Homo sapiens
cattctaggcctcctggcccagg

SEQ ID NO: 2891723 - DNA, 17 bp, Homo sapiens
cattctaggctcactgc

SEQ ID NO: 2891724 - DNA, 14 bp, Homo sapiens
cattctcagccaca

SEQ ID NO: 2891725 - DNA, 15 bp, Homo sapiens
cattctcaggcacca

SEQ ID NO: 2891726 - DNA, 18 bp, Homo sapiens
cattctccacagcaaccc

SEQ ID NO: 2891727 - DNA, 23 bp, Homo sapiens
cattctccccctctttgggcagt

SEQ ID NO: 2891728 - DNA, 14 bp, Homo sapiens
cattctcctcctcc

SEQ ID NO: 2891729 - DNA, 16 bp, Homo sapiens
cattctcctcctcctc

SEQ ID NO: 2891730 - DNA, 13 bp, Homo sapiens
cattctcctgcct

SEQ ID NO: 2891731 - DNA, 17 bp, Homo sapiens
cattctctattgtaatt

SEQ ID NO: 2891732 - DNA, 18 bp, Homo sapiens
cattctctctcctgtcca

SEQ ID NO: 2891733 - DNA, 19 bp, Homo sapiens
cattctctcttcctgcagt

SEQ ID NO: 2891734 - DNA, 14 bp, Homo sapiens
cattctctgtctca

SEQ ID NO: 2891735 - DNA, 13 bp, Homo sapiens
cattctcttttaa

SEQ ID NO: 2891736 - DNA, 22 bp, Homo sapiens
cattctgattcgaatgacactg

SEQ ID NO: 2891737 - DNA, 20 bp, Homo sapiens
cattctgatttggaaaaaga

SEQ ID NO: 2891738 - DNA, 11 bp, Homo sapiens
cattctgcaag

SEQ ID NO: 2891739 - DNA, 17 bp, Homo sapiens
cattctgcctctctagg

SEQ ID NO: 2891740 - DNA, 19 bp, Homo sapiens
cattctggcagttttgaca

SEQ ID NO: 2891741 - DNA, 20 bp, Homo sapiens
cattctggcagttttgacat

SEQ ID NO: 2891742 - DNA, 13 bp, Homo sapiens
cattcttaaaaaa

SEQ ID NO: 2891743 - DNA, 18 bp, Homo sapiens
cattcttaacaaactctt

SEQ ID NO: 2891744 - DNA, 15 bp, Homo sapiens
cattcttataacata

SEQ ID NO: 2891745 - DNA, 12 bp, Homo sapiens
cattcttggctt

SEQ ID NO: 2891746 - DNA, 19 bp, Homo sapiens
cattcttgtaaggctttga

SEQ ID NO: 2891747 - DNA, 14 bp, Homo sapiens
cattctttcccaac

SEQ ID NO: 2891748 - DNA, 12 bp, Homo sapiens
cattctttcttc

SEQ ID NO: 2891749 - DNA, 17 bp, Homo sapiens
cattctttcttggtgca

SEQ ID NO: 2891750 - DNA, 22 bp, Homo sapiens
cattcttttcacttcctctcca

SEQ ID NO: 2891751 - DNA, 18 bp, Homo sapiens
cattcttttgtaatttaa

SEQ ID NO: 2891752 - DNA, 16 bp, Homo sapiens
cattctttttttcttg

SEQ ID NO: 2891753 - DNA, 18 bp, Homo sapiens
catttgtggcagtccctt

SEQ ID NO: 2891754 - DNA, 17 bp, Homo sapiens
catttgtgtcactgtac

SEQ ID NO: 2891755 - DNA, 19 bp, Homo sapiens
catttgtgtcactgtacag

SEQ ID NO: 2891756 - DNA, 23 bp, Homo sapiens
catttgtgtcactgtacagtttt

SEQ ID NO: 2891757 - DNA, 15 bp, Homo sapiens
catttgttgctgctg

SEQ ID NO: 2891758 - DNA, 13 bp, Homo sapiens
cattttaacaaga

SEQ ID NO: 2891759 - DNA, 12 bp, Homo sapiens
cattttaacagt

SEQ ID NO: 2891760 - DNA, 21 bp, Homo sapiens
cattttaacagtacctgtgcc

SEQ ID NO: 2891761 - DNA, 14 bp, Homo sapiens
cattttacgctaga

SEQ ID NO: 2891762 - DNA, 18 bp, Homo sapiens
cattttacgctagattaa

SEQ ID NO: 2891763 - DNA, 18 bp, Homo sapiens
cattttacgttttagaaa

SEQ ID NO: 2891764 - DNA, 17 bp, Homo sapiens
cattttactttttcctg

SEQ ID NO: 2891765 - DNA, 15 bp, Homo sapiens
cattttatattgaaa

SEQ ID NO: 2891766 - DNA, 16 bp, Homo sapiens
cattttcacttttaaa

SEQ ID NO: 2891767 - DNA, 14 bp, Homo sapiens
cattttcagagtga

SEQ ID NO: 2891768 - DNA, 16 bp, Homo sapiens
cattttcagagtgaca

SEQ ID NO: 2891769 - DNA, 23 bp, Homo sapiens
cattttcagcatcaaacatgaaa

SEQ ID NO: 2891770 - DNA, 14 bp, Homo sapiens
cattttcattccta

SEQ ID NO: 2891771 - DNA, 12 bp, Homo sapiens
cattttctgtgg

SEQ ID NO: 2891772 - DNA, 22 bp, Homo sapiens
cattttcttgtcaatggaagaa

SEQ ID NO: 2891773 - DNA, 21 bp, Homo sapiens
cattttcttttgttcttgata

SEQ ID NO: 2891774 - DNA, 18 bp, Homo sapiens
cattttgaaaacccctgg

SEQ ID NO: 2891775 - DNA, 23 bp, Homo sapiens
cattttgaaaacccctggctgaa

SEQ ID NO: 2891776 - DNA, 12 bp, Homo sapiens
cattttgaatgt

SEQ ID NO: 2891777 - DNA, 18 bp, Homo sapiens
cattttgaatgtgatcat

SEQ ID NO: 2891778 - DNA, 20 bp, Homo sapiens
cattttgaatgtgatcatct

SEQ ID NO: 2891779 - DNA, 18 bp, Homo sapiens
cattttgacaacatggct

SEQ ID NO: 2891780 - DNA, 22 bp, Homo sapiens
cattttgacaacatggcttctc

SEQ ID NO: 2891781 - DNA, 18 bp, Homo sapiens
cattttgctctgtgaact

SEQ ID NO: 2891782 - DNA, 16 bp, Homo sapiens
catggcagctgggccc

SEQ ID NO: 2891783 - DNA, 17 bp, Homo sapiens
catggcagctgggccca

SEQ ID NO: 2891784 - DNA, 21 bp, Homo sapiens
catggcatcttcgtcttcact

SEQ ID NO: 2891785 - DNA, 19 bp, Homo sapiens
catggccctgctgcccctc

SEQ ID NO: 2891786 - DNA, 20 bp, Homo sapiens
catggccctgctgcccctcc

SEQ ID NO: 2891787 - DNA, 14 bp, Homo sapiens
catggcctctgcaa

SEQ ID NO: 2891788 - DNA, 21 bp, Homo sapiens
catggccttccacgtcttcct

SEQ ID NO: 2891789 - DNA, 21 bp, Homo sapiens
catggctgggggagggactgc

SEQ ID NO: 2891790 - DNA, 16 bp, Homo sapiens
catggcttctcctttg

SEQ ID NO: 2891791 - DNA, 20 bp, Homo sapiens
catggcttctcctttggcat

SEQ ID NO: 2891792 - DNA, 21 bp, Homo sapiens
catggcttctcctttggcatg

SEQ ID NO: 2891793 - DNA, 17 bp, Homo sapiens
catggctttcatcctgt

SEQ ID NO: 2891794 - DNA, 20 bp, Homo sapiens
catggctttcatcctgtgtc

SEQ ID NO: 2891795 - DNA, 21 bp, Homo sapiens
catggctttcatcctgtgtcc

SEQ ID NO: 2891796 - DNA, 13 bp, Homo sapiens
catgggagccggg

SEQ ID NO: 2891797 - DNA, 19 bp, Homo sapiens
catgggcacaaagggccca

SEQ ID NO: 2891798 - DNA, 17 bp, Homo sapiens
catgggcagagcccaag

SEQ ID NO: 2891799 - DNA, 14 bp, Homo sapiens
catgggccagcccc

SEQ ID NO: 2891800 - DNA, 16 bp, Homo sapiens
catgggccagcccctc

SEQ ID NO: 2891801 - DNA, 17 bp, Homo sapiens
catgggccagcccctcc

SEQ ID NO: 2891802 - DNA, 21 bp, Homo sapiens
catgggccagcccctccatct

SEQ ID NO: 2891803 - DNA, 17 bp, Homo sapiens
catgggccccccatgca

SEQ ID NO: 2891804 - DNA, 20 bp, Homo sapiens
catgggtcctcggcccatct

SEQ ID NO: 2891805 - DNA, 14 bp, Homo sapiens
catgggtcgggaga

SEQ ID NO: 2891806 - DNA, 19 bp, Homo sapiens
catgggtcgggagagggga

SEQ ID NO: 2891807 - DNA, 13 bp, Homo sapiens
catgggtctggcc

SEQ ID NO: 2891808 - DNA, 14 bp, Homo sapiens
catgggtctggcct

SEQ ID NO: 2891809 - DNA, 14 bp, Homo sapiens
catgggtctggcta

SEQ ID NO: 2891810 - DNA, 16 bp, Homo sapiens
catggtagaaaatgca

SEQ ID NO: 2891811 - DNA, 21 bp, Homo sapiens
catggtcacacactgatgctt

SEQ ID NO: 2891812 - DNA, 14 bp, Homo sapiens
catggtctgtcctg

SEQ ID NO: 2891813 - DNA, 18 bp, Homo sapiens
catggtgaaacccccatc

SEQ ID NO: 2891814 - DNA, 15 bp, Homo sapiens
catggtgccccagga

SEQ ID NO: 2891815 - DNA, 17 bp, Homo sapiens
catggtgccccaggacc

SEQ ID NO: 2891816 - DNA, 18 bp, Homo sapiens
catggtgccccaggacca

SEQ ID NO: 2891817 - DNA, 20 bp, Homo sapiens
catggtgccccaggaccagc

SEQ ID NO: 2891818 - DNA, 23 bp, Homo sapiens
catggtggcaccagcgaagggag

SEQ ID NO: 2891819 - DNA, 18 bp, Homo sapiens
catggtggcatgcacctg

SEQ ID NO: 2891820 - DNA, 20 bp, Homo sapiens
catggtggcatgcacctgca

SEQ ID NO: 2891821 - DNA, 13 bp, Homo sapiens
catggtgtggcca

SEQ ID NO: 2891822 - DNA, 15 bp, Homo sapiens
catggtgtggccatc

SEQ ID NO: 2891823 - DNA, 17 bp, Homo sapiens
catggtgtgtgtctctg

SEQ ID NO: 2891824 - DNA, 18 bp, Homo sapiens
catggtgtgtgtctctga

SEQ ID NO: 2891825 - DNA, 15 bp, Homo sapiens
catggttctcaattt

SEQ ID NO: 2891826 - DNA, 22 bp, Homo sapiens
catggttctcaatttatttggg

SEQ ID NO: 2891827 - DNA, 20 bp, Homo sapiens
catggtttagataaaggaaa

SEQ ID NO: 2891828 - DNA, 21 bp, Homo sapiens
catggtttagataaaggaaac

SEQ ID NO: 2891829 - DNA, 14 bp, Homo sapiens
catgtaaaatcttc

SEQ ID NO: 2891830 - DNA, 17 bp, Homo sapiens
catgtaaaatcttcagc

SEQ ID NO: 2891831 - DNA, 22 bp, Homo sapiens
catgtaaaatcttcagctggtg

SEQ ID NO: 2891832 - DNA, 15 bp, Homo sapiens
catgtaaaggccttt

SEQ ID NO: 2891833 - DNA, 19 bp, Homo sapiens
catgtaacgaaacacttca

SEQ ID NO: 2891834 - DNA, 23 bp, Homo sapiens
catgtaatataaagatgttaaaa

SEQ ID NO: 2891835 - DNA, 19 bp, Homo sapiens
catgtaatgttaatgttat

SEQ ID NO: 2891836 - DNA, 23 bp, Homo sapiens
catgtaatgttaatgttatatca

SEQ ID NO: 2891837 - DNA, 19 bp, Homo sapiens
catgtacaaaaattatgca

SEQ ID NO: 2891838 - DNA, 23 bp, Homo sapiens
catgtacatagtaaagtattttt

SEQ ID NO: 2891839 - DNA, 20 bp, Homo sapiens
catgtactgttactgtgtca

SEQ ID NO: 2891840 - DNA, 19 bp, Homo sapiens
catgtacttccctcttgaa

SEQ ID NO: 2891841 - DNA, 14 bp, Homo sapiens
catgtagcagacaa

SEQ ID NO: 2891842 - DNA, 23 bp, Homo sapiens
catgtagccccagtcagaagttc

SEQ ID NO: 2891843 - DNA, 20 bp, Homo sapiens
catgtagccccctggcctct

SEQ ID NO: 2891844 - DNA, 18 bp, Homo sapiens
catgtaggaagtaggaag

SEQ ID NO: 2891845 - DNA, 17 bp, Homo sapiens
catgtagtatcaaatat

SEQ ID NO: 2891846 - DNA, 18 bp, Homo sapiens
catgtagtatcaaatatt

SEQ ID NO: 2891847 - DNA, 21 bp, Homo sapiens
catgtagtatcaaatattaga

SEQ ID NO: 2891848 - DNA, 22 bp, Homo sapiens
catgtagtatcaaatattagat

SEQ ID NO: 2891849 - DNA, 23 bp, Homo sapiens
catgtagtgtgggaggctcctgt

SEQ ID NO: 2891850 - DNA, 15 bp, Homo sapiens
catgtatcataatta

SEQ ID NO: 2891851 - DNA, 19 bp, Homo sapiens
catgtatcataattaccaa

SEQ ID NO: 2891852 - DNA, 19 bp, Homo sapiens
catgtatctctctgtggtg

SEQ ID NO: 2891853 - DNA, 14 bp, Homo sapiens
catgtatctgtcta

SEQ ID NO: 2891854 - DNA, 15 bp, Homo sapiens
catgtatctgtctac

SEQ ID NO: 2891855 - DNA, 16 bp, Homo sapiens
catgtatctgtctact

SEQ ID NO: 2891856 - DNA, 22 bp, Homo sapiens
catgtatgtatgagacagaaac

SEQ ID NO: 2891857 - DNA, 13 bp, Homo sapiens
catgtatgtcttg

SEQ ID NO: 2891858 - DNA, 17 bp, Homo sapiens
catgtatgtcttggaca

SEQ ID NO: 2891859 - DNA, 16 bp, Homo sapiens
catgtatgtggataca

SEQ ID NO: 2891860 - DNA, 22 bp, Homo sapiens
catgtatgtggatacagtcatt

SEQ ID NO: 2891861 - DNA, 21 bp, Homo sapiens
catgtcaagaggaaaagctgt

SEQ ID NO: 2891862 - DNA, 17 bp, Homo sapiens
catgtcccccgtgcacg

SEQ ID NO: 2891863 - DNA, 22 bp, Homo sapiens
catgtccttgtgtgttttgaga

SEQ ID NO: 2891864 - DNA, 17 bp, Homo sapiens
catgtcctttccatctg

SEQ ID NO: 2891865 - DNA, 22 bp, Homo sapiens
catgtcctttccatctgtccac

SEQ ID NO: 2891866 - DNA, 15 bp, Homo sapiens
catgtcgctccggtc

SEQ ID NO: 2891867 - DNA, 16 bp, Homo sapiens
catgtctaacctgatt

SEQ ID NO: 2891868 - DNA, 14 bp, Homo sapiens
catgtctaattcat

SEQ ID NO: 2891869 - DNA, 22 bp, Homo sapiens
catgtctaattcatttactcac

SEQ ID NO: 2891870 - DNA, 15 bp, Homo sapiens
catgtctcacagacg

SEQ ID NO: 2891871 - DNA, 14 bp, Homo sapiens
catgtctgcctgga

SEQ ID NO: 2891872 - DNA, 15 bp, Homo sapiens
catgtgaacctcaaa

SEQ ID NO: 2891873 - DNA, 12 bp, Homo sapiens
catgtgacacat

SEQ ID NO: 2891874 - DNA, 13 bp, Homo sapiens
catgtgacacata

SEQ ID NO: 2891875 - DNA, 14 bp, Homo sapiens
catgtgactctttc

SEQ ID NO: 2891876 - DNA, 16 bp, Homo sapiens
catgtgactctttcca

SEQ ID NO: 2891877 - DNA, 17 bp, Homo sapiens
catgtgactctttccaa

SEQ ID NO: 2891878 - DNA, 20 bp, Homo sapiens
catgtgcaactcttgtattg

SEQ ID NO: 2891879 - DNA, 23 bp, Homo sapiens
catgtgcataacaaattctgaat

SEQ ID NO: 2891880 - DNA, 17 bp, Homo sapiens
catgtgcctctgtcctt

SEQ ID NO: 2891881 - DNA, 14 bp, Homo sapiens
catgtgcgtggaag

SEQ ID NO: 2891882 - DNA, 16 bp, Homo sapiens
catgtgcgtggaagtg

SEQ ID NO: 2891883 - DNA, 19 bp, Homo sapiens
catgtgcgtggaagtgttc

SEQ ID NO: 2891884 - DNA, 21 bp, Homo sapiens
catgtgctagtcactggcagc

SEQ ID NO: 2891885 - DNA, 23 bp, Homo sapiens
catgtggcagcaggcatggcttc

SEQ ID NO: 2891886 - DNA, 18 bp, Homo sapiens
catgtggccatggcctct

SEQ ID NO: 2891887 - DNA, 19 bp, Homo sapiens
catgtggccatggcctctg

SEQ ID NO: 2891888 - DNA, 15 bp, Homo sapiens
catgtggcctgccca

SEQ ID NO: 2891889 - DNA, 16 bp, Homo sapiens
catgtggcctgcccag

SEQ ID NO: 2891890 - DNA, 20 bp, Homo sapiens
catgtggcctgcccagcctc

SEQ ID NO: 2891891 - DNA, 23 bp, Homo sapiens
catgtggcttctctgtctctgtg

SEQ ID NO: 2891892 - DNA, 23 bp, Homo sapiens
catgtggtgatgatgtgtatata

SEQ ID NO: 2891893 - DNA, 16 bp, Homo sapiens
catgtgtaatcaataa

SEQ ID NO: 2891894 - DNA, 22 bp, Homo sapiens
catgtgtaatcaataaacgatt

SEQ ID NO: 2891895 - DNA, 15 bp, Homo sapiens
catgtgtatatatgt

SEQ ID NO: 2891896 - DNA, 14 bp, Homo sapiens
catgtgtatgagaa

SEQ ID NO: 2891897 - DNA, 22 bp, Homo sapiens
catgtgtatgagaagtactttg

SEQ ID NO: 2891898 - DNA, 18 bp, Homo sapiens
catgtgtatgggcaaaaa

SEQ ID NO: 2891899 - DNA, 22 bp, Homo sapiens
catgtgtgtccacgactgtctc

SEQ ID NO: 2891900 - DNA, 16 bp, Homo sapiens
catgtgttaagtattt

SEQ ID NO: 2891901 - DNA, 22 bp, Homo sapiens
catgtgttgttgtttttgataa

SEQ ID NO: 2891902 - DNA, 16 bp, Homo sapiens
catgtgttttgctttt

SEQ ID NO: 2891903 - DNA, 16 bp, Homo sapiens
catgttagcccttcct

SEQ ID NO: 2891904 - DNA, 13 bp, Homo sapiens
catgttcatcaat

SEQ ID NO: 2891905 - DNA, 18 bp, Homo sapiens
catgttcccaaaacaatg

SEQ ID NO: 2891906 - DNA, 20 bp, Homo sapiens
catgttgatcatgtactttt

SEQ ID NO: 2891907 - DNA, 14 bp, Homo sapiens
catcacagggtggg

SEQ ID NO: 2891908 - DNA, 18 bp, Homo sapiens
catcacagggtgggcctc

SEQ ID NO: 2891909 - DNA, 19 bp, Homo sapiens
catcacagggtgggcctcg

SEQ ID NO: 2891910 - DNA, 21 bp, Homo sapiens
catcacagggtgggcctcggc

SEQ ID NO: 2891911 - DNA, 11 bp, Homo sapiens
catcacattta

SEQ ID NO: 2891912 - DNA, 13 bp, Homo sapiens
catcaccaggtgc

SEQ ID NO: 2891913 - DNA, 17 bp, Homo sapiens
catcaccaggtgcatct

SEQ ID NO: 2891914 - DNA, 13 bp, Homo sapiens
catcacccaggct

SEQ ID NO: 2891915 - DNA, 16 bp, Homo sapiens
catcaccttaggcagg

SEQ ID NO: 2891916 - DNA, 22 bp, Homo sapiens
catcaccttaggcagggaagtg

SEQ ID NO: 2891917 - DNA, 20 bp, Homo sapiens
catcacgtgtactggctcct

SEQ ID NO: 2891918 - DNA, 13 bp, Homo sapiens
catcactcagccc

SEQ ID NO: 2891919 - DNA, 14 bp, Homo sapiens
catcactcagcccc

SEQ ID NO: 2891920 - DNA, 16 bp, Homo sapiens
catcactcagccccta

SEQ ID NO: 2891921 - DNA, 17 bp, Homo sapiens
catcactcagcccctac

SEQ ID NO: 2891922 - DNA, 23 bp, Homo sapiens
catcactcagcccctacccctgc

SEQ ID NO: 2891923 - DNA, 15 bp, Homo sapiens
catcactcgcaggac

SEQ ID NO: 2891924 - DNA, 16 bp, Homo sapiens
catcactgagttttcc

SEQ ID NO: 2891925 - DNA, 19 bp, Homo sapiens
catcactggagcaccaggc

SEQ ID NO: 2891926 - DNA, 20 bp, Homo sapiens
catcactgttcatgctggcg

SEQ ID NO: 2891927 - DNA, 15 bp, Homo sapiens
catcagaactgaaat

SEQ ID NO: 2891928 - DNA, 15 bp, Homo sapiens
catcagaaggagaag

SEQ ID NO: 2891929 - DNA, 18 bp, Homo sapiens
catcagaagtaactccca

SEQ ID NO: 2891930 - DNA, 15 bp, Homo sapiens
catcagacattataa

SEQ ID NO: 2891931 - DNA, 20 bp, Homo sapiens
catcagcatgttttctgctt

SEQ ID NO: 2891932 - DNA, 16 bp, Homo sapiens
catcagcctccttctt

SEQ ID NO: 2891933 - DNA, 20 bp, Homo sapiens
catcagctgtctgtcatctg

SEQ ID NO: 2891934 - DNA, 23 bp, Homo sapiens
catcagcttaggggctgctgacc

SEQ ID NO: 2891935 - DNA, 22 bp, Homo sapiens
catcaggatactcaaagtggaa

SEQ ID NO: 2891936 - DNA, 15 bp, Homo sapiens
catcaggctctgttc

SEQ ID NO: 2891937 - DNA, 17 bp, Homo sapiens
catcagtccctatgtat

SEQ ID NO: 2891938 - DNA, 19 bp, Homo sapiens
catcagtgccagcccctgc

SEQ ID NO: 2891939 - DNA, 17 bp, Homo sapiens
catcatctcttgataaa

SEQ ID NO: 2891940 - DNA, 17 bp, Homo sapiens
catcatctgctgcacat

SEQ ID NO: 2891941 - DNA, 21 bp, Homo sapiens
catcatgaactggcttgtaca

SEQ ID NO: 2891942 - DNA, 20 bp, Homo sapiens
catcatgaggaaagcagttg

SEQ ID NO: 2891943 - DNA, 23 bp, Homo sapiens
catcatgaggccggatgaaactt

SEQ ID NO: 2891944 - DNA, 12 bp, Homo sapiens
catcatgcatgt

SEQ ID NO: 2891945 - DNA, 14 bp, Homo sapiens
catcatgtatctgt

SEQ ID NO: 2891946 - DNA, 23 bp, Homo sapiens
catcattcataaaagtttgcatg

SEQ ID NO: 2891947 - DNA, 14 bp, Homo sapiens
catcattccctctc

SEQ ID NO: 2891948 - DNA, 23 bp, Homo sapiens
catcattccctctcatctcaggt

SEQ ID NO: 2891949 - DNA, 15 bp, Homo sapiens
catcattctctgtct

SEQ ID NO: 2891950 - DNA, 16 bp, Homo sapiens
catcattctctgtctc

SEQ ID NO: 2891951 - DNA, 21 bp, Homo sapiens
catcattgctgtctgcagcct

SEQ ID NO: 2891952 - DNA, 18 bp, Homo sapiens
catcattggataaatttg

SEQ ID NO: 2891953 - DNA, 22 bp, Homo sapiens
catcattgggccagttccttct

SEQ ID NO: 2891954 - DNA, 16 bp, Homo sapiens
catcattgtccccatg

SEQ ID NO: 2891955 - DNA, 23 bp, Homo sapiens
catcattgtccccatgcaacaac

SEQ ID NO: 2891956 - DNA, 21 bp, Homo sapiens
catcatttaaaaaaaaagaat

SEQ ID NO: 2891957 - DNA, 16 bp, Homo sapiens
catccaaagcagacag

SEQ ID NO: 2891958 - DNA, 14 bp, Homo sapiens
catccaaccttccc

SEQ ID NO: 2891959 - DNA, 14 bp, Homo sapiens
catccaactctaaa

SEQ ID NO: 2891960 - DNA, 17 bp, Homo sapiens
catccacatgggagccg

SEQ ID NO: 2891961 - DNA, 14 bp, Homo sapiens
catccacattttaa

SEQ ID NO: 2891962 - DNA, 23 bp, Homo sapiens
catccagaactgctaccttccta

SEQ ID NO: 2891963 - DNA, 16 bp, Homo sapiens
catccagcagtctctg

SEQ ID NO: 2891964 - DNA, 23 bp, Homo sapiens
catccagctacttagctggccaa

SEQ ID NO: 2891965 - DNA, 17 bp, Homo sapiens
catccaggccagggctc

SEQ ID NO: 2891966 - DNA, 18 bp, Homo sapiens
catccaggccagggctcc

SEQ ID NO: 2891967 - DNA, 19 bp, Homo sapiens
catccaggccagggctcct

SEQ ID NO: 2891968 - DNA, 15 bp, Homo sapiens
catccaggctggcca

SEQ ID NO: 2891969 - DNA, 17 bp, Homo sapiens
catccataaagaagcaa

SEQ ID NO: 2891970 - DNA, 18 bp, Homo sapiens
catccatagtaactgaca

SEQ ID NO: 2891971 - DNA, 13 bp, Homo sapiens
catccatcatcat

SEQ ID NO: 2891972 - DNA, 15 bp, Homo sapiens
catccatcatctgct

SEQ ID NO: 2891973 - DNA, 16 bp, Homo sapiens
catccatctgtccgtc

SEQ ID NO: 2891974 - DNA, 18 bp, Homo sapiens
catccatctgtccgtcca

SEQ ID NO: 2891975 - DNA, 22 bp, Homo sapiens
catccatgtacttccctcttga

SEQ ID NO: 2891976 - DNA, 13 bp, Homo sapiens
catccattaatta

SEQ ID NO: 2891977 - DNA, 11 bp, Homo sapiens
catcccagcct

SEQ ID NO: 2891978 - DNA, 20 bp, Homo sapiens
catcccattcacttctgcat

SEQ ID NO: 2891979 - DNA, 12 bp, Homo sapiens
catcccattgcc

SEQ ID NO: 2891980 - DNA, 21 bp, Homo sapiens
catccccacgacccctgcctc

SEQ ID NO: 2891981 - DNA, 15 bp, Homo sapiens
catccccagagccca

SEQ ID NO: 2891982 - DNA, 17 bp, Homo sapiens
catccccatcggccctg

SEQ ID NO: 2891983 - DNA, 22 bp, Homo sapiens
catccccatcggccctgtcccc

SEQ ID NO: 2891984 - DNA, 21 bp, Homo sapiens
catccccctctcacgccaccc

SEQ ID NO: 2891985 - DNA, 19 bp, Homo sapiens
catccccttgaactcttca

SEQ ID NO: 2891986 - DNA, 21 bp, Homo sapiens
catcccgggacgcagcaggag

SEQ ID NO: 2891987 - DNA, 16 bp, Homo sapiens
catcccggtgcatgca

SEQ ID NO: 2891988 - DNA, 17 bp, Homo sapiens
catccctcccccagcag

SEQ ID NO: 2891989 - DNA, 18 bp, Homo sapiens
catccctcccccagcaga

SEQ ID NO: 2891990 - DNA, 15 bp, Homo sapiens
catccctgccagctc

SEQ ID NO: 2891991 - DNA, 13 bp, Homo sapiens
catccctgcttct

SEQ ID NO: 2891992 - DNA, 16 bp, Homo sapiens
catccctgcttctggc

SEQ ID NO: 2891993 - DNA, 20 bp, Homo sapiens
catccgcagactgcttggcc

SEQ ID NO: 2891994 - DNA, 14 bp, Homo sapiens
catccgccagggcc

SEQ ID NO: 2891995 - DNA, 16 bp, Homo sapiens
catccgcgtgtgcctg

SEQ ID NO: 2891996 - DNA, 18 bp, Homo sapiens
catccgtagttccctgaa

SEQ ID NO: 2891997 - DNA, 18 bp, Homo sapiens
catcctaccccctgtgcc

SEQ ID NO: 2891998 - DNA, 15 bp, Homo sapiens
catcctatgcaatat

SEQ ID NO: 2891999 - DNA, 20 bp, Homo sapiens
catcctattacttttcatct

SEQ ID NO: 2892000 - DNA, 19 bp, Homo sapiens
catcctcagatgctcaaag

SEQ ID NO: 2892001 - DNA, 20 bp, Homo sapiens
catcctccacgttctgctca

SEQ ID NO: 2892002 - DNA, 14 bp, Homo sapiens
catcctccagcagg

SEQ ID NO: 2892003 - DNA, 14 bp, Homo sapiens
catcctcccaatct

SEQ ID NO: 2892004 - DNA, 13 bp, Homo sapiens
catcctccccacc

SEQ ID NO: 2892005 - DNA, 15 bp, Homo sapiens
catcctccccaccag

SEQ ID NO: 2892006 - DNA, 20 bp, Homo sapiens
catcctccccaccagagctg

SEQ ID NO: 2892007 - DNA, 22 bp, Homo sapiens
catcctccccaccagagctgcc

SEQ ID NO: 2892008 - DNA, 15 bp, Homo sapiens
catcctcctcctcat

SEQ ID NO: 2892009 - DNA, 11 bp, Homo sapiens
catcctcctct

SEQ ID NO: 2892010 - DNA, 13 bp, Homo sapiens
catcctcctctcc

SEQ ID NO: 2892011 - DNA, 15 bp, Homo sapiens
catcctcctctccat

SEQ ID NO: 2892012 - DNA, 17 bp, Homo sapiens
catcctcctctccatgc

SEQ ID NO: 2892013 - DNA, 18 bp, Homo sapiens
catcctcctctccatgca

SEQ ID NO: 2892014 - DNA, 13 bp, Homo sapiens
catcctgacagga

SEQ ID NO: 2892015 - DNA, 13 bp, Homo sapiens
catcctgcttctc

SEQ ID NO: 2892016 - DNA, 14 bp, Homo sapiens
catcctggctggag

SEQ ID NO: 2892017 - DNA, 12 bp, Homo sapiens
catcctgtgaag

SEQ ID NO: 2892018 - DNA, 12 bp, Homo sapiens
catcctgtgtcc

SEQ ID NO: 2892019 - DNA, 15 bp, Homo sapiens
catcctgtgtcccct

SEQ ID NO: 2892020 - DNA, 22 bp, Homo sapiens
catcctgtgtcccctgacctgt

SEQ ID NO: 2892021 - DNA, 15 bp, Homo sapiens
catcctgtgtttcta

SEQ ID NO: 2892022 - DNA, 20 bp, Homo sapiens
catcctgttggctgctgcca

SEQ ID NO: 2892023 - DNA, 20 bp, Homo sapiens
catccttatccttcatcttt

SEQ ID NO: 2892024 - DNA, 22 bp, Homo sapiens
catccttatccttcatctttta

SEQ ID NO: 2892025 - DNA, 21 bp, Homo sapiens
catccttccctgtctgccagg

SEQ ID NO: 2892026 - DNA, 13 bp, Homo sapiens
catccttcccttt

SEQ ID NO: 2892027 - DNA, 16 bp, Homo sapiens
catccttgactgaagc

SEQ ID NO: 2892028 - DNA, 17 bp, Homo sapiens
catccttgagattctga

SEQ ID NO: 2892029 - DNA, 13 bp, Homo sapiens
catccttgcagtt

SEQ ID NO: 2892030 - DNA, 20 bp, Homo sapiens
catccttgcctgtctaaagc

SEQ ID NO: 2892031 - DNA, 17 bp, Homo sapiens
catccttggtgctcttg

SEQ ID NO: 2892032 - DNA, 19 bp, Homo sapiens
catcctttgttctgagcat

SEQ ID NO: 2892033 - DNA, 15 bp, Homo sapiens
catccttttttctct

SEQ ID NO: 2892034 - DNA, 20 bp, Homo sapiens
catccttttttctcttctgt

SEQ ID NO: 2892035 - DNA, 15 bp, Homo sapiens
catcgccccaactcc

SEQ ID NO: 2892036 - DNA, 20 bp, Homo sapiens
catcggacaagacccccagc

SEQ ID NO: 2892037 - DNA, 21 bp, Homo sapiens
catcggacaagacccccagca

SEQ ID NO: 2892038 - DNA, 14 bp, Homo sapiens
catcggccctgtcc

SEQ ID NO: 2892039 - DNA, 15 bp, Homo sapiens
catcgggcccaggga

SEQ ID NO: 2892040 - DNA, 16 bp, Homo sapiens
catcggtcatgtgtgt

SEQ ID NO: 2892041 - DNA, 16 bp, Homo sapiens
catcgttccccacccc

SEQ ID NO: 2892042 - DNA, 22 bp, Homo sapiens
catctaacgtgcattataattt

SEQ ID NO: 2892043 - DNA, 12 bp, Homo sapiens
catctaagcctg

SEQ ID NO: 2892044 - DNA, 20 bp, Homo sapiens
cagtccctgggagcaagttg

SEQ ID NO: 2892045 - DNA, 12 bp, Homo sapiens
cagtccctgggg

SEQ ID NO: 2892046 - DNA, 19 bp, Homo sapiens
cagtccgtcaaaacagatt

SEQ ID NO: 2892047 - DNA, 14 bp, Homo sapiens
cagtcctctgcctc

SEQ ID NO: 2892048 - DNA, 13 bp, Homo sapiens
cagtcctgctggc

SEQ ID NO: 2892049 - DNA, 15 bp, Homo sapiens
cagtcctgctggcct

SEQ ID NO: 2892050 - DNA, 19 bp, Homo sapiens
cagtcctgctggcctgctc

SEQ ID NO: 2892051 - DNA, 13 bp, Homo sapiens
cagtcctggtcct

SEQ ID NO: 2892052 - DNA, 22 bp, Homo sapiens
cagtcctggtcctggctgcact

SEQ ID NO: 2892053 - DNA, 18 bp, Homo sapiens
cagtcctggtctgctcag

SEQ ID NO: 2892054 - DNA, 15 bp, Homo sapiens
cagtccttaaaaatc

SEQ ID NO: 2892055 - DNA, 16 bp, Homo sapiens
cagtccttaaaaatca

SEQ ID NO: 2892056 - DNA, 16 bp, Homo sapiens
cagtcgatagagctgt

SEQ ID NO: 2892057 - DNA, 13 bp, Homo sapiens
cagtcgcacacac

SEQ ID NO: 2892058 - DNA, 16 bp, Homo sapiens
cagtcgctcagtctgt

SEQ ID NO: 2892059 - DNA, 16 bp, Homo sapiens
cagtcgctgcagggag

SEQ ID NO: 2892060 - DNA, 21 bp, Homo sapiens
cagtcgctgcagggagcacca

SEQ ID NO: 2892061 - DNA, 22 bp, Homo sapiens
cagtcggaaaagcgtctttaag

SEQ ID NO: 2892062 - DNA, 17 bp, Homo sapiens
cagtcggcatgccagga

SEQ ID NO: 2892063 - DNA, 18 bp, Homo sapiens
cagtcgggagagccaggc

SEQ ID NO: 2892064 - DNA, 19 bp, Homo sapiens
cagtcggtgaccccatcac

SEQ ID NO: 2892065 - DNA, 21 bp, Homo sapiens
cagtcgtggctttggcagtgt

SEQ ID NO: 2892066 - DNA, 18 bp, Homo sapiens
cagtctaagtaagtgtct

SEQ ID NO: 2892067 - DNA, 22 bp, Homo sapiens
cagtctaagtaagtgtctgtga

SEQ ID NO: 2892068 - DNA, 15 bp, Homo sapiens
cagtctacttctgtg

SEQ ID NO: 2892069 - DNA, 16 bp, Homo sapiens
cagtctacttctgtgt

SEQ ID NO: 2892070 - DNA, 14 bp, Homo sapiens
cagtctcaattttg

SEQ ID NO: 2892071 - DNA, 20 bp, Homo sapiens
cagtctcaattttgtattta

SEQ ID NO: 2892072 - DNA, 16 bp, Homo sapiens
cagtctccgcctcctg

SEQ ID NO: 2892073 - DNA, 22 bp, Homo sapiens
cagtctcctcccctactctgcc

SEQ ID NO: 2892074 - DNA, 15 bp, Homo sapiens
cagtctcgggtggct

SEQ ID NO: 2892075 - DNA, 12 bp, Homo sapiens
cagtctctgcct

SEQ ID NO: 2892076 - DNA, 13 bp, Homo sapiens
cagtctctgcctt

SEQ ID NO: 2892077 - DNA, 14 bp, Homo sapiens
cagtctctgccttg

SEQ ID NO: 2892078 - DNA, 19 bp, Homo sapiens
cagtctctgccttgccttt

SEQ ID NO: 2892079 - DNA, 16 bp, Homo sapiens
cagtctgctttctcta

SEQ ID NO: 2892080 - DNA, 14 bp, Homo sapiens
cagtctggagagct

SEQ ID NO: 2892081 - DNA, 18 bp, Homo sapiens
cagtctgggtctgggttt

SEQ ID NO: 2892082 - DNA, 23 bp, Homo sapiens
cagtctgggtctgggtttggatc

SEQ ID NO: 2892083 - DNA, 22 bp, Homo sapiens
cagtctgtcttctgtatataaa

SEQ ID NO: 2892084 - DNA, 23 bp, Homo sapiens
cagtctgtcttctgtatataaat

SEQ ID NO: 2892085 - DNA, 15 bp, Homo sapiens
cagtctgttcactgc

SEQ ID NO: 2892086 - DNA, 12 bp, Homo sapiens
cagtctgttctc

SEQ ID NO: 2892087 - DNA, 15 bp, Homo sapiens
cagtctgttctcaca

SEQ ID NO: 2892088 - DNA, 17 bp, Homo sapiens
cagtcttccatttgcaa

SEQ ID NO: 2892089 - DNA, 21 bp, Homo sapiens
cagtcttccatttgcaaggga

SEQ ID NO: 2892090 - DNA, 23 bp, Homo sapiens
cagtcttcctcttagcctctgga

SEQ ID NO: 2892091 - DNA, 13 bp, Homo sapiens
cagtctttccccc

SEQ ID NO: 2892092 - DNA, 14 bp, Homo sapiens
cagtctttccccca

SEQ ID NO: 2892093 - DNA, 19 bp, Homo sapiens
cagtcttttctctgaaaag

SEQ ID NO: 2892094 - DNA, 15 bp, Homo sapiens
cagtgaaaaacatta

SEQ ID NO: 2892095 - DNA, 18 bp, Homo sapiens
cagtgaaacacttgcttg

SEQ ID NO: 2892096 - DNA, 16 bp, Homo sapiens
cagtgaaagaaaataa

SEQ ID NO: 2892097 - DNA, 16 bp, Homo sapiens
cagtgaagacagaagt

SEQ ID NO: 2892098 - DNA, 18 bp, Homo sapiens
cagtgaaggcccatgaag

SEQ ID NO: 2892099 - DNA, 16 bp, Homo sapiens
cagtgaagtgttctgc

SEQ ID NO: 2892100 - DNA, 18 bp, Homo sapiens
cagtgaatgattcagtgt

SEQ ID NO: 2892101 - DNA, 15 bp, Homo sapiens
cagtgaatttaagca

SEQ ID NO: 2892102 - DNA, 18 bp, Homo sapiens
cagtgaatttaagcatga

SEQ ID NO: 2892103 - DNA, 21 bp, Homo sapiens
cagtgaatttttgcaataatg

SEQ ID NO: 2892104 - DNA, 22 bp, Homo sapiens
cagtgaatttttgcaataatgc

SEQ ID NO: 2892105 - DNA, 23 bp, Homo sapiens
cagtgaatttttgcaataatgca

SEQ ID NO: 2892106 - DNA, 17 bp, Homo sapiens
cagtgacctgaggaagc

SEQ ID NO: 2892107 - DNA, 19 bp, Homo sapiens
caggtagctgggattacag

SEQ ID NO: 2892108 - DNA, 16 bp, Homo sapiens
caggtaggaaacaatt

SEQ ID NO: 2892109 - DNA, 18 bp, Homo sapiens
caggtagttgcaattgaa

SEQ ID NO: 2892110 - DNA, 23 bp, Homo sapiens
caggtagttgcaattgaattaaa

SEQ ID NO: 2892111 - DNA, 20 bp, Homo sapiens
caggtatgttgcctttatgg

SEQ ID NO: 2892112 - DNA, 11 bp, Homo sapiens
caggtattttc

SEQ ID NO: 2892113 - DNA, 15 bp, Homo sapiens
caggtcaacagaatg

SEQ ID NO: 2892114 - DNA, 18 bp, Homo sapiens
caggtcaacagaatgaaa

SEQ ID NO: 2892115 - DNA, 11 bp, Homo sapiens
caggtcactgt

SEQ ID NO: 2892116 - DNA, 18 bp, Homo sapiens
caggtcactgtcactgcc

SEQ ID NO: 2892117 - DNA, 19 bp, Homo sapiens
caggtcactgtcactgccg

SEQ ID NO: 2892118 - DNA, 18 bp, Homo sapiens
caggtcaggaccaggacc

SEQ ID NO: 2892119 - DNA, 17 bp, Homo sapiens
caggtcaggggtgacac

SEQ ID NO: 2892120 - DNA, 13 bp, Homo sapiens
caggtcagtttat

SEQ ID NO: 2892121 - DNA, 16 bp, Homo sapiens
caggtccaggctgtgt

SEQ ID NO: 2892122 - DNA, 21 bp, Homo sapiens
caggtccattctgtttaaatc

SEQ ID NO: 2892123 - DNA, 14 bp, Homo sapiens
caggtcccagcgag

SEQ ID NO: 2892124 - DNA, 15 bp, Homo sapiens
caggtcccagcgagc

SEQ ID NO: 2892125 - DNA, 21 bp, Homo sapiens
caggtcccagcgagccacagg

SEQ ID NO: 2892126 - DNA, 16 bp, Homo sapiens
caggtcccccccaggt

SEQ ID NO: 2892127 - DNA, 15 bp, Homo sapiens
caggtcccccgactg

SEQ ID NO: 2892128 - DNA, 20 bp, Homo sapiens
caggtcccccgactgcctgt

SEQ ID NO: 2892129 - DNA, 18 bp, Homo sapiens
caggtccccctgcagcta

SEQ ID NO: 2892130 - DNA, 12 bp, Homo sapiens
caggtcccctca

SEQ ID NO: 2892131 - DNA, 16 bp, Homo sapiens
caggtccctccccttc

SEQ ID NO: 2892132 - DNA, 20 bp, Homo sapiens
caggtctccatgaagaagct

SEQ ID NO: 2892133 - DNA, 13 bp, Homo sapiens
caggtctctgaga

SEQ ID NO: 2892134 - DNA, 23 bp, Homo sapiens
caggtctgcaagggcccagagtg

SEQ ID NO: 2892135 - DNA, 13 bp, Homo sapiens
caggtctttccta

SEQ ID NO: 2892136 - DNA, 14 bp, Homo sapiens
caggtgagcagaca

SEQ ID NO: 2892137 - DNA, 20 bp, Homo sapiens
caggtgagtcctagagctac

SEQ ID NO: 2892138 - DNA, 15 bp, Homo sapiens
caggtgagtgtgagg

SEQ ID NO: 2892139 - DNA, 22 bp, Homo sapiens
caggtgcacacatcaccaggtg

SEQ ID NO: 2892140 - DNA, 17 bp, Homo sapiens
caggtgcagccagaggc

SEQ ID NO: 2892141 - DNA, 19 bp, Homo sapiens
caggtgcatctgcaggcac

SEQ ID NO: 2892142 - DNA, 21 bp, Homo sapiens
caggtgcctttcaaatttaga

SEQ ID NO: 2892143 - DNA, 14 bp, Homo sapiens
caggtgcggcgcgc

SEQ ID NO: 2892144 - DNA, 19 bp, Homo sapiens
caggtgcgggaccatctga

SEQ ID NO: 2892145 - DNA, 13 bp, Homo sapiens
caggtgctggccc

SEQ ID NO: 2892146 - DNA, 16 bp, Homo sapiens
caggtgctggcccagc

SEQ ID NO: 2892147 - DNA, 18 bp, Homo sapiens
caggtgctggcccagcat

SEQ ID NO: 2892148 - DNA, 14 bp, Homo sapiens
caggtggagagcac

SEQ ID NO: 2892149 - DNA, 13 bp, Homo sapiens
caggtggccatgc

SEQ ID NO: 2892150 - DNA, 19 bp, Homo sapiens
caggtggccgcccctgagg

SEQ ID NO: 2892151 - DNA, 16 bp, Homo sapiens
caggtggctgacccag

SEQ ID NO: 2892152 - DNA, 19 bp, Homo sapiens
caggtggctgacccagtcc

SEQ ID NO: 2892153 - DNA, 13 bp, Homo sapiens
caggtgggagctg

SEQ ID NO: 2892154 - DNA, 22 bp, Homo sapiens
caggtgggaggaaagggcctgg

SEQ ID NO: 2892155 - DNA, 22 bp, Homo sapiens
caggtggggagactgggctgag

SEQ ID NO: 2892156 - DNA, 21 bp, Homo sapiens
caggtggggtgatggccagag

SEQ ID NO: 2892157 - DNA, 19 bp, Homo sapiens
caggtggggtttcctgcat

SEQ ID NO: 2892158 - DNA, 20 bp, Homo sapiens
caggtggtgtcactgtccct

SEQ ID NO: 2892159 - DNA, 20 bp, Homo sapiens
caggtggtgtccttcttcct

SEQ ID NO: 2892160 - DNA, 21 bp, Homo sapiens
caggtggtgtccttcttcctc

SEQ ID NO: 2892161 - DNA, 16 bp, Homo sapiens
caggtgtagctgagct

SEQ ID NO: 2892162 - DNA, 21 bp, Homo sapiens
caggtgtagctgagctgtgac

SEQ ID NO: 2892163 - DNA, 17 bp, Homo sapiens
caggtgtcagccattgc

SEQ ID NO: 2892164 - DNA, 14 bp, Homo sapiens
caggtgtcaggccc

SEQ ID NO: 2892165 - DNA, 22 bp, Homo sapiens
caggtgtggtggctcacacctg

SEQ ID NO: 2892166 - DNA, 18 bp, Homo sapiens
caggtgttaacattccaa

SEQ ID NO: 2892167 - DNA, 13 bp, Homo sapiens
caggttacaacag

SEQ ID NO: 2892168 - DNA, 22 bp, Homo sapiens
caggttacaacagatttgtgaa

SEQ ID NO: 2892169 - DNA, 23 bp, Homo sapiens
caggttacaacagatttgtgaac

SEQ ID NO: 2892170 - DNA, 18 bp, Homo sapiens
caggttactaccctcacc

SEQ ID NO: 2892171 - DNA, 13 bp, Homo sapiens
caggttagaagaa

SEQ ID NO: 2892172 - DNA, 15 bp, Homo sapiens
caggttcacagcagc

SEQ ID NO: 2892173 - DNA, 22 bp, Homo sapiens
caggttcacttaaaagctggct

SEQ ID NO: 2892174 - DNA, 17 bp, Homo sapiens
caggttcccaagctcag

SEQ ID NO: 2892175 - DNA, 12 bp, Homo sapiens
caggttcctaag

SEQ ID NO: 2892176 - DNA, 14 bp, Homo sapiens
caggttggaaaaga

SEQ ID NO: 2892177 - DNA, 22 bp, Homo sapiens
caggttggaaaagaaatcaatt

SEQ ID NO: 2892178 - DNA, 21 bp, Homo sapiens
caggttggcggcagacacatt

SEQ ID NO: 2892179 - DNA, 15 bp, Homo sapiens
cagcccgcacacctg

SEQ ID NO: 2892180 - DNA, 15 bp, Homo sapiens
cagcccgccagaggc

SEQ ID NO: 2892181 - DNA, 23 bp, Homo sapiens
cagcccggcggggaccttggtct

SEQ ID NO: 2892182 - DNA, 20 bp, Homo sapiens
cagcccggctcggcccagca

SEQ ID NO: 2892183 - DNA, 17 bp, Homo sapiens
cagcccgtcctcctcta

SEQ ID NO: 2892184 - DNA, 18 bp, Homo sapiens
cagccctcattggctctt

SEQ ID NO: 2892185 - DNA, 21 bp, Homo sapiens
cagccctccatggtcctgtct

SEQ ID NO: 2892186 - DNA, 21 bp, Homo sapiens
cagccctccctgtcctcctcg

SEQ ID NO: 2892187 - DNA, 22 bp, Homo sapiens
cagccctccctgtcctcctcgg

SEQ ID NO: 2892188 - DNA, 13 bp, Homo sapiens
cagccctcctcac

SEQ ID NO: 2892189 - DNA, 14 bp, Homo sapiens
cagccctcctcacc

SEQ ID NO: 2892190 - DNA, 14 bp, Homo sapiens
cagccctctgcctc

SEQ ID NO: 2892191 - DNA, 18 bp, Homo sapiens
cagccctgagaaagccct

SEQ ID NO: 2892192 - DNA, 19 bp, Homo sapiens
cagccctgagaaagccctg

SEQ ID NO: 2892193 - DNA, 18 bp, Homo sapiens
cagccctgagttcctagc

SEQ ID NO: 2892194 - DNA, 15 bp, Homo sapiens
cagccctgcccaccc

SEQ ID NO: 2892195 - DNA, 13 bp, Homo sapiens
cagccctgctgct

SEQ ID NO: 2892196 - DNA, 18 bp, Homo sapiens
cagccctgctgcttccta

SEQ ID NO: 2892197 - DNA, 19 bp, Homo sapiens
cagccctgctgcttcctaa

SEQ ID NO: 2892198 - DNA, 23 bp, Homo sapiens
cagccctgggccccaccacctag

SEQ ID NO: 2892199 - DNA, 16 bp, Homo sapiens
cagccctgtctactga

SEQ ID NO: 2892200 - DNA, 20 bp, Homo sapiens
cagcccttgagggagaactt

SEQ ID NO: 2892201 - DNA, 14 bp, Homo sapiens
cagcccttgtttat

SEQ ID NO: 2892202 - DNA, 18 bp, Homo sapiens
cagccgattcacctgagc

SEQ ID NO: 2892203 - DNA, 15 bp, Homo sapiens
cagccggagggaggc

SEQ ID NO: 2892204 - DNA, 13 bp, Homo sapiens
cagccgggcacag

SEQ ID NO: 2892205 - DNA, 16 bp, Homo sapiens
cagccgggcacagtgg

SEQ ID NO: 2892206 - DNA, 15 bp, Homo sapiens
cagccgtcagccatc

SEQ ID NO: 2892207 - DNA, 20 bp, Homo sapiens
cagccgtcagccatcagcca

SEQ ID NO: 2892208 - DNA, 15 bp, Homo sapiens
cagccgtccatagca

SEQ ID NO: 2892209 - DNA, 14 bp, Homo sapiens
cagccgtgagcatg

SEQ ID NO: 2892210 - DNA, 20 bp, Homo sapiens
cagcctcacagatgctggcc

SEQ ID NO: 2892211 - DNA, 13 bp, Homo sapiens
cagcctcacttgg

SEQ ID NO: 2892212 - DNA, 21 bp, Homo sapiens
cagcctcacttggtctgccag

SEQ ID NO: 2892213 - DNA, 21 bp, Homo sapiens
cagcctcccaaagtgctgaga

SEQ ID NO: 2892214 - DNA, 18 bp, Homo sapiens
cagcctcccatccagggc

SEQ ID NO: 2892215 - DNA, 18 bp, Homo sapiens
cagcctcccctgccaggg

SEQ ID NO: 2892216 - DNA, 16 bp, Homo sapiens
cagcctccctgaagcc

SEQ ID NO: 2892217 - DNA, 15 bp, Homo sapiens
cagcctcgcacaggc

SEQ ID NO: 2892218 - DNA, 23 bp, Homo sapiens
cagcctctccactcatgtgactc

SEQ ID NO: 2892219 - DNA, 15 bp, Homo sapiens
cagcctctcctcctt

SEQ ID NO: 2892220 - DNA, 17 bp, Homo sapiens
cagcctctttctgtccc

SEQ ID NO: 2892221 - DNA, 16 bp, Homo sapiens
cagcctgaataaacca

SEQ ID NO: 2892222 - DNA, 21 bp, Homo sapiens
cagcctgaataaaccaagaca

SEQ ID NO: 2892223 - DNA, 16 bp, Homo sapiens
cagcctgagcaactct

SEQ ID NO: 2892224 - DNA, 20 bp, Homo sapiens
cagcctgagcaactcttgat

SEQ ID NO: 2892225 - DNA, 19 bp, Homo sapiens
cagcctgatcaggcttcct

SEQ ID NO: 2892226 - DNA, 22 bp, Homo sapiens
cagcctgcacagtgtcccccag

SEQ ID NO: 2892227 - DNA, 19 bp, Homo sapiens
cagcctgcctggcaggctg

SEQ ID NO: 2892228 - DNA, 21 bp, Homo sapiens
cagcctgcgctcggcaggaag

SEQ ID NO: 2892229 - DNA, 13 bp, Homo sapiens
cagcctggccaga

SEQ ID NO: 2892230 - DNA, 15 bp, Homo sapiens
cagcctggccagaca

SEQ ID NO: 2892231 - DNA, 16 bp, Homo sapiens
cagcctgggaggcaca

SEQ ID NO: 2892232 - DNA, 17 bp, Homo sapiens
cagcctgggaggcacag

SEQ ID NO: 2892233 - DNA, 18 bp, Homo sapiens
cagcctgggcaacaaagt

SEQ ID NO: 2892234 - DNA, 20 bp, Homo sapiens
cagcctgggcaacaagagca

SEQ ID NO: 2892235 - DNA, 15 bp, Homo sapiens
cagcctgggccccag

SEQ ID NO: 2892236 - DNA, 17 bp, Homo sapiens
cagcctggggctggcct

SEQ ID NO: 2892237 - DNA, 15 bp, Homo sapiens
cagcctggttttcgt

SEQ ID NO: 2892238 - DNA, 12 bp, Homo sapiens
cagcctgtcagc

SEQ ID NO: 2892239 - DNA, 16 bp, Homo sapiens
cagcctgtccaacatg

SEQ ID NO: 2892240 - DNA, 21 bp, Homo sapiens
cagcctgtgagggagtgcaga

SEQ ID NO: 2892241 - DNA, 12 bp, Homo sapiens
cagcctgtggcg

SEQ ID NO: 2892242 - DNA, 20 bp, Homo sapiens
cagcctgtggcggtgcctgg

SEQ ID NO: 2892243 - DNA, 22 bp, Homo sapiens
cagccttattttgttggtgctt

SEQ ID NO: 2892244 - DNA, 18 bp, Homo sapiens
cagccttcaagaatcaga

SEQ ID NO: 2892245 - DNA, 19 bp, Homo sapiens
cagccttcacttttctgag

SEQ ID NO: 2892246 - DNA, 13 bp, Homo sapiens
cagccttgccaga

SEQ ID NO: 2892247 - DNA, 21 bp, Homo sapiens
cagccttgggggggctgcctt

SEQ ID NO: 2892248 - DNA, 22 bp, Homo sapiens
cagccttgggggggctgccttt

SEQ ID NO: 2892249 - DNA, 20 bp, Homo sapiens
cagcctttctcctgtttatg

SEQ ID NO: 2892250 - DNA, 12 bp, Homo sapiens
cagcctttcttc

SEQ ID NO: 2892251 - DNA, 13 bp, Homo sapiens
cagcctttcttcc

SEQ ID NO: 2892252 - DNA, 23 bp, Homo sapiens
cagcctttgatcaggtggggagt

SEQ ID NO: 2892253 - DNA, 21 bp, Homo sapiens
cagcctttgggtcctgggcag

SEQ ID NO: 2892254 - DNA, 21 bp, Homo sapiens
cagcgaaaggatgtaaacagt

SEQ ID NO: 2892255 - DNA, 15 bp, Homo sapiens
cagcgagaaggagtg

SEQ ID NO: 2892256 - DNA, 13 bp, Homo sapiens
cagcgagccacag

SEQ ID NO: 2892257 - DNA, 16 bp, Homo sapiens
cagcgagccacaggaa

SEQ ID NO: 2892258 - DNA, 17 bp, Homo sapiens
cagcgaggaggctccag

SEQ ID NO: 2892259 - DNA, 22 bp, Homo sapiens
cagcgatggtgctgcccaggcc

SEQ ID NO: 2892260 - DNA, 22 bp, Homo sapiens
cagcgatgtatgcagctatctg

SEQ ID NO: 2892261 - DNA, 18 bp, Homo sapiens
cagcgatttcaagaagga

SEQ ID NO: 2892262 - DNA, 19 bp, Homo sapiens
cagcgccaggctgaccaca

SEQ ID NO: 2892263 - DNA, 21 bp, Homo sapiens
cagcgccaggctgaccacagc

SEQ ID NO: 2892264 - DNA, 14 bp, Homo sapiens
cagcgcccccaggc

SEQ ID NO: 2892265 - DNA, 15 bp, Homo sapiens
cagcgcccccaggcc

SEQ ID NO: 2892266 - DNA, 17 bp, Homo sapiens
cagcgcccccaggcctg

SEQ ID NO: 2892267 - DNA, 20 bp, Homo sapiens
cagcgcccccaggcctgccc

SEQ ID NO: 2892268 - DNA, 22 bp, Homo sapiens
cagcgcccccaggcctgccctg

SEQ ID NO: 2892269 - DNA, 22 bp, Homo sapiens
cagcgcctgtcccctcacagac

SEQ ID NO: 2892270 - DNA, 23 bp, Homo sapiens
cagcgcctgtcccctcacagact

SEQ ID NO: 2892271 - DNA, 24 bp, Homo sapiens
cagcgcctgtcccctcacagactc

SEQ ID NO: 2892272 - DNA, 12 bp, Homo sapiens
cagcgcctttcc

SEQ ID NO: 2892273 - DNA, 22 bp, Homo sapiens
cagcgcctttcccaactctagc

SEQ ID NO: 2892274 - DNA, 15 bp, Homo sapiens
cagcgcgcaggcctg

SEQ ID NO: 2892275 - DNA, 22 bp, Homo sapiens
cagcgctttgggaggccgaggc

SEQ ID NO: 2892276 - DNA, 19 bp, Homo sapiens
cagcggcaggaccgccatg

SEQ ID NO: 2892277 - DNA, 13 bp, Homo sapiens
cagcggcctcagg

SEQ ID NO: 2892278 - DNA, 14 bp, Homo sapiens
cagcggcctcaggg

SEQ ID NO: 2892279 - DNA, 15 bp, Homo sapiens
cagcggccttgaaga

SEQ ID NO: 2892280 - DNA, 20 bp, Homo sapiens
cagcggccttgaagacagag

SEQ ID NO: 2892281 - DNA, 14 bp, Homo sapiens
cagcggctccaact

SEQ ID NO: 2892282 - DNA, 15 bp, Homo sapiens
cagcggctccaactc

SEQ ID NO: 2892283 - DNA, 16 bp, Homo sapiens
cagcggctccagctca

SEQ ID NO: 2892284 - DNA, 16 bp, Homo sapiens
cagcggctctggtcct

SEQ ID NO: 2892285 - DNA, 12 bp, Homo sapiens
cagcggctgcct

SEQ ID NO: 2892286 - DNA, 17 bp, Homo sapiens
cagcggctggaattggg

SEQ ID NO: 2892287 - DNA, 20 bp, Homo sapiens
cagcggtccaacgccgcctt

SEQ ID NO: 2892288 - DNA, 15 bp, Homo sapiens
cagcggtgggaagga

SEQ ID NO: 2892289 - DNA, 23 bp, Homo sapiens
cagcggtgggaaggaaaggcaga

SEQ ID NO: 2892290 - DNA, 21 bp, Homo sapiens
cagcgtatatataagaaagac

SEQ ID NO: 2892291 - DNA, 23 bp, Homo sapiens
cagcgtatatataagaaagacat

SEQ ID NO: 2892292 - DNA, 15 bp, Homo sapiens
cagcgtcctcctctg

SEQ ID NO: 2892293 - DNA, 15 bp, Homo sapiens
cagcgtcctgtccac

SEQ ID NO: 2892294 - DNA, 18 bp, Homo sapiens
cagcgtcttccttcttta

SEQ ID NO: 2892295 - DNA, 12 bp, Homo sapiens
cagctaaagcaa

SEQ ID NO: 2892296 - DNA, 17 bp, Homo sapiens
cagctaactccgagagc

SEQ ID NO: 2892297 - DNA, 18 bp, Homo sapiens
cagctaagaacctggaac

SEQ ID NO: 2892298 - DNA, 19 bp, Homo sapiens
cagctaaggacatttccca

SEQ ID NO: 2892299 - DNA, 21 bp, Homo sapiens
cagctaaggaggggaaaaaaa

SEQ ID NO: 2892300 - DNA, 16 bp, Homo sapiens
cagctactcaggaggc

SEQ ID NO: 2892301 - DNA, 22 bp, Homo sapiens
ccctgcaggctgcaggagggca

SEQ ID NO: 2892302 - DNA, 21 bp, Homo sapiens
ccctgcatctgaccagcagcg

SEQ ID NO: 2892303 - DNA, 17 bp, Homo sapiens
ccctgccaccgactgcc

SEQ ID NO: 2892304 - DNA, 21 bp, Homo sapiens
ccctgccaccgactgcccagc

SEQ ID NO: 2892305 - DNA, 15 bp, Homo sapiens
ccctgccactcaccc

SEQ ID NO: 2892306 - DNA, 16 bp, Homo sapiens
ccctgccactcaccct

SEQ ID NO: 2892307 - DNA, 13 bp, Homo sapiens
ccctgccagaccc

SEQ ID NO: 2892308 - DNA, 21 bp, Homo sapiens
ccctgccagaccccctggaga

SEQ ID NO: 2892309 - DNA, 13 bp, Homo sapiens
ccctgccagctct

SEQ ID NO: 2892310 - DNA, 12 bp, Homo sapiens
ccctgccagggc

SEQ ID NO: 2892311 - DNA, 15 bp, Homo sapiens
ccctgccagtgcctt

SEQ ID NO: 2892312 - DNA, 12 bp, Homo sapiens
ccctgccatccc

SEQ ID NO: 2892313 - DNA, 13 bp, Homo sapiens
ccctgccatcccc

SEQ ID NO: 2892314 - DNA, 12 bp, Homo sapiens
ccctgcccaagt

SEQ ID NO: 2892315 - DNA, 14 bp, Homo sapiens
ccctgcccaagtga

SEQ ID NO: 2892316 - DNA, 22 bp, Homo sapiens
ccctgccccgcaggcctgcctt

SEQ ID NO: 2892317 - DNA, 23 bp, Homo sapiens
ccctgcccctgtgcctctgtcct

SEQ ID NO: 2892318 - DNA, 17 bp, Homo sapiens
ccctgcccgtgtacata

SEQ ID NO: 2892319 - DNA, 16 bp, Homo sapiens
ccctgccctcatggga

SEQ ID NO: 2892320 - DNA, 15 bp, Homo sapiens
ccctgccctcccctc

SEQ ID NO: 2892321 - DNA, 12 bp, Homo sapiens
ccctgccctgtg

SEQ ID NO: 2892322 - DNA, 14 bp, Homo sapiens
ccctgccctgtggg

SEQ ID NO: 2892323 - DNA, 13 bp, Homo sapiens
ccctgccgcctcc

SEQ ID NO: 2892324 - DNA, 15 bp, Homo sapiens
ccctgccgcctcccg

SEQ ID NO: 2892325 - DNA, 18 bp, Homo sapiens
ccctgccgcctcccggga

SEQ ID NO: 2892326 - DNA, 10 bp, Homo sapiens
ccctgcctca

SEQ ID NO: 2892327 - DNA, 14 bp, Homo sapiens
ccctgcctcacatc

SEQ ID NO: 2892328 - DNA, 17 bp, Homo sapiens
ccctgcctcacatctcc

SEQ ID NO: 2892329 - DNA, 20 bp, Homo sapiens
ccctgcctcacatctccctt

SEQ ID NO: 2892330 - DNA, 13 bp, Homo sapiens
ccctgcctccacc

SEQ ID NO: 2892331 - DNA, 16 bp, Homo sapiens
ccctgcctccagctgt

SEQ ID NO: 2892332 - DNA, 18 bp, Homo sapiens
ccctgcctcgagggccgc

SEQ ID NO: 2892333 - DNA, 15 bp, Homo sapiens
ccctgcctgctgtgg

SEQ ID NO: 2892334 - DNA, 12 bp, Homo sapiens
ccctgcctggac

SEQ ID NO: 2892335 - DNA, 19 bp, Homo sapiens
ccctgcctttgggagcagg

SEQ ID NO: 2892336 - DNA, 22 bp, Homo sapiens
ccctgcgggtgaacaaagcagc

SEQ ID NO: 2892337 - DNA, 14 bp, Homo sapiens
ccctgctatgaaag

SEQ ID NO: 2892338 - DNA, 22 bp, Homo sapiens
ccctgctatttcaggccctcag

SEQ ID NO: 2892339 - DNA, 19 bp, Homo sapiens
ccctgctccagaagatagc

SEQ ID NO: 2892340 - DNA, 19 bp, Homo sapiens
ccctgctccctctccccct

SEQ ID NO: 2892341 - DNA, 15 bp, Homo sapiens
ccctgctgcccctcc

SEQ ID NO: 2892342 - DNA, 20 bp, Homo sapiens
ccctgctgctgccagggctt

SEQ ID NO: 2892343 - DNA, 15 bp, Homo sapiens
ccctgctgctggtgc

SEQ ID NO: 2892344 - DNA, 19 bp, Homo sapiens
ccctgctgctggtgcacag

SEQ ID NO: 2892345 - DNA, 17 bp, Homo sapiens
ccctgctgctgtcacct

SEQ ID NO: 2892346 - DNA, 19 bp, Homo sapiens
ccctgctggggtctcaggt

SEQ ID NO: 2892347 - DNA, 13 bp, Homo sapiens
ccctgctgtctct

SEQ ID NO: 2892348 - DNA, 20 bp, Homo sapiens
ccctgctgtctctctgggct

SEQ ID NO: 2892349 - DNA, 22 bp, Homo sapiens
ccctgcttagaacccttctgct

SEQ ID NO: 2892350 - DNA, 19 bp, Homo sapiens
ccctgcttcatatctctcc

SEQ ID NO: 2892351 - DNA, 14 bp, Homo sapiens
ccctggaacctttc

SEQ ID NO: 2892352 - DNA, 15 bp, Homo sapiens
ccctggaacctttcc

SEQ ID NO: 2892353 - DNA, 16 bp, Homo sapiens
ccctggaccagtggtc

SEQ ID NO: 2892354 - DNA, 23 bp, Homo sapiens
ccctggaccagtggtctcacatg

SEQ ID NO: 2892355 - DNA, 21 bp, Homo sapiens
ccctggagaggccctctggag

SEQ ID NO: 2892356 - DNA, 13 bp, Homo sapiens
ccctggaggtggc

SEQ ID NO: 2892357 - DNA, 19 bp, Homo sapiens
ccctggagtgtgtcagagc

SEQ ID NO: 2892358 - DNA, 20 bp, Homo sapiens
ccctggagtgtgtcagagcc

SEQ ID NO: 2892359 - DNA, 21 bp, Homo sapiens
ccctggagtgtgtcagagccc

SEQ ID NO: 2892360 - DNA, 14 bp, Homo sapiens
ccctggcagctgcc

SEQ ID NO: 2892361 - DNA, 15 bp, Homo sapiens
ccctggcagctgccc

SEQ ID NO: 2892362 - DNA, 17 bp, Homo sapiens
ccctggcagctgcccct

SEQ ID NO: 2892363 - DNA, 18 bp, Homo sapiens
ccctggcagctgcccctc

SEQ ID NO: 2892364 - DNA, 19 bp, Homo sapiens
ccctggcagctgcccctcc

SEQ ID NO: 2892365 - DNA, 23 bp, Homo sapiens
ccctggcagctgcccctcctgga

SEQ ID NO: 2892366 - DNA, 23 bp, Homo sapiens
ccctggcattatgtccactgtgt

SEQ ID NO: 2892367 - DNA, 23 bp, Homo sapiens
ccctggccactgaaaagctttcc

SEQ ID NO: 2892368 - DNA, 18 bp, Homo sapiens
ccgaagtccagctttctg

SEQ ID NO: 2892369 - DNA, 13 bp, Homo sapiens
ccgacaccactcc

SEQ ID NO: 2892370 - DNA, 15 bp, Homo sapiens
ccgacaccactcctg

SEQ ID NO: 2892371 - DNA, 20 bp, Homo sapiens
ccgacaccactcctgccagc

SEQ ID NO: 2892372 - DNA, 12 bp, Homo sapiens
ccgacactgttc

SEQ ID NO: 2892373 - DNA, 21 bp, Homo sapiens
ccgacagcggccttgaagaca

SEQ ID NO: 2892374 - DNA, 20 bp, Homo sapiens
ccgacagtcggtgaccccat

SEQ ID NO: 2892375 - DNA, 23 bp, Homo sapiens
ccgacagtcggtgaccccatcac

SEQ ID NO: 2892376 - DNA, 17 bp, Homo sapiens
ccgaccagaggagcctt

SEQ ID NO: 2892377 - DNA, 18 bp, Homo sapiens
ccgaccagaggagccttt

SEQ ID NO: 2892378 - DNA, 14 bp, Homo sapiens
ccgacccgaggccc

SEQ ID NO: 2892379 - DNA, 16 bp, Homo sapiens
ccgacccgaggcccag

SEQ ID NO: 2892380 - DNA, 20 bp, Homo sapiens
ccgactcccccaaccaagga

SEQ ID NO: 2892381 - DNA, 12 bp, Homo sapiens
ccgactgcccag

SEQ ID NO: 2892382 - DNA, 13 bp, Homo sapiens
ccgactgcccagc

SEQ ID NO: 2892383 - DNA, 16 bp, Homo sapiens
ccgactgcccagccac

SEQ ID NO: 2892384 - DNA, 21 bp, Homo sapiens
ccgactgcccagccactccaa

SEQ ID NO: 2892385 - DNA, 14 bp, Homo sapiens
ccgactgggctcaa

SEQ ID NO: 2892386 - DNA, 18 bp, Homo sapiens
ccgagagcagtgggcagg

SEQ ID NO: 2892387 - DNA, 14 bp, Homo sapiens
ccgagagcctgctc

SEQ ID NO: 2892388 - DNA, 19 bp, Homo sapiens
ccgagcctggctccaaacc

SEQ ID NO: 2892389 - DNA, 12 bp, Homo sapiens
ccgagcgctggt

SEQ ID NO: 2892390 - DNA, 16 bp, Homo sapiens
ccgagctggtttcctg

SEQ ID NO: 2892391 - DNA, 15 bp, Homo sapiens
ccgaggcaggcagat

SEQ ID NO: 2892392 - DNA, 14 bp, Homo sapiens
ccgaggccctgcat

SEQ ID NO: 2892393 - DNA, 13 bp, Homo sapiens
ccgaggctgcccc

SEQ ID NO: 2892394 - DNA, 21 bp, Homo sapiens
ccgaggctgccccaggccgga

SEQ ID NO: 2892395 - DNA, 17 bp, Homo sapiens
ccgagggctcagaagag

SEQ ID NO: 2892396 - DNA, 20 bp, Homo sapiens
ccgagggctcagaagagcag

SEQ ID NO: 2892397 - DNA, 20 bp, Homo sapiens
ccgaggttgtggggaggctg

SEQ ID NO: 2892398 - DNA, 23 bp, Homo sapiens
ccgaggttgtggggaggctgcac

SEQ ID NO: 2892399 - DNA, 19 bp, Homo sapiens
ccgagtcattcgttctgtg

SEQ ID NO: 2892400 - DNA, 13 bp, Homo sapiens
ccgagtccaagct

SEQ ID NO: 2892401 - DNA, 15 bp, Homo sapiens
ccgagtccaagctgg

SEQ ID NO: 2892402 - DNA, 13 bp, Homo sapiens
ccgagtgagtcag

SEQ ID NO: 2892403 - DNA, 23 bp, Homo sapiens
ccgagtgagtcagtgatgaggcc

SEQ ID NO: 2892404 - DNA, 16 bp, Homo sapiens
ccgagtgcggcgtgga

SEQ ID NO: 2892405 - DNA, 17 bp, Homo sapiens
ccgagtgcggcgtggag

SEQ ID NO: 2892406 - DNA, 18 bp, Homo sapiens
ccgatagagggacggcca

SEQ ID NO: 2892407 - DNA, 14 bp, Homo sapiens
ccgatgctgacctc

SEQ ID NO: 2892408 - DNA, 18 bp, Homo sapiens
ccgatggcggggatctgg

SEQ ID NO: 2892409 - DNA, 21 bp, Homo sapiens
ccgatggtgggtggggctgca

SEQ ID NO: 2892410 - DNA, 23 bp, Homo sapiens
ccgattttagagttcttttggat

SEQ ID NO: 2892411 - DNA, 17 bp, Homo sapiens
ccgcacaaagcggctct

SEQ ID NO: 2892412 - DNA, 14 bp, Homo sapiens
ccgcacctgtacag

SEQ ID NO: 2892413 - DNA, 23 bp, Homo sapiens
ccgcacctgtcggtggctgcctt

SEQ ID NO: 2892414 - DNA, 18 bp, Homo sapiens
ccgcacgcctctccctgc

SEQ ID NO: 2892415 - DNA, 15 bp, Homo sapiens
ccgcactctggcggt

SEQ ID NO: 2892416 - DNA, 14 bp, Homo sapiens
ccgcagacctctgg

SEQ ID NO: 2892417 - DNA, 12 bp, Homo sapiens
ccgcagactgct

SEQ ID NO: 2892418 - DNA, 18 bp, Homo sapiens
ccgcagactgcttggcca

SEQ ID NO: 2892419 - DNA, 12 bp, Homo sapiens
ccgcagaggcag

SEQ ID NO: 2892420 - DNA, 14 bp, Homo sapiens
ccgcagccctggca

SEQ ID NO: 2892421 - DNA, 21 bp, Homo sapiens
ccgcaggcctgccttctcagg

SEQ ID NO: 2892422 - DNA, 22 bp, Homo sapiens
ccgcagtggggtcaagctgagc

SEQ ID NO: 2892423 - DNA, 22 bp, Homo sapiens
ccgcagtgtgcactaaggggcc

SEQ ID NO: 2892424 - DNA, 15 bp, Homo sapiens
ccgcatccctgcttc

SEQ ID NO: 2892425 - DNA, 20 bp, Homo sapiens
ccgcatccctgcttctggcg

SEQ ID NO: 2892426 - DNA, 12 bp, Homo sapiens
ccgcatcttctc

SEQ ID NO: 2892427 - DNA, 19 bp, Homo sapiens
ccgcatcttctccatctgg

SEQ ID NO: 2892428 - DNA, 20 bp, Homo sapiens
ccgcatcttctccatctggc

SEQ ID NO: 2892429 - DNA, 22 bp, Homo sapiens
ccgcatcttctccatctggcag

SEQ ID NO: 2892430 - DNA, 14 bp, Homo sapiens
ccgcatggcagctg

SEQ ID NO: 2892431 - DNA, 15 bp, Homo sapiens
ccgcatggcagctgg

SEQ ID NO: 2892432 - DNA, 19 bp, Homo sapiens
ccgcatggcagctgggccc

SEQ ID NO: 2892433 - DNA, 16 bp, Homo sapiens
ccgcattccaggctcc

SEQ ID NO: 2892434 - DNA, 15 bp, Homo sapiens
ccgcattccctgagt

SEQ ID NO: 2892435 - DNA, 21 bp, Homo sapiens
ccgccaaaagctgctcaggga

SEQ ID NO: 2892436 - DNA, 12 bp, Homo sapiens
ccgccaggcgag

SEQ ID NO: 2892437 - DNA, 21 bp, Homo sapiens
ccgccaggcgctgcagggccg

SEQ ID NO: 2892438 - DNA, 20 bp, Homo sapiens
ccgccagggagacctggaca

SEQ ID NO: 2892439 - DNA, 21 bp, Homo sapiens
ccgccagggcccacaccccct

SEQ ID NO: 2892440 - DNA, 19 bp, Homo sapiens
ccgccatctgcgcagggtg

SEQ ID NO: 2892441 - DNA, 19 bp, Homo sapiens
ccgcccagctctcccacat

SEQ ID NO: 2892442 - DNA, 16 bp, Homo sapiens
ccgccccctgccctcc

SEQ ID NO: 2892443 - DNA, 18 bp, Homo sapiens
ccgccccgggctggccct

SEQ ID NO: 2892444 - DNA, 12 bp, Homo sapiens
ccgcccctgagg

SEQ ID NO: 2892445 - DNA, 15 bp, Homo sapiens
ccgccgcccgctggg

SEQ ID NO: 2892446 - DNA, 16 bp, Homo sapiens
ccgccggggtcctggg

SEQ ID NO: 2892447 - DNA, 22 bp, Homo sapiens
ccgccggggtcctgggaggctg

SEQ ID NO: 2892448 - DNA, 24 bp, Homo sapiens
ccgccggggtcctgggaggctgca

SEQ ID NO: 2892449 - DNA, 21 bp, Homo sapiens
ccgcctactgtccctctcagt

SEQ ID NO: 2892450 - DNA, 23 bp, Homo sapiens
ccgcctcaatgtggttgcaaggc

SEQ ID NO: 2892451 - DNA, 12 bp, Homo sapiens
ccgcctcagcct

SEQ ID NO: 2892452 - DNA, 13 bp, Homo sapiens
ccgcctccacact

SEQ ID NO: 2892453 - DNA, 18 bp, Homo sapiens
ccgcctcccgggaagcat

SEQ ID NO: 2892454 - DNA, 16 bp, Homo sapiens
ccgcctgcccacctgc

SEQ ID NO: 2892455 - DNA, 22 bp, Homo sapiens
ccgcctgccctcccgcaccttc

SEQ ID NO: 2892456 - DNA, 12 bp, Homo sapiens
ccgcctgcctcc

SEQ ID NO: 2892457 - DNA, 17 bp, Homo sapiens
ccgcctgcctcctggct

SEQ ID NO: 2892458 - DNA, 19 bp, Homo sapiens
ccgcctgcctcctggctca

SEQ ID NO: 2892459 - DNA, 15 bp, Homo sapiens
ccgcctgcctgccac

SEQ ID NO: 2892460 - DNA, 15 bp, Homo sapiens
ccgcctgccttagca

SEQ ID NO: 2892461 - DNA, 22 bp, Homo sapiens
ccgcctggatgcggatggccgg

SEQ ID NO: 2892462 - DNA, 22 bp, Homo sapiens
ccgcctggtactcaagcccgcg

SEQ ID NO: 2892463 - DNA, 13 bp, Homo sapiens
ccgccttccctca

SEQ ID NO: 2892464 - DNA, 22 bp, Homo sapiens
ccgccttctcccttctctcacc

SEQ ID NO: 2892465 - DNA, 17 bp, Homo sapiens
ccgccttggccttgcag

SEQ ID NO: 2892466 - DNA, 22 bp, Homo sapiens
ccgccttggccttgcagctggc

SEQ ID NO: 2892467 - DNA, 23 bp, Homo sapiens
ccgcctttacaagggagaagaca

SEQ ID NO: 2892468 - DNA, 12 bp, Homo sapiens
ccgcgagaggcc

SEQ ID NO: 2892469 - DNA, 14 bp, Homo sapiens
ccgcgccctccctc

SEQ ID NO: 2892470 - DNA, 17 bp, Homo sapiens
ccgcgccctccgacctc

SEQ ID NO: 2892471 - DNA, 17 bp, Homo sapiens
ccgcgcgtccagctgcc

SEQ ID NO: 2892472 - DNA, 18 bp, Homo sapiens
ccgcggacgtgctggcct

SEQ ID NO: 2892473 - DNA, 19 bp, Homo sapiens
ccgcggacgtgctggcctt

SEQ ID NO: 2892474 - DNA, 12 bp, Homo sapiens
ccgcggcccaga

SEQ ID NO: 2892475 - DNA, 16 bp, Homo sapiens
ccgcggcctgcaccga

SEQ ID NO: 2892476 - DNA, 17 bp, Homo sapiens
ccgcggcctgcaccgac

SEQ ID NO: 2892477 - DNA, 17 bp, Homo sapiens
ccgcgggcacagccagc

SEQ ID NO: 2892478 - DNA, 19 bp, Homo sapiens
ccgcgtccgagaaggcgga

SEQ ID NO: 2892479 - DNA, 22 bp, Homo sapiens
ccgcgtgatcaaagccacactc

SEQ ID NO: 2892480 - DNA, 14 bp, Homo sapiens
ccgcgtgccgggcc

SEQ ID NO: 2892481 - DNA, 16 bp, Homo sapiens
ccgcgtgccgggcccc

SEQ ID NO: 2892482 - DNA, 23 bp, Homo sapiens
ccgctccaggtaccttgaccttt

SEQ ID NO: 2892483 - DNA, 22 bp, Homo sapiens
ccgctcccacctagtgccccag

SEQ ID NO: 2892484 - DNA, 16 bp, Homo sapiens
ccgctctcctgccaca

SEQ ID NO: 2892485 - DNA, 13 bp, Homo sapiens
ccgctgaccctgg

SEQ ID NO: 2892486 - DNA, 22 bp, Homo sapiens
ccgctgaccctgggcctggagg

SEQ ID NO: 2892487 - DNA, 23 bp, Homo sapiens
ccgctgagcgaggagatgctcct

SEQ ID NO: 2892488 - DNA, 11 bp, Homo sapiens
ccgctgccacc

SEQ ID NO: 2892489 - DNA, 12 bp, Homo sapiens
ccgctgccaccc

SEQ ID NO: 2892490 - DNA, 17 bp, Homo sapiens
ccgctgccacccacctc

SEQ ID NO: 2892491 - DNA, 17 bp, Homo sapiens
ccgctgccctgggtcct

SEQ ID NO: 2892492 - DNA, 20 bp, Homo sapiens
ccgctgccctgggtcctgcc

SEQ ID NO: 2892493 - DNA, 23 bp, Homo sapiens
ccgctgccctgggtcctgcctgc

SEQ ID NO: 2892494 - DNA, 14 bp, Homo sapiens
ccgctgctgtgcaa

SEQ ID NO: 2892495 - DNA, 21 bp, Homo sapiens
ccgctgtggccgcacgcctct

SEQ ID NO: 2892496 - DNA, 14 bp, Homo sapiens
ccgctgttcaccca

SEQ ID NO: 2892497 - DNA, 14 bp, Homo sapiens
ccgcttatcctgct

SEQ ID NO: 2892498 - DNA, 19 bp, Homo sapiens
ccgcttgaaaagctagtgt

SEQ ID NO: 2892499 - DNA, 18 bp, Homo sapiens
ccgcttggagcagagggg

SEQ ID NO: 2892500 - DNA, 16 bp, Homo sapiens
ccgcttgtccagcgcc

SEQ ID NO: 2892501 - DNA, 17 bp, Homo sapiens
ccgcttgtccagcgcct

SEQ ID NO: 2892502 - DNA, 20 bp, Homo sapiens
ccggaatgccacccacatct

SEQ ID NO: 2892503 - DNA, 22 bp, Homo sapiens
ccggacacacctctgctccaaa

SEQ ID NO: 2892504 - DNA, 16 bp, Homo sapiens
ccggacacttctcagg

SEQ ID NO: 2892505 - DNA, 14 bp, Homo sapiens
ccggagaggaccgg

SEQ ID NO: 2892506 - DNA, 23 bp, Homo sapiens
ccggagatagatgactttgcaga

SEQ ID NO: 2892507 - DNA, 16 bp, Homo sapiens
ccggagcctccagctg

SEQ ID NO: 2892508 - DNA, 18 bp, Homo sapiens
ccggagctgcccctctct

SEQ ID NO: 2892509 - DNA, 20 bp, Homo sapiens
ccggagctgcccctctctgg

SEQ ID NO: 2892510 - DNA, 23 bp, Homo sapiens
ccggagctggaggatcccctcca

SEQ ID NO: 2892511 - DNA, 21 bp, Homo sapiens
ccggaggccttggggtggggg

SEQ ID NO: 2892512 - DNA, 20 bp, Homo sapiens
ccggagggaaactgtgaatg

SEQ ID NO: 2892513 - DNA, 19 bp, Homo sapiens
ccggatgaaacttctcagt

SEQ ID NO: 2892514 - DNA, 12 bp, Homo sapiens
ccggattggccc

SEQ ID NO: 2892515 - DNA, 14 bp, Homo sapiens
ccggattggccctg

SEQ ID NO: 2892516 - DNA, 19 bp, Homo sapiens
ccggattggccctgcccct

SEQ ID NO: 2892517 - DNA, 16 bp, Homo sapiens
ccggcagcctctcttc

SEQ ID NO: 2892518 - DNA, 16 bp, Homo sapiens
ccggcagggcgggcag

SEQ ID NO: 2892519 - DNA, 17 bp, Homo sapiens
ccggcatccttgcctgt

SEQ ID NO: 2892520 - DNA, 18 bp, Homo sapiens
ccggcatccttgcctgtc

SEQ ID NO: 2892521 - DNA, 20 bp, Homo sapiens
ccggcatccttgcctgtcta

SEQ ID NO: 2892522 - DNA, 15 bp, Homo sapiens
ccggccagccatgtc

SEQ ID NO: 2892523 - DNA, 13 bp, Homo sapiens
ccggcccctcacc

SEQ ID NO: 2892524 - DNA, 19 bp, Homo sapiens
ccggcccctcaccctctgt

SEQ ID NO: 2892525 - DNA, 22 bp, Homo sapiens
ccggcccctcaccctctgtccc

SEQ ID NO: 2892526 - DNA, 17 bp, Homo sapiens
ccggcccctccccctga

SEQ ID NO: 2892527 - DNA, 16 bp, Homo sapiens
ccggccctgcccctcc

SEQ ID NO: 2892528 - DNA, 15 bp, Homo sapiens
ccggccgctccacca

SEQ ID NO: 2892529 - DNA, 21 bp, Homo sapiens
ccggcctgggtgacagagtga

SEQ ID NO: 2892530 - DNA, 22 bp, Homo sapiens
ccggcctgggtgacagagtgag

SEQ ID NO: 2892531 - DNA, 15 bp, Homo sapiens
ccggcgagccctgtg

SEQ ID NO: 2892532 - DNA, 12 bp, Homo sapiens
ccggcgcctgcc

SEQ ID NO: 2892533 - DNA, 16 bp, Homo sapiens
ccggcgcctgccctgc

SEQ ID NO: 2892534 - DNA, 20 bp, Homo sapiens
ccggcgcctgccctgcccaa

SEQ ID NO: 2892535 - DNA, 20 bp, Homo sapiens
ccggcggaaagcctctgtcc

SEQ ID NO: 2892536 - DNA, 21 bp, Homo sapiens
ccggcggccctgctgaagctg

SEQ ID NO: 2892537 - DNA, 16 bp, Homo sapiens
ccggcggggaccttgg

SEQ ID NO: 2892538 - DNA, 21 bp, Homo sapiens
ccggcgggtgctctgaggcct

SEQ ID NO: 2892539 - DNA, 16 bp, Homo sapiens
ccggctcggcccagca

SEQ ID NO: 2892540 - DNA, 16 bp, Homo sapiens
ccggctctggctctcc

SEQ ID NO: 2892541 - DNA, 17 bp, Homo sapiens
ccggctctggctctccc

SEQ ID NO: 2892542 - DNA, 16 bp, Homo sapiens
ccggctgaccctgtgc

SEQ ID NO: 2892543 - DNA, 12 bp, Homo sapiens
ccggctggaaat

SEQ ID NO: 2892544 - DNA, 13 bp, Homo sapiens
ccggctggcctgg

SEQ ID NO: 2892545 - DNA, 15 bp, Homo sapiens
ccggcttcctttccc

SEQ ID NO: 2892546 - DNA, 14 bp, Homo sapiens
ccggctttcagggc

SEQ ID NO: 2892547 - DNA, 17 bp, Homo sapiens
ccgggaagccaccctcc

SEQ ID NO: 2892548 - DNA, 21 bp, Homo sapiens
ccgggacaccgtggggaaggg

SEQ ID NO: 2892549 - DNA, 18 bp, Homo sapiens
ccgggaccccgagcctgg

SEQ ID NO: 2892550 - DNA, 20 bp, Homo sapiens
ccgggacccggcggccctgc

SEQ ID NO: 2892551 - DNA, 16 bp, Homo sapiens
ccgggagaagccacct

SEQ ID NO: 2892552 - DNA, 12 bp, Homo sapiens
ccgggagctggt

SEQ ID NO: 2892553 - DNA, 14 bp, Homo sapiens
ccgggatcctgccc

SEQ ID NO: 2892554 - DNA, 12 bp, Homo sapiens
ccgggcactccc

SEQ ID NO: 2892555 - DNA, 20 bp, Homo sapiens
ccgggcactcccgggatggg

SEQ ID NO: 2892556 - DNA, 11 bp, Homo sapiens
ccgggcagaaa

SEQ ID NO: 2892557 - DNA, 18 bp, Homo sapiens
ccgggcaggcgtgactca

SEQ ID NO: 2892558 - DNA, 17 bp, Homo sapiens
ccgggcaggggagccag

SEQ ID NO: 2892559 - DNA, 19 bp, Homo sapiens
ccgggcaggggagccaggg

SEQ ID NO: 2892560 - DNA, 14 bp, Homo sapiens
ccgggcatgatggt

SEQ ID NO: 2892561 - DNA, 14 bp, Homo sapiens
ccgggcatggtggc

SEQ ID NO: 2892562 - DNA, 22 bp, Homo sapiens
ccgggcatggtggcgcaagcct

SEQ ID NO: 2892563 - DNA, 20 bp, Homo sapiens
ccgggcatgtctgcctggag

SEQ ID NO: 2892564 - DNA, 15 bp, Homo sapiens
ccgggcccccaccgc

SEQ ID NO: 2892565 - DNA, 17 bp, Homo sapiens
ccgggctggccctgtgc

SEQ ID NO: 2892566 - DNA, 19 bp, Homo sapiens
ccgggctggccctgtgcag

SEQ ID NO: 2892567 - DNA, 21 bp, Homo sapiens
ccgggctggctgcttgcagcc

SEQ ID NO: 2892568 - DNA, 23 bp, Homo sapiens
ccgggctggctgcttgcagccag

SEQ ID NO: 2892569 - DNA, 12 bp, Homo sapiens
ccggggaggggg

SEQ ID NO: 2892570 - DNA, 17 bp, Homo sapiens
ccggggagggggcacgg

SEQ ID NO: 2892571 - DNA, 12 bp, Homo sapiens
ccggggcccagg

SEQ ID NO: 2892572 - DNA, 13 bp, Homo sapiens
ccggggcccaggg

SEQ ID NO: 2892573 - DNA, 15 bp, Homo sapiens
ccggggcctgggcag

SEQ ID NO: 2892574 - DNA, 19 bp, Homo sapiens
ccggggcctgggcaggagg

SEQ ID NO: 2892575 - DNA, 15 bp, Homo sapiens
ccggggcgcctagag

SEQ ID NO: 2892576 - DNA, 20 bp, Homo sapiens
ccggggcgcctagagcgcgg

SEQ ID NO: 2892577 - DNA, 21 bp, Homo sapiens
ccgggggcagtctgagagagg

SEQ ID NO: 2892578 - DNA, 16 bp, Homo sapiens
ccgggggtggctctgt

SEQ ID NO: 2892579 - DNA, 16 bp, Homo sapiens
ccggggtcctgggagg

SEQ ID NO: 2892580 - DNA, 18 bp, Homo sapiens
ccggggttcagcctcctg

SEQ ID NO: 2892581 - DNA, 21 bp, Homo sapiens
ccgggttcacgccattctcct

SEQ ID NO: 2892582 - DNA, 12 bp, Homo sapiens
ccgggttccagc

SEQ ID NO: 2892583 - DNA, 16 bp, Homo sapiens
ccgggttctcctgatt

SEQ ID NO: 2892584 - DNA, 22 bp, Homo sapiens
ccggtaaacacgcctgcaaacg

SEQ ID NO: 2892585 - DNA, 13 bp, Homo sapiens
ccggtccccacag

SEQ ID NO: 2892586 - DNA, 22 bp, Homo sapiens
ccggtctatgtcgagagctggc

SEQ ID NO: 2892587 - DNA, 18 bp, Homo sapiens
ccggtggcggccccagca

SEQ ID NO: 2892588 - DNA, 20 bp, Homo sapiens
ccggtggcggccccagcacc

SEQ ID NO: 2892589 - DNA, 22 bp, Homo sapiens
ccggtgggtccgcatccctgct

SEQ ID NO: 2892590 - DNA, 17 bp, Homo sapiens
ccggttcccacaagcct

SEQ ID NO: 2892591 - DNA, 14 bp, Homo sapiens
ccgtaatcccagct

SEQ ID NO: 2892592 - DNA, 15 bp, Homo sapiens
ccgtaatcccagcta

SEQ ID NO: 2892593 - DNA, 16 bp, Homo sapiens
ccgtagttattttgca

SEQ ID NO: 2892594 - DNA, 15 bp, Homo sapiens
ccgtagttccctgaa

SEQ ID NO: 2892595 - DNA, 22 bp, Homo sapiens
ccgtagttccctgaaaacccag

SEQ ID NO: 2892596 - DNA, 22 bp, Homo sapiens
ccgtcaaaacagattgtttgca

SEQ ID NO: 2892597 - DNA, 14 bp, Homo sapiens
ccgtcaacgttgta

SEQ ID NO: 2892598 - DNA, 17 bp, Homo sapiens
ccgtcaacgttgtactg

SEQ ID NO: 2892599 - DNA, 20 bp, Homo sapiens
ccgtcacgtgcgctgggcac

SEQ ID NO: 2892600 - DNA, 10 bp, Homo sapiens
ccgtccctga

SEQ ID NO: 2892601 - DNA, 13 bp, Homo sapiens
ccgtcggagctgc

SEQ ID NO: 2892602 - DNA, 15 bp, Homo sapiens
ccgtcggagctgcct

SEQ ID NO: 2892603 - DNA, 17 bp, Homo sapiens
ccgtcggagctgcctgc

SEQ ID NO: 2892604 - DNA, 15 bp, Homo sapiens
ccgtctcccttggcc

SEQ ID NO: 2892605 - DNA, 14 bp, Homo sapiens
ccgtctctactaaa

SEQ ID NO: 2892606 - DNA, 20 bp, Homo sapiens
ccgtctggggttcagcccct

SEQ ID NO: 2892607 - DNA, 13 bp, Homo sapiens
ccgtctgtccatc

SEQ ID NO: 2892608 - DNA, 15 bp, Homo sapiens
ccgtctgtccatctg

SEQ ID NO: 2892609 - DNA, 16 bp, Homo sapiens
ccgtctgtccatctgc

SEQ ID NO: 2892610 - DNA, 11 bp, Homo sapiens
ccgtctgtcct

SEQ ID NO: 2892611 - DNA, 13 bp, Homo sapiens
ccgtctgtcctca

SEQ ID NO: 2892612 - DNA, 23 bp, Homo sapiens
ccgtctgtctgtctagtgtctgg

SEQ ID NO: 2892613 - DNA, 15 bp, Homo sapiens
ccgtgagcatgtttg

SEQ ID NO: 2892614 - DNA, 18 bp, Homo sapiens
ccgtgaggctgctgccat

SEQ ID NO: 2892615 - DNA, 15 bp, Homo sapiens
ccgtgatagaaaaaa

SEQ ID NO: 2892616 - DNA, 23 bp, Homo sapiens
ccgtgatgtagggtaaggtgcct

SEQ ID NO: 2892617 - DNA, 14 bp, Homo sapiens
ccgtgccaacccca

SEQ ID NO: 2892618 - DNA, 17 bp, Homo sapiens
ccgtgccacccccagcc

SEQ ID NO: 2892619 - DNA, 17 bp, Homo sapiens
ccgtgccgcctgcactc

SEQ ID NO: 2892620 - DNA, 18 bp, Homo sapiens
ccgtgcctgggcccctcc

SEQ ID NO: 2892621 - DNA, 16 bp, Homo sapiens
ccgtgctcgccccagc

SEQ ID NO: 2892622 - DNA, 18 bp, Homo sapiens
ccgtgctgacagctgctc

SEQ ID NO: 2892623 - DNA, 19 bp, Homo sapiens
ccgtgctgacagctgctcc

SEQ ID NO: 2892624 - DNA, 21 bp, Homo sapiens
ccgtgctgacagctgctccta

SEQ ID NO: 2892625 - DNA, 13 bp, Homo sapiens
ccgtggactgcag

SEQ ID NO: 2892626 - DNA, 16 bp, Homo sapiens
ccgtggcctggcatct

SEQ ID NO: 2892627 - DNA, 18 bp, Homo sapiens
ccgtggcctggcatctgt

SEQ ID NO: 2892628 - DNA, 23 bp, Homo sapiens
ccgtggcttgggctggtcagagt

SEQ ID NO: 2892629 - DNA, 13 bp, Homo sapiens
ccgtggggcaggg

SEQ ID NO: 2892630 - DNA, 15 bp, Homo sapiens
ccgtggggcagggag

SEQ ID NO: 2892631 - DNA, 23 bp, Homo sapiens
ccgtggggcagggagctgggccc

SEQ ID NO: 2892632 - DNA, 18 bp, Homo sapiens
ccgtgggttgctaactga

SEQ ID NO: 2892633 - DNA, 23 bp, Homo sapiens
ccgtgtgggctttaaaagaaaaa

SEQ ID NO: 2892634 - DNA, 18 bp, Homo sapiens
ccgtgtgtttagaagcct

SEQ ID NO: 2892635 - DNA, 13 bp, Homo sapiens
ccgttactctcca

SEQ ID NO: 2892636 - DNA, 17 bp, Homo sapiens
ccgttactctccaacct

SEQ ID NO: 2892637 - DNA, 20 bp, Homo sapiens
ccgttgtttacttaaagatt

SEQ ID NO: 2892638 - DNA, 13 bp, Homo sapiens
ccgtttgcttttg

SEQ ID NO: 2892639 - DNA, 23 bp, Homo sapiens
ccgtttttcaagaaaactggaaa

SEQ ID NO: 2892640 - DNA, 14 bp, Homo sapiens
cctaaaaacacaga

SEQ ID NO: 2892641 - DNA, 18 bp, Homo sapiens
cctaaaagcacactcatc

SEQ ID NO: 2892642 - DNA, 16 bp, Homo sapiens
cctaaaccaaaaactg

SEQ ID NO: 2892643 - DNA, 21 bp, Homo sapiens
cctaaaccaaaaactgaaagt

SEQ ID NO: 2892644 - DNA, 18 bp, Homo sapiens
cctaaagagttattcaaa

SEQ ID NO: 2892645 - DNA, 18 bp, Homo sapiens
cctaaagatgggaggaga

SEQ ID NO: 2892646 - DNA, 14 bp, Homo sapiens
cctaaatttattaa

SEQ ID NO: 2892647 - DNA, 15 bp, Homo sapiens
cctaacaggctgtag

SEQ ID NO: 2892648 - DNA, 11 bp, Homo sapiens
cctaaccacta

SEQ ID NO: 2892649 - DNA, 15 bp, Homo sapiens
cctaacccctttcct

SEQ ID NO: 2892650 - DNA, 11 bp, Homo sapiens
cctaactgtat

SEQ ID NO: 2892651 - DNA, 20 bp, Homo sapiens
cctaacttattgcctgggca

SEQ ID NO: 2892652 - DNA, 17 bp, Homo sapiens
cctaacttcgtattttt

SEQ ID NO: 2892653 - DNA, 12 bp, Homo sapiens
cctaagacatgt

SEQ ID NO: 2892654 - DNA, 15 bp, Homo sapiens
cctaagacctggggt

SEQ ID NO: 2892655 - DNA, 20 bp, Homo sapiens
cctaagactaatgctttctg

SEQ ID NO: 2892656 - DNA, 20 bp, Homo sapiens
cctaagaggtttttcctctt

SEQ ID NO: 2892657 - DNA, 16 bp, Homo sapiens
cctaaggccactgttt

SEQ ID NO: 2892658 - DNA, 18 bp, Homo sapiens
cctaaggccactgtttta

SEQ ID NO: 2892659 - DNA, 19 bp, Homo sapiens
cctaagggtcgaaagctct

SEQ ID NO: 2892660 - DNA, 22 bp, Homo sapiens
cctaagggtcgaaagctctaga

SEQ ID NO: 2892661 - DNA, 23 bp, Homo sapiens
cctaagggtcgaaagctctagaa

SEQ ID NO: 2892662 - DNA, 20 bp, Homo sapiens
cctaagtttcagttgatttt

SEQ ID NO: 2892663 - DNA, 17 bp, Homo sapiens
cctaatatcaaatgcag

SEQ ID NO: 2892664 - DNA, 18 bp, Homo sapiens
cctaatcaagagtctctc

SEQ ID NO: 2892665 - DNA, 13 bp, Homo sapiens
cctaatccaggca

SEQ ID NO: 2892666 - DNA, 20 bp, Homo sapiens
cctaatccaggcagatccag

SEQ ID NO: 2892667 - DNA, 22 bp, Homo sapiens
cctaatccctgggcattgcttt

SEQ ID NO: 2892668 - DNA, 19 bp, Homo sapiens
cctaatgatgacttgagcc

SEQ ID NO: 2892669 - DNA, 14 bp, Homo sapiens
cctaattcatcttt

SEQ ID NO: 2892670 - DNA, 15 bp, Homo sapiens
cctaattcatctttt

SEQ ID NO: 2892671 - DNA, 13 bp, Homo sapiens
cctacaataaact

SEQ ID NO: 2892672 - DNA, 15 bp, Homo sapiens
cctacactgatgcaa

SEQ ID NO: 2892673 - DNA, 15 bp, Homo sapiens
cctacagcccacctg

SEQ ID NO: 2892674 - DNA, 18 bp, Homo sapiens
cctacagggggtggagag

SEQ ID NO: 2892675 - DNA, 14 bp, Homo sapiens
cctacatgttattc

SEQ ID NO: 2892676 - DNA, 13 bp, Homo sapiens
cctaccacctccc

SEQ ID NO: 2892677 - DNA, 19 bp, Homo sapiens
cctacccatccccgcagtg

SEQ ID NO: 2892678 - DNA, 16 bp, Homo sapiens
cctacccctgccctgc

SEQ ID NO: 2892679 - DNA, 23 bp, Homo sapiens
cctaccgcatggcagctgggccc

SEQ ID NO: 2892680 - DNA, 15 bp, Homo sapiens
cctaccttccccaga

SEQ ID NO: 2892681 - DNA, 15 bp, Homo sapiens
cctaccttgcctcct

SEQ ID NO: 2892682 - DNA, 20 bp, Homo sapiens
cctacgtcaaacatgaagtg

SEQ ID NO: 2892683 - DNA, 21 bp, Homo sapiens
cctacgtcaaacatgaagtgt

SEQ ID NO: 2892684 - DNA, 17 bp, Homo sapiens
cctactccgctcactga

SEQ ID NO: 2892685 - DNA, 22 bp, Homo sapiens
cctactctgtgtaaatattttt

SEQ ID NO: 2892686 - DNA, 13 bp, Homo sapiens
cctactgactgat

SEQ ID NO: 2892687 - DNA, 14 bp, Homo sapiens
cctactgtccctct

SEQ ID NO: 2892688 - DNA, 13 bp, Homo sapiens
cctactgttctaa

SEQ ID NO: 2892689 - DNA, 16 bp, Homo sapiens
cctactgttctaaagc

SEQ ID NO: 2892690 - DNA, 19 bp, Homo sapiens
cctactgttctaaagctct

SEQ ID NO: 2892691 - DNA, 22 bp, Homo sapiens
cctactgttctaaagctctgac

SEQ ID NO: 2892692 - DNA, 21 bp, Homo sapiens
cctacttcattttcagagtga

SEQ ID NO: 2892693 - DNA, 14 bp, Homo sapiens
cctactttctattt

SEQ ID NO: 2892694 - DNA, 20 bp, Homo sapiens
cctagaaatgtagcagcagc

SEQ ID NO: 2892695 - DNA, 23 bp, Homo sapiens
cctagaagtaagaagaggagcct

SEQ ID NO: 2892696 - DNA, 22 bp, Homo sapiens
cctagagacagtgatgcctgcc

SEQ ID NO: 2892697 - DNA, 17 bp, Homo sapiens
cctagagcactctcacc

SEQ ID NO: 2892698 - DNA, 21 bp, Homo sapiens
cctagagcgcggctggctctg

SEQ ID NO: 2892699 - DNA, 14 bp, Homo sapiens
cctagatccaggct

SEQ ID NO: 2892700 - DNA, 15 bp, Homo sapiens
cctagatccaggctt

SEQ ID NO: 2892701 - DNA, 22 bp, Homo sapiens
cctagatccaggcttctcccgg

SEQ ID NO: 2892702 - DNA, 14 bp, Homo sapiens
cctagatcctaagg

SEQ ID NO: 2892703 - DNA, 17 bp, Homo sapiens
cctagcagcccaccctg

SEQ ID NO: 2892704 - DNA, 12 bp, Homo sapiens
cctagccaccca

SEQ ID NO: 2892705 - DNA, 13 bp, Homo sapiens
cctagccattctg

SEQ ID NO: 2892706 - DNA, 13 bp, Homo sapiens
cctagccctggga

SEQ ID NO: 2892707 - DNA, 15 bp, Homo sapiens
cctagccctgggaca

SEQ ID NO: 2892708 - DNA, 23 bp, Homo sapiens
cctagctcttgggcctgacctcc

SEQ ID NO: 2892709 - DNA, 14 bp, Homo sapiens
cctagctgacgcca

SEQ ID NO: 2892710 - DNA, 16 bp, Homo sapiens
cctagcttatctccct

SEQ ID NO: 2892711 - DNA, 19 bp, Homo sapiens
cctagcttatctccctgct

SEQ ID NO: 2892712 - DNA, 22 bp, Homo sapiens
cctagcttatctccctgcttca

SEQ ID NO: 2892713 - DNA, 20 bp, Homo sapiens
cctaggagtgccccattctt

SEQ ID NO: 2892714 - DNA, 16 bp, Homo sapiens
cctaggatttcagcca

SEQ ID NO: 2892715 - DNA, 19 bp, Homo sapiens
cctaggcagtaggccggtg

SEQ ID NO: 2892716 - DNA, 19 bp, Homo sapiens
cctaggccactcctccaaa

SEQ ID NO: 2892717 - DNA, 22 bp, Homo sapiens
cctaggctaggacgttggcctc

SEQ ID NO: 2892718 - DNA, 16 bp, Homo sapiens
cctaggctagggtggg

SEQ ID NO: 2892719 - DNA, 22 bp, Homo sapiens
cccctgagtccgcctgcgcctc

SEQ ID NO: 2892720 - DNA, 13 bp, Homo sapiens
cccctgcacagtt

SEQ ID NO: 2892721 - DNA, 14 bp, Homo sapiens
cccctgccagtgcc

SEQ ID NO: 2892722 - DNA, 15 bp, Homo sapiens
cccctgccctgctcc

SEQ ID NO: 2892723 - DNA, 12 bp, Homo sapiens
cccctgccgcct

SEQ ID NO: 2892724 - DNA, 15 bp, Homo sapiens
cccctgccgcctccc

SEQ ID NO: 2892725 - DNA, 22 bp, Homo sapiens
cccctgcctcgagggccgcctg

SEQ ID NO: 2892726 - DNA, 15 bp, Homo sapiens
cccctgcctttggga

SEQ ID NO: 2892727 - DNA, 19 bp, Homo sapiens
cccctgctgtctctctggg

SEQ ID NO: 2892728 - DNA, 12 bp, Homo sapiens
cccctggaacct

SEQ ID NO: 2892729 - DNA, 17 bp, Homo sapiens
cccctggaacctttccc

SEQ ID NO: 2892730 - DNA, 22 bp, Homo sapiens
cccctggagtgtgtcagagccc

SEQ ID NO: 2892731 - DNA, 18 bp, Homo sapiens
cccctggcagctgcccct

SEQ ID NO: 2892732 - DNA, 11 bp, Homo sapiens
cccctggcagt

SEQ ID NO: 2892733 - DNA, 19 bp, Homo sapiens
cccctggctgaacagtgct

SEQ ID NO: 2892734 - DNA, 21 bp, Homo sapiens
cccctggctgaacagtgctct

SEQ ID NO: 2892735 - DNA, 15 bp, Homo sapiens
cccctggggctggtg

SEQ ID NO: 2892736 - DNA, 19 bp, Homo sapiens
cccctgggggctctcatgt

SEQ ID NO: 2892737 - DNA, 13 bp, Homo sapiens
cccctggggtggc

SEQ ID NO: 2892738 - DNA, 19 bp, Homo sapiens
cccctggggtggccaccag

SEQ ID NO: 2892739 - DNA, 16 bp, Homo sapiens
cccctggtaagcagag

SEQ ID NO: 2892740 - DNA, 23 bp, Homo sapiens
cccctgtgcctctgtcctagact

SEQ ID NO: 2892741 - DNA, 20 bp, Homo sapiens
cccctgtttcaatcactgtc

SEQ ID NO: 2892742 - DNA, 16 bp, Homo sapiens
ccccttaagccctggc

SEQ ID NO: 2892743 - DNA, 21 bp, Homo sapiens
ccccttaccccaaagagaaag

SEQ ID NO: 2892744 - DNA, 15 bp, Homo sapiens
ccccttactgagcgc

SEQ ID NO: 2892745 - DNA, 11 bp, Homo sapiens
ccccttcccac

SEQ ID NO: 2892746 - DNA, 15 bp, Homo sapiens
ccccttgcccttcct

SEQ ID NO: 2892747 - DNA, 17 bp, Homo sapiens
ccccttgcccttcctga

SEQ ID NO: 2892748 - DNA, 13 bp, Homo sapiens
ccccttgtccctg

SEQ ID NO: 2892749 - DNA, 17 bp, Homo sapiens
ccccttgtccctggggc

SEQ ID NO: 2892750 - DNA, 15 bp, Homo sapiens
cccctttgggccctg

SEQ ID NO: 2892751 - DNA, 17 bp, Homo sapiens
cccctttggttttacta

SEQ ID NO: 2892752 - DNA, 15 bp, Homo sapiens
cccgaagggccccca

SEQ ID NO: 2892753 - DNA, 16 bp, Homo sapiens
cccgacaccagaagct

SEQ ID NO: 2892754 - DNA, 12 bp, Homo sapiens
cccgacagaggg

SEQ ID NO: 2892755 - DNA, 19 bp, Homo sapiens
cccgacccccgcagaggca

SEQ ID NO: 2892756 - DNA, 18 bp, Homo sapiens
cccgactcaccttgtgtg

SEQ ID NO: 2892757 - DNA, 16 bp, Homo sapiens
cccgactgcctgtctc

SEQ ID NO: 2892758 - DNA, 12 bp, Homo sapiens
cccgaggagggg

SEQ ID NO: 2892759 - DNA, 14 bp, Homo sapiens
cccgaggccctgca

SEQ ID NO: 2892760 - DNA, 16 bp, Homo sapiens
cccgaggccctgcatg

SEQ ID NO: 2892761 - DNA, 12 bp, Homo sapiens
cccgaggctgcc

SEQ ID NO: 2892762 - DNA, 13 bp, Homo sapiens
cccgaggctgccc

SEQ ID NO: 2892763 - DNA, 18 bp, Homo sapiens
cccgagggctcagaagag

SEQ ID NO: 2892764 - DNA, 18 bp, Homo sapiens
cccgaggttgtggggagg

SEQ ID NO: 2892765 - DNA, 18 bp, Homo sapiens
cccgagtgcggcgtggag

SEQ ID NO: 2892766 - DNA, 14 bp, Homo sapiens
cccgcacctgtctg

SEQ ID NO: 2892767 - DNA, 12 bp, Homo sapiens
cccgcagaggca

SEQ ID NO: 2892768 - DNA, 19 bp, Homo sapiens
cccgcagcctggcatctgt

SEQ ID NO: 2892769 - DNA, 19 bp, Homo sapiens
cccgcaggcctgccttctc

SEQ ID NO: 2892770 - DNA, 16 bp, Homo sapiens
cccgcattccaggctc

SEQ ID NO: 2892771 - DNA, 15 bp, Homo sapiens
cccgccaaaagctgc

SEQ ID NO: 2892772 - DNA, 23 bp, Homo sapiens
cccgccacatggtgtggccatca

SEQ ID NO: 2892773 - DNA, 17 bp, Homo sapiens
cccgccccctccctata

SEQ ID NO: 2892774 - DNA, 16 bp, Homo sapiens
cccgccccctgccctc

SEQ ID NO: 2892775 - DNA, 17 bp, Homo sapiens
cccgccccgggctggcc

SEQ ID NO: 2892776 - DNA, 17 bp, Homo sapiens
cccgccctcaggctccg

SEQ ID NO: 2892777 - DNA, 14 bp, Homo sapiens
cccgccctctctca

SEQ ID NO: 2892778 - DNA, 12 bp, Homo sapiens
cccgcctcagcc

SEQ ID NO: 2892779 - DNA, 13 bp, Homo sapiens
cccgcctcagcct

SEQ ID NO: 2892780 - DNA, 18 bp, Homo sapiens
cccgcctcagcctctcaa

SEQ ID NO: 2892781 - DNA, 13 bp, Homo sapiens
cccgcctgcccac

SEQ ID NO: 2892782 - DNA, 16 bp, Homo sapiens
cccgcctgcccacctg

SEQ ID NO: 2892783 - DNA, 11 bp, Homo sapiens
cccgcctgcct

SEQ ID NO: 2892784 - DNA, 17 bp, Homo sapiens
cccgcctgcctcctggc

SEQ ID NO: 2892785 - DNA, 12 bp, Homo sapiens
cccgccttccct

SEQ ID NO: 2892786 - DNA, 13 bp, Homo sapiens
cccgcgatgccct

SEQ ID NO: 2892787 - DNA, 15 bp, Homo sapiens
cccgcgccctccctc

SEQ ID NO: 2892788 - DNA, 13 bp, Homo sapiens
cccgcggcctgca

SEQ ID NO: 2892789 - DNA, 20 bp, Homo sapiens
cccgcgggcacagccagccc

SEQ ID NO: 2892790 - DNA, 16 bp, Homo sapiens
cccgctccgtctctgt

SEQ ID NO: 2892791 - DNA, 12 bp, Homo sapiens
cccgctgctgtg

SEQ ID NO: 2892792 - DNA, 23 bp, Homo sapiens
cccgctggggaccggttcccaca

SEQ ID NO: 2892793 - DNA, 17 bp, Homo sapiens
cccgcttagcgctctgg

SEQ ID NO: 2892794 - DNA, 22 bp, Homo sapiens
cccgcttagcgctctggacaga

SEQ ID NO: 2892795 - DNA, 14 bp, Homo sapiens
cccgcttgtccagc

SEQ ID NO: 2892796 - DNA, 18 bp, Homo sapiens
cccgcttgtccagcgcct

SEQ ID NO: 2892797 - DNA, 14 bp, Homo sapiens
cccggaacaagcct

SEQ ID NO: 2892798 - DNA, 17 bp, Homo sapiens
cccggagctgcccctct

SEQ ID NO: 2892799 - DNA, 20 bp, Homo sapiens
cccggagggaaactgtgaat

SEQ ID NO: 2892800 - DNA, 21 bp, Homo sapiens
cccggagggaaactgtgaatg

SEQ ID NO: 2892801 - DNA, 12 bp, Homo sapiens
cccggcagggcg

SEQ ID NO: 2892802 - DNA, 21 bp, Homo sapiens
cccggcagggcgggcagaggg

SEQ ID NO: 2892803 - DNA, 20 bp, Homo sapiens
cccggcatgagactcagtgc

SEQ ID NO: 2892804 - DNA, 23 bp, Homo sapiens
cccggcatgagactcagtgcaga

SEQ ID NO: 2892805 - DNA, 14 bp, Homo sapiens
cccggcccctcacc

SEQ ID NO: 2892806 - DNA, 14 bp, Homo sapiens
cccggcgcctgccc

SEQ ID NO: 2892807 - DNA, 16 bp, Homo sapiens
cccggcgcctggcctc

SEQ ID NO: 2892808 - DNA, 13 bp, Homo sapiens
cctaggggccagg

SEQ ID NO: 2892809 - DNA, 14 bp, Homo sapiens
cctagggtgggaag

SEQ ID NO: 2892810 - DNA, 21 bp, Homo sapiens
cctaggtgcagctcctcagcg

SEQ ID NO: 2892811 - DNA, 16 bp, Homo sapiens
cctagtcgggcagggc

SEQ ID NO: 2892812 - DNA, 20 bp, Homo sapiens
cctagtcgggcagggcccct

SEQ ID NO: 2892813 - DNA, 21 bp, Homo sapiens
cctagtcgggcagggcccctg

SEQ ID NO: 2892814 - DNA, 19 bp, Homo sapiens
cctagtgaaggcttctctc

SEQ ID NO: 2892815 - DNA, 16 bp, Homo sapiens
cctagttggtgagaaa

SEQ ID NO: 2892816 - DNA, 15 bp, Homo sapiens
cctagttttcctact

SEQ ID NO: 2892817 - DNA, 12 bp, Homo sapiens
cctataaaacag

SEQ ID NO: 2892818 - DNA, 16 bp, Homo sapiens
cctataatcccagcta

SEQ ID NO: 2892819 - DNA, 20 bp, Homo sapiens
cctatagaaatgtattttga

SEQ ID NO: 2892820 - DNA, 21 bp, Homo sapiens
cctatagaaatgtattttgaa

SEQ ID NO: 2892821 - DNA, 13 bp, Homo sapiens
cctatatatttct

SEQ ID NO: 2892822 - DNA, 16 bp, Homo sapiens
cctatcacctatttcc

SEQ ID NO: 2892823 - DNA, 12 bp, Homo sapiens
cctatccaccca

SEQ ID NO: 2892824 - DNA, 14 bp, Homo sapiens
cctatccacccagc

SEQ ID NO: 2892825 - DNA, 18 bp, Homo sapiens
cctatccacccagcccat

SEQ ID NO: 2892826 - DNA, 21 bp, Homo sapiens
cctatccacccagcccattct

SEQ ID NO: 2892827 - DNA, 22 bp, Homo sapiens
cctatctgtttacagtgttccg

SEQ ID NO: 2892828 - DNA, 13 bp, Homo sapiens
cctatcttgtgaa

SEQ ID NO: 2892829 - DNA, 21 bp, Homo sapiens
cctatgaagtaaagaactgca

SEQ ID NO: 2892830 - DNA, 11 bp, Homo sapiens
cctatggaaac

SEQ ID NO: 2892831 - DNA, 16 bp, Homo sapiens
cctatggaatttataa

SEQ ID NO: 2892832 - DNA, 14 bp, Homo sapiens
cctatgtatttgca

SEQ ID NO: 2892833 - DNA, 14 bp, Homo sapiens
cctatgtctcagga

SEQ ID NO: 2892834 - DNA, 15 bp, Homo sapiens
cctatgtctcaggag

SEQ ID NO: 2892835 - DNA, 16 bp, Homo sapiens
cctattacttttcatc

SEQ ID NO: 2892836 - DNA, 19 bp, Homo sapiens
cctattccagtgtccatgt

SEQ ID NO: 2892837 - DNA, 22 bp, Homo sapiens
cctattgcaaaggttccaactg

SEQ ID NO: 2892838 - DNA, 20 bp, Homo sapiens
cctattgccaggaatgtttc

SEQ ID NO: 2892839 - DNA, 21 bp, Homo sapiens
cctattgccaggaatgtttca

SEQ ID NO: 2892840 - DNA, 21 bp, Homo sapiens
cctattggtgttatgtttatg

SEQ ID NO: 2892841 - DNA, 17 bp, Homo sapiens
cctattgtgactcttct

SEQ ID NO: 2892842 - DNA, 22 bp, Homo sapiens
cctattgtgactcttctaaaaa

SEQ ID NO: 2892843 - DNA, 19 bp, Homo sapiens
cctcaaaaagcagaaggag

SEQ ID NO: 2892844 - DNA, 21 bp, Homo sapiens
cctcaaatacatacctactga

SEQ ID NO: 2892845 - DNA, 17 bp, Homo sapiens
cctcaacctcttctggc

SEQ ID NO: 2892846 - DNA, 21 bp, Homo sapiens
cctcaactccaccctctgcga

SEQ ID NO: 2892847 - DNA, 15 bp, Homo sapiens
cctcaagtaaaagaa

SEQ ID NO: 2892848 - DNA, 18 bp, Homo sapiens
cctcaagtgatcctccca

SEQ ID NO: 2892849 - DNA, 16 bp, Homo sapiens
cctcaagttccagtgc

SEQ ID NO: 2892850 - DNA, 20 bp, Homo sapiens
cctcaatgtgaatcagaccc

SEQ ID NO: 2892851 - DNA, 23 bp, Homo sapiens
ccaggaagaatggtgtgtttccc

SEQ ID NO: 2892852 - DNA, 13 bp, Homo sapiens
ccaggaagcaggg

SEQ ID NO: 2892853 - DNA, 18 bp, Homo sapiens
ccaggaagcccactgcct

SEQ ID NO: 2892854 - DNA, 15 bp, Homo sapiens
ccaggaagccgtgcc

SEQ ID NO: 2892855 - DNA, 20 bp, Homo sapiens
ccaggaagccgtgccctgcc

SEQ ID NO: 2892856 - DNA, 18 bp, Homo sapiens
ccaggaaggacagactgg

SEQ ID NO: 2892857 - DNA, 21 bp, Homo sapiens
ccaggaaggacagactggccg

SEQ ID NO: 2892858 - DNA, 23 bp, Homo sapiens
ccaggaagggagggagctgaggc

SEQ ID NO: 2892859 - DNA, 20 bp, Homo sapiens
ccaggaatgtttcagctgca

SEQ ID NO: 2892860 - DNA, 23 bp, Homo sapiens
ccaggaatgtttcagctgcagtt

SEQ ID NO: 2892861 - DNA, 14 bp, Homo sapiens
ccaggaatttccca

SEQ ID NO: 2892862 - DNA, 19 bp, Homo sapiens
ccaggaatttcccaggacc

SEQ ID NO: 2892863 - DNA, 21 bp, Homo sapiens
ccaggaatttcccaggaccct

SEQ ID NO: 2892864 - DNA, 14 bp, Homo sapiens
ccaggacaggacca

SEQ ID NO: 2892865 - DNA, 13 bp, Homo sapiens
ccaggacaggccc

SEQ ID NO: 2892866 - DNA, 13 bp, Homo sapiens
ccaggaccagctc

SEQ ID NO: 2892867 - DNA, 14 bp, Homo sapiens
ccaggaccagctca

SEQ ID NO: 2892868 - DNA, 17 bp, Homo sapiens
ccaggaccagctcagga

SEQ ID NO: 2892869 - DNA, 23 bp, Homo sapiens
ccaggaccagtcaacctgggcaa

SEQ ID NO: 2892870 - DNA, 23 bp, Homo sapiens
ccaggacccagggagaggctgtg

SEQ ID NO: 2892871 - DNA, 16 bp, Homo sapiens
ccaggacccgccagcc

SEQ ID NO: 2892872 - DNA, 17 bp, Homo sapiens
ccaggacccgccagccc

SEQ ID NO: 2892873 - DNA, 19 bp, Homo sapiens
ccaggaccctgaaggggcc

SEQ ID NO: 2892874 - DNA, 23 bp, Homo sapiens
ccaggaccctgaaggggccatga

SEQ ID NO: 2892875 - DNA, 18 bp, Homo sapiens
ccaggactctgaccccag

SEQ ID NO: 2892876 - DNA, 14 bp, Homo sapiens
cccaggatttgact

SEQ ID NO: 2892877 - DNA, 12 bp, Homo sapiens
cccaggcaggga

SEQ ID NO: 2892878 - DNA, 17 bp, Homo sapiens
cccaggcagggagacgg

SEQ ID NO: 2892879 - DNA, 16 bp, Homo sapiens
cccaggcaggtctgca

SEQ ID NO: 2892880 - DNA, 21 bp, Homo sapiens
cccaggcattgccaagggctt

SEQ ID NO: 2892881 - DNA, 18 bp, Homo sapiens
cccaggccaacagtagcc

SEQ ID NO: 2892882 - DNA, 14 bp, Homo sapiens
cccaggccagggct

SEQ ID NO: 2892883 - DNA, 15 bp, Homo sapiens
cccaggccagggctg

SEQ ID NO: 2892884 - DNA, 19 bp, Homo sapiens
cccaggccagggctgggtc

SEQ ID NO: 2892885 - DNA, 21 bp, Homo sapiens
cccaggccagggctgggtcac

SEQ ID NO: 2892886 - DNA, 23 bp, Homo sapiens
cccaggccagggctgggtcacag

SEQ ID NO: 2892887 - DNA, 13 bp, Homo sapiens
cccaggccatgtg

SEQ ID NO: 2892888 - DNA, 15 bp, Homo sapiens
cccaggccatgtggc

SEQ ID NO: 2892889 - DNA, 16 bp, Homo sapiens
cccaggccatgtggcc

SEQ ID NO: 2892890 - DNA, 18 bp, Homo sapiens
cccaggccatgtggcctg

SEQ ID NO: 2892891 - DNA, 13 bp, Homo sapiens
cccaggccccagg

SEQ ID NO: 2892892 - DNA, 18 bp, Homo sapiens
cccaggccccaggaagcc

SEQ ID NO: 2892893 - DNA, 13 bp, Homo sapiens
cccaggcctccag

SEQ ID NO: 2892894 - DNA, 16 bp, Homo sapiens
cccaggcctccagctc

SEQ ID NO: 2892895 - DNA, 18 bp, Homo sapiens
cccaggcctgccctgcta

SEQ ID NO: 2892896 - DNA, 14 bp, Homo sapiens
cccaggccttgctg

SEQ ID NO: 2892897 - DNA, 11 bp, Homo sapiens
cccaggctgga

SEQ ID NO: 2892898 - DNA, 20 bp, Homo sapiens
cccaggctggagtgcaatga

SEQ ID NO: 2892899 - DNA, 16 bp, Homo sapiens
ccactgagctctgcct

SEQ ID NO: 2892900 - DNA, 22 bp, Homo sapiens
ccactgcaagtccttttgtaaa

SEQ ID NO: 2892901 - DNA, 16 bp, Homo sapiens
ccactgcactccagcc

SEQ ID NO: 2892902 - DNA, 17 bp, Homo sapiens
ccactgcactccagcct

SEQ ID NO: 2892903 - DNA, 19 bp, Homo sapiens
ccactgcactccagcctgg

SEQ ID NO: 2892904 - DNA, 23 bp, Homo sapiens
ccactgcactccagcctgggtca

SEQ ID NO: 2892905 - DNA, 17 bp, Homo sapiens
ccactgcaggccccgct

SEQ ID NO: 2892906 - DNA, 11 bp, Homo sapiens
ccactgccatg

SEQ ID NO: 2892907 - DNA, 16 bp, Homo sapiens
ccactgccattaccca

SEQ ID NO: 2892908 - DNA, 19 bp, Homo sapiens
ccactgccattacccagtg

SEQ ID NO: 2892909 - DNA, 20 bp, Homo sapiens
ccactgccattacccagtgc

SEQ ID NO: 2892910 - DNA, 15 bp, Homo sapiens
ccactgcctcctccc

SEQ ID NO: 2892911 - DNA, 18 bp, Homo sapiens
ccactgctgcagtagggg

SEQ ID NO: 2892912 - DNA, 16 bp, Homo sapiens
ccactgctgcttctcc

SEQ ID NO: 2892913 - DNA, 20 bp, Homo sapiens
ccactgcttcttatggtggt

SEQ ID NO: 2892914 - DNA, 15 bp, Homo sapiens
ccactggaaggagca

SEQ ID NO: 2892915 - DNA, 16 bp, Homo sapiens
ccactgggcacctgcg

SEQ ID NO: 2892916 - DNA, 17 bp, Homo sapiens
ccactgggcacctgcgc

SEQ ID NO: 2892917 - DNA, 14 bp, Homo sapiens
ccactgggcccctc

SEQ ID NO: 2892918 - DNA, 16 bp, Homo sapiens
ccactgggcccctcag

SEQ ID NO: 2892919 - DNA, 22 bp, Homo sapiens
ccactggggtccagggagcagg

SEQ ID NO: 2892920 - DNA, 21 bp, Homo sapiens
ccactgtatgatttataaaca

SEQ ID NO: 2892921 - DNA, 21 bp, Homo sapiens
ccactgtcctgggcctgcaga

SEQ ID NO: 2892922 - DNA, 12 bp, Homo sapiens
ccactgtctttt

SEQ ID NO: 2892923 - DNA, 15 bp, Homo sapiens
ccactgtctttttct

SEQ ID NO: 2892924 - DNA, 13 bp, Homo sapiens
ccactgtgcttgg

SEQ ID NO: 2892925 - DNA, 17 bp, Homo sapiens
ccactgtggaagtccct

SEQ ID NO: 2892926 - DNA, 18 bp, Homo sapiens
ccactgtggaagtccctc

SEQ ID NO: 2892927 - DNA, 20 bp, Homo sapiens
ccactgtggaagtccctcag

SEQ ID NO: 2892928 - DNA, 12 bp, Homo sapiens
ccactgtgtata

SEQ ID NO: 2892929 - DNA, 21 bp, Homo sapiens
ccactgtgtttctgtgctcca

SEQ ID NO: 2892930 - DNA, 16 bp, Homo sapiens
ccacttaggctttgta

SEQ ID NO: 2892931 - DNA, 15 bp, Homo sapiens
ccacttctggtcccc

SEQ ID NO: 2892932 - DNA, 19 bp, Homo sapiens
ccacttctggtcccctgtg

SEQ ID NO: 2892933 - DNA, 19 bp, Homo sapiens
ccacttgccagggctctgg

SEQ ID NO: 2892934 - DNA, 22 bp, Homo sapiens
ccacttgccagggctctggggg

SEQ ID NO: 2892935 - DNA, 13 bp, Homo sapiens
ccactttcattca

SEQ ID NO: 2892936 - DNA, 16 bp, Homo sapiens
ccactttccaccaact

SEQ ID NO: 2892937 - DNA, 17 bp, Homo sapiens
ccactttgctgttcctt

SEQ ID NO: 2892938 - DNA, 21 bp, Homo sapiens
ccactttgttggcccttccag

SEQ ID NO: 2892939 - DNA, 22 bp, Homo sapiens
ccactttgttggcccttccagt

SEQ ID NO: 2892940 - DNA, 12 bp, Homo sapiens
ccacttttctag

SEQ ID NO: 2892941 - DNA, 19 bp, Homo sapiens
ccacttttctagttaactt

SEQ ID NO: 2892942 - DNA, 19 bp, Homo sapiens
ccagaaacctgggagagac

SEQ ID NO: 2892943 - DNA, 15 bp, Homo sapiens
ccagaaagaaaatga

SEQ ID NO: 2892944 - DNA, 19 bp, Homo sapiens
ccagaaccaccccggcccc

SEQ ID NO: 2892945 - DNA, 19 bp, Homo sapiens
ccagaactcactggggcct

SEQ ID NO: 2892946 - DNA, 20 bp, Homo sapiens
ccagaacttgaccctgagct

SEQ ID NO: 2892947 - DNA, 15 bp, Homo sapiens
ccagaagaaaatttg

SEQ ID NO: 2892948 - DNA, 21 bp, Homo sapiens
ccagaagactcctaggccctt

SEQ ID NO: 2892949 - DNA, 20 bp, Homo sapiens
ccagaagctgagcaccaggg

SEQ ID NO: 2892950 - DNA, 17 bp, Homo sapiens
ccagaagctgtactttt

SEQ ID NO: 2892951 - DNA, 18 bp, Homo sapiens
ccagaaggagacaggcag

SEQ ID NO: 2892952 - DNA, 16 bp, Homo sapiens
ccagaagtattgttta

SEQ ID NO: 2892953 - DNA, 20 bp, Homo sapiens
ccagaagtattgtttacatt

SEQ ID NO: 2892954 - DNA, 15 bp, Homo sapiens
ccagaataagttatt

SEQ ID NO: 2892955 - DNA, 22 bp, Homo sapiens
ccagaataagttattgcagttt

SEQ ID NO: 2892956 - DNA, 15 bp, Homo sapiens
ccagaatgaggctgc

SEQ ID NO: 2892957 - DNA, 17 bp, Homo sapiens
ccagaatgctgtacatc

SEQ ID NO: 2892958 - DNA, 21 bp, Homo sapiens
ccagaatgctgtacatctatt

SEQ ID NO: 2892959 - DNA, 18 bp, Homo sapiens
ccagaattacccttcctc

SEQ ID NO: 2892960 - DNA, 15 bp, Homo sapiens
ccagacaaggagagc

SEQ ID NO: 2892961 - DNA, 14 bp, Homo sapiens
ccagacactgcgcc

SEQ ID NO: 2892962 - DNA, 11 bp, Homo sapiens
ccagacactgg

SEQ ID NO: 2892963 - DNA, 12 bp, Homo sapiens
ccagacagaggg

SEQ ID NO: 2892964 - DNA, 15 bp, Homo sapiens
ccagacagagggtca

SEQ ID NO: 2892965 - DNA, 23 bp, Homo sapiens
ccagacagagggtcacagtgttt

SEQ ID NO: 2892966 - DNA, 19 bp, Homo sapiens
ccagacagctgctcagagc

SEQ ID NO: 2892967 - DNA, 17 bp, Homo sapiens
agcactttgggaggcag

SEQ ID NO: 2892968 - DNA, 14 bp, Homo sapiens
agcagaagaaagga

SEQ ID NO: 2892969 - DNA, 17 bp, Homo sapiens
agcagaatggaggcagg

SEQ ID NO: 2892970 - DNA, 13 bp, Homo sapiens
agcagaattttaa

SEQ ID NO: 2892971 - DNA, 20 bp, Homo sapiens
agcagaattttaatgtgaag

SEQ ID NO: 2892972 - DNA, 13 bp, Homo sapiens
agcagacacactg

SEQ ID NO: 2892973 - DNA, 17 bp, Homo sapiens
agcagactgatcaggac

SEQ ID NO: 2892974 - DNA, 19 bp, Homo sapiens
agcagactgatcaggacct

SEQ ID NO: 2892975 - DNA, 16 bp, Homo sapiens
agcagagaatataaca

SEQ ID NO: 2892976 - DNA, 13 bp, Homo sapiens
agcagagagccct

SEQ ID NO: 2892977 - DNA, 14 bp, Homo sapiens
agcagagagccctg

SEQ ID NO: 2892978 - DNA, 18 bp, Homo sapiens
agcagagcaaaatgctct

SEQ ID NO: 2892979 - DNA, 14 bp, Homo sapiens
agcagaggaccagg

SEQ ID NO: 2892980 - DNA, 16 bp, Homo sapiens
agcagaggaccagggc

SEQ ID NO: 2892981 - DNA, 21 bp, Homo sapiens
agcagaggaggggccgctgcc

SEQ ID NO: 2892982 - DNA, 13 bp, Homo sapiens
agcagaggcagtg

SEQ ID NO: 2892983 - DNA, 18 bp, Homo sapiens
agcagaggcagtggccac

SEQ ID NO: 2892984 - DNA, 13 bp, Homo sapiens
agcagaggtctcc

SEQ ID NO: 2892985 - DNA, 19 bp, Homo sapiens
agcagatgcaaagaggcaa

SEQ ID NO: 2892986 - DNA, 21 bp, Homo sapiens
agcagattggaaggagacaca

SEQ ID NO: 2892987 - DNA, 16 bp, Homo sapiens
agcagattttcctaag

SEQ ID NO: 2892988 - DNA, 16 bp, Homo sapiens
agcagcaaaatcctta

SEQ ID NO: 2892989 - DNA, 23 bp, Homo sapiens
agcagcaaaatccttacttccag

SEQ ID NO: 2892990 - DNA, 15 bp, Homo sapiens
agcagcaaattttca

SEQ ID NO: 2892991 - DNA, 15 bp, Homo sapiens
agcagcaagaaaaaa

SEQ ID NO: 2892992 - DNA, 18 bp, Homo sapiens
agcagcagagagccctgg

SEQ ID NO: 2892993 - DNA, 22 bp, Homo sapiens
agcagcagagagccctgggtga

SEQ ID NO: 2892994 - DNA, 16 bp, Homo sapiens
agcagcagcctactga

SEQ ID NO: 2892995 - DNA, 13 bp, Homo sapiens
agcagcatcccag

SEQ ID NO: 2892996 - DNA, 15 bp, Homo sapiens
agcagcatcccagcc

SEQ ID NO: 2892997 - DNA, 21 bp, Homo sapiens
agcagccaagctccttgggag

SEQ ID NO: 2892998 - DNA, 13 bp, Homo sapiens
agcagccacgagg

SEQ ID NO: 2892999 - DNA, 14 bp, Homo sapiens
agcagccaggaggg

SEQ ID NO: 2893000 - DNA, 15 bp, Homo sapiens
agcagccaggaggga

SEQ ID NO: 2893001 - DNA, 16 bp, Homo sapiens
agcagccaggagggac

SEQ ID NO: 2893002 - DNA, 12 bp, Homo sapiens
agcagcccaccc

SEQ ID NO: 2893003 - DNA, 13 bp, Homo sapiens
agcagcccaccct

SEQ ID NO: 2893004 - DNA, 16 bp, Homo sapiens
agcagcccaccctgct

SEQ ID NO: 2893005 - DNA, 14 bp, Homo sapiens
agcagccctcctca

SEQ ID NO: 2893006 - DNA, 12 bp, Homo sapiens
aaaaaaaataga

SEQ ID NO: 2893007 - DNA, 11 bp, Homo sapiens
aaaaaaaatgt

SEQ ID NO: 2893008 - DNA, 13 bp, Homo sapiens
aaaaaaacataaa

SEQ ID NO: 2893009 - DNA, 11 bp, Homo sapiens
aaaaaaagaaa

SEQ ID NO: 2893010 - DNA, 13 bp, Homo sapiens
aaaaaaaggaaaa

SEQ ID NO: 2893011 - DNA, 11 bp, Homo sapiens
aaaaaaagtta

SEQ ID NO: 2893012 - DNA, 13 bp, Homo sapiens
aaaaaaatagatg

SEQ ID NO: 2893013 - DNA, 13 bp, Homo sapiens
aaaaaaataggat

SEQ ID NO: 2893014 - DNA, 14 bp, Homo sapiens
aaaaaaatgccata

SEQ ID NO: 2893015 - DNA, 12 bp, Homo sapiens
aaaaaacaaaaa

SEQ ID NO: 2893016 - DNA, 13 bp, Homo sapiens
aaaaaacaagaaa

SEQ ID NO: 2893017 - DNA, 10 bp, Homo sapiens
aaaaaacatt

SEQ ID NO: 2893018 - DNA, 19 bp, Homo sapiens
aaaaaactcgaggactgta

SEQ ID NO: 2893019 - DNA, 13 bp, Homo sapiens
aaaaaagaaagtt

SEQ ID NO: 2893020 - DNA, 12 bp, Homo sapiens
aaaaaagaaatt

SEQ ID NO: 2893021 - DNA, 20 bp, Homo sapiens
aaaaaagaaattatctttag

SEQ ID NO: 2893022 - DNA, 16 bp, Homo sapiens
aaaaaaggcattgttt

SEQ ID NO: 2893023 - DNA, 11 bp, Homo sapiens
aaaaaatactg

SEQ ID NO: 2893024 - DNA, 14 bp, Homo sapiens
aaaaaatactgcca

SEQ ID NO: 2893025 - DNA, 16 bp, Homo sapiens
aaaaaatactgccaga

SEQ ID NO: 2893026 - DNA, 20 bp, Homo sapiens
aaaaaatactgccagatgct

SEQ ID NO: 2893027 - DNA, 12 bp, Homo sapiens
aaaaaatggaaa

SEQ ID NO: 2893028 - DNA, 16 bp, Homo sapiens
aaaaaatgtatatgca

SEQ ID NO: 2893029 - DNA, 12 bp, Homo sapiens
aaaaacaacaaa

SEQ ID NO: 2893030 - DNA, 18 bp, Homo sapiens
aaaaacaagactgcctcc

SEQ ID NO: 2893031 - DNA, 19 bp, Homo sapiens
aaaaacaattaactgccct

SEQ ID NO: 2893032 - DNA, 15 bp, Homo sapiens
aaaaacacacaaaaa

SEQ ID NO: 2893033 - DNA, 15 bp, Homo sapiens
aaaaacagcattgct

SEQ ID NO: 2893034 - DNA, 17 bp, Homo sapiens
aaaaacagcattgcttt

SEQ ID NO: 2893035 - DNA, 20 bp, Homo sapiens
aaaaacagcattgctttctg

SEQ ID NO: 2893036 - DNA, 16 bp, Homo sapiens
aaaaaccgttcaaatt

SEQ ID NO: 2893037 - DNA, 19 bp, Homo sapiens
aaaaactacaaccaatgga

SEQ ID NO: 2893038 - DNA, 23 bp, Homo sapiens
aaaaactattaaggatgtagctt

SEQ ID NO: 2893039 - DNA, 14 bp, Homo sapiens
aaaaactgcagtca

SEQ ID NO: 2893040 - DNA, 11 bp, Homo sapiens
aaaaagaaaaa

SEQ ID NO: 2893041 - DNA, 13 bp, Homo sapiens
aaaaagaaattat

SEQ ID NO: 2893042 - DNA, 16 bp, Homo sapiens
aaaaagaaattatctt

SEQ ID NO: 2893043 - DNA, 14 bp, Homo sapiens
aaaaagaagccaca

SEQ ID NO: 2893044 - DNA, 17 bp, Homo sapiens
aaaaagacgatgtttat

SEQ ID NO: 2893045 - DNA, 10 bp, Homo sapiens
aaaaagatat

SEQ ID NO: 2893046 - DNA, 19 bp, Homo sapiens
aaaaagattgtattacttt

SEQ ID NO: 2893047 - DNA, 20 bp, Homo sapiens
aaaaagcgctgtttccttgc

SEQ ID NO: 2893048 - DNA, 11 bp, Homo sapiens
aaaaaggactg

SEQ ID NO: 2893049 - DNA, 20 bp, Homo sapiens
aaaaaggactggaaaaatga

SEQ ID NO: 2893050 - DNA, 21 bp, Homo sapiens
aaaaagggagaaagaaaactg

SEQ ID NO: 2893051 - DNA, 15 bp, Homo sapiens
aaaaagggaggggga

SEQ ID NO: 2893052 - DNA, 22 bp, Homo sapiens
aaaaagggccctggtaaaatag

SEQ ID NO: 2893053 - DNA, 20 bp, Homo sapiens
aaaaaggtataaataataat

SEQ ID NO: 2893054 - DNA, 13 bp, Homo sapiens
aaaaagtattatt

SEQ ID NO: 2893055 - DNA, 14 bp, Homo sapiens
aaaaagtattattt

SEQ ID NO: 2893056 - DNA, 15 bp, Homo sapiens
aaaaagtattatttt

SEQ ID NO: 2893057 - DNA, 22 bp, Homo sapiens
aaaaagtctacgctctcctttc

SEQ ID NO: 2893058 - DNA, 14 bp, Homo sapiens
aaaaagttgttcaa

SEQ ID NO: 2893059 - DNA, 17 bp, Homo sapiens
aaaaagtttgccagaag

SEQ ID NO: 2893060 - DNA, 20 bp, Homo sapiens
aaaaagtttgttactttgaa

SEQ ID NO: 2893061 - DNA, 13 bp, Homo sapiens
aaaaatactacct

SEQ ID NO: 2893062 - DNA, 14 bp, Homo sapiens
aaaaatactaccta

SEQ ID NO: 2893063 - DNA, 11 bp, Homo sapiens
aaaaatactgc

SEQ ID NO: 2893064 - DNA, 18 bp, Homo sapiens
aaaaatactttttctaat

SEQ ID NO: 2893065 - DNA, 11 bp, Homo sapiens
aaaaatagaaa

SEQ ID NO: 2893066 - DNA, 13 bp, Homo sapiens
aaaaatagaaaca

SEQ ID NO: 2893067 - DNA, 16 bp, Homo sapiens
aaaaatagaaacatat

SEQ ID NO: 2893068 - DNA, 13 bp, Homo sapiens
aaaaatatactga

SEQ ID NO: 2893069 - DNA, 18 bp, Homo sapiens
aaaaatatatgttgaatg

SEQ ID NO: 2893070 - DNA, 21 bp, Homo sapiens
aaaaatatcaagtactacatt

SEQ ID NO: 2893071 - DNA, 13 bp, Homo sapiens
aaaaatattttct

SEQ ID NO: 2893072 - DNA, 18 bp, Homo sapiens
aaaaatcaacctatcaaa

SEQ ID NO: 2893073 - DNA, 20 bp, Homo sapiens
aaaaatcacttgattcataa

SEQ ID NO: 2893074 - DNA, 14 bp, Homo sapiens
aaaaatgaactgta

SEQ ID NO: 2893075 - DNA, 15 bp, Homo sapiens
aaaaatgatgttcat

SEQ ID NO: 2893076 - DNA, 20 bp, Homo sapiens
aaaaatgatttcagtagcac

SEQ ID NO: 2893077 - DNA, 17 bp, Homo sapiens
aaaaatgccataataca

SEQ ID NO: 2893078 - DNA, 18 bp, Homo sapiens
aaaaatgccataatacaa

SEQ ID NO: 2893079 - DNA, 22 bp, Homo sapiens
aaaaatgccataatacaaaagg

SEQ ID NO: 2893080 - DNA, 13 bp, Homo sapiens
aaaaatgctaata

SEQ ID NO: 2893081 - DNA, 23 bp, Homo sapiens
aaaaatgggacttcttttcacat

SEQ ID NO: 2893082 - DNA, 22 bp, Homo sapiens
aaaaatggtggcttcagctcca

SEQ ID NO: 2893083 - DNA, 12 bp, Homo sapiens
aaaaatgtgaaa

SEQ ID NO: 2893084 - DNA, 14 bp, Homo sapiens
aaaaatgtgaaatt

SEQ ID NO: 2893085 - DNA, 15 bp, Homo sapiens
aaaaatgtgaaattt

SEQ ID NO: 2893086 - DNA, 13 bp, Homo sapiens
aaaaatgttcact

SEQ ID NO: 2893087 - DNA, 20 bp, Homo sapiens
aaaaatgttttttcatgtgt

SEQ ID NO: 2893088 - DNA, 21 bp, Homo sapiens
aaaaattacaaagaaaataat

SEQ ID NO: 2893089 - DNA, 19 bp, Homo sapiens
aaaaattcctttgtgtttc

SEQ ID NO: 2893090 - DNA, 23 bp, Homo sapiens
aaaaattgtttcaaaataaaaac

SEQ ID NO: 2893091 - DNA, 13 bp, Homo sapiens
aaaaatttattat

SEQ ID NO: 2893092 - DNA, 15 bp, Homo sapiens
aaaaatttttgcaaa

SEQ ID NO: 2893093 - DNA, 15 bp, Homo sapiens
aaaacaaaactgcat

SEQ ID NO: 2893094 - DNA, 19 bp, Homo sapiens
aaaacaaacaaatcaaaca

SEQ ID NO: 2893095 - DNA, 23 bp, Homo sapiens
aaaacaaaggagcattaagccca

SEQ ID NO: 2893096 - DNA, 13 bp, Homo sapiens
aaaacaacaaata

SEQ ID NO: 2893097 - DNA, 22 bp, Homo sapiens
aaaacaactatggatcagaata

SEQ ID NO: 2893098 - DNA, 22 bp, Homo sapiens
aaaacaacttaataaaaactta

SEQ ID NO: 2893099 - DNA, 17 bp, Homo sapiens
aaaacaagactgcctcc

SEQ ID NO: 2893100 - DNA, 15 bp, Homo sapiens
aaaacaagtttgcta

SEQ ID NO: 2893101 - DNA, 18 bp, Homo sapiens
aaaacaattggttgtata

SEQ ID NO: 2893102 - DNA, 19 bp, Homo sapiens
aaaacaattggttgtatat

SEQ ID NO: 2893103 - DNA, 20 bp, Homo sapiens
aaaacaattgttctgggtga

SEQ ID NO: 2893104 - DNA, 11 bp, Homo sapiens
aaaacacagag

SEQ ID NO: 2893105 - DNA, 20 bp, Homo sapiens
aaaacacagtgtttttgtaa

SEQ ID NO: 2893106 - DNA, 22 bp, Homo sapiens
aaaacagaacatcattagaaca

SEQ ID NO: 2893107 - DNA, 13 bp, Homo sapiens
aaaacagaagcct

SEQ ID NO: 2893108 - DNA, 11 bp, Homo sapiens
aaaacagatat

SEQ ID NO: 2893109 - DNA, 16 bp, Homo sapiens
aaaacatacttcaaaa

SEQ ID NO: 2893110 - DNA, 13 bp, Homo sapiens
aaaacatagaaaa

SEQ ID NO: 2893111 - DNA, 13 bp, Homo sapiens
aaaacatagactg

SEQ ID NO: 2893112 - DNA, 15 bp, Homo sapiens
aaaacatagactgaa

SEQ ID NO: 2893113 - DNA, 18 bp, Homo sapiens
aaaacatattttacatct

SEQ ID NO: 2893114 - DNA, 20 bp, Homo sapiens
aaaaccaattcatgaagtga

SEQ ID NO: 2893115 - DNA, 19 bp, Homo sapiens
aaaaccactatgcaaagaa

SEQ ID NO: 2893116 - DNA, 22 bp, Homo sapiens
aaaaccatattttattgtattt

SEQ ID NO: 2893117 - DNA, 17 bp, Homo sapiens
aaaacccattgtcttta

SEQ ID NO: 2893118 - DNA, 14 bp, Homo sapiens
aaaaccttttgaaa

SEQ ID NO: 2893119 - DNA, 14 bp, Homo sapiens
aaaacgcgcagatg

SEQ ID NO: 2893120 - DNA, 15 bp, Homo sapiens
aaaacgtgtaaatga

SEQ ID NO: 2893121 - DNA, 13 bp, Homo sapiens
aaaactaaatgtg

SEQ ID NO: 2893122 - DNA, 18 bp, Homo sapiens
aaaactaaatgtgtacac

SEQ ID NO: 2893123 - DNA, 17 bp, Homo sapiens
aaaactacctgtgagca

SEQ ID NO: 2893124 - DNA, 15 bp, Homo sapiens
aaaactagtaaaact

SEQ ID NO: 2893125 - DNA, 13 bp, Homo sapiens
aaaactatgtatt

SEQ ID NO: 2893126 - DNA, 20 bp, Homo sapiens
aaaactatgtattaatttag

SEQ ID NO: 2893127 - DNA, 21 bp, Homo sapiens
aaaactatgtattaatttaga

SEQ ID NO: 2893128 - DNA, 16 bp, Homo sapiens
aaaactattcatgcta

SEQ ID NO: 2893129 - DNA, 20 bp, Homo sapiens
aaaactattcatgctaccca

SEQ ID NO: 2893130 - DNA, 13 bp, Homo sapiens
aaaactcaaagaa

SEQ ID NO: 2893131 - DNA, 22 bp, Homo sapiens
aaaactcgaggactgtatttgt

SEQ ID NO: 2893132 - DNA, 15 bp, Homo sapiens
aaaactctctcccag

SEQ ID NO: 2893133 - DNA, 23 bp, Homo sapiens
aaaactgaaagtgaaagtccaga

SEQ ID NO: 2893134 - DNA, 15 bp, Homo sapiens
aaaactgacagagga

SEQ ID NO: 2893135 - DNA, 23 bp, Homo sapiens
aaaactgcagtcatcaacaatga

SEQ ID NO: 2893136 - DNA, 14 bp, Homo sapiens
aaaactgcatttca

SEQ ID NO: 2893137 - DNA, 20 bp, Homo sapiens
aaaactggaaatctggattt

SEQ ID NO: 2893138 - DNA, 16 bp, Homo sapiens
aaaactggacctgtat

SEQ ID NO: 2893139 - DNA, 21 bp, Homo sapiens
aaaactggcaacattccaaga

SEQ ID NO: 2893140 - DNA, 13 bp, Homo sapiens
aaaactgtatgga

SEQ ID NO: 2893141 - DNA, 16 bp, Homo sapiens
aaaacttctaggtaat

SEQ ID NO: 2893142 - DNA, 15 bp, Homo sapiens
aaaacttgtgctata

SEQ ID NO: 2893143 - DNA, 16 bp, Homo sapiens
aaaagaaaaaaaccaa

SEQ ID NO: 2893144 - DNA, 19 bp, Homo sapiens
aaaagaaaacattccagat

SEQ ID NO: 2893145 - DNA, 14 bp, Homo sapiens
aaaagaaataataa

SEQ ID NO: 2893146 - DNA, 17 bp, Homo sapiens
ttttaagacagagtttc

SEQ ID NO: 2893147 - DNA, 20 bp, Homo sapiens
ttttaagaggctttggccca

SEQ ID NO: 2893148 - DNA, 15 bp, Homo sapiens
ttttaagcaaatgca

SEQ ID NO: 2893149 - DNA, 20 bp, Homo sapiens
ttttaaggtgagttctcact

SEQ ID NO: 2893150 - DNA, 15 bp, Homo sapiens
ttttaagttaataga

SEQ ID NO: 2893151 - DNA, 18 bp, Homo sapiens
ttttaagttaatagattt

SEQ ID NO: 2893152 - DNA, 23 bp, Homo sapiens
ttttaagttaatagattttttca

SEQ ID NO: 2893153 - DNA, 15 bp, Homo sapiens
ttttaagttcacttt

SEQ ID NO: 2893154 - DNA, 23 bp, Homo sapiens
ttttaatagaaataaattcctaa

SEQ ID NO: 2893155 - DNA, 19 bp, Homo sapiens
ttttaataggatttttaga

SEQ ID NO: 2893156 - DNA, 14 bp, Homo sapiens
ttttaatataaatt

SEQ ID NO: 2893157 - DNA, 20 bp, Homo sapiens
ttttaatcaattaggggcaa

SEQ ID NO: 2893158 - DNA, 12 bp, Homo sapiens
ttttaatcatga

SEQ ID NO: 2893159 - DNA, 16 bp, Homo sapiens
ttttaatcatgaaatt

SEQ ID NO: 2893160 - DNA, 23 bp, Homo sapiens
ttttaatcatgagcctgtttatt

SEQ ID NO: 2893161 - DNA, 13 bp, Homo sapiens
ttttaatgtgaag

SEQ ID NO: 2893162 - DNA, 18 bp, Homo sapiens
ttttaatgtgctgtgtaa

SEQ ID NO: 2893163 - DNA, 19 bp, Homo sapiens
ttttaatgtgctgtgtaaa

SEQ ID NO: 2893164 - DNA, 18 bp, Homo sapiens
ttttaattccatgaatcg

SEQ ID NO: 2893165 - DNA, 17 bp, Homo sapiens
ttttaatttacaaaaat

SEQ ID NO: 2893166 - DNA, 20 bp, Homo sapiens
ttttaatttagtaaatgtta

SEQ ID NO: 2893167 - DNA, 12 bp, Homo sapiens
ttttaattttgt

SEQ ID NO: 2893168 - DNA, 13 bp, Homo sapiens
ttttaattttgta

SEQ ID NO: 2893169 - DNA, 15 bp, Homo sapiens
ttttaattttgtatt

SEQ ID NO: 2893170 - DNA, 12 bp, Homo sapiens
ttttaattttta

SEQ ID NO: 2893171 - DNA, 15 bp, Homo sapiens
ttttacaaattaata

SEQ ID NO: 2893172 - DNA, 18 bp, Homo sapiens
ttttacaaattaatattt

SEQ ID NO: 2893173 - DNA, 20 bp, Homo sapiens
ttttacaaattaatatttgt

SEQ ID NO: 2893174 - DNA, 16 bp, Homo sapiens
ttttacaattgaaatg

SEQ ID NO: 2893175 - DNA, 21 bp, Homo sapiens
ttttacacagaaacactgcct

SEQ ID NO: 2893176 - DNA, 14 bp, Homo sapiens
ttttacatacagtg

SEQ ID NO: 2893177 - DNA, 16 bp, Homo sapiens
ttttacatactgctgt

SEQ ID NO: 2893178 - DNA, 15 bp, Homo sapiens
ttttacattctgtgt

SEQ ID NO: 2893179 - DNA, 15 bp, Homo sapiens
ttttactgtgtttta

SEQ ID NO: 2893180 - DNA, 20 bp, Homo sapiens
ttttagaaaattttatgtat

SEQ ID NO: 2893181 - DNA, 16 bp, Homo sapiens
ttttagaattaaaatt

SEQ ID NO: 2893182 - DNA, 20 bp, Homo sapiens
ttttagacaaatactcatgt

SEQ ID NO: 2893183 - DNA, 21 bp, Homo sapiens
ttttagacaaatactcatgtg

SEQ ID NO: 2893184 - DNA, 23 bp, Homo sapiens
ttttagacaaatactcatgtgta

SEQ ID NO: 2893185 - DNA, 21 bp, Homo sapiens
ttttagaggcagggctgcatt

SEQ ID NO: 2893186 - DNA, 18 bp, Homo sapiens
ttttagaggtgagtttta

SEQ ID NO: 2893187 - DNA, 17 bp, Homo sapiens
ttttagagtaagaaatt

SEQ ID NO: 2893188 - DNA, 20 bp, Homo sapiens
ttttagctgatgaacttatt

SEQ ID NO: 2893189 - DNA, 17 bp, Homo sapiens
ttttaggaaaagcatct

SEQ ID NO: 2893190 - DNA, 15 bp, Homo sapiens
ttttaggattctgtc

SEQ ID NO: 2893191 - DNA, 20 bp, Homo sapiens
ttttaggccaaaaaaatgta

SEQ ID NO: 2893192 - DNA, 19 bp, Homo sapiens
ttttagtatttatttatgt

SEQ ID NO: 2893193 - DNA, 13 bp, Homo sapiens
ttttagtcacttt

SEQ ID NO: 2893194 - DNA, 19 bp, Homo sapiens
ttttagtgaacttgaaata

SEQ ID NO: 2893195 - DNA, 16 bp, Homo sapiens
ttttagtgttaaagag

SEQ ID NO: 2893196 - DNA, 22 bp, Homo sapiens
ttttagtgttaaagagataaag

SEQ ID NO: 2893197 - DNA, 21 bp, Homo sapiens
ttttagttccaacaaagaaag

SEQ ID NO: 2893198 - DNA, 21 bp, Homo sapiens
ttttagtttaaaatcttgcat

SEQ ID NO: 2893199 - DNA, 18 bp, Homo sapiens
ttttagtttctgttctgt

SEQ ID NO: 2893200 - DNA, 19 bp, Homo sapiens
ttttagtttctgttctgtg

SEQ ID NO: 2893201 - DNA, 21 bp, Homo sapiens
ttttagtttctgttctgtgga

SEQ ID NO: 2893202 - DNA, 12 bp, Homo sapiens
ttttataaagtg

SEQ ID NO: 2893203 - DNA, 18 bp, Homo sapiens
ttttataaataaactgtt

SEQ ID NO: 2893204 - DNA, 16 bp, Homo sapiens
ttttataatgttgtat

SEQ ID NO: 2893205 - DNA, 14 bp, Homo sapiens
ttttatacaaaata

SEQ ID NO: 2893206 - DNA, 20 bp, Homo sapiens
ttttatagcctggactgcta

SEQ ID NO: 2893207 - DNA, 16 bp, Homo sapiens
ttttatagttgtattt

SEQ ID NO: 2893208 - DNA, 14 bp, Homo sapiens
ttttatatctgtat

SEQ ID NO: 2893209 - DNA, 13 bp, Homo sapiens
ttttatatttgag

SEQ ID NO: 2893210 - DNA, 14 bp, Homo sapiens
ttttatcatttcta

SEQ ID NO: 2893211 - DNA, 19 bp, Homo sapiens
ttttatcccttcctgtctg

SEQ ID NO: 2893212 - DNA, 22 bp, Homo sapiens
ttttatctacccagtcatgtac

SEQ ID NO: 2893213 - DNA, 13 bp, Homo sapiens
ttttatctccaag

SEQ ID NO: 2893214 - DNA, 22 bp, Homo sapiens
ttttatctccatactttggatg

SEQ ID NO: 2893215 - DNA, 23 bp, Homo sapiens
ttttatctgttaaccaaataaaa

SEQ ID NO: 2893216 - DNA, 15 bp, Homo sapiens
ttttatctgtttcct

SEQ ID NO: 2893217 - DNA, 11 bp, Homo sapiens
ttttatgagaa

SEQ ID NO: 2893218 - DNA, 19 bp, Homo sapiens
ttttatgagaaagccttct

SEQ ID NO: 2893219 - DNA, 14 bp, Homo sapiens
ttttatgagaaatg

SEQ ID NO: 2893220 - DNA, 15 bp, Homo sapiens
ttttatgagaaatgt

SEQ ID NO: 2893221 - DNA, 21 bp, Homo sapiens
ttttatgagatggatcacata

SEQ ID NO: 2893222 - DNA, 13 bp, Homo sapiens
ttttatgtttgta

SEQ ID NO: 2893223 - DNA, 14 bp, Homo sapiens
ttttatgttttatt

SEQ ID NO: 2893224 - DNA, 19 bp, Homo sapiens
ttttattaaattaattgaa

SEQ ID NO: 2893225 - DNA, 13 bp, Homo sapiens
ttttattaatgca

SEQ ID NO: 2893226 - DNA, 18 bp, Homo sapiens
ttttattacattagttaa

SEQ ID NO: 2893227 - DNA, 23 bp, Homo sapiens
tgttcttgaatttaataatctgt

SEQ ID NO: 2893228 - DNA, 12 bp, Homo sapiens
tgttcttgttgt

SEQ ID NO: 2893229 - DNA, 13 bp, Homo sapiens
tgttcttgttgtt

SEQ ID NO: 2893230 - DNA, 14 bp, Homo sapiens
tgttctttatatac

SEQ ID NO: 2893231 - DNA, 20 bp, Homo sapiens
tgttctttatatacaataat

SEQ ID NO: 2893232 - DNA, 17 bp, Homo sapiens
tgttcttttcccgcctc

SEQ ID NO: 2893233 - DNA, 23 bp, Homo sapiens
tgttgaaaataatccattttcac

SEQ ID NO: 2893234 - DNA, 14 bp, Homo sapiens
tgttgaaacagaaa

SEQ ID NO: 2893235 - DNA, 12 bp, Homo sapiens
tgttgaaagcaa

SEQ ID NO: 2893236 - DNA, 19 bp, Homo sapiens
tgttgaaagcaaaaatgct

SEQ ID NO: 2893237 - DNA, 22 bp, Homo sapiens
tgttgaagaaattataaagata

SEQ ID NO: 2893238 - DNA, 18 bp, Homo sapiens
tgttgaatactttttaca

SEQ ID NO: 2893239 - DNA, 18 bp, Homo sapiens
tgttgaattcttttgcca

SEQ ID NO: 2893240 - DNA, 16 bp, Homo sapiens
tgttgacatatttaat

SEQ ID NO: 2893241 - DNA, 18 bp, Homo sapiens
tgttgaccactccagaga

SEQ ID NO: 2893242 - DNA, 19 bp, Homo sapiens
tgttgaccactccagagaa

SEQ ID NO: 2893243 - DNA, 16 bp, Homo sapiens
tgttgactgctgctcc

SEQ ID NO: 2893244 - DNA, 20 bp, Homo sapiens
tgttgactgctgctccccac

SEQ ID NO: 2893245 - DNA, 22 bp, Homo sapiens
tgttgactgctgctccccaccc

SEQ ID NO: 2893246 - DNA, 21 bp, Homo sapiens
tgttgactttatttctgagca

SEQ ID NO: 2893247 - DNA, 23 bp, Homo sapiens
tgttgagaatcccaaatttgatt

SEQ ID NO: 2893248 - DNA, 15 bp, Homo sapiens
tgttgagagtgtgac

SEQ ID NO: 2893249 - DNA, 17 bp, Homo sapiens
tgttgagtctctgaaca

SEQ ID NO: 2893250 - DNA, 23 bp, Homo sapiens
tgttgatcatgtactttttagta

SEQ ID NO: 2893251 - DNA, 16 bp, Homo sapiens
tgttgatccatccagc

SEQ ID NO: 2893252 - DNA, 13 bp, Homo sapiens
tgttgattgctaa

SEQ ID NO: 2893253 - DNA, 18 bp, Homo sapiens
tgttgatttttactgtgt

SEQ ID NO: 2893254 - DNA, 20 bp, Homo sapiens
tgttgatttttactgtgttt

SEQ ID NO: 2893255 - DNA, 20 bp, Homo sapiens
tgttgcacacccactcagct

SEQ ID NO: 2893256 - DNA, 21 bp, Homo sapiens
tgttgcacagcagcaattgtt

SEQ ID NO: 2893257 - DNA, 20 bp, Homo sapiens
tgttgcaccaattaagtgtt

SEQ ID NO: 2893258 - DNA, 23 bp, Homo sapiens
tgttgcaccaattaagtgttgaa

SEQ ID NO: 2893259 - DNA, 16 bp, Homo sapiens
tgttgcactgaaaacc

SEQ ID NO: 2893260 - DNA, 11 bp, Homo sapiens
tgttgcacttt

SEQ ID NO: 2893261 - DNA, 14 bp, Homo sapiens
tgttgcacttttga

SEQ ID NO: 2893262 - DNA, 18 bp, Homo sapiens
tgttgcacttttgaatgt

SEQ ID NO: 2893263 - DNA, 18 bp, Homo sapiens
tgttgcagtggcctggcc

SEQ ID NO: 2893264 - DNA, 14 bp, Homo sapiens
tgttgcatagaatt

SEQ ID NO: 2893265 - DNA, 14 bp, Homo sapiens
tgttgcatggatgt

SEQ ID NO: 2893266 - DNA, 14 bp, Homo sapiens
tgttgccatgtgtt

SEQ ID NO: 2893267 - DNA, 15 bp, Homo sapiens
tgttgccatgtgttt

SEQ ID NO: 2893268 - DNA, 21 bp, Homo sapiens
tgttgcctcctctctccctgc

SEQ ID NO: 2893269 - DNA, 14 bp, Homo sapiens
tgttgcctcttgca

SEQ ID NO: 2893270 - DNA, 16 bp, Homo sapiens
tgttgctataataaag

SEQ ID NO: 2893271 - DNA, 19 bp, Homo sapiens
tgttgctcaaaaaatgagc

SEQ ID NO: 2893272 - DNA, 17 bp, Homo sapiens
tgttgctcgaagactgt

SEQ ID NO: 2893273 - DNA, 16 bp, Homo sapiens
tgttgctgctgctgct

SEQ ID NO: 2893274 - DNA, 14 bp, Homo sapiens
tgttgcttacaatt

SEQ ID NO: 2893275 - DNA, 17 bp, Homo sapiens
tgttgcttcttgtgaag

SEQ ID NO: 2893276 - DNA, 16 bp, Homo sapiens
tgttgctttgttgcac

SEQ ID NO: 2893277 - DNA, 23 bp, Homo sapiens
tgttggacaaatgtgaagatgca

SEQ ID NO: 2893278 - DNA, 16 bp, Homo sapiens
tgttggagatgcagcc

SEQ ID NO: 2893279 - DNA, 20 bp, Homo sapiens
tgttggatttgtttaaaagg

SEQ ID NO: 2893280 - DNA, 18 bp, Homo sapiens
tgttggcacatcctatgc

SEQ ID NO: 2893281 - DNA, 23 bp, Homo sapiens
tgttggcgtggggcctttgtcag

SEQ ID NO: 2893282 - DNA, 23 bp, Homo sapiens
tgttttttcaaaatagaaaagtt

SEQ ID NO: 2893283 - DNA, 18 bp, Homo sapiens
tgttttttcatagtgcct

SEQ ID NO: 2893284 - DNA, 13 bp, Homo sapiens
ttaaaaaaaatgt

SEQ ID NO: 2893285 - DNA, 15 bp, Homo sapiens
ttaaaaaaaatgtga

SEQ ID NO: 2893286 - DNA, 12 bp, Homo sapiens
ttaaaaaaatgg

SEQ ID NO: 2893287 - DNA, 16 bp, Homo sapiens
ttaaaaaaatggcagt

SEQ ID NO: 2893288 - DNA, 20 bp, Homo sapiens
ttaaaaaaatttttgcaaat

SEQ ID NO: 2893289 - DNA, 16 bp, Homo sapiens
ttaaaaaacaattggt

SEQ ID NO: 2893290 - DNA, 15 bp, Homo sapiens
ttaaaaaatcttaat

SEQ ID NO: 2893291 - DNA, 16 bp, Homo sapiens
ttaaaaaatcttaatg

SEQ ID NO: 2893292 - DNA, 13 bp, Homo sapiens
ttaaaaactagta

SEQ ID NO: 2893293 - DNA, 15 bp, Homo sapiens
ttaaaaagaaaatca

SEQ ID NO: 2893294 - DNA, 12 bp, Homo sapiens
ttaaaaagcaaa

SEQ ID NO: 2893295 - DNA, 22 bp, Homo sapiens
ttaaaaagggagaaagaaaact

SEQ ID NO: 2893296 - DNA, 23 bp, Homo sapiens
ttaaaaagggagaaagaaaactg

SEQ ID NO: 2893297 - DNA, 16 bp, Homo sapiens
ttaaaaaggtttacag

SEQ ID NO: 2893298 - DNA, 15 bp, Homo sapiens
ttaaaaagtgagaaa

SEQ ID NO: 2893299 - DNA, 11 bp, Homo sapiens
ttaaaaataaa

SEQ ID NO: 2893300 - DNA, 14 bp, Homo sapiens
ttaaaaatatttca

SEQ ID NO: 2893301 - DNA, 16 bp, Homo sapiens
ttaaaaatatttcaga

SEQ ID NO: 2893302 - DNA, 12 bp, Homo sapiens
ttaaaaatgtat

SEQ ID NO: 2893303 - DNA, 20 bp, Homo sapiens
ttaaaaatgttttttcatgt

SEQ ID NO: 2893304 - DNA, 20 bp, Homo sapiens
ttaaaaattgtcttcatgta

SEQ ID NO: 2893305 - DNA, 20 bp, Homo sapiens
ttaaaacaatattgtttcta

SEQ ID NO: 2893306 - DNA, 18 bp, Homo sapiens
ttaaaacaatccttacta

SEQ ID NO: 2893307 - DNA, 14 bp, Homo sapiens
ttaaaacacttctg

SEQ ID NO: 2893308 - DNA, 20 bp, Homo sapiens
ttaaaacacttctgtcctgt

SEQ ID NO: 2893309 - DNA, 18 bp, Homo sapiens
ttaaaacactttcaaaac

SEQ ID NO: 2893310 - DNA, 19 bp, Homo sapiens
ttaaaactgtatttaagga

SEQ ID NO: 2893311 - DNA, 16 bp, Homo sapiens
ttaaaagacaaatatg

SEQ ID NO: 2893312 - DNA, 18 bp, Homo sapiens
ttaaaagataaatattat

SEQ ID NO: 2893313 - DNA, 21 bp, Homo sapiens
ttaaaagatgcaatgtagagg

SEQ ID NO: 2893314 - DNA, 16 bp, Homo sapiens
ttaaaagattcatttt

SEQ ID NO: 2893315 - DNA, 20 bp, Homo sapiens
ttaaaaggatttttatcttt

SEQ ID NO: 2893316 - DNA, 14 bp, Homo sapiens
ttaaaagtgtacaa

SEQ ID NO: 2893317 - DNA, 18 bp, Homo sapiens
ttaaaagtgtattttatt

SEQ ID NO: 2893318 - DNA, 20 bp, Homo sapiens
ttaaaagttgttaccaaata

SEQ ID NO: 2893319 - DNA, 16 bp, Homo sapiens
ttaaaataaattctct

SEQ ID NO: 2893320 - DNA, 19 bp, Homo sapiens
ttaaaataaattctctcct

SEQ ID NO: 2893321 - DNA, 16 bp, Homo sapiens
ttaaaatagaggcttt

SEQ ID NO: 2893322 - DNA, 15 bp, Homo sapiens
ttaaaatatgaaggt

SEQ ID NO: 2893323 - DNA, 12 bp, Homo sapiens
ttaaaatcctca

SEQ ID NO: 2893324 - DNA, 15 bp, Homo sapiens
ttaaaatgaatctta

SEQ ID NO: 2893325 - DNA, 17 bp, Homo sapiens
ttaaaatgtaaactctt

SEQ ID NO: 2893326 - DNA, 16 bp, Homo sapiens
ttaaaatgtaaagcca

SEQ ID NO: 2893327 - DNA, 24 bp, Homo sapiens
ttaaaatgtaagattatagattct

SEQ ID NO: 2893328 - DNA, 18 bp, Homo sapiens
ttaaaatgttggtgcaat

SEQ ID NO: 2893329 - DNA, 20 bp, Homo sapiens
ttaaaatgtttactgtaaat

SEQ ID NO: 2893330 - DNA, 16 bp, Homo sapiens
ttaaaattaagtagaa

SEQ ID NO: 2893331 - DNA, 12 bp, Homo sapiens
ttaaaattctct

SEQ ID NO: 2893332 - DNA, 18 bp, Homo sapiens
ttaaaattgctaacgttt

SEQ ID NO: 2893333 - DNA, 17 bp, Homo sapiens
ttaaaattggcctttta

SEQ ID NO: 2893334 - DNA, 16 bp, Homo sapiens
ttaaaattgttaccac

SEQ ID NO: 2893335 - DNA, 22 bp, Homo sapiens
ttaaaatttggtgcttataaga

SEQ ID NO: 2893336 - DNA, 13 bp, Homo sapiens
ttaaaatttgtag

SEQ ID NO: 2893337 - DNA, 12 bp, Homo sapiens
ttaaacaaacca

SEQ ID NO: 2893338 - DNA, 16 bp, Homo sapiens
ttaaacaaaccagaat

SEQ ID NO: 2893339 - DNA, 19 bp, Homo sapiens
ttaaacagcctattcctga

SEQ ID NO: 2893340 - DNA, 13 bp, Homo sapiens
ttaaacattgaag

SEQ ID NO: 2893341 - DNA, 19 bp, Homo sapiens
ttaaaccagattggagcaa

SEQ ID NO: 2893342 - DNA, 19 bp, Homo sapiens
ttaaacccacaagctgcct

SEQ ID NO: 2893343 - DNA, 20 bp, Homo sapiens
ttaaacccacaagctgcctc

SEQ ID NO: 2893344 - DNA, 16 bp, Homo sapiens
ttaaacccattttagt

SEQ ID NO: 2893345 - DNA, 17 bp, Homo sapiens
ttaaacctttttcttga

SEQ ID NO: 2893346 - DNA, 15 bp, Homo sapiens
ttaaactaacctttt

SEQ ID NO: 2893347 - DNA, 18 bp, Homo sapiens
ttaaactactatttttct

SEQ ID NO: 2893348 - DNA, 18 bp, Homo sapiens
ttaaactagatgacctca

SEQ ID NO: 2893349 - DNA, 20 bp, Homo sapiens
ttaaactagatgacctcatt

SEQ ID NO: 2893350 - DNA, 18 bp, Homo sapiens
ttaaactccctttcatgt

SEQ ID NO: 2893351 - DNA, 22 bp, Homo sapiens
ttaaactcgagatacagctttt

SEQ ID NO: 2893352 - DNA, 17 bp, Homo sapiens
ttaaactctcctttgat

SEQ ID NO: 2893353 - DNA, 22 bp, Homo sapiens
ttaaactctcttcttccattag

SEQ ID NO: 2893354 - DNA, 15 bp, Homo sapiens
ttaaactctttttgg

SEQ ID NO: 2893355 - DNA, 20 bp, Homo sapiens
ttaaactgattagtattcag

SEQ ID NO: 2893356 - DNA, 14 bp, Homo sapiens
ttaaacttatgaat

SEQ ID NO: 2893357 - DNA, 13 bp, Homo sapiens
ttaaagaaaatgt

SEQ ID NO: 2893358 - DNA, 18 bp, Homo sapiens
ttaaagaaatttaatgtt

SEQ ID NO: 2893359 - DNA, 12 bp, Homo sapiens
ttaaagacagag

SEQ ID NO: 2893360 - DNA, 16 bp, Homo sapiens
ttaaagactacctggg

SEQ ID NO: 2893361 - DNA, 14 bp, Homo sapiens
ttaaagagataaag

SEQ ID NO: 2893362 - DNA, 12 bp, Homo sapiens
ttaaagagtcta

SEQ ID NO: 2893363 - DNA, 16 bp, Homo sapiens
ttaaagagtctagatt

SEQ ID NO: 2893364 - DNA, 17 bp, Homo sapiens
ttaaagagtctagattc

SEQ ID NO: 2893365 - DNA, 18 bp, Homo sapiens
ttaaagagtctagattca

SEQ ID NO: 2893366 - DNA, 15 bp, Homo sapiens
ttaaagcaaaccagc

SEQ ID NO: 2893367 - DNA, 16 bp, Homo sapiens
ttaaagcatatgctat

SEQ ID NO: 2893368 - DNA, 18 bp, Homo sapiens
ttaaagcattacagtatt

SEQ ID NO: 2893369 - DNA, 16 bp, Homo sapiens
ttaaaggaaaagcaca

SEQ ID NO: 2893370 - DNA, 18 bp, Homo sapiens
tgtgttgtcttgaaagat

SEQ ID NO: 2893371 - DNA, 20 bp, Homo sapiens
tgtgttgtgtttgtagtctt

SEQ ID NO: 2893372 - DNA, 23 bp, Homo sapiens
tgtgttgttgcttcttgtgaagg

SEQ ID NO: 2893373 - DNA, 13 bp, Homo sapiens
tgtgttgtttcca

SEQ ID NO: 2893374 - DNA, 14 bp, Homo sapiens
tgtgttgtttccat

SEQ ID NO: 2893375 - DNA, 14 bp, Homo sapiens
tgtgtttccctaga

SEQ ID NO: 2893376 - DNA, 11 bp, Homo sapiens
tgtgtttcctt

SEQ ID NO: 2893377 - DNA, 14 bp, Homo sapiens
tgtgtttctgtgct

SEQ ID NO: 2893378 - DNA, 16 bp, Homo sapiens
tgtgtttgaaatcatc

SEQ ID NO: 2893379 - DNA, 17 bp, Homo sapiens
tgtgtttggctttcagg

SEQ ID NO: 2893380 - DNA, 20 bp, Homo sapiens
tgtgtttgttctttttattg

SEQ ID NO: 2893381 - DNA, 14 bp, Homo sapiens
tgtgttttcatcat

SEQ ID NO: 2893382 - DNA, 17 bp, Homo sapiens
tgtgttttcatcatttc

SEQ ID NO: 2893383 - DNA, 20 bp, Homo sapiens
tgtgttttcatcatttcagc

SEQ ID NO: 2893384 - DNA, 16 bp, Homo sapiens
tgtgtttttctttttc

SEQ ID NO: 2893385 - DNA, 18 bp, Homo sapiens
tgtgtttttctttttcca

SEQ ID NO: 2893386 - DNA, 16 bp, Homo sapiens
tgtgtttttgcactgt

SEQ ID NO: 2893387 - DNA, 16 bp, Homo sapiens
tgttaaaaataaatcc

SEQ ID NO: 2893388 - DNA, 17 bp, Homo sapiens
tgttaaacagcctattc

SEQ ID NO: 2893389 - DNA, 17 bp, Homo sapiens
tgttaaagagataaaga

SEQ ID NO: 2893390 - DNA, 19 bp, Homo sapiens
tgttaaagagataaagaat

SEQ ID NO: 2893391 - DNA, 18 bp, Homo sapiens
tgttaacacattttgtat

SEQ ID NO: 2893392 - DNA, 20 bp, Homo sapiens
tgttaacacattttgtataa

SEQ ID NO: 2893393 - DNA, 21 bp, Homo sapiens
tgttaacacattttgtataat

SEQ ID NO: 2893394 - DNA, 16 bp, Homo sapiens
tgttaacattccaaga

SEQ ID NO: 2893395 - DNA, 21 bp, Homo sapiens
tgttaacgtgatgtgccacta

SEQ ID NO: 2893396 - DNA, 22 bp, Homo sapiens
tgttaactgaagatattccaac

SEQ ID NO: 2893397 - DNA, 18 bp, Homo sapiens
tgttaactgtactgaagg

SEQ ID NO: 2893398 - DNA, 17 bp, Homo sapiens
tgttaagacttgacagt

SEQ ID NO: 2893399 - DNA, 20 bp, Homo sapiens
tgttaagacttgacagtgga

SEQ ID NO: 2893400 - DNA, 22 bp, Homo sapiens
tgttaaggtcctgaaagtaact

SEQ ID NO: 2893401 - DNA, 17 bp, Homo sapiens
tgttaagtattttcata

SEQ ID NO: 2893402 - DNA, 14 bp, Homo sapiens
tgttaatcaaacaa

SEQ ID NO: 2893403 - DNA, 13 bp, Homo sapiens
tgttaatcaattt

SEQ ID NO: 2893404 - DNA, 18 bp, Homo sapiens
tgttaattaaatatttct

SEQ ID NO: 2893405 - DNA, 21 bp, Homo sapiens
tgttaattataaacagcaggg

SEQ ID NO: 2893406 - DNA, 19 bp, Homo sapiens
tgttacaagtttatatata

SEQ ID NO: 2893407 - DNA, 13 bp, Homo sapiens
tgttacaataaaa

SEQ ID NO: 2893408 - DNA, 15 bp, Homo sapiens
tgttacccatgaaaa

SEQ ID NO: 2893409 - DNA, 22 bp, Homo sapiens
tgttacctgaaaacactgtgca

SEQ ID NO: 2893410 - DNA, 21 bp, Homo sapiens
tgttacgatatttcgtttggt

SEQ ID NO: 2893411 - DNA, 16 bp, Homo sapiens
tgttactatctgcttt

SEQ ID NO: 2893412 - DNA, 14 bp, Homo sapiens
tgttactcatcttt

SEQ ID NO: 2893413 - DNA, 18 bp, Homo sapiens
tgttacttaaacatcatt

SEQ ID NO: 2893414 - DNA, 18 bp, Homo sapiens
tgttacttccccacccct

SEQ ID NO: 2893415 - DNA, 13 bp, Homo sapiens
tgttacttgaagt

SEQ ID NO: 2893416 - DNA, 15 bp, Homo sapiens
tgttacttgaagtaa

SEQ ID NO: 2893417 - DNA, 18 bp, Homo sapiens
tgttacttgaagtaacta

SEQ ID NO: 2893418 - DNA, 13 bp, Homo sapiens
tgttactttgaat

SEQ ID NO: 2893419 - DNA, 22 bp, Homo sapiens
tgttagaaccaccaaaattata

SEQ ID NO: 2893420 - DNA, 18 bp, Homo sapiens
tgttagaattgatttcca

SEQ ID NO: 2893421 - DNA, 15 bp, Homo sapiens
tgttagactcatggt

SEQ ID NO: 2893422 - DNA, 19 bp, Homo sapiens
tgttagattttgcattttt

SEQ ID NO: 2893423 - DNA, 17 bp, Homo sapiens
tgttagctcctcactgt

SEQ ID NO: 2893424 - DNA, 21 bp, Homo sapiens
tgttaggattttcacattctt

SEQ ID NO: 2893425 - DNA, 14 bp, Homo sapiens
tgttagtggcaccg

SEQ ID NO: 2893426 - DNA, 14 bp, Homo sapiens
tgttagttaagttt

SEQ ID NO: 2893427 - DNA, 18 bp, Homo sapiens
tgttagttctagctctat

SEQ ID NO: 2893428 - DNA, 16 bp, Homo sapiens
tgttagtttagtgtgt

SEQ ID NO: 2893429 - DNA, 18 bp, Homo sapiens
tgttataggttgttggat

SEQ ID NO: 2893430 - DNA, 19 bp, Homo sapiens
tgttatcaccgtgggctcc

SEQ ID NO: 2893431 - DNA, 19 bp, Homo sapiens
tgttatccttgtttcctta

SEQ ID NO: 2893432 - DNA, 22 bp, Homo sapiens
tgtgaatatggacagttagcat

SEQ ID NO: 2893433 - DNA, 20 bp, Homo sapiens
tgtgaatatggactcagttt

SEQ ID NO: 2893434 - DNA, 18 bp, Homo sapiens
tgtgaatcagaccctacc

SEQ ID NO: 2893435 - DNA, 22 bp, Homo sapiens
tgtgaatccatgggtctggcta

SEQ ID NO: 2893436 - DNA, 17 bp, Homo sapiens
tgtgaatctgggtggga

SEQ ID NO: 2893437 - DNA, 14 bp, Homo sapiens
tgtgaatgaacact

SEQ ID NO: 2893438 - DNA, 17 bp, Homo sapiens
tgtgaatgaacactctt

SEQ ID NO: 2893439 - DNA, 12 bp, Homo sapiens
tgtgaatgcttc

SEQ ID NO: 2893440 - DNA, 13 bp, Homo sapiens
tgtgaatgcttct

SEQ ID NO: 2893441 - DNA, 14 bp, Homo sapiens
tgtgaattccttaa

SEQ ID NO: 2893442 - DNA, 20 bp, Homo sapiens
tgtgacaatgactaagccaa

SEQ ID NO: 2893443 - DNA, 23 bp, Homo sapiens
tgtgacacactacaccacacaca

SEQ ID NO: 2893444 - DNA, 12 bp, Homo sapiens
tgtgacattgct

SEQ ID NO: 2893445 - DNA, 17 bp, Homo sapiens
tgtgaccaatacatttg

SEQ ID NO: 2893446 - DNA, 19 bp, Homo sapiens
tgtgaccagtctgaccctt

SEQ ID NO: 2893447 - DNA, 15 bp, Homo sapiens
tgtgacccccagctc

SEQ ID NO: 2893448 - DNA, 18 bp, Homo sapiens
tgtgacccctcctggggc

SEQ ID NO: 2893449 - DNA, 23 bp, Homo sapiens
tgtgacccctcctggggccaggc

SEQ ID NO: 2893450 - DNA, 12 bp, Homo sapiens
tgtgacctagca

SEQ ID NO: 2893451 - DNA, 15 bp, Homo sapiens
tgtgacgtgcactgt

SEQ ID NO: 2893452 - DNA, 16 bp, Homo sapiens
tgtgacgtgcactgtg

SEQ ID NO: 2893453 - DNA, 17 bp, Homo sapiens
tgtgactaaaaatgcat

SEQ ID NO: 2893454 - DNA, 15 bp, Homo sapiens
tgtgactaattgtat

SEQ ID NO: 2893455 - DNA, 17 bp, Homo sapiens
tgtgactaattgtataa

SEQ ID NO: 2893456 - DNA, 22 bp, Homo sapiens
tgtgactaattgtataacaggt

SEQ ID NO: 2893457 - DNA, 17 bp, Homo sapiens
tgtgactataaagctgt

SEQ ID NO: 2893458 - DNA, 13 bp, Homo sapiens
tgtgactctgggc

SEQ ID NO: 2893459 - DNA, 17 bp, Homo sapiens
tgtgagataacttcctt

SEQ ID NO: 2893460 - DNA, 18 bp, Homo sapiens
tgtgagatgatttgtact

SEQ ID NO: 2893461 - DNA, 14 bp, Homo sapiens
tgtgagatgtaatt

SEQ ID NO: 2893462 - DNA, 14 bp, Homo sapiens
tgtgagcagaagac

SEQ ID NO: 2893463 - DNA, 17 bp, Homo sapiens
tgtgagcagaagactat

SEQ ID NO: 2893464 - DNA, 14 bp, Homo sapiens
tgtgagccttgcat

SEQ ID NO: 2893465 - DNA, 19 bp, Homo sapiens
tgtgagctcccaggtgcag

SEQ ID NO: 2893466 - DNA, 16 bp, Homo sapiens
tgtgagcttacattga

SEQ ID NO: 2893467 - DNA, 12 bp, Homo sapiens
tgtgaggcaggg

SEQ ID NO: 2893468 - DNA, 13 bp, Homo sapiens
tgtgagggagaga

SEQ ID NO: 2893469 - DNA, 19 bp, Homo sapiens
tgtgagggagtgcagaaca

SEQ ID NO: 2893470 - DNA, 14 bp, Homo sapiens
tgtgagggcagcac

SEQ ID NO: 2893471 - DNA, 18 bp, Homo sapiens
tgtgaggggcccctggcc

SEQ ID NO: 2893472 - DNA, 16 bp, Homo sapiens
tgtgagtatcagaatt

SEQ ID NO: 2893473 - DNA, 21 bp, Homo sapiens
tgtgagtctccccttgcagcc

SEQ ID NO: 2893474 - DNA, 23 bp, Homo sapiens
tgtgagtctccccttgcagcctg

SEQ ID NO: 2893475 - DNA, 18 bp, Homo sapiens
tgtgagtctttggttcta

SEQ ID NO: 2893476 - DNA, 17 bp, Homo sapiens
tgtgagtgtttggggga

SEQ ID NO: 2893477 - DNA, 16 bp, Homo sapiens
tgtgatatatgtatta

SEQ ID NO: 2893478 - DNA, 19 bp, Homo sapiens
tgtgatattctaagactta

SEQ ID NO: 2893479 - DNA, 15 bp, Homo sapiens
tgtgatattgaccat

SEQ ID NO: 2893480 - DNA, 22 bp, Homo sapiens
tgtgatattgaccatgtgatta

SEQ ID NO: 2893481 - DNA, 20 bp, Homo sapiens
tgtgatgaatctacatttgt

SEQ ID NO: 2893482 - DNA, 18 bp, Homo sapiens
tgtgatgggatctgtaag

SEQ ID NO: 2893483 - DNA, 20 bp, Homo sapiens
tgtgattgggaataaatatg

SEQ ID NO: 2893484 - DNA, 14 bp, Homo sapiens
tgtgattgtgccta

SEQ ID NO: 2893485 - DNA, 16 bp, Homo sapiens
tgtgatttaatagtgt

SEQ ID NO: 2893486 - DNA, 19 bp, Homo sapiens
tgtgatttaatagtgttaa

SEQ ID NO: 2893487 - DNA, 20 bp, Homo sapiens
tgtgatttaatagtgttaat

SEQ ID NO: 2893488 - DNA, 22 bp, Homo sapiens
tgtgatttaatagtgttaatca

SEQ ID NO: 2893489 - DNA, 14 bp, Homo sapiens
tgtgattttaactc

SEQ ID NO: 2893490 - DNA, 16 bp, Homo sapiens
tgtgattttaactctg

SEQ ID NO: 2893491 - DNA, 20 bp, Homo sapiens
tgtgattttaactctgtctt

SEQ ID NO: 2893492 - DNA, 22 bp, Homo sapiens
tgtgattttttgttcttgttgt

SEQ ID NO: 2893493 - DNA, 17 bp, Homo sapiens
tgtgcaaaaaaattaaa

SEQ ID NO: 2893494 - DNA, 23 bp, Homo sapiens
tgtgcaaaaaaattaaaatggat

SEQ ID NO: 2893495 - DNA, 17 bp, Homo sapiens
tgtgcaaaaaggactgg

SEQ ID NO: 2893496 - DNA, 14 bp, Homo sapiens
tgtgcaaaagcagg

SEQ ID NO: 2893497 - DNA, 15 bp, Homo sapiens
tgtgcaactcttgta

SEQ ID NO: 2893498 - DNA, 17 bp, Homo sapiens
tgtgcaataatttacat

SEQ ID NO: 2893499 - DNA, 21 bp, Homo sapiens
tgtgcacatatcaagaagtca

SEQ ID NO: 2893500 - DNA, 10 bp, Homo sapiens
tgtgcacatc

SEQ ID NO: 2893501 - DNA, 23 bp, Homo sapiens
tgtgcacatccgcgtgtgcctgt

SEQ ID NO: 2893502 - DNA, 20 bp, Homo sapiens
tgtgcacatctgtgtcttgt

SEQ ID NO: 2893503 - DNA, 19 bp, Homo sapiens
tgtgcaccaccacacccgg

SEQ ID NO: 2893504 - DNA, 12 bp, Homo sapiens
tgtgcactaagg

SEQ ID NO: 2893505 - DNA, 21 bp, Homo sapiens
tgtgcactgcccatggacagg

SEQ ID NO: 2893506 - DNA, 20 bp, Homo sapiens
tgtcgattagactggacagc

SEQ ID NO: 2893507 - DNA, 14 bp, Homo sapiens
tgtcgcccaggctg

SEQ ID NO: 2893508 - DNA, 14 bp, Homo sapiens
tgtcggaggaaaga

SEQ ID NO: 2893509 - DNA, 16 bp, Homo sapiens
tgtcggaggaaagaca

SEQ ID NO: 2893510 - DNA, 17 bp, Homo sapiens
tgtcggaggaaagacaa

SEQ ID NO: 2893511 - DNA, 19 bp, Homo sapiens
tgtcggaggaaagacaaca

SEQ ID NO: 2893512 - DNA, 20 bp, Homo sapiens
tgtcgggctttgtgtgaagg

SEQ ID NO: 2893513 - DNA, 21 bp, Homo sapiens
tgtcgtctctcccaccccctc

SEQ ID NO: 2893514 - DNA, 23 bp, Homo sapiens
tgtcgtgagtgtctcttgtctaa

SEQ ID NO: 2893515 - DNA, 14 bp, Homo sapiens
tgtcgtgttttcaa

SEQ ID NO: 2893516 - DNA, 21 bp, Homo sapiens
tgtcgtgttttcaaggaagaa

SEQ ID NO: 2893517 - DNA, 18 bp, Homo sapiens
tgtcgtttcattcatttt

SEQ ID NO: 2893518 - DNA, 15 bp, Homo sapiens
tgtctaaaacaataa

SEQ ID NO: 2893519 - DNA, 17 bp, Homo sapiens
tgtctaaaacaataaaa

SEQ ID NO: 2893520 - DNA, 21 bp, Homo sapiens
tgtctaaacaatgctgatttg

SEQ ID NO: 2893521 - DNA, 13 bp, Homo sapiens
tgtctaaagcctt

SEQ ID NO: 2893522 - DNA, 23 bp, Homo sapiens
tgtctaaagccttaactaagact

SEQ ID NO: 2893523 - DNA, 15 bp, Homo sapiens
tgtctaagattctag

SEQ ID NO: 2893524 - DNA, 17 bp, Homo sapiens
tgtctaagattctagat

SEQ ID NO: 2893525 - DNA, 18 bp, Homo sapiens
tgtctaagattctagatc

SEQ ID NO: 2893526 - DNA, 21 bp, Homo sapiens
tgtctaagcagttttgtaaat

SEQ ID NO: 2893527 - DNA, 19 bp, Homo sapiens
tgtctaattcatttactca

SEQ ID NO: 2893528 - DNA, 21 bp, Homo sapiens
tgtctactttctcttgtttaa

SEQ ID NO: 2893529 - DNA, 22 bp, Homo sapiens
tgtctactttctcttgtttaaa

SEQ ID NO: 2893530 - DNA, 17 bp, Homo sapiens
tgtctagaatcctgctt

SEQ ID NO: 2893531 - DNA, 18 bp, Homo sapiens
tgtctagaatcctgcttt

SEQ ID NO: 2893532 - DNA, 20 bp, Homo sapiens
tgtctagcatgccaacaaga

SEQ ID NO: 2893533 - DNA, 21 bp, Homo sapiens
tgtctagcatgccaacaagaa

SEQ ID NO: 2893534 - DNA, 20 bp, Homo sapiens
tgtctagccttagtcaataa

SEQ ID NO: 2893535 - DNA, 13 bp, Homo sapiens
tgtctagtgtctg

SEQ ID NO: 2893536 - DNA, 18 bp, Homo sapiens
tgtctatctctaataaaa

SEQ ID NO: 2893537 - DNA, 13 bp, Homo sapiens
tgtctattattat

SEQ ID NO: 2893538 - DNA, 21 bp, Homo sapiens
tgtctcaatagctccaagctg

SEQ ID NO: 2893539 - DNA, 23 bp, Homo sapiens
tgtctcaatagctccaagctgtt

SEQ ID NO: 2893540 - DNA, 17 bp, Homo sapiens
tgtctcactgaaacatt

SEQ ID NO: 2893541 - DNA, 12 bp, Homo sapiens
tgtctcagtgat

SEQ ID NO: 2893542 - DNA, 23 bp, Homo sapiens
tgtctcagtgattcgcttttggt

SEQ ID NO: 2893543 - DNA, 15 bp, Homo sapiens
tgtctccatggccct

SEQ ID NO: 2893544 - DNA, 18 bp, Homo sapiens
tgtctcctactctgtgta

SEQ ID NO: 2893545 - DNA, 17 bp, Homo sapiens
tgtctcctttaagagct

SEQ ID NO: 2893546 - DNA, 14 bp, Homo sapiens
tgtctcgtctcctg

SEQ ID NO: 2893547 - DNA, 20 bp, Homo sapiens
tgtctcgtctcctgacatgt

SEQ ID NO: 2893548 - DNA, 12 bp, Homo sapiens
tgtctctctggg

SEQ ID NO: 2893549 - DNA, 18 bp, Homo sapiens
tgtctctttccactttgt

SEQ ID NO: 2893550 - DNA, 23 bp, Homo sapiens
tgtctctttgcaactcctgtaat

SEQ ID NO: 2893551 - DNA, 12 bp, Homo sapiens
tgtctgaaaaat

SEQ ID NO: 2893552 - DNA, 14 bp, Homo sapiens
tgtctgaacaaaaa

SEQ ID NO: 2893553 - DNA, 12 bp, Homo sapiens
tgtctgaacttt

SEQ ID NO: 2893554 - DNA, 15 bp, Homo sapiens
tgtctgagagaccat

SEQ ID NO: 2893555 - DNA, 20 bp, Homo sapiens
tgtctgagagaccatctcct

SEQ ID NO: 2893556 - DNA, 18 bp, Homo sapiens
tgtctgagagtttagttg

SEQ ID NO: 2893557 - DNA, 13 bp, Homo sapiens
tgtctgcaacatg

SEQ ID NO: 2893558 - DNA, 15 bp, Homo sapiens
tgtctgcaatggtga

SEQ ID NO: 2893559 - DNA, 17 bp, Homo sapiens
tgtctgcagccctgaga

SEQ ID NO: 2893560 - DNA, 21 bp, Homo sapiens
tgtctgcctggagtgctgtgc

SEQ ID NO: 2893561 - DNA, 14 bp, Homo sapiens
tgtctggcctgagg

SEQ ID NO: 2893562 - DNA, 17 bp, Homo sapiens
tgtctggctgcagagca

SEQ ID NO: 2893563 - DNA, 17 bp, Homo sapiens
tgtctggtccaggagaa

SEQ ID NO: 2893564 - DNA, 13 bp, Homo sapiens
tgtctgtacacgt

SEQ ID NO: 2893565 - DNA, 19 bp, Homo sapiens
tgtctgtacacgtgtcctg

SEQ ID NO: 2893566 - DNA, 19 bp, Homo sapiens
tgtctgtacctaaagcaat

SEQ ID NO: 2893567 - DNA, 22 bp, Homo sapiens
tgtctgtaggtacgttttatat

SEQ ID NO: 2893568 - DNA, 14 bp, Homo sapiens
tgtctgtccaaccc

SEQ ID NO: 2893569 - DNA, 18 bp, Homo sapiens
tgtctgtccaacccctcc

SEQ ID NO: 2893570 - DNA, 15 bp, Homo sapiens
tgtctgtctctcccc

SEQ ID NO: 2893571 - DNA, 22 bp, Homo sapiens
tgtctgtgatgctcccaagcaa

SEQ ID NO: 2893572 - DNA, 20 bp, Homo sapiens
tgtctgtggatggtcattgc

SEQ ID NO: 2893573 - DNA, 21 bp, Homo sapiens
tgtctgtggatggtcattgca

SEQ ID NO: 2893574 - DNA, 22 bp, Homo sapiens
tgtctgtggttgcagtctttcc

SEQ ID NO: 2893575 - DNA, 11 bp, Homo sapiens
tgtctgttaca

SEQ ID NO: 2893576 - DNA, 16 bp, Homo sapiens
tgtctgtttgttctct

SEQ ID NO: 2893577 - DNA, 20 bp, Homo sapiens
tgtcttaatttctatcttgt

SEQ ID NO: 2893578 - DNA, 18 bp, Homo sapiens
tgtcttagctctggacgt

SEQ ID NO: 2893579 - DNA, 24 bp, Homo sapiens
tgtcttcacctgattcaactaaaa

SEQ ID NO: 2893580 - DNA, 20 bp, Homo sapiens
tgtcttcaggctctgcccag

SEQ ID NO: 2893581 - DNA, 23 bp, Homo sapiens
tgtcttcagtggaacacaaatga

SEQ ID NO: 2893582 - DNA, 14 bp, Homo sapiens
tgtcttctcctaat

SEQ ID NO: 2893583 - DNA, 20 bp, Homo sapiens
tgtcttctccttcaaaacat

SEQ ID NO: 2893584 - DNA, 21 bp, Homo sapiens
tgtcttctctatcctctctct

SEQ ID NO: 2893585 - DNA, 16 bp, Homo sapiens
tggggctggttctgta

SEQ ID NO: 2893586 - DNA, 15 bp, Homo sapiens
tgggggaagccctgg

SEQ ID NO: 2893587 - DNA, 16 bp, Homo sapiens
tgggggaagccctgga

SEQ ID NO: 2893588 - DNA, 22 bp, Homo sapiens
tgggggagaaaaaatcactgtt

SEQ ID NO: 2893589 - DNA, 23 bp, Homo sapiens
tgggggagaaaaaatcactgttt

SEQ ID NO: 2893590 - DNA, 15 bp, Homo sapiens
tgggggagagaggca

SEQ ID NO: 2893591 - DNA, 17 bp, Homo sapiens
tgggggagattgaactt

SEQ ID NO: 2893592 - DNA, 20 bp, Homo sapiens
tgggggagccaggagacctg

SEQ ID NO: 2893593 - DNA, 22 bp, Homo sapiens
tgggggctccccttgcccttcc

SEQ ID NO: 2893594 - DNA, 17 bp, Homo sapiens
tggggggacccagtgca

SEQ ID NO: 2893595 - DNA, 17 bp, Homo sapiens
tggggggcttcatacac

SEQ ID NO: 2893596 - DNA, 23 bp, Homo sapiens
tgggggggctcccgtggcctgta

SEQ ID NO: 2893597 - DNA, 15 bp, Homo sapiens
tgggggggctgcctt

SEQ ID NO: 2893598 - DNA, 17 bp, Homo sapiens
tgggggtcatcagggag

SEQ ID NO: 2893599 - DNA, 19 bp, Homo sapiens
tggggtaagcggaataaac

SEQ ID NO: 2893600 - DNA, 13 bp, Homo sapiens
tggggtcatgccc

SEQ ID NO: 2893601 - DNA, 13 bp, Homo sapiens
tggggtctccctc

SEQ ID NO: 2893602 - DNA, 14 bp, Homo sapiens
tggggtctggcagc

SEQ ID NO: 2893603 - DNA, 18 bp, Homo sapiens
tggggtctggcagcctcc

SEQ ID NO: 2893604 - DNA, 16 bp, Homo sapiens
tggggtgaacagctgg

SEQ ID NO: 2893605 - DNA, 16 bp, Homo sapiens
tggggtgcactcgcca

SEQ ID NO: 2893606 - DNA, 21 bp, Homo sapiens
ttccacggagccactcctctg

SEQ ID NO: 2893607 - DNA, 15 bp, Homo sapiens
ttccactcccactgc

SEQ ID NO: 2893608 - DNA, 19 bp, Homo sapiens
ttccactcccactgccagg

SEQ ID NO: 2893609 - DNA, 16 bp, Homo sapiens
ttccactctgatagaa

SEQ ID NO: 2893610 - DNA, 18 bp, Homo sapiens
ttccactctgatagaatt

SEQ ID NO: 2893611 - DNA, 13 bp, Homo sapiens
ttccacttctctg

SEQ ID NO: 2893612 - DNA, 15 bp, Homo sapiens
ttccagaatgctgta

SEQ ID NO: 2893613 - DNA, 20 bp, Homo sapiens
ttctaacaaggacttggaga

SEQ ID NO: 2893614 - DNA, 17 bp, Homo sapiens
ttctaacatattgccat

SEQ ID NO: 2893615 - DNA, 23 bp, Homo sapiens
ttctaaccaaagagtctctggct

SEQ ID NO: 2893616 - DNA, 15 bp, Homo sapiens
ttctaactccagtga

SEQ ID NO: 2893617 - DNA, 13 bp, Homo sapiens
ttctaagactcaa

SEQ ID NO: 2893618 - DNA, 23 bp, Homo sapiens
ttctaagatgtgatattctaaga

SEQ ID NO: 2893619 - DNA, 23 bp, Homo sapiens
ttctaaggactttttcttaggtt

SEQ ID NO: 2893620 - DNA, 17 bp, Homo sapiens
ttctaaggcctaggatt

SEQ ID NO: 2893621 - DNA, 20 bp, Homo sapiens
ttctaaggcctaggattcta

SEQ ID NO: 2893622 - DNA, 21 bp, Homo sapiens
ttctaagggaggcacttcctc

SEQ ID NO: 2893623 - DNA, 14 bp, Homo sapiens
ttctaagtttctaa

SEQ ID NO: 2893624 - DNA, 20 bp, Homo sapiens
ttctaagtttctaagattct

SEQ ID NO: 2893625 - DNA, 15 bp, Homo sapiens
ttctaatcataacat

SEQ ID NO: 2893626 - DNA, 13 bp, Homo sapiens
ttctaatgatgat

SEQ ID NO: 2893627 - DNA, 15 bp, Homo sapiens
ttctaattttgtgct

SEQ ID NO: 2893628 - DNA, 15 bp, Homo sapiens
ttctacacagagcag

SEQ ID NO: 2893629 - DNA, 14 bp, Homo sapiens
ttctacacctggac

SEQ ID NO: 2893630 - DNA, 15 bp, Homo sapiens
ttctacataattgtg

SEQ ID NO: 2893631 - DNA, 15 bp, Homo sapiens
ttctactaagttatt

SEQ ID NO: 2893632 - DNA, 22 bp, Homo sapiens
ttctacttgcttattacattta

SEQ ID NO: 2893633 - DNA, 19 bp, Homo sapiens
ttctactttgatatgactg

SEQ ID NO: 2893634 - DNA, 22 bp, Homo sapiens
ttctagaacatccctgccagct

SEQ ID NO: 2893635 - DNA, 22 bp, Homo sapiens
ttctagaagataacattttcaa

SEQ ID NO: 2893636 - DNA, 23 bp, Homo sapiens
ttctagaagataacattttcaat

SEQ ID NO: 2893637 - DNA, 16 bp, Homo sapiens
ttctagagcactgcca

SEQ ID NO: 2893638 - DNA, 19 bp, Homo sapiens
ttctagagttcagagtcct

SEQ ID NO: 2893639 - DNA, 22 bp, Homo sapiens
ttctagagttttatagcctgga

SEQ ID NO: 2893640 - DNA, 22 bp, Homo sapiens
ttctagatcagatgctccaaga

SEQ ID NO: 2893641 - DNA, 23 bp, Homo sapiens
ttctagatcagatgctccaagat

SEQ ID NO: 2893642 - DNA, 14 bp, Homo sapiens
ttctagatgacata

SEQ ID NO: 2893643 - DNA, 21 bp, Homo sapiens
ttctagcctggggcttgaatt

SEQ ID NO: 2893644 - DNA, 19 bp, Homo sapiens
ttctagctctatttacttc

SEQ ID NO: 2893645 - DNA, 23 bp, Homo sapiens
ttctaggaagaattttaaaaatg

SEQ ID NO: 2893646 - DNA, 21 bp, Homo sapiens
ttctaggagtcaactggctgg

SEQ ID NO: 2893647 - DNA, 14 bp, Homo sapiens
ttctagggctggga

SEQ ID NO: 2893648 - DNA, 15 bp, Homo sapiens
ttctagggtattctg

SEQ ID NO: 2893649 - DNA, 18 bp, Homo sapiens
ttctaggtaggaaatgtg

SEQ ID NO: 2893650 - DNA, 17 bp, Homo sapiens
ttctaggtttcaaagat

SEQ ID NO: 2893651 - DNA, 16 bp, Homo sapiens
ttctagtacataattg

SEQ ID NO: 2893652 - DNA, 18 bp, Homo sapiens
ttctagtttgcaacttca

SEQ ID NO: 2893653 - DNA, 14 bp, Homo sapiens
ttctagtttgcatt

SEQ ID NO: 2893654 - DNA, 15 bp, Homo sapiens
ttctagtttgcattc

SEQ ID NO: 2893655 - DNA, 15 bp, Homo sapiens
ttctagtttttaatt

SEQ ID NO: 2893656 - DNA, 21 bp, Homo sapiens
ttctataaggccataaaacag

SEQ ID NO: 2893657 - DNA, 13 bp, Homo sapiens
ttctataatttaa

SEQ ID NO: 2893658 - DNA, 14 bp, Homo sapiens
ttctataatttaaa

SEQ ID NO: 2893659 - DNA, 14 bp, Homo sapiens
ttctatacaaatat

SEQ ID NO: 2893660 - DNA, 15 bp, Homo sapiens
ttctatagttctaga

SEQ ID NO: 2893661 - DNA, 18 bp, Homo sapiens
ttctatattttaatagaa

SEQ ID NO: 2893662 - DNA, 19 bp, Homo sapiens
ttctatattttaatagaaa

SEQ ID NO: 2893663 - DNA, 14 bp, Homo sapiens
ttctatcctctgta

SEQ ID NO: 2893664 - DNA, 15 bp, Homo sapiens
ttctatcgttattat

SEQ ID NO: 2893665 - DNA, 22 bp, Homo sapiens
ttctatgccatttttagtttaa

SEQ ID NO: 2893666 - DNA, 13 bp, Homo sapiens
ttctatgtttact

SEQ ID NO: 2893667 - DNA, 15 bp, Homo sapiens
ttctattaaagtgct

SEQ ID NO: 2893668 - DNA, 21 bp, Homo sapiens
ttctattaaagtgctaaggtt

SEQ ID NO: 2893669 - DNA, 17 bp, Homo sapiens
ttctattgacttcaatg

SEQ ID NO: 2893670 - DNA, 19 bp, Homo sapiens
ttctatttctcctccatgg

SEQ ID NO: 2893671 - DNA, 17 bp, Homo sapiens
ttctatttctctgtgta

SEQ ID NO: 2893672 - DNA, 22 bp, Homo sapiens
ttctattttaagactgatttta

SEQ ID NO: 2893673 - DNA, 17 bp, Homo sapiens
ttctatttttatcatga

SEQ ID NO: 2893674 - DNA, 15 bp, Homo sapiens
ttctcaaagctggga

SEQ ID NO: 2893675 - DNA, 13 bp, Homo sapiens
ttctcaaagtttt

SEQ ID NO: 2893676 - DNA, 23 bp, Homo sapiens
ttctcaaagttttattataaatt

SEQ ID NO: 2893677 - DNA, 17 bp, Homo sapiens
ttctcaagttctaagat

SEQ ID NO: 2893678 - DNA, 20 bp, Homo sapiens
ttctcaagttctaagattct

SEQ ID NO: 2893679 - DNA, 18 bp, Homo sapiens
ttctcaatgaaaaatagt

SEQ ID NO: 2893680 - DNA, 19 bp, Homo sapiens
ttctcaccagctgcaaagt

SEQ ID NO: 2893681 - DNA, 15 bp, Homo sapiens
ttctcactccaccac

SEQ ID NO: 2893682 - DNA, 15 bp, Homo sapiens
ttctcagagcactgt

SEQ ID NO: 2893683 - DNA, 12 bp, Homo sapiens
ttctcaggaaat

SEQ ID NO: 2893684 - DNA, 21 bp, Homo sapiens
ttctcagtgccaactgtggct

SEQ ID NO: 2893685 - DNA, 22 bp, Homo sapiens
ttctcatagataagatataaat

SEQ ID NO: 2893686 - DNA, 17 bp, Homo sapiens
ttctccaaaggctctgt

SEQ ID NO: 2893687 - DNA, 19 bp, Homo sapiens
ttctccacaacactgtgtc

SEQ ID NO: 2893688 - DNA, 15 bp, Homo sapiens
ttctccacagcaacc

SEQ ID NO: 2893689 - DNA, 14 bp, Homo sapiens
ttctccactcagtt

SEQ ID NO: 2893690 - DNA, 14 bp, Homo sapiens
ttctccagaaccca

SEQ ID NO: 2893691 - DNA, 15 bp, Homo sapiens
ttctccagtccctgg

SEQ ID NO: 2893692 - DNA, 20 bp, Homo sapiens
ttctccatccacatgggagc

SEQ ID NO: 2893693 - DNA, 15 bp, Homo sapiens
ttctccatgttggtc

SEQ ID NO: 2893694 - DNA, 22 bp, Homo sapiens
ttctccccgaggctgccccagg

SEQ ID NO: 2893695 - DNA, 23 bp, Homo sapiens
ttctccctggggatgtgctttgt

SEQ ID NO: 2893696 - DNA, 16 bp, Homo sapiens
ttctcctcctcctccc

SEQ ID NO: 2893697 - DNA, 18 bp, Homo sapiens
ttctcctcctcctccctc

SEQ ID NO: 2893698 - DNA, 14 bp, Homo sapiens
ttctcctcttgtaa

SEQ ID NO: 2893699 - DNA, 22 bp, Homo sapiens
ttctcctttggcatgtttaatt

SEQ ID NO: 2893700 - DNA, 14 bp, Homo sapiens
ttctcctttgtact

SEQ ID NO: 2893701 - DNA, 17 bp, Homo sapiens
ttctcctttgtactttg

SEQ ID NO: 2893702 - DNA, 19 bp, Homo sapiens
ttctcgcctaggatttcag

SEQ ID NO: 2893703 - DNA, 23 bp, Homo sapiens
ttctcgcctaggatttcagccat

SEQ ID NO: 2893704 - DNA, 22 bp, Homo sapiens
ttctcgctcccgccagcagcat

SEQ ID NO: 2893705 - DNA, 14 bp, Homo sapiens
ttctcggagctggc

SEQ ID NO: 2893706 - DNA, 19 bp, Homo sapiens
ttctctaagagaacaatgt

SEQ ID NO: 2893707 - DNA, 15 bp, Homo sapiens
ttctctattgtaatt

SEQ ID NO: 2893708 - DNA, 16 bp, Homo sapiens
ttctctccaatttaac

SEQ ID NO: 2893709 - DNA, 17 bp, Homo sapiens
ttctctccacttctggt

SEQ ID NO: 2893710 - DNA, 16 bp, Homo sapiens
ttctctcctaatgatg

SEQ ID NO: 2893711 - DNA, 19 bp, Homo sapiens
ttctctcctaatgatgact

SEQ ID NO: 2893712 - DNA, 23 bp, Homo sapiens
ttctctgaagagtgggtttcaca

SEQ ID NO: 2893713 - DNA, 16 bp, Homo sapiens
ttctctgagtcagctg

SEQ ID NO: 2893714 - DNA, 12 bp, Homo sapiens
ttctctgcccag

SEQ ID NO: 2893715 - DNA, 13 bp, Homo sapiens
ttctctgcccagc

SEQ ID NO: 2893716 - DNA, 21 bp, Homo sapiens
ttctctgccgctacctccctc

SEQ ID NO: 2893717 - DNA, 16 bp, Homo sapiens
ttctctgggtcccggg

SEQ ID NO: 2893718 - DNA, 13 bp, Homo sapiens
ttctctgtacttt

SEQ ID NO: 2893719 - DNA, 10 bp, Homo sapiens
ttctctgtat

SEQ ID NO: 2893720 - DNA, 13 bp, Homo sapiens
ttctctgtatatt

SEQ ID NO: 2893721 - DNA, 15 bp, Homo sapiens
ttctctgtatattta

SEQ ID NO: 2893722 - DNA, 11 bp, Homo sapiens
ttctctgtcca

SEQ ID NO: 2893723 - DNA, 12 bp, Homo sapiens
ttctctgtgaat

SEQ ID NO: 2893724 - DNA, 22 bp, Homo sapiens
ttctctgtgaatccatgggtct

SEQ ID NO: 2893725 - DNA, 18 bp, Homo sapiens
ttctctgtgtctaagatt

SEQ ID NO: 2893726 - DNA, 20 bp, Homo sapiens
ttctctgtgtctaagattct

SEQ ID NO: 2893727 - DNA, 18 bp, Homo sapiens
ttctcttagctactgtat

SEQ ID NO: 2893728 - DNA, 20 bp, Homo sapiens
ttctcttccttttatcagta

SEQ ID NO: 2893729 - DNA, 18 bp, Homo sapiens
ttctcttctgttctgatt

SEQ ID NO: 2893730 - DNA, 12 bp, Homo sapiens
ttctcttctttg

SEQ ID NO: 2893731 - DNA, 20 bp, Homo sapiens
ttctcttgacagtctgaagc

SEQ ID NO: 2893732 - DNA, 13 bp, Homo sapiens
ttctcttttcctc

SEQ ID NO: 2893733 - DNA, 17 bp, Homo sapiens
ttctgaaaaatgaatgt

SEQ ID NO: 2893734 - DNA, 19 bp, Homo sapiens
ttctgaaactcccttgtgt

SEQ ID NO: 2893735 - DNA, 23 bp, Homo sapiens
ttctgaaactcccttgtgttcct

SEQ ID NO: 2893736 - DNA, 20 bp, Homo sapiens
ttctgaagcttatgtttctt

SEQ ID NO: 2893737 - DNA, 20 bp, Homo sapiens
ttctgaagtgtgtccatcct

SEQ ID NO: 2893738 - DNA, 13 bp, Homo sapiens
ttctgaagtttta

SEQ ID NO: 2893739 - DNA, 20 bp, Homo sapiens
ttctgaatgtttgtgtctgt

SEQ ID NO: 2893740 - DNA, 21 bp, Homo sapiens
ttctgaatgtttgtgtctgtg

SEQ ID NO: 2893741 - DNA, 16 bp, Homo sapiens
ttctgaattgtccttt

SEQ ID NO: 2893742 - DNA, 15 bp, Homo sapiens
ttctgacagttgtga

SEQ ID NO: 2893743 - DNA, 18 bp, Homo sapiens
ttctgacagtttttctgt

SEQ ID NO: 2893744 - DNA, 18 bp, Homo sapiens
ttctgacctcaagtgatt

SEQ ID NO: 2893745 - DNA, 13 bp, Homo sapiens
ttctttaaaagaa

SEQ ID NO: 2893746 - DNA, 15 bp, Homo sapiens
ttctttaaaattaca

SEQ ID NO: 2893747 - DNA, 14 bp, Homo sapiens
ttctttaaacactc

SEQ ID NO: 2893748 - DNA, 21 bp, Homo sapiens
ttctttaaatcagtattccat

SEQ ID NO: 2893749 - DNA, 12 bp, Homo sapiens
ttctttaaatta

SEQ ID NO: 2893750 - DNA, 14 bp, Homo sapiens
ttctttaatatgat

SEQ ID NO: 2893751 - DNA, 13 bp, Homo sapiens
ttctttagaaaac

SEQ ID NO: 2893752 - DNA, 18 bp, Homo sapiens
ttctttagagaactgaaa

SEQ ID NO: 2893753 - DNA, 20 bp, Homo sapiens
ttctttagagaactgaaaag

SEQ ID NO: 2893754 - DNA, 16 bp, Homo sapiens
ttctttatacaacagt

SEQ ID NO: 2893755 - DNA, 19 bp, Homo sapiens
ttctttatacaacagtgct

SEQ ID NO: 2893756 - DNA, 18 bp, Homo sapiens
ttctttatatacaataat

SEQ ID NO: 2893757 - DNA, 18 bp, Homo sapiens
ttctttcctttactcctg

SEQ ID NO: 2893758 - DNA, 13 bp, Homo sapiens
ttctttctcccta

SEQ ID NO: 2893759 - DNA, 12 bp, Homo sapiens
ttctttcttggt

SEQ ID NO: 2893760 - DNA, 12 bp, Homo sapiens
ttctttgcaaag

SEQ ID NO: 2893761 - DNA, 18 bp, Homo sapiens
ttctttgcctgttcagtt

SEQ ID NO: 2893762 - DNA, 22 bp, Homo sapiens
ttctttggccccttgctggagt

SEQ ID NO: 2893763 - DNA, 13 bp, Homo sapiens
ttctttgggccag

SEQ ID NO: 2893764 - DNA, 19 bp, Homo sapiens
ttctttggtaggtaaatct

SEQ ID NO: 2893765 - DNA, 12 bp, Homo sapiens
ttctttgttcct

SEQ ID NO: 2893766 - DNA, 16 bp, Homo sapiens
ttctttgttcctgctt

SEQ ID NO: 2893767 - DNA, 17 bp, Homo sapiens
ttctttgttcctgcttt

SEQ ID NO: 2893768 - DNA, 22 bp, Homo sapiens
ttctttgttcctgctttctctt

SEQ ID NO: 2893769 - DNA, 12 bp, Homo sapiens
ttcttttatcac

SEQ ID NO: 2893770 - DNA, 20 bp, Homo sapiens
ttcttttcacattcttataa

SEQ ID NO: 2893771 - DNA, 14 bp, Homo sapiens
ttcttttggcttcc

SEQ ID NO: 2893772 - DNA, 13 bp, Homo sapiens
ttcttttgtaatt

SEQ ID NO: 2893773 - DNA, 16 bp, Homo sapiens
ttcttttgtaattgtg

SEQ ID NO: 2893774 - DNA, 13 bp, Homo sapiens
ttcttttgtttca

SEQ ID NO: 2893775 - DNA, 20 bp, Homo sapiens
ttctttttaattattttaaa

SEQ ID NO: 2893776 - DNA, 17 bp, Homo sapiens
ttctttttcttgtcatt

SEQ ID NO: 2893777 - DNA, 16 bp, Homo sapiens
ttgaaaaaaaatagat

SEQ ID NO: 2893778 - DNA, 19 bp, Homo sapiens
ttgaaaaaaagtttctatt

SEQ ID NO: 2893779 - DNA, 20 bp, Homo sapiens
ttgaaaaaatagagcctgag

SEQ ID NO: 2893780 - DNA, 22 bp, Homo sapiens
ttgaaaaaatagagcctgaggg

SEQ ID NO: 2893781 - DNA, 13 bp, Homo sapiens
ttgaaaaaatcaa

SEQ ID NO: 2893782 - DNA, 14 bp, Homo sapiens
ttgaaaaatcactt

SEQ ID NO: 2893783 - DNA, 13 bp, Homo sapiens
ttgaaaagaggtg

SEQ ID NO: 2893784 - DNA, 14 bp, Homo sapiens
ttgaaaagaggtgt

SEQ ID NO: 2893785 - DNA, 21 bp, Homo sapiens
ttgaaaagaggtgtgcaagag

SEQ ID NO: 2893786 - DNA, 19 bp, Homo sapiens
ttgaaaagattctgaaacc

SEQ ID NO: 2893787 - DNA, 21 bp, Homo sapiens
ttgaaaatcttataatttaaa

SEQ ID NO: 2893788 - DNA, 19 bp, Homo sapiens
ttgaaaatgtatttcctga

SEQ ID NO: 2893789 - DNA, 15 bp, Homo sapiens
ttgaaacagaaaaat

SEQ ID NO: 2893790 - DNA, 14 bp, Homo sapiens
ttgaaactgcttga

SEQ ID NO: 2893791 - DNA, 17 bp, Homo sapiens
ttgaaagaaaggactct

SEQ ID NO: 2893792 - DNA, 15 bp, Homo sapiens
ttgaaagattcaggt

SEQ ID NO: 2893793 - DNA, 22 bp, Homo sapiens
ttgaaagattcaggtatgttgc

SEQ ID NO: 2893794 - DNA, 20 bp, Homo sapiens
ttgaaagcaaaaatgctaat

SEQ ID NO: 2893795 - DNA, 23 bp, Homo sapiens
ttgaaaggggaaacgtctcccag

SEQ ID NO: 2893796 - DNA, 12 bp, Homo sapiens
ttgaaatacctt

SEQ ID NO: 2893797 - DNA, 16 bp, Homo sapiens
ttgaaatgaactttgt

SEQ ID NO: 2893798 - DNA, 23 bp, Homo sapiens
ttgaaatgaactttgtcagtgtt

SEQ ID NO: 2893799 - DNA, 16 bp, Homo sapiens
ttgaaatgtaatttca

SEQ ID NO: 2893800 - DNA, 20 bp, Homo sapiens
ttgaaattctgaatttgcaa

SEQ ID NO: 2893801 - DNA, 15 bp, Homo sapiens
ttgaacacaaactgt

SEQ ID NO: 2893802 - DNA, 21 bp, Homo sapiens
ttgaacgtgccagcagccctt

SEQ ID NO: 2893803 - DNA, 22 bp, Homo sapiens
ttgaactgatagttactgttgt

SEQ ID NO: 2893804 - DNA, 13 bp, Homo sapiens
ttgaactgattca

SEQ ID NO: 2893805 - DNA, 22 bp, Homo sapiens
ttgaactttcctggatgtctga

SEQ ID NO: 2893806 - DNA, 16 bp, Homo sapiens
ttgaacttttttccac

SEQ ID NO: 2893807 - DNA, 22 bp, Homo sapiens
ttgaacttttttccactgaagt

SEQ ID NO: 2893808 - DNA, 21 bp, Homo sapiens
ttgaagaatgttaagacttga

SEQ ID NO: 2893809 - DNA, 18 bp, Homo sapiens
ttgaagaggatattcttc

SEQ ID NO: 2893810 - DNA, 14 bp, Homo sapiens
ttgaagatctgatt

SEQ ID NO: 2893811 - DNA, 14 bp, Homo sapiens
ttgaagcacgtaca

SEQ ID NO: 2893812 - DNA, 11 bp, Homo sapiens
ttgaagcagct

SEQ ID NO: 2893813 - DNA, 17 bp, Homo sapiens
ttgaagctgttgctatt

SEQ ID NO: 2893814 - DNA, 11 bp, Homo sapiens
ttgaaggaaac

SEQ ID NO: 2893815 - DNA, 21 bp, Homo sapiens
ttgaaggaaatgagtggccag

SEQ ID NO: 2893816 - DNA, 15 bp, Homo sapiens
ttgaaggcaaaattg

SEQ ID NO: 2893817 - DNA, 15 bp, Homo sapiens
ttgaaggcctggaat

SEQ ID NO: 2893818 - DNA, 20 bp, Homo sapiens
ttgaagggccagagccaggg

SEQ ID NO: 2893819 - DNA, 23 bp, Homo sapiens
ttgaaggtgctgacggccaggga

SEQ ID NO: 2893820 - DNA, 21 bp, Homo sapiens
ttgaagtaactataacaaaaa

SEQ ID NO: 2893821 - DNA, 15 bp, Homo sapiens
ttgaagtacttgcca

SEQ ID NO: 2893822 - DNA, 21 bp, Homo sapiens
ttgaagtctttaatattttaa

SEQ ID NO: 2893823 - DNA, 12 bp, Homo sapiens
ttgaataaagaa

SEQ ID NO: 2893824 - DNA, 21 bp, Homo sapiens
ttgaataaagcctgcttttta

SEQ ID NO: 2893825 - DNA, 19 bp, Homo sapiens
ttgaataggaaataaaatt

SEQ ID NO: 2893826 - DNA, 18 bp, Homo sapiens
ttgaataggaagatcgtt

SEQ ID NO: 2893827 - DNA, 22 bp, Homo sapiens
ttgaatatttagcataaattta

SEQ ID NO: 2893828 - DNA, 20 bp, Homo sapiens
ttgaatccaaatctgtcctc

SEQ ID NO: 2893829 - DNA, 21 bp, Homo sapiens
ttgaatctatgaacctgaaaa

SEQ ID NO: 2893830 - DNA, 20 bp, Homo sapiens
ttgaatctatttaagtaaaa

SEQ ID NO: 2893831 - DNA, 17 bp, Homo sapiens
ttgaatgtccaaaattt

SEQ ID NO: 2893832 - DNA, 18 bp, Homo sapiens
ttgaatgtgatcatcttt

SEQ ID NO: 2893833 - DNA, 15 bp, Homo sapiens
ttgaattctggaaac

SEQ ID NO: 2893834 - DNA, 22 bp, Homo sapiens
ttgaattggcctgaacagatgt

SEQ ID NO: 2893835 - DNA, 14 bp, Homo sapiens
ttgaattgttacat

SEQ ID NO: 2893836 - DNA, 14 bp, Homo sapiens
ttgaattttctgtg

SEQ ID NO: 2893837 - DNA, 18 bp, Homo sapiens
ttgacaactggcaggcag

SEQ ID NO: 2893838 - DNA, 14 bp, Homo sapiens
ttgacacaagtgga

SEQ ID NO: 2893839 - DNA, 19 bp, Homo sapiens
ttgacacaggtctttccta

SEQ ID NO: 2893840 - DNA, 15 bp, Homo sapiens
ttgacacctttgaat

SEQ ID NO: 2893841 - DNA, 20 bp, Homo sapiens
ttgacagatactttgtattt

SEQ ID NO: 2893842 - DNA, 14 bp, Homo sapiens
ttgacagctttgct

SEQ ID NO: 2893843 - DNA, 17 bp, Homo sapiens
ttgacagctttgctgct

SEQ ID NO: 2893844 - DNA, 12 bp, Homo sapiens
ttgacagtctga

SEQ ID NO: 2893845 - DNA, 16 bp, Homo sapiens
ttgacagtttttgaca

SEQ ID NO: 2893846 - DNA, 16 bp, Homo sapiens
ttgacatatttaatgt

SEQ ID NO: 2893847 - DNA, 18 bp, Homo sapiens
ttgacatcagccagctgc

SEQ ID NO: 2893848 - DNA, 23 bp, Homo sapiens
ttgacatgagatttataaggttt

SEQ ID NO: 2893849 - DNA, 13 bp, Homo sapiens
ttgacattcaaaa

SEQ ID NO: 2893850 - DNA, 13 bp, Homo sapiens
ttgacattctcta

SEQ ID NO: 2893851 - DNA, 14 bp, Homo sapiens
ttgacattctctat

SEQ ID NO: 2893852 - DNA, 14 bp, Homo sapiens
ttgacattgatgtg

SEQ ID NO: 2893853 - DNA, 16 bp, Homo sapiens
ttgaccaagcaggaag

SEQ ID NO: 2893854 - DNA, 22 bp, Homo sapiens
ttgaccaagcaggaagctcaga

SEQ ID NO: 2893855 - DNA, 15 bp, Homo sapiens
ttgaccagtttcttt

SEQ ID NO: 2893856 - DNA, 15 bp, Homo sapiens
ttgaccattggctgc

SEQ ID NO: 2893857 - DNA, 19 bp, Homo sapiens
ttgacctcctccctgttat

SEQ ID NO: 2893858 - DNA, 21 bp, Homo sapiens
ttgacctcctccctgttattt

SEQ ID NO: 2893859 - DNA, 18 bp, Homo sapiens
ttgacctgtcctctttgt

SEQ ID NO: 2893860 - DNA, 14 bp, Homo sapiens
ttgacgaactggct

SEQ ID NO: 2893861 - DNA, 16 bp, Homo sapiens
ttgactaatttcacat

SEQ ID NO: 2893862 - DNA, 14 bp, Homo sapiens
ttgactaattttac

SEQ ID NO: 2893863 - DNA, 21 bp, Homo sapiens
ttgactcaagtttttacaaaa

SEQ ID NO: 2893864 - DNA, 21 bp, Homo sapiens
ttgactcctttggtatttcac

SEQ ID NO: 2893865 - DNA, 17 bp, Homo sapiens
ttgacttagatattaaa

SEQ ID NO: 2893866 - DNA, 23 bp, Homo sapiens
ttgacttagatattaaaatttgg

SEQ ID NO: 2893867 - DNA, 13 bp, Homo sapiens
ttgactttaattt

SEQ ID NO: 2893868 - DNA, 11 bp, Homo sapiens
ttgactttgtc

SEQ ID NO: 2893869 - DNA, 12 bp, Homo sapiens
ttgactttgtct

SEQ ID NO: 2893870 - DNA, 15 bp, Homo sapiens
ttgagaagaaaacat

SEQ ID NO: 2893871 - DNA, 18 bp, Homo sapiens
ttgagaagaaaacatcta

SEQ ID NO: 2893872 - DNA, 23 bp, Homo sapiens
ttgagaatcccaaatttgattga

SEQ ID NO: 2893873 - DNA, 16 bp, Homo sapiens
ttgagaatggaaacca

SEQ ID NO: 2893874 - DNA, 17 bp, Homo sapiens
ttgagaatggaaaccac

SEQ ID NO: 2893875 - DNA, 22 bp, Homo sapiens
ttgagacacggagcccagccct

SEQ ID NO: 2893876 - DNA, 15 bp, Homo sapiens
ttgagaccaggctgg

SEQ ID NO: 2893877 - DNA, 22 bp, Homo sapiens
ttgagagacagtaacacaatta

SEQ ID NO: 2893878 - DNA, 22 bp, Homo sapiens
ttggaaatggcatgcaaaagca

SEQ ID NO: 2893879 - DNA, 20 bp, Homo sapiens
ttggaaccaaagtctaaact

SEQ ID NO: 2893880 - DNA, 20 bp, Homo sapiens
ttggaactaacacgtgatgt

SEQ ID NO: 2893881 - DNA, 19 bp, Homo sapiens
ttggaagacatatattata

SEQ ID NO: 2893882 - DNA, 15 bp, Homo sapiens
ttggaagcaacgtgt

SEQ ID NO: 2893883 - DNA, 22 bp, Homo sapiens
ttggaatgcacagggcaattga

SEQ ID NO: 2893884 - DNA, 19 bp, Homo sapiens
ttggacagaagcagctctt

SEQ ID NO: 2893885 - DNA, 16 bp, Homo sapiens
ttggacagatttcagt

SEQ ID NO: 2893886 - DNA, 17 bp, Homo sapiens
ttggacagatttcagta

SEQ ID NO: 2893887 - DNA, 19 bp, Homo sapiens
ttggacccaaggaaaactg

SEQ ID NO: 2893888 - DNA, 20 bp, Homo sapiens
ttggacctcattttattaaa

SEQ ID NO: 2893889 - DNA, 17 bp, Homo sapiens
ttggactgagatttctt

SEQ ID NO: 2893890 - DNA, 20 bp, Homo sapiens
ttggactgagatttcttaaa

SEQ ID NO: 2893891 - DNA, 20 bp, Homo sapiens
ttggacttcaaagcaagctg

SEQ ID NO: 2893892 - DNA, 12 bp, Homo sapiens
ttggacttctga

SEQ ID NO: 2893893 - DNA, 21 bp, Homo sapiens
ttggagacttaacagcatttg

SEQ ID NO: 2893894 - DNA, 14 bp, Homo sapiens
ttggagatgcagcc

SEQ ID NO: 2893895 - DNA, 11 bp, Homo sapiens
ttggagcattt

SEQ ID NO: 2893896 - DNA, 15 bp, Homo sapiens
ttggagcctgcagag

SEQ ID NO: 2893897 - DNA, 18 bp, Homo sapiens
ttggagtgttatgtattt

SEQ ID NO: 2893898 - DNA, 22 bp, Homo sapiens
ttggagtgttccccttccactg

SEQ ID NO: 2893899 - DNA, 15 bp, Homo sapiens
ttggataataaaaat

SEQ ID NO: 2893900 - DNA, 18 bp, Homo sapiens
ttggataataaaaattgt

SEQ ID NO: 2893901 - DNA, 22 bp, Homo sapiens
ttggatacagcagtagacattt

SEQ ID NO: 2893902 - DNA, 12 bp, Homo sapiens
ttggatatttgg

SEQ ID NO: 2893903 - DNA, 14 bp, Homo sapiens
ttggatctatttat

SEQ ID NO: 2893904 - DNA, 13 bp, Homo sapiens
ttggatgaggagt

SEQ ID NO: 2893905 - DNA, 13 bp, Homo sapiens
ttggatgatacag

SEQ ID NO: 2893906 - DNA, 14 bp, Homo sapiens
ttggattggggtcc

SEQ ID NO: 2893907 - DNA, 14 bp, Homo sapiens
ttggattgtatatt

SEQ ID NO: 2893908 - DNA, 18 bp, Homo sapiens
ttggattgtatattgtgt

SEQ ID NO: 2893909 - DNA, 20 bp, Homo sapiens
ttggatttacgactgaagaa

SEQ ID NO: 2893910 - DNA, 15 bp, Homo sapiens
ttggatttctttata

SEQ ID NO: 2893911 - DNA, 18 bp, Homo sapiens
ttggatttgtccaaacag

SEQ ID NO: 2893912 - DNA, 18 bp, Homo sapiens
ttggatttgtttaaaagg

SEQ ID NO: 2893913 - DNA, 17 bp, Homo sapiens
ttggcaaacgggcttga

SEQ ID NO: 2893914 - DNA, 13 bp, Homo sapiens
ttggcaaggaaag

SEQ ID NO: 2893915 - DNA, 13 bp, Homo sapiens
ttggcaccagaca

SEQ ID NO: 2893916 - DNA, 15 bp, Homo sapiens
ttggcacctgcctag

SEQ ID NO: 2893917 - DNA, 16 bp, Homo sapiens
ttggcagaactgctgg

SEQ ID NO: 2893918 - DNA, 18 bp, Homo sapiens
ttggcagaactgctgggg

SEQ ID NO: 2893919 - DNA, 15 bp, Homo sapiens
ttggcagcacctgtc

SEQ ID NO: 2893920 - DNA, 14 bp, Homo sapiens
ttggcatctactct

SEQ ID NO: 2893921 - DNA, 23 bp, Homo sapiens
ttggcattcaaccacgcaggaag

SEQ ID NO: 2893922 - DNA, 16 bp, Homo sapiens
ttggcattgatcttaa

SEQ ID NO: 2893923 - DNA, 16 bp, Homo sapiens
ttggccaagagaaggg

SEQ ID NO: 2893924 - DNA, 11 bp, Homo sapiens
ttggccaatta

SEQ ID NO: 2893925 - DNA, 20 bp, Homo sapiens
ttggccaccaggtgcctttc

SEQ ID NO: 2893926 - DNA, 19 bp, Homo sapiens
ttggcccaagactgggctg

SEQ ID NO: 2893927 - DNA, 13 bp, Homo sapiens
ttggcccaatgcc

SEQ ID NO: 2893928 - DNA, 17 bp, Homo sapiens
ttggcccagagacggag

SEQ ID NO: 2893929 - DNA, 16 bp, Homo sapiens
ttggcccctggaacct

SEQ ID NO: 2893930 - DNA, 21 bp, Homo sapiens
ttggcccctggaacctttccc

SEQ ID NO: 2893931 - DNA, 23 bp, Homo sapiens
ttggccctgcccctccccctacc

SEQ ID NO: 2893932 - DNA, 21 bp, Homo sapiens
ttggccggctgtgctcagaga

SEQ ID NO: 2893933 - DNA, 14 bp, Homo sapiens
ttggcctctctgta

SEQ ID NO: 2893934 - DNA, 20 bp, Homo sapiens
ttggcctgaacagatgtaaa

SEQ ID NO: 2893935 - DNA, 11 bp, Homo sapiens
ttggcctgcct

SEQ ID NO: 2893936 - DNA, 20 bp, Homo sapiens
ttggcgggtccacttgccag

SEQ ID NO: 2893937 - DNA, 22 bp, Homo sapiens
ttggcgggtccacttgccaggg

SEQ ID NO: 2893938 - DNA, 15 bp, Homo sapiens
ttggctgaaattctt

SEQ ID NO: 2893939 - DNA, 15 bp, Homo sapiens
ttggctgctgccacc

SEQ ID NO: 2893940 - DNA, 21 bp, Homo sapiens
ttggcttccatgatggttatt

SEQ ID NO: 2893941 - DNA, 19 bp, Homo sapiens
ttgggaaacttgtcacttg

SEQ ID NO: 2893942 - DNA, 21 bp, Homo sapiens
ttgggaaacttgtcacttgca

SEQ ID NO: 2893943 - DNA, 12 bp, Homo sapiens
ttgggaaagata

SEQ ID NO: 2893944 - DNA, 19 bp, Homo sapiens
ttgggaagctatttccttt

SEQ ID NO: 2893945 - DNA, 15 bp, Homo sapiens
ttgggaataaatatg

SEQ ID NO: 2893946 - DNA, 20 bp, Homo sapiens
ttgggacccctggtggttca

SEQ ID NO: 2893947 - DNA, 20 bp, Homo sapiens
ttgggaccctgctttagagc

SEQ ID NO: 2893948 - DNA, 11 bp, Homo sapiens
ttgggagcagg

SEQ ID NO: 2893949 - DNA, 19 bp, Homo sapiens
ttgggagcctgaggcagga

SEQ ID NO: 2893950 - DNA, 16 bp, Homo sapiens
ttgggattttagaaca

SEQ ID NO: 2893951 - DNA, 20 bp, Homo sapiens
ttgggcagaatcctgggccc

SEQ ID NO: 2893952 - DNA, 23 bp, Homo sapiens
ttgggcagggtctctgctccagc

SEQ ID NO: 2893953 - DNA, 17 bp, Homo sapiens
ttgggcatgtgggcttc

SEQ ID NO: 2893954 - DNA, 13 bp, Homo sapiens
ttgggccagacat

SEQ ID NO: 2893955 - DNA, 17 bp, Homo sapiens
ttgggccagacatgcca

SEQ ID NO: 2893956 - DNA, 17 bp, Homo sapiens
ttgggcctgctccagac

SEQ ID NO: 2893957 - DNA, 22 bp, Homo sapiens
ttgggcctggccagtcttcctc

SEQ ID NO: 2893958 - DNA, 14 bp, Homo sapiens
ttgggctggtcaga

SEQ ID NO: 2893959 - DNA, 20 bp, Homo sapiens
ttgggcttatttagaaaaaa

SEQ ID NO: 2893960 - DNA, 22 bp, Homo sapiens
ttgggcttatttagaaaaaagg

SEQ ID NO: 2893961 - DNA, 14 bp, Homo sapiens
ttgggcttcagcct

SEQ ID NO: 2893962 - DNA, 17 bp, Homo sapiens
ttggggaaaaattcttg

SEQ ID NO: 2893963 - DNA, 19 bp, Homo sapiens
ttggggacatctctttgaa

SEQ ID NO: 2893964 - DNA, 21 bp, Homo sapiens
ttggggagttaagacctggca

SEQ ID NO: 2893965 - DNA, 16 bp, Homo sapiens
ttgggggacagccttc

SEQ ID NO: 2893966 - DNA, 19 bp, Homo sapiens
ttgggggacgtttctcatt

SEQ ID NO: 2893967 - DNA, 21 bp, Homo sapiens
ttgggggcaggtcaggaccag

SEQ ID NO: 2893968 - DNA, 17 bp, Homo sapiens
ttgggggttcaggcccg

SEQ ID NO: 2893969 - DNA, 16 bp, Homo sapiens
ttggggtacaattgta

SEQ ID NO: 2893970 - DNA, 22 bp, Homo sapiens
ttggggtggcgcgcctgccttt

SEQ ID NO: 2893971 - DNA, 17 bp, Homo sapiens
ttggggtgggggccagg

SEQ ID NO: 2893972 - DNA, 17 bp, Homo sapiens
ttggggtttgatttgct

SEQ ID NO: 2893973 - DNA, 16 bp, Homo sapiens
ttggggttttttaata

SEQ ID NO: 2893974 - DNA, 17 bp, Homo sapiens
ttgggtcatttttaact

SEQ ID NO: 2893975 - DNA, 15 bp, Homo sapiens
ttgggtcctgggcag

SEQ ID NO: 2893976 - DNA, 16 bp, Homo sapiens
ttgggtcctgggcagg

SEQ ID NO: 2893977 - DNA, 17 bp, Homo sapiens
ttgggtctattccagct

SEQ ID NO: 2893978 - DNA, 18 bp, Homo sapiens
ttgggtctattccagctc

SEQ ID NO: 2893979 - DNA, 21 bp, Homo sapiens
ttgggtggaattatatttgat

SEQ ID NO: 2893980 - DNA, 17 bp, Homo sapiens
ttgggtggagaagccat

SEQ ID NO: 2893981 - DNA, 18 bp, Homo sapiens
ttgggtggagaagccatt

SEQ ID NO: 2893982 - DNA, 15 bp, Homo sapiens
ttgggttcaggcctg

SEQ ID NO: 2893983 - DNA, 23 bp, Homo sapiens
ttgggttgattctcgactgcttt

SEQ ID NO: 2893984 - DNA, 19 bp, Homo sapiens
ttggtaaagactggctttt

SEQ ID NO: 2893985 - DNA, 16 bp, Homo sapiens
ttggtaaatttcccca

SEQ ID NO: 2893986 - DNA, 21 bp, Homo sapiens
ttggtaaatttccccaacagt

SEQ ID NO: 2893987 - DNA, 12 bp, Homo sapiens
ttggtaatgtgt

SEQ ID NO: 2893988 - DNA, 13 bp, Homo sapiens
ttggtacaaaaat

SEQ ID NO: 2893989 - DNA, 15 bp, Homo sapiens
ttggtaggtaaatct

SEQ ID NO: 2893990 - DNA, 13 bp, Homo sapiens
ttggtcacatgga

SEQ ID NO: 2893991 - DNA, 14 bp, Homo sapiens
ttggtcacccagac

SEQ ID NO: 2893992 - DNA, 16 bp, Homo sapiens
ttggtcagaatgcagt

SEQ ID NO: 2893993 - DNA, 15 bp, Homo sapiens
ttggtcagcttttgt

SEQ ID NO: 2893994 - DNA, 14 bp, Homo sapiens
ttggtcaggctggt

SEQ ID NO: 2893995 - DNA, 19 bp, Homo sapiens
ttggtccaaaaaaaggaaa

SEQ ID NO: 2893996 - DNA, 22 bp, Homo sapiens
ttggtccaaaaaaaggaaaaat

SEQ ID NO: 2893997 - DNA, 20 bp, Homo sapiens
ttggtcccgtggatgctctt

SEQ ID NO: 2893998 - DNA, 19 bp, Homo sapiens
ttggtcctacctattatcc

SEQ ID NO: 2893999 - DNA, 14 bp, Homo sapiens
ttggtcctctctct

SEQ ID NO: 2894000 - DNA, 19 bp, Homo sapiens
ttggtctgggtggatgtga

SEQ ID NO: 2894001 - DNA, 15 bp, Homo sapiens
ttggtgaacagtttt

SEQ ID NO: 2894002 - DNA, 20 bp, Homo sapiens
ttggtgaccagtttcttaaa

SEQ ID NO: 2894003 - DNA, 18 bp, Homo sapiens
ttggtgagaaacctgtat

SEQ ID NO: 2894004 - DNA, 14 bp, Homo sapiens
ttggtgagaacctg

SEQ ID NO: 2894005 - DNA, 17 bp, Homo sapiens
ttggtgctgttgaaaat

SEQ ID NO: 2894006 - DNA, 17 bp, Homo sapiens
ttggtggaatctttagc

SEQ ID NO: 2894007 - DNA, 17 bp, Homo sapiens
ttggtgtatatcatgaa

SEQ ID NO: 2894008 - DNA, 21 bp, Homo sapiens
ttggtgtcaacatgaaacacc

SEQ ID NO: 2894009 - DNA, 17 bp, Homo sapiens
ttggtgtcattattcca

SEQ ID NO: 2894010 - DNA, 19 bp, Homo sapiens
ttggtgtgttggacagaga

SEQ ID NO: 2894011 - DNA, 18 bp, Homo sapiens
ttggttaatttttacatg

SEQ ID NO: 2894012 - DNA, 17 bp, Homo sapiens
ttggttagagaagtaag

SEQ ID NO: 2894013 - DNA, 21 bp, Homo sapiens
ttggttatgatggaaaggaag

SEQ ID NO: 2894014 - DNA, 14 bp, Homo sapiens
ttggttcattaatt

SEQ ID NO: 2894015 - DNA, 20 bp, Homo sapiens
ttggttcattaattctataa

SEQ ID NO: 2894016 - DNA, 18 bp, Homo sapiens
ttggttcccccactgatc

SEQ ID NO: 2894017 - DNA, 15 bp, Homo sapiens
ttggttgtatataaa

SEQ ID NO: 2894018 - DNA, 16 bp, Homo sapiens
ttggttgtattctttg

SEQ ID NO: 2894019 - DNA, 15 bp, Homo sapiens
ttggtttactttcaa

SEQ ID NO: 2894020 - DNA, 16 bp, Homo sapiens
ttggtttactttcaaa

SEQ ID NO: 2894021 - DNA, 18 bp, Homo sapiens
ttgtaaaaaaaaaaaaca

SEQ ID NO: 2894022 - DNA, 13 bp, Homo sapiens
ttgtaaaatcaaa

SEQ ID NO: 2894023 - DNA, 16 bp, Homo sapiens
ttgtaaagtgaagaat

SEQ ID NO: 2894024 - DNA, 18 bp, Homo sapiens
ttgtaaataaaggaacca

SEQ ID NO: 2894025 - DNA, 20 bp, Homo sapiens
ttgtaaataaattttgtgca

SEQ ID NO: 2894026 - DNA, 21 bp, Homo sapiens
ttgtaaataaattttgtgcaa

SEQ ID NO: 2894027 - DNA, 22 bp, Homo sapiens
ttgtaaataaattttgtgcaaa

SEQ ID NO: 2894028 - DNA, 20 bp, Homo sapiens
ttgtaaatacataaaacaaa

SEQ ID NO: 2894029 - DNA, 22 bp, Homo sapiens
ttgtaaatatggggatagtctg

SEQ ID NO: 2894030 - DNA, 13 bp, Homo sapiens
ttgtaaatattgt

SEQ ID NO: 2894031 - DNA, 19 bp, Homo sapiens
ttgtaaatgtactggtaat

SEQ ID NO: 2894032 - DNA, 23 bp, Homo sapiens
ttgtaaatgtactggtaattgta

SEQ ID NO: 2894033 - DNA, 16 bp, Homo sapiens
ttgtaaattattaatt

SEQ ID NO: 2894034 - DNA, 21 bp, Homo sapiens
ttgtaaatttggatttacgac

SEQ ID NO: 2894035 - DNA, 23 bp, Homo sapiens
ttgtaagccctctttaatgctgt

SEQ ID NO: 2894036 - DNA, 20 bp, Homo sapiens
ttgtaaggtctttgtaaaat

SEQ ID NO: 2894037 - DNA, 21 bp, Homo sapiens
ttgtaaggtctttgtaaaatc

SEQ ID NO: 2894038 - DNA, 12 bp, Homo sapiens
ttgtaatatttc

SEQ ID NO: 2894039 - DNA, 21 bp, Homo sapiens
ttgtaatatttcttcaagtga

SEQ ID NO: 2894040 - DNA, 14 bp, Homo sapiens
ttgtaatcactgtt

SEQ ID NO: 2894041 - DNA, 22 bp, Homo sapiens
ttgtaatgaattcctagaatta

SEQ ID NO: 2894042 - DNA, 15 bp, Homo sapiens
ttgtaattatgtaaa

SEQ ID NO: 2894043 - DNA, 16 bp, Homo sapiens
ttgtaattatgtaaat

SEQ ID NO: 2894044 - DNA, 12 bp, Homo sapiens
ttgtaattgtgt

SEQ ID NO: 2894045 - DNA, 16 bp, Homo sapiens
ttgtaattttgttcct

SEQ ID NO: 2894046 - DNA, 21 bp, Homo sapiens
ttgtaattttgttcctgttta

SEQ ID NO: 2894047 - DNA, 13 bp, Homo sapiens
ttgtacacttttt

SEQ ID NO: 2894048 - DNA, 15 bp, Homo sapiens
ttgtacagcccagag

SEQ ID NO: 2894049 - DNA, 14 bp, Homo sapiens
ttgtacagccttat

SEQ ID NO: 2894050 - DNA, 21 bp, Homo sapiens
ttgtacagcgttttaaaagaa

SEQ ID NO: 2894051 - DNA, 15 bp, Homo sapiens
ttgtacagtattttt

SEQ ID NO: 2894052 - DNA, 24 bp, Homo sapiens
ttgtacagtatttttcagatataa

SEQ ID NO: 2894053 - DNA, 16 bp, Homo sapiens
ttgtacagtttaaaat

SEQ ID NO: 2894054 - DNA, 12 bp, Homo sapiens
ttgtacatgaaa

SEQ ID NO: 2894055 - DNA, 20 bp, Homo sapiens
ttgtacatgtgtagcctgtg

SEQ ID NO: 2894056 - DNA, 17 bp, Homo sapiens
ttgtaccacagtttctt

SEQ ID NO: 2894057 - DNA, 17 bp, Homo sapiens
ttgtactgtttaatgtt

SEQ ID NO: 2894058 - DNA, 19 bp, Homo sapiens
ttgtactttatttttctga

SEQ ID NO: 2894059 - DNA, 16 bp, Homo sapiens
ttgtactttgtttttc

SEQ ID NO: 2894060 - DNA, 18 bp, Homo sapiens
ttgtactttgtttttcca

SEQ ID NO: 2894061 - DNA, 23 bp, Homo sapiens
ttgtactttttgttccagagctg

SEQ ID NO: 2894062 - DNA, 14 bp, Homo sapiens
ttgtagaaattctt

SEQ ID NO: 2894063 - DNA, 16 bp, Homo sapiens
ttgtagaatgtattgt

SEQ ID NO: 2894064 - DNA, 22 bp, Homo sapiens
ttgtagactatggaatgtcagt

SEQ ID NO: 2894065 - DNA, 17 bp, Homo sapiens
ttgtagcatcctcttta

SEQ ID NO: 2894066 - DNA, 21 bp, Homo sapiens
ttgtagcggatgattcttcaa

SEQ ID NO: 2894067 - DNA, 21 bp, Homo sapiens
ttgtaggacttttaaacaaaa

SEQ ID NO: 2894068 - DNA, 16 bp, Homo sapiens
ttgtagggttacagag

SEQ ID NO: 2894069 - DNA, 19 bp, Homo sapiens
ttgtaggttattttatatt

SEQ ID NO: 2894070 - DNA, 21 bp, Homo sapiens
ttgtaggttattttatatttg

SEQ ID NO: 2894071 - DNA, 13 bp, Homo sapiens
ttgtagtttacct

SEQ ID NO: 2894072 - DNA, 16 bp, Homo sapiens
ttgtataacatcactg

SEQ ID NO: 2894073 - DNA, 15 bp, Homo sapiens
ttgtataattgtatc

SEQ ID NO: 2894074 - DNA, 17 bp, Homo sapiens
ttgtataattgtatcgt

SEQ ID NO: 2894075 - DNA, 13 bp, Homo sapiens
ttgtatataaagt

SEQ ID NO: 2894076 - DNA, 14 bp, Homo sapiens
ttgtatatgactgc

SEQ ID NO: 2894077 - DNA, 18 bp, Homo sapiens
ttgtatatgactgcattt

SEQ ID NO: 2894078 - DNA, 19 bp, Homo sapiens
ttgtatatgactgcatttg

SEQ ID NO: 2894079 - DNA, 16 bp, Homo sapiens
ttgtatattatttcta

SEQ ID NO: 2894080 - DNA, 21 bp, Homo sapiens
ttgtatcgatgttatgtaaaa

SEQ ID NO: 2894081 - DNA, 12 bp, Homo sapiens
ttgtatctctta

SEQ ID NO: 2894082 - DNA, 17 bp, Homo sapiens
ttgtatgtgtgtagaca

SEQ ID NO: 2894083 - DNA, 16 bp, Homo sapiens
ttgtattaaacttgaa

SEQ ID NO: 2894084 - DNA, 14 bp, Homo sapiens
ttgtattacaaatc

SEQ ID NO: 2894085 - DNA, 16 bp, Homo sapiens
ttgtattctctgagct

SEQ ID NO: 2894086 - DNA, 18 bp, Homo sapiens
ttgtattctttgatgtta

SEQ ID NO: 2894087 - DNA, 19 bp, Homo sapiens
ttgtattctttgatgttaa

SEQ ID NO: 2894088 - DNA, 17 bp, Homo sapiens
ttgtattgctgctgtgc

SEQ ID NO: 2894089 - DNA, 14 bp, Homo sapiens
ttgtattgttttct

SEQ ID NO: 2894090 - DNA, 16 bp, Homo sapiens
ttgtatttctcttgtc

SEQ ID NO: 2894091 - DNA, 18 bp, Homo sapiens
ttgtcaatggaagaaacc

SEQ ID NO: 2894092 - DNA, 19 bp, Homo sapiens
ttgtcaatttatgaatata

SEQ ID NO: 2894093 - DNA, 14 bp, Homo sapiens
ttgtcacagctctt

SEQ ID NO: 2894094 - DNA, 14 bp, Homo sapiens
ttgtcacttgcatg

SEQ ID NO: 2894095 - DNA, 15 bp, Homo sapiens
ttgtcacttgcatgt

SEQ ID NO: 2894096 - DNA, 13 bp, Homo sapiens
ttgtcagcatctg

SEQ ID NO: 2894097 - DNA, 14 bp, Homo sapiens
ttgtcagcatctga

SEQ ID NO: 2894098 - DNA, 20 bp, Homo sapiens
ttgtcagcatctgaccatct

SEQ ID NO: 2894099 - DNA, 15 bp, Homo sapiens
ttgtcagccacctcc

SEQ ID NO: 2894100 - DNA, 22 bp, Homo sapiens
ttgtcatttcctttgttgtcta

SEQ ID NO: 2894101 - DNA, 13 bp, Homo sapiens
ttgtccaaacagg

SEQ ID NO: 2894102 - DNA, 23 bp, Homo sapiens
ttgtccaaacaggtgctggccca

SEQ ID NO: 2894103 - DNA, 22 bp, Homo sapiens
ttgtccaattgttgacagttct

SEQ ID NO: 2894104 - DNA, 17 bp, Homo sapiens
ttgtccaggaagtcaga

SEQ ID NO: 2894105 - DNA, 12 bp, Homo sapiens
ttgtccctgggg

SEQ ID NO: 2894106 - DNA, 19 bp, Homo sapiens
ttgtccctggggcactccc

SEQ ID NO: 2894107 - DNA, 21 bp, Homo sapiens
ttgtccctggggcactccccc

SEQ ID NO: 2894108 - DNA, 19 bp, Homo sapiens
ttgtcctgaatggctttgt

SEQ ID NO: 2894109 - DNA, 19 bp, Homo sapiens
ttgtcctgatgcttttgtc

SEQ ID NO: 2894110 - DNA, 20 bp, Homo sapiens
ttgtcctttaaaaaagaaaa

SEQ ID NO: 2894111 - DNA, 17 bp, Homo sapiens
ttgtcctttaactatca

SEQ ID NO: 2894112 - DNA, 18 bp, Homo sapiens
ttgtctctacaaaaaata

SEQ ID NO: 2894113 - DNA, 14 bp, Homo sapiens
ttgtctctactttt

SEQ ID NO: 2894114 - DNA, 12 bp, Homo sapiens
ttgtctgtaaaa

SEQ ID NO: 2894115 - DNA, 16 bp, Homo sapiens
ttgtcttagctctgga

SEQ ID NO: 2894116 - DNA, 22 bp, Homo sapiens
ttgtcttgaaaaaaaatagatg

SEQ ID NO: 2894117 - DNA, 22 bp, Homo sapiens
ttgtcttgaatgtcttttgaat

SEQ ID NO: 2894118 - DNA, 23 bp, Homo sapiens
ttgtctttatgagctaaaaatat

SEQ ID NO: 2894119 - DNA, 15 bp, Homo sapiens
ttgtcttttcccctc

SEQ ID NO: 2894120 - DNA, 19 bp, Homo sapiens
ttgtctttttagatgccca

SEQ ID NO: 2894121 - DNA, 22 bp, Homo sapiens
ttgtctttttgtataaatgaca

SEQ ID NO: 2894122 - DNA, 22 bp, Homo sapiens
ttgtgaaggccatgatattttg

SEQ ID NO: 2894123 - DNA, 18 bp, Homo sapiens
ttgtgacagctctttttg

SEQ ID NO: 2894124 - DNA, 17 bp, Homo sapiens
ttgtgaccaatacattt

SEQ ID NO: 2894125 - DNA, 18 bp, Homo sapiens
ttgtgaccaatacatttg

SEQ ID NO: 2894126 - DNA, 23 bp, Homo sapiens
ttgtgaccaatacatttgtattt

SEQ ID NO: 2894127 - DNA, 16 bp, Homo sapiens
ttgtgaccttagtgtt

SEQ ID NO: 2894128 - DNA, 19 bp, Homo sapiens
ttgtgaccttagtgtttct

SEQ ID NO: 2894129 - DNA, 14 bp, Homo sapiens
ttgtgactaattgt

SEQ ID NO: 2894130 - DNA, 17 bp, Homo sapiens
ttgtgagccttgctgcc

SEQ ID NO: 2894131 - DNA, 19 bp, Homo sapiens
ttgtgagccttgctgccaa

SEQ ID NO: 2894132 - DNA, 14 bp, Homo sapiens
ttgtgagggagaga

SEQ ID NO: 2894133 - DNA, 21 bp, Homo sapiens
ttgtgatatttgacagacatc

SEQ ID NO: 2894134 - DNA, 10 bp, Homo sapiens
ttgtgatttt

SEQ ID NO: 2894135 - DNA, 17 bp, Homo sapiens
ttgtgccagcccggagg

SEQ ID NO: 2894136 - DNA, 13 bp, Homo sapiens
ttgtgctataaag

SEQ ID NO: 2894137 - DNA, 18 bp, Homo sapiens
ttgtgctccatagagcag

SEQ ID NO: 2894138 - DNA, 14 bp, Homo sapiens
ttgtgctttgaaaa

SEQ ID NO: 2894139 - DNA, 18 bp, Homo sapiens
ttgtgctttgaaaaaaag

SEQ ID NO: 2894140 - DNA, 17 bp, Homo sapiens
ttgtggaagatagaatt

SEQ ID NO: 2894141 - DNA, 16 bp, Homo sapiens
ttgtggataacaaaga

SEQ ID NO: 2894142 - DNA, 18 bp, Homo sapiens
ttgtggataacaaagata

SEQ ID NO: 2894143 - DNA, 18 bp, Homo sapiens
ttgtggatgttttaattc

SEQ ID NO: 2894144 - DNA, 16 bp, Homo sapiens
ttgtggatttcagttt

SEQ ID NO: 2894145 - DNA, 16 bp, Homo sapiens
ttgtggcaagtgaatt

SEQ ID NO: 2894146 - DNA, 18 bp, Homo sapiens
ttgtggccaaggagctgc

SEQ ID NO: 2894147 - DNA, 16 bp, Homo sapiens
ttgtgggaatttaaga

SEQ ID NO: 2894148 - DNA, 20 bp, Homo sapiens
ttgtggggacctcagcctgc

SEQ ID NO: 2894149 - DNA, 20 bp, Homo sapiens
ttgtgggggctagaaaaaac

SEQ ID NO: 2894150 - DNA, 20 bp, Homo sapiens
ttgtgggttctatgtttact

SEQ ID NO: 2894151 - DNA, 21 bp, Homo sapiens
ttgtggtgtgagtatcagaat

SEQ ID NO: 2894152 - DNA, 21 bp, Homo sapiens
ttgtgtaaaaaatggaaaaaa

SEQ ID NO: 2894153 - DNA, 13 bp, Homo sapiens
ttgtgtaatttat

SEQ ID NO: 2894154 - DNA, 23 bp, Homo sapiens
ttgtgtactcggaaattaaagtt

SEQ ID NO: 2894155 - DNA, 15 bp, Homo sapiens
ttgtgtatatttaag

SEQ ID NO: 2894156 - DNA, 20 bp, Homo sapiens
ttgtgtatccattatcatgt

SEQ ID NO: 2894157 - DNA, 21 bp, Homo sapiens
ttgtgtatccattatcatgtg

SEQ ID NO: 2894158 - DNA, 22 bp, Homo sapiens
ttgtgtatttacgctttgattc

SEQ ID NO: 2894159 - DNA, 19 bp, Homo sapiens
ttgtgtcactgtacagttt

SEQ ID NO: 2894160 - DNA, 16 bp, Homo sapiens
ttgtgtcatattttaa

SEQ ID NO: 2894161 - DNA, 13 bp, Homo sapiens
ttgtgtctgtggt

SEQ ID NO: 2894162 - DNA, 18 bp, Homo sapiens
ttgtgtgcgctgcctggc

SEQ ID NO: 2894163 - DNA, 23 bp, Homo sapiens
ttgtgtgtcaggccctctgcctg

SEQ ID NO: 2894164 - DNA, 15 bp, Homo sapiens
ttgtgtgtcatgcca

SEQ ID NO: 2894165 - DNA, 23 bp, Homo sapiens
ttgtgttcagttccagcttttgt

SEQ ID NO: 2894166 - DNA, 11 bp, Homo sapiens
ttgtgttcctt

SEQ ID NO: 2894167 - DNA, 21 bp, Homo sapiens
ttgtgttccttctgtgaagaa

SEQ ID NO: 2894168 - DNA, 22 bp, Homo sapiens
ttgtgttccttctgtgaagaag

SEQ ID NO: 2894169 - DNA, 13 bp, Homo sapiens
ttgtgtttctaga

SEQ ID NO: 2894170 - DNA, 21 bp, Homo sapiens
ttgtgtttctagaatcacagc

SEQ ID NO: 2894171 - DNA, 21 bp, Homo sapiens
ttgttaaaaataaatcccatg

SEQ ID NO: 2894172 - DNA, 20 bp, Homo sapiens
ttgttaatgcctataacttt

SEQ ID NO: 2894173 - DNA, 15 bp, Homo sapiens
ttgttaattaaatat

SEQ ID NO: 2894174 - DNA, 20 bp, Homo sapiens
ttgttaccaaatacacattt

SEQ ID NO: 2894175 - DNA, 14 bp, Homo sapiens
ttgttactttgaat

SEQ ID NO: 2894176 - DNA, 15 bp, Homo sapiens
ttgttagtggacttg

SEQ ID NO: 2894177 - DNA, 22 bp, Homo sapiens
ttgttagtttagtgtgtgtgca

SEQ ID NO: 2894178 - DNA, 19 bp, Homo sapiens
ttgttatggcttaatgaca

SEQ ID NO: 2894179 - DNA, 17 bp, Homo sapiens
ttgttatgtgtctggaa

SEQ ID NO: 2894180 - DNA, 13 bp, Homo sapiens
ttgttcacactcc

SEQ ID NO: 2894181 - DNA, 16 bp, Homo sapiens
ttaatcatgagcctgt

SEQ ID NO: 2894182 - DNA, 19 bp, Homo sapiens
ttaatcatgagcctgttta

SEQ ID NO: 2894183 - DNA, 21 bp, Homo sapiens
ttaatccctatgtttgtctca

SEQ ID NO: 2894184 - DNA, 15 bp, Homo sapiens
ttaatctgttgtttg

SEQ ID NO: 2894185 - DNA, 14 bp, Homo sapiens
ttaatgacacttgt

SEQ ID NO: 2894186 - DNA, 14 bp, Homo sapiens
ttaatgcactttct

SEQ ID NO: 2894187 - DNA, 23 bp, Homo sapiens
ttaatgccgatatactctagatg

SEQ ID NO: 2894188 - DNA, 23 bp, Homo sapiens
ttaatgcctataactttttttca

SEQ ID NO: 2894189 - DNA, 16 bp, Homo sapiens
ttaatgctatttgaac

SEQ ID NO: 2894190 - DNA, 20 bp, Homo sapiens
ttaatgctatttgaacaagt

SEQ ID NO: 2894191 - DNA, 21 bp, Homo sapiens
ttaatgtagacattatctttt

SEQ ID NO: 2894192 - DNA, 17 bp, Homo sapiens
ttaatgtgaactctccc

SEQ ID NO: 2894193 - DNA, 19 bp, Homo sapiens
ttaatgttgaatgctgctt

SEQ ID NO: 2894194 - DNA, 20 bp, Homo sapiens
ttaatgtttatacagagtaa

SEQ ID NO: 2894195 - DNA, 12 bp, Homo sapiens
ttaattaaatat

SEQ ID NO: 2894196 - DNA, 18 bp, Homo sapiens
ttaattagcattctggca

SEQ ID NO: 2894197 - DNA, 14 bp, Homo sapiens
ttaattataaacag

SEQ ID NO: 2894198 - DNA, 19 bp, Homo sapiens
ttaattataaacagcaggg

SEQ ID NO: 2894199 - DNA, 22 bp, Homo sapiens
ttaattatgccttttttgatca

SEQ ID NO: 2894200 - DNA, 22 bp, Homo sapiens
ttaattcagatgttttacgcaa

SEQ ID NO: 2894201 - DNA, 13 bp, Homo sapiens
ttaattcatattt

SEQ ID NO: 2894202 - DNA, 12 bp, Homo sapiens
ttaattgtattt

SEQ ID NO: 2894203 - DNA, 21 bp, Homo sapiens
ttaatttaaaaaagcaaatgg

SEQ ID NO: 2894204 - DNA, 17 bp, Homo sapiens
ttaatttagtaaatgtt

SEQ ID NO: 2894205 - DNA, 19 bp, Homo sapiens
ttaatttagtaaatgttat

SEQ ID NO: 2894206 - DNA, 21 bp, Homo sapiens
ttaatttgagatcgtccactg

SEQ ID NO: 2894207 - DNA, 22 bp, Homo sapiens
ttaatttgagatcgtccactgt

SEQ ID NO: 2894208 - DNA, 18 bp, Homo sapiens
ttaatttgcatctgaaat

SEQ ID NO: 2894209 - DNA, 22 bp, Homo sapiens
ttaatttggataataaaaattg

SEQ ID NO: 2894210 - DNA, 18 bp, Homo sapiens
ttaatttgttttgtttta

SEQ ID NO: 2894211 - DNA, 17 bp, Homo sapiens
ttaattttattcaagaa

SEQ ID NO: 2894212 - DNA, 17 bp, Homo sapiens
ttaattttggttgtatt

SEQ ID NO: 2894213 - DNA, 20 bp, Homo sapiens
ttaattttggttgtattctt

SEQ ID NO: 2894214 - DNA, 14 bp, Homo sapiens
ttaattttgtattt

SEQ ID NO: 2894215 - DNA, 17 bp, Homo sapiens
ttaattttgtattttcc

SEQ ID NO: 2894216 - DNA, 22 bp, Homo sapiens
ttaatttttaaaagactttgat

SEQ ID NO: 2894217 - DNA, 19 bp, Homo sapiens
ttaatttttacatggagaa

SEQ ID NO: 2894218 - DNA, 15 bp, Homo sapiens
ttcaactttgaataa

SEQ ID NO: 2894219 - DNA, 19 bp, Homo sapiens
ttcaactttgaataaagaa

SEQ ID NO: 2894220 - DNA, 17 bp, Homo sapiens
ttcaagaaaactggaaa

SEQ ID NO: 2894221 - DNA, 14 bp, Homo sapiens
ttcaagaccagcct

SEQ ID NO: 2894222 - DNA, 14 bp, Homo sapiens
ttcaagacttgata

SEQ ID NO: 2894223 - DNA, 17 bp, Homo sapiens
ttcaagaggcgtgtgca

SEQ ID NO: 2894224 - DNA, 18 bp, Homo sapiens
ttcaagagggcaagtgga

SEQ ID NO: 2894225 - DNA, 20 bp, Homo sapiens
ttcaaggaacttgaaaaata

SEQ ID NO: 2894226 - DNA, 20 bp, Homo sapiens
ttcaaggaagaaaacggaaa

SEQ ID NO: 2894227 - DNA, 19 bp, Homo sapiens
ttcaaggacattggtgaga

SEQ ID NO: 2894228 - DNA, 18 bp, Homo sapiens
ttcaaggagaatatgata

SEQ ID NO: 2894229 - DNA, 14 bp, Homo sapiens
ttcaaggagggcac

SEQ ID NO: 2894230 - DNA, 22 bp, Homo sapiens
ttcaaggcactctagattccat

SEQ ID NO: 2894231 - DNA, 17 bp, Homo sapiens
ttcaaggctcagaagga

SEQ ID NO: 2894232 - DNA, 22 bp, Homo sapiens
ttcaagggaattaaataaataa

SEQ ID NO: 2894233 - DNA, 14 bp, Homo sapiens
ttcaaggtgacaga

SEQ ID NO: 2894234 - DNA, 14 bp, Homo sapiens
ttcaaggttctaac

SEQ ID NO: 2894235 - DNA, 19 bp, Homo sapiens
ttcaagtgactctcctgcc

SEQ ID NO: 2894236 - DNA, 16 bp, Homo sapiens
ttcaataaatgatata

SEQ ID NO: 2894237 - DNA, 19 bp, Homo sapiens
ttcaataaatgtctgttga

SEQ ID NO: 2894238 - DNA, 18 bp, Homo sapiens
ttcaatagttcaaggaac

SEQ ID NO: 2894239 - DNA, 12 bp, Homo sapiens
ttcaattaaaat

SEQ ID NO: 2894240 - DNA, 17 bp, Homo sapiens
ttcaattgcatctccca

SEQ ID NO: 2894241 - DNA, 22 bp, Homo sapiens
ttcaatttactttttaaacagt

SEQ ID NO: 2894242 - DNA, 23 bp, Homo sapiens
ttcaatttactttttaaacagtg

SEQ ID NO: 2894243 - DNA, 19 bp, Homo sapiens
ttcaatttgccattggttt

SEQ ID NO: 2894244 - DNA, 22 bp, Homo sapiens
ttcacaaacttttatactcttt

SEQ ID NO: 2894245 - DNA, 20 bp, Homo sapiens
ttcacaatgaaatgctctcc

SEQ ID NO: 2894246 - DNA, 17 bp, Homo sapiens
ttcacagaagcctagga

SEQ ID NO: 2894247 - DNA, 18 bp, Homo sapiens
ttcacagagcacgcctgc

SEQ ID NO: 2894248 - DNA, 16 bp, Homo sapiens
ttcacagatgctgtgt

SEQ ID NO: 2894249 - DNA, 18 bp, Homo sapiens
ttcacagcctttctgaac

SEQ ID NO: 2894250 - DNA, 13 bp, Homo sapiens
ttcacagctttta

SEQ ID NO: 2894251 - DNA, 15 bp, Homo sapiens
ttcacaggtcaataa

SEQ ID NO: 2894252 - DNA, 21 bp, Homo sapiens
ttcacagttctttgggccaga

SEQ ID NO: 2894253 - DNA, 19 bp, Homo sapiens
ttcacataaatgcagccca

SEQ ID NO: 2894254 - DNA, 20 bp, Homo sapiens
ttcacataaatgcagcccat

SEQ ID NO: 2894255 - DNA, 18 bp, Homo sapiens
ttcacatagctgtctaga

SEQ ID NO: 2894256 - DNA, 19 bp, Homo sapiens
ttcacatctaacctcatct

SEQ ID NO: 2894257 - DNA, 15 bp, Homo sapiens
ttcacattagaagac

SEQ ID NO: 2894258 - DNA, 23 bp, Homo sapiens
ttcacattcccctggggacccac

SEQ ID NO: 2894259 - DNA, 13 bp, Homo sapiens
ttcacattcttat

SEQ ID NO: 2894260 - DNA, 16 bp, Homo sapiens
ttcacattcttggctt

SEQ ID NO: 2894261 - DNA, 15 bp, Homo sapiens
ttcaccaatgttgta

SEQ ID NO: 2894262 - DNA, 18 bp, Homo sapiens
ttcaccagacttttctct

SEQ ID NO: 2894263 - DNA, 19 bp, Homo sapiens
ttcaccagaggaatcactc

SEQ ID NO: 2894264 - DNA, 20 bp, Homo sapiens
ttcaccatcatgtaccaagt

SEQ ID NO: 2894265 - DNA, 21 bp, Homo sapiens
ttcaccatgatggccaggctg

SEQ ID NO: 2894266 - DNA, 12 bp, Homo sapiens
ttcaccatggcc

SEQ ID NO: 2894267 - DNA, 21 bp, Homo sapiens
ttcacctgattcaactaaaaa

SEQ ID NO: 2894268 - DNA, 18 bp, Homo sapiens
ttcacctgccccaactct

SEQ ID NO: 2894269 - DNA, 21 bp, Homo sapiens
ttcacctggaagcatttgttt

SEQ ID NO: 2894270 - DNA, 13 bp, Homo sapiens
ttcacctttgtag

SEQ ID NO: 2894271 - DNA, 12 bp, Homo sapiens
ttcacgccattc

SEQ ID NO: 2894272 - DNA, 15 bp, Homo sapiens
ttcacgccattctcc

SEQ ID NO: 2894273 - DNA, 22 bp, Homo sapiens
ttcacgccattctcctgcctca

SEQ ID NO: 2894274 - DNA, 14 bp, Homo sapiens
ttcacgtgcagctc

SEQ ID NO: 2894275 - DNA, 23 bp, Homo sapiens
ttcactaaaagtgtgtgaaacct

SEQ ID NO: 2894276 - DNA, 14 bp, Homo sapiens
ttcactattcctat

SEQ ID NO: 2894277 - DNA, 13 bp, Homo sapiens
ttcactctaattg

SEQ ID NO: 2894278 - DNA, 23 bp, Homo sapiens
ttcactcttaggcactttggggg

SEQ ID NO: 2894279 - DNA, 20 bp, Homo sapiens
ttcactgcatggctcccaca

SEQ ID NO: 2894280 - DNA, 15 bp, Homo sapiens
ttcactgctgctcct

SEQ ID NO: 2894281 - DNA, 18 bp, Homo sapiens
ttcactgctgctcctctt

SEQ ID NO: 2894282 - DNA, 16 bp, Homo sapiens
ttcactggaaaggaaa

SEQ ID NO: 2894283 - DNA, 18 bp, Homo sapiens
ttcactggcataaatctg

SEQ ID NO: 2894284 - DNA, 21 bp, Homo sapiens
ttcactggcataaatctgaag

SEQ ID NO: 2894285 - DNA, 13 bp, Homo sapiens
ttcactgtctttt

SEQ ID NO: 2894286 - DNA, 18 bp, Homo sapiens
ttcacttaaaagctggct

SEQ ID NO: 2894287 - DNA, 22 bp, Homo sapiens
ttcacttagaacctttctgtgt

SEQ ID NO: 2894288 - DNA, 23 bp, Homo sapiens
ttcacttctgcattcctgtaact

SEQ ID NO: 2894289 - DNA, 13 bp, Homo sapiens
ttcacttgtcttg

SEQ ID NO: 2894290 - DNA, 15 bp, Homo sapiens
ttcacttttaaacta

SEQ ID NO: 2894291 - DNA, 22 bp, Homo sapiens
ttcacttttgcaaggttccaca

SEQ ID NO: 2894292 - DNA, 20 bp, Homo sapiens
ttcagaaaggggctcttctg

SEQ ID NO: 2894293 - DNA, 23 bp, Homo sapiens
ttcagaaggttattttctttatc

SEQ ID NO: 2894294 - DNA, 15 bp, Homo sapiens
ttcagaccccagcgg

SEQ ID NO: 2894295 - DNA, 13 bp, Homo sapiens
ttcagactcagac

SEQ ID NO: 2894296 - DNA, 21 bp, Homo sapiens
ttcagactcccattcctgaag

SEQ ID NO: 2894297 - DNA, 23 bp, Homo sapiens
ttcagacttgccatgtgactctg

SEQ ID NO: 2894298 - DNA, 14 bp, Homo sapiens
ttcagacttgtcaa

SEQ ID NO: 2894299 - DNA, 21 bp, Homo sapiens
ttcagaggagcatcagctgtc

SEQ ID NO: 2894300 - DNA, 22 bp, Homo sapiens
ttcagaggccctcgctgccagc

SEQ ID NO: 2894301 - DNA, 23 bp, Homo sapiens
ttcagaggccctcgctgccagct

SEQ ID NO: 2894302 - DNA, 22 bp, Homo sapiens
ttcagagtttggttaatcagtg

SEQ ID NO: 2894303 - DNA, 21 bp, Homo sapiens
ttcagagtttgtcatatactg

SEQ ID NO: 2894304 - DNA, 12 bp, Homo sapiens
ttcagatataaa

SEQ ID NO: 2894305 - DNA, 14 bp, Homo sapiens
ttcagatataaata

SEQ ID NO: 2894306 - DNA, 15 bp, Homo sapiens
ttcagatatcaaaat

SEQ ID NO: 2894307 - DNA, 18 bp, Homo sapiens
ttcagatatcaaaattct

SEQ ID NO: 2894308 - DNA, 22 bp, Homo sapiens
ttcagatatcaaaattctagct

SEQ ID NO: 2894309 - DNA, 15 bp, Homo sapiens
ttcagatgcttctgg

SEQ ID NO: 2894310 - DNA, 19 bp, Homo sapiens
ttcagatgcttctgggaga

SEQ ID NO: 2894311 - DNA, 16 bp, Homo sapiens
ttcagatgtaatgttt

SEQ ID NO: 2894312 - DNA, 18 bp, Homo sapiens
ttcagatgtggagccagg

SEQ ID NO: 2894313 - DNA, 17 bp, Homo sapiens
ttcagcaagagagaacc

SEQ ID NO: 2894314 - DNA, 20 bp, Homo sapiens
ttcagcatcaaacatgaaaa

SEQ ID NO: 2894315 - DNA, 14 bp, Homo sapiens
ttcagccaatttgt

SEQ ID NO: 2894316 - DNA, 13 bp, Homo sapiens
ttcagcccatctc

SEQ ID NO: 2894317 - DNA, 14 bp, Homo sapiens
ttcagcccctcctc

SEQ ID NO: 2894318 - DNA, 16 bp, Homo sapiens
ttcagcccctcctctg

SEQ ID NO: 2894319 - DNA, 17 bp, Homo sapiens
ttcagcccctcctctgc

SEQ ID NO: 2894320 - DNA, 18 bp, Homo sapiens
ttcagccgaattgtggtg

SEQ ID NO: 2894321 - DNA, 18 bp, Homo sapiens
ttcagcgcccccaggcct

SEQ ID NO: 2894322 - DNA, 14 bp, Homo sapiens
ttcagctccagccc

SEQ ID NO: 2894323 - DNA, 15 bp, Homo sapiens
ttcagctccagcccc

SEQ ID NO: 2894324 - DNA, 13 bp, Homo sapiens
ttcagctgcagtt

SEQ ID NO: 2894325 - DNA, 23 bp, Homo sapiens
ttcagctggtggatggtgacttt

SEQ ID NO: 2894326 - DNA, 13 bp, Homo sapiens
ttcagcttgggga

SEQ ID NO: 2894327 - DNA, 21 bp, Homo sapiens
ttcagctttatttttctttaa

SEQ ID NO: 2894328 - DNA, 14 bp, Homo sapiens
ttcagctttcttca

SEQ ID NO: 2894329 - DNA, 11 bp, Homo sapiens
ttcaggaacct

SEQ ID NO: 2894330 - DNA, 22 bp, Homo sapiens
ttcaggaacctcgagtactgtg

SEQ ID NO: 2894331 - DNA, 21 bp, Homo sapiens
ttcaggatgcacggtttctgt

SEQ ID NO: 2894332 - DNA, 19 bp, Homo sapiens
ttcaggccaggtagcagca

SEQ ID NO: 2894333 - DNA, 14 bp, Homo sapiens
ttcaggctcctaaa

SEQ ID NO: 2894334 - DNA, 20 bp, Homo sapiens
ttcagggcagcccctgcaga

SEQ ID NO: 2894335 - DNA, 19 bp, Homo sapiens
ttcagggcctggttgaaga

SEQ ID NO: 2894336 - DNA, 14 bp, Homo sapiens
ttcaggggaagggc

SEQ ID NO: 2894337 - DNA, 19 bp, Homo sapiens
ttcaggtagctgcccctgg

SEQ ID NO: 2894338 - DNA, 21 bp, Homo sapiens
ttcaggtgaataataaaatca

SEQ ID NO: 2894339 - DNA, 17 bp, Homo sapiens
ttcaggtgcagaggaag

SEQ ID NO: 2894340 - DNA, 14 bp, Homo sapiens
ttcagtactgcagc

SEQ ID NO: 2894341 - DNA, 22 bp, Homo sapiens
ttcagtacttcagcaagagaga

SEQ ID NO: 2894342 - DNA, 19 bp, Homo sapiens
ttcagtacttttttaaata

SEQ ID NO: 2894343 - DNA, 17 bp, Homo sapiens
ttcagtatgttttacac

SEQ ID NO: 2894344 - DNA, 16 bp, Homo sapiens
ttcagtattaaactct

SEQ ID NO: 2894345 - DNA, 20 bp, Homo sapiens
ttcagtattaaactctcctt

SEQ ID NO: 2894346 - DNA, 21 bp, Homo sapiens
ttcagtattaaactctccttt

SEQ ID NO: 2894347 - DNA, 20 bp, Homo sapiens
ttcagtattatgtagttgtt

SEQ ID NO: 2894348 - DNA, 15 bp, Homo sapiens
ttcagtccctgagca

SEQ ID NO: 2894349 - DNA, 14 bp, Homo sapiens
ttcagtctgctctc

SEQ ID NO: 2894350 - DNA, 16 bp, Homo sapiens
tttatagttgtatttt

SEQ ID NO: 2894351 - DNA, 12 bp, Homo sapiens
tttatataaaaa

SEQ ID NO: 2894352 - DNA, 14 bp, Homo sapiens
tttatataatatct

SEQ ID NO: 2894353 - DNA, 16 bp, Homo sapiens
tttatatacaataatg

SEQ ID NO: 2894354 - DNA, 15 bp, Homo sapiens
tttatatatacagta

SEQ ID NO: 2894355 - DNA, 21 bp, Homo sapiens
tttatatatacagtaacttta

SEQ ID NO: 2894356 - DNA, 16 bp, Homo sapiens
tttatatctgtatgta

SEQ ID NO: 2894357 - DNA, 14 bp, Homo sapiens
tttatatgtacatg

SEQ ID NO: 2894358 - DNA, 16 bp, Homo sapiens
tttatattcatcaaat

SEQ ID NO: 2894359 - DNA, 23 bp, Homo sapiens
tttatattcatcaaataaacctt

SEQ ID NO: 2894360 - DNA, 16 bp, Homo sapiens
tttatattgtaaatat

SEQ ID NO: 2894361 - DNA, 19 bp, Homo sapiens
tttatattttatactgcac

SEQ ID NO: 2894362 - DNA, 14 bp, Homo sapiens
tttatattttccct

SEQ ID NO: 2894363 - DNA, 15 bp, Homo sapiens
tttatattttctatt

SEQ ID NO: 2894364 - DNA, 15 bp, Homo sapiens
tttatcaactttggt

SEQ ID NO: 2894365 - DNA, 19 bp, Homo sapiens
tttatcacctcattctgaa

SEQ ID NO: 2894366 - DNA, 15 bp, Homo sapiens
tttatcagcaaaaaa

SEQ ID NO: 2894367 - DNA, 22 bp, Homo sapiens
tttatcatgaattcccttttaa

SEQ ID NO: 2894368 - DNA, 17 bp, Homo sapiens
tttatcattcctttcca

SEQ ID NO: 2894369 - DNA, 18 bp, Homo sapiens
tttatcatttctactgaa

SEQ ID NO: 2894370 - DNA, 17 bp, Homo sapiens
tttatccaaaatgtgta

SEQ ID NO: 2894371 - DNA, 18 bp, Homo sapiens
tttatccaaaatgtgtat

SEQ ID NO: 2894372 - DNA, 20 bp, Homo sapiens
tttatccaaaatgtgtattt

SEQ ID NO: 2894373 - DNA, 17 bp, Homo sapiens
tttatccctgcttatct

SEQ ID NO: 2894374 - DNA, 15 bp, Homo sapiens
tttatcccttcctgt

SEQ ID NO: 2894375 - DNA, 14 bp, Homo sapiens
tttatccttccttt

SEQ ID NO: 2894376 - DNA, 14 bp, Homo sapiens
tttatccttgaact

SEQ ID NO: 2894377 - DNA, 14 bp, Homo sapiens
tttatctaaaagaa

SEQ ID NO: 2894378 - DNA, 12 bp, Homo sapiens
tttatctgtgga

SEQ ID NO: 2894379 - DNA, 23 bp, Homo sapiens
tttatgaccagagcaaaaatgta

SEQ ID NO: 2894380 - DNA, 17 bp, Homo sapiens
tttatgagaaagccttc

SEQ ID NO: 2894381 - DNA, 12 bp, Homo sapiens
tttatgagaaat

SEQ ID NO: 2894382 - DNA, 14 bp, Homo sapiens
tttatgagaaatgt

SEQ ID NO: 2894383 - DNA, 20 bp, Homo sapiens
tttatgagaaatgtaatgcg

SEQ ID NO: 2894384 - DNA, 17 bp, Homo sapiens
tttatgataatagattc

SEQ ID NO: 2894385 - DNA, 18 bp, Homo sapiens
tttatgataatagattct

SEQ ID NO: 2894386 - DNA, 16 bp, Homo sapiens
tttatgatgacaatca

SEQ ID NO: 2894387 - DNA, 18 bp, Homo sapiens
tttatgcaaaaggtttat

SEQ ID NO: 2894388 - DNA, 19 bp, Homo sapiens
tttatgcaaccataagaca

SEQ ID NO: 2894389 - DNA, 19 bp, Homo sapiens
tttatgcacttataaggtg

SEQ ID NO: 2894390 - DNA, 22 bp, Homo sapiens
tttatggggctgaacggggaga

SEQ ID NO: 2894391 - DNA, 21 bp, Homo sapiens
tttatggtttcccccttctac

SEQ ID NO: 2894392 - DNA, 23 bp, Homo sapiens
tttatgtttgcacttgtgattat

SEQ ID NO: 2894393 - DNA, 11 bp, Homo sapiens
tttattaaata

SEQ ID NO: 2894394 - DNA, 12 bp, Homo sapiens
tttattaaatct

SEQ ID NO: 2894395 - DNA, 22 bp, Homo sapiens
tttattaaattaattgaatcta

SEQ ID NO: 2894396 - DNA, 23 bp, Homo sapiens
tttattaagccaggaaacatgaa

SEQ ID NO: 2894397 - DNA, 20 bp, Homo sapiens
tttattaatagaatgataaa

SEQ ID NO: 2894398 - DNA, 17 bp, Homo sapiens
tttattaatgcactttc

SEQ ID NO: 2894399 - DNA, 16 bp, Homo sapiens
tttattacatctttca

SEQ ID NO: 2894400 - DNA, 17 bp, Homo sapiens
tttattaccccctcctt

SEQ ID NO: 2894401 - DNA, 20 bp, Homo sapiens
tttattatgcattcttataa

SEQ ID NO: 2894402 - DNA, 16 bp, Homo sapiens
tttattatttatttat

SEQ ID NO: 2894403 - DNA, 19 bp, Homo sapiens
tttattccagaatgctgta

SEQ ID NO: 2894404 - DNA, 23 bp, Homo sapiens
tttattccagaatgctgtacatc

SEQ ID NO: 2894405 - DNA, 13 bp, Homo sapiens
tttattgaatatt

SEQ ID NO: 2894406 - DNA, 12 bp, Homo sapiens
tttattgacaca

SEQ ID NO: 2894407 - DNA, 15 bp, Homo sapiens
tttattgacacagaa

SEQ ID NO: 2894408 - DNA, 12 bp, Homo sapiens
tttattgcaatg

SEQ ID NO: 2894409 - DNA, 23 bp, Homo sapiens
tttattgccattatagcgcctgt

SEQ ID NO: 2894410 - DNA, 12 bp, Homo sapiens
tttattgccttc

SEQ ID NO: 2894411 - DNA, 22 bp, Homo sapiens
tttattgccttctcaccagctg

SEQ ID NO: 2894412 - DNA, 12 bp, Homo sapiens
tttatttaactt

SEQ ID NO: 2894413 - DNA, 11 bp, Homo sapiens
tttatttaatt

SEQ ID NO: 2894414 - DNA, 13 bp, Homo sapiens
tttatttgttgag

SEQ ID NO: 2894415 - DNA, 14 bp, Homo sapiens
tttattttgtggga

SEQ ID NO: 2894416 - DNA, 22 bp, Homo sapiens
tttatttttctttaaagccagt

SEQ ID NO: 2894417 - DNA, 22 bp, Homo sapiens
tttatttttgcaaaataagttt

SEQ ID NO: 2894418 - DNA, 17 bp, Homo sapiens
tttattttttcttttgt

SEQ ID NO: 2894419 - DNA, 21 bp, Homo sapiens
tttcaaaacatacaagcaaca

SEQ ID NO: 2894420 - DNA, 18 bp, Homo sapiens
tttcaaaaccttttgaaa

SEQ ID NO: 2894421 - DNA, 21 bp, Homo sapiens
tttcaaaataagtatttctga

SEQ ID NO: 2894422 - DNA, 13 bp, Homo sapiens
tttcaaaattaat

SEQ ID NO: 2894423 - DNA, 19 bp, Homo sapiens
tttcaaaattaatagcttt

SEQ ID NO: 2894424 - DNA, 14 bp, Homo sapiens
tttcaaacatttgt

SEQ ID NO: 2894425 - DNA, 14 bp, Homo sapiens
tttcaaactgtaaa

SEQ ID NO: 2894426 - DNA, 13 bp, Homo sapiens
tttcaaagacaat

SEQ ID NO: 2894427 - DNA, 14 bp, Homo sapiens
tttcaaagacaatc

SEQ ID NO: 2894428 - DNA, 14 bp, Homo sapiens
tttcaaagatgctg

SEQ ID NO: 2894429 - DNA, 19 bp, Homo sapiens
tttcaaagatgctgtgagt

SEQ ID NO: 2894430 - DNA, 12 bp, Homo sapiens
tttaaaatgtct

SEQ ID NO: 2894431 - DNA, 22 bp, Homo sapiens
tttaaaattaagtagaacaaaa

SEQ ID NO: 2894432 - DNA, 17 bp, Homo sapiens
tttaaaatttgtagaat

SEQ ID NO: 2894433 - DNA, 13 bp, Homo sapiens
tttaaacaaatga

SEQ ID NO: 2894434 - DNA, 15 bp, Homo sapiens
tttaaacaaatgagt

SEQ ID NO: 2894435 - DNA, 21 bp, Homo sapiens
tttaaacccattttagtcact

SEQ ID NO: 2894436 - DNA, 12 bp, Homo sapiens
tttaaactagat

SEQ ID NO: 2894437 - DNA, 15 bp, Homo sapiens
tttaaagaagtctct

SEQ ID NO: 2894438 - DNA, 18 bp, Homo sapiens
tttaaagaagtctcttaa

SEQ ID NO: 2894439 - DNA, 20 bp, Homo sapiens
tttaaagaagtgcatgaaaa

SEQ ID NO: 2894440 - DNA, 18 bp, Homo sapiens
tttaaagaatatgacttt

SEQ ID NO: 2894441 - DNA, 23 bp, Homo sapiens
tttaaagagtctagattcaaagg

SEQ ID NO: 2894442 - DNA, 23 bp, Homo sapiens
tttaaaggtggattttgtttaaa

SEQ ID NO: 2894443 - DNA, 22 bp, Homo sapiens
tttaaagtactgagcagtatta

SEQ ID NO: 2894444 - DNA, 22 bp, Homo sapiens
tttaaagtgactaatggcatga

SEQ ID NO: 2894445 - DNA, 19 bp, Homo sapiens
tttaaataaagacctatgt

SEQ ID NO: 2894446 - DNA, 20 bp, Homo sapiens
tttaaatacagtcttccatt

SEQ ID NO: 2894447 - DNA, 13 bp, Homo sapiens
tttaaatattttc

SEQ ID NO: 2894448 - DNA, 14 bp, Homo sapiens
tttaaatattttct

SEQ ID NO: 2894449 - DNA, 19 bp, Homo sapiens
tttaaatctgcagcacatt

SEQ ID NO: 2894450 - DNA, 12 bp, Homo sapiens
tttaaatgaaag

SEQ ID NO: 2894451 - DNA, 11 bp, Homo sapiens
tttaaatgtac

SEQ ID NO: 2894452 - DNA, 20 bp, Homo sapiens
tttaaatgtacagacatatt

SEQ ID NO: 2894453 - DNA, 18 bp, Homo sapiens
tttaaatgtacttatatt

SEQ ID NO: 2894454 - DNA, 24 bp, Homo sapiens
tttaaatgtgaatttttatttctt

SEQ ID NO: 2894455 - DNA, 12 bp, Homo sapiens
tttaaatgttta

SEQ ID NO: 2894456 - DNA, 14 bp, Homo sapiens
tttaaattggttca

SEQ ID NO: 2894457 - DNA, 18 bp, Homo sapiens
tttaaattttacccttta

SEQ ID NO: 2894458 - DNA, 12 bp, Homo sapiens
tttaaattttct

SEQ ID NO: 2894459 - DNA, 14 bp, Homo sapiens
tttaaattttctcc

SEQ ID NO: 2894460 - DNA, 21 bp, Homo sapiens
tttaaattttctccagtccct

SEQ ID NO: 2894461 - DNA, 12 bp, Homo sapiens
tttaacaagaag

SEQ ID NO: 2894462 - DNA, 22 bp, Homo sapiens
tttaaccaagttgtttattcca

SEQ ID NO: 2894463 - DNA, 18 bp, Homo sapiens
tttaacgtatgtatttca

SEQ ID NO: 2894464 - DNA, 12 bp, Homo sapiens
tttaactctgcg

SEQ ID NO: 2894465 - DNA, 22 bp, Homo sapiens
tttaactctgcggatagcattt

SEQ ID NO: 2894466 - DNA, 19 bp, Homo sapiens
tttaactgaagatgttgag

SEQ ID NO: 2894467 - DNA, 21 bp, Homo sapiens
tttaactgccaatccttaaat

SEQ ID NO: 2894468 - DNA, 13 bp, Homo sapiens
tttaactggtgca

SEQ ID NO: 2894469 - DNA, 19 bp, Homo sapiens
tttaactggtgcactttgt

SEQ ID NO: 2894470 - DNA, 15 bp, Homo sapiens
tttaagacttagtta

SEQ ID NO: 2894471 - DNA, 12 bp, Homo sapiens
tttaagagactc

SEQ ID NO: 2894472 - DNA, 20 bp, Homo sapiens
tttaagaggctttggcccaa

SEQ ID NO: 2894473 - DNA, 14 bp, Homo sapiens
tttaagagtgaagt

SEQ ID NO: 2894474 - DNA, 16 bp, Homo sapiens
tttaagatatccatct

SEQ ID NO: 2894475 - DNA, 19 bp, Homo sapiens
tttaagatatccatctttt

SEQ ID NO: 2894476 - DNA, 23 bp, Homo sapiens
tttaagatatccatctttttctt

SEQ ID NO: 2894477 - DNA, 14 bp, Homo sapiens
tttaagatgacact

SEQ ID NO: 2894478 - DNA, 15 bp, Homo sapiens
tttaagatttgtgtt

SEQ ID NO: 2894479 - DNA, 15 bp, Homo sapiens
tttaagcaaatgcat

SEQ ID NO: 2894480 - DNA, 15 bp, Homo sapiens
tttaagcaacatctt

SEQ ID NO: 2894481 - DNA, 12 bp, Homo sapiens
tttaaggaaaat

SEQ ID NO: 2894482 - DNA, 20 bp, Homo sapiens
tttaagtctacaaaaaggta

SEQ ID NO: 2894483 - DNA, 19 bp, Homo sapiens
tttaagtgaaagtgaggaa

SEQ ID NO: 2894484 - DNA, 14 bp, Homo sapiens
tttaagtgtaactg

SEQ ID NO: 2894485 - DNA, 14 bp, Homo sapiens
tttaagttcccaga

SEQ ID NO: 2894486 - DNA, 19 bp, Homo sapiens
tttaagttggctagagctt

SEQ ID NO: 2894487 - DNA, 13 bp, Homo sapiens
tttaataactttg

SEQ ID NO: 2894488 - DNA, 14 bp, Homo sapiens
tttaatagtgttaa

SEQ ID NO: 2894489 - DNA, 18 bp, Homo sapiens
tttaatagtgttaatcaa

SEQ ID NO: 2894490 - DNA, 13 bp, Homo sapiens
tttaatatgttga

SEQ ID NO: 2894491 - DNA, 17 bp, Homo sapiens
tttaatattattactgt

SEQ ID NO: 2894492 - DNA, 14 bp, Homo sapiens
tttaatatttccaa

SEQ ID NO: 2894493 - DNA, 13 bp, Homo sapiens
tttaatcatgaaa

SEQ ID NO: 2894494 - DNA, 13 bp, Homo sapiens
tttaatcatgagc

SEQ ID NO: 2894495 - DNA, 18 bp, Homo sapiens
tttaatcatgagcctgtt

SEQ ID NO: 2894496 - DNA, 19 bp, Homo sapiens
tttaatcatgagcctgttt

SEQ ID NO: 2894497 - DNA, 16 bp, Homo sapiens
tttaatgaacaaatgg

SEQ ID NO: 2894498 - DNA, 23 bp, Homo sapiens
tttaatgccgatatactctagat

SEQ ID NO: 2894499 - DNA, 15 bp, Homo sapiens
tttaatgctatttga

SEQ ID NO: 2894500 - DNA, 16 bp, Homo sapiens
tttaatgctgtctttg

SEQ ID NO: 2894501 - DNA, 21 bp, Homo sapiens
tttaatggacacttttcacct

SEQ ID NO: 2894502 - DNA, 22 bp, Homo sapiens
tttaatggccggctggaaatgc

SEQ ID NO: 2894503 - DNA, 12 bp, Homo sapiens
tttaatgtgaag

SEQ ID NO: 2894504 - DNA, 16 bp, Homo sapiens
tttaatgtgctgtgta

SEQ ID NO: 2894505 - DNA, 17 bp, Homo sapiens
tttaatgtgctgtgtaa

SEQ ID NO: 2894506 - DNA, 19 bp, Homo sapiens
tttaatgtgctgtgtaaag

SEQ ID NO: 2894507 - DNA, 21 bp, Homo sapiens
tttaatgtgctgtgtaaagtt

SEQ ID NO: 2894508 - DNA, 17 bp, Homo sapiens
tttaatgttacatagta

SEQ ID NO: 2894509 - DNA, 17 bp, Homo sapiens
tttaatgtttatacaga

SEQ ID NO: 2894510 - DNA, 15 bp, Homo sapiens
tttaatgttttaaat

SEQ ID NO: 2894511 - DNA, 18 bp, Homo sapiens
tttaatgttttaaatgta

SEQ ID NO: 2894512 - DNA, 20 bp, Homo sapiens
tttaattaaaaactagtagt

SEQ ID NO: 2894513 - DNA, 15 bp, Homo sapiens
tttaattattttaaa

SEQ ID NO: 2894514 - DNA, 14 bp, Homo sapiens
tttaattcatgttt

SEQ ID NO: 2894515 - DNA, 23 bp, Homo sapiens
tttaattcatgtttcttaaatgg

SEQ ID NO: 2894516 - DNA, 14 bp, Homo sapiens
tttaattgtgatat

SEQ ID NO: 2894517 - DNA, 14 bp, Homo sapiens
tttaatttatgtaa

SEQ ID NO: 2894518 - DNA, 22 bp, Homo sapiens
tttaatttattaattgctttga

SEQ ID NO: 2894519 - DNA, 19 bp, Homo sapiens
tttaatttcaggtctcagg

SEQ ID NO: 2894520 - DNA, 23 bp, Homo sapiens
tttaatttttaaaagactttgat

SEQ ID NO: 2894521 - DNA, 17 bp, Homo sapiens
tttaattttttaaataa

SEQ ID NO: 2894522 - DNA, 14 bp, Homo sapiens
tttacaaaatacta

SEQ ID NO: 2894523 - DNA, 16 bp, Homo sapiens
tttacaaattaatatt

SEQ ID NO: 2894524 - DNA, 22 bp, Homo sapiens
tttacaaattaatatttgtgct

SEQ ID NO: 2894525 - DNA, 15 bp, Homo sapiens
tttacaacaaacact

SEQ ID NO: 2894526 - DNA, 12 bp, Homo sapiens
tttacaatgtgt

SEQ ID NO: 2894527 - DNA, 13 bp, Homo sapiens
tttacacagcaat

SEQ ID NO: 2894528 - DNA, 18 bp, Homo sapiens
tttacaccacactttcaa

SEQ ID NO: 2894529 - DNA, 13 bp, Homo sapiens
tttacactgtacc

SEQ ID NO: 2894530 - DNA, 14 bp, Homo sapiens
tttacactgtacca

SEQ ID NO: 2894531 - DNA, 13 bp, Homo sapiens
tttacagaaaaag

SEQ ID NO: 2894532 - DNA, 17 bp, Homo sapiens
tttacagtacttgtctt

SEQ ID NO: 2894533 - DNA, 16 bp, Homo sapiens
tttacattctgtgtgt

SEQ ID NO: 2894534 - DNA, 16 bp, Homo sapiens
tttacattgttgagct

SEQ ID NO: 2894535 - DNA, 18 bp, Homo sapiens
tttaccaacatgtatctg

SEQ ID NO: 2894536 - DNA, 21 bp, Homo sapiens
tttaccaacatgtatctgtct

SEQ ID NO: 2894537 - DNA, 22 bp, Homo sapiens
tttaccaacatgtatctgtcta

SEQ ID NO: 2894538 - DNA, 16 bp, Homo sapiens
tttaccccatccctgt

SEQ ID NO: 2894539 - DNA, 13 bp, Homo sapiens
tttacctataaaa

SEQ ID NO: 2894540 - DNA, 13 bp, Homo sapiens
tttacctcccctt

SEQ ID NO: 2894541 - DNA, 18 bp, Homo sapiens
tttaccttttatgcaaaa

SEQ ID NO: 2894542 - DNA, 14 bp, Homo sapiens
tttacgcaaggaag

SEQ ID NO: 2894543 - DNA, 15 bp, Homo sapiens
tttacgttttagaaa

SEQ ID NO: 2894544 - DNA, 14 bp, Homo sapiens
tttactacagctat

SEQ ID NO: 2894545 - DNA, 21 bp, Homo sapiens
tttactacagctatgaagaaa

SEQ ID NO: 2894546 - DNA, 22 bp, Homo sapiens
tttactacttctctctgtattt

SEQ ID NO: 2894547 - DNA, 19 bp, Homo sapiens
tttactagactgaggagcc

SEQ ID NO: 2894548 - DNA, 23 bp, Homo sapiens
tttactagggatccctcatctgt

SEQ ID NO: 2894549 - DNA, 19 bp, Homo sapiens
tttactcaccatatttgaa

SEQ ID NO: 2894550 - DNA, 21 bp, Homo sapiens
tttactcaccatatttgaatt

SEQ ID NO: 2894551 - DNA, 17 bp, Homo sapiens
tttactcctcacactta

SEQ ID NO: 2894552 - DNA, 11 bp, Homo sapiens
tttactcctgg

SEQ ID NO: 2894553 - DNA, 21 bp, Homo sapiens
tttactctgttgaatatttag

SEQ ID NO: 2894554 - DNA, 17 bp, Homo sapiens
tttactgcctgaataaa

SEQ ID NO: 2894555 - DNA, 16 bp, Homo sapiens
tttacttaaagattta

SEQ ID NO: 2894556 - DNA, 12 bp, Homo sapiens
tttactttcaaa

SEQ ID NO: 2894557 - DNA, 14 bp, Homo sapiens
tttactttgccaac

SEQ ID NO: 2894558 - DNA, 19 bp, Homo sapiens
tttagaaaacccaagtttt

SEQ ID NO: 2894559 - DNA, 20 bp, Homo sapiens
tttagaaaacccaagttttt

SEQ ID NO: 2894560 - DNA, 18 bp, Homo sapiens
tttagaagtgtcatgttt

SEQ ID NO: 2894561 - DNA, 13 bp, Homo sapiens
tttagaattaaaa

SEQ ID NO: 2894562 - DNA, 20 bp, Homo sapiens
tttagacagtctcactttgt

SEQ ID NO: 2894563 - DNA, 23 bp, Homo sapiens
tttgcaatcttaagcagagataa

SEQ ID NO: 2894564 - DNA, 17 bp, Homo sapiens
tttgcaattctttttgg

SEQ ID NO: 2894565 - DNA, 21 bp, Homo sapiens
tttgcacaaacttgtgagcat

SEQ ID NO: 2894566 - DNA, 21 bp, Homo sapiens
tttgcacctttctagttgaaa

SEQ ID NO: 2894567 - DNA, 18 bp, Homo sapiens
tttgcagttcctcttcat

SEQ ID NO: 2894568 - DNA, 18 bp, Homo sapiens
tttgcataacaattcctc

SEQ ID NO: 2894569 - DNA, 20 bp, Homo sapiens
tttgcataacaattcctcta

SEQ ID NO: 2894570 - DNA, 22 bp, Homo sapiens
tttgcataacaattcctctact

SEQ ID NO: 2894571 - DNA, 21 bp, Homo sapiens
tttgcatagcagctgctacta

SEQ ID NO: 2894572 - DNA, 20 bp, Homo sapiens
tttgcatcgtcccctccccc

SEQ ID NO: 2894573 - DNA, 22 bp, Homo sapiens
tttgcatctgaaataggaaaca

SEQ ID NO: 2894574 - DNA, 19 bp, Homo sapiens
tttgccactgatattcaga

SEQ ID NO: 2894575 - DNA, 18 bp, Homo sapiens
tttgcccacacacactcc

SEQ ID NO: 2894576 - DNA, 22 bp, Homo sapiens
tttgcccacacacactccttcc

SEQ ID NO: 2894577 - DNA, 22 bp, Homo sapiens
tttgcctccagaagcactggga

SEQ ID NO: 2894578 - DNA, 12 bp, Homo sapiens
tttgcctgtaac

SEQ ID NO: 2894579 - DNA, 16 bp, Homo sapiens
tttgcctgttcagtta

SEQ ID NO: 2894580 - DNA, 19 bp, Homo sapiens
tttgcctgttcagttacag

SEQ ID NO: 2894581 - DNA, 15 bp, Homo sapiens
tttgctataatcatt

SEQ ID NO: 2894582 - DNA, 16 bp, Homo sapiens
tttgctataatcatta

SEQ ID NO: 2894583 - DNA, 17 bp, Homo sapiens
tttgctataatcattag

SEQ ID NO: 2894584 - DNA, 20 bp, Homo sapiens
tttgctataatcattagttt

SEQ ID NO: 2894585 - DNA, 18 bp, Homo sapiens
tttgctatcttaattttg

SEQ ID NO: 2894586 - DNA, 15 bp, Homo sapiens
tttgctatgtaaggg

SEQ ID NO: 2894587 - DNA, 15 bp, Homo sapiens
tttgctcagaggaat

SEQ ID NO: 2894588 - DNA, 23 bp, Homo sapiens
tttgctctgtgaactatcccctg

SEQ ID NO: 2894589 - DNA, 18 bp, Homo sapiens
tttgctcttcaagaaatc

SEQ ID NO: 2894590 - DNA, 12 bp, Homo sapiens
tttgctgggaga

SEQ ID NO: 2894591 - DNA, 12 bp, Homo sapiens
tttgctgtcaca

SEQ ID NO: 2894592 - DNA, 12 bp, Homo sapiens
tttgctgtgcca

SEQ ID NO: 2894593 - DNA, 19 bp, Homo sapiens
tttgctgttccacaaagca

SEQ ID NO: 2894594 - DNA, 20 bp, Homo sapiens
tttgctgttccacaaagcag

SEQ ID NO: 2894595 - DNA, 22 bp, Homo sapiens
tttgctgttttaaattgcattt

SEQ ID NO: 2894596 - DNA, 14 bp, Homo sapiens
tttgcttaccttgt

SEQ ID NO: 2894597 - DNA, 13 bp, Homo sapiens
tttgcttggtgct

SEQ ID NO: 2894598 - DNA, 17 bp, Homo sapiens
tttgcttggtgctggtt

SEQ ID NO: 2894599 - DNA, 14 bp, Homo sapiens
tttgcttgtcttct

SEQ ID NO: 2894600 - DNA, 15 bp, Homo sapiens
tttgctttctgctca

SEQ ID NO: 2894601 - DNA, 15 bp, Homo sapiens
tttggaaaatgcatt

SEQ ID NO: 2894602 - DNA, 14 bp, Homo sapiens
tttggaaagaaatt

SEQ ID NO: 2894603 - DNA, 20 bp, Homo sapiens
tttggaaagcaaggtttcct

SEQ ID NO: 2894604 - DNA, 21 bp, Homo sapiens
tttggaagacatatattatat

SEQ ID NO: 2894605 - DNA, 15 bp, Homo sapiens
tttggaattgacatt

SEQ ID NO: 2894606 - DNA, 18 bp, Homo sapiens
tttggactccatctctca

SEQ ID NO: 2894607 - DNA, 18 bp, Homo sapiens
tttggagagtttcctgaa

SEQ ID NO: 2894608 - DNA, 19 bp, Homo sapiens
tttggagtgttatgtattt

SEQ ID NO: 2894609 - DNA, 13 bp, Homo sapiens
tttggataataaa

SEQ ID NO: 2894610 - DNA, 17 bp, Homo sapiens
tttggatgacttgttca

SEQ ID NO: 2894611 - DNA, 20 bp, Homo sapiens
tttggattcttatgtagcag

SEQ ID NO: 2894612 - DNA, 19 bp, Homo sapiens
tttggatttacgactgaag

SEQ ID NO: 2894613 - DNA, 22 bp, Homo sapiens
tttggatttcctttatactgtg

SEQ ID NO: 2894614 - DNA, 18 bp, Homo sapiens
tttggatttttaattaaa

SEQ ID NO: 2894615 - DNA, 14 bp, Homo sapiens
tttggcaaggaaag

SEQ ID NO: 2894616 - DNA, 17 bp, Homo sapiens
tttggcaatgccatcat

SEQ ID NO: 2894617 - DNA, 20 bp, Homo sapiens
tttggcagagcttcttccag

SEQ ID NO: 2894618 - DNA, 23 bp, Homo sapiens
tttggcatctgcaaaggaatcac

SEQ ID NO: 2894619 - DNA, 20 bp, Homo sapiens
tttggcccaagactgggctg

SEQ ID NO: 2894620 - DNA, 19 bp, Homo sapiens
tttggctctgaagaagcaa

SEQ ID NO: 2894621 - DNA, 13 bp, Homo sapiens
tttggctgcttct

SEQ ID NO: 2894622 - DNA, 14 bp, Homo sapiens
tttggcttccatga

SEQ ID NO: 2894623 - DNA, 13 bp, Homo sapiens
tttggctttcagg

SEQ ID NO: 2894624 - DNA, 19 bp, Homo sapiens
tttgggaaagatggataaa

SEQ ID NO: 2894625 - DNA, 24 bp, Homo sapiens
tttgggaaagatggataaactgag

SEQ ID NO: 2894626 - DNA, 20 bp, Homo sapiens
tttgggaccctgctttagag

SEQ ID NO: 2894627 - DNA, 11 bp, Homo sapiens
tttgggcatgt

SEQ ID NO: 2894628 - DNA, 12 bp, Homo sapiens
tttgggccctgc

SEQ ID NO: 2894629 - DNA, 16 bp, Homo sapiens
tttgggctaacattta

SEQ ID NO: 2894630 - DNA, 14 bp, Homo sapiens
tttgggggaaactt

SEQ ID NO: 2894631 - DNA, 17 bp, Homo sapiens
tttgggggaaacttcct

SEQ ID NO: 2894632 - DNA, 18 bp, Homo sapiens
tttgggggacgtttctca

SEQ ID NO: 2894633 - DNA, 18 bp, Homo sapiens
tttgggtcatttttaact

SEQ ID NO: 2894634 - DNA, 14 bp, Homo sapiens
tttggtataaatta

SEQ ID NO: 2894635 - DNA, 21 bp, Homo sapiens
tttggtccttcaaaggcttgt

SEQ ID NO: 2894636 - DNA, 18 bp, Homo sapiens
tttggtgccaatgtgaaa

SEQ ID NO: 2894637 - DNA, 21 bp, Homo sapiens
tttggtggtttaaaaatggta

SEQ ID NO: 2894638 - DNA, 18 bp, Homo sapiens
tttggtgtgcatctgtgt

SEQ ID NO: 2894639 - DNA, 11 bp, Homo sapiens
tttggttctaa

SEQ ID NO: 2894640 - DNA, 20 bp, Homo sapiens
tttggttcttctcaaaagaa

SEQ ID NO: 2894641 - DNA, 22 bp, Homo sapiens
tttgtaaaaacagcattgcttt

SEQ ID NO: 2894642 - DNA, 16 bp, Homo sapiens
tttgtaaagtgaagaa

SEQ ID NO: 2894643 - DNA, 20 bp, Homo sapiens
tttgtaaataggatttttag

SEQ ID NO: 2894644 - DNA, 14 bp, Homo sapiens
tttgtaaatgtact

SEQ ID NO: 2894645 - DNA, 18 bp, Homo sapiens
tttgtaagaactaaagaa

SEQ ID NO: 2894646 - DNA, 20 bp, Homo sapiens
tttgtaagcaacttgcttct

SEQ ID NO: 2894647 - DNA, 14 bp, Homo sapiens
tttgtaattgtgta

SEQ ID NO: 2894648 - DNA, 17 bp, Homo sapiens
tttgtaattttagtatt

SEQ ID NO: 2894649 - DNA, 12 bp, Homo sapiens
tttgtaccagtg

SEQ ID NO: 2894650 - DNA, 19 bp, Homo sapiens
tttgtaccagtgaattttt

SEQ ID NO: 2894651 - DNA, 21 bp, Homo sapiens
tttgtaccctgaagtgttttt

SEQ ID NO: 2894652 - DNA, 18 bp, Homo sapiens
tttgtaccttattgatct

SEQ ID NO: 2894653 - DNA, 22 bp, Homo sapiens
tttgtactttgtttttccatgt

SEQ ID NO: 2894654 - DNA, 18 bp, Homo sapiens
tttgtagctttcctggaa

SEQ ID NO: 2894655 - DNA, 19 bp, Homo sapiens
tttgtagctttcctggaag

SEQ ID NO: 2894656 - DNA, 21 bp, Homo sapiens
tttgtaggagaaactcccatg

SEQ ID NO: 2894657 - DNA, 15 bp, Homo sapiens
tttgtaggttatttt

SEQ ID NO: 2894658 - DNA, 18 bp, Homo sapiens
tttgtataattgtatcgt

SEQ ID NO: 2894659 - DNA, 13 bp, Homo sapiens
tttgtatccattt

SEQ ID NO: 2894660 - DNA, 22 bp, Homo sapiens
tttgtatgaaattataatctgt

SEQ ID NO: 2894661 - DNA, 22 bp, Homo sapiens
tttgtatgccaagtgagaagat

SEQ ID NO: 2894662 - DNA, 12 bp, Homo sapiens
tttgtatgtttt

SEQ ID NO: 2894663 - DNA, 14 bp, Homo sapiens
tttgtatttaatga

SEQ ID NO: 2894664 - DNA, 14 bp, Homo sapiens
tttgtcagcatctg

SEQ ID NO: 2894665 - DNA, 17 bp, Homo sapiens
tttgtcatcagccacca

SEQ ID NO: 2894666 - DNA, 15 bp, Homo sapiens
tttgtccaaacaggt

SEQ ID NO: 2894667 - DNA, 16 bp, Homo sapiens
tttgtccaaacaggtg

SEQ ID NO: 2894668 - DNA, 12 bp, Homo sapiens
tttgtcctgaat

SEQ ID NO: 2894669 - DNA, 13 bp, Homo sapiens
tttgtcctgaatg

SEQ ID NO: 2894670 - DNA, 17 bp, Homo sapiens
tttgtcctgaatggctt

SEQ ID NO: 2894671 - DNA, 22 bp, Homo sapiens
tttgtcctgaatggctttgtct

SEQ ID NO: 2894672 - DNA, 14 bp, Homo sapiens
tttgtctaaaacaa

SEQ ID NO: 2894673 - DNA, 20 bp, Homo sapiens
tttgtctcctactctgtgta

SEQ ID NO: 2894674 - DNA, 13 bp, Homo sapiens
tttgtcttgaaaa

SEQ ID NO: 2894675 - DNA, 16 bp, Homo sapiens
tttgtcttgaatgtct

SEQ ID NO: 2894676 - DNA, 17 bp, Homo sapiens
tttgtctttcaaattta

SEQ ID NO: 2894677 - DNA, 13 bp, Homo sapiens
tttgtctttttgt

SEQ ID NO: 2894678 - DNA, 17 bp, Homo sapiens
tttgtgaagccctgttg

SEQ ID NO: 2894679 - DNA, 18 bp, Homo sapiens
tttgtgaatagaactctg

SEQ ID NO: 2894680 - DNA, 18 bp, Homo sapiens
tttgtgactaattgtata

SEQ ID NO: 2894681 - DNA, 12 bp, Homo sapiens
tttgtgatgaat

SEQ ID NO: 2894682 - DNA, 19 bp, Homo sapiens
tttgtgatgaatctacatt

SEQ ID NO: 2894683 - DNA, 20 bp, Homo sapiens
tttgtgatgaatctacattt

SEQ ID NO: 2894684 - DNA, 22 bp, Homo sapiens
tttgtgctgaatgttgggactg

SEQ ID NO: 2894685 - DNA, 18 bp, Homo sapiens
tttgtgctttgaaaaaaa

SEQ ID NO: 2894686 - DNA, 17 bp, Homo sapiens
tttgtgcttttagtaaa

SEQ ID NO: 2894687 - DNA, 21 bp, Homo sapiens
tttgtggccaaggagctgcta

SEQ ID NO: 2894688 - DNA, 22 bp, Homo sapiens
tttgtggccaaggagctgctat

SEQ ID NO: 2894689 - DNA, 14 bp, Homo sapiens
tttgtgggaattta

SEQ ID NO: 2894690 - DNA, 21 bp, Homo sapiens
tttgtggggacctcagcctgc

SEQ ID NO: 2894691 - DNA, 13 bp, Homo sapiens
tttgtgtatttaa

SEQ ID NO: 2894692 - DNA, 14 bp, Homo sapiens
tttgttaccacaga

SEQ ID NO: 2894693 - DNA, 12 bp, Homo sapiens
tttgttacttta

SEQ ID NO: 2894694 - DNA, 13 bp, Homo sapiens
tttgttataaatg

SEQ ID NO: 2894695 - DNA, 22 bp, Homo sapiens
tttgttatgtgtctggaagaag

SEQ ID NO: 2894696 - DNA, 14 bp, Homo sapiens
tttgttcacactcc

SEQ ID NO: 2894697 - DNA, 18 bp, Homo sapiens
tttgttcccaaggacttc

SEQ ID NO: 2894698 - DNA, 23 bp, Homo sapiens
tttgttcccaaggacttccacat

SEQ ID NO: 2894699 - DNA, 20 bp, Homo sapiens
tttctctccagcctgacttg

SEQ ID NO: 2894700 - DNA, 22 bp, Homo sapiens
tttctctcccaacgctgaagcg

SEQ ID NO: 2894701 - DNA, 18 bp, Homo sapiens
tttctctgaaaagcaaag

SEQ ID NO: 2894702 - DNA, 16 bp, Homo sapiens
tttctctgtacttttc

SEQ ID NO: 2894703 - DNA, 11 bp, Homo sapiens
tttctctgtat

SEQ ID NO: 2894704 - DNA, 14 bp, Homo sapiens
tttctctgtatatt

SEQ ID NO: 2894705 - DNA, 13 bp, Homo sapiens
tttctcttgtctt

SEQ ID NO: 2894706 - DNA, 13 bp, Homo sapiens
tttctctttcagt

SEQ ID NO: 2894707 - DNA, 16 bp, Homo sapiens
tttctgaaaagaaata

SEQ ID NO: 2894708 - DNA, 13 bp, Homo sapiens
tttctgaaactcc

SEQ ID NO: 2894709 - DNA, 14 bp, Homo sapiens
tttctgaaactccc

SEQ ID NO: 2894710 - DNA, 17 bp, Homo sapiens
tttctgaaattcacaga

SEQ ID NO: 2894711 - DNA, 19 bp, Homo sapiens
tttctgaatgtttgtgtct

SEQ ID NO: 2894712 - DNA, 13 bp, Homo sapiens
tttctgacagttt

SEQ ID NO: 2894713 - DNA, 16 bp, Homo sapiens
tttctgagcacacttt

SEQ ID NO: 2894714 - DNA, 15 bp, Homo sapiens
tttctgatcaaggcc

SEQ ID NO: 2894715 - DNA, 15 bp, Homo sapiens
tttctgatgttgcct

SEQ ID NO: 2894716 - DNA, 16 bp, Homo sapiens
tttctgatgttgcctt

SEQ ID NO: 2894717 - DNA, 19 bp, Homo sapiens
tttctgattccatcctgtg

SEQ ID NO: 2894718 - DNA, 15 bp, Homo sapiens
tttctgcaatgactg

SEQ ID NO: 2894719 - DNA, 16 bp, Homo sapiens
tttctgcaatgactgt

SEQ ID NO: 2894720 - DNA, 19 bp, Homo sapiens
tttctgcacaggtctctgt

SEQ ID NO: 2894721 - DNA, 20 bp, Homo sapiens
tttctgcacaggtctctgtt

SEQ ID NO: 2894722 - DNA, 21 bp, Homo sapiens
tttctgcacaggtctctgttt

SEQ ID NO: 2894723 - DNA, 13 bp, Homo sapiens
tttctgcatatgt

SEQ ID NO: 2894724 - DNA, 16 bp, Homo sapiens
tttctgctttaaatta

SEQ ID NO: 2894725 - DNA, 15 bp, Homo sapiens
tttctggggaaagac

SEQ ID NO: 2894726 - DNA, 16 bp, Homo sapiens
tttctggtataaagct

SEQ ID NO: 2894727 - DNA, 15 bp, Homo sapiens
tttctggttctaaca

SEQ ID NO: 2894728 - DNA, 17 bp, Homo sapiens
tttctgtatatactttt

SEQ ID NO: 2894729 - DNA, 14 bp, Homo sapiens
tttctgtctcccct

SEQ ID NO: 2894730 - DNA, 12 bp, Homo sapiens
tttctgtgaagc

SEQ ID NO: 2894731 - DNA, 20 bp, Homo sapiens
tttctgttcagcttttcagt

SEQ ID NO: 2894732 - DNA, 15 bp, Homo sapiens
tttctgttgaagttt

SEQ ID NO: 2894733 - DNA, 17 bp, Homo sapiens
tttcttaaagcaaagtc

SEQ ID NO: 2894734 - DNA, 13 bp, Homo sapiens
tttcttaaatata

SEQ ID NO: 2894735 - DNA, 13 bp, Homo sapiens
tttcttaaatctt

SEQ ID NO: 2894736 - DNA, 17 bp, Homo sapiens
tttcttaaccagttgtg

SEQ ID NO: 2894737 - DNA, 17 bp, Homo sapiens
tttcttacacaagagct

SEQ ID NO: 2894738 - DNA, 21 bp, Homo sapiens
tttcttacacaagagctggag

SEQ ID NO: 2894739 - DNA, 13 bp, Homo sapiens
tttcttatagatt

SEQ ID NO: 2894740 - DNA, 20 bp, Homo sapiens
tttcttcacttacaagaaag

SEQ ID NO: 2894741 - DNA, 17 bp, Homo sapiens
tttcttcccgcacaaat

SEQ ID NO: 2894742 - DNA, 18 bp, Homo sapiens
tttcttctagaagataac

SEQ ID NO: 2894743 - DNA, 20 bp, Homo sapiens
tttcttctcgcctaggattt

SEQ ID NO: 2894744 - DNA, 14 bp, Homo sapiens
tttcttcttttcct

SEQ ID NO: 2894745 - DNA, 17 bp, Homo sapiens
tttcttgatcttaaaga

SEQ ID NO: 2894746 - DNA, 19 bp, Homo sapiens
tttcttgctaagctccagc

SEQ ID NO: 2894747 - DNA, 20 bp, Homo sapiens
tttcttggaactgtcccagc

SEQ ID NO: 2894748 - DNA, 12 bp, Homo sapiens
tttcttgtttgt

SEQ ID NO: 2894749 - DNA, 13 bp, Homo sapiens
tttctttaaaaga

SEQ ID NO: 2894750 - DNA, 14 bp, Homo sapiens
tttctttaaaagaa

SEQ ID NO: 2894751 - DNA, 15 bp, Homo sapiens
tttctttaaagccag

SEQ ID NO: 2894752 - DNA, 15 bp, Homo sapiens
tttctttaatatgat

SEQ ID NO: 2894753 - DNA, 13 bp, Homo sapiens
tttctttctagtt

SEQ ID NO: 2894754 - DNA, 14 bp, Homo sapiens
tttctttgcaaagt

SEQ ID NO: 2894755 - DNA, 23 bp, Homo sapiens
tttcttttggtaaagactggctt

SEQ ID NO: 2894756 - DNA, 19 bp, Homo sapiens
tttcttttgtaataaacta

SEQ ID NO: 2894757 - DNA, 13 bp, Homo sapiens
tttctttttgaat

SEQ ID NO: 2894758 - DNA, 22 bp, Homo sapiens
tttgaaaaaaagtttctattta

SEQ ID NO: 2894759 - DNA, 16 bp, Homo sapiens
tttgaaaaaattaaaa

SEQ ID NO: 2894760 - DNA, 23 bp, Homo sapiens
tttgaaaaaattaaaatctttct

SEQ ID NO: 2894761 - DNA, 15 bp, Homo sapiens
tttgaaacaaagaag

SEQ ID NO: 2894762 - DNA, 18 bp, Homo sapiens
tttgaaacacaataccta

SEQ ID NO: 2894763 - DNA, 23 bp, Homo sapiens
tttgaaactagaaatctgtcctg

SEQ ID NO: 2894764 - DNA, 17 bp, Homo sapiens
tttgaaactcgagacca

SEQ ID NO: 2894765 - DNA, 17 bp, Homo sapiens
tttcaggaatttaaaat

SEQ ID NO: 2894766 - DNA, 18 bp, Homo sapiens
tttcagggcagcccctgc

SEQ ID NO: 2894767 - DNA, 21 bp, Homo sapiens
tttcagggcagcccctgcaga

SEQ ID NO: 2894768 - DNA, 21 bp, Homo sapiens
tttcaggttcagtattatgta

SEQ ID NO: 2894769 - DNA, 22 bp, Homo sapiens
tttcagtacttcagcaagagag

SEQ ID NO: 2894770 - DNA, 20 bp, Homo sapiens
tttcagtattaaactctcct

SEQ ID NO: 2894771 - DNA, 16 bp, Homo sapiens
tttcagtgctgctgaa

SEQ ID NO: 2894772 - DNA, 21 bp, Homo sapiens
tttcagtttatttgaaccaat

SEQ ID NO: 2894773 - DNA, 14 bp, Homo sapiens
tttcataagtattt

SEQ ID NO: 2894774 - DNA, 17 bp, Homo sapiens
tttcataagtatttcaa

SEQ ID NO: 2894775 - DNA, 19 bp, Homo sapiens
tttcataagtatttcaaat

SEQ ID NO: 2894776 - DNA, 14 bp, Homo sapiens
tttcataatctttg

SEQ ID NO: 2894777 - DNA, 17 bp, Homo sapiens
tttcatatattattccg

SEQ ID NO: 2894778 - DNA, 15 bp, Homo sapiens
tttcatcatttcagc

SEQ ID NO: 2894779 - DNA, 17 bp, Homo sapiens
tttcatcatttcagcca

SEQ ID NO: 2894780 - DNA, 22 bp, Homo sapiens
tttcatccccttacccttagaa

SEQ ID NO: 2894781 - DNA, 13 bp, Homo sapiens
tttcatcctgtgt

SEQ ID NO: 2894782 - DNA, 17 bp, Homo sapiens
tttcatccttttttctc

SEQ ID NO: 2894783 - DNA, 15 bp, Homo sapiens
tttcatctgggaaag

SEQ ID NO: 2894784 - DNA, 16 bp, Homo sapiens
tttcatctgggaaaga

SEQ ID NO: 2894785 - DNA, 19 bp, Homo sapiens
tttcatgtaaactgtgcac

SEQ ID NO: 2894786 - DNA, 17 bp, Homo sapiens
tttcatgtctttccact

SEQ ID NO: 2894787 - DNA, 12 bp, Homo sapiens
tttcatgttaat

SEQ ID NO: 2894788 - DNA, 17 bp, Homo sapiens
tttcatgttttaacaaa

SEQ ID NO: 2894789 - DNA, 16 bp, Homo sapiens
tttcattaaacttgaa

SEQ ID NO: 2894790 - DNA, 14 bp, Homo sapiens
tttcattccaaagg

SEQ ID NO: 2894791 - DNA, 15 bp, Homo sapiens
tttcattgcaaagtt

SEQ ID NO: 2894792 - DNA, 17 bp, Homo sapiens
tttcattggttaatttt

SEQ ID NO: 2894793 - DNA, 19 bp, Homo sapiens
tttcatttggttcattaat

SEQ ID NO: 2894794 - DNA, 17 bp, Homo sapiens
tttcattttattttaat

SEQ ID NO: 2894795 - DNA, 17 bp, Homo sapiens
tttcatttttaaatgtg

SEQ ID NO: 2894796 - DNA, 15 bp, Homo sapiens
tttccaaaatttttc

SEQ ID NO: 2894797 - DNA, 16 bp, Homo sapiens
tttccaaaatttttca

SEQ ID NO: 2894798 - DNA, 18 bp, Homo sapiens
tttccaaaatttttcaac

SEQ ID NO: 2894799 - DNA, 15 bp, Homo sapiens
tttccaaattcacaa

SEQ ID NO: 2894800 - DNA, 17 bp, Homo sapiens
tttccaacgtttggaag

SEQ ID NO: 2894801 - DNA, 20 bp, Homo sapiens
tttccaagtcatttttgttt

SEQ ID NO: 2894802 - DNA, 16 bp, Homo sapiens
tttccaagtgtgcata

SEQ ID NO: 2894803 - DNA, 15 bp, Homo sapiens
tttccaccaactttt

SEQ ID NO: 2894804 - DNA, 22 bp, Homo sapiens
tttccaccaactttttccaagt

SEQ ID NO: 2894805 - DNA, 23 bp, Homo sapiens
tttccaccttttgtttttccagt

SEQ ID NO: 2894806 - DNA, 14 bp, Homo sapiens
tttccactactgct

SEQ ID NO: 2894807 - DNA, 16 bp, Homo sapiens
tttccactccattgtc

SEQ ID NO: 2894808 - DNA, 18 bp, Homo sapiens
tttccactcctcctagcc

SEQ ID NO: 2894809 - DNA, 16 bp, Homo sapiens
tttccacttctctggg

SEQ ID NO: 2894810 - DNA, 23 bp, Homo sapiens
tttccagaaagaaaatgaatttg

SEQ ID NO: 2894811 - DNA, 19 bp, Homo sapiens
tttccagacttccttgaga

SEQ ID NO: 2894812 - DNA, 13 bp, Homo sapiens
tttccagggaggg

SEQ ID NO: 2894813 - DNA, 23 bp, Homo sapiens
tttccatgcaccctcatacacag

SEQ ID NO: 2894814 - DNA, 20 bp, Homo sapiens
tttccatggcaggaaggctt

SEQ ID NO: 2894815 - DNA, 19 bp, Homo sapiens
tttccatgggaccacaact

SEQ ID NO: 2894816 - DNA, 18 bp, Homo sapiens
tttccatgtgttttgctt

SEQ ID NO: 2894817 - DNA, 14 bp, Homo sapiens
tttccattgtttga

SEQ ID NO: 2894818 - DNA, 23 bp, Homo sapiens
tttcccaacccccagcccccacc

SEQ ID NO: 2894819 - DNA, 12 bp, Homo sapiens
tttcccaactct

SEQ ID NO: 2894820 - DNA, 19 bp, Homo sapiens
tttcccacttcccaccctg

SEQ ID NO: 2894821 - DNA, 14 bp, Homo sapiens
tttcccaggaccct

SEQ ID NO: 2894822 - DNA, 16 bp, Homo sapiens
tttcccaggaccctga

SEQ ID NO: 2894823 - DNA, 12 bp, Homo sapiens
tttcccaggacg

SEQ ID NO: 2894824 - DNA, 14 bp, Homo sapiens
tttccccaacagtg

SEQ ID NO: 2894825 - DNA, 15 bp, Homo sapiens
tttccccagccacag

SEQ ID NO: 2894826 - DNA, 19 bp, Homo sapiens
tttccccagcctctcctcc

SEQ ID NO: 2894827 - DNA, 13 bp, Homo sapiens
tttcccccactcc

SEQ ID NO: 2894828 - DNA, 14 bp, Homo sapiens
tttcccccaggaaa

SEQ ID NO: 2894829 - DNA, 18 bp, Homo sapiens
tttcccccctccttctgc

SEQ ID NO: 2894830 - DNA, 20 bp, Homo sapiens
tttcccctgcccccagacct

SEQ ID NO: 2894831 - DNA, 19 bp, Homo sapiens
tttccctcttgtgctcagt

SEQ ID NO: 2894832 - DNA, 21 bp, Homo sapiens
tttccctggtgcctctcactt

SEQ ID NO: 2894833 - DNA, 15 bp, Homo sapiens
tttccgttttgcctg

SEQ ID NO: 2894834 - DNA, 15 bp, Homo sapiens
tttcctaaggctgca

SEQ ID NO: 2894835 - DNA, 23 bp, Homo sapiens
tttcctaataaagttctgtactc

SEQ ID NO: 2894836 - DNA, 13 bp, Homo sapiens
ttttgtttcatta

SEQ ID NO: 2894837 - DNA, 22 bp, Homo sapiens
ttttgtttgctatcttaatttt

SEQ ID NO: 2894838 - DNA, 17 bp, Homo sapiens
ttttgtttttcattcag

SEQ ID NO: 2894839 - DNA, 15 bp, Homo sapiens
ttttgtttttccagt

SEQ ID NO: 2894840 - DNA, 19 bp, Homo sapiens
tttttaaaaaaaatgtgaa

SEQ ID NO: 2894841 - DNA, 20 bp, Homo sapiens
tttttaaaaaaaatgtgaaa

SEQ ID NO: 2894842 - DNA, 18 bp, Homo sapiens
tttttaaaaaagacattt

SEQ ID NO: 2894843 - DNA, 18 bp, Homo sapiens
tttttaaaacacatgttt

SEQ ID NO: 2894844 - DNA, 23 bp, Homo sapiens
tttttaaaacacatgtttttata

SEQ ID NO: 2894845 - DNA, 23 bp, Homo sapiens
tttttaaaaccactatgcaaaga

SEQ ID NO: 2894846 - DNA, 12 bp, Homo sapiens
tttttaaaagat

SEQ ID NO: 2894847 - DNA, 23 bp, Homo sapiens
tttttaaaatgaatcttatgcaa

SEQ ID NO: 2894848 - DNA, 15 bp, Homo sapiens
tttttaaacagggtc

SEQ ID NO: 2894849 - DNA, 22 bp, Homo sapiens
tttttaaagaaaatgtgtctgc

SEQ ID NO: 2894850 - DNA, 17 bp, Homo sapiens
tttttaaagacagggtc

SEQ ID NO: 2894851 - DNA, 16 bp, Homo sapiens
tttttaaatattttct

SEQ ID NO: 2894852 - DNA, 14 bp, Homo sapiens
tttttaaattttct

SEQ ID NO: 2894853 - DNA, 19 bp, Homo sapiens
tttttaaattttgtaatga

SEQ ID NO: 2894854 - DNA, 11 bp, Homo sapiens
tttttaactca

SEQ ID NO: 2894855 - DNA, 12 bp, Homo sapiens
tttttaactcat

SEQ ID NO: 2894856 - DNA, 16 bp, Homo sapiens
tttttaactgattctt

SEQ ID NO: 2894857 - DNA, 12 bp, Homo sapiens
tttttaagagta

SEQ ID NO: 2894858 - DNA, 15 bp, Homo sapiens
tttttaagttcccag

SEQ ID NO: 2894859 - DNA, 13 bp, Homo sapiens
tttttaatatgtt

SEQ ID NO: 2894860 - DNA, 18 bp, Homo sapiens
tttttaatatgttgactt

SEQ ID NO: 2894861 - DNA, 22 bp, Homo sapiens
tttttaatcgtttttgttttaa

SEQ ID NO: 2894862 - DNA, 13 bp, Homo sapiens
tttttaattaaaa

SEQ ID NO: 2894863 - DNA, 16 bp, Homo sapiens
tttttaattaaaaact

SEQ ID NO: 2894864 - DNA, 20 bp, Homo sapiens
tttttaattaaaaactagta

SEQ ID NO: 2894865 - DNA, 15 bp, Homo sapiens
tttttaattatttaa

SEQ ID NO: 2894866 - DNA, 12 bp, Homo sapiens
tttttaattcat

SEQ ID NO: 2894867 - DNA, 12 bp, Homo sapiens
tttttacaaaat

SEQ ID NO: 2894868 - DNA, 14 bp, Homo sapiens
tttttacaagatgt

SEQ ID NO: 2894869 - DNA, 14 bp, Homo sapiens
tttttactcaacca

SEQ ID NO: 2894870 - DNA, 13 bp, Homo sapiens
tttttactgtgtt

SEQ ID NO: 2894871 - DNA, 17 bp, Homo sapiens
tttttagaggtgagttt

SEQ ID NO: 2894872 - DNA, 14 bp, Homo sapiens
tttttagccattgt

SEQ ID NO: 2894873 - DNA, 23 bp, Homo sapiens
tttttagtatttatttatgtact

SEQ ID NO: 2894874 - DNA, 18 bp, Homo sapiens
tttttagtttaaaatctt

SEQ ID NO: 2894875 - DNA, 12 bp, Homo sapiens
tttttataaaca

SEQ ID NO: 2894876 - DNA, 15 bp, Homo sapiens
tttttataatatcca

SEQ ID NO: 2894877 - DNA, 13 bp, Homo sapiens
tttttatacaaaa

SEQ ID NO: 2894878 - DNA, 14 bp, Homo sapiens
tggacgctgtgctg

SEQ ID NO: 2894879 - DNA, 12 bp, Homo sapiens
tggacgtgaaat

SEQ ID NO: 2894880 - DNA, 14 bp, Homo sapiens
tggactccagcctg

SEQ ID NO: 2894881 - DNA, 17 bp, Homo sapiens
tggactccggccctcct

SEQ ID NO: 2894882 - DNA, 19 bp, Homo sapiens
tggactcctgccaccagca

SEQ ID NO: 2894883 - DNA, 15 bp, Homo sapiens
tggactctcagtctc

SEQ ID NO: 2894884 - DNA, 15 bp, Homo sapiens
tggactctgcacatg

SEQ ID NO: 2894885 - DNA, 16 bp, Homo sapiens
tggactctgcacatga

SEQ ID NO: 2894886 - DNA, 19 bp, Homo sapiens
tggactctgcacatgtctt

SEQ ID NO: 2894887 - DNA, 21 bp, Homo sapiens
tggactctggtgcctccagag

SEQ ID NO: 2894888 - DNA, 22 bp, Homo sapiens
tggactgaatgggatcatgaaa

SEQ ID NO: 2894889 - DNA, 16 bp, Homo sapiens
tggactgagcgaggaa

SEQ ID NO: 2894890 - DNA, 22 bp, Homo sapiens
tggactgagcgaggaaaaacaa

SEQ ID NO: 2894891 - DNA, 19 bp, Homo sapiens
tggactgcagaagcaaggg

SEQ ID NO: 2894892 - DNA, 20 bp, Homo sapiens
tggactgcagtcggcatgcc

SEQ ID NO: 2894893 - DNA, 18 bp, Homo sapiens
tggactggaccagacaat

SEQ ID NO: 2894894 - DNA, 18 bp, Homo sapiens
tggactggttatcttgtt

SEQ ID NO: 2894895 - DNA, 18 bp, Homo sapiens
tggacttcaaagcaagct

SEQ ID NO: 2894896 - DNA, 12 bp, Homo sapiens
tggacttctgaa

SEQ ID NO: 2894897 - DNA, 21 bp, Homo sapiens
tggacttctgaaaaatgaatg

SEQ ID NO: 2894898 - DNA, 23 bp, Homo sapiens
tggacttggtacagttgcaggag

SEQ ID NO: 2894899 - DNA, 14 bp, Homo sapiens
tggagaagcacact

SEQ ID NO: 2894900 - DNA, 14 bp, Homo sapiens
tggagaagccattg

SEQ ID NO: 2894901 - DNA, 18 bp, Homo sapiens
tggagaagccattgtctt

SEQ ID NO: 2894902 - DNA, 18 bp, Homo sapiens
tggagaatactgccaaaa

SEQ ID NO: 2894903 - DNA, 15 bp, Homo sapiens
tggagaatgtggaga

SEQ ID NO: 2894904 - DNA, 24 bp, Homo sapiens
tggagacaatgtctgcagccctga

SEQ ID NO: 2894905 - DNA, 19 bp, Homo sapiens
tggagaccagggagccttt

SEQ ID NO: 2894906 - DNA, 15 bp, Homo sapiens
tggagagaaggcctc

SEQ ID NO: 2894907 - DNA, 14 bp, Homo sapiens
tggagagaggattt

SEQ ID NO: 2894908 - DNA, 17 bp, Homo sapiens
tggagagcgaggaggcg

SEQ ID NO: 2894909 - DNA, 13 bp, Homo sapiens
tggagagtgagag

SEQ ID NO: 2894910 - DNA, 16 bp, Homo sapiens
tggagagtttcctgaa

SEQ ID NO: 2894911 - DNA, 20 bp, Homo sapiens
tggagataaagatttcttga

SEQ ID NO: 2894912 - DNA, 23 bp, Homo sapiens
tggagatatttatggggggagaa

SEQ ID NO: 2894913 - DNA, 18 bp, Homo sapiens
tggagatgctgagggtgt

SEQ ID NO: 2894914 - DNA, 16 bp, Homo sapiens
tggagattctgattca

SEQ ID NO: 2894915 - DNA, 18 bp, Homo sapiens
tggagcaatcacagatga

SEQ ID NO: 2894916 - DNA, 22 bp, Homo sapiens
tggagcatttatgtagacattg

SEQ ID NO: 2894917 - DNA, 13 bp, Homo sapiens
tggagccaggcgt

SEQ ID NO: 2894918 - DNA, 15 bp, Homo sapiens
tggagccaggcgtgt

SEQ ID NO: 2894919 - DNA, 16 bp, Homo sapiens
tggagcccctcctccc

SEQ ID NO: 2894920 - DNA, 19 bp, Homo sapiens
tggagcccgcactgtccca

SEQ ID NO: 2894921 - DNA, 15 bp, Homo sapiens
tggagccctgttcct

SEQ ID NO: 2894922 - DNA, 20 bp, Homo sapiens
tggagccttttaactgtgca

SEQ ID NO: 2894923 - DNA, 12 bp, Homo sapiens
tggagcggctca

SEQ ID NO: 2894924 - DNA, 13 bp, Homo sapiens
tggagcggctgct

SEQ ID NO: 2894925 - DNA, 17 bp, Homo sapiens
tggagcgtttgctgtgc

SEQ ID NO: 2894926 - DNA, 15 bp, Homo sapiens
tggagctcttgggtc

SEQ ID NO: 2894927 - DNA, 21 bp, Homo sapiens
tggagctcttgggtcagagaa

SEQ ID NO: 2894928 - DNA, 20 bp, Homo sapiens
tggagctgagaagaggagga

SEQ ID NO: 2894929 - DNA, 12 bp, Homo sapiens
tggagctgagca

SEQ ID NO: 2894930 - DNA, 14 bp, Homo sapiens
tggagctgggaggt

SEQ ID NO: 2894931 - DNA, 21 bp, Homo sapiens
tggagcttcatggcagaaggc

SEQ ID NO: 2894932 - DNA, 15 bp, Homo sapiens
tggaggagagaagaa

SEQ ID NO: 2894933 - DNA, 21 bp, Homo sapiens
tggaggatcccctccaagcct

SEQ ID NO: 2894934 - DNA, 21 bp, Homo sapiens
tggaggcaggggacaagggag

SEQ ID NO: 2894935 - DNA, 16 bp, Homo sapiens
tggaggcagtgtcatt

SEQ ID NO: 2894936 - DNA, 14 bp, Homo sapiens
tggaggccagccag

SEQ ID NO: 2894937 - DNA, 16 bp, Homo sapiens
tggaggcctcagggag

SEQ ID NO: 2894938 - DNA, 14 bp, Homo sapiens
tggagggaggcccc

SEQ ID NO: 2894939 - DNA, 16 bp, Homo sapiens
tggagggaggccccag

SEQ ID NO: 2894940 - DNA, 18 bp, Homo sapiens
tggagggatcattttctg

SEQ ID NO: 2894941 - DNA, 18 bp, Homo sapiens
tggagggcacttggccag

SEQ ID NO: 2894942 - DNA, 12 bp, Homo sapiens
tggagggcagag

SEQ ID NO: 2894943 - DNA, 13 bp, Homo sapiens
tggagggcagaga

SEQ ID NO: 2894944 - DNA, 21 bp, Homo sapiens
tggagggcgcccagcagcctg

SEQ ID NO: 2894945 - DNA, 17 bp, Homo sapiens
tggaggttaaggctgag

SEQ ID NO: 2894946 - DNA, 24 bp, Homo sapiens
tggaggttaaggctgaggaaaggc

SEQ ID NO: 2894947 - DNA, 13 bp, Homo sapiens
tggaggttctaag

SEQ ID NO: 2894948 - DNA, 17 bp, Homo sapiens
tggaggttgataacttt

SEQ ID NO: 2894949 - DNA, 20 bp, Homo sapiens
tggaggttgcagtgagctga

SEQ ID NO: 2894950 - DNA, 22 bp, Homo sapiens
tggagtaaaaaaggagacagtt

SEQ ID NO: 2894951 - DNA, 15 bp, Homo sapiens
tggagtacttagcta

SEQ ID NO: 2894952 - DNA, 15 bp, Homo sapiens
tggagtccagctcta

SEQ ID NO: 2894953 - DNA, 16 bp, Homo sapiens
tggagtcccagagctg

SEQ ID NO: 2894954 - DNA, 18 bp, Homo sapiens
tggagtcccaggggcagc

SEQ ID NO: 2894955 - DNA, 23 bp, Homo sapiens
tggagtcccaggggcagccacac

SEQ ID NO: 2894956 - DNA, 16 bp, Homo sapiens
tggagtcccttttcat

SEQ ID NO: 2894957 - DNA, 17 bp, Homo sapiens
tggagtgcaatgacaca

SEQ ID NO: 2894958 - DNA, 17 bp, Homo sapiens
tggagtgctgtgctgtg

SEQ ID NO: 2894959 - DNA, 16 bp, Homo sapiens
tggagtggctcgccag

SEQ ID NO: 2894960 - DNA, 15 bp, Homo sapiens
tggagtgtgagccac

SEQ ID NO: 2894961 - DNA, 18 bp, Homo sapiens
tggagtgttatgtatttc

SEQ ID NO: 2894962 - DNA, 19 bp, Homo sapiens
tggagtgttccccttccac

SEQ ID NO: 2894963 - DNA, 15 bp, Homo sapiens
tggagttcctgctcc

SEQ ID NO: 2894964 - DNA, 16 bp, Homo sapiens
tggagttcttgtgcca

SEQ ID NO: 2894965 - DNA, 14 bp, Homo sapiens
tggagtttctaagg

SEQ ID NO: 2894966 - DNA, 14 bp, Homo sapiens
tggagtttctctct

SEQ ID NO: 2894967 - DNA, 17 bp, Homo sapiens
tggagttttaactgtaa

SEQ ID NO: 2894968 - DNA, 14 bp, Homo sapiens
tggataaaaaagaa

SEQ ID NO: 2894969 - DNA, 20 bp, Homo sapiens
tggataaaaaagaaaacatt

SEQ ID NO: 2894970 - DNA, 18 bp, Homo sapiens
tggataacaaagatatct

SEQ ID NO: 2894971 - DNA, 23 bp, Homo sapiens
tggatagaacatgggatacttta

SEQ ID NO: 2894972 - DNA, 16 bp, Homo sapiens
tggatagccttgaaaa

SEQ ID NO: 2894973 - DNA, 21 bp, Homo sapiens
tggatagccttgaaaacaaac

SEQ ID NO: 2894974 - DNA, 19 bp, Homo sapiens
tggatcagtcctttgatca

SEQ ID NO: 2894975 - DNA, 18 bp, Homo sapiens
tggatcccaaagcaagga

SEQ ID NO: 2894976 - DNA, 17 bp, Homo sapiens
tggatcccatcaaagaa

SEQ ID NO: 2894977 - DNA, 16 bp, Homo sapiens
tggatcccgttcagaa

SEQ ID NO: 2894978 - DNA, 19 bp, Homo sapiens
tggatcctcagttctcaaa

SEQ ID NO: 2894979 - DNA, 18 bp, Homo sapiens
tggatcctgggctgggtg

SEQ ID NO: 2894980 - DNA, 16 bp, Homo sapiens
tggatccttcccaagg

SEQ ID NO: 2894981 - DNA, 14 bp, Homo sapiens
tggatctagaaggg

SEQ ID NO: 2894982 - DNA, 19 bp, Homo sapiens
tggatctgggaccctttcc

SEQ ID NO: 2894983 - DNA, 21 bp, Homo sapiens
tggatctgggaccctttcctt

SEQ ID NO: 2894984 - DNA, 23 bp, Homo sapiens
tggatctttctccctttctcctc

SEQ ID NO: 2894985 - DNA, 20 bp, Homo sapiens
tggatgaaaaatatttctga

SEQ ID NO: 2894986 - DNA, 21 bp, Homo sapiens
tggatgaaaaatatttctgag

SEQ ID NO: 2894987 - DNA, 21 bp, Homo sapiens
tggatgatggtcttcagcctc

SEQ ID NO: 2894988 - DNA, 14 bp, Homo sapiens
tggatgatgtttcg

SEQ ID NO: 2894989 - DNA, 14 bp, Homo sapiens
tggatgccttcccc

SEQ ID NO: 2894990 - DNA, 23 bp, Homo sapiens
tggatgctctttcaatgcagcac

SEQ ID NO: 2894991 - DNA, 14 bp, Homo sapiens
tggatgctgtgcta

SEQ ID NO: 2894992 - DNA, 23 bp, Homo sapiens
tggatgctgtgctacgtgtgaaa

SEQ ID NO: 2894993 - DNA, 16 bp, Homo sapiens
tggatggaacatgccc

SEQ ID NO: 2894994 - DNA, 13 bp, Homo sapiens
tggatggcttcta

SEQ ID NO: 2894995 - DNA, 18 bp, Homo sapiens
tggatggtcattgcagtt

SEQ ID NO: 2894996 - DNA, 23 bp, Homo sapiens
tggatgtcctcaaagaagtggtt

SEQ ID NO: 2894997 - DNA, 17 bp, Homo sapiens
tggatgtctgccaattt

SEQ ID NO: 2894998 - DNA, 12 bp, Homo sapiens
tggatgtgagca

SEQ ID NO: 2894999 - DNA, 14 bp, Homo sapiens
tggatgtgagcaga

SEQ ID NO: 2895000 - DNA, 18 bp, Homo sapiens
tggatgttttaattccat

SEQ ID NO: 2895001 - DNA, 20 bp, Homo sapiens
tggatgttttaattccatga

SEQ ID NO: 2895002 - DNA, 21 bp, Homo sapiens
tggattaaaaatagagcaaga

SEQ ID NO: 2895003 - DNA, 19 bp, Homo sapiens
tggattagcctttgacatt

SEQ ID NO: 2895004 - DNA, 20 bp, Homo sapiens
tggattccaaccttcctttt

SEQ ID NO: 2895005 - DNA, 18 bp, Homo sapiens
tggattccccatctcagg

SEQ ID NO: 2895006 - DNA, 15 bp, Homo sapiens
tgctgtagagacttc

SEQ ID NO: 2895007 - DNA, 16 bp, Homo sapiens
tgctgtcacatagttt

SEQ ID NO: 2895008 - DNA, 18 bp, Homo sapiens
tgctgtccctgcactgtg

SEQ ID NO: 2895009 - DNA, 18 bp, Homo sapiens
tgctgtcctcaggtggcc

SEQ ID NO: 2895010 - DNA, 14 bp, Homo sapiens
tgctgtcctggtgg

SEQ ID NO: 2895011 - DNA, 12 bp, Homo sapiens
tgctgtctcctt

SEQ ID NO: 2895012 - DNA, 13 bp, Homo sapiens
tgctgtctctctg

SEQ ID NO: 2895013 - DNA, 14 bp, Homo sapiens
tgctgtctctctgg

SEQ ID NO: 2895014 - DNA, 16 bp, Homo sapiens
tgctgtctctctgggc

SEQ ID NO: 2895015 - DNA, 18 bp, Homo sapiens
tgctgtctctctgggctg

SEQ ID NO: 2895016 - DNA, 13 bp, Homo sapiens
tgctgtctcttaa

SEQ ID NO: 2895017 - DNA, 18 bp, Homo sapiens
tgctgtctcttaaatctc

SEQ ID NO: 2895018 - DNA, 15 bp, Homo sapiens
tgctgtctgcagcct

SEQ ID NO: 2895019 - DNA, 13 bp, Homo sapiens
tgctgtctttgtg

SEQ ID NO: 2895020 - DNA, 23 bp, Homo sapiens
tgctgtctttgtggactgtgggt

SEQ ID NO: 2895021 - DNA, 23 bp, Homo sapiens
tgctgtgagtctttggttctaag

SEQ ID NO: 2895022 - DNA, 18 bp, Homo sapiens
tgctgtgcgtggaaaaag

SEQ ID NO: 2895023 - DNA, 22 bp, Homo sapiens
tgctgtgctacgtgtgaaatct

SEQ ID NO: 2895024 - DNA, 16 bp, Homo sapiens
tgctgtggtgtgtccc

SEQ ID NO: 2895025 - DNA, 23 bp, Homo sapiens
tgctgtggtgtgtccccctctgt

SEQ ID NO: 2895026 - DNA, 13 bp, Homo sapiens
tgctgtgtatatg

SEQ ID NO: 2895027 - DNA, 23 bp, Homo sapiens
tgctgtgtatatggtatatatac

SEQ ID NO: 2895028 - DNA, 16 bp, Homo sapiens
tgctgtgtgagaccag

SEQ ID NO: 2895029 - DNA, 17 bp, Homo sapiens
tgctgttacgacaaaga

SEQ ID NO: 2895030 - DNA, 15 bp, Homo sapiens
tgctgttccttactt

SEQ ID NO: 2895031 - DNA, 13 bp, Homo sapiens
tgctgttcgttca

SEQ ID NO: 2895032 - DNA, 22 bp, Homo sapiens
tgctgttcgttcaaaagtggag

SEQ ID NO: 2895033 - DNA, 13 bp, Homo sapiens
tgctgttgaaagc

SEQ ID NO: 2895034 - DNA, 16 bp, Homo sapiens
tgctgttgaaagcaaa

SEQ ID NO: 2895035 - DNA, 15 bp, Homo sapiens
tgctgttgattgcta

SEQ ID NO: 2895036 - DNA, 18 bp, Homo sapiens
tgctgttgattgctaaat

SEQ ID NO: 2895037 - DNA, 20 bp, Homo sapiens
tgctgttgattgctaaatgt

SEQ ID NO: 2895038 - DNA, 14 bp, Homo sapiens
tgctgttgcctcat

SEQ ID NO: 2895039 - DNA, 17 bp, Homo sapiens
tgctgttggtcctctct

SEQ ID NO: 2895040 - DNA, 20 bp, Homo sapiens
tgctgttggtcctctctctg

SEQ ID NO: 2895041 - DNA, 20 bp, Homo sapiens
tgctgtttagatttattaga

SEQ ID NO: 2895042 - DNA, 17 bp, Homo sapiens
tgctgtttagcttcctc

SEQ ID NO: 2895043 - DNA, 18 bp, Homo sapiens
tgctgtttagcttcctcc

SEQ ID NO: 2895044 - DNA, 19 bp, Homo sapiens
tgctgtttagcttcctcca

SEQ ID NO: 2895045 - DNA, 11 bp, Homo sapiens
tgctgtttcct

SEQ ID NO: 2895046 - DNA, 22 bp, Homo sapiens
tgctgttttaaattgcatttct

SEQ ID NO: 2895047 - DNA, 16 bp, Homo sapiens
tgcttaaggcatactt

SEQ ID NO: 2895048 - DNA, 21 bp, Homo sapiens
tgcttaaggcatacttttaat

SEQ ID NO: 2895049 - DNA, 20 bp, Homo sapiens
tgcttaataataattgaaga

SEQ ID NO: 2895050 - DNA, 21 bp, Homo sapiens
tgcttaataataattgaagaa

SEQ ID NO: 2895051 - DNA, 20 bp, Homo sapiens
tgcttaattcaaataataat

SEQ ID NO: 2895052 - DNA, 18 bp, Homo sapiens
tgcttaattgtgaacagc

SEQ ID NO: 2895053 - DNA, 16 bp, Homo sapiens
tgcttacaatctttat

SEQ ID NO: 2895054 - DNA, 23 bp, Homo sapiens
tgcttacaatttttttaattttg

SEQ ID NO: 2895055 - DNA, 19 bp, Homo sapiens
tgcttaccttgactgttga

SEQ ID NO: 2895056 - DNA, 13 bp, Homo sapiens
tgcttaccttgtt

SEQ ID NO: 2895057 - DNA, 16 bp, Homo sapiens
tgcttaccttgttttg

SEQ ID NO: 2895058 - DNA, 14 bp, Homo sapiens
tgcttagaaaagaa

SEQ ID NO: 2895059 - DNA, 18 bp, Homo sapiens
tgcttagaacccttctgc

SEQ ID NO: 2895060 - DNA, 19 bp, Homo sapiens
tgcttagaacccttctgct

SEQ ID NO: 2895061 - DNA, 22 bp, Homo sapiens
tgcttagaacccttctgctttc

SEQ ID NO: 2895062 - DNA, 23 bp, Homo sapiens
tgcttagaacccttctgctttct

SEQ ID NO: 2895063 - DNA, 24 bp, Homo sapiens
tgcttagaacccttctgctttcta

SEQ ID NO: 2895064 - DNA, 15 bp, Homo sapiens
tgcttaggagacaga

SEQ ID NO: 2895065 - DNA, 21 bp, Homo sapiens
tgcttataagagagagttaaa

SEQ ID NO: 2895066 - DNA, 20 bp, Homo sapiens
tgcttatgatgggctcccca

SEQ ID NO: 2895067 - DNA, 21 bp, Homo sapiens
tgcttatgatgggctccccag

SEQ ID NO: 2895068 - DNA, 22 bp, Homo sapiens
tgcttatgtgttgcataaacaa

SEQ ID NO: 2895069 - DNA, 13 bp, Homo sapiens
tgcttcaatagtt

SEQ ID NO: 2895070 - DNA, 14 bp, Homo sapiens
tgcttcaattaaaa

SEQ ID NO: 2895071 - DNA, 17 bp, Homo sapiens
tgcttcaccagactttt

SEQ ID NO: 2895072 - DNA, 19 bp, Homo sapiens
tgcttcaccagacttttct

SEQ ID NO: 2895073 - DNA, 21 bp, Homo sapiens
tgcttcagatgtggagccagg

SEQ ID NO: 2895074 - DNA, 14 bp, Homo sapiens
tgcttcatacaggg

SEQ ID NO: 2895075 - DNA, 11 bp, Homo sapiens
tgcttcatatc

SEQ ID NO: 2895076 - DNA, 12 bp, Homo sapiens
tgcttcatatct

SEQ ID NO: 2895077 - DNA, 18 bp, Homo sapiens
tgcttcatcttcccaggt

SEQ ID NO: 2895078 - DNA, 20 bp, Homo sapiens
tgcttccatggcttcctgag

SEQ ID NO: 2895079 - DNA, 13 bp, Homo sapiens
tgcttcctaactt

SEQ ID NO: 2895080 - DNA, 13 bp, Homo sapiens
tgcttcctctgaa

SEQ ID NO: 2895081 - DNA, 18 bp, Homo sapiens
tgcttcctctgaatatta

SEQ ID NO: 2895082 - DNA, 16 bp, Homo sapiens
tgcttcgttttctaaa

SEQ ID NO: 2895083 - DNA, 23 bp, Homo sapiens
tgcttctaaatgcccagttcact

SEQ ID NO: 2895084 - DNA, 19 bp, Homo sapiens
tgcttctagttctgccagg

SEQ ID NO: 2895085 - DNA, 20 bp, Homo sapiens
tgcttctgagtggtgttttt

SEQ ID NO: 2895086 - DNA, 21 bp, Homo sapiens
tgcttctgctgtacaagatgt

SEQ ID NO: 2895087 - DNA, 16 bp, Homo sapiens
tgcttctggctttgtt

SEQ ID NO: 2895088 - DNA, 11 bp, Homo sapiens
tgcttcttgta

SEQ ID NO: 2895089 - DNA, 20 bp, Homo sapiens
tgcttcttgtaatatttctt

SEQ ID NO: 2895090 - DNA, 12 bp, Homo sapiens
tgcttcttgtga

SEQ ID NO: 2895091 - DNA, 15 bp, Homo sapiens
tgcttcttgtgaagg

SEQ ID NO: 2895092 - DNA, 16 bp, Homo sapiens
tgcttgacaacatctg

SEQ ID NO: 2895093 - DNA, 17 bp, Homo sapiens
tgcttgagcatcaggat

SEQ ID NO: 2895094 - DNA, 14 bp, Homo sapiens
tgcttgagctcagg

SEQ ID NO: 2895095 - DNA, 20 bp, Homo sapiens
tgcttgatgggattctggac

SEQ ID NO: 2895096 - DNA, 16 bp, Homo sapiens
tgcttgcagtagattt

SEQ ID NO: 2895097 - DNA, 18 bp, Homo sapiens
tgcttgcctgcagggcca

SEQ ID NO: 2895098 - DNA, 20 bp, Homo sapiens
tgcttgcctgcagggccatg

SEQ ID NO: 2895099 - DNA, 19 bp, Homo sapiens
tgcttgctaatatttccag

SEQ ID NO: 2895100 - DNA, 17 bp, Homo sapiens
tgcttggagcaatcaga

SEQ ID NO: 2895101 - DNA, 16 bp, Homo sapiens
tgcttggccaggattt

SEQ ID NO: 2895102 - DNA, 17 bp, Homo sapiens
tgcttgggggtttttga

SEQ ID NO: 2895103 - DNA, 18 bp, Homo sapiens
tgcttgggggtttttgaa

SEQ ID NO: 2895104 - DNA, 16 bp, Homo sapiens
tgcttggtgctggttt

SEQ ID NO: 2895105 - DNA, 15 bp, Homo sapiens
tgcttgtataggttt

SEQ ID NO: 2895106 - DNA, 20 bp, Homo sapiens
tgcttgtgaaaatgtgttct

SEQ ID NO: 2895107 - DNA, 20 bp, Homo sapiens
tgcttgtgcctcccttccca

SEQ ID NO: 2895108 - DNA, 22 bp, Homo sapiens
tgcttgtgcctcccttcccagt

SEQ ID NO: 2895109 - DNA, 23 bp, Homo sapiens
tgcttgtgcctcccttcccagtg

SEQ ID NO: 2895110 - DNA, 24 bp, Homo sapiens
tgcttgtgctcatgtgtgtggtca

SEQ ID NO: 2895111 - DNA, 12 bp, Homo sapiens
tgcttgttacat

SEQ ID NO: 2895112 - DNA, 12 bp, Homo sapiens
tgcttgttgtca

SEQ ID NO: 2895113 - DNA, 18 bp, Homo sapiens
tgctttaaattaaaattt

SEQ ID NO: 2895114 - DNA, 19 bp, Homo sapiens
tgctttacaggatcatgta

SEQ ID NO: 2895115 - DNA, 22 bp, Homo sapiens
tgctttataccccatttgattt

SEQ ID NO: 2895116 - DNA, 23 bp, Homo sapiens
tgctttcctcttactttcagttt

SEQ ID NO: 2895117 - DNA, 21 bp, Homo sapiens
tgctttctattacccctcatt

SEQ ID NO: 2895118 - DNA, 11 bp, Homo sapiens
tgctttctctt

SEQ ID NO: 2895119 - DNA, 12 bp, Homo sapiens
tgctttctgaaa

SEQ ID NO: 2895120 - DNA, 14 bp, Homo sapiens
tgctttctgatcaa

SEQ ID NO: 2895121 - DNA, 12 bp, Homo sapiens
tgctttctgctc

SEQ ID NO: 2895122 - DNA, 16 bp, Homo sapiens
tgctttctgttcatct

SEQ ID NO: 2895123 - DNA, 14 bp, Homo sapiens
tggattggggtccc

SEQ ID NO: 2895124 - DNA, 19 bp, Homo sapiens
tggatttacgactgaagaa

SEQ ID NO: 2895125 - DNA, 20 bp, Homo sapiens
tggatttctttatataaggt

SEQ ID NO: 2895126 - DNA, 17 bp, Homo sapiens
tggatttgtccaaacag

SEQ ID NO: 2895127 - DNA, 19 bp, Homo sapiens
tggattttagtcaaatatt

SEQ ID NO: 2895128 - DNA, 13 bp, Homo sapiens
tggcaaacaaaac

SEQ ID NO: 2895129 - DNA, 16 bp, Homo sapiens
tggcaaacaaaaccaa

SEQ ID NO: 2895130 - DNA, 17 bp, Homo sapiens
tggcaaacatgtgcaac

SEQ ID NO: 2895131 - DNA, 19 bp, Homo sapiens
tggcaaactctccaccaca

SEQ ID NO: 2895132 - DNA, 22 bp, Homo sapiens
tggcaaatgccaactgttggaa

SEQ ID NO: 2895133 - DNA, 13 bp, Homo sapiens
tggcaacacagag

SEQ ID NO: 2895134 - DNA, 13 bp, Homo sapiens
tggcaacagatct

SEQ ID NO: 2895135 - DNA, 16 bp, Homo sapiens
tggcaacagatctgga

SEQ ID NO: 2895136 - DNA, 17 bp, Homo sapiens
tggcaacagatctggaa

SEQ ID NO: 2895137 - DNA, 16 bp, Homo sapiens
tggcaatataatcttt

SEQ ID NO: 2895138 - DNA, 18 bp, Homo sapiens
tggcacatcctatgcaat

SEQ ID NO: 2895139 - DNA, 19 bp, Homo sapiens
tggcacatctgtcctgaca

SEQ ID NO: 2895140 - DNA, 18 bp, Homo sapiens
tggcaccagcgaagggag

SEQ ID NO: 2895141 - DNA, 16 bp, Homo sapiens
tggcaccgcctcccca

SEQ ID NO: 2895142 - DNA, 12 bp, Homo sapiens
tggcacctccta

SEQ ID NO: 2895143 - DNA, 22 bp, Homo sapiens
tggcacctgcctagctcttggg

SEQ ID NO: 2895144 - DNA, 15 bp, Homo sapiens
tggcacgcacctgta

SEQ ID NO: 2895145 - DNA, 19 bp, Homo sapiens
tggcacgcacctgtagtcc

SEQ ID NO: 2895146 - DNA, 16 bp, Homo sapiens
tggcactatttttatt

SEQ ID NO: 2895147 - DNA, 16 bp, Homo sapiens
tggcactccctccagc

SEQ ID NO: 2895148 - DNA, 17 bp, Homo sapiens
tggcactccctccagca

SEQ ID NO: 2895149 - DNA, 15 bp, Homo sapiens
tggcacttgcctggg

SEQ ID NO: 2895150 - DNA, 16 bp, Homo sapiens
tggcacttgcctgggt

SEQ ID NO: 2895151 - DNA, 16 bp, Homo sapiens
tggcagaactgctggg

SEQ ID NO: 2895152 - DNA, 17 bp, Homo sapiens
tggcagaactgctgggg

SEQ ID NO: 2895153 - DNA, 22 bp, Homo sapiens
tggcagaactgctggggctggt

SEQ ID NO: 2895154 - DNA, 15 bp, Homo sapiens
tggcagaagggaatt

SEQ ID NO: 2895155 - DNA, 19 bp, Homo sapiens
tggcagaagggaattgctc

SEQ ID NO: 2895156 - DNA, 17 bp, Homo sapiens
tggcagactgtgtaaaa

SEQ ID NO: 2895157 - DNA, 18 bp, Homo sapiens
tggcagagtttgtgtgtt

SEQ ID NO: 2895158 - DNA, 20 bp, Homo sapiens
tggcagattcccactgccgc

SEQ ID NO: 2895159 - DNA, 22 bp, Homo sapiens
tggcagccacacgcaggcggcc

SEQ ID NO: 2895160 - DNA, 17 bp, Homo sapiens
tggcagcctgcacctgg

SEQ ID NO: 2895161 - DNA, 18 bp, Homo sapiens
tggcagcctgcacctggt

SEQ ID NO: 2895162 - DNA, 11 bp, Homo sapiens
tggcagctgcc

SEQ ID NO: 2895163 - DNA, 16 bp, Homo sapiens
tggcagctgcccctcc

SEQ ID NO: 2895164 - DNA, 17 bp, Homo sapiens
tggcagctgcccctcct

SEQ ID NO: 2895165 - DNA, 18 bp, Homo sapiens
tggcagctgcccctcctg

SEQ ID NO: 2895166 - DNA, 20 bp, Homo sapiens
tggcagctgcccctcctgga

SEQ ID NO: 2895167 - DNA, 15 bp, Homo sapiens
tggcagctgcccctg

SEQ ID NO: 2895168 - DNA, 16 bp, Homo sapiens
tggcagctgcccctgg

SEQ ID NO: 2895169 - DNA, 18 bp, Homo sapiens
tggcagctgcccctggca

SEQ ID NO: 2895170 - DNA, 11 bp, Homo sapiens
tggcagctggg

SEQ ID NO: 2895171 - DNA, 12 bp, Homo sapiens
tggcagctgggc

SEQ ID NO: 2895172 - DNA, 19 bp, Homo sapiens
tggcagctgggcccacagc

SEQ ID NO: 2895173 - DNA, 23 bp, Homo sapiens
tggcagctgggcccacagccccc

SEQ ID NO: 2895174 - DNA, 15 bp, Homo sapiens
tggcaggatccaagg

SEQ ID NO: 2895175 - DNA, 17 bp, Homo sapiens
tggcagggtgggatgga

SEQ ID NO: 2895176 - DNA, 17 bp, Homo sapiens
tggcaggtcactgtcac

SEQ ID NO: 2895177 - DNA, 19 bp, Homo sapiens
tggcaggtcactgtcactg

SEQ ID NO: 2895178 - DNA, 13 bp, Homo sapiens
tggcagtgtttgt

SEQ ID NO: 2895179 - DNA, 17 bp, Homo sapiens
tggcagtgttttgagaa

SEQ ID NO: 2895180 - DNA, 18 bp, Homo sapiens
tggcagtgttttggttca

SEQ ID NO: 2895181 - DNA, 20 bp, Homo sapiens
tggcataatagtcaatttct

SEQ ID NO: 2895182 - DNA, 22 bp, Homo sapiens
tggcatccagagtccctgcctg

SEQ ID NO: 2895183 - DNA, 18 bp, Homo sapiens
tggcatccagggctgcca

SEQ ID NO: 2895184 - DNA, 16 bp, Homo sapiens
tggcatcctgtgaagt

SEQ ID NO: 2895185 - DNA, 22 bp, Homo sapiens
tggcatcgaccacaccagcctc

SEQ ID NO: 2895186 - DNA, 23 bp, Homo sapiens
tggcatcgaccacaccagcctcc

SEQ ID NO: 2895187 - DNA, 15 bp, Homo sapiens
tggcatctcccacac

SEQ ID NO: 2895188 - DNA, 20 bp, Homo sapiens
tggcatctgaatgaaaataa

SEQ ID NO: 2895189 - DNA, 14 bp, Homo sapiens
tggcatctgcaaag

SEQ ID NO: 2895190 - DNA, 15 bp, Homo sapiens
tggcatctgcaaagg

SEQ ID NO: 2895191 - DNA, 13 bp, Homo sapiens
tggcatctgtgcg

SEQ ID NO: 2895192 - DNA, 13 bp, Homo sapiens
tggcatctgtgtg

SEQ ID NO: 2895193 - DNA, 13 bp, Homo sapiens
tggcatgagaaat

SEQ ID NO: 2895194 - DNA, 16 bp, Homo sapiens
tggcatgatccaagca

SEQ ID NO: 2895195 - DNA, 15 bp, Homo sapiens
tggcatgcacctgca

SEQ ID NO: 2895196 - DNA, 13 bp, Homo sapiens
tggcatgtcttca

SEQ ID NO: 2895197 - DNA, 12 bp, Homo sapiens
tggcatgtcttt

SEQ ID NO: 2895198 - DNA, 20 bp, Homo sapiens
tggcatgttagcccttcctc

SEQ ID NO: 2895199 - DNA, 23 bp, Homo sapiens
tggcattcaaccacgcaggaagc

SEQ ID NO: 2895200 - DNA, 17 bp, Homo sapiens
tggcattctacacctgg

SEQ ID NO: 2895201 - DNA, 18 bp, Homo sapiens
tggcattctttgcaatac

SEQ ID NO: 2895202 - DNA, 16 bp, Homo sapiens
tggcattgatcttaaa

SEQ ID NO: 2895203 - DNA, 19 bp, Homo sapiens
tggcatttcaattcctggc

SEQ ID NO: 2895204 - DNA, 20 bp, Homo sapiens
tggcatttttagctccttga

SEQ ID NO: 2895205 - DNA, 15 bp, Homo sapiens
tggccaacatggtga

SEQ ID NO: 2895206 - DNA, 19 bp, Homo sapiens
tggccaaggagctgctata

SEQ ID NO: 2895207 - DNA, 12 bp, Homo sapiens
tggccacactgt

SEQ ID NO: 2895208 - DNA, 18 bp, Homo sapiens
tggccacactgtgacaca

SEQ ID NO: 2895209 - DNA, 16 bp, Homo sapiens
tggccacatggcggag

SEQ ID NO: 2895210 - DNA, 20 bp, Homo sapiens
tggccaccacccaacctgtc

SEQ ID NO: 2895211 - DNA, 22 bp, Homo sapiens
tggccaccacccaacctgtcct

SEQ ID NO: 2895212 - DNA, 17 bp, Homo sapiens
tggccaccgggggtggc

SEQ ID NO: 2895213 - DNA, 23 bp, Homo sapiens
tggccaccgggggtggctctgtc

SEQ ID NO: 2895214 - DNA, 16 bp, Homo sapiens
tggccacggcccaggg

SEQ ID NO: 2895215 - DNA, 15 bp, Homo sapiens
tggccactgaaaagc

SEQ ID NO: 2895216 - DNA, 12 bp, Homo sapiens
tggccagacaca

SEQ ID NO: 2895217 - DNA, 18 bp, Homo sapiens
tggccagaggtgtcaccc

SEQ ID NO: 2895218 - DNA, 12 bp, Homo sapiens
tggccagccgct

SEQ ID NO: 2895219 - DNA, 17 bp, Homo sapiens
tggccagccgctctcct

SEQ ID NO: 2895220 - DNA, 20 bp, Homo sapiens
tggccagccgctctcctgcc

SEQ ID NO: 2895221 - DNA, 21 bp, Homo sapiens
tggccagccgctctcctgcca

SEQ ID NO: 2895222 - DNA, 13 bp, Homo sapiens
tggccagcctaca

SEQ ID NO: 2895223 - DNA, 15 bp, Homo sapiens
tggccagcgccaggg

SEQ ID NO: 2895224 - DNA, 22 bp, Homo sapiens
tggccagcgccagggcccaggc

SEQ ID NO: 2895225 - DNA, 21 bp, Homo sapiens
tggccaggaagctttggtgag

SEQ ID NO: 2895226 - DNA, 20 bp, Homo sapiens
tggccaggctgatctcgaac

SEQ ID NO: 2895227 - DNA, 20 bp, Homo sapiens
tggccaggctggtcttgaac

SEQ ID NO: 2895228 - DNA, 23 bp, Homo sapiens
tggccaggctggtcttgaactcc

SEQ ID NO: 2895229 - DNA, 22 bp, Homo sapiens
tggccagggccacgctccagct

SEQ ID NO: 2895230 - DNA, 15 bp, Homo sapiens
tggccagtcctggtc

SEQ ID NO: 2895231 - DNA, 15 bp, Homo sapiens
tggccagtcttcctc

SEQ ID NO: 2895232 - DNA, 17 bp, Homo sapiens
tggccagtcttcctctt

SEQ ID NO: 2895233 - DNA, 22 bp, Homo sapiens
tggccagtgctgcccatgagca

SEQ ID NO: 2895234 - DNA, 13 bp, Homo sapiens
tggccatcccaca

SEQ ID NO: 2895235 - DNA, 14 bp, Homo sapiens
tggccatgcctcag

SEQ ID NO: 2895236 - DNA, 15 bp, Homo sapiens
tggccatgcctcagc

SEQ ID NO: 2895237 - DNA, 18 bp, Homo sapiens
tggccatgctgtccctgc

SEQ ID NO: 2895238 - DNA, 18 bp, Homo sapiens
tggccatggcctctgcaa

SEQ ID NO: 2895239 - DNA, 20 bp, Homo sapiens
tggccatggtccccaagacc

SEQ ID NO: 2895240 - DNA, 14 bp, Homo sapiens
tggcccagcatgga

SEQ ID NO: 2895241 - DNA, 15 bp, Homo sapiens
tggcccagcatggaa

SEQ ID NO: 2895242 - DNA, 17 bp, Homo sapiens
tggcccaggaccatcat

SEQ ID NO: 2895243 - DNA, 13 bp, Homo sapiens
tggcccaggagct

SEQ ID NO: 2895244 - DNA, 22 bp, Homo sapiens
tggcccaggccttgctgactct

SEQ ID NO: 2895245 - DNA, 15 bp, Homo sapiens
tggcccagggcccag

SEQ ID NO: 2895246 - DNA, 17 bp, Homo sapiens
tggcccagggcccagag

SEQ ID NO: 2895247 - DNA, 23 bp, Homo sapiens
tggcccagggcccagagcccagc

SEQ ID NO: 2895248 - DNA, 18 bp, Homo sapiens
tggcccagggggcctgga

SEQ ID NO: 2895249 - DNA, 21 bp, Homo sapiens
tggcccagggggcctggagca

SEQ ID NO: 2895250 - DNA, 15 bp, Homo sapiens
tggccccagagatga

SEQ ID NO: 2895251 - DNA, 15 bp, Homo sapiens
tggccccaggacctg

SEQ ID NO: 2895252 - DNA, 15 bp, Homo sapiens
tggccccgccctcag

SEQ ID NO: 2895253 - DNA, 16 bp, Homo sapiens
tggccccgccctcagg

SEQ ID NO: 2895254 - DNA, 17 bp, Homo sapiens
tggccccgccctcaggc

SEQ ID NO: 2895255 - DNA, 20 bp, Homo sapiens
tggccccgccgcctggtact

SEQ ID NO: 2895256 - DNA, 16 bp, Homo sapiens
tggccccgcctgcctg

SEQ ID NO: 2895257 - DNA, 22 bp, Homo sapiens
tgggcacacgcctcccactggg

SEQ ID NO: 2895258 - DNA, 16 bp, Homo sapiens
tgggcacccaccctgg

SEQ ID NO: 2895259 - DNA, 16 bp, Homo sapiens
tgggcaccccactgca

SEQ ID NO: 2895260 - DNA, 15 bp, Homo sapiens
tgggcacttccctgc

SEQ ID NO: 2895261 - DNA, 17 bp, Homo sapiens
tgggcacttccctgctg

SEQ ID NO: 2895262 - DNA, 16 bp, Homo sapiens
tgggcagaatcctggg

SEQ ID NO: 2895263 - DNA, 19 bp, Homo sapiens
tgggcagaatcctgggccc

SEQ ID NO: 2895264 - DNA, 20 bp, Homo sapiens
tgggcagaatcctgggcccc

SEQ ID NO: 2895265 - DNA, 13 bp, Homo sapiens
tgggcagagcctg

SEQ ID NO: 2895266 - DNA, 16 bp, Homo sapiens
tgggcagagcctgtcc

SEQ ID NO: 2895267 - DNA, 12 bp, Homo sapiens
tgggcagcagca

SEQ ID NO: 2895268 - DNA, 13 bp, Homo sapiens
tgggcagggagcg

SEQ ID NO: 2895269 - DNA, 16 bp, Homo sapiens
tgggcagggtctctgc

SEQ ID NO: 2895270 - DNA, 17 bp, Homo sapiens
tgggcagggtctctgct

SEQ ID NO: 2895271 - DNA, 15 bp, Homo sapiens
tgctccatagagcag

SEQ ID NO: 2895272 - DNA, 18 bp, Homo sapiens
tgctccatagtttggcat

SEQ ID NO: 2895273 - DNA, 23 bp, Homo sapiens
tgctccatagtttggcatttgca

SEQ ID NO: 2895274 - DNA, 24 bp, Homo sapiens
tgctccatctccgcctccacactg

SEQ ID NO: 2895275 - DNA, 17 bp, Homo sapiens
tgctccattttcttgtc

SEQ ID NO: 2895276 - DNA, 12 bp, Homo sapiens
tgctcccaactc

SEQ ID NO: 2895277 - DNA, 22 bp, Homo sapiens
tgctcccacacttgtgccagcc

SEQ ID NO: 2895278 - DNA, 13 bp, Homo sapiens
tgctccccacgtc

SEQ ID NO: 2895279 - DNA, 14 bp, Homo sapiens
tgctcccccacccc

SEQ ID NO: 2895280 - DNA, 23 bp, Homo sapiens
tgctcccccaccccctccccagg

SEQ ID NO: 2895281 - DNA, 16 bp, Homo sapiens
tgctccctaccacctc

SEQ ID NO: 2895282 - DNA, 15 bp, Homo sapiens
tgctccctcacatgt

SEQ ID NO: 2895283 - DNA, 12 bp, Homo sapiens
tgctccctctgt

SEQ ID NO: 2895284 - DNA, 17 bp, Homo sapiens
tgctccgaggactggac

SEQ ID NO: 2895285 - DNA, 13 bp, Homo sapiens
tgctccgctgcct

SEQ ID NO: 2895286 - DNA, 16 bp, Homo sapiens
tgctccggcctgcgtc

SEQ ID NO: 2895287 - DNA, 14 bp, Homo sapiens
tgctccgtggactg

SEQ ID NO: 2895288 - DNA, 13 bp, Homo sapiens
tgctcctccaggg

SEQ ID NO: 2895289 - DNA, 22 bp, Homo sapiens
tgctcctccagggccacgtgcc

SEQ ID NO: 2895290 - DNA, 19 bp, Homo sapiens
tgctcctccttggtgcctg

SEQ ID NO: 2895291 - DNA, 19 bp, Homo sapiens
tgctcctctttcccctcct

SEQ ID NO: 2895292 - DNA, 13 bp, Homo sapiens
tgctcctgcccag

SEQ ID NO: 2895293 - DNA, 14 bp, Homo sapiens
tgctcctggggaga

SEQ ID NO: 2895294 - DNA, 15 bp, Homo sapiens
tgctcctggggagaa

SEQ ID NO: 2895295 - DNA, 18 bp, Homo sapiens
tgctccttagctgccaag

SEQ ID NO: 2895296 - DNA, 15 bp, Homo sapiens
tgctcgcccaggaag

SEQ ID NO: 2895297 - DNA, 18 bp, Homo sapiens
tgctcgcccaggaaggcc

SEQ ID NO: 2895298 - DNA, 16 bp, Homo sapiens
tgctcgggaagggagg

SEQ ID NO: 2895299 - DNA, 19 bp, Homo sapiens
tgctcgggaagggagggga

SEQ ID NO: 2895300 - DNA, 16 bp, Homo sapiens
tgctctagatgagctg

SEQ ID NO: 2895301 - DNA, 18 bp, Homo sapiens
tgctctagatgagctggg

SEQ ID NO: 2895302 - DNA, 14 bp, Homo sapiens
tgctctatatgtaa

SEQ ID NO: 2895303 - DNA, 21 bp, Homo sapiens
tgctctccggcgcagacaggc

SEQ ID NO: 2895304 - DNA, 19 bp, Homo sapiens
tgctctcgcacctttccaa

SEQ ID NO: 2895305 - DNA, 13 bp, Homo sapiens
tgctctctgcagc

SEQ ID NO: 2895306 - DNA, 15 bp, Homo sapiens
tgctctctgcagcca

SEQ ID NO: 2895307 - DNA, 12 bp, Homo sapiens
tgctctgaccct

SEQ ID NO: 2895308 - DNA, 16 bp, Homo sapiens
tgctctgatccctcta

SEQ ID NO: 2895309 - DNA, 13 bp, Homo sapiens
tgctctgcctcta

SEQ ID NO: 2895310 - DNA, 18 bp, Homo sapiens
tgctctgctctaccatgt

SEQ ID NO: 2895311 - DNA, 15 bp, Homo sapiens
tgctctgtgaactat

SEQ ID NO: 2895312 - DNA, 20 bp, Homo sapiens
tgctcttagattgggccatg

SEQ ID NO: 2895313 - DNA, 22 bp, Homo sapiens
tgctcttagattgggccatggc

SEQ ID NO: 2895314 - DNA, 13 bp, Homo sapiens
tgctcttctgtgg

SEQ ID NO: 2895315 - DNA, 23 bp, Homo sapiens
tgctcttctgtggaccactgcat

SEQ ID NO: 2895316 - DNA, 17 bp, Homo sapiens
tgctcttgttctgttcc

SEQ ID NO: 2895317 - DNA, 14 bp, Homo sapiens
tgctctttcccagg

SEQ ID NO: 2895318 - DNA, 15 bp, Homo sapiens
tgctctttcccagga

SEQ ID NO: 2895319 - DNA, 17 bp, Homo sapiens
tgctctttcccaggacg

SEQ ID NO: 2895320 - DNA, 12 bp, Homo sapiens
tgctgaaataaa

SEQ ID NO: 2895321 - DNA, 23 bp, Homo sapiens
tgctgaatgtcattatttgataa

SEQ ID NO: 2895322 - DNA, 20 bp, Homo sapiens
tgctgaatgttgggactgct

SEQ ID NO: 2895323 - DNA, 14 bp, Homo sapiens
tgctgacagctctt

SEQ ID NO: 2895324 - DNA, 15 bp, Homo sapiens
tgctgacagctgctc

SEQ ID NO: 2895325 - DNA, 19 bp, Homo sapiens
tgctgacctcacctggtcc

SEQ ID NO: 2895326 - DNA, 20 bp, Homo sapiens
tgctgacctcacctggtcct

SEQ ID NO: 2895327 - DNA, 21 bp, Homo sapiens
tgctgacctcagcggttgcca

SEQ ID NO: 2895328 - DNA, 14 bp, Homo sapiens
tgctgacggccagg

SEQ ID NO: 2895329 - DNA, 22 bp, Homo sapiens
tgctgacggccagggagaagct

SEQ ID NO: 2895330 - DNA, 14 bp, Homo sapiens
tgctgactctctga

SEQ ID NO: 2895331 - DNA, 17 bp, Homo sapiens
tgctgagagacccaagg

SEQ ID NO: 2895332 - DNA, 14 bp, Homo sapiens
tgctgagcctctgc

SEQ ID NO: 2895333 - DNA, 18 bp, Homo sapiens
tgctgagggaccgagccc

SEQ ID NO: 2895334 - DNA, 23 bp, Homo sapiens
tgctgagggaccgagcccagcag

SEQ ID NO: 2895335 - DNA, 22 bp, Homo sapiens
tgctgagggtgtttcttcctgc

SEQ ID NO: 2895336 - DNA, 15 bp, Homo sapiens
tgctgagtgacagct

SEQ ID NO: 2895337 - DNA, 22 bp, Homo sapiens
tgctgataccatatgaatgaaa

SEQ ID NO: 2895338 - DNA, 19 bp, Homo sapiens
tgctgatcatcgccagagg

SEQ ID NO: 2895339 - DNA, 19 bp, Homo sapiens
tgctgatgaatcactgttt

SEQ ID NO: 2895340 - DNA, 14 bp, Homo sapiens
tgctgatggtctgg

SEQ ID NO: 2895341 - DNA, 14 bp, Homo sapiens
tgctgatgttcagt

SEQ ID NO: 2895342 - DNA, 15 bp, Homo sapiens
tgctgatgttcagtg

SEQ ID NO: 2895343 - DNA, 18 bp, Homo sapiens
tgctgatgttcagtgtaa

SEQ ID NO: 2895344 - DNA, 22 bp, Homo sapiens
tgctgcaaatagccttcctgac

SEQ ID NO: 2895345 - DNA, 17 bp, Homo sapiens
tgctgcagccctgccag

SEQ ID NO: 2895346 - DNA, 17 bp, Homo sapiens
tgctgccaagtcctgcc

SEQ ID NO: 2895347 - DNA, 21 bp, Homo sapiens
tgctgccaccaaatctgtcta

SEQ ID NO: 2895348 - DNA, 15 bp, Homo sapiens
tgctgccactctgct

SEQ ID NO: 2895349 - DNA, 15 bp, Homo sapiens
tgctgccagggcttc

SEQ ID NO: 2895350 - DNA, 12 bp, Homo sapiens
tgctgcccaggc

SEQ ID NO: 2895351 - DNA, 14 bp, Homo sapiens
tgctgcccatgagc

SEQ ID NO: 2895352 - DNA, 19 bp, Homo sapiens
tgctgcccatgagcaagcc

SEQ ID NO: 2895353 - DNA, 18 bp, Homo sapiens
tgctgccccatgaagcca

SEQ ID NO: 2895354 - DNA, 20 bp, Homo sapiens
tgctgccccatgaagccaca

SEQ ID NO: 2895355 - DNA, 15 bp, Homo sapiens
tgctgccctgaagaa

SEQ ID NO: 2895356 - DNA, 22 bp, Homo sapiens
tgctgccctgaagaatggcgcc

SEQ ID NO: 2895357 - DNA, 19 bp, Homo sapiens
tgctgcccttggtttctgg

SEQ ID NO: 2895358 - DNA, 13 bp, Homo sapiens
tgctgcctcagct

SEQ ID NO: 2895359 - DNA, 20 bp, Homo sapiens
tgctgcctcagctcagcttc

SEQ ID NO: 2895360 - DNA, 14 bp, Homo sapiens
tgctgctccccacc

SEQ ID NO: 2895361 - DNA, 19 bp, Homo sapiens
tgctgctcctctttcccct

SEQ ID NO: 2895362 - DNA, 20 bp, Homo sapiens
tgctgctccttagctgccaa

SEQ ID NO: 2895363 - DNA, 12 bp, Homo sapiens
tgctgctgctgc

SEQ ID NO: 2895364 - DNA, 13 bp, Homo sapiens
tgctgctgtgcgt

SEQ ID NO: 2895365 - DNA, 19 bp, Homo sapiens
tgctgctgtgcgtggaaaa

SEQ ID NO: 2895366 - DNA, 12 bp, Homo sapiens
tgctgcttccta

SEQ ID NO: 2895367 - DNA, 14 bp, Homo sapiens
tgctgcttcctaac

SEQ ID NO: 2895368 - DNA, 16 bp, Homo sapiens
tgctgcttcctaactt

SEQ ID NO: 2895369 - DNA, 17 bp, Homo sapiens
tgctgcttcctaactta

SEQ ID NO: 2895370 - DNA, 23 bp, Homo sapiens
tgctgcttgtgcctcccttccca

SEQ ID NO: 2895371 - DNA, 23 bp, Homo sapiens
tgctgctttgttgttctgcctgt

SEQ ID NO: 2895372 - DNA, 13 bp, Homo sapiens
tgctggaggccct

SEQ ID NO: 2895373 - DNA, 14 bp, Homo sapiens
tgctggcatgtctt

SEQ ID NO: 2895374 - DNA, 13 bp, Homo sapiens
tgctggcccaggg

SEQ ID NO: 2895375 - DNA, 20 bp, Homo sapiens
tgctggcctccctccgtccc

SEQ ID NO: 2895376 - DNA, 12 bp, Homo sapiens
tgctggcctctt

SEQ ID NO: 2895377 - DNA, 17 bp, Homo sapiens
tgctggcctcttggcac

SEQ ID NO: 2895378 - DNA, 22 bp, Homo sapiens
tgctggcctcttggcacctgcc

SEQ ID NO: 2895379 - DNA, 23 bp, Homo sapiens
tgctggcctcttggcacctgcct

SEQ ID NO: 2895380 - DNA, 19 bp, Homo sapiens
tgctggcgacactcagggc

SEQ ID NO: 2895381 - DNA, 21 bp, Homo sapiens
tgctggcgacactcagggcag

SEQ ID NO: 2895382 - DNA, 22 bp, Homo sapiens
tgctggcgacactcagggcagc

SEQ ID NO: 2895383 - DNA, 19 bp, Homo sapiens
tgccttttgcagaagaggg

SEQ ID NO: 2895384 - DNA, 15 bp, Homo sapiens
tgcctttttatttat

SEQ ID NO: 2895385 - DNA, 19 bp, Homo sapiens
tgcctttttatttatatgt

SEQ ID NO: 2895386 - DNA, 13 bp, Homo sapiens
tgcctttttcctt

SEQ ID NO: 2895387 - DNA, 14 bp, Homo sapiens
tgcctttttcctta

SEQ ID NO: 2895388 - DNA, 19 bp, Homo sapiens
tgcgaactagagatgtgca

SEQ ID NO: 2895389 - DNA, 16 bp, Homo sapiens
tgcgaagtcctatgga

SEQ ID NO: 2895390 - DNA, 14 bp, Homo sapiens
tgcgaccctggggg

SEQ ID NO: 2895391 - DNA, 14 bp, Homo sapiens
tgcgagtatgtgtt

SEQ ID NO: 2895392 - DNA, 19 bp, Homo sapiens
tgcgattatctacccacgt

SEQ ID NO: 2895393 - DNA, 16 bp, Homo sapiens
tgcgattttattactg

SEQ ID NO: 2895394 - DNA, 21 bp, Homo sapiens
tgcgcaaactttaacaggttt

SEQ ID NO: 2895395 - DNA, 18 bp, Homo sapiens
tgcgcacaccgccagcag

SEQ ID NO: 2895396 - DNA, 18 bp, Homo sapiens
tgcgcacttaccgccctg

SEQ ID NO: 2895397 - DNA, 15 bp, Homo sapiens
tgcgcagccccatct

SEQ ID NO: 2895398 - DNA, 16 bp, Homo sapiens
tgcgcagccccatctg

SEQ ID NO: 2895399 - DNA, 21 bp, Homo sapiens
tgcgcagccccatctgtgcat

SEQ ID NO: 2895400 - DNA, 22 bp, Homo sapiens
tgcgcatcttgcctccaggtgc

SEQ ID NO: 2895401 - DNA, 16 bp, Homo sapiens
tgcgccaccatgccct

SEQ ID NO: 2895402 - DNA, 13 bp, Homo sapiens
tgcgccaggcaga

SEQ ID NO: 2895403 - DNA, 16 bp, Homo sapiens
tgcgccaggcagagct

SEQ ID NO: 2895404 - DNA, 17 bp, Homo sapiens
tgcgccaggcagagctg

SEQ ID NO: 2895405 - DNA, 18 bp, Homo sapiens
tgcgccaggcagagctga

SEQ ID NO: 2895406 - DNA, 22 bp, Homo sapiens
tgcgccaggcagagctgagggc

SEQ ID NO: 2895407 - DNA, 15 bp, Homo sapiens
tgcgcctccatccat

SEQ ID NO: 2895408 - DNA, 23 bp, Homo sapiens
tgcgcgcgctctctctctttctc

SEQ ID NO: 2895409 - DNA, 22 bp, Homo sapiens
tgcgctaacccccagcccacag

SEQ ID NO: 2895410 - DNA, 17 bp, Homo sapiens
tgcgctcggcaggaagg

SEQ ID NO: 2895411 - DNA, 18 bp, Homo sapiens
tgcgctcggcaggaagga

SEQ ID NO: 2895412 - DNA, 13 bp, Homo sapiens
tgcgctgcctggc

SEQ ID NO: 2895413 - DNA, 15 bp, Homo sapiens
tgcgctgcctggcca

SEQ ID NO: 2895414 - DNA, 17 bp, Homo sapiens
tgcgctgcctggccagg

SEQ ID NO: 2895415 - DNA, 17 bp, Homo sapiens
tgcgctgggcacttccc

SEQ ID NO: 2895416 - DNA, 14 bp, Homo sapiens
tgcgcttcctgagc

SEQ ID NO: 2895417 - DNA, 16 bp, Homo sapiens
tgcgctttattttctt

SEQ ID NO: 2895418 - DNA, 16 bp, Homo sapiens
tgcgctttgaacgtgc

SEQ ID NO: 2895419 - DNA, 21 bp, Homo sapiens
tgcgctttgaacgtgccagca

SEQ ID NO: 2895420 - DNA, 14 bp, Homo sapiens
tgcggaaaggtatt

SEQ ID NO: 2895421 - DNA, 19 bp, Homo sapiens
tgcggacaccgtggcctgg

SEQ ID NO: 2895422 - DNA, 13 bp, Homo sapiens
tgcggagccagca

SEQ ID NO: 2895423 - DNA, 18 bp, Homo sapiens
tgcggagtccattatttg

SEQ ID NO: 2895424 - DNA, 20 bp, Homo sapiens
tgcggcctggggggaacgga

SEQ ID NO: 2895425 - DNA, 17 bp, Homo sapiens
tgcggcgcgggcccctc

SEQ ID NO: 2895426 - DNA, 14 bp, Homo sapiens
tgcggcgtggagac

SEQ ID NO: 2895427 - DNA, 18 bp, Homo sapiens
tgcggcgtggagactggc

SEQ ID NO: 2895428 - DNA, 21 bp, Homo sapiens
tgcgggaccggtacagaaagg

SEQ ID NO: 2895429 - DNA, 21 bp, Homo sapiens
tgcgggcattttgaatgtgat

SEQ ID NO: 2895430 - DNA, 13 bp, Homo sapiens
tgcgggccacagg

SEQ ID NO: 2895431 - DNA, 16 bp, Homo sapiens
tgcgggccacagggca

SEQ ID NO: 2895432 - DNA, 12 bp, Homo sapiens
tgcgggctcgcc

SEQ ID NO: 2895433 - DNA, 17 bp, Homo sapiens
tgcgggcttttccccgg

SEQ ID NO: 2895434 - DNA, 20 bp, Homo sapiens
tgcggggcctgtctcagtga

SEQ ID NO: 2895435 - DNA, 21 bp, Homo sapiens
tgcgggtcaacatttccaaaa

SEQ ID NO: 2895436 - DNA, 13 bp, Homo sapiens
tgcgggtcctcag

SEQ ID NO: 2895437 - DNA, 17 bp, Homo sapiens
tgcgggtcctcagctgc

SEQ ID NO: 2895438 - DNA, 18 bp, Homo sapiens
tgcgggtcctcagctgct

SEQ ID NO: 2895439 - DNA, 21 bp, Homo sapiens
tgcgggtgaacaaagcagcca

SEQ ID NO: 2895440 - DNA, 23 bp, Homo sapiens
tgcgggtgaacaaagcagccacg

SEQ ID NO: 2895441 - DNA, 16 bp, Homo sapiens
tgcggtagccagcaca

SEQ ID NO: 2895442 - DNA, 18 bp, Homo sapiens
tgcggtagccagcacaca

SEQ ID NO: 2895443 - DNA, 19 bp, Homo sapiens
tgcggttcttacagcacat

SEQ ID NO: 2895444 - DNA, 23 bp, Homo sapiens
tgcgtcatgggccccccatgcat

SEQ ID NO: 2895445 - DNA, 19 bp, Homo sapiens
tgcgtgacactctccttgc

SEQ ID NO: 2895446 - DNA, 21 bp, Homo sapiens
tgcgtgacactctccttgcag

SEQ ID NO: 2895447 - DNA, 22 bp, Homo sapiens
tgcgtgacactctccttgcagt

SEQ ID NO: 2895448 - DNA, 16 bp, Homo sapiens
tgcgtggaagtgttcc

SEQ ID NO: 2895449 - DNA, 17 bp, Homo sapiens
tgcgtggaagtgttcct

SEQ ID NO: 2895450 - DNA, 21 bp, Homo sapiens
tgcgtggaagtgttcctgtct

SEQ ID NO: 2895451 - DNA, 16 bp, Homo sapiens
tgcgtggactctgcac

SEQ ID NO: 2895452 - DNA, 18 bp, Homo sapiens
tgcgtggactctgcacat

SEQ ID NO: 2895453 - DNA, 22 bp, Homo sapiens
tgcgtggactctgcacatgtct

SEQ ID NO: 2895454 - DNA, 22 bp, Homo sapiens
tgcgtggcacatctaaattgat

SEQ ID NO: 2895455 - DNA, 22 bp, Homo sapiens
tgcgtggcttccctgtcccagt

SEQ ID NO: 2895456 - DNA, 14 bp, Homo sapiens
tgcgtggtgtggcc

SEQ ID NO: 2895457 - DNA, 16 bp, Homo sapiens
tgcgtgtatatgtgct

SEQ ID NO: 2895458 - DNA, 12 bp, Homo sapiens
tgctaaaaatgt

SEQ ID NO: 2895459 - DNA, 14 bp, Homo sapiens
tgctaaaattcaga

SEQ ID NO: 2895460 - DNA, 13 bp, Homo sapiens
tgctaaacactgc

SEQ ID NO: 2895461 - DNA, 22 bp, Homo sapiens
tgctaaacactgcgctttattt

SEQ ID NO: 2895462 - DNA, 22 bp, Homo sapiens
tgctaaataaaatttgttgcat

SEQ ID NO: 2895463 - DNA, 22 bp, Homo sapiens
tgctaacgttttttcttctttt

SEQ ID NO: 2895464 - DNA, 16 bp, Homo sapiens
tgctaactttgccctt

SEQ ID NO: 2895465 - DNA, 22 bp, Homo sapiens
tgctaagaatatttgaatgtat

SEQ ID NO: 2895466 - DNA, 16 bp, Homo sapiens
tgctaagatgctctat

SEQ ID NO: 2895467 - DNA, 12 bp, Homo sapiens
tgctaaggttct

SEQ ID NO: 2895468 - DNA, 14 bp, Homo sapiens
tgctaaggttctaa

SEQ ID NO: 2895469 - DNA, 16 bp, Homo sapiens
tgctaaggttctaagg

SEQ ID NO: 2895470 - DNA, 13 bp, Homo sapiens
tgctaatattaaa

SEQ ID NO: 2895471 - DNA, 15 bp, Homo sapiens
tgctaatattaaaag

SEQ ID NO: 2895472 - DNA, 16 bp, Homo sapiens
tgctaatattttattt

SEQ ID NO: 2895473 - DNA, 18 bp, Homo sapiens
tgctaatgcctttcatct

SEQ ID NO: 2895474 - DNA, 20 bp, Homo sapiens
tgctaattgctgttgaaagc

SEQ ID NO: 2895475 - DNA, 21 bp, Homo sapiens
tgctaattgctgttgaaagca

SEQ ID NO: 2895476 - DNA, 22 bp, Homo sapiens
tgctaattgctgttgaaagcaa

SEQ ID NO: 2895477 - DNA, 23 bp, Homo sapiens
tgctaattgctgttgaaagcaaa

SEQ ID NO: 2895478 - DNA, 20 bp, Homo sapiens
tgctacaaagaagacatgtt

SEQ ID NO: 2895479 - DNA, 23 bp, Homo sapiens
tgctacaaagaagacatgtttta

SEQ ID NO: 2895480 - DNA, 13 bp, Homo sapiens
tgctacacttctg

SEQ ID NO: 2895481 - DNA, 16 bp, Homo sapiens
tgctacagaaagcaca

SEQ ID NO: 2895482 - DNA, 16 bp, Homo sapiens
tgctacatgtgctgga

SEQ ID NO: 2895483 - DNA, 15 bp, Homo sapiens
tgctacgtgcctccc

SEQ ID NO: 2895484 - DNA, 18 bp, Homo sapiens
tgctacgtgcctcccgag

SEQ ID NO: 2895485 - DNA, 14 bp, Homo sapiens
tgctacgtgtgaaa

SEQ ID NO: 2895486 - DNA, 15 bp, Homo sapiens
tgctacgtgtgaaat

SEQ ID NO: 2895487 - DNA, 18 bp, Homo sapiens
tgctacgtgtgaaatctg

SEQ ID NO: 2895488 - DNA, 21 bp, Homo sapiens
tgctacgtgtgaaatctgtct

SEQ ID NO: 2895489 - DNA, 14 bp, Homo sapiens
tgctacgtgtgatt

SEQ ID NO: 2895490 - DNA, 16 bp, Homo sapiens
tgctacgtgtgatttt

SEQ ID NO: 2895491 - DNA, 15 bp, Homo sapiens
tgctactctgttcct

SEQ ID NO: 2895492 - DNA, 16 bp, Homo sapiens
tgctactctgttcctt

SEQ ID NO: 2895493 - DNA, 14 bp, Homo sapiens
tgctactgattgtt

SEQ ID NO: 2895494 - DNA, 18 bp, Homo sapiens
tgctactgcccctctccg

SEQ ID NO: 2895495 - DNA, 12 bp, Homo sapiens
tgctacttccca

SEQ ID NO: 2895496 - DNA, 14 bp, Homo sapiens
tgctagaagaaaac

SEQ ID NO: 2895497 - DNA, 14 bp, Homo sapiens
tgctaggcccctgt

SEQ ID NO: 2895498 - DNA, 16 bp, Homo sapiens
tgctaggcccctgtgt

SEQ ID NO: 2895499 - DNA, 20 bp, Homo sapiens
tgctaggggaaggactggcc

SEQ ID NO: 2895500 - DNA, 20 bp, Homo sapiens
tgctagtcactggcagcctg

SEQ ID NO: 2895501 - DNA, 22 bp, Homo sapiens
tgctagtctagtttcctttttg

SEQ ID NO: 2895502 - DNA, 17 bp, Homo sapiens
tgctataaagttaaagt

SEQ ID NO: 2895503 - DNA, 22 bp, Homo sapiens
tgctataatcattagttttaga

SEQ ID NO: 2895504 - DNA, 19 bp, Homo sapiens
tgctataattctatactgt

SEQ ID NO: 2895505 - DNA, 23 bp, Homo sapiens
tgctataattctatactgttgat

SEQ ID NO: 2895506 - DNA, 13 bp, Homo sapiens
tgctatagacatt

SEQ ID NO: 2895507 - DNA, 21 bp, Homo sapiens
tgctatagtatttgattcaaa

SEQ ID NO: 2895508 - DNA, 17 bp, Homo sapiens
tgctatattgcccaggc

SEQ ID NO: 2895509 - DNA, 17 bp, Homo sapiens
tgctatcattattcgta

SEQ ID NO: 2895510 - DNA, 15 bp, Homo sapiens
tgctatccatttctc

SEQ ID NO: 2895511 - DNA, 20 bp, Homo sapiens
tgctatcggcagatgatgct

SEQ ID NO: 2895512 - DNA, 20 bp, Homo sapiens
tgctatctactaagtttcct

SEQ ID NO: 2895513 - DNA, 18 bp, Homo sapiens
tgctatcttaattttggt

SEQ ID NO: 2895514 - DNA, 15 bp, Homo sapiens
tgctatggtgctctg

SEQ ID NO: 2895515 - DNA, 13 bp, Homo sapiens
tgctattaaagtg

SEQ ID NO: 2895516 - DNA, 23 bp, Homo sapiens
tgctattaaccttgccttagaaa

SEQ ID NO: 2895517 - DNA, 21 bp, Homo sapiens
tgctattgtaaggtctttgta

SEQ ID NO: 2895518 - DNA, 14 bp, Homo sapiens
tgctatttcagcaa

SEQ ID NO: 2895519 - DNA, 17 bp, Homo sapiens
tctgtaaaagtgtctgt

SEQ ID NO: 2895520 - DNA, 20 bp, Homo sapiens
tctgtaaccacctctctgtc

SEQ ID NO: 2895521 - DNA, 18 bp, Homo sapiens
tctgtaagcataagctta

SEQ ID NO: 2895522 - DNA, 16 bp, Homo sapiens
tctgtaaggaactgga

SEQ ID NO: 2895523 - DNA, 23 bp, Homo sapiens
tctgtacaaaggggaaagaacat

SEQ ID NO: 2895524 - DNA, 23 bp, Homo sapiens
tctgtacaatgaacccccatgat

SEQ ID NO: 2895525 - DNA, 13 bp, Homo sapiens
tctgtacacgtgt

SEQ ID NO: 2895526 - DNA, 13 bp, Homo sapiens
tctgtaccccatg

SEQ ID NO: 2895527 - DNA, 20 bp, Homo sapiens
tctgtaggagcaacttctct

SEQ ID NO: 2895528 - DNA, 13 bp, Homo sapiens
tctgtataaatgt

SEQ ID NO: 2895529 - DNA, 15 bp, Homo sapiens
tctgtataaatgtct

SEQ ID NO: 2895530 - DNA, 14 bp, Homo sapiens
tctgtatactgtgg

SEQ ID NO: 2895531 - DNA, 17 bp, Homo sapiens
ctgagcagtccctgctt

SEQ ID NO: 2895532 - DNA, 17 bp, Homo sapiens
ctgagcagtctacttct

SEQ ID NO: 2895533 - DNA, 20 bp, Homo sapiens
ctgagcagtctacttctgtg

SEQ ID NO: 2895534 - DNA, 12 bp, Homo sapiens
ctgagcatctcc

SEQ ID NO: 2895535 - DNA, 23 bp, Homo sapiens
ctgagccaaagccagagtggcca

SEQ ID NO: 2895536 - DNA, 19 bp, Homo sapiens
ctgagccacactgaaaagg

SEQ ID NO: 2895537 - DNA, 12 bp, Homo sapiens
ctgagcccctgt

SEQ ID NO: 2895538 - DNA, 20 bp, Homo sapiens
ctgagcccgcagcccagacc

SEQ ID NO: 2895539 - DNA, 18 bp, Homo sapiens
ctgagcctgcagggaagc

SEQ ID NO: 2895540 - DNA, 19 bp, Homo sapiens
ctgagcctgcagggaagcc

SEQ ID NO: 2895541 - DNA, 13 bp, Homo sapiens
ctgagcctggcca

SEQ ID NO: 2895542 - DNA, 17 bp, Homo sapiens
ctgagcctggccagcct

SEQ ID NO: 2895543 - DNA, 18 bp, Homo sapiens
ctgagcgaggaaaaacaa

SEQ ID NO: 2895544 - DNA, 14 bp, Homo sapiens
ctgagcgcaagcca

SEQ ID NO: 2895545 - DNA, 17 bp, Homo sapiens
ctgagcgcaagccacag

SEQ ID NO: 2895546 - DNA, 15 bp, Homo sapiens
ctgagcgccaggatg

SEQ ID NO: 2895547 - DNA, 22 bp, Homo sapiens
ctgagcgcctgggtccagggga

SEQ ID NO: 2895548 - DNA, 21 bp, Homo sapiens
ctgagcgtttaaagtactgag

SEQ ID NO: 2895549 - DNA, 12 bp, Homo sapiens
ctgagctctcca

SEQ ID NO: 2895550 - DNA, 20 bp, Homo sapiens
ctgagctctccaggccaggt

SEQ ID NO: 2895551 - DNA, 13 bp, Homo sapiens
ctgagctctgcct

SEQ ID NO: 2895552 - DNA, 16 bp, Homo sapiens
tgagctacttcttatt

SEQ ID NO: 2895553 - DNA, 21 bp, Homo sapiens
tgagctacttcttattcactt

SEQ ID NO: 2895554 - DNA, 17 bp, Homo sapiens
tgagctatgataagatt

SEQ ID NO: 2895555 - DNA, 22 bp, Homo sapiens
tgagctatgataagattgaaat

SEQ ID NO: 2895556 - DNA, 16 bp, Homo sapiens
tgagctattgctgttc

SEQ ID NO: 2895557 - DNA, 12 bp, Homo sapiens
tgagctctgcct

SEQ ID NO: 2895558 - DNA, 13 bp, Homo sapiens
tgagctctgcctc

SEQ ID NO: 2895559 - DNA, 15 bp, Homo sapiens
tgagctctgcctcaa

SEQ ID NO: 2895560 - DNA, 15 bp, Homo sapiens
tgagctgaccagccg

SEQ ID NO: 2895561 - DNA, 17 bp, Homo sapiens
tgagctgagatcgtgcc

SEQ ID NO: 2895562 - DNA, 16 bp, Homo sapiens
tgagctgagccaggct

SEQ ID NO: 2895563 - DNA, 14 bp, Homo sapiens
tgagctgaggcagc

SEQ ID NO: 2895564 - DNA, 22 bp, Homo sapiens
tgagctgcccggcgcctgccct

SEQ ID NO: 2895565 - DNA, 20 bp, Homo sapiens
tgagctgcctgtaacttgag

SEQ ID NO: 2895566 - DNA, 13 bp, Homo sapiens
tgagctggggagg

SEQ ID NO: 2895567 - DNA, 17 bp, Homo sapiens
tgagctggggaggtggg

SEQ ID NO: 2895568 - DNA, 23 bp, Homo sapiens
tgagctggggaggtgggaggcca

SEQ ID NO: 2895569 - DNA, 16 bp, Homo sapiens
tgagctgtcatcaaca

SEQ ID NO: 2895570 - DNA, 16 bp, Homo sapiens
tgaggaaacaacagct

SEQ ID NO: 2895571 - DNA, 23 bp, Homo sapiens
tgaggaagccaggtccacggtct

SEQ ID NO: 2895572 - DNA, 19 bp, Homo sapiens
tgaggaaggcaggaagaga

SEQ ID NO: 2895573 - DNA, 20 bp, Homo sapiens
tgaggaaggcaggaagagag

SEQ ID NO: 2895574 - DNA, 13 bp, Homo sapiens
tgaggacaaagaa

SEQ ID NO: 2895575 - DNA, 13 bp, Homo sapiens
tgaggacagctgt

SEQ ID NO: 2895576 - DNA, 18 bp, Homo sapiens
tgaggacagctgtcctct

SEQ ID NO: 2895577 - DNA, 16 bp, Homo sapiens
tgaggaccagggtgga

SEQ ID NO: 2895578 - DNA, 22 bp, Homo sapiens
tgaggactctgcaagtgtctgg

SEQ ID NO: 2895579 - DNA, 14 bp, Homo sapiens
tgaggagaatgaaa

SEQ ID NO: 2895580 - DNA, 21 bp, Homo sapiens
tgaggagagaaaatatatgta

SEQ ID NO: 2895581 - DNA, 17 bp, Homo sapiens
tgaggagcaagggtggc

SEQ ID NO: 2895582 - DNA, 20 bp, Homo sapiens
tgaggagccccatctgtcta

SEQ ID NO: 2895583 - DNA, 21 bp, Homo sapiens
tgaggatcccctgtcccctgg

SEQ ID NO: 2895584 - DNA, 22 bp, Homo sapiens
tgaggatcccctgtcccctggg

SEQ ID NO: 2895585 - DNA, 17 bp, Homo sapiens
tgaggatgtcactcaga

SEQ ID NO: 2895586 - DNA, 16 bp, Homo sapiens
tgaggatttagaagtg

SEQ ID NO: 2895587 - DNA, 22 bp, Homo sapiens
tgaggcacaagaatcacttgaa

SEQ ID NO: 2895588 - DNA, 18 bp, Homo sapiens
tgaggcagaagaattgaa

SEQ ID NO: 2895589 - DNA, 15 bp, Homo sapiens
tgaggcaggggcgga

SEQ ID NO: 2895590 - DNA, 17 bp, Homo sapiens
tgaggcagttaaataat

SEQ ID NO: 2895591 - DNA, 13 bp, Homo sapiens
tgaggccacactc

SEQ ID NO: 2895592 - DNA, 20 bp, Homo sapiens
tgaggccacactcagcacaa

SEQ ID NO: 2895593 - DNA, 20 bp, Homo sapiens
tgaggccgcggcctccccga

SEQ ID NO: 2895594 - DNA, 18 bp, Homo sapiens
tgaggcctgagacccagg

SEQ ID NO: 2895595 - DNA, 15 bp, Homo sapiens
tgaggccttgtgtgt

SEQ ID NO: 2895596 - DNA, 15 bp, Homo sapiens
tgaggctgagaaagc

SEQ ID NO: 2895597 - DNA, 15 bp, Homo sapiens
tgaggctgctgccat

SEQ ID NO: 2895598 - DNA, 11 bp, Homo sapiens
tgaggctggca

SEQ ID NO: 2895599 - DNA, 17 bp, Homo sapiens
tgagggaacagacagga

SEQ ID NO: 2895600 - DNA, 22 bp, Homo sapiens
tgagggaacagacaggagaaat

SEQ ID NO: 2895601 - DNA, 16 bp, Homo sapiens
tgagggaatgacacca

SEQ ID NO: 2895602 - DNA, 18 bp, Homo sapiens
tgagggagggagccatgg

SEQ ID NO: 2895603 - DNA, 15 bp, Homo sapiens
tgagggagtgcagaa

SEQ ID NO: 2895604 - DNA, 17 bp, Homo sapiens
tgagggcaccaccaaga

SEQ ID NO: 2895605 - DNA, 15 bp, Homo sapiens
tgagggcagcactgg

SEQ ID NO: 2895606 - DNA, 11 bp, Homo sapiens
tgagggcagtc

SEQ ID NO: 2895607 - DNA, 13 bp, Homo sapiens
tgagggccctgtg

SEQ ID NO: 2895608 - DNA, 17 bp, Homo sapiens
tgaggggacgggcaagt

SEQ ID NO: 2895609 - DNA, 18 bp, Homo sapiens
tgaggggcccctggccca

SEQ ID NO: 2895610 - DNA, 21 bp, Homo sapiens
tgaggggcccctggcccagga

SEQ ID NO: 2895611 - DNA, 23 bp, Homo sapiens
tgaggggtcgacttcgggctggc

SEQ ID NO: 2895612 - DNA, 20 bp, Homo sapiens
tgagggtgcccttttccagc

SEQ ID NO: 2895613 - DNA, 18 bp, Homo sapiens
tgagggtttgtgctacca

SEQ ID NO: 2895614 - DNA, 22 bp, Homo sapiens
tgaggtgagttgggggtatcta

SEQ ID NO: 2895615 - DNA, 20 bp, Homo sapiens
tgaggtggaagccctccttc

SEQ ID NO: 2895616 - DNA, 21 bp, Homo sapiens
tgaggtgggttttcttcccat

SEQ ID NO: 2895617 - DNA, 23 bp, Homo sapiens
tgaggtggtagtaaaacacagag

SEQ ID NO: 2895618 - DNA, 16 bp, Homo sapiens
tgaggtgtctggcctg

SEQ ID NO: 2895619 - DNA, 22 bp, Homo sapiens
tgagtaactgatttgtaacaag

SEQ ID NO: 2895620 - DNA, 18 bp, Homo sapiens
tgagtaatgggatttgaa

SEQ ID NO: 2895621 - DNA, 23 bp, Homo sapiens
tgagtacagagtgtggactctgg

SEQ ID NO: 2895622 - DNA, 18 bp, Homo sapiens
tgagtacagatactgtga

SEQ ID NO: 2895623 - DNA, 22 bp, Homo sapiens
tgagtactgttaagaataataa

SEQ ID NO: 2895624 - DNA, 21 bp, Homo sapiens
tgagtagctttcatttactga

SEQ ID NO: 2895625 - DNA, 15 bp, Homo sapiens
tgagtaggccctgct

SEQ ID NO: 2895626 - DNA, 15 bp, Homo sapiens
tgagtatttggtcca

SEQ ID NO: 2895627 - DNA, 13 bp, Homo sapiens
tgagtcaccagga

SEQ ID NO: 2895628 - DNA, 16 bp, Homo sapiens
tgagtcactgagcatc

SEQ ID NO: 2895629 - DNA, 22 bp, Homo sapiens
tgagtcaggcaattgattgtga

SEQ ID NO: 2895630 - DNA, 22 bp, Homo sapiens
tgagtccctcacgtttcttccc

SEQ ID NO: 2895631 - DNA, 16 bp, Homo sapiens
tgagtccctccatgca

SEQ ID NO: 2895632 - DNA, 15 bp, Homo sapiens
tgagtcctggcccaa

SEQ ID NO: 2895633 - DNA, 15 bp, Homo sapiens
tgagtccttgaaaat

SEQ ID NO: 2895634 - DNA, 18 bp, Homo sapiens
tgagtccttgaaaatatt

SEQ ID NO: 2895635 - DNA, 16 bp, Homo sapiens
tgagtctacctgagca

SEQ ID NO: 2895636 - DNA, 21 bp, Homo sapiens
tgaagacagagcaaagcgccc

SEQ ID NO: 2895637 - DNA, 21 bp, Homo sapiens
tgaagacattttttgctataa

SEQ ID NO: 2895638 - DNA, 16 bp, Homo sapiens
tgaagaccaaagttgt

SEQ ID NO: 2895639 - DNA, 14 bp, Homo sapiens
tgaagaccagcttt

SEQ ID NO: 2895640 - DNA, 15 bp, Homo sapiens
tgaagaccagctttc

SEQ ID NO: 2895641 - DNA, 21 bp, Homo sapiens
tgaagaccccagatgtgaggg

SEQ ID NO: 2895642 - DNA, 17 bp, Homo sapiens
tgaagactggaagctaa

SEQ ID NO: 2895643 - DNA, 18 bp, Homo sapiens
tgaagaggaacagtgtgg

SEQ ID NO: 2895644 - DNA, 23 bp, Homo sapiens
tgaagagtaagtcaacctgcctg

SEQ ID NO: 2895645 - DNA, 17 bp, Homo sapiens
tgaagagtcctctgaat

SEQ ID NO: 2895646 - DNA, 17 bp, Homo sapiens
tgaagatctgatttata

SEQ ID NO: 2895647 - DNA, 18 bp, Homo sapiens
tgaagatggcatcctgtg

SEQ ID NO: 2895648 - DNA, 19 bp, Homo sapiens
tgaagatggcatcctgtga

SEQ ID NO: 2895649 - DNA, 15 bp, Homo sapiens
tgaagatgggagcct

SEQ ID NO: 2895650 - DNA, 13 bp, Homo sapiens
tgaagatgtaagg

SEQ ID NO: 2895651 - DNA, 17 bp, Homo sapiens
tgaagatttatttttaa

SEQ ID NO: 2895652 - DNA, 14 bp, Homo sapiens
tgaagcaagctgtg

SEQ ID NO: 2895653 - DNA, 20 bp, Homo sapiens
tgaagcaagctgtgttactt

SEQ ID NO: 2895654 - DNA, 21 bp, Homo sapiens
tgaagcaagctgtgttacttg

SEQ ID NO: 2895655 - DNA, 19 bp, Homo sapiens
tgaagcagatgcaaagagg

SEQ ID NO: 2895656 - DNA, 10 bp, Homo sapiens
tgaagcagct

SEQ ID NO: 2895657 - DNA, 11 bp, Homo sapiens
tgaagcagctc

SEQ ID NO: 2895658 - DNA, 17 bp, Homo sapiens
tgaagcagctctgcctt

SEQ ID NO: 2895659 - DNA, 13 bp, Homo sapiens
tgaagcagtcttg

SEQ ID NO: 2895660 - DNA, 16 bp, Homo sapiens
tgaagcagtcttgctc

SEQ ID NO: 2895661 - DNA, 18 bp, Homo sapiens
tgaagcatttcaaagccc

SEQ ID NO: 2895662 - DNA, 22 bp, Homo sapiens
tgaagcatttcaaagccctgcc

SEQ ID NO: 2895663 - DNA, 16 bp, Homo sapiens
tgaagcgaacatcttc

SEQ ID NO: 2895664 - DNA, 18 bp, Homo sapiens
tgaagcgaacatcttcat

SEQ ID NO: 2895665 - DNA, 16 bp, Homo sapiens
tgaagcggtcagactg

SEQ ID NO: 2895666 - DNA, 22 bp, Homo sapiens
tgaagctactgtgtgtgtgaat

SEQ ID NO: 2895667 - DNA, 19 bp, Homo sapiens
tgaagctatttatctgtag

SEQ ID NO: 2895668 - DNA, 19 bp, Homo sapiens
tgaagctcacctgttgctt

SEQ ID NO: 2895669 - DNA, 20 bp, Homo sapiens
tgaagctcgcatccagacag

SEQ ID NO: 2895670 - DNA, 17 bp, Homo sapiens
tgaagctgctgcagccc

SEQ ID NO: 2895671 - DNA, 20 bp, Homo sapiens
tgaagctgctgcagccctgc

SEQ ID NO: 2895672 - DNA, 13 bp, Homo sapiens
tgaagctgctgta

SEQ ID NO: 2895673 - DNA, 23 bp, Homo sapiens
tgaagctgttgctatttgtattt

SEQ ID NO: 2895674 - DNA, 13 bp, Homo sapiens
tgaagcttgtgta

SEQ ID NO: 2895675 - DNA, 23 bp, Homo sapiens
tgaagcttgtgtatccattatca

SEQ ID NO: 2895676 - DNA, 14 bp, Homo sapiens
tgaaggaaacagtt

SEQ ID NO: 2895677 - DNA, 16 bp, Homo sapiens
tgaaggaaacagttaa

SEQ ID NO: 2895678 - DNA, 22 bp, Homo sapiens
tgaaggagaggcaacatccaaa

SEQ ID NO: 2895679 - DNA, 22 bp, Homo sapiens
tgaaggagccccattcctggga

SEQ ID NO: 2895680 - DNA, 24 bp, Homo sapiens
tgaaggatattttcaacaattaga

SEQ ID NO: 2895681 - DNA, 22 bp, Homo sapiens
tgaaggcaaaaatctacagtgt

SEQ ID NO: 2895682 - DNA, 16 bp, Homo sapiens
tgaaggcaaaattgca

SEQ ID NO: 2895683 - DNA, 18 bp, Homo sapiens
tgaaggcaaaattgcaaa

SEQ ID NO: 2895684 - DNA, 18 bp, Homo sapiens
tgaaggcagagaaaggga

SEQ ID NO: 2895685 - DNA, 19 bp, Homo sapiens
tgaaggccgagaagcaaga

SEQ ID NO: 2895686 - DNA, 12 bp, Homo sapiens
tgaaggctggca

SEQ ID NO: 2895687 - DNA, 13 bp, Homo sapiens
tgaaggctggcat

SEQ ID NO: 2895688 - DNA, 20 bp, Homo sapiens
tgaaggctggcatgatccaa

SEQ ID NO: 2895689 - DNA, 21 bp, Homo sapiens
tgaagggaaggcaaaggcaga

SEQ ID NO: 2895690 - DNA, 23 bp, Homo sapiens
tgaagggacggctgtgggaccag

SEQ ID NO: 2895691 - DNA, 10 bp, Homo sapiens
tgaaggggcg

SEQ ID NO: 2895692 - DNA, 19 bp, Homo sapiens
tgaaggtcccctggcagtg

SEQ ID NO: 2895693 - DNA, 17 bp, Homo sapiens
tgaaggtcctagcttta

SEQ ID NO: 2895694 - DNA, 23 bp, Homo sapiens
tgaaggtgtgtcctcaagaagaa

SEQ ID NO: 2895695 - DNA, 15 bp, Homo sapiens
tgaaggttaaaggaa

SEQ ID NO: 2895696 - DNA, 18 bp, Homo sapiens
tgaagtaactataacaaa

SEQ ID NO: 2895697 - DNA, 19 bp, Homo sapiens
tgaagtaactataacaaaa

SEQ ID NO: 2895698 - DNA, 14 bp, Homo sapiens
tgaagtaatgaatt

SEQ ID NO: 2895699 - DNA, 21 bp, Homo sapiens
tgaagtacttgccagaagttg

SEQ ID NO: 2895700 - DNA, 13 bp, Homo sapiens
tgaagtactttta

SEQ ID NO: 2895701 - DNA, 20 bp, Homo sapiens
tgaagtatctaaaagtgtca

SEQ ID NO: 2895702 - DNA, 17 bp, Homo sapiens
tgaagtatgaagtctga

SEQ ID NO: 2895703 - DNA, 20 bp, Homo sapiens
tgaagtccaggactgggtct

SEQ ID NO: 2895704 - DNA, 14 bp, Homo sapiens
tgaagtcctggctt

SEQ ID NO: 2895705 - DNA, 17 bp, Homo sapiens
tgaagtctgagggaaac

SEQ ID NO: 2895706 - DNA, 23 bp, Homo sapiens
tgaagtcttaaggacaaagtgcc

SEQ ID NO: 2895707 - DNA, 21 bp, Homo sapiens
tgaagtcttactacagaaatg

SEQ ID NO: 2895708 - DNA, 13 bp, Homo sapiens
tgaagtgaggaca

SEQ ID NO: 2895709 - DNA, 17 bp, Homo sapiens
tgaagtgggaaagcatt

SEQ ID NO: 2895710 - DNA, 21 bp, Homo sapiens
tgaagtggttcagtctagaag

SEQ ID NO: 2895711 - DNA, 22 bp, Homo sapiens
tgaagtgtgtttccttcagtgc

SEQ ID NO: 2895712 - DNA, 23 bp, Homo sapiens
tgaagtgttaatactagttgtga

SEQ ID NO: 2895713 - DNA, 21 bp, Homo sapiens
tgaagttaaaacacctttcct

SEQ ID NO: 2895714 - DNA, 22 bp, Homo sapiens
tgaagttaaaacacctttcctt

SEQ ID NO: 2895715 - DNA, 19 bp, Homo sapiens
tgaagttactttcttaatg

SEQ ID NO: 2895716 - DNA, 14 bp, Homo sapiens
tgaagttagaattc

SEQ ID NO: 2895717 - DNA, 15 bp, Homo sapiens
tgaagttagaattcc

SEQ ID NO: 2895718 - DNA, 19 bp, Homo sapiens
tgaagttagaattccttca

SEQ ID NO: 2895719 - DNA, 21 bp, Homo sapiens
tgaagttaggttcttaaaagt

SEQ ID NO: 2895720 - DNA, 22 bp, Homo sapiens
tgaagttaggttcttaaaagtg

SEQ ID NO: 2895721 - DNA, 15 bp, Homo sapiens
tgaagttttacattg

SEQ ID NO: 2895722 - DNA, 18 bp, Homo sapiens
tgaagttttattttaaat

SEQ ID NO: 2895723 - DNA, 23 bp, Homo sapiens
tgaagttttattttaaattatta

SEQ ID NO: 2895724 - DNA, 14 bp, Homo sapiens
tgaataaaaagaaa

SEQ ID NO: 2895725 - DNA, 16 bp, Homo sapiens
tgaataaaccaagaca

SEQ ID NO: 2895726 - DNA, 21 bp, Homo sapiens
tgaataaaccaagacaagacc

SEQ ID NO: 2895727 - DNA, 15 bp, Homo sapiens
tgaataaagaatact

SEQ ID NO: 2895728 - DNA, 20 bp, Homo sapiens
tgaataaagaatacttgaac

SEQ ID NO: 2895729 - DNA, 14 bp, Homo sapiens
tgaataaataccca

SEQ ID NO: 2895730 - DNA, 23 bp, Homo sapiens
tgaataacagtagtcctttgata

SEQ ID NO: 2895731 - DNA, 16 bp, Homo sapiens
tgaataataaaatcaa

SEQ ID NO: 2895732 - DNA, 20 bp, Homo sapiens
tgaataataagcaggatgtt

SEQ ID NO: 2895733 - DNA, 22 bp, Homo sapiens
tgaataatcatgtgaaatgttt

SEQ ID NO: 2895734 - DNA, 23 bp, Homo sapiens
tgaatacacatctctgtcagtgt

SEQ ID NO: 2895735 - DNA, 17 bp, Homo sapiens
tgaatacagcagcaaga

SEQ ID NO: 2895736 - DNA, 18 bp, Homo sapiens
tgaatacttacattctct

SEQ ID NO: 2895737 - DNA, 16 bp, Homo sapiens
tgaatactttttacaa

SEQ ID NO: 2895738 - DNA, 20 bp, Homo sapiens
tgaatagcttgtttctgtca

SEQ ID NO: 2895739 - DNA, 13 bp, Homo sapiens
tgaataggttccc

SEQ ID NO: 2895740 - DNA, 23 bp, Homo sapiens
tgaatatgcctgtaattcagtgt

SEQ ID NO: 2895741 - DNA, 17 bp, Homo sapiens
tgaatatggaagtaaag

SEQ ID NO: 2895742 - DNA, 23 bp, Homo sapiens
tgaatatggacagttagcattta

SEQ ID NO: 2895743 - DNA, 23 bp, Homo sapiens
tgacagtgacgtgactcagagct

SEQ ID NO: 2895744 - DNA, 16 bp, Homo sapiens
tgacagttctgaagaa

SEQ ID NO: 2895745 - DNA, 18 bp, Homo sapiens
tgacataaaatttacatt

SEQ ID NO: 2895746 - DNA, 14 bp, Homo sapiens
tgacatagcctcat

SEQ ID NO: 2895747 - DNA, 13 bp, Homo sapiens
tgacatatttaat

SEQ ID NO: 2895748 - DNA, 16 bp, Homo sapiens
tgacatatttaatgtt

SEQ ID NO: 2895749 - DNA, 19 bp, Homo sapiens
tgacatatttaatgtttta

SEQ ID NO: 2895750 - DNA, 20 bp, Homo sapiens
tgacatatttaatgttttaa

SEQ ID NO: 2895751 - DNA, 22 bp, Homo sapiens
tgacatcagaagtaactcccac

SEQ ID NO: 2895752 - DNA, 24 bp, Homo sapiens
tgacatcagaagtaactcccactc

SEQ ID NO: 2895753 - DNA, 17 bp, Homo sapiens
tgacatcagccagctgc

SEQ ID NO: 2895754 - DNA, 21 bp, Homo sapiens
tgacatccactgtttgccttg

SEQ ID NO: 2895755 - DNA, 14 bp, Homo sapiens
tgacatctctttga

SEQ ID NO: 2895756 - DNA, 14 bp, Homo sapiens
tgacatctggaatc

SEQ ID NO: 2895757 - DNA, 17 bp, Homo sapiens
tgacatgaccctctgtc

SEQ ID NO: 2895758 - DNA, 19 bp, Homo sapiens
tgacatgaccctctgtccc

SEQ ID NO: 2895759 - DNA, 22 bp, Homo sapiens
tgacatggaaagggtcttcctt

SEQ ID NO: 2895760 - DNA, 15 bp, Homo sapiens
tgacattcacctgcc

SEQ ID NO: 2895761 - DNA, 18 bp, Homo sapiens
tgacattcacctgcccca

SEQ ID NO: 2895762 - DNA, 22 bp, Homo sapiens
tgacattctcaggaagccccca

SEQ ID NO: 2895763 - DNA, 20 bp, Homo sapiens
tgacattctctattgtaatt

SEQ ID NO: 2895764 - DNA, 21 bp, Homo sapiens
tgacattgatgtgttcggttt

SEQ ID NO: 2895765 - DNA, 14 bp, Homo sapiens
tgacattgccaaaa

SEQ ID NO: 2895766 - DNA, 19 bp, Homo sapiens
tgacattgccaaaaaggat

SEQ ID NO: 2895767 - DNA, 19 bp, Homo sapiens
tgacattgcgtttgacctt

SEQ ID NO: 2895768 - DNA, 22 bp, Homo sapiens
tgacattgctggtcatccttgg

SEQ ID NO: 2895769 - DNA, 12 bp, Homo sapiens
tgacattgtctc

SEQ ID NO: 2895770 - DNA, 15 bp, Homo sapiens
tgacatttaataact

SEQ ID NO: 2895771 - DNA, 17 bp, Homo sapiens
tgacatttaatgccatc

SEQ ID NO: 2895772 - DNA, 18 bp, Homo sapiens
tgacatttatttttcatt

SEQ ID NO: 2895773 - DNA, 16 bp, Homo sapiens
tgaccaaaagttacat

SEQ ID NO: 2895774 - DNA, 20 bp, Homo sapiens
tgaccaaagtcccttcctgc

SEQ ID NO: 2895775 - DNA, 14 bp, Homo sapiens
tgaccaaagtcctt

SEQ ID NO: 2895776 - DNA, 17 bp, Homo sapiens
tgaccaacagttccttc

SEQ ID NO: 2895777 - DNA, 17 bp, Homo sapiens
tgaccaacatggagaaa

SEQ ID NO: 2895778 - DNA, 20 bp, Homo sapiens
tgaccaacatggagaaaccc

SEQ ID NO: 2895779 - DNA, 21 bp, Homo sapiens
tgaccaagcaggaagctcaga

SEQ ID NO: 2895780 - DNA, 16 bp, Homo sapiens
tgaccaatacatttgt

SEQ ID NO: 2895781 - DNA, 15 bp, Homo sapiens
tgaccaatgtcttga

SEQ ID NO: 2895782 - DNA, 18 bp, Homo sapiens
tgaccacatagcatgagg

SEQ ID NO: 2895783 - DNA, 21 bp, Homo sapiens
tgaccacatagcatgaggcca

SEQ ID NO: 2895784 - DNA, 23 bp, Homo sapiens
tgaccaccaaattgttatttgca

SEQ ID NO: 2895785 - DNA, 14 bp, Homo sapiens
tgaccacgcacctc

SEQ ID NO: 2895786 - DNA, 15 bp, Homo sapiens
tgaccactccagaga

SEQ ID NO: 2895787 - DNA, 16 bp, Homo sapiens
tgaccactccagagaa

SEQ ID NO: 2895788 - DNA, 14 bp, Homo sapiens
tgaccagcagcgcc

SEQ ID NO: 2895789 - DNA, 18 bp, Homo sapiens
tgaccagggaagtgtgtg

SEQ ID NO: 2895790 - DNA, 16 bp, Homo sapiens
tgaccagtctgaccct

SEQ ID NO: 2895791 - DNA, 14 bp, Homo sapiens
tgaccagtttctta

SEQ ID NO: 2895792 - DNA, 22 bp, Homo sapiens
tgaccagtttcttttcttttgt

SEQ ID NO: 2895793 - DNA, 14 bp, Homo sapiens
tgaccatctgtgac

SEQ ID NO: 2895794 - DNA, 23 bp, Homo sapiens
tgaccatctgtgactataaagct

SEQ ID NO: 2895795 - DNA, 14 bp, Homo sapiens
tgacccacagcctc

SEQ ID NO: 2895796 - DNA, 17 bp, Homo sapiens
tgacccacttctcatca

SEQ ID NO: 2895797 - DNA, 23 bp, Homo sapiens
tgacccacttctcatcacacaca

SEQ ID NO: 2895798 - DNA, 14 bp, Homo sapiens
tgacccagctactg

SEQ ID NO: 2895799 - DNA, 20 bp, Homo sapiens
tgacccagtccctgggggaa

SEQ ID NO: 2895800 - DNA, 18 bp, Homo sapiens
tgaccccatcactcgcag

SEQ ID NO: 2895801 - DNA, 16 bp, Homo sapiens
tgaccccctcccccca

SEQ ID NO: 2895802 - DNA, 13 bp, Homo sapiens
tgacccctacccc

SEQ ID NO: 2895803 - DNA, 17 bp, Homo sapiens
tgacccctaccccctca

SEQ ID NO: 2895804 - DNA, 12 bp, Homo sapiens
tgacccctcctg

SEQ ID NO: 2895805 - DNA, 14 bp, Homo sapiens
tgacccctcctggg

SEQ ID NO: 2895806 - DNA, 16 bp, Homo sapiens
tgacccctcctggggc

SEQ ID NO: 2895807 - DNA, 22 bp, Homo sapiens
tgacccctcctggggccaggcc

SEQ ID NO: 2895808 - DNA, 18 bp, Homo sapiens
tgacccggattggccctg

SEQ ID NO: 2895809 - DNA, 23 bp, Homo sapiens
tgacccggattggccctgcccct

SEQ ID NO: 2895810 - DNA, 13 bp, Homo sapiens
tgaccctctgtcc

SEQ ID NO: 2895811 - DNA, 14 bp, Homo sapiens
tgaccctctgtccc

SEQ ID NO: 2895812 - DNA, 16 bp, Homo sapiens
tgaccctctgtcccca

SEQ ID NO: 2895813 - DNA, 18 bp, Homo sapiens
tgaccctctgtccccagg

SEQ ID NO: 2895814 - DNA, 19 bp, Homo sapiens
tgaccctctgtccccaggc

SEQ ID NO: 2895815 - DNA, 17 bp, Homo sapiens
tgaccctgagctgacca

SEQ ID NO: 2895816 - DNA, 17 bp, Homo sapiens
tgaccctgggcctggag

SEQ ID NO: 2895817 - DNA, 14 bp, Homo sapiens
tgaccctggggctg

SEQ ID NO: 2895818 - DNA, 19 bp, Homo sapiens
tgaccctgtatatagccca

SEQ ID NO: 2895819 - DNA, 20 bp, Homo sapiens
tgaccctgtatatagcccag

SEQ ID NO: 2895820 - DNA, 20 bp, Homo sapiens
tgacccttacagcctctgac

SEQ ID NO: 2895821 - DNA, 18 bp, Homo sapiens
tgacccttctccaaaggc

SEQ ID NO: 2895822 - DNA, 14 bp, Homo sapiens
tgaccgcccagctc

SEQ ID NO: 2895823 - DNA, 19 bp, Homo sapiens
tgaccgcgactaatttcaa

SEQ ID NO: 2895824 - DNA, 13 bp, Homo sapiens
tgaccggctgccg

SEQ ID NO: 2895825 - DNA, 14 bp, Homo sapiens
tgaccggctgccgt

SEQ ID NO: 2895826 - DNA, 20 bp, Homo sapiens
tgacctcaagtgatctgccc

SEQ ID NO: 2895827 - DNA, 18 bp, Homo sapiens
tgacctcacctggtcctc

SEQ ID NO: 2895828 - DNA, 15 bp, Homo sapiens
tgacctccacagctt

SEQ ID NO: 2895829 - DNA, 18 bp, Homo sapiens
tgacctccagtcctgctg

SEQ ID NO: 2895830 - DNA, 20 bp, Homo sapiens
tgacctccagtcctgctggc

SEQ ID NO: 2895831 - DNA, 22 bp, Homo sapiens
tgacctccatactgggctaagg

SEQ ID NO: 2895832 - DNA, 22 bp, Homo sapiens
tgacctgacttgcctccgtgtc

SEQ ID NO: 2895833 - DNA, 14 bp, Homo sapiens
tgacctgaggaagc

SEQ ID NO: 2895834 - DNA, 15 bp, Homo sapiens
tgacctgaggaagcg

SEQ ID NO: 2895835 - DNA, 16 bp, Homo sapiens
tgacctgccagccggt

SEQ ID NO: 2895836 - DNA, 23 bp, Homo sapiens
tgacctgcgggtcctcagctgct

SEQ ID NO: 2895837 - DNA, 12 bp, Homo sapiens
tgacctggtggg

SEQ ID NO: 2895838 - DNA, 21 bp, Homo sapiens
tgacctggtgggagcacctgc

SEQ ID NO: 2895839 - DNA, 13 bp, Homo sapiens
tgacctgtccagg

SEQ ID NO: 2895840 - DNA, 14 bp, Homo sapiens
tgacctgtcctctt

SEQ ID NO: 2895841 - DNA, 15 bp, Homo sapiens
tgacctgtttctctg

SEQ ID NO: 2895842 - DNA, 16 bp, Homo sapiens
tgaccttagtgtttct

SEQ ID NO: 2895843 - DNA, 13 bp, Homo sapiens
tgaccttcatttc

SEQ ID NO: 2895844 - DNA, 18 bp, Homo sapiens
tgaccttccaagagcctg

SEQ ID NO: 2895845 - DNA, 20 bp, Homo sapiens
tgaccttccaagagcctgag

SEQ ID NO: 2895846 - DNA, 14 bp, Homo sapiens
tgaccttgggacca

SEQ ID NO: 2895847 - DNA, 20 bp, Homo sapiens
tgaccttgggaccaaagggg

SEQ ID NO: 2895848 - DNA, 15 bp, Homo sapiens
tgacctttgtacagc

SEQ ID NO: 2895849 - DNA, 20 bp, Homo sapiens
tgacctttgtacagcccaga

SEQ ID NO: 2895850 - DNA, 18 bp, Homo sapiens
tgaccttttatgtagtaa

SEQ ID NO: 2895851 - DNA, 23 bp, Homo sapiens
tgaccttttatgtagtaattgac

SEQ ID NO: 2895852 - DNA, 14 bp, Homo sapiens
tgacgctgaataaa

SEQ ID NO: 2895853 - DNA, 16 bp, Homo sapiens
tgacggctgccattgg

SEQ ID NO: 2895854 - DNA, 21 bp, Homo sapiens
tgacggctgggtgtttcagtt

SEQ ID NO: 2895855 - DNA, 21 bp, Homo sapiens
tgacgggccaggccctggagg

SEQ ID NO: 2895856 - DNA, 17 bp, Homo sapiens
tgacggtgcagtctggg

SEQ ID NO: 2895857 - DNA, 17 bp, Homo sapiens
tgacgtgactcagagct

SEQ ID NO: 2895858 - DNA, 15 bp, Homo sapiens
tgactaaaaaacaaa

SEQ ID NO: 2895859 - DNA, 22 bp, Homo sapiens
tgactaaaaaacaaagaagaca

SEQ ID NO: 2895860 - DNA, 20 bp, Homo sapiens
tgactaaactacattataaa

SEQ ID NO: 2895861 - DNA, 20 bp, Homo sapiens
tgactaactagacaccaaag

SEQ ID NO: 2895862 - DNA, 19 bp, Homo sapiens
tgactaagccaagctgtgt

SEQ ID NO: 2895863 - DNA, 22 bp, Homo sapiens
tgactaagccaagctgtgttca

SEQ ID NO: 2895864 - DNA, 15 bp, Homo sapiens
tgactaatggcatga

SEQ ID NO: 2895865 - DNA, 15 bp, Homo sapiens
tgactaattgtataa

SEQ ID NO: 2895866 - DNA, 22 bp, Homo sapiens
tgactaattgtataacaggtta

SEQ ID NO: 2895867 - DNA, 23 bp, Homo sapiens
tgactaattgtataacaggttat

SEQ ID NO: 2895868 - DNA, 21 bp, Homo sapiens
tgactaattttacatgtttat

SEQ ID NO: 2895869 - DNA, 17 bp, Homo sapiens
tgactacagtcaggaaa

SEQ ID NO: 2895870 - DNA, 13 bp, Homo sapiens
tgactacctactg

SEQ ID NO: 2895871 - DNA, 13 bp, Homo sapiens
tgactagggagcc

SEQ ID NO: 2895872 - DNA, 17 bp, Homo sapiens
tgactagggagccatgt

SEQ ID NO: 2895873 - DNA, 17 bp, Homo sapiens
tgactaggttctgtaga

SEQ ID NO: 2895874 - DNA, 15 bp, Homo sapiens
tgactataaagctgt

SEQ ID NO: 2895875 - DNA, 21 bp, Homo sapiens
tctttccactcctcctagcca

SEQ ID NO: 2895876 - DNA, 22 bp, Homo sapiens
tctttccactcctcctagccac

SEQ ID NO: 2895877 - DNA, 19 bp, Homo sapiens
tctttccacttctctgggt

SEQ ID NO: 2895878 - DNA, 20 bp, Homo sapiens
tctttccattggatctcatt

SEQ ID NO: 2895879 - DNA, 14 bp, Homo sapiens
tctttcccaggacg

SEQ ID NO: 2895880 - DNA, 19 bp, Homo sapiens
tctttcccctcctttgtct

SEQ ID NO: 2895881 - DNA, 17 bp, Homo sapiens
tctttcctaaggctgca

SEQ ID NO: 2895882 - DNA, 21 bp, Homo sapiens
tctttcctcaagtatcttcta

SEQ ID NO: 2895883 - DNA, 13 bp, Homo sapiens
tctttcctgccct

SEQ ID NO: 2895884 - DNA, 17 bp, Homo sapiens
tctttcctgcccttttc

SEQ ID NO: 2895885 - DNA, 20 bp, Homo sapiens
tctttcctgcccttttcctg

SEQ ID NO: 2895886 - DNA, 22 bp, Homo sapiens
tctttcgttggttgtttctctg

SEQ ID NO: 2895887 - DNA, 15 bp, Homo sapiens
tctttctagtttgtt

SEQ ID NO: 2895888 - DNA, 14 bp, Homo sapiens
tctttctgtccctt

SEQ ID NO: 2895889 - DNA, 10 bp, Homo sapiens
tctttcttcc

SEQ ID NO: 2895890 - DNA, 18 bp, Homo sapiens
tctttcttcctccagtct

SEQ ID NO: 2895891 - DNA, 15 bp, Homo sapiens
tctttcttctcgcct

SEQ ID NO: 2895892 - DNA, 13 bp, Homo sapiens
tctttcttgtttg

SEQ ID NO: 2895893 - DNA, 21 bp, Homo sapiens
tctttcttgtttgtcagcatc

SEQ ID NO: 2895894 - DNA, 22 bp, Homo sapiens
tctttgaaagacttccaaagaa

SEQ ID NO: 2895895 - DNA, 17 bp, Homo sapiens
tctttgaattttctgtg

SEQ ID NO: 2895896 - DNA, 17 bp, Homo sapiens
tctttgactgtcagcaa

SEQ ID NO: 2895897 - DNA, 19 bp, Homo sapiens
tctttgatgttaacacatt

SEQ ID NO: 2895898 - DNA, 15 bp, Homo sapiens
tctttgatttaactg

SEQ ID NO: 2895899 - DNA, 15 bp, Homo sapiens
tctttgcaaagtatt

SEQ ID NO: 2895900 - DNA, 23 bp, Homo sapiens
tctttgcaaagtattgtaaatta

SEQ ID NO: 2895901 - DNA, 18 bp, Homo sapiens
tctttgccataactttat

SEQ ID NO: 2895902 - DNA, 12 bp, Homo sapiens
tctttgcctgtt

SEQ ID NO: 2895903 - DNA, 22 bp, Homo sapiens
tctttgctgcagtcatctactt

SEQ ID NO: 2895904 - DNA, 16 bp, Homo sapiens
tctttgctgcattcct

SEQ ID NO: 2895905 - DNA, 20 bp, Homo sapiens
tctttgctttgtagtttgct

SEQ ID NO: 2895906 - DNA, 22 bp, Homo sapiens
tctttgggaggtgtctgtgaag

SEQ ID NO: 2895907 - DNA, 15 bp, Homo sapiens
tctttggggaaaaat

SEQ ID NO: 2895908 - DNA, 19 bp, Homo sapiens
tctttggggaaaaattctt

SEQ ID NO: 2895909 - DNA, 15 bp, Homo sapiens
tctttggtaggtaaa

SEQ ID NO: 2895910 - DNA, 18 bp, Homo sapiens
tctttggtaggtaaatct

SEQ ID NO: 2895911 - DNA, 17 bp, Homo sapiens
tctttggtgtacagact

SEQ ID NO: 2895912 - DNA, 14 bp, Homo sapiens
tctttggttctaag

SEQ ID NO: 2895913 - DNA, 21 bp, Homo sapiens
tctttgtaagaactaaagaag

SEQ ID NO: 2895914 - DNA, 15 bp, Homo sapiens
tctttgtaataaaat

SEQ ID NO: 2895915 - DNA, 19 bp, Homo sapiens
tctttgtctaaaacaataa

SEQ ID NO: 2895916 - DNA, 20 bp, Homo sapiens
tctttgtctaaaacaataaa

SEQ ID NO: 2895917 - DNA, 21 bp, Homo sapiens
tctttgtgataattctcagta

SEQ ID NO: 2895918 - DNA, 22 bp, Homo sapiens
tctttgtggccaaggagctgct

SEQ ID NO: 2895919 - DNA, 13 bp, Homo sapiens
tctttgttcctgc

SEQ ID NO: 2895920 - DNA, 14 bp, Homo sapiens
tctttgttcctgct

SEQ ID NO: 2895921 - DNA, 13 bp, Homo sapiens
tcttttaaagact

SEQ ID NO: 2895922 - DNA, 19 bp, Homo sapiens
tcttttaaagactacctgg

SEQ ID NO: 2895923 - DNA, 19 bp, Homo sapiens
tcttttaatcatgagcctg

SEQ ID NO: 2895924 - DNA, 12 bp, Homo sapiens
tcttttacaact

SEQ ID NO: 2895925 - DNA, 19 bp, Homo sapiens
tcttttactaagacatagt

SEQ ID NO: 2895926 - DNA, 17 bp, Homo sapiens
tcttttagctgatgaac

SEQ ID NO: 2895927 - DNA, 16 bp, Homo sapiens
tcttttagttccaaca

SEQ ID NO: 2895928 - DNA, 19 bp, Homo sapiens
tcttttataactagtcctt

SEQ ID NO: 2895929 - DNA, 14 bp, Homo sapiens
tcttttatatttgt

SEQ ID NO: 2895930 - DNA, 14 bp, Homo sapiens
tcttttatttcatt

SEQ ID NO: 2895931 - DNA, 15 bp, Homo sapiens
tcttttcaattatat

SEQ ID NO: 2895932 - DNA, 19 bp, Homo sapiens
tcttttcacattcttataa

SEQ ID NO: 2895933 - DNA, 19 bp, Homo sapiens
tcttttcatctgggaaaga

SEQ ID NO: 2895934 - DNA, 22 bp, Homo sapiens
tcttttcatctgggaaagacat

SEQ ID NO: 2895935 - DNA, 14 bp, Homo sapiens
tcttttccagaaag

SEQ ID NO: 2895936 - DNA, 21 bp, Homo sapiens
tcttttcccctcattgcattt

SEQ ID NO: 2895937 - DNA, 11 bp, Homo sapiens
tcttttcctcg

SEQ ID NO: 2895938 - DNA, 15 bp, Homo sapiens
tcttttcctctctct

SEQ ID NO: 2895939 - DNA, 16 bp, Homo sapiens
tcttttctaaaagact

SEQ ID NO: 2895940 - DNA, 22 bp, Homo sapiens
tcttttctaagtggcgtgtgca

SEQ ID NO: 2895941 - DNA, 14 bp, Homo sapiens
tcttttctctgaaa

SEQ ID NO: 2895942 - DNA, 15 bp, Homo sapiens
tcttttcttcctggc

SEQ ID NO: 2895943 - DNA, 15 bp, Homo sapiens
tcttttctttagaga

SEQ ID NO: 2895944 - DNA, 21 bp, Homo sapiens
tcttttctttagagaactgaa

SEQ ID NO: 2895945 - DNA, 15 bp, Homo sapiens
tcttttgaaacaata

SEQ ID NO: 2895946 - DNA, 17 bp, Homo sapiens
tcttttgaattgttaca

SEQ ID NO: 2895947 - DNA, 22 bp, Homo sapiens
tcttttgacttaatctcatttg

SEQ ID NO: 2895948 - DNA, 13 bp, Homo sapiens
tcttttggcttcc

SEQ ID NO: 2895949 - DNA, 12 bp, Homo sapiens
tcttttgtaatt

SEQ ID NO: 2895950 - DNA, 15 bp, Homo sapiens
tcttttgtaatttaa

SEQ ID NO: 2895951 - DNA, 14 bp, Homo sapiens
tcttttgtttcatt

SEQ ID NO: 2895952 - DNA, 23 bp, Homo sapiens
tcttttgttttggtttggttttg

SEQ ID NO: 2895953 - DNA, 13 bp, Homo sapiens
tctttttaagaat

SEQ ID NO: 2895954 - DNA, 13 bp, Homo sapiens
tctttttaattat

SEQ ID NO: 2895955 - DNA, 15 bp, Homo sapiens
tctttttattcattg

SEQ ID NO: 2895956 - DNA, 13 bp, Homo sapiens
tctttttcaaaaa

SEQ ID NO: 2895957 - DNA, 14 bp, Homo sapiens
tctttttcaaaaat

SEQ ID NO: 2895958 - DNA, 15 bp, Homo sapiens
tctttttctcttctg

SEQ ID NO: 2895959 - DNA, 22 bp, Homo sapiens
tctttttgataagcacattaaa

SEQ ID NO: 2895960 - DNA, 13 bp, Homo sapiens
tctttttgtgtgc

SEQ ID NO: 2895961 - DNA, 17 bp, Homo sapiens
tctttttgtttcactgg

SEQ ID NO: 2895962 - DNA, 17 bp, Homo sapiens
tcttttttgtacagtat

SEQ ID NO: 2895963 - DNA, 15 bp, Homo sapiens
tctttttttcttggc

SEQ ID NO: 2895964 - DNA, 23 bp, Homo sapiens
tctttttttttttttttaaagaa

SEQ ID NO: 2895965 - DNA, 14 bp, Homo sapiens
tgaaaaaaaataga

SEQ ID NO: 2895966 - DNA, 21 bp, Homo sapiens
tgaaaaaagaagtttgggcta

SEQ ID NO: 2895967 - DNA, 20 bp, Homo sapiens
tgaaaaaagcaagattgaaa

SEQ ID NO: 2895968 - DNA, 21 bp, Homo sapiens
tgaaaaaagcaagattgaaat

SEQ ID NO: 2895969 - DNA, 22 bp, Homo sapiens
tgaaaaagcaacgggaaatgtg

SEQ ID NO: 2895970 - DNA, 14 bp, Homo sapiens
tgaaaaatgaaaga

SEQ ID NO: 2895971 - DNA, 18 bp, Homo sapiens
tgaaaaatgaaagatgat

SEQ ID NO: 2895972 - DNA, 13 bp, Homo sapiens
tgaaaacaaacaa

SEQ ID NO: 2895973 - DNA, 16 bp, Homo sapiens
tgaaaacactgtgcac

SEQ ID NO: 2895974 - DNA, 13 bp, Homo sapiens
tgaaaacagatat

SEQ ID NO: 2895975 - DNA, 18 bp, Homo sapiens
tgaaaacagatattacag

SEQ ID NO: 2895976 - DNA, 16 bp, Homo sapiens
tgaaaacccaaggcca

SEQ ID NO: 2895977 - DNA, 13 bp, Homo sapiens
tgaaaagaaataa

SEQ ID NO: 2895978 - DNA, 14 bp, Homo sapiens
tgaaaagaaataat

SEQ ID NO: 2895979 - DNA, 18 bp, Homo sapiens
tgaaaagacgctaataaa

SEQ ID NO: 2895980 - DNA, 13 bp, Homo sapiens
tgaaaagaggtgt

SEQ ID NO: 2895981 - DNA, 22 bp, Homo sapiens
tgaaaagaggtgtgcaagagag

SEQ ID NO: 2895982 - DNA, 19 bp, Homo sapiens
tgaaaagggtcagaaggat

SEQ ID NO: 2895983 - DNA, 17 bp, Homo sapiens
tgaaaataaagtgtata

SEQ ID NO: 2895984 - DNA, 13 bp, Homo sapiens
tgaaaataactga

SEQ ID NO: 2895985 - DNA, 18 bp, Homo sapiens
tgaaaataactgaaccaa

SEQ ID NO: 2895986 - DNA, 14 bp, Homo sapiens
tgaaaatacatttc

SEQ ID NO: 2895987 - DNA, 16 bp, Homo sapiens
tgaaaatataaccagc

SEQ ID NO: 2895988 - DNA, 18 bp, Homo sapiens
tgaaaatatctgctcaaa

SEQ ID NO: 2895989 - DNA, 16 bp, Homo sapiens
tgaaaatattctgatt

SEQ ID NO: 2895990 - DNA, 20 bp, Homo sapiens
tgaaaatattctgattggtc

SEQ ID NO: 2895991 - DNA, 22 bp, Homo sapiens
tgaaaatattctgattggtctg

SEQ ID NO: 2895992 - DNA, 14 bp, Homo sapiens
tgaaaatatttaaa

SEQ ID NO: 2895993 - DNA, 23 bp, Homo sapiens
tgaaaatattttttatatataca

SEQ ID NO: 2895994 - DNA, 11 bp, Homo sapiens
tgaaaatgaag

SEQ ID NO: 2895995 - DNA, 14 bp, Homo sapiens
tgaaaatgaagaag

SEQ ID NO: 2895996 - DNA, 16 bp, Homo sapiens
tgaaaatgtatttcct

SEQ ID NO: 2895997 - DNA, 14 bp, Homo sapiens
tgaaaatgtcttgt

SEQ ID NO: 2895998 - DNA, 15 bp, Homo sapiens
tgaaaattatttgaa

SEQ ID NO: 2895999 - DNA, 15 bp, Homo sapiens
tgaaaattgtataaa

SEQ ID NO: 2896000 - DNA, 21 bp, Homo sapiens
tgaacttcgcatcaaaagaca

SEQ ID NO: 2896001 - DNA, 17 bp, Homo sapiens
tgaactttgggaagcct

SEQ ID NO: 2896002 - DNA, 18 bp, Homo sapiens
tgaactttgggaagcctt

SEQ ID NO: 2896003 - DNA, 21 bp, Homo sapiens
tgaagaaaccttcagatttgt

SEQ ID NO: 2896004 - DNA, 13 bp, Homo sapiens
tgaagaaacgctt

SEQ ID NO: 2896005 - DNA, 21 bp, Homo sapiens
tgaagaaatccaatcctagcc

SEQ ID NO: 2896006 - DNA, 20 bp, Homo sapiens
tgaagaaattataaagataa

SEQ ID NO: 2896007 - DNA, 14 bp, Homo sapiens
tgaagaacatgtga

SEQ ID NO: 2896008 - DNA, 19 bp, Homo sapiens
tgaagaaccagtcccccca

SEQ ID NO: 2896009 - DNA, 13 bp, Homo sapiens
tgaagaagccctg

SEQ ID NO: 2896010 - DNA, 14 bp, Homo sapiens
tgaagaagccctgt

SEQ ID NO: 2896011 - DNA, 15 bp, Homo sapiens
tgaagaagccctgtt

SEQ ID NO: 2896012 - DNA, 19 bp, Homo sapiens
tgaagaaggaagctgtgtt

SEQ ID NO: 2896013 - DNA, 22 bp, Homo sapiens
tgaagaaggaagctgtgttgaa

SEQ ID NO: 2896014 - DNA, 23 bp, Homo sapiens
tgaagaaggaagctgtgttgaaa

SEQ ID NO: 2896015 - DNA, 21 bp, Homo sapiens
tgaagaatccttttgtagaat

SEQ ID NO: 2896016 - DNA, 13 bp, Homo sapiens
tgaagaatgttaa

SEQ ID NO: 2896017 - DNA, 19 bp, Homo sapiens
tgaagaattgccaatcttg

SEQ ID NO: 2896018 - DNA, 20 bp, Homo sapiens
tgaagaattgccaatcttgt

SEQ ID NO: 2896019 - DNA, 19 bp, Homo sapiens
tctgcagccagcccagccc

SEQ ID NO: 2896020 - DNA, 15 bp, Homo sapiens
tctgcagccctgaga

SEQ ID NO: 2896021 - DNA, 23 bp, Homo sapiens
tctgcaggcctaggtgcagctcc

SEQ ID NO: 2896022 - DNA, 15 bp, Homo sapiens
tctgcaggtgagcag

SEQ ID NO: 2896023 - DNA, 21 bp, Homo sapiens
tctgcaggtgagcagacagga

SEQ ID NO: 2896024 - DNA, 18 bp, Homo sapiens
tctgcagtcgcttgccaa

SEQ ID NO: 2896025 - DNA, 21 bp, Homo sapiens
tctgcagtcgcttgccaaagc

SEQ ID NO: 2896026 - DNA, 22 bp, Homo sapiens
tctgcatgtaaaatcttcagct

SEQ ID NO: 2896027 - DNA, 23 bp, Homo sapiens
tctgcatgtaaaatcttcagctg

SEQ ID NO: 2896028 - DNA, 18 bp, Homo sapiens
tctgcattgcccagtctt

SEQ ID NO: 2896029 - DNA, 18 bp, Homo sapiens
tctgcatttcggtggcta

SEQ ID NO: 2896030 - DNA, 19 bp, Homo sapiens
tctgcatttcggtggctag

SEQ ID NO: 2896031 - DNA, 18 bp, Homo sapiens
tctgcatttttctgcaga

SEQ ID NO: 2896032 - DNA, 14 bp, Homo sapiens
tctgccaatctgta

SEQ ID NO: 2896033 - DNA, 20 bp, Homo sapiens
tctgccaatctgtacaaaat

SEQ ID NO: 2896034 - DNA, 20 bp, Homo sapiens
tctgccacaaaaatgttcac

SEQ ID NO: 2896035 - DNA, 15 bp, Homo sapiens
tctgccaggagacag

SEQ ID NO: 2896036 - DNA, 22 bp, Homo sapiens
tctcaatttatttggggggaaa

SEQ ID NO: 2896037 - DNA, 12 bp, Homo sapiens
tctcaattttgt

SEQ ID NO: 2896038 - DNA, 13 bp, Homo sapiens
tctcaattttgta

SEQ ID NO: 2896039 - DNA, 15 bp, Homo sapiens
tctcaattttgtatt

SEQ ID NO: 2896040 - DNA, 11 bp, Homo sapiens
tctcacactcc

SEQ ID NO: 2896041 - DNA, 14 bp, Homo sapiens
tctcacactcctcc

SEQ ID NO: 2896042 - DNA, 16 bp, Homo sapiens
tctcacactcctcctg

SEQ ID NO: 2896043 - DNA, 20 bp, Homo sapiens
tctcacactcctcctgccag

SEQ ID NO: 2896044 - DNA, 21 bp, Homo sapiens
tctcacactcctcctgccagc

SEQ ID NO: 2896045 - DNA, 21 bp, Homo sapiens
tctcacactggttctcaatga

SEQ ID NO: 2896046 - DNA, 23 bp, Homo sapiens
tctcacactggttctcaatgaaa

SEQ ID NO: 2896047 - DNA, 16 bp, Homo sapiens
tctcaccagctgcaaa

SEQ ID NO: 2896048 - DNA, 19 bp, Homo sapiens
tctcaccagctgcaaagtg

SEQ ID NO: 2896049 - DNA, 13 bp, Homo sapiens
tctcaccccaagc

SEQ ID NO: 2896050 - DNA, 16 bp, Homo sapiens
tctcaccttccaaatc

SEQ ID NO: 2896051 - DNA, 16 bp, Homo sapiens
tctcacgccacccccg

SEQ ID NO: 2896052 - DNA, 19 bp, Homo sapiens
tctcactagttgtcagctt

SEQ ID NO: 2896053 - DNA, 17 bp, Homo sapiens
tctcactatgtttctca

SEQ ID NO: 2896054 - DNA, 19 bp, Homo sapiens
tctcactatgtttctcaga

SEQ ID NO: 2896055 - DNA, 13 bp, Homo sapiens
tctcactccacca

SEQ ID NO: 2896056 - DNA, 14 bp, Homo sapiens
tctcactccaccac

SEQ ID NO: 2896057 - DNA, 15 bp, Homo sapiens
tctcactccaccacc

SEQ ID NO: 2896058 - DNA, 18 bp, Homo sapiens
tctcactccaccacccaa

SEQ ID NO: 2896059 - DNA, 20 bp, Homo sapiens
tctcactctgttgcccaggc

SEQ ID NO: 2896060 - DNA, 20 bp, Homo sapiens
tctcactgccatcaaactgt

SEQ ID NO: 2896061 - DNA, 12 bp, Homo sapiens
tctcagaaaact

SEQ ID NO: 2896062 - DNA, 17 bp, Homo sapiens
tctcagagcactgtgtt

SEQ ID NO: 2896063 - DNA, 19 bp, Homo sapiens
tctcagagcactgtgttca

SEQ ID NO: 2896064 - DNA, 14 bp, Homo sapiens
tctcagatccttgt

SEQ ID NO: 2896065 - DNA, 17 bp, Homo sapiens
tctcagatccttgtttc

SEQ ID NO: 2896066 - DNA, 18 bp, Homo sapiens
tctcagatccttgtttca

SEQ ID NO: 2896067 - DNA, 19 bp, Homo sapiens
tctcagatccttgtttcaa

SEQ ID NO: 2896068 - DNA, 16 bp, Homo sapiens
tctcagctcccaggcc

SEQ ID NO: 2896069 - DNA, 17 bp, Homo sapiens
tctcagctcccaggcca

SEQ ID NO: 2896070 - DNA, 20 bp, Homo sapiens
tctcaggacagtgatgttgg

SEQ ID NO: 2896071 - DNA, 23 bp, Homo sapiens
tctcaggaccaaagctttcatgt

SEQ ID NO: 2896072 - DNA, 23 bp, Homo sapiens
tctcaggctgtcccaagctccca

SEQ ID NO: 2896073 - DNA, 13 bp, Homo sapiens
tctccttcttagc

SEQ ID NO: 2896074 - DNA, 23 bp, Homo sapiens
tctccttgctcctggccttgctg

SEQ ID NO: 2896075 - DNA, 22 bp, Homo sapiens
tctcctttgaagtgggaaagca

SEQ ID NO: 2896076 - DNA, 23 bp, Homo sapiens
tctcctttggcatgtttaattgt

SEQ ID NO: 2896077 - DNA, 17 bp, Homo sapiens
tctccttttgaacttgt

SEQ ID NO: 2896078 - DNA, 15 bp, Homo sapiens
tctcgaactcctgac

SEQ ID NO: 2896079 - DNA, 15 bp, Homo sapiens
tctcgaactcctggc

SEQ ID NO: 2896080 - DNA, 12 bp, Homo sapiens
tctcgactgctt

SEQ ID NO: 2896081 - DNA, 14 bp, Homo sapiens
tctcgatgcaatga

SEQ ID NO: 2896082 - DNA, 13 bp, Homo sapiens
tctcgatgctgct

SEQ ID NO: 2896083 - DNA, 22 bp, Homo sapiens
tctcgatgctgctggcctccct

SEQ ID NO: 2896084 - DNA, 12 bp, Homo sapiens
tctcgcctggaa

SEQ ID NO: 2896085 - DNA, 16 bp, Homo sapiens
tctcgcctggaaacag

SEQ ID NO: 2896086 - DNA, 17 bp, Homo sapiens
tctcgccttcctgcagt

SEQ ID NO: 2896087 - DNA, 15 bp, Homo sapiens
tctcgctccctccca

SEQ ID NO: 2896088 - DNA, 17 bp, Homo sapiens
tctcgctctgttgccca

SEQ ID NO: 2896089 - DNA, 21 bp, Homo sapiens
tctcggccccctcaccccagc

SEQ ID NO: 2896090 - DNA, 14 bp, Homo sapiens
tctcggctcagtgc

SEQ ID NO: 2896091 - DNA, 16 bp, Homo sapiens
tctcggctcagtgcaa

SEQ ID NO: 2896092 - DNA, 20 bp, Homo sapiens
tctcggcttggatcctgggc

SEQ ID NO: 2896093 - DNA, 16 bp, Homo sapiens
tctcggggtccagtgc

SEQ ID NO: 2896094 - DNA, 17 bp, Homo sapiens
tctcggggtccagtgca

SEQ ID NO: 2896095 - DNA, 19 bp, Homo sapiens
tctcggttgaaacctgtat

SEQ ID NO: 2896096 - DNA, 17 bp, Homo sapiens
tctcgtcaggctgccag

SEQ ID NO: 2896097 - DNA, 18 bp, Homo sapiens
tctcgtcaggctgccaga

SEQ ID NO: 2896098 - DNA, 14 bp, Homo sapiens
tctcgttgcctctg

SEQ ID NO: 2896099 - DNA, 14 bp, Homo sapiens
tctcgtttgtgatt

SEQ ID NO: 2896100 - DNA, 22 bp, Homo sapiens
tctctaaagagtttattttaag

SEQ ID NO: 2896101 - DNA, 22 bp, Homo sapiens
tctctaactcagaaacatcagt

SEQ ID NO: 2896102 - DNA, 16 bp, Homo sapiens
tctctaataagaaaac

SEQ ID NO: 2896103 - DNA, 17 bp, Homo sapiens
tctctacaaaaaataaa

SEQ ID NO: 2896104 - DNA, 20 bp, Homo sapiens
tctctacaaaaaataaaata

SEQ ID NO: 2896105 - DNA, 13 bp, Homo sapiens
tctctaccagata

SEQ ID NO: 2896106 - DNA, 20 bp, Homo sapiens
tctctactaaaaataagaaa

SEQ ID NO: 2896107 - DNA, 22 bp, Homo sapiens
tctctaggaccatggttaagag

SEQ ID NO: 2896108 - DNA, 12 bp, Homo sapiens
tctctagtagtt

SEQ ID NO: 2896109 - DNA, 18 bp, Homo sapiens
tctctagtagttaaaaaa

SEQ ID NO: 2896110 - DNA, 13 bp, Homo sapiens
tctctatcattaa

SEQ ID NO: 2896111 - DNA, 15 bp, Homo sapiens
tctctatcattaaag

SEQ ID NO: 2896112 - DNA, 16 bp, Homo sapiens
tctctatcattaaagt

SEQ ID NO: 2896113 - DNA, 13 bp, Homo sapiens
tctctatgtgaat

SEQ ID NO: 2896114 - DNA, 15 bp, Homo sapiens
tctctatgtgaatat

SEQ ID NO: 2896115 - DNA, 13 bp, Homo sapiens
tctctattgtaat

SEQ ID NO: 2896116 - DNA, 19 bp, Homo sapiens
tctctattgtaattttgtt

SEQ ID NO: 2896117 - DNA, 22 bp, Homo sapiens
tctctcaaacggcaacattcct

SEQ ID NO: 2896118 - DNA, 19 bp, Homo sapiens
tctctcagccccatcgccc

SEQ ID NO: 2896119 - DNA, 20 bp, Homo sapiens
tctctcatatcactgaagga

SEQ ID NO: 2896120 - DNA, 21 bp, Homo sapiens
tctctccacttctggtcccct

SEQ ID NO: 2896121 - DNA, 13 bp, Homo sapiens
tctctccagatgt

SEQ ID NO: 2896122 - DNA, 13 bp, Homo sapiens
tctctccagcctc

SEQ ID NO: 2896123 - DNA, 20 bp, Homo sapiens
tctctccagcctcacagatg

SEQ ID NO: 2896124 - DNA, 16 bp, Homo sapiens
tctctccccctctgtc

SEQ ID NO: 2896125 - DNA, 15 bp, Homo sapiens
tctctccctctttct

SEQ ID NO: 2896126 - DNA, 23 bp, Homo sapiens
tctctcccttacccatcttgctt

SEQ ID NO: 2896127 - DNA, 14 bp, Homo sapiens
tctctcctgcggga

SEQ ID NO: 2896128 - DNA, 13 bp, Homo sapiens
tctctcctggact

SEQ ID NO: 2896129 - DNA, 14 bp, Homo sapiens
tctctcctggactg

SEQ ID NO: 2896130 - DNA, 15 bp, Homo sapiens
tctctcctggactgg

SEQ ID NO: 2896131 - DNA, 13 bp, Homo sapiens
tctctccttcctc

SEQ ID NO: 2896132 - DNA, 19 bp, Homo sapiens
tctctccttgttgccccca

SEQ ID NO: 2896133 - DNA, 13 bp, Homo sapiens
tctctcgttaatt

SEQ ID NO: 2896134 - DNA, 22 bp, Homo sapiens
tctctctatgcaaaatgtctgt

SEQ ID NO: 2896135 - DNA, 16 bp, Homo sapiens
tctctctgcctgctgg

SEQ ID NO: 2896136 - DNA, 17 bp, Homo sapiens
tctctctgcctgctggg

SEQ ID NO: 2896137 - DNA, 14 bp, Homo sapiens
tctctctggagccc

SEQ ID NO: 2896138 - DNA, 12 bp, Homo sapiens
tctctctgtggt

SEQ ID NO: 2896139 - DNA, 18 bp, Homo sapiens
tctctcttgtcacatgga

SEQ ID NO: 2896140 - DNA, 23 bp, Homo sapiens
tctctgaagagtgggtttcacaa

SEQ ID NO: 2896141 - DNA, 21 bp, Homo sapiens
tctctgacaatgcgtggcaca

SEQ ID NO: 2896142 - DNA, 13 bp, Homo sapiens
tctctgagatttt

SEQ ID NO: 2896143 - DNA, 18 bp, Homo sapiens
tctctgagctggggaggt

SEQ ID NO: 2896144 - DNA, 15 bp, Homo sapiens
tctctgagctttgtt

SEQ ID NO: 2896145 - DNA, 16 bp, Homo sapiens
tctctgagctttgtta

SEQ ID NO: 2896146 - DNA, 17 bp, Homo sapiens
tctctgagtacattgtg

SEQ ID NO: 2896147 - DNA, 22 bp, Homo sapiens
tctctgagtgtctctgcctgga

SEQ ID NO: 2896148 - DNA, 16 bp, Homo sapiens
tctctgcagccagccc

SEQ ID NO: 2896149 - DNA, 20 bp, Homo sapiens
tctctgcagccagcccagcc

SEQ ID NO: 2896150 - DNA, 20 bp, Homo sapiens
tctctgcatttttctgcaga

SEQ ID NO: 2896151 - DNA, 13 bp, Homo sapiens
tctctgcccaacc

SEQ ID NO: 2896152 - DNA, 13 bp, Homo sapiens
tctctgcccagcc

SEQ ID NO: 2896153 - DNA, 23 bp, Homo sapiens
tctctgcccctaaagatgggagg

SEQ ID NO: 2896154 - DNA, 22 bp, Homo sapiens
tctctgccccttaaatcacaca

SEQ ID NO: 2896155 - DNA, 22 bp, Homo sapiens
tctctgccgctacctccctccc

SEQ ID NO: 2896156 - DNA, 21 bp, Homo sapiens
tctctgcctagaatctttatt

SEQ ID NO: 2896157 - DNA, 14 bp, Homo sapiens
tctctgcctgctgg

SEQ ID NO: 2896158 - DNA, 15 bp, Homo sapiens
tctctgcctgctggg

SEQ ID NO: 2896159 - DNA, 17 bp, Homo sapiens
tctctgcctgctgggct

SEQ ID NO: 2896160 - DNA, 18 bp, Homo sapiens
tctctgcctgctgggctc

SEQ ID NO: 2896161 - DNA, 17 bp, Homo sapiens
tctctgcctggagcagg

SEQ ID NO: 2896162 - DNA, 12 bp, Homo sapiens
tctctgccttgc

SEQ ID NO: 2896163 - DNA, 12 bp, Homo sapiens
tctctgctccag

SEQ ID NO: 2896164 - DNA, 14 bp, Homo sapiens
tctctgctccagca

SEQ ID NO: 2896165 - DNA, 23 bp, Homo sapiens
tctctgctctgcgtgtcacctgt

SEQ ID NO: 2896166 - DNA, 23 bp, Homo sapiens
tctctggaagaggaaccaggaga

SEQ ID NO: 2896167 - DNA, 12 bp, Homo sapiens
tctctggagccc

SEQ ID NO: 2896168 - DNA, 14 bp, Homo sapiens
tctctggagcccct

SEQ ID NO: 2896169 - DNA, 17 bp, Homo sapiens
tctctggcgacagtttt

SEQ ID NO: 2896170 - DNA, 13 bp, Homo sapiens
tctctggctcagc

SEQ ID NO: 2896171 - DNA, 15 bp, Homo sapiens
tctctggctcagctg

SEQ ID NO: 2896172 - DNA, 22 bp, Homo sapiens
tctctgggtttacaacaaacac

SEQ ID NO: 2896173 - DNA, 19 bp, Homo sapiens
tctctggtgttctctggct

SEQ ID NO: 2896174 - DNA, 16 bp, Homo sapiens
tctctgtcagtgtgaa

SEQ ID NO: 2896175 - DNA, 17 bp, Homo sapiens
tctctgtcagtgtgaaa

SEQ ID NO: 2896176 - DNA, 19 bp, Homo sapiens
tctctgtcccttgctgtat

SEQ ID NO: 2896177 - DNA, 12 bp, Homo sapiens
tctctgtctcat

SEQ ID NO: 2896178 - DNA, 15 bp, Homo sapiens
tctctgtctcatcca

SEQ ID NO: 2896179 - DNA, 16 bp, Homo sapiens
tctctgtctcatccat

SEQ ID NO: 2896180 - DNA, 19 bp, Homo sapiens
tctctgtcttctctccact

SEQ ID NO: 2896181 - DNA, 13 bp, Homo sapiens
ctttcatcctgtg

SEQ ID NO: 2896182 - DNA, 19 bp, Homo sapiens
ctttcatgtaaactgtgca

SEQ ID NO: 2896183 - DNA, 17 bp, Homo sapiens
ctttccaacgtttggaa

SEQ ID NO: 2896184 - DNA, 19 bp, Homo sapiens
ctttccactcccactgcca

SEQ ID NO: 2896185 - DNA, 18 bp, Homo sapiens
ctttccactcctcctagc

SEQ ID NO: 2896186 - DNA, 16 bp, Homo sapiens
ctttccagctactttt

SEQ ID NO: 2896187 - DNA, 16 bp, Homo sapiens
ctttccagcttagaat

SEQ ID NO: 2896188 - DNA, 15 bp, Homo sapiens
ctttccatctgtcca

SEQ ID NO: 2896189 - DNA, 23 bp, Homo sapiens
ctttccattttctataagaaaaa

SEQ ID NO: 2896190 - DNA, 15 bp, Homo sapiens
ctttcccaagccttc

SEQ ID NO: 2896191 - DNA, 12 bp, Homo sapiens
ctttcccaggac

SEQ ID NO: 2896192 - DNA, 13 bp, Homo sapiens
ctttcccaggacg

SEQ ID NO: 2896193 - DNA, 18 bp, Homo sapiens
ctttccccagcctctcct

SEQ ID NO: 2896194 - DNA, 19 bp, Homo sapiens
ctttcccccaccagctaag

SEQ ID NO: 2896195 - DNA, 15 bp, Homo sapiens
ctttcccccaggaaa

SEQ ID NO: 2896196 - DNA, 12 bp, Homo sapiens
ctttcccctcct

SEQ ID NO: 2896197 - DNA, 18 bp, Homo sapiens
ctttcccctcctttgtct

SEQ ID NO: 2896198 - DNA, 18 bp, Homo sapiens
ctttccccttccttttaa

SEQ ID NO: 2896199 - DNA, 20 bp, Homo sapiens
ctttcccttttccatttgaa

SEQ ID NO: 2896200 - DNA, 21 bp, Homo sapiens
ctttccgtcaacgttgtactg

SEQ ID NO: 2896201 - DNA, 17 bp, Homo sapiens
ctttccgtggcactgca

SEQ ID NO: 2896202 - DNA, 20 bp, Homo sapiens
ctttcctaagacctggggtt

SEQ ID NO: 2896203 - DNA, 17 bp, Homo sapiens
ctttcctaaggctgcaa

SEQ ID NO: 2896204 - DNA, 15 bp, Homo sapiens
ctttcctactttcta

SEQ ID NO: 2896205 - DNA, 13 bp, Homo sapiens
ctttcctatcacc

SEQ ID NO: 2896206 - DNA, 15 bp, Homo sapiens
cttgtgccagcccgg

SEQ ID NO: 2896207 - DNA, 19 bp, Homo sapiens
cttgtgccatagtcacatg

SEQ ID NO: 2896208 - DNA, 12 bp, Homo sapiens
cttgtgcctccc

SEQ ID NO: 2896209 - DNA, 14 bp, Homo sapiens
cttgtgcctggggt

SEQ ID NO: 2896210 - DNA, 15 bp, Homo sapiens
cttgtgctcatgtgt

SEQ ID NO: 2896211 - DNA, 18 bp, Homo sapiens
cttgtgtaatttatgtga

SEQ ID NO: 2896212 - DNA, 14 bp, Homo sapiens
cttgtgtatccatt

SEQ ID NO: 2896213 - DNA, 16 bp, Homo sapiens
cttgtgtatccattat

SEQ ID NO: 2896214 - DNA, 18 bp, Homo sapiens
cttgtgtatttctctgtg

SEQ ID NO: 2896215 - DNA, 12 bp, Homo sapiens
cttgtgtctgta

SEQ ID NO: 2896216 - DNA, 17 bp, Homo sapiens
cttgtgtgtcaggccct

SEQ ID NO: 2896217 - DNA, 21 bp, Homo sapiens
cttgtgtgtcaggccctctgc

SEQ ID NO: 2896218 - DNA, 17 bp, Homo sapiens
cttgtgttcatgtggag

SEQ ID NO: 2896219 - DNA, 11 bp, Homo sapiens
cttgtgttcct

SEQ ID NO: 2896220 - DNA, 15 bp, Homo sapiens
cttgtgttccttctg

SEQ ID NO: 2896221 - DNA, 17 bp, Homo sapiens
cttgtgttccttctgtg

SEQ ID NO: 2896222 - DNA, 23 bp, Homo sapiens
cttgtgttccttctgtgaagaag

SEQ ID NO: 2896223 - DNA, 17 bp, Homo sapiens
cttgtgtttaagcacca

SEQ ID NO: 2896224 - DNA, 15 bp, Homo sapiens
cttgttattattgtt

SEQ ID NO: 2896225 - DNA, 15 bp, Homo sapiens
cttgttcatttctgt

SEQ ID NO: 2896226 - DNA, 16 bp, Homo sapiens
cttgttcatttctgtc

SEQ ID NO: 2896227 - DNA, 18 bp, Homo sapiens
cttgttcatttctgtctc

SEQ ID NO: 2896228 - DNA, 15 bp, Homo sapiens
cttgttccaaggcca

SEQ ID NO: 2896229 - DNA, 18 bp, Homo sapiens
cttgttgctttgttgcac

SEQ ID NO: 2896230 - DNA, 13 bp, Homo sapiens
cttgttgtttata

SEQ ID NO: 2896231 - DNA, 21 bp, Homo sapiens
cttgttgtttgttgacagctt

SEQ ID NO: 2896232 - DNA, 15 bp, Homo sapiens
cttgtttaaaaaaag

SEQ ID NO: 2896233 - DNA, 16 bp, Homo sapiens
cttgtttatgatattt

SEQ ID NO: 2896234 - DNA, 23 bp, Homo sapiens
cttgtttatgatatttcttgctt

SEQ ID NO: 2896235 - DNA, 19 bp, Homo sapiens
cttgtttgctcacctgggg

SEQ ID NO: 2896236 - DNA, 19 bp, Homo sapiens
cttgtttggtagttagcca

SEQ ID NO: 2896237 - DNA, 12 bp, Homo sapiens
cttgtttgtcag

SEQ ID NO: 2896238 - DNA, 14 bp, Homo sapiens
cttgtttgtcagca

SEQ ID NO: 2896239 - DNA, 17 bp, Homo sapiens
cttgtttgtcagcatct

SEQ ID NO: 2896240 - DNA, 15 bp, Homo sapiens
cccgcagcctggcat

SEQ ID NO: 2896241 - DNA, 19 bp, Homo sapiens
cccgcagtgtgcactaagg

SEQ ID NO: 2896242 - DNA, 12 bp, Homo sapiens
cccgcccccacc

SEQ ID NO: 2896243 - DNA, 17 bp, Homo sapiens
cccgccccctgccctcc

SEQ ID NO: 2896244 - DNA, 14 bp, Homo sapiens
cccgccccgggctg

SEQ ID NO: 2896245 - DNA, 19 bp, Homo sapiens
cccgccccgggctggccct

SEQ ID NO: 2896246 - DNA, 23 bp, Homo sapiens
cccgccccgggctggccctgtgc

SEQ ID NO: 2896247 - DNA, 14 bp, Homo sapiens
cccgcccgcacagc

SEQ ID NO: 2896248 - DNA, 13 bp, Homo sapiens
cccgccctcaggc

SEQ ID NO: 2896249 - DNA, 11 bp, Homo sapiens
cccgccctctc

SEQ ID NO: 2896250 - DNA, 16 bp, Homo sapiens
cccgccgatagaggga

SEQ ID NO: 2896251 - DNA, 18 bp, Homo sapiens
cccgcctgcccacctgcc

SEQ ID NO: 2896252 - DNA, 12 bp, Homo sapiens
cccgcctgcctc

SEQ ID NO: 2896253 - DNA, 16 bp, Homo sapiens
cccgcctgcctcctgg

SEQ ID NO: 2896254 - DNA, 13 bp, Homo sapiens
cccgcctgcctgc

SEQ ID NO: 2896255 - DNA, 16 bp, Homo sapiens
cccgcctgcctgccac

SEQ ID NO: 2896256 - DNA, 14 bp, Homo sapiens
cccgccttccctca

SEQ ID NO: 2896257 - DNA, 19 bp, Homo sapiens
cccgccttccctcactctt

SEQ ID NO: 2896258 - DNA, 13 bp, Homo sapiens
cccgcggcccaga

SEQ ID NO: 2896259 - DNA, 15 bp, Homo sapiens
cccgcgggcacagcc

SEQ ID NO: 2896260 - DNA, 17 bp, Homo sapiens
cccgctcagcccagctg

SEQ ID NO: 2896261 - DNA, 19 bp, Homo sapiens
cccgctccgtctctgtcct

SEQ ID NO: 2896262 - DNA, 16 bp, Homo sapiens
cccgctgctgtgcaac

SEQ ID NO: 2896263 - DNA, 16 bp, Homo sapiens
cccgcttagcgctctg

SEQ ID NO: 2896264 - DNA, 19 bp, Homo sapiens
cccggaattccgtcaccac

SEQ ID NO: 2896265 - DNA, 13 bp, Homo sapiens
cccggacctctgg

SEQ ID NO: 2896266 - DNA, 15 bp, Homo sapiens
cccggattggccctg

SEQ ID NO: 2896267 - DNA, 17 bp, Homo sapiens
cccggattggccctgcc

SEQ ID NO: 2896268 - DNA, 20 bp, Homo sapiens
cccggattggccctgcccct

SEQ ID NO: 2896269 - DNA, 22 bp, Homo sapiens
cccggattggccctgcccctcc

SEQ ID NO: 2896270 - DNA, 20 bp, Homo sapiens
cccggcccctcaccctctgt

SEQ ID NO: 2896271 - DNA, 21 bp, Homo sapiens
cccggcgcctgccctgcccaa

SEQ ID NO: 2896272 - DNA, 17 bp, Homo sapiens
cccggcggccctgctga

SEQ ID NO: 2896273 - DNA, 17 bp, Homo sapiens
cccggctaatttttgta

SEQ ID NO: 2896274 - DNA, 14 bp, Homo sapiens
cccggctcggccca

SEQ ID NO: 2896275 - DNA, 15 bp, Homo sapiens
cccggctgggcctcc

SEQ ID NO: 2896276 - DNA, 16 bp, Homo sapiens
cccgggaagcatcctc

SEQ ID NO: 2896277 - DNA, 19 bp, Homo sapiens
cccgggaagcatcctcccc

SEQ ID NO: 2896278 - DNA, 23 bp, Homo sapiens
cccgggaagcatcctccccacca

SEQ ID NO: 2896279 - DNA, 13 bp, Homo sapiens
cccgggaaggaag

SEQ ID NO: 2896280 - DNA, 15 bp, Homo sapiens
cccgggctggccctg

SEQ ID NO: 2896281 - DNA, 17 bp, Homo sapiens
cccgggctggccctgtg

SEQ ID NO: 2896282 - DNA, 13 bp, Homo sapiens
cccggggcccagg

SEQ ID NO: 2896283 - DNA, 21 bp, Homo sapiens
cccggggtccccgccctctct

SEQ ID NO: 2896284 - DNA, 23 bp, Homo sapiens
cccggggtccccgccctctctca

SEQ ID NO: 2896285 - DNA, 22 bp, Homo sapiens
cccgggttcacgccattctcct

SEQ ID NO: 2896286 - DNA, 13 bp, Homo sapiens
cccggtgctccct

SEQ ID NO: 2896287 - DNA, 16 bp, Homo sapiens
cccggtgctccctctg

SEQ ID NO: 2896288 - DNA, 12 bp, Homo sapiens
cccgtcctcctc

SEQ ID NO: 2896289 - DNA, 16 bp, Homo sapiens
cccgtcggagctgcct

SEQ ID NO: 2896290 - DNA, 13 bp, Homo sapiens
cccgtcgtgtgct

SEQ ID NO: 2896291 - DNA, 23 bp, Homo sapiens
cccgtctgtgtgtgacccctcct

SEQ ID NO: 2896292 - DNA, 22 bp, Homo sapiens
cccgtgacagactcctgaggac

SEQ ID NO: 2896293 - DNA, 13 bp, Homo sapiens
cccgtgcctgggc

SEQ ID NO: 2896294 - DNA, 21 bp, Homo sapiens
cccgtgcctgggcccctcccc

SEQ ID NO: 2896295 - DNA, 15 bp, Homo sapiens
cccgtggcctggcat

SEQ ID NO: 2896296 - DNA, 20 bp, Homo sapiens
cccgtggcttggcatctgtg

SEQ ID NO: 2896297 - DNA, 22 bp, Homo sapiens
cccgtggcttggcatctgtgtg

SEQ ID NO: 2896298 - DNA, 12 bp, Homo sapiens
cccgttttcccc

SEQ ID NO: 2896299 - DNA, 16 bp, Homo sapiens
cccgttttccccatga

SEQ ID NO: 2896300 - DNA, 14 bp, Homo sapiens
ccctaacaggctgt

SEQ ID NO: 2896301 - DNA, 20 bp, Homo sapiens
ccctaaggcatgtgtgaaac

SEQ ID NO: 2896302 - DNA, 21 bp, Homo sapiens
ccctaagtgatttccacaggt

SEQ ID NO: 2896303 - DNA, 21 bp, Homo sapiens
ccctaattcagccatgtacag

SEQ ID NO: 2896304 - DNA, 22 bp, Homo sapiens
ccctaattcagccatgtacaga

SEQ ID NO: 2896305 - DNA, 16 bp, Homo sapiens
ccctaattcatctttt

SEQ ID NO: 2896306 - DNA, 17 bp, Homo sapiens
ccctaccacctccccag

SEQ ID NO: 2896307 - DNA, 19 bp, Homo sapiens
ccctaccacctccccagcc

SEQ ID NO: 2896308 - DNA, 14 bp, Homo sapiens
ccctaccccctcat

SEQ ID NO: 2896309 - DNA, 16 bp, Homo sapiens
ccctaccccctcatcc

SEQ ID NO: 2896310 - DNA, 21 bp, Homo sapiens
ccctaccccctcatcccccag

SEQ ID NO: 2896311 - DNA, 20 bp, Homo sapiens
ccctaccgcatggcagctgg

SEQ ID NO: 2896312 - DNA, 17 bp, Homo sapiens
ccctagaaacttccaaa

SEQ ID NO: 2896313 - DNA, 15 bp, Homo sapiens
ccctagaaaggagag

SEQ ID NO: 2896314 - DNA, 16 bp, Homo sapiens
ccctagaaaggagaga

SEQ ID NO: 2896315 - DNA, 15 bp, Homo sapiens
ccctagactctgtaa

SEQ ID NO: 2896316 - DNA, 23 bp, Homo sapiens
ccctagactctgtaaccacctct

SEQ ID NO: 2896317 - DNA, 22 bp, Homo sapiens
ccctagactttaggctttcagc

SEQ ID NO: 2896318 - DNA, 21 bp, Homo sapiens
ccctagagacagtgatgcctg

SEQ ID NO: 2896319 - DNA, 13 bp, Homo sapiens
ccctagatccagg

SEQ ID NO: 2896320 - DNA, 15 bp, Homo sapiens
ccctagatccaggct

SEQ ID NO: 2896321 - DNA, 23 bp, Homo sapiens
ccctagatccaggcttctcccgg

SEQ ID NO: 2896322 - DNA, 22 bp, Homo sapiens
ccctaggattccccctgccctg

SEQ ID NO: 2896323 - DNA, 23 bp, Homo sapiens
ccctaggattccccctgccctgt

SEQ ID NO: 2896324 - DNA, 19 bp, Homo sapiens
ccctatactgtagtattct

SEQ ID NO: 2896325 - DNA, 16 bp, Homo sapiens
ccctatccacccagcc

SEQ ID NO: 2896326 - DNA, 17 bp, Homo sapiens
ccctcaagaggaagtga

SEQ ID NO: 2896327 - DNA, 13 bp, Homo sapiens
ccctcacagactc

SEQ ID NO: 2896328 - DNA, 23 bp, Homo sapiens
ccctcacagactcttccaccaga

SEQ ID NO: 2896329 - DNA, 9 bp, Homo sapiens
ccctcaccc

SEQ ID NO: 2896330 - DNA, 10 bp, Homo sapiens
ccctcacccc

SEQ ID NO: 2896331 - DNA, 16 bp, Homo sapiens
ccctcaccccacaatt

SEQ ID NO: 2896332 - DNA, 12 bp, Homo sapiens
ccctcaccccag

SEQ ID NO: 2896333 - DNA, 17 bp, Homo sapiens
ccctcaccccagctccg

SEQ ID NO: 2896334 - DNA, 19 bp, Homo sapiens
ccctcacctggtacctgga

SEQ ID NO: 2896335 - DNA, 20 bp, Homo sapiens
ccctcaccttggcaccagac

SEQ ID NO: 2896336 - DNA, 16 bp, Homo sapiens
ccctcactcttcctca

SEQ ID NO: 2896337 - DNA, 18 bp, Homo sapiens
ccctcagaacccttggct

SEQ ID NO: 2896338 - DNA, 14 bp, Homo sapiens
ccctcagagcccat

SEQ ID NO: 2896339 - DNA, 15 bp, Homo sapiens
ccctcagctctgtcc

SEQ ID NO: 2896340 - DNA, 15 bp, Homo sapiens
ccctcaggggaagct

SEQ ID NO: 2896341 - DNA, 17 bp, Homo sapiens
ccctcaggggaagctgc

SEQ ID NO: 2896342 - DNA, 20 bp, Homo sapiens
ccctcaggtgtagctgagct

SEQ ID NO: 2896343 - DNA, 18 bp, Homo sapiens
ccctcagttgtgcagctt

SEQ ID NO: 2896344 - DNA, 17 bp, Homo sapiens
ccctcatctctctgccc

SEQ ID NO: 2896345 - DNA, 21 bp, Homo sapiens
ccctccacaaagcaaaggcag

SEQ ID NO: 2896346 - DNA, 22 bp, Homo sapiens
ccctccacggtccgcggcctgc

SEQ ID NO: 2896347 - DNA, 23 bp, Homo sapiens
ccctccacggtccgcggcctgca

SEQ ID NO: 2896348 - DNA, 19 bp, Homo sapiens
ccctccagagacaggaaag

SEQ ID NO: 2896349 - DNA, 16 bp, Homo sapiens
ccctccagcacaaaca

SEQ ID NO: 2896350 - DNA, 14 bp, Homo sapiens
ccctccatccccat

SEQ ID NO: 2896351 - DNA, 15 bp, Homo sapiens
ccctccatccccatc

SEQ ID NO: 2896352 - DNA, 20 bp, Homo sapiens
ccctccatggtcctgtctgt

SEQ ID NO: 2896353 - DNA, 23 bp, Homo sapiens
ccctccatggtcctgtctgtcct

SEQ ID NO: 2896354 - DNA, 19 bp, Homo sapiens
ccctcccacacccaaagct

SEQ ID NO: 2896355 - DNA, 15 bp, Homo sapiens
ccctcccaccacccc

SEQ ID NO: 2896356 - DNA, 15 bp, Homo sapiens
ccctcccactttgct

SEQ ID NO: 2896357 - DNA, 14 bp, Homo sapiens
ccctcccagctctg

SEQ ID NO: 2896358 - DNA, 16 bp, Homo sapiens
ccctccccaaagtccc

SEQ ID NO: 2896359 - DNA, 15 bp, Homo sapiens
ccctccccaactccc

SEQ ID NO: 2896360 - DNA, 13 bp, Homo sapiens
ccctccccaccca

SEQ ID NO: 2896361 - DNA, 12 bp, Homo sapiens
ccctccccaggg

SEQ ID NO: 2896362 - DNA, 16 bp, Homo sapiens
ccctccccatctgtgt

SEQ ID NO: 2896363 - DNA, 17 bp, Homo sapiens
ccctccccatctgtgtt

SEQ ID NO: 2896364 - DNA, 22 bp, Homo sapiens
ccctcccccacgtctctctgcc

SEQ ID NO: 2896365 - DNA, 13 bp, Homo sapiens
ccctcccccagca

SEQ ID NO: 2896366 - DNA, 20 bp, Homo sapiens
ccctcccccccatgcactgt

SEQ ID NO: 2896367 - DNA, 12 bp, Homo sapiens
ccctcccctcag

SEQ ID NO: 2896368 - DNA, 14 bp, Homo sapiens
ccctcccctcagag

SEQ ID NO: 2896369 - DNA, 20 bp, Homo sapiens
ccctccctatatgcacccct

SEQ ID NO: 2896370 - DNA, 15 bp, Homo sapiens
ccctccctcccttcc

SEQ ID NO: 2896371 - DNA, 16 bp, Homo sapiens
ccctccgactccagat

SEQ ID NO: 2896372 - DNA, 21 bp, Homo sapiens
ccctcctctgaaacagctgcc

SEQ ID NO: 2896373 - DNA, 16 bp, Homo sapiens
ccctcctggagcagaa

SEQ ID NO: 2896374 - DNA, 19 bp, Homo sapiens
ccctcctggtgtcacccca

SEQ ID NO: 2896375 - DNA, 20 bp, Homo sapiens
ccctcctggtgtcaccccag

SEQ ID NO: 2896376 - DNA, 21 bp, Homo sapiens
ccctcctggtgtcaccccaga

SEQ ID NO: 2896377 - DNA, 22 bp, Homo sapiens
ccctcctggtgtcaccccagag

SEQ ID NO: 2896378 - DNA, 23 bp, Homo sapiens
ccctcctggtgtcaccccagagc

SEQ ID NO: 2896379 - DNA, 15 bp, Homo sapiens
ccctccttctgctgt

SEQ ID NO: 2896380 - DNA, 17 bp, Homo sapiens
ccctcgaccctgtgcag

SEQ ID NO: 2896381 - DNA, 21 bp, Homo sapiens
ccctcgcttggacggctgggc

SEQ ID NO: 2896382 - DNA, 13 bp, Homo sapiens
ccctcggctctgg

SEQ ID NO: 2896383 - DNA, 18 bp, Homo sapiens
ccctcgtcttcagctgca

SEQ ID NO: 2896384 - DNA, 15 bp, Homo sapiens
ccctctaacccagtg

SEQ ID NO: 2896385 - DNA, 16 bp, Homo sapiens
ccctctaacccagtgg

SEQ ID NO: 2896386 - DNA, 19 bp, Homo sapiens
ccctctagaaatttttcag

SEQ ID NO: 2896387 - DNA, 14 bp, Homo sapiens
ccctctagggcagg

SEQ ID NO: 2896388 - DNA, 12 bp, Homo sapiens
ccctctcacgcc

SEQ ID NO: 2896389 - DNA, 16 bp, Homo sapiens
ccctctcatctcaggt

SEQ ID NO: 2896390 - DNA, 23 bp, Homo sapiens
ccctctccaactgcctaaggccc

SEQ ID NO: 2896391 - DNA, 13 bp, Homo sapiens
ccctctcctccgt

SEQ ID NO: 2896392 - DNA, 17 bp, Homo sapiens
ccctctcctgcctactc

SEQ ID NO: 2896393 - DNA, 23 bp, Homo sapiens
ccctctctcatatcactgaagga

SEQ ID NO: 2896394 - DNA, 22 bp, Homo sapiens
ccctctctcctggactggttat

SEQ ID NO: 2896395 - DNA, 16 bp, Homo sapiens
ccctctctgctctgcg

SEQ ID NO: 2896396 - DNA, 19 bp, Homo sapiens
ccctctctgggcctcagag

SEQ ID NO: 2896397 - DNA, 14 bp, Homo sapiens
ccctctcttccggg

SEQ ID NO: 2896398 - DNA, 20 bp, Homo sapiens
ccctctgaaagttgtacatg

SEQ ID NO: 2896399 - DNA, 16 bp, Homo sapiens
ccctctgcacccagaa

SEQ ID NO: 2896400 - DNA, 15 bp, Homo sapiens
ccctctgccccatcc

SEQ ID NO: 2896401 - DNA, 18 bp, Homo sapiens
ccctctgccccatcctcc

SEQ ID NO: 2896402 - DNA, 17 bp, Homo sapiens
ccctctgcctcatcctc

SEQ ID NO: 2896403 - DNA, 20 bp, Homo sapiens
ccctctgcctcatcctcctc

SEQ ID NO: 2896404 - DNA, 14 bp, Homo sapiens
ccctctgcctgcac

SEQ ID NO: 2896405 - DNA, 15 bp, Homo sapiens
ccctctgcctgcact

SEQ ID NO: 2896406 - DNA, 17 bp, Homo sapiens
ccctctgcctgcactcc

SEQ ID NO: 2896407 - DNA, 18 bp, Homo sapiens
ccctctgctgctgcccgg

SEQ ID NO: 2896408 - DNA, 23 bp, Homo sapiens
ccctctgctgctgcccggggtgg

SEQ ID NO: 2896409 - DNA, 15 bp, Homo sapiens
ccctctggaagtggc

SEQ ID NO: 2896410 - DNA, 19 bp, Homo sapiens
ccctctgtcacccagtctg

SEQ ID NO: 2896411 - DNA, 20 bp, Homo sapiens
ccctctgtccaggcactgag

SEQ ID NO: 2896412 - DNA, 13 bp, Homo sapiens
ccctctgtcccca

SEQ ID NO: 2896413 - DNA, 17 bp, Homo sapiens
ccctctgtccccacgag

SEQ ID NO: 2896414 - DNA, 16 bp, Homo sapiens
ccctctgtccccaggc

SEQ ID NO: 2896415 - DNA, 22 bp, Homo sapiens
ccctctgtccccaggcctggct

SEQ ID NO: 2896416 - DNA, 17 bp, Homo sapiens
ccctctgtctgtcttct

SEQ ID NO: 2896417 - DNA, 23 bp, Homo sapiens
ccctctgtcttcaggctctgccc

SEQ ID NO: 2896418 - DNA, 18 bp, Homo sapiens
ccctctttaatgctgtct

SEQ ID NO: 2896419 - DNA, 19 bp, Homo sapiens
ccctctttaatgctgtctt

SEQ ID NO: 2896420 - DNA, 22 bp, Homo sapiens
ccctctttaatgctgtctttgt

SEQ ID NO: 2896421 - DNA, 16 bp, Homo sapiens
ccctctttctagcctg

SEQ ID NO: 2896422 - DNA, 17 bp, Homo sapiens
ccctctttctagcctgg

SEQ ID NO: 2896423 - DNA, 23 bp, Homo sapiens
ccctctttcttgtttgtcagcat

SEQ ID NO: 2896424 - DNA, 19 bp, Homo sapiens
ccctctttgggcagtgcca

SEQ ID NO: 2896425 - DNA, 18 bp, Homo sapiens
ccctctttttctctgtat

SEQ ID NO: 2896426 - DNA, 14 bp, Homo sapiens
ccctgaaaacccag

SEQ ID NO: 2896427 - DNA, 16 bp, Homo sapiens
ccctgaaaacccagag

SEQ ID NO: 2896428 - DNA, 18 bp, Homo sapiens
ccctgaaacactgcttct

SEQ ID NO: 2896429 - DNA, 15 bp, Homo sapiens
ccctgaccctgtgga

SEQ ID NO: 2896430 - DNA, 19 bp, Homo sapiens
ccctgaccctgtggaagca

SEQ ID NO: 2896431 - DNA, 14 bp, Homo sapiens
ccctgacctgtcca

SEQ ID NO: 2896432 - DNA, 15 bp, Homo sapiens
ccctgacctgtccag

SEQ ID NO: 2896433 - DNA, 16 bp, Homo sapiens
ccctgacctgtgagcc

SEQ ID NO: 2896434 - DNA, 15 bp, Homo sapiens
ccctgacggctgcca

SEQ ID NO: 2896435 - DNA, 9 bp, Homo sapiens
ccctgactg

SEQ ID NO: 2896436 - DNA, 18 bp, Homo sapiens
ccctgactgtcagggagg

SEQ ID NO: 2896437 - DNA, 20 bp, Homo sapiens
ccctgactgtcagggagggc

SEQ ID NO: 2896438 - DNA, 18 bp, Homo sapiens
ccctgagatctctgcagg

SEQ ID NO: 2896439 - DNA, 14 bp, Homo sapiens
ccctgagctgacca

SEQ ID NO: 2896440 - DNA, 17 bp, Homo sapiens
ccctgagctgaggcagc

SEQ ID NO: 2896441 - DNA, 21 bp, Homo sapiens
ccctgagctgaggcagcagtg

SEQ ID NO: 2896442 - DNA, 21 bp, Homo sapiens
ccctgaggggctggggagggg

SEQ ID NO: 2896443 - DNA, 20 bp, Homo sapiens
ccctgcaaaaggactctcag

SEQ ID NO: 2896444 - DNA, 19 bp, Homo sapiens
ccctgcagacgtctggccc

SEQ ID NO: 2896445 - DNA, 22 bp, Homo sapiens
ccctgcagacgtctggccctgg

SEQ ID NO: 2896446 - DNA, 16 bp, Homo sapiens
ccctgcatctgaccag

SEQ ID NO: 2896447 - DNA, 18 bp, Homo sapiens
ccctgcatctgaccagca

SEQ ID NO: 2896448 - DNA, 18 bp, Homo sapiens
ccctgccactcacccttc

SEQ ID NO: 2896449 - DNA, 21 bp, Homo sapiens
ccctgccactcacccttcctg

SEQ ID NO: 2896450 - DNA, 12 bp, Homo sapiens
ccctgccagctc

SEQ ID NO: 2896451 - DNA, 13 bp, Homo sapiens
ccctgcccaagtg

SEQ ID NO: 2896452 - DNA, 16 bp, Homo sapiens
ccctgcccaagtgacc

SEQ ID NO: 2896453 - DNA, 12 bp, Homo sapiens
ccctgcccaccc

SEQ ID NO: 2896454 - DNA, 15 bp, Homo sapiens
ccctgcccacccccg

SEQ ID NO: 2896455 - DNA, 17 bp, Homo sapiens
ccctgcccacccccggg

SEQ ID NO: 2896456 - DNA, 18 bp, Homo sapiens
ccctgcccacccccggga

SEQ ID NO: 2896457 - DNA, 19 bp, Homo sapiens
ccctgcccctccccctacc

SEQ ID NO: 2896458 - DNA, 21 bp, Homo sapiens
ccctgcccctccccctaccgc

SEQ ID NO: 2896459 - DNA, 22 bp, Homo sapiens
ccctgcccctccccctaccgca

SEQ ID NO: 2896460 - DNA, 14 bp, Homo sapiens
ccctgcccctccct

SEQ ID NO: 2896461 - DNA, 15 bp, Homo sapiens
ccctgcccctcccta

SEQ ID NO: 2896462 - DNA, 12 bp, Homo sapiens
ccctgcccctgt

SEQ ID NO: 2896463 - DNA, 13 bp, Homo sapiens
ccctgcccctgtg

SEQ ID NO: 2896464 - DNA, 14 bp, Homo sapiens
ccctgcccctgtgc

SEQ ID NO: 2896465 - DNA, 14 bp, Homo sapiens
ccctgcccgccaca

SEQ ID NO: 2896466 - DNA, 20 bp, Homo sapiens
ccctgcccgttcttgaaatg

SEQ ID NO: 2896467 - DNA, 13 bp, Homo sapiens
ccctgccctgtgc

SEQ ID NO: 2896468 - DNA, 20 bp, Homo sapiens
ccctgccctgtgccgcactc

SEQ ID NO: 2896469 - DNA, 11 bp, Homo sapiens
ccctgcctcac

SEQ ID NO: 2896470 - DNA, 15 bp, Homo sapiens
ccctgcctcagctgc

SEQ ID NO: 2896471 - DNA, 22 bp, Homo sapiens
ccctgcctccagctgtcagcct

SEQ ID NO: 2896472 - DNA, 23 bp, Homo sapiens
ccctgcctccagctgtcagcctg

SEQ ID NO: 2896473 - DNA, 14 bp, Homo sapiens
ccctgcctcgaggg

SEQ ID NO: 2896474 - DNA, 14 bp, Homo sapiens
ccctgcctgctgtg

SEQ ID NO: 2896475 - DNA, 16 bp, Homo sapiens
ccctgcctgctgtgga

SEQ ID NO: 2896476 - DNA, 18 bp, Homo sapiens
ccctgcctggaccagcct

SEQ ID NO: 2896477 - DNA, 18 bp, Homo sapiens
ccctgcctttgggagcag

SEQ ID NO: 2896478 - DNA, 13 bp, Homo sapiens
ccctgcggcctcc

SEQ ID NO: 2896479 - DNA, 17 bp, Homo sapiens
ccctgcgggccacaggg

SEQ ID NO: 2896480 - DNA, 18 bp, Homo sapiens
ccctgcgggccacagggc

SEQ ID NO: 2896481 - DNA, 19 bp, Homo sapiens
ccctgctatttcaggccct

SEQ ID NO: 2896482 - DNA, 18 bp, Homo sapiens
ccctgctctgttgcctct

SEQ ID NO: 2896483 - DNA, 15 bp, Homo sapiens
ccctgctgcttccta

SEQ ID NO: 2896484 - DNA, 18 bp, Homo sapiens
ccctgctgcttcctaact

SEQ ID NO: 2896485 - DNA, 12 bp, Homo sapiens
ccctgctggggt

SEQ ID NO: 2896486 - DNA, 18 bp, Homo sapiens
ccctgctggggtctcagg

SEQ ID NO: 2896487 - DNA, 23 bp, Homo sapiens
ccctgctggggtctcaggtccag

SEQ ID NO: 2896488 - DNA, 24 bp, Homo sapiens
ccctgctggggtctcaggtccagc

SEQ ID NO: 2896489 - DNA, 17 bp, Homo sapiens
ccctgctgtctctctgg

SEQ ID NO: 2896490 - DNA, 19 bp, Homo sapiens
ccctgctgtctctctgggc

SEQ ID NO: 2896491 - DNA, 22 bp, Homo sapiens
ccctgctgtctctctgggctgc

SEQ ID NO: 2896492 - DNA, 23 bp, Homo sapiens
ccctgcttagaacccttctgctt

SEQ ID NO: 2896493 - DNA, 21 bp, Homo sapiens
ccctggaacctttcccttgtg

SEQ ID NO: 2896494 - DNA, 21 bp, Homo sapiens
ccctggaaggacatccatgtt

SEQ ID NO: 2896495 - DNA, 20 bp, Homo sapiens
ccctggccgagtccaagctg

SEQ ID NO: 2896496 - DNA, 19 bp, Homo sapiens
ccctggcctggtccctggt

SEQ ID NO: 2896497 - DNA, 23 bp, Homo sapiens
ccctggcctggtccctggtcctt

SEQ ID NO: 2896498 - DNA, 16 bp, Homo sapiens
ccctggcgggtggctg

SEQ ID NO: 2896499 - DNA, 17 bp, Homo sapiens
ccctggcgggtggctgc

SEQ ID NO: 2896500 - DNA, 18 bp, Homo sapiens
ccctggcgggtggctgca

SEQ ID NO: 2896501 - DNA, 20 bp, Homo sapiens
ccctggcgggtggctgcaag

SEQ ID NO: 2896502 - DNA, 15 bp, Homo sapiens
ccctggctaacagtc

SEQ ID NO: 2896503 - DNA, 16 bp, Homo sapiens
ccctggctctgggccg

SEQ ID NO: 2896504 - DNA, 18 bp, Homo sapiens
ccctggctgaacagtgct

SEQ ID NO: 2896505 - DNA, 22 bp, Homo sapiens
ccctggctgaacagtgctctgc

SEQ ID NO: 2896506 - DNA, 11 bp, Homo sapiens
ccctggctgca

SEQ ID NO: 2896507 - DNA, 17 bp, Homo sapiens
ccctggctgcagcctcc

SEQ ID NO: 2896508 - DNA, 23 bp, Homo sapiens
ccctggctgggacgtggctcagc

SEQ ID NO: 2896509 - DNA, 18 bp, Homo sapiens
ccctgggagcaagttgca

SEQ ID NO: 2896510 - DNA, 16 bp, Homo sapiens
ccctgggccccaccac

SEQ ID NO: 2896511 - DNA, 13 bp, Homo sapiens
ccctgggcctgga

SEQ ID NO: 2896512 - DNA, 22 bp, Homo sapiens
ccctgggctttcacgggcccca

SEQ ID NO: 2896513 - DNA, 14 bp, Homo sapiens
ccctggggcactcc

SEQ ID NO: 2896514 - DNA, 19 bp, Homo sapiens
ccctggggcgggcagccag

SEQ ID NO: 2896515 - DNA, 21 bp, Homo sapiens
ccctggggcgggcagccaggc

SEQ ID NO: 2896516 - DNA, 19 bp, Homo sapiens
ccctggggctgagtctcca

SEQ ID NO: 2896517 - DNA, 21 bp, Homo sapiens
ccctggggctgagtctccagg

SEQ ID NO: 2896518 - DNA, 23 bp, Homo sapiens
ccctggggctgagtctccagggc

SEQ ID NO: 2896519 - DNA, 13 bp, Homo sapiens
ccctggggctggc

SEQ ID NO: 2896520 - DNA, 17 bp, Homo sapiens
ccctgggggaagccctg

SEQ ID NO: 2896521 - DNA, 20 bp, Homo sapiens
ccctgggggaagccctggat

SEQ ID NO: 2896522 - DNA, 21 bp, Homo sapiens
ccctgggggcacaggaggcag

SEQ ID NO: 2896523 - DNA, 12 bp, Homo sapiens
ccctgggtcctg

SEQ ID NO: 2896524 - DNA, 14 bp, Homo sapiens
ccctgggtcctgcc

SEQ ID NO: 2896525 - DNA, 15 bp, Homo sapiens
ccctgggtcctgcct

SEQ ID NO: 2896526 - DNA, 18 bp, Homo sapiens
ccctgggtcctgcctgca

SEQ ID NO: 2896527 - DNA, 19 bp, Homo sapiens
ccctgggtcctgcctgcag

SEQ ID NO: 2896528 - DNA, 22 bp, Homo sapiens
ccctgggtgtccccgctgctgt

SEQ ID NO: 2896529 - DNA, 18 bp, Homo sapiens
ccctgggtttggcccctg

SEQ ID NO: 2896530 - DNA, 23 bp, Homo sapiens
ccctggtaaagaaaagcctcagc

SEQ ID NO: 2896531 - DNA, 13 bp, Homo sapiens
ccctggtccttca

SEQ ID NO: 2896532 - DNA, 22 bp, Homo sapiens
ccctggtccttcactggcgcct

SEQ ID NO: 2896533 - DNA, 15 bp, Homo sapiens
ccctggtgctcctgc

SEQ ID NO: 2896534 - DNA, 16 bp, Homo sapiens
ccctggtgggccaaca

SEQ ID NO: 2896535 - DNA, 15 bp, Homo sapiens
ccctggttcctgctg

SEQ ID NO: 2896536 - DNA, 16 bp, Homo sapiens
ccctggttcctgctgt

SEQ ID NO: 2896537 - DNA, 18 bp, Homo sapiens
ccctggttcctgctgtcc

SEQ ID NO: 2896538 - DNA, 19 bp, Homo sapiens
ccctggttcctgctgtcct

SEQ ID NO: 2896539 - DNA, 21 bp, Homo sapiens
ccctgtaacgtaacccattaa

SEQ ID NO: 2896540 - DNA, 14 bp, Homo sapiens
ccctgtcaccaagc

SEQ ID NO: 2896541 - DNA, 14 bp, Homo sapiens
ccctgtcccctggg

SEQ ID NO: 2896542 - DNA, 15 bp, Homo sapiens
ccctgtcccctgggg

SEQ ID NO: 2896543 - DNA, 16 bp, Homo sapiens
ccctgtcccctggggc

SEQ ID NO: 2896544 - DNA, 18 bp, Homo sapiens
ccctgtcccctggggctg

SEQ ID NO: 2896545 - DNA, 21 bp, Homo sapiens
ccctgtccggaatgccaccca

SEQ ID NO: 2896546 - DNA, 22 bp, Homo sapiens
ccctgtccggaatgccacccac

SEQ ID NO: 2896547 - DNA, 16 bp, Homo sapiens
ccctgtcctcctcgga

SEQ ID NO: 2896548 - DNA, 12 bp, Homo sapiens
ccctgtctagag

SEQ ID NO: 2896549 - DNA, 16 bp, Homo sapiens
ccctgtctagagaggg

SEQ ID NO: 2896550 - DNA, 17 bp, Homo sapiens
ccctgtctagagaggga

SEQ ID NO: 2896551 - DNA, 22 bp, Homo sapiens
ccctgtgccgcactctggcggt

SEQ ID NO: 2896552 - DNA, 15 bp, Homo sapiens
ccctgtgcctctgtc

SEQ ID NO: 2896553 - DNA, 15 bp, Homo sapiens
ccctgtgccttgtca

SEQ ID NO: 2896554 - DNA, 12 bp, Homo sapiens
ccctgtggagtc

SEQ ID NO: 2896555 - DNA, 19 bp, Homo sapiens
ccctgtggagtccagctct

SEQ ID NO: 2896556 - DNA, 22 bp, Homo sapiens
ccctgtggagtccagctctact

SEQ ID NO: 2896557 - DNA, 20 bp, Homo sapiens
ccctgtggatgagccctcag

SEQ ID NO: 2896558 - DNA, 22 bp, Homo sapiens
ccctgtggatgagccctcagaa

SEQ ID NO: 2896559 - DNA, 23 bp, Homo sapiens
ccctgtggatgagccctcagaac

SEQ ID NO: 2896560 - DNA, 12 bp, Homo sapiens
ccctgtgggacc

SEQ ID NO: 2896561 - DNA, 17 bp, Homo sapiens
ccctgtgggaccccagg

SEQ ID NO: 2896562 - DNA, 18 bp, Homo sapiens
ccctgtgggaccccaggc

SEQ ID NO: 2896563 - DNA, 16 bp, Homo sapiens
ccctgttacaaagctg

SEQ ID NO: 2896564 - DNA, 12 bp, Homo sapiens
ccctgttatttt

SEQ ID NO: 2896565 - DNA, 21 bp, Homo sapiens
ccctgttcaggctggctcgta

SEQ ID NO: 2896566 - DNA, 14 bp, Homo sapiens
ccctgttcatgttt

SEQ ID NO: 2896567 - DNA, 16 bp, Homo sapiens
ccctgttccccagaga

SEQ ID NO: 2896568 - DNA, 19 bp, Homo sapiens
ccctgttctcgttgcccta

SEQ ID NO: 2896569 - DNA, 13 bp, Homo sapiens
ccctgttgtgcca

SEQ ID NO: 2896570 - DNA, 17 bp, Homo sapiens
ccctgtttcaatcactg

SEQ ID NO: 2896571 - DNA, 22 bp, Homo sapiens
ccctgttttcccacgaggaatc

SEQ ID NO: 2896572 - DNA, 22 bp, Homo sapiens
cccttaagcagcaacagcctac

SEQ ID NO: 2896573 - DNA, 18 bp, Homo sapiens
cccttacccatcttgctt

SEQ ID NO: 2896574 - DNA, 15 bp, Homo sapiens
cccttagcagcccag

SEQ ID NO: 2896575 - DNA, 18 bp, Homo sapiens
cccttcacaaagcccaag

SEQ ID NO: 2896576 - DNA, 20 bp, Homo sapiens
cccttcacaaagcccaaggg

SEQ ID NO: 2896577 - DNA, 17 bp, Homo sapiens
cccttcagtgcccacca

SEQ ID NO: 2896578 - DNA, 12 bp, Homo sapiens
cccttcatcctt

SEQ ID NO: 2896579 - DNA, 19 bp, Homo sapiens
cccttcattgatttcctgt

SEQ ID NO: 2896580 - DNA, 12 bp, Homo sapiens
cccttccacctc

SEQ ID NO: 2896581 - DNA, 14 bp, Homo sapiens
cccttccacctcac

SEQ ID NO: 2896582 - DNA, 13 bp, Homo sapiens
cccttccactgag

SEQ ID NO: 2896583 - DNA, 13 bp, Homo sapiens
cccttccagtggg

SEQ ID NO: 2896584 - DNA, 21 bp, Homo sapiens
cccttcccctcccccactcct

SEQ ID NO: 2896585 - DNA, 15 bp, Homo sapiens
cccttccctgcctcc

SEQ ID NO: 2896586 - DNA, 17 bp, Homo sapiens
cccttccgccttctccc

SEQ ID NO: 2896587 - DNA, 14 bp, Homo sapiens
cccttcctcatctg

SEQ ID NO: 2896588 - DNA, 18 bp, Homo sapiens
cccttcctcatctgtgcc

SEQ ID NO: 2896589 - DNA, 19 bp, Homo sapiens
cccttcctcatctgtgcct

SEQ ID NO: 2896590 - DNA, 23 bp, Homo sapiens
cccttcctcctccaccaccgccc

SEQ ID NO: 2896591 - DNA, 13 bp, Homo sapiens
cccttcctgaccc

SEQ ID NO: 2896592 - DNA, 14 bp, Homo sapiens
cccttcctggccca

SEQ ID NO: 2896593 - DNA, 15 bp, Homo sapiens
cccttcctggcccag

SEQ ID NO: 2896594 - DNA, 18 bp, Homo sapiens
cccttcgacatgctgcca

SEQ ID NO: 2896595 - DNA, 21 bp, Homo sapiens
cccttcgacatgctgccagga

SEQ ID NO: 2896596 - DNA, 22 bp, Homo sapiens
cccttcgacatgctgccaggaa

SEQ ID NO: 2896597 - DNA, 14 bp, Homo sapiens
cccttcgctctgct

SEQ ID NO: 2896598 - DNA, 15 bp, Homo sapiens
cccttcgctctgctg

SEQ ID NO: 2896599 - DNA, 13 bp, Homo sapiens
cccttctgctttc

SEQ ID NO: 2896600 - DNA, 17 bp, Homo sapiens
cccttctgtccctcaca

SEQ ID NO: 2896601 - DNA, 12 bp, Homo sapiens
cccttgaactct

SEQ ID NO: 2896602 - DNA, 18 bp, Homo sapiens
cccttgacaactggcagg

SEQ ID NO: 2896603 - DNA, 21 bp, Homo sapiens
cccttgacaactggcaggcag

SEQ ID NO: 2896604 - DNA, 19 bp, Homo sapiens
cccttgagacctcagccat

SEQ ID NO: 2896605 - DNA, 20 bp, Homo sapiens
cccttgagacctcagccatg

SEQ ID NO: 2896606 - DNA, 19 bp, Homo sapiens
cccttgagtaggccctgct

SEQ ID NO: 2896607 - DNA, 21 bp, Homo sapiens
cccttggtttctgggggctgg

SEQ ID NO: 2896608 - DNA, 17 bp, Homo sapiens
cccttgtccctggggca

SEQ ID NO: 2896609 - DNA, 20 bp, Homo sapiens
cccttgtgtgtaccacaccc

SEQ ID NO: 2896610 - DNA, 21 bp, Homo sapiens
cccttgtgtgtaccacaccct

SEQ ID NO: 2896611 - DNA, 23 bp, Homo sapiens
ccggcatgagactcagtgcagat

SEQ ID NO: 2896612 - DNA, 11 bp, Homo sapiens
ccggccagcca

SEQ ID NO: 2896613 - DNA, 14 bp, Homo sapiens
ccggccccctgccc

SEQ ID NO: 2896614 - DNA, 18 bp, Homo sapiens
ccggccccgagagcaggc

SEQ ID NO: 2896615 - DNA, 16 bp, Homo sapiens
ccggcccctcaccctc

SEQ ID NO: 2896616 - DNA, 23 bp, Homo sapiens
ccggcccctcaccctctgtcccc

SEQ ID NO: 2896617 - DNA, 12 bp, Homo sapiens
ccggccctgccc

SEQ ID NO: 2896618 - DNA, 19 bp, Homo sapiens
ccggccctgcccctcccta

SEQ ID NO: 2896619 - DNA, 19 bp, Homo sapiens
ccggcgcctgccctgccca

SEQ ID NO: 2896620 - DNA, 23 bp, Homo sapiens
ccggcgcctgccctgcccaagtg

SEQ ID NO: 2896621 - DNA, 20 bp, Homo sapiens
ccggcggggaccttggtctg

SEQ ID NO: 2896622 - DNA, 17 bp, Homo sapiens
ccggctcggcccagcac

SEQ ID NO: 2896623 - DNA, 19 bp, Homo sapiens
ccggctggcctggaggctc

SEQ ID NO: 2896624 - DNA, 14 bp, Homo sapiens
ccggcttctcggct

SEQ ID NO: 2896625 - DNA, 16 bp, Homo sapiens
ccggctttgtggcact

SEQ ID NO: 2896626 - DNA, 17 bp, Homo sapiens
ccggctttgtggcactg

SEQ ID NO: 2896627 - DNA, 22 bp, Homo sapiens
ccgggaaagaagagccggagcc

SEQ ID NO: 2896628 - DNA, 15 bp, Homo sapiens
ccgggaagcatcctc

SEQ ID NO: 2896629 - DNA, 16 bp, Homo sapiens
ccgggaagcatcctcc

SEQ ID NO: 2896630 - DNA, 20 bp, Homo sapiens
ccgggaagcatcctccccac

SEQ ID NO: 2896631 - DNA, 21 bp, Homo sapiens
ccgggaagcatcctccccacc

SEQ ID NO: 2896632 - DNA, 11 bp, Homo sapiens
ccgggaaggaa

SEQ ID NO: 2896633 - DNA, 19 bp, Homo sapiens
ccgggacacctaggctagg

SEQ ID NO: 2896634 - DNA, 19 bp, Homo sapiens
ccgggacccggcggccctg

SEQ ID NO: 2896635 - DNA, 13 bp, Homo sapiens
ccgggaccctcag

SEQ ID NO: 2896636 - DNA, 15 bp, Homo sapiens
ccgggaccctcaggt

SEQ ID NO: 2896637 - DNA, 17 bp, Homo sapiens
ccgggacctggtgctgc

SEQ ID NO: 2896638 - DNA, 13 bp, Homo sapiens
ccgggactcactg

SEQ ID NO: 2896639 - DNA, 13 bp, Homo sapiens
ccgggatgggtgg

SEQ ID NO: 2896640 - DNA, 15 bp, Homo sapiens
ccgggccctgggccc

SEQ ID NO: 2896641 - DNA, 17 bp, Homo sapiens
ccgggcccttcagtccc

SEQ ID NO: 2896642 - DNA, 17 bp, Homo sapiens
ccgggccgaccctgcgg

SEQ ID NO: 2896643 - DNA, 20 bp, Homo sapiens
ccgggccgaccctgcggcct

SEQ ID NO: 2896644 - DNA, 21 bp, Homo sapiens
ccgggccgaccctgcggcctc

SEQ ID NO: 2896645 - DNA, 22 bp, Homo sapiens
ccgggccgaccctgcggcctcc

SEQ ID NO: 2896646 - DNA, 14 bp, Homo sapiens
ccgggcctgtacag

SEQ ID NO: 2896647 - DNA, 11 bp, Homo sapiens
ccgggctgcag

SEQ ID NO: 2896648 - DNA, 22 bp, Homo sapiens
ccgggctggctgcttgcagcca

SEQ ID NO: 2896649 - DNA, 10 bp, Homo sapiens
ccggggaggg

SEQ ID NO: 2896650 - DNA, 11 bp, Homo sapiens
ccggggagggg

SEQ ID NO: 2896651 - DNA, 22 bp, Homo sapiens
ccggggccctctctgcaccgga

SEQ ID NO: 2896652 - DNA, 23 bp, Homo sapiens
ccggggccctctctgcaccggac

SEQ ID NO: 2896653 - DNA, 12 bp, Homo sapiens
ccgggggacaga

SEQ ID NO: 2896654 - DNA, 13 bp, Homo sapiens
ccgggggacagag

SEQ ID NO: 2896655 - DNA, 15 bp, Homo sapiens
ccgggggtggctctg

SEQ ID NO: 2896656 - DNA, 21 bp, Homo sapiens
ccggggtccccgccctctctc

SEQ ID NO: 2896657 - DNA, 14 bp, Homo sapiens
ccggggtcctggga

SEQ ID NO: 2896658 - DNA, 22 bp, Homo sapiens
ccggggtcctgggaggctgcag

SEQ ID NO: 2896659 - DNA, 23 bp, Homo sapiens
ccggggtcctgggaggctgcagc

SEQ ID NO: 2896660 - DNA, 14 bp, Homo sapiens
ccggggtctcctgg

SEQ ID NO: 2896661 - DNA, 14 bp, Homo sapiens
ccggggtggggtgc

SEQ ID NO: 2896662 - DNA, 16 bp, Homo sapiens
ccgggtcaccctgtga

SEQ ID NO: 2896663 - DNA, 16 bp, Homo sapiens
ccgggtgtggcacgca

SEQ ID NO: 2896664 - DNA, 22 bp, Homo sapiens
ccgggtgtggcacgcacctgta

SEQ ID NO: 2896665 - DNA, 15 bp, Homo sapiens
ccgggttccagcacc

SEQ ID NO: 2896666 - DNA, 20 bp, Homo sapiens
ccggtccccacagactgccc

SEQ ID NO: 2896667 - DNA, 20 bp, Homo sapiens
ccggtcccttgagacctcag

SEQ ID NO: 2896668 - DNA, 22 bp, Homo sapiens
ccggtgcatgcaggtctccatg

SEQ ID NO: 2896669 - DNA, 15 bp, Homo sapiens
ccggtgttctaagat

SEQ ID NO: 2896670 - DNA, 21 bp, Homo sapiens
ccggttcccacaagcctgcct

SEQ ID NO: 2896671 - DNA, 14 bp, Homo sapiens
ccgtagttccctga

SEQ ID NO: 2896672 - DNA, 12 bp, Homo sapiens
ccgtatcaaatg

SEQ ID NO: 2896673 - DNA, 19 bp, Homo sapiens
ccgtcaccacgactggcca

SEQ ID NO: 2896674 - DNA, 21 bp, Homo sapiens
ccgtcaccacgactggccagg

SEQ ID NO: 2896675 - DNA, 12 bp, Homo sapiens
ccgtccagagcc

SEQ ID NO: 2896676 - DNA, 13 bp, Homo sapiens
ccgtcccccccca

SEQ ID NO: 2896677 - DNA, 20 bp, Homo sapiens
ccgtcggagctgcctgcagc

SEQ ID NO: 2896678 - DNA, 17 bp, Homo sapiens
ccgtctggggttcagcc

SEQ ID NO: 2896679 - DNA, 19 bp, Homo sapiens
ccgtctggggttcagcccc

SEQ ID NO: 2896680 - DNA, 22 bp, Homo sapiens
ccgtctggggttcagcccctcc

SEQ ID NO: 2896681 - DNA, 23 bp, Homo sapiens
ccgtctgtgtggggttctcagtg

SEQ ID NO: 2896682 - DNA, 18 bp, Homo sapiens
ccgtgaaaacggagctga

SEQ ID NO: 2896683 - DNA, 18 bp, Homo sapiens
ccgtgacagactcctgag

SEQ ID NO: 2896684 - DNA, 13 bp, Homo sapiens
ccgtgacagtggc

SEQ ID NO: 2896685 - DNA, 17 bp, Homo sapiens
ccgtgaggctgctgcca

SEQ ID NO: 2896686 - DNA, 19 bp, Homo sapiens
ccgtgaggctgctgccatc

SEQ ID NO: 2896687 - DNA, 18 bp, Homo sapiens
ccgtgagtgacatagcct

SEQ ID NO: 2896688 - DNA, 22 bp, Homo sapiens
ccgtgcacggttcaatggtaga

SEQ ID NO: 2896689 - DNA, 18 bp, Homo sapiens
ccgtgccacccccagccc

SEQ ID NO: 2896690 - DNA, 21 bp, Homo sapiens
ccgtgccacccccagccctgg

SEQ ID NO: 2896691 - DNA, 23 bp, Homo sapiens
ccgtggcatcaccttaggcaggg

SEQ ID NO: 2896692 - DNA, 18 bp, Homo sapiens
ccgtggccccgccctcag

SEQ ID NO: 2896693 - DNA, 21 bp, Homo sapiens
ccgtggcctggcatctgtgtg

SEQ ID NO: 2896694 - DNA, 13 bp, Homo sapiens
ccgtggcctgggc

SEQ ID NO: 2896695 - DNA, 14 bp, Homo sapiens
ccgtggcctgggct

SEQ ID NO: 2896696 - DNA, 22 bp, Homo sapiens
ccgtggctccagaatgtgctgc

SEQ ID NO: 2896697 - DNA, 23 bp, Homo sapiens
ccgtggctccagaatgtgctgcc

SEQ ID NO: 2896698 - DNA, 23 bp, Homo sapiens
ccgtggctgtggcatccagagtc

SEQ ID NO: 2896699 - DNA, 20 bp, Homo sapiens
ccgtggcttggcatctgtgt

SEQ ID NO: 2896700 - DNA, 20 bp, Homo sapiens
ccgtggcttgggctggtcag

SEQ ID NO: 2896701 - DNA, 14 bp, Homo sapiens
ccgtgggctccctg

SEQ ID NO: 2896702 - DNA, 22 bp, Homo sapiens
ccgttactctccaacctggaca

SEQ ID NO: 2896703 - DNA, 20 bp, Homo sapiens
ccgttcaaattctcttcttt

SEQ ID NO: 2896704 - DNA, 13 bp, Homo sapiens
ccgttcagcctgt

SEQ ID NO: 2896705 - DNA, 12 bp, Homo sapiens
ccgttttcccca

SEQ ID NO: 2896706 - DNA, 15 bp, Homo sapiens
ccgttttccccatga

SEQ ID NO: 2896707 - DNA, 17 bp, Homo sapiens
ccgttttccccatgaca

SEQ ID NO: 2896708 - DNA, 13 bp, Homo sapiens
cctaaacatatga

SEQ ID NO: 2896709 - DNA, 12 bp, Homo sapiens
cctcaaatacat

SEQ ID NO: 2896710 - DNA, 16 bp, Homo sapiens
cctcaacctcctgggt

SEQ ID NO: 2896711 - DNA, 16 bp, Homo sapiens
cctcaagaaataaaag

SEQ ID NO: 2896712 - DNA, 22 bp, Homo sapiens
cctcaaggttttaggttctaaa

SEQ ID NO: 2896713 - DNA, 19 bp, Homo sapiens
cctcaagtgatcctcccac

SEQ ID NO: 2896714 - DNA, 18 bp, Homo sapiens
cctcaagttccagtgcag

SEQ ID NO: 2896715 - DNA, 18 bp, Homo sapiens
cctcaatccagctatgtt

SEQ ID NO: 2896716 - DNA, 21 bp, Homo sapiens
cctcaatgtgaatcagaccct

SEQ ID NO: 2896717 - DNA, 22 bp, Homo sapiens
cctcaatgtgaatcagacccta

SEQ ID NO: 2896718 - DNA, 21 bp, Homo sapiens
cctcacaactccttccatcct

SEQ ID NO: 2896719 - DNA, 14 bp, Homo sapiens
cctcacactccaga

SEQ ID NO: 2896720 - DNA, 12 bp, Homo sapiens
cctcacagactc

SEQ ID NO: 2896721 - DNA, 13 bp, Homo sapiens
cctcacagatgct

SEQ ID NO: 2896722 - DNA, 14 bp, Homo sapiens
cctcacagatgctg

SEQ ID NO: 2896723 - DNA, 20 bp, Homo sapiens
cctcacagatgctggcctct

SEQ ID NO: 2896724 - DNA, 15 bp, Homo sapiens
cctcacagcacagag

SEQ ID NO: 2896725 - DNA, 19 bp, Homo sapiens
cctcacagcacagagaaga

SEQ ID NO: 2896726 - DNA, 16 bp, Homo sapiens
cctcaccacccccact

SEQ ID NO: 2896727 - DNA, 16 bp, Homo sapiens
cctcaccatgatgggg

SEQ ID NO: 2896728 - DNA, 16 bp, Homo sapiens
cctcacccaccctgtg

SEQ ID NO: 2896729 - DNA, 17 bp, Homo sapiens
cctcaccccgaggccct

SEQ ID NO: 2896730 - DNA, 16 bp, Homo sapiens
cctcaccccgtctggg

SEQ ID NO: 2896731 - DNA, 20 bp, Homo sapiens
cctcaccctctgtccccacg

SEQ ID NO: 2896732 - DNA, 15 bp, Homo sapiens
cctcaccctttacct

SEQ ID NO: 2896733 - DNA, 15 bp, Homo sapiens
cctcaccttggcacc

SEQ ID NO: 2896734 - DNA, 16 bp, Homo sapiens
cctcaccttggcacca

SEQ ID NO: 2896735 - DNA, 14 bp, Homo sapiens
cctcacgcacctcc

SEQ ID NO: 2896736 - DNA, 13 bp, Homo sapiens
cctcacgccccct

SEQ ID NO: 2896737 - DNA, 22 bp, Homo sapiens
cctcacgtatttcacagagcac

SEQ ID NO: 2896738 - DNA, 17 bp, Homo sapiens
cctcacgtgcaggacag

SEQ ID NO: 2896739 - DNA, 19 bp, Homo sapiens
cctcactactcgagcccac

SEQ ID NO: 2896740 - DNA, 15 bp, Homo sapiens
cctcactccctaggc

SEQ ID NO: 2896741 - DNA, 18 bp, Homo sapiens
cctcactccctaggccca

SEQ ID NO: 2896742 - DNA, 13 bp, Homo sapiens
cctcactcttgaa

SEQ ID NO: 2896743 - DNA, 22 bp, Homo sapiens
cctcactcttgaagtccaggac

SEQ ID NO: 2896744 - DNA, 23 bp, Homo sapiens
cctcactcttgaagtccaggact

SEQ ID NO: 2896745 - DNA, 20 bp, Homo sapiens
cctcactgaaaacatctgga

SEQ ID NO: 2896746 - DNA, 13 bp, Homo sapiens
cctcactggctca

SEQ ID NO: 2896747 - DNA, 18 bp, Homo sapiens
cctcactggctcatgccc

SEQ ID NO: 2896748 - DNA, 19 bp, Homo sapiens
cctcacttggtctgccagg

SEQ ID NO: 2896749 - DNA, 22 bp, Homo sapiens
cctcacttttaatgaacaaatg

SEQ ID NO: 2896750 - DNA, 16 bp, Homo sapiens
cctcagaacccttggc

SEQ ID NO: 2896751 - DNA, 16 bp, Homo sapiens
cctcagacagccccct

SEQ ID NO: 2896752 - DNA, 23 bp, Homo sapiens
cctcagacgagacccaagggcag

SEQ ID NO: 2896753 - DNA, 16 bp, Homo sapiens
cctcagactgcaccca

SEQ ID NO: 2896754 - DNA, 17 bp, Homo sapiens
cctcagactgcacccag

SEQ ID NO: 2896755 - DNA, 18 bp, Homo sapiens
cctcagactgcacccagg

SEQ ID NO: 2896756 - DNA, 19 bp, Homo sapiens
cctcagactgcacccagga

SEQ ID NO: 2896757 - DNA, 20 bp, Homo sapiens
cctcagactgcacccaggag

SEQ ID NO: 2896758 - DNA, 15 bp, Homo sapiens
cctcagagcccatgg

SEQ ID NO: 2896759 - DNA, 21 bp, Homo sapiens
cctcagagtgcaagcccctgc

SEQ ID NO: 2896760 - DNA, 14 bp, Homo sapiens
cctcagatgtgttg

SEQ ID NO: 2896761 - DNA, 11 bp, Homo sapiens
cctcagccaga

SEQ ID NO: 2896762 - DNA, 15 bp, Homo sapiens
cctcagccagagaag

SEQ ID NO: 2896763 - DNA, 18 bp, Homo sapiens
cctcagccctgaccctgt

SEQ ID NO: 2896764 - DNA, 21 bp, Homo sapiens
cctcagccctgaccctgtgga

SEQ ID NO: 2896765 - DNA, 16 bp, Homo sapiens
cctcagccgtcagcca

SEQ ID NO: 2896766 - DNA, 18 bp, Homo sapiens
cctcagccgtcagccatc

SEQ ID NO: 2896767 - DNA, 16 bp, Homo sapiens
cctcagcctccccagt

SEQ ID NO: 2896768 - DNA, 15 bp, Homo sapiens
cctcagcctcctggg

SEQ ID NO: 2896769 - DNA, 16 bp, Homo sapiens
cctcagcctcctgggt

SEQ ID NO: 2896770 - DNA, 11 bp, Homo sapiens
cctcagcctgc

SEQ ID NO: 2896771 - DNA, 12 bp, Homo sapiens
cctcagcctgca

SEQ ID NO: 2896772 - DNA, 14 bp, Homo sapiens
cctcagcctgcaca

SEQ ID NO: 2896773 - DNA, 16 bp, Homo sapiens
cctcagcctgcaccct

SEQ ID NO: 2896774 - DNA, 12 bp, Homo sapiens
cctcagcctggc

SEQ ID NO: 2896775 - DNA, 13 bp, Homo sapiens
cctcagcctggcc

SEQ ID NO: 2896776 - DNA, 17 bp, Homo sapiens
cctcagcctggccagac

SEQ ID NO: 2896777 - DNA, 18 bp, Homo sapiens
cctcagccttgccagaga

SEQ ID NO: 2896778 - DNA, 23 bp, Homo sapiens
cctcagccttggataatgctgtt

SEQ ID NO: 2896779 - DNA, 22 bp, Homo sapiens
cctcagctcagcttcgtgcctg

SEQ ID NO: 2896780 - DNA, 20 bp, Homo sapiens
cctcagctctgtcctgttag

SEQ ID NO: 2896781 - DNA, 15 bp, Homo sapiens
cctcaggcacacagc

SEQ ID NO: 2896782 - DNA, 24 bp, Homo sapiens
cctcagggacagagacacctgcac

SEQ ID NO: 2896783 - DNA, 23 bp, Homo sapiens
cctcagggatgtgggaatctccc

SEQ ID NO: 2896784 - DNA, 15 bp, Homo sapiens
cctcagggccaggaa

SEQ ID NO: 2896785 - DNA, 18 bp, Homo sapiens
cctcagggccaggaagga

SEQ ID NO: 2896786 - DNA, 17 bp, Homo sapiens
cctcaggggaagctgct

SEQ ID NO: 2896787 - DNA, 18 bp, Homo sapiens
cctcaggggaagctgcta

SEQ ID NO: 2896788 - DNA, 18 bp, Homo sapiens
cctcagggtctaaggagc

SEQ ID NO: 2896789 - DNA, 21 bp, Homo sapiens
cctcagggtctaaggagcgct

SEQ ID NO: 2896790 - DNA, 13 bp, Homo sapiens
cctcagggtgtcc

SEQ ID NO: 2896791 - DNA, 12 bp, Homo sapiens
cctcaggtggcc

SEQ ID NO: 2896792 - DNA, 20 bp, Homo sapiens
cctcagtagcatctcagtgg

SEQ ID NO: 2896793 - DNA, 22 bp, Homo sapiens
cctcagtcccaaatccttccca

SEQ ID NO: 2896794 - DNA, 23 bp, Homo sapiens
cctcagtgcaaaatgtcttgtgt

SEQ ID NO: 2896795 - DNA, 22 bp, Homo sapiens
cctcagtggagacaagtgggaa

SEQ ID NO: 2896796 - DNA, 16 bp, Homo sapiens
cctcagtggctctggg

SEQ ID NO: 2896797 - DNA, 14 bp, Homo sapiens
cctcagttctcaaa

SEQ ID NO: 2896798 - DNA, 14 bp, Homo sapiens
cctcagttgtgcag

SEQ ID NO: 2896799 - DNA, 15 bp, Homo sapiens
cctcagttgtgcagc

SEQ ID NO: 2896800 - DNA, 16 bp, Homo sapiens
cctcagttgtgcagct

SEQ ID NO: 2896801 - DNA, 17 bp, Homo sapiens
cctcagttgtgcagctt

SEQ ID NO: 2896802 - DNA, 22 bp, Homo sapiens
cctcatcaggagttccagtgct

SEQ ID NO: 2896803 - DNA, 17 bp, Homo sapiens
cctcatcctcagatgct

SEQ ID NO: 2896804 - DNA, 19 bp, Homo sapiens
cctcatcctgcttctcttt

SEQ ID NO: 2896805 - DNA, 19 bp, Homo sapiens
cctcatctccagtatcctg

SEQ ID NO: 2896806 - DNA, 17 bp, Homo sapiens
cctcatctgcctggaaa

SEQ ID NO: 2896807 - DNA, 14 bp, Homo sapiens
cctcatctgtgcct

SEQ ID NO: 2896808 - DNA, 17 bp, Homo sapiens
cctcatgtcatttctca

SEQ ID NO: 2896809 - DNA, 17 bp, Homo sapiens
cctcattaatgacactt

SEQ ID NO: 2896810 - DNA, 16 bp, Homo sapiens
cctcattcaggaaaac

SEQ ID NO: 2896811 - DNA, 22 bp, Homo sapiens
cctcattcaggaaaactgacag

SEQ ID NO: 2896812 - DNA, 20 bp, Homo sapiens
cctcatttatccctcaaccc

SEQ ID NO: 2896813 - DNA, 17 bp, Homo sapiens
cctcatttggggtagct

SEQ ID NO: 2896814 - DNA, 19 bp, Homo sapiens
cctccaatcctccccgctc

SEQ ID NO: 2896815 - DNA, 16 bp, Homo sapiens
cctccacacaagggaa

SEQ ID NO: 2896816 - DNA, 12 bp, Homo sapiens
cctccacagctt

SEQ ID NO: 2896817 - DNA, 19 bp, Homo sapiens
cctccacctatccctaaca

SEQ ID NO: 2896818 - DNA, 21 bp, Homo sapiens
cctccacggtccgcggcctgc

SEQ ID NO: 2896819 - DNA, 22 bp, Homo sapiens
cctccacggtccgcggcctgca

SEQ ID NO: 2896820 - DNA, 21 bp, Homo sapiens
cctccagaactcactggggcc

SEQ ID NO: 2896821 - DNA, 12 bp, Homo sapiens
cctccagaagcc

SEQ ID NO: 2896822 - DNA, 13 bp, Homo sapiens
cctccagaagcct

SEQ ID NO: 2896823 - DNA, 17 bp, Homo sapiens
cctccagcacaaacaca

SEQ ID NO: 2896824 - DNA, 20 bp, Homo sapiens
cctccagctgtcagcctggt

SEQ ID NO: 2896825 - DNA, 20 bp, Homo sapiens
cctccagcttttcctcaggg

SEQ ID NO: 2896826 - DNA, 19 bp, Homo sapiens
cctccagggccacgtgcca

SEQ ID NO: 2896827 - DNA, 20 bp, Homo sapiens
cctccagggccacgtgccag

SEQ ID NO: 2896828 - DNA, 14 bp, Homo sapiens
cctccaggtgcaga

SEQ ID NO: 2896829 - DNA, 17 bp, Homo sapiens
cctccaggtgcagaggt

SEQ ID NO: 2896830 - DNA, 18 bp, Homo sapiens
cctccaggtgcagaggta

SEQ ID NO: 2896831 - DNA, 13 bp, Homo sapiens
cctccagtcctgc

SEQ ID NO: 2896832 - DNA, 14 bp, Homo sapiens
cctccagtcctgct

SEQ ID NO: 2896833 - DNA, 15 bp, Homo sapiens
cctccagtcctgctg

SEQ ID NO: 2896834 - DNA, 16 bp, Homo sapiens
cctccagtcctgctgg

SEQ ID NO: 2896835 - DNA, 15 bp, Homo sapiens
cctccagtctgttct

SEQ ID NO: 2896836 - DNA, 19 bp, Homo sapiens
cctccagtctgttctcaca

SEQ ID NO: 2896837 - DNA, 18 bp, Homo sapiens
cctccagttgtagcaggt

SEQ ID NO: 2896838 - DNA, 20 bp, Homo sapiens
cctccataagtttaacttta

SEQ ID NO: 2896839 - DNA, 17 bp, Homo sapiens
cctccatccatctgtcc

SEQ ID NO: 2896840 - DNA, 20 bp, Homo sapiens
cctccatccccatcggccct

SEQ ID NO: 2896841 - DNA, 14 bp, Homo sapiens
cctccatggtcctg

SEQ ID NO: 2896842 - DNA, 23 bp, Homo sapiens
cctccatggtcctgtctgtcctt

SEQ ID NO: 2896843 - DNA, 14 bp, Homo sapiens
cctccattcctgct

SEQ ID NO: 2896844 - DNA, 23 bp, Homo sapiens
cctcccaatctcaatacagcctg

SEQ ID NO: 2896845 - DNA, 20 bp, Homo sapiens
cctcccaatttcagactccc

SEQ ID NO: 2896846 - DNA, 13 bp, Homo sapiens
cctcccactgggg

SEQ ID NO: 2896847 - DNA, 12 bp, Homo sapiens
cctcccactttg

SEQ ID NO: 2896848 - DNA, 16 bp, Homo sapiens
cctcccagagtgctgg

SEQ ID NO: 2896849 - DNA, 13 bp, Homo sapiens
cctcccagtgcct

SEQ ID NO: 2896850 - DNA, 19 bp, Homo sapiens
cctccccaaagccactgga

SEQ ID NO: 2896851 - DNA, 23 bp, Homo sapiens
cctccccaaagccactggaagga

SEQ ID NO: 2896852 - DNA, 13 bp, Homo sapiens
cctccccaatcca

SEQ ID NO: 2896853 - DNA, 20 bp, Homo sapiens
cctccccaccagagctgcct

SEQ ID NO: 2896854 - DNA, 12 bp, Homo sapiens
cctccccaccca

SEQ ID NO: 2896855 - DNA, 20 bp, Homo sapiens
cctccccacccaagagagga

SEQ ID NO: 2896856 - DNA, 14 bp, Homo sapiens
cctccccagtagct

SEQ ID NO: 2896857 - DNA, 15 bp, Homo sapiens
cctccccatctgtgt

SEQ ID NO: 2896858 - DNA, 23 bp, Homo sapiens
cctccccatctgtgttctaactt

SEQ ID NO: 2896859 - DNA, 16 bp, Homo sapiens
cctccccatggagcca

SEQ ID NO: 2896860 - DNA, 16 bp, Homo sapiens
cctcccccactcctct

SEQ ID NO: 2896861 - DNA, 15 bp, Homo sapiens
cctccccccactgca

SEQ ID NO: 2896862 - DNA, 16 bp, Homo sapiens
cctccccccactgcag

SEQ ID NO: 2896863 - DNA, 20 bp, Homo sapiens
cctccccccactgcaggccc

SEQ ID NO: 2896864 - DNA, 15 bp, Homo sapiens
cctcccccccatgca

SEQ ID NO: 2896865 - DNA, 23 bp, Homo sapiens
cctccccctaccgcatggcagct

SEQ ID NO: 2896866 - DNA, 19 bp, Homo sapiens
cctccccctgccagtgcct

SEQ ID NO: 2896867 - DNA, 21 bp, Homo sapiens
cctccccgaggttgtggggag

SEQ ID NO: 2896868 - DNA, 17 bp, Homo sapiens
cctccccgtctcattcc

SEQ ID NO: 2896869 - DNA, 18 bp, Homo sapiens
cctcccctatccacccag

SEQ ID NO: 2896870 - DNA, 17 bp, Homo sapiens
cctcccctctccttcct

SEQ ID NO: 2896871 - DNA, 16 bp, Homo sapiens
cctccccttttctatg

SEQ ID NO: 2896872 - DNA, 18 bp, Homo sapiens
cctcccggcctggcttca

SEQ ID NO: 2896873 - DNA, 18 bp, Homo sapiens
cctccctagatccaggct

SEQ ID NO: 2896874 - DNA, 22 bp, Homo sapiens
cctccctagatccaggcttctc

SEQ ID NO: 2896875 - DNA, 20 bp, Homo sapiens
cctccctctcttccgggagc

SEQ ID NO: 2896876 - DNA, 15 bp, Homo sapiens
cctccctctgcctca

SEQ ID NO: 2896877 - DNA, 17 bp, Homo sapiens
cctccctctgcctcatc

SEQ ID NO: 2896878 - DNA, 15 bp, Homo sapiens
cctccctgcctccag

SEQ ID NO: 2896879 - DNA, 12 bp, Homo sapiens
cctccctgcgct

SEQ ID NO: 2896880 - DNA, 13 bp, Homo sapiens
cctccctggcaga

SEQ ID NO: 2896881 - DNA, 14 bp, Homo sapiens
cctccctgtcctcc

SEQ ID NO: 2896882 - DNA, 11 bp, Homo sapiens
cctcccttccc

SEQ ID NO: 2896883 - DNA, 12 bp, Homo sapiens
cctcccttccca

SEQ ID NO: 2896884 - DNA, 15 bp, Homo sapiens
cctcccttctgctac

SEQ ID NO: 2896885 - DNA, 22 bp, Homo sapiens
cctcccttgagtaggccctgct

SEQ ID NO: 2896886 - DNA, 15 bp, Homo sapiens
cctccgacctctctc

SEQ ID NO: 2896887 - DNA, 19 bp, Homo sapiens
cctccgatgcctggcctgc

SEQ ID NO: 2896888 - DNA, 16 bp, Homo sapiens
cctccgccaggcgaga

SEQ ID NO: 2896889 - DNA, 23 bp, Homo sapiens
cctccgcctactgtccctctcag

SEQ ID NO: 2896890 - DNA, 18 bp, Homo sapiens
cctccgccttcacattcc

SEQ ID NO: 2896891 - DNA, 17 bp, Homo sapiens
cctccgccttcccagca

SEQ ID NO: 2896892 - DNA, 17 bp, Homo sapiens
ccgacaccactcctgcc

SEQ ID NO: 2896893 - DNA, 16 bp, Homo sapiens
ccgaccctgcggcctc

SEQ ID NO: 2896894 - DNA, 22 bp, Homo sapiens
ccgacctcgtcctccccctgcc

SEQ ID NO: 2896895 - DNA, 19 bp, Homo sapiens
ccgacctctctcagcccca

SEQ ID NO: 2896896 - DNA, 18 bp, Homo sapiens
ccgacctctctcggcccc

SEQ ID NO: 2896897 - DNA, 22 bp, Homo sapiens
ccgacggctgtgacgcagccgg

SEQ ID NO: 2896898 - DNA, 11 bp, Homo sapiens
ccgactccccc

SEQ ID NO: 2896899 - DNA, 14 bp, Homo sapiens
ccgactgcccagcc

SEQ ID NO: 2896900 - DNA, 16 bp, Homo sapiens
ccgactgcctgtctcc

SEQ ID NO: 2896901 - DNA, 14 bp, Homo sapiens
ccgactgcgctgct

SEQ ID NO: 2896902 - DNA, 22 bp, Homo sapiens
ccgacttttgtttaccagagaa

SEQ ID NO: 2896903 - DNA, 13 bp, Homo sapiens
ccgagaagaacag

SEQ ID NO: 2896904 - DNA, 15 bp, Homo sapiens
ccgagagcctgctcc

SEQ ID NO: 2896905 - DNA, 21 bp, Homo sapiens
ccgagagtagccgagagcctg

SEQ ID NO: 2896906 - DNA, 23 bp, Homo sapiens
ccgagatagggtggcacatctgt

SEQ ID NO: 2896907 - DNA, 20 bp, Homo sapiens
ccgagatcgtgccattgcac

SEQ ID NO: 2896908 - DNA, 22 bp, Homo sapiens
ccgagcgctggtcccctccctc

SEQ ID NO: 2896909 - DNA, 13 bp, Homo sapiens
ccgagctctgtgg

SEQ ID NO: 2896910 - DNA, 19 bp, Homo sapiens
ccgagctctgtgggaaaaa

SEQ ID NO: 2896911 - DNA, 16 bp, Homo sapiens
ccgagctgaggactct

SEQ ID NO: 2896912 - DNA, 14 bp, Homo sapiens
ccgagctggaaaac

SEQ ID NO: 2896913 - DNA, 15 bp, Homo sapiens
ccgagctggtttcct

SEQ ID NO: 2896914 - DNA, 18 bp, Homo sapiens
ccgaggaactcgcctcag

SEQ ID NO: 2896915 - DNA, 19 bp, Homo sapiens
ccgaggactggactgtttt

SEQ ID NO: 2896916 - DNA, 12 bp, Homo sapiens
ccgaggaggggc

SEQ ID NO: 2896917 - DNA, 14 bp, Homo sapiens
ccgaggcaggcaga

SEQ ID NO: 2896918 - DNA, 11 bp, Homo sapiens
ccgaggccagt

SEQ ID NO: 2896919 - DNA, 12 bp, Homo sapiens
ccgaggccctgc

SEQ ID NO: 2896920 - DNA, 16 bp, Homo sapiens
ccgaggccctgcatgg

SEQ ID NO: 2896921 - DNA, 17 bp, Homo sapiens
ccgaggctgccccaggc

SEQ ID NO: 2896922 - DNA, 17 bp, Homo sapiens
ccgagggttgattaagg

SEQ ID NO: 2896923 - DNA, 17 bp, Homo sapiens
ccgatagagggacggcc

SEQ ID NO: 2896924 - DNA, 13 bp, Homo sapiens
ccgatgctgacct

SEQ ID NO: 2896925 - DNA, 19 bp, Homo sapiens
ccgatgggagtctccctcc

SEQ ID NO: 2896926 - DNA, 18 bp, Homo sapiens
ccgatggtcccaggaagc

SEQ ID NO: 2896927 - DNA, 16 bp, Homo sapiens
ccgcaaaccacactgg

SEQ ID NO: 2896928 - DNA, 21 bp, Homo sapiens
ccgcaaaccacactggactcc

SEQ ID NO: 2896929 - DNA, 15 bp, Homo sapiens
ccgcaagggcctgga

SEQ ID NO: 2896930 - DNA, 13 bp, Homo sapiens
ccgcaccctggcc

SEQ ID NO: 2896931 - DNA, 22 bp, Homo sapiens
ccgcacctgtacagtggaaccg

SEQ ID NO: 2896932 - DNA, 22 bp, Homo sapiens
ccgcacctgtcggtggctgcct

SEQ ID NO: 2896933 - DNA, 16 bp, Homo sapiens
ccgcaccttcctcctc

SEQ ID NO: 2896934 - DNA, 23 bp, Homo sapiens
ccgcaccttcctcctccccgctc

SEQ ID NO: 2896935 - DNA, 15 bp, Homo sapiens
ccgcagacctctgga

SEQ ID NO: 2896936 - DNA, 17 bp, Homo sapiens
ccgcagactgcttggcc

SEQ ID NO: 2896937 - DNA, 19 bp, Homo sapiens
ccgcagactgcttggccag

SEQ ID NO: 2896938 - DNA, 12 bp, Homo sapiens
ccgcagagactg

SEQ ID NO: 2896939 - DNA, 12 bp, Homo sapiens
ccgcagctgctg

SEQ ID NO: 2896940 - DNA, 23 bp, Homo sapiens
ccgcagctgctgccactctgctg

SEQ ID NO: 2896941 - DNA, 13 bp, Homo sapiens
ccgcaggaagctg

SEQ ID NO: 2896942 - DNA, 15 bp, Homo sapiens
ccgcaggaagctgct

SEQ ID NO: 2896943 - DNA, 19 bp, Homo sapiens
ccgcaggaagctgctccgt

SEQ ID NO: 2896944 - DNA, 22 bp, Homo sapiens
ccgcaggcgcggcggctctgcc

SEQ ID NO: 2896945 - DNA, 21 bp, Homo sapiens
ccgcatcctagtctctatcat

SEQ ID NO: 2896946 - DNA, 15 bp, Homo sapiens
ccgcatcttctccat

SEQ ID NO: 2896947 - DNA, 13 bp, Homo sapiens
ccgcatggcagct

SEQ ID NO: 2896948 - DNA, 16 bp, Homo sapiens
ccgcatggcagctggg

SEQ ID NO: 2896949 - DNA, 17 bp, Homo sapiens
ccgcatggcagctgggc

SEQ ID NO: 2896950 - DNA, 20 bp, Homo sapiens
ccgcattcagtgcacctgcc

SEQ ID NO: 2896951 - DNA, 14 bp, Homo sapiens
ccgcattccaggct

SEQ ID NO: 2896952 - DNA, 13 bp, Homo sapiens
ccgcattccctga

SEQ ID NO: 2896953 - DNA, 23 bp, Homo sapiens
ccgcattccctgagtcaccagga

SEQ ID NO: 2896954 - DNA, 22 bp, Homo sapiens
ccgccagccccgctcccaccta

SEQ ID NO: 2896955 - DNA, 17 bp, Homo sapiens
ccgccaggcgctgcagg

SEQ ID NO: 2896956 - DNA, 23 bp, Homo sapiens
ccgccaggcgctgcagggccgcg

SEQ ID NO: 2896957 - DNA, 19 bp, Homo sapiens
ccgccatacattaaggagc

SEQ ID NO: 2896958 - DNA, 14 bp, Homo sapiens
ccgccatctgcgca

SEQ ID NO: 2896959 - DNA, 15 bp, Homo sapiens
ccgccatctgcgcag

SEQ ID NO: 2896960 - DNA, 22 bp, Homo sapiens
ccgcccagagacccaagctgcc

SEQ ID NO: 2896961 - DNA, 12 bp, Homo sapiens
ccgcccagctct

SEQ ID NO: 2896962 - DNA, 19 bp, Homo sapiens
ccgcccatgcactggggac

SEQ ID NO: 2896963 - DNA, 19 bp, Homo sapiens
ccgccccaaagtaaaagaa

SEQ ID NO: 2896964 - DNA, 13 bp, Homo sapiens
ccgcccccaccgg

SEQ ID NO: 2896965 - DNA, 15 bp, Homo sapiens
ccgcccccaccgggc

SEQ ID NO: 2896966 - DNA, 17 bp, Homo sapiens
ccgccccctgccctccc

SEQ ID NO: 2896967 - DNA, 16 bp, Homo sapiens
ccgccccgggctggcc

SEQ ID NO: 2896968 - DNA, 16 bp, Homo sapiens
ccgccctgcgggccac

SEQ ID NO: 2896969 - DNA, 14 bp, Homo sapiens
ccgccgcccgctgg

SEQ ID NO: 2896970 - DNA, 19 bp, Homo sapiens
ccgccgcgcctggcctaga

SEQ ID NO: 2896971 - DNA, 17 bp, Homo sapiens
ccgccggggtcctggga

SEQ ID NO: 2896972 - DNA, 19 bp, Homo sapiens
ccgccggggtcctgggagg

SEQ ID NO: 2896973 - DNA, 15 bp, Homo sapiens
ccgcctcccatcccg

SEQ ID NO: 2896974 - DNA, 23 bp, Homo sapiens
ccgcctccctagttagcatccag

SEQ ID NO: 2896975 - DNA, 16 bp, Homo sapiens
ccgcctcgtgccagca

SEQ ID NO: 2896976 - DNA, 17 bp, Homo sapiens
ccgcctcgtgccagcag

SEQ ID NO: 2896977 - DNA, 20 bp, Homo sapiens
ccgcctcgtgccagcagcct

SEQ ID NO: 2896978 - DNA, 21 bp, Homo sapiens
ccgcctcgtgccagcagcctc

SEQ ID NO: 2896979 - DNA, 13 bp, Homo sapiens
ccgcctgcccacc

SEQ ID NO: 2896980 - DNA, 21 bp, Homo sapiens
ccgcctgcccacctgcctggc

SEQ ID NO: 2896981 - DNA, 14 bp, Homo sapiens
ccgccttcagcctc

SEQ ID NO: 2896982 - DNA, 12 bp, Homo sapiens
ccgccttccctc

SEQ ID NO: 2896983 - DNA, 21 bp, Homo sapiens
ccgccttctcccttctctcac

SEQ ID NO: 2896984 - DNA, 17 bp, Homo sapiens
ccgcctttacaagggag

SEQ ID NO: 2896985 - DNA, 18 bp, Homo sapiens
ccgcgcggagacctcctg

SEQ ID NO: 2896986 - DNA, 19 bp, Homo sapiens
ccgcgcggagacctcctga

SEQ ID NO: 2896987 - DNA, 22 bp, Homo sapiens
ccgcgcggagacctcctgacaa

SEQ ID NO: 2896988 - DNA, 23 bp, Homo sapiens
ccgcgcgtccagctgcccttccg

SEQ ID NO: 2896989 - DNA, 14 bp, Homo sapiens
ccgcggccctgggg

SEQ ID NO: 2896990 - DNA, 15 bp, Homo sapiens
ccgcggcctccccga

SEQ ID NO: 2896991 - DNA, 20 bp, Homo sapiens
ccgcggggacattgggaagg

SEQ ID NO: 2896992 - DNA, 22 bp, Homo sapiens
ccgcgtgtccccggggcccagg

SEQ ID NO: 2896993 - DNA, 15 bp, Homo sapiens
ccgctcccacctagt

SEQ ID NO: 2896994 - DNA, 19 bp, Homo sapiens
ccgctccgtctctgtcctc

SEQ ID NO: 2896995 - DNA, 15 bp, Homo sapiens
ccgctctcctgccac

SEQ ID NO: 2896996 - DNA, 14 bp, Homo sapiens
ccgctgccacccac

SEQ ID NO: 2896997 - DNA, 15 bp, Homo sapiens
ccgctgccacccacc

SEQ ID NO: 2896998 - DNA, 20 bp, Homo sapiens
ccgctgccacccacctccct

SEQ ID NO: 2896999 - DNA, 23 bp, Homo sapiens
ccgctgccacccacctccctgcc

SEQ ID NO: 2897000 - DNA, 20 bp, Homo sapiens
cctccgcgtgatcaaagcca

SEQ ID NO: 2897001 - DNA, 18 bp, Homo sapiens
cctccgcttatcctgcta

SEQ ID NO: 2897002 - DNA, 23 bp, Homo sapiens
cctccgcttatcctgctagcagg

SEQ ID NO: 2897003 - DNA, 22 bp, Homo sapiens
cctccgggcaggggagccaggg

SEQ ID NO: 2897004 - DNA, 20 bp, Homo sapiens
cctccggggttcagcctcct

SEQ ID NO: 2897005 - DNA, 13 bp, Homo sapiens
cctccgtggcaca

SEQ ID NO: 2897006 - DNA, 14 bp, Homo sapiens
cctcctagcccctt

SEQ ID NO: 2897007 - DNA, 13 bp, Homo sapiens
cctcctcaccccg

SEQ ID NO: 2897008 - DNA, 19 bp, Homo sapiens
cctcctcactccctaggcc

SEQ ID NO: 2897009 - DNA, 15 bp, Homo sapiens
cctcctcagctttgc

SEQ ID NO: 2897010 - DNA, 12 bp, Homo sapiens
cctcctccaggg

SEQ ID NO: 2897011 - DNA, 20 bp, Homo sapiens
cctcctccagggtgatttta

SEQ ID NO: 2897012 - DNA, 21 bp, Homo sapiens
cctcctccccaactgtggggg

SEQ ID NO: 2897013 - DNA, 21 bp, Homo sapiens
cctcctccctcctcactccct

SEQ ID NO: 2897014 - DNA, 22 bp, Homo sapiens
cctcctccctggctgcagcctc

SEQ ID NO: 2897015 - DNA, 23 bp, Homo sapiens
cctcctctccatgcaagtgctgt

SEQ ID NO: 2897016 - DNA, 18 bp, Homo sapiens
cctcctctcccgtctcgc

SEQ ID NO: 2897017 - DNA, 16 bp, Homo sapiens
cctcctctctccctgc

SEQ ID NO: 2897018 - DNA, 12 bp, Homo sapiens
cctcctctgaaa

SEQ ID NO: 2897019 - DNA, 15 bp, Homo sapiens
cctcctctgaaacag

SEQ ID NO: 2897020 - DNA, 16 bp, Homo sapiens
cctcctctgaaacagc

SEQ ID NO: 2897021 - DNA, 20 bp, Homo sapiens
cctcctctgaaacagctgcc

SEQ ID NO: 2897022 - DNA, 21 bp, Homo sapiens
cctcctctgaaacagctgcct

SEQ ID NO: 2897023 - DNA, 14 bp, Homo sapiens
cctcctctgcccgg

SEQ ID NO: 2897024 - DNA, 11 bp, Homo sapiens
cctcctctgtg

SEQ ID NO: 2897025 - DNA, 12 bp, Homo sapiens
cctcctctgtga

SEQ ID NO: 2897026 - DNA, 13 bp, Homo sapiens
cctcctgccagct

SEQ ID NO: 2897027 - DNA, 20 bp, Homo sapiens
cctcctgccagctctgtcac

SEQ ID NO: 2897028 - DNA, 14 bp, Homo sapiens
cctcctgcccacct

SEQ ID NO: 2897029 - DNA, 12 bp, Homo sapiens
cctcctgcccag

SEQ ID NO: 2897030 - DNA, 13 bp, Homo sapiens
cctcctgcccagg

SEQ ID NO: 2897031 - DNA, 18 bp, Homo sapiens
cctcctgctctgcacggt

SEQ ID NO: 2897032 - DNA, 18 bp, Homo sapiens
cctcctggcctcagactg

SEQ ID NO: 2897033 - DNA, 21 bp, Homo sapiens
cctcctggcctcagactgcac

SEQ ID NO: 2897034 - DNA, 20 bp, Homo sapiens
cctcctggctcaggcccagc

SEQ ID NO: 2897035 - DNA, 15 bp, Homo sapiens
cctcctggggccagg

SEQ ID NO: 2897036 - DNA, 17 bp, Homo sapiens
cctcctggggccaggcc

SEQ ID NO: 2897037 - DNA, 17 bp, Homo sapiens
cctcctggtgtcacccc

SEQ ID NO: 2897038 - DNA, 21 bp, Homo sapiens
cctcctggtgtcaccccagag

SEQ ID NO: 2897039 - DNA, 18 bp, Homo sapiens
cctcctgtctcgccagaa

SEQ ID NO: 2897040 - DNA, 16 bp, Homo sapiens
cctccttacattaaaa

SEQ ID NO: 2897041 - DNA, 17 bp, Homo sapiens
cctccttcaattccata

SEQ ID NO: 2897042 - DNA, 12 bp, Homo sapiens
cctccttcagac

SEQ ID NO: 2897043 - DNA, 14 bp, Homo sapiens
cctccttcagacac

SEQ ID NO: 2897044 - DNA, 15 bp, Homo sapiens
cctccttcagacacc

SEQ ID NO: 2897045 - DNA, 14 bp, Homo sapiens
cctccttcttccac

SEQ ID NO: 2897046 - DNA, 12 bp, Homo sapiens
cctccttgccag

SEQ ID NO: 2897047 - DNA, 17 bp, Homo sapiens
cctccttgcttgttaca

SEQ ID NO: 2897048 - DNA, 20 bp, Homo sapiens
cctccttgggcagggtctct

SEQ ID NO: 2897049 - DNA, 15 bp, Homo sapiens
cctccttggtgcctg

SEQ ID NO: 2897050 - DNA, 14 bp, Homo sapiens
cctcctttctctgt

SEQ ID NO: 2897051 - DNA, 15 bp, Homo sapiens
cctcctttctctgta

SEQ ID NO: 2897052 - DNA, 16 bp, Homo sapiens
cctcctttctctgtat

SEQ ID NO: 2897053 - DNA, 14 bp, Homo sapiens
cctcgaaagtgtca

SEQ ID NO: 2897054 - DNA, 15 bp, Homo sapiens
cctcgaaagtgtcat

SEQ ID NO: 2897055 - DNA, 15 bp, Homo sapiens
cctcgacatcactgt

SEQ ID NO: 2897056 - DNA, 13 bp, Homo sapiens
cctcgagggccgc

SEQ ID NO: 2897057 - DNA, 15 bp, Homo sapiens
cctcgagggccgcct

SEQ ID NO: 2897058 - DNA, 20 bp, Homo sapiens
cctcgagggccgcctgcctt

SEQ ID NO: 2897059 - DNA, 24 bp, Homo sapiens
cctcgagggccgcctgccttagca

SEQ ID NO: 2897060 - DNA, 17 bp, Homo sapiens
cctcgagtactgtgggc

SEQ ID NO: 2897061 - DNA, 21 bp, Homo sapiens
cctcgagtactgtgggcaatt

SEQ ID NO: 2897062 - DNA, 12 bp, Homo sapiens
cctcgcacaggc

SEQ ID NO: 2897063 - DNA, 13 bp, Homo sapiens
cctcgcacaggcc

SEQ ID NO: 2897064 - DNA, 15 bp, Homo sapiens
cctcgcacaggccct

SEQ ID NO: 2897065 - DNA, 18 bp, Homo sapiens
cctcgcacaggccctagc

SEQ ID NO: 2897066 - DNA, 20 bp, Homo sapiens
cctcgcacaggccctagctt

SEQ ID NO: 2897067 - DNA, 14 bp, Homo sapiens
cctcgcacttgcag

SEQ ID NO: 2897068 - DNA, 14 bp, Homo sapiens
cctcgccctgggtc

SEQ ID NO: 2897069 - DNA, 16 bp, Homo sapiens
cctcgcctgccctcct

SEQ ID NO: 2897070 - DNA, 13 bp, Homo sapiens
cctcgccttgtgt

SEQ ID NO: 2897071 - DNA, 12 bp, Homo sapiens
cctcgctctgtt

SEQ ID NO: 2897072 - DNA, 19 bp, Homo sapiens
cctcgctctgttacccagg

SEQ ID NO: 2897073 - DNA, 19 bp, Homo sapiens
cctcgctgccagctctgta

SEQ ID NO: 2897074 - DNA, 18 bp, Homo sapiens
cctcgctggactctcagt

SEQ ID NO: 2897075 - DNA, 15 bp, Homo sapiens
cctgcctgctgtgga

SEQ ID NO: 2897076 - DNA, 18 bp, Homo sapiens
cctgcctggccggccagc

SEQ ID NO: 2897077 - DNA, 19 bp, Homo sapiens
cctgcctggccggccagcc

SEQ ID NO: 2897078 - DNA, 16 bp, Homo sapiens
cctgccttagcaatgg

SEQ ID NO: 2897079 - DNA, 19 bp, Homo sapiens
cctgccttcactgtgctcc

SEQ ID NO: 2897080 - DNA, 14 bp, Homo sapiens
cctgccttctcagg

SEQ ID NO: 2897081 - DNA, 15 bp, Homo sapiens
cctgccttctcaggg

SEQ ID NO: 2897082 - DNA, 11 bp, Homo sapiens
cctgcctttgc

SEQ ID NO: 2897083 - DNA, 15 bp, Homo sapiens
cctgcgaccctgggg

SEQ ID NO: 2897084 - DNA, 15 bp, Homo sapiens
cctgcgcacaggtgg

SEQ ID NO: 2897085 - DNA, 18 bp, Homo sapiens
cctgcgcccagtccttcc

SEQ ID NO: 2897086 - DNA, 18 bp, Homo sapiens
cctgcgctcggcaggaag

SEQ ID NO: 2897087 - DNA, 20 bp, Homo sapiens
cctgcgctcggcaggaagga

SEQ ID NO: 2897088 - DNA, 20 bp, Homo sapiens
cctgcgctttgaacgtgcca

SEQ ID NO: 2897089 - DNA, 15 bp, Homo sapiens
cctgcggcctccacc

SEQ ID NO: 2897090 - DNA, 17 bp, Homo sapiens
cctgcgggtcctcagct

SEQ ID NO: 2897091 - DNA, 23 bp, Homo sapiens
cctgcgggtgaacaaagcagcca

SEQ ID NO: 2897092 - DNA, 24 bp, Homo sapiens
cctgcgggtgaacaaagcagccac

SEQ ID NO: 2897093 - DNA, 20 bp, Homo sapiens
cctgcgtctccatatgtgta

SEQ ID NO: 2897094 - DNA, 16 bp, Homo sapiens
cctgctagcaggcccc

SEQ ID NO: 2897095 - DNA, 22 bp, Homo sapiens
cctgctattactaaggagtaat

SEQ ID NO: 2897096 - DNA, 22 bp, Homo sapiens
cctgctatttcaggccctcagc

SEQ ID NO: 2897097 - DNA, 14 bp, Homo sapiens
cctgctccagacct

SEQ ID NO: 2897098 - DNA, 15 bp, Homo sapiens
cctgctccagacctg

SEQ ID NO: 2897099 - DNA, 23 bp, Homo sapiens
cctgctcccccaccccctcccca

SEQ ID NO: 2897100 - DNA, 14 bp, Homo sapiens
cctgctcctaaggg

SEQ ID NO: 2897101 - DNA, 16 bp, Homo sapiens
cctgctcctcatctgc

SEQ ID NO: 2897102 - DNA, 19 bp, Homo sapiens
cctgctctccggcgcagac

SEQ ID NO: 2897103 - DNA, 21 bp, Homo sapiens
cctgctctccggcgcagacag

SEQ ID NO: 2897104 - DNA, 15 bp, Homo sapiens
cctgctctgcacggt

SEQ ID NO: 2897105 - DNA, 21 bp, Homo sapiens
cctgctcttacttcccccacc

SEQ ID NO: 2897106 - DNA, 12 bp, Homo sapiens
cctgctgagagt

SEQ ID NO: 2897107 - DNA, 20 bp, Homo sapiens
cctgctgcccctccctgcct

SEQ ID NO: 2897108 - DNA, 22 bp, Homo sapiens
cctgctgcctgggtaggcccca

SEQ ID NO: 2897109 - DNA, 20 bp, Homo sapiens
cctgctgctgccagggcttc

SEQ ID NO: 2897110 - DNA, 16 bp, Homo sapiens
cctgctgctgtcacct

SEQ ID NO: 2897111 - DNA, 18 bp, Homo sapiens
cctgctgctgtcacctct

SEQ ID NO: 2897112 - DNA, 20 bp, Homo sapiens
cctgctgctgtcacctctcc

SEQ ID NO: 2897113 - DNA, 14 bp, Homo sapiens
cctgctgcttccta

SEQ ID NO: 2897114 - DNA, 16 bp, Homo sapiens
cctgctgcttcctaac

SEQ ID NO: 2897115 - DNA, 17 bp, Homo sapiens
cctgctgcttcctaact

SEQ ID NO: 2897116 - DNA, 20 bp, Homo sapiens
cctgctgctttgttgttctg

SEQ ID NO: 2897117 - DNA, 13 bp, Homo sapiens
cctgctggcctgc

SEQ ID NO: 2897118 - DNA, 14 bp, Homo sapiens
cctgctggcctgct

SEQ ID NO: 2897119 - DNA, 16 bp, Homo sapiens
cctgctggcctgctct

SEQ ID NO: 2897120 - DNA, 12 bp, Homo sapiens
cctgctggctgg

SEQ ID NO: 2897121 - DNA, 16 bp, Homo sapiens
cctgctggctggtgcc

SEQ ID NO: 2897122 - DNA, 19 bp, Homo sapiens
cctgctggctggtgcctga

SEQ ID NO: 2897123 - DNA, 12 bp, Homo sapiens
cctgctgggctc

SEQ ID NO: 2897124 - DNA, 17 bp, Homo sapiens
cctgctgggctctccac

SEQ ID NO: 2897125 - DNA, 13 bp, Homo sapiens
cctggctgcactc

SEQ ID NO: 2897126 - DNA, 19 bp, Homo sapiens
cctggctgcagcctccggg

SEQ ID NO: 2897127 - DNA, 14 bp, Homo sapiens
cctggctgctgctt

SEQ ID NO: 2897128 - DNA, 14 bp, Homo sapiens
cctggctgttctga

SEQ ID NO: 2897129 - DNA, 15 bp, Homo sapiens
cctggcttcactctc

SEQ ID NO: 2897130 - DNA, 18 bp, Homo sapiens
cctggcttgtaactccac

SEQ ID NO: 2897131 - DNA, 20 bp, Homo sapiens
cctggcttgtaactccacca

SEQ ID NO: 2897132 - DNA, 23 bp, Homo sapiens
cctgggaaaccccttctctgtga

SEQ ID NO: 2897133 - DNA, 23 bp, Homo sapiens
cctgggacatcaggagactgggc

SEQ ID NO: 2897134 - DNA, 23 bp, Homo sapiens
cctgggagagacttggatgagga

SEQ ID NO: 2897135 - DNA, 13 bp, Homo sapiens
cctgggagcaagt

SEQ ID NO: 2897136 - DNA, 16 bp, Homo sapiens
cctgggagcaagttgc

SEQ ID NO: 2897137 - DNA, 17 bp, Homo sapiens
cctgggagcaagttgca

SEQ ID NO: 2897138 - DNA, 20 bp, Homo sapiens
cctgggaggatcctgagctg

SEQ ID NO: 2897139 - DNA, 20 bp, Homo sapiens
cctgggaggctgcagccagg

SEQ ID NO: 2897140 - DNA, 17 bp, Homo sapiens
cctgggcaacaagagca

SEQ ID NO: 2897141 - DNA, 20 bp, Homo sapiens
cctgggcaggtgggagctga

SEQ ID NO: 2897142 - DNA, 13 bp, Homo sapiens
cctgggcagtgcc

SEQ ID NO: 2897143 - DNA, 18 bp, Homo sapiens
cctgggcagtgcccacca

SEQ ID NO: 2897144 - DNA, 16 bp, Homo sapiens
cctgggcatccttctt

SEQ ID NO: 2897145 - DNA, 12 bp, Homo sapiens
cctgggccccca

SEQ ID NO: 2897146 - DNA, 22 bp, Homo sapiens
cctgggcccctcccctcagagc

SEQ ID NO: 2897147 - DNA, 22 bp, Homo sapiens
cctgggccgcgtgccgggcccc

SEQ ID NO: 2897148 - DNA, 13 bp, Homo sapiens
cctgggctgggca

SEQ ID NO: 2897149 - DNA, 16 bp, Homo sapiens
cctgggctgggcagcc

SEQ ID NO: 2897150 - DNA, 18 bp, Homo sapiens
cctgggctgggcagcctt

SEQ ID NO: 2897151 - DNA, 19 bp, Homo sapiens
cctgggctgggcagccttg

SEQ ID NO: 2897152 - DNA, 21 bp, Homo sapiens
cctgggctgggtggcccctgt

SEQ ID NO: 2897153 - DNA, 23 bp, Homo sapiens
cctgggcttggcccgcggcctgc

SEQ ID NO: 2897154 - DNA, 12 bp, Homo sapiens
cctggggaccca

SEQ ID NO: 2897155 - DNA, 15 bp, Homo sapiens
cctggggatgtgctt

SEQ ID NO: 2897156 - DNA, 12 bp, Homo sapiens
cctggggcactc

SEQ ID NO: 2897157 - DNA, 14 bp, Homo sapiens
cctggggccaggcc

SEQ ID NO: 2897158 - DNA, 13 bp, Homo sapiens
cctggggcgggca

SEQ ID NO: 2897159 - DNA, 15 bp, Homo sapiens
cctggggctggcctc

SEQ ID NO: 2897160 - DNA, 22 bp, Homo sapiens
cctggggcttgaatttgcatgt

SEQ ID NO: 2897161 - DNA, 13 bp, Homo sapiens
cctgggggagaga

SEQ ID NO: 2897162 - DNA, 13 bp, Homo sapiens
cctgggggctctc

SEQ ID NO: 2897163 - DNA, 16 bp, Homo sapiens
cctgggggctctcatg

SEQ ID NO: 2897164 - DNA, 14 bp, Homo sapiens
cctgggggtgccag

SEQ ID NO: 2897165 - DNA, 20 bp, Homo sapiens
cctggggtgtgggaggcccg

SEQ ID NO: 2897166 - DNA, 22 bp, Homo sapiens
cctgggtaggccccacaaggcc

SEQ ID NO: 2897167 - DNA, 17 bp, Homo sapiens
cctgggtcacagagtga

SEQ ID NO: 2897168 - DNA, 19 bp, Homo sapiens
cctgggtcctgcctgcagt

SEQ ID NO: 2897169 - DNA, 13 bp, Homo sapiens
cctgggtgacaga

SEQ ID NO: 2897170 - DNA, 19 bp, Homo sapiens
cctgggtgacagagtgaga

SEQ ID NO: 2897171 - DNA, 19 bp, Homo sapiens
cctgggtgacttcaggtgg

SEQ ID NO: 2897172 - DNA, 21 bp, Homo sapiens
cctgggtggggctgctcctcc

SEQ ID NO: 2897173 - DNA, 14 bp, Homo sapiens
cctgggtgtccccg

SEQ ID NO: 2897174 - DNA, 17 bp, Homo sapiens
cctgggttgcagacagg

SEQ ID NO: 2897175 - DNA, 13 bp, Homo sapiens
cctgggtttcttt

SEQ ID NO: 2897176 - DNA, 17 bp, Homo sapiens
cctgggtttggcccctg

SEQ ID NO: 2897177 - DNA, 19 bp, Homo sapiens
cctgggttttgtattctct

SEQ ID NO: 2897178 - DNA, 20 bp, Homo sapiens
cctgggttttgtattctctg

SEQ ID NO: 2897179 - DNA, 21 bp, Homo sapiens
cctgggttttgtattctctga

SEQ ID NO: 2897180 - DNA, 23 bp, Homo sapiens
cctggtaaagaaaagcctcagct

SEQ ID NO: 2897181 - DNA, 13 bp, Homo sapiens
cctggtactccct

SEQ ID NO: 2897182 - DNA, 12 bp, Homo sapiens
cctggtccctgg

SEQ ID NO: 2897183 - DNA, 14 bp, Homo sapiens
cctggtccctggga

SEQ ID NO: 2897184 - DNA, 14 bp, Homo sapiens
cctggtccctggtc

SEQ ID NO: 2897185 - DNA, 21 bp, Homo sapiens
cctggtccctggtccttcact

SEQ ID NO: 2897186 - DNA, 15 bp, Homo sapiens
cctggtcctggcctc

SEQ ID NO: 2897187 - DNA, 17 bp, Homo sapiens
cctggtcctggcctcct

SEQ ID NO: 2897188 - DNA, 16 bp, Homo sapiens
cctggtccttcactgg

SEQ ID NO: 2897189 - DNA, 17 bp, Homo sapiens
cctggtccttcactggc

SEQ ID NO: 2897190 - DNA, 16 bp, Homo sapiens
cctggtctgttttctg

SEQ ID NO: 2897191 - DNA, 19 bp, Homo sapiens
cctggtgctcctgcccagc

SEQ ID NO: 2897192 - DNA, 20 bp, Homo sapiens
cctggtgctcctgcccagcc

SEQ ID NO: 2897193 - DNA, 22 bp, Homo sapiens
cctggtgctcctgcccagccac

SEQ ID NO: 2897194 - DNA, 15 bp, Homo sapiens
cctggtgctgcctct

SEQ ID NO: 2897195 - DNA, 13 bp, Homo sapiens
cctggtggctggg

SEQ ID NO: 2897196 - DNA, 15 bp, Homo sapiens
cctggtggctgggcc

SEQ ID NO: 2897197 - DNA, 19 bp, Homo sapiens
cctggtgggtggtgtcctg

SEQ ID NO: 2897198 - DNA, 12 bp, Homo sapiens
cctggtggttca

SEQ ID NO: 2897199 - DNA, 12 bp, Homo sapiens
cctggtgtcacc

SEQ ID NO: 2897200 - DNA, 19 bp, Homo sapiens
cctggtgtcaccccagagc

SEQ ID NO: 2897201 - DNA, 21 bp, Homo sapiens
cctggtgtcaccccagagcca

SEQ ID NO: 2897202 - DNA, 20 bp, Homo sapiens
cctggtgtgaaggtcctgct

SEQ ID NO: 2897203 - DNA, 15 bp, Homo sapiens
cctggttcctgctgt

SEQ ID NO: 2897204 - DNA, 16 bp, Homo sapiens
cctggttcctgctgtc

SEQ ID NO: 2897205 - DNA, 17 bp, Homo sapiens
cctggttcctgctgtcc

SEQ ID NO: 2897206 - DNA, 21 bp, Homo sapiens
cctggttttcgtcatcttccc

SEQ ID NO: 2897207 - DNA, 22 bp, Homo sapiens
cctggtttttaaatagagtttg

SEQ ID NO: 2897208 - DNA, 19 bp, Homo sapiens
cctgtaaaaaaaaaaaagt

SEQ ID NO: 2897209 - DNA, 16 bp, Homo sapiens
cctgtaaatgtcctga

SEQ ID NO: 2897210 - DNA, 13 bp, Homo sapiens
cctgtaatcccag

SEQ ID NO: 2897211 - DNA, 19 bp, Homo sapiens
cctgtaatcccagaacttt

SEQ ID NO: 2897212 - DNA, 18 bp, Homo sapiens
cctgtaatcccagcactt

SEQ ID NO: 2897213 - DNA, 22 bp, Homo sapiens
cctgtaatcccagcactttggg

SEQ ID NO: 2897214 - DNA, 15 bp, Homo sapiens
cctgtaatcccagct

SEQ ID NO: 2897215 - DNA, 18 bp, Homo sapiens
cctgtaatcccagctact

SEQ ID NO: 2897216 - DNA, 23 bp, Homo sapiens
cctgtaatcccagctactcagga

SEQ ID NO: 2897217 - DNA, 14 bp, Homo sapiens
cctgtaatcttttt

SEQ ID NO: 2897218 - DNA, 18 bp, Homo sapiens
cctgtaatctttttctcc

SEQ ID NO: 2897219 - DNA, 14 bp, Homo sapiens
cctgtaattcagtg

SEQ ID NO: 2897220 - DNA, 12 bp, Homo sapiens
cctctctgtccc

SEQ ID NO: 2897221 - DNA, 20 bp, Homo sapiens
cctctctgtctttttccttc

SEQ ID NO: 2897222 - DNA, 20 bp, Homo sapiens
cctctcttccgggagctggt

SEQ ID NO: 2897223 - DNA, 17 bp, Homo sapiens
cctctcttttcctctct

SEQ ID NO: 2897224 - DNA, 15 bp, Homo sapiens
cctctgaaacagctg

SEQ ID NO: 2897225 - DNA, 17 bp, Homo sapiens
cctctgaaacagctgcc

SEQ ID NO: 2897226 - DNA, 18 bp, Homo sapiens
cctctgaaacagctgcct

SEQ ID NO: 2897227 - DNA, 16 bp, Homo sapiens
cctctgaaaccctgga

SEQ ID NO: 2897228 - DNA, 17 bp, Homo sapiens
cctctgacagcagcctg

SEQ ID NO: 2897229 - DNA, 12 bp, Homo sapiens
cctctgactcag

SEQ ID NO: 2897230 - DNA, 16 bp, Homo sapiens
cctctgactcagggct

SEQ ID NO: 2897231 - DNA, 17 bp, Homo sapiens
cctctgcacccagaaca

SEQ ID NO: 2897232 - DNA, 23 bp, Homo sapiens
cctctgcagtcgcttgccaaagc

SEQ ID NO: 2897233 - DNA, 22 bp, Homo sapiens
cctctgcccgggagctcaggaa

SEQ ID NO: 2897234 - DNA, 13 bp, Homo sapiens
cctctgcctcatc

SEQ ID NO: 2897235 - DNA, 18 bp, Homo sapiens
cctctgcctcatcctcct

SEQ ID NO: 2897236 - DNA, 20 bp, Homo sapiens
cctctgcctcatcctcctcc

SEQ ID NO: 2897237 - DNA, 18 bp, Homo sapiens
cctctgcctcctccccag

SEQ ID NO: 2897238 - DNA, 11 bp, Homo sapiens
cctctgcctgc

SEQ ID NO: 2897239 - DNA, 12 bp, Homo sapiens
cctctgcctgca

SEQ ID NO: 2897240 - DNA, 13 bp, Homo sapiens
cctctgcctgcac

SEQ ID NO: 2897241 - DNA, 11 bp, Homo sapiens
cctctgcctgg

SEQ ID NO: 2897242 - DNA, 20 bp, Homo sapiens
cctctgctccaaaggaaatc

SEQ ID NO: 2897243 - DNA, 13 bp, Homo sapiens
cctctgctcccca

SEQ ID NO: 2897244 - DNA, 16 bp, Homo sapiens
cctctgctgctgcccg

SEQ ID NO: 2897245 - DNA, 14 bp, Homo sapiens
cctctgcttcccag

SEQ ID NO: 2897246 - DNA, 11 bp, Homo sapiens
cctctggatct

SEQ ID NO: 2897247 - DNA, 21 bp, Homo sapiens
cctctggattaggtctctgtt

SEQ ID NO: 2897248 - DNA, 18 bp, Homo sapiens
cctctggccctgccttct

SEQ ID NO: 2897249 - DNA, 22 bp, Homo sapiens
cctctggccctggggtgtgtct

SEQ ID NO: 2897250 - DNA, 12 bp, Homo sapiens
cctctggcttcc

SEQ ID NO: 2897251 - DNA, 16 bp, Homo sapiens
cctctgggccaggttg

SEQ ID NO: 2897252 - DNA, 17 bp, Homo sapiens
cctctgtaccccatgac

SEQ ID NO: 2897253 - DNA, 19 bp, Homo sapiens
cctctgtaccccatgacct

SEQ ID NO: 2897254 - DNA, 22 bp, Homo sapiens
cctctgtccacttgtgggtcct

SEQ ID NO: 2897255 - DNA, 15 bp, Homo sapiens
cctctgtccaggcac

SEQ ID NO: 2897256 - DNA, 14 bp, Homo sapiens
cctctgtccccacg

SEQ ID NO: 2897257 - DNA, 15 bp, Homo sapiens
cctctgtccccacga

SEQ ID NO: 2897258 - DNA, 15 bp, Homo sapiens
cctctgtccccaggc

SEQ ID NO: 2897259 - DNA, 20 bp, Homo sapiens
cctctgtctagcatgccaac

SEQ ID NO: 2897260 - DNA, 21 bp, Homo sapiens
cctctgtctagcatgccaaca

SEQ ID NO: 2897261 - DNA, 15 bp, Homo sapiens
cctctgtcttctcta

SEQ ID NO: 2897262 - DNA, 22 bp, Homo sapiens
cctctgtcttggctttcatgtt

SEQ ID NO: 2897263 - DNA, 19 bp, Homo sapiens
cctctgtgaccaatgtctt

SEQ ID NO: 2897264 - DNA, 21 bp, Homo sapiens
cctctgtgccttcttttgatt

SEQ ID NO: 2897265 - DNA, 16 bp, Homo sapiens
cctctgtggtgtctgc

SEQ ID NO: 2897266 - DNA, 17 bp, Homo sapiens
cctctgtggtgtctgcc

SEQ ID NO: 2897267 - DNA, 21 bp, Homo sapiens
cctctgtgtagccgccctgag

SEQ ID NO: 2897268 - DNA, 22 bp, Homo sapiens
cctctgtgtagccgccctgaga

SEQ ID NO: 2897269 - DNA, 16 bp, Homo sapiens
cctctgttcagtgtaa

SEQ ID NO: 2897270 - DNA, 20 bp, Homo sapiens
cctcttagcctctggatcta

SEQ ID NO: 2897271 - DNA, 14 bp, Homo sapiens
cctcttcagaggcc

SEQ ID NO: 2897272 - DNA, 16 bp, Homo sapiens
cctcttcagaggccct

SEQ ID NO: 2897273 - DNA, 18 bp, Homo sapiens
cctcttctcttgacagtc

SEQ ID NO: 2897274 - DNA, 21 bp, Homo sapiens
cctcttctcttgacagtctga

SEQ ID NO: 2897275 - DNA, 14 bp, Homo sapiens
cctcttctgcatct

SEQ ID NO: 2897276 - DNA, 17 bp, Homo sapiens
cctcttctgggagggca

SEQ ID NO: 2897277 - DNA, 21 bp, Homo sapiens
cctcttctgggagggcagcag

SEQ ID NO: 2897278 - DNA, 19 bp, Homo sapiens
cctcttggataccagctca

SEQ ID NO: 2897279 - DNA, 22 bp, Homo sapiens
cctcttggataccagctcaggg

SEQ ID NO: 2897280 - DNA, 23 bp, Homo sapiens
cctcttggataccagctcagggg

SEQ ID NO: 2897281 - DNA, 21 bp, Homo sapiens
cctcttggcacctgcctagct

SEQ ID NO: 2897282 - DNA, 13 bp, Homo sapiens
cctcttggcctga

SEQ ID NO: 2897283 - DNA, 22 bp, Homo sapiens
cctcttggggagtttagggtgg

SEQ ID NO: 2897284 - DNA, 13 bp, Homo sapiens
cctcttgtaaata

SEQ ID NO: 2897285 - DNA, 14 bp, Homo sapiens
cctcttgtaaataa

SEQ ID NO: 2897286 - DNA, 11 bp, Homo sapiens
cctgtacagtc

SEQ ID NO: 2897287 - DNA, 12 bp, Homo sapiens
cctgtacagtct

SEQ ID NO: 2897288 - DNA, 19 bp, Homo sapiens
cctgtacagtctgtcttct

SEQ ID NO: 2897289 - DNA, 18 bp, Homo sapiens
cctgtagagccagccttg

SEQ ID NO: 2897290 - DNA, 19 bp, Homo sapiens
cctgtagatgcagaaaaag

SEQ ID NO: 2897291 - DNA, 21 bp, Homo sapiens
cctgtagatgcagaaaaagaa

SEQ ID NO: 2897292 - DNA, 12 bp, Homo sapiens
cctgtagcccac

SEQ ID NO: 2897293 - DNA, 16 bp, Homo sapiens
cctgtagcccactctg

SEQ ID NO: 2897294 - DNA, 24 bp, Homo sapiens
cctgtagcccactctgctcgcctt

SEQ ID NO: 2897295 - DNA, 16 bp, Homo sapiens
cctgtagccttctgta

SEQ ID NO: 2897296 - DNA, 19 bp, Homo sapiens
cctgtagccttctgtagga

SEQ ID NO: 2897297 - DNA, 19 bp, Homo sapiens
cctgtagttgcgtggactc

SEQ ID NO: 2897298 - DNA, 20 bp, Homo sapiens
cctgtagttgcgtggactct

SEQ ID NO: 2897299 - DNA, 17 bp, Homo sapiens
cctgtataaccctgtta

SEQ ID NO: 2897300 - DNA, 21 bp, Homo sapiens
cctgtatatagcccagccagg

SEQ ID NO: 2897301 - DNA, 19 bp, Homo sapiens
cctgtatatttgtaaagct

SEQ ID NO: 2897302 - DNA, 22 bp, Homo sapiens
cctgtatcctccctggcagaca

SEQ ID NO: 2897303 - DNA, 14 bp, Homo sapiens
cctgtatgttgtcc

SEQ ID NO: 2897304 - DNA, 15 bp, Homo sapiens
cctgtattcagacag

SEQ ID NO: 2897305 - DNA, 23 bp, Homo sapiens
cctgtatttaaaaatagaaacat

SEQ ID NO: 2897306 - DNA, 18 bp, Homo sapiens
cctgtcaaacaaagccag

SEQ ID NO: 2897307 - DNA, 22 bp, Homo sapiens
cctgtcaaacaaagccagaagc

SEQ ID NO: 2897308 - DNA, 14 bp, Homo sapiens
cctgtcaccaagct

SEQ ID NO: 2897309 - DNA, 20 bp, Homo sapiens
cctgtcagccaacattgcct

SEQ ID NO: 2897310 - DNA, 22 bp, Homo sapiens
cctgtccacacccagctcagca

SEQ ID NO: 2897311 - DNA, 15 bp, Homo sapiens
cctgtccagctccaa

SEQ ID NO: 2897312 - DNA, 12 bp, Homo sapiens
cctgtcccagga

SEQ ID NO: 2897313 - DNA, 13 bp, Homo sapiens
cctgtcccaggac

SEQ ID NO: 2897314 - DNA, 15 bp, Homo sapiens
cctgtccccatctgt

SEQ ID NO: 2897315 - DNA, 18 bp, Homo sapiens
cctgtccccgccttccct

SEQ ID NO: 2897316 - DNA, 12 bp, Homo sapiens
cctgtcccctgg

SEQ ID NO: 2897317 - DNA, 13 bp, Homo sapiens
cctgtcccctggg

SEQ ID NO: 2897318 - DNA, 14 bp, Homo sapiens
cctgtcccctgggg

SEQ ID NO: 2897319 - DNA, 15 bp, Homo sapiens
cctgtcccctggggc

SEQ ID NO: 2897320 - DNA, 19 bp, Homo sapiens
cctgtcccctggggctggt

SEQ ID NO: 2897321 - DNA, 19 bp, Homo sapiens
cctgtcctagtctcctttg

SEQ ID NO: 2897322 - DNA, 13 bp, Homo sapiens
cctgtcctcaccg

SEQ ID NO: 2897323 - DNA, 21 bp, Homo sapiens
cctgtcctccaacaccaagca

SEQ ID NO: 2897324 - DNA, 22 bp, Homo sapiens
cctgtcctccaacaccaagcac

SEQ ID NO: 2897325 - DNA, 13 bp, Homo sapiens
cctgtcctcccag

SEQ ID NO: 2897326 - DNA, 12 bp, Homo sapiens
cctgtcctcttt

SEQ ID NO: 2897327 - DNA, 14 bp, Homo sapiens
cctgtcctctttgt

SEQ ID NO: 2897328 - DNA, 19 bp, Homo sapiens
cctgtccttactcagagct

SEQ ID NO: 2897329 - DNA, 22 bp, Homo sapiens
cctgtcgggctttgtgtgaagg

SEQ ID NO: 2897330 - DNA, 18 bp, Homo sapiens
cctgtcggtggctgcctt

SEQ ID NO: 2897331 - DNA, 20 bp, Homo sapiens
cctgtctaaagccttaacta

SEQ ID NO: 2897332 - DNA, 12 bp, Homo sapiens
cctgtctccttt

SEQ ID NO: 2897333 - DNA, 23 bp, Homo sapiens
cctgtctcctttcaccccagggc

SEQ ID NO: 2897334 - DNA, 14 bp, Homo sapiens
cctgtctcgccaga

SEQ ID NO: 2897335 - DNA, 22 bp, Homo sapiens
cctgtctctaaaaagaagccac

SEQ ID NO: 2897336 - DNA, 23 bp, Homo sapiens
cctgtctctaaaaagaagccaca

SEQ ID NO: 2897337 - DNA, 13 bp, Homo sapiens
cctgtctctttcc

SEQ ID NO: 2897338 - DNA, 20 bp, Homo sapiens
cctgtctctttccactttgt

SEQ ID NO: 2897339 - DNA, 15 bp, Homo sapiens
cctgtctgaacaaaa

SEQ ID NO: 2897340 - DNA, 20 bp, Homo sapiens
cctgtctgaacaaaaactgt

SEQ ID NO: 2897341 - DNA, 20 bp, Homo sapiens
cctgtctgtccaacccctcc

SEQ ID NO: 2897342 - DNA, 17 bp, Homo sapiens
cctgtctgttacactgg

SEQ ID NO: 2897343 - DNA, 13 bp, Homo sapiens
cctgtcttgctcc

SEQ ID NO: 2897344 - DNA, 20 bp, Homo sapiens
cctgtcttgctcctggggag

SEQ ID NO: 2897345 - DNA, 23 bp, Homo sapiens
cctgtcttgtcaggtggaccctg

SEQ ID NO: 2897346 - DNA, 19 bp, Homo sapiens
cctgtctttcctaagacct

SEQ ID NO: 2897347 - DNA, 19 bp, Homo sapiens
cctgtgaaatagttcaaag

SEQ ID NO: 2897348 - DNA, 15 bp, Homo sapiens
cctgtgaccctctca

SEQ ID NO: 2897349 - DNA, 18 bp, Homo sapiens
cctgtgaccctctcactt

SEQ ID NO: 2897350 - DNA, 14 bp, Homo sapiens
cctgtgaccttggg

SEQ ID NO: 2897351 - DNA, 22 bp, Homo sapiens
cctgtgaggggcccctggccca

SEQ ID NO: 2897352 - DNA, 20 bp, Homo sapiens
cctgtgcaattcagtctgct

SEQ ID NO: 2897353 - DNA, 20 bp, Homo sapiens
cctgtgcagccgctgagcga

SEQ ID NO: 2897354 - DNA, 14 bp, Homo sapiens
cctgtgcatgtatg

SEQ ID NO: 2897355 - DNA, 20 bp, Homo sapiens
cctgtgcccatcatctctgc

SEQ ID NO: 2897356 - DNA, 21 bp, Homo sapiens
cctgtgcccatcatctctgcc

SEQ ID NO: 2897357 - DNA, 24 bp, Homo sapiens
cctgtgcccatcatctctgccttt

SEQ ID NO: 2897358 - DNA, 14 bp, Homo sapiens
cctgtgccccagtt

SEQ ID NO: 2897359 - DNA, 12 bp, Homo sapiens
cctgtgcctccc

SEQ ID NO: 2897360 - DNA, 19 bp, Homo sapiens
cctgtgcctccctctcctc

SEQ ID NO: 2897361 - DNA, 14 bp, Homo sapiens
cctgtgcctctgtc

SEQ ID NO: 2897362 - DNA, 18 bp, Homo sapiens
cctgtgcgttcccttcag

SEQ ID NO: 2897363 - DNA, 14 bp, Homo sapiens
cctgtggacaggat

SEQ ID NO: 2897364 - DNA, 22 bp, Homo sapiens
cctgtggacaggatgaggacag

SEQ ID NO: 2897365 - DNA, 16 bp, Homo sapiens
cctgtggagtccagct

SEQ ID NO: 2897366 - DNA, 20 bp, Homo sapiens
cctgtggagtccagctctac

SEQ ID NO: 2897367 - DNA, 17 bp, Homo sapiens
cctgtggattagaatag

SEQ ID NO: 2897368 - DNA, 13 bp, Homo sapiens
cctgtggcagctg

SEQ ID NO: 2897369 - DNA, 16 bp, Homo sapiens
cctgtggcagctgccc

SEQ ID NO: 2897370 - DNA, 18 bp, Homo sapiens
cctgtggccctgtcctgc

SEQ ID NO: 2897371 - DNA, 15 bp, Homo sapiens
cctgtggcggtgcct

SEQ ID NO: 2897372 - DNA, 19 bp, Homo sapiens
cctgtggcggtgcctgggt

SEQ ID NO: 2897373 - DNA, 17 bp, Homo sapiens
cctgtggctccctctct

SEQ ID NO: 2897374 - DNA, 21 bp, Homo sapiens
cctgtggctccctctctcctg

SEQ ID NO: 2897375 - DNA, 19 bp, Homo sapiens
cctgtgggaccccaggccc

SEQ ID NO: 2897376 - DNA, 23 bp, Homo sapiens
cctgtggggtcaacccttctgga

SEQ ID NO: 2897377 - DNA, 20 bp, Homo sapiens
cctgtggtaactttgcaggc

SEQ ID NO: 2897378 - DNA, 20 bp, Homo sapiens
cctgtggtgatgtgcctgta

SEQ ID NO: 2897379 - DNA, 22 bp, Homo sapiens
cctgtggtggcctggtgcacag

SEQ ID NO: 2897380 - DNA, 20 bp, Homo sapiens
cctgtgtcccctgacctgtc

SEQ ID NO: 2897381 - DNA, 23 bp, Homo sapiens
cctgtgtctgcgaagtcctatgg

SEQ ID NO: 2897382 - DNA, 16 bp, Homo sapiens
cctgtgtgcaggttcc

SEQ ID NO: 2897383 - DNA, 12 bp, Homo sapiens
cctgtgtggcca

SEQ ID NO: 2897384 - DNA, 15 bp, Homo sapiens
cctgtgtggccactt

SEQ ID NO: 2897385 - DNA, 23 bp, Homo sapiens
cctgtgtggccacttctgtccat

SEQ ID NO: 2897386 - DNA, 15 bp, Homo sapiens
cctgttagcagacag

SEQ ID NO: 2897387 - DNA, 16 bp, Homo sapiens
cctgttagcagacagg

SEQ ID NO: 2897388 - DNA, 19 bp, Homo sapiens
cctgttaggagaagctgca

SEQ ID NO: 2897389 - DNA, 15 bp, Homo sapiens
cctgttcaaggcccc

SEQ ID NO: 2897390 - DNA, 23 bp, Homo sapiens
cctgttcagaaaggggctcttct

SEQ ID NO: 2897391 - DNA, 14 bp, Homo sapiens
cctgttcatgtttt

SEQ ID NO: 2897392 - DNA, 22 bp, Homo sapiens
cctgttcatgtttttgttttaa

SEQ ID NO: 2897393 - DNA, 15 bp, Homo sapiens
cctgttccccagaga

SEQ ID NO: 2897394 - DNA, 12 bp, Homo sapiens
cctgttcctccc

SEQ ID NO: 2897395 - DNA, 13 bp, Homo sapiens
cctgttctcgttg

SEQ ID NO: 2897396 - DNA, 12 bp, Homo sapiens
cctgttctgtag

SEQ ID NO: 2897397 - DNA, 18 bp, Homo sapiens
cctgttctgtagctttct

SEQ ID NO: 2897398 - DNA, 20 bp, Homo sapiens
cctgttctgtagctttctgg

SEQ ID NO: 2897399 - DNA, 13 bp, Homo sapiens
cctgttctgtgac

SEQ ID NO: 2897400 - DNA, 21 bp, Homo sapiens
cctgttgaagattatttcatt

SEQ ID NO: 2897401 - DNA, 17 bp, Homo sapiens
cctgttgcttacaattt

SEQ ID NO: 2897402 - DNA, 14 bp, Homo sapiens
cctgtttattgcca

SEQ ID NO: 2897403 - DNA, 20 bp, Homo sapiens
cctgtttatttttaaatttt

SEQ ID NO: 2897404 - DNA, 17 bp, Homo sapiens
cctgtttcaatcactgt

SEQ ID NO: 2897405 - DNA, 13 bp, Homo sapiens
cctgtttctgaaa

SEQ ID NO: 2897406 - DNA, 19 bp, Homo sapiens
cctgtttctgaaaagaaat

SEQ ID NO: 2897407 - DNA, 16 bp, Homo sapiens
cctgtttggattttta

SEQ ID NO: 2897408 - DNA, 14 bp, Homo sapiens
ccttaactaagact

SEQ ID NO: 2897409 - DNA, 18 bp, Homo sapiens
ccttaactaagactcccg

SEQ ID NO: 2897410 - DNA, 21 bp, Homo sapiens
ccttaagatttttcttttccg

SEQ ID NO: 2897411 - DNA, 20 bp, Homo sapiens
ccttaagccaatcatgtaat

SEQ ID NO: 2897412 - DNA, 16 bp, Homo sapiens
ccttaagccctggccc

SEQ ID NO: 2897413 - DNA, 12 bp, Homo sapiens
ccttaataaata

SEQ ID NO: 2897414 - DNA, 23 bp, Homo sapiens
ccttaataaatatagttgtcttt

SEQ ID NO: 2897415 - DNA, 17 bp, Homo sapiens
ccttacagtaggagccc

SEQ ID NO: 2897416 - DNA, 19 bp, Homo sapiens
ccttacagttatcctgcaa

SEQ ID NO: 2897417 - DNA, 14 bp, Homo sapiens
ccttacattaaaaa

SEQ ID NO: 2897418 - DNA, 14 bp, Homo sapiens
ccttacccatctgc

SEQ ID NO: 2897419 - DNA, 17 bp, Homo sapiens
ccttacccatcttgctt

SEQ ID NO: 2897420 - DNA, 23 bp, Homo sapiens
ccttaccccacaacgtgcaactg

SEQ ID NO: 2897421 - DNA, 13 bp, Homo sapiens
ccttacctcctgc

SEQ ID NO: 2897422 - DNA, 15 bp, Homo sapiens
ccttatttctcatca

SEQ ID NO: 2897423 - DNA, 23 bp, Homo sapiens
ccttatttgtcggggaagatgaa

SEQ ID NO: 2897424 - DNA, 13 bp, Homo sapiens
ccttcaaaacatt

SEQ ID NO: 2897425 - DNA, 20 bp, Homo sapiens
ccttcacatcctgtgtttct

SEQ ID NO: 2897426 - DNA, 13 bp, Homo sapiens
ccttcacatctcc

SEQ ID NO: 2897427 - DNA, 21 bp, Homo sapiens
ccttcacattcccctggggac

SEQ ID NO: 2897428 - DNA, 14 bp, Homo sapiens
ccttcactggcgcc

SEQ ID NO: 2897429 - DNA, 16 bp, Homo sapiens
ccttcactggcgcctt

SEQ ID NO: 2897430 - DNA, 17 bp, Homo sapiens
ccttcactggcgccttc

SEQ ID NO: 2897431 - DNA, 18 bp, Homo sapiens
ccttcactggcgccttct

SEQ ID NO: 2897432 - DNA, 20 bp, Homo sapiens
ccttcactggcgccttctcg

SEQ ID NO: 2897433 - DNA, 21 bp, Homo sapiens
ccttcactgttgcttaattgt

SEQ ID NO: 2897434 - DNA, 18 bp, Homo sapiens
ccttcagaacagaggcat

SEQ ID NO: 2897435 - DNA, 17 bp, Homo sapiens
ccttcagcagcagctca

SEQ ID NO: 2897436 - DNA, 18 bp, Homo sapiens
ccttcagcagcagctcac

SEQ ID NO: 2897437 - DNA, 12 bp, Homo sapiens
ccttcagggtga

SEQ ID NO: 2897438 - DNA, 11 bp, Homo sapiens
ccttcagtgcc

SEQ ID NO: 2897439 - DNA, 19 bp, Homo sapiens
ccttcataccgcctcgtgc

SEQ ID NO: 2897440 - DNA, 21 bp, Homo sapiens
ccttcataccgcctcgtgcca

SEQ ID NO: 2897441 - DNA, 22 bp, Homo sapiens
ccttcataccgcctcgtgccag

SEQ ID NO: 2897442 - DNA, 13 bp, Homo sapiens
ccttcatctttta

SEQ ID NO: 2897443 - DNA, 11 bp, Homo sapiens
ccttcattaaa

SEQ ID NO: 2897444 - DNA, 23 bp, Homo sapiens
ccttcattctgcaagtatactag

SEQ ID NO: 2897445 - DNA, 21 bp, Homo sapiens
ccttcattgatttcctgtgtc

SEQ ID NO: 2897446 - DNA, 19 bp, Homo sapiens
ccttccaacaggagctggg

SEQ ID NO: 2897447 - DNA, 22 bp, Homo sapiens
ccttccaagtttgacttgtata

SEQ ID NO: 2897448 - DNA, 21 bp, Homo sapiens
ccttccacctcacaactcctt

SEQ ID NO: 2897449 - DNA, 14 bp, Homo sapiens
ccttccagcccaga

SEQ ID NO: 2897450 - DNA, 12 bp, Homo sapiens
ccttccagtggg

SEQ ID NO: 2897451 - DNA, 23 bp, Homo sapiens
ccttccatccttgactgaagcga

SEQ ID NO: 2897452 - DNA, 15 bp, Homo sapiens
ccttccatgctccca

SEQ ID NO: 2897453 - DNA, 23 bp, Homo sapiens
ccttccatggtgtgatcgtctga

SEQ ID NO: 2897454 - DNA, 21 bp, Homo sapiens
ccttcccaagtaagaggctgg

SEQ ID NO: 2897455 - DNA, 22 bp, Homo sapiens
ccttcccaagtaagaggctgga

SEQ ID NO: 2897456 - DNA, 13 bp, Homo sapiens
ccttcccacccct

SEQ ID NO: 2897457 - DNA, 18 bp, Homo sapiens
ccttcccagctctccctc

SEQ ID NO: 2897458 - DNA, 20 bp, Homo sapiens
ccttcccagtgggctgtgtt

SEQ ID NO: 2897459 - DNA, 21 bp, Homo sapiens
ccttccccagacttgcactgg

SEQ ID NO: 2897460 - DNA, 16 bp, Homo sapiens
ccttccccttgtccct

SEQ ID NO: 2897461 - DNA, 24 bp, Homo sapiens
ccttccctcaccttggcaccagac

SEQ ID NO: 2897462 - DNA, 12 bp, Homo sapiens
ccttcctcatct

SEQ ID NO: 2897463 - DNA, 17 bp, Homo sapiens
ccttcctcatctgtgcc

SEQ ID NO: 2897464 - DNA, 17 bp, Homo sapiens
ccttcctctctccagat

SEQ ID NO: 2897465 - DNA, 23 bp, Homo sapiens
ccttcctctgtaagatatcccag

SEQ ID NO: 2897466 - DNA, 16 bp, Homo sapiens
ccttcctcttggctga

SEQ ID NO: 2897467 - DNA, 12 bp, Homo sapiens
ccttcctgaccc

SEQ ID NO: 2897468 - DNA, 16 bp, Homo sapiens
ccttcctgcttcctgt

SEQ ID NO: 2897469 - DNA, 16 bp, Homo sapiens
ccttcctggcccaggc

SEQ ID NO: 2897470 - DNA, 17 bp, Homo sapiens
ccttcctggcccaggcc

SEQ ID NO: 2897471 - DNA, 21 bp, Homo sapiens
ccttcctggcccaggccttgc

SEQ ID NO: 2897472 - DNA, 14 bp, Homo sapiens
ccttccttccctgg

SEQ ID NO: 2897473 - DNA, 14 bp, Homo sapiens
ccttccttgccagt

SEQ ID NO: 2897474 - DNA, 22 bp, Homo sapiens
ccttccttgttacccatgaaaa

SEQ ID NO: 2897475 - DNA, 17 bp, Homo sapiens
ccttcgacatgctgcca

SEQ ID NO: 2897476 - DNA, 18 bp, Homo sapiens
ccttcgacatgctgccag

SEQ ID NO: 2897477 - DNA, 20 bp, Homo sapiens
ccttcgacatgctgccagga

SEQ ID NO: 2897478 - DNA, 20 bp, Homo sapiens
ccttcgtttactatgcctgt

SEQ ID NO: 2897479 - DNA, 13 bp, Homo sapiens
ccttctaaaggtg

SEQ ID NO: 2897480 - DNA, 14 bp, Homo sapiens
ccttctaaaggtgt

SEQ ID NO: 2897481 - DNA, 22 bp, Homo sapiens
ccttctaaaggtgttgtccctt

SEQ ID NO: 2897482 - DNA, 20 bp, Homo sapiens
ccttctagggttattgcatt

SEQ ID NO: 2897483 - DNA, 16 bp, Homo sapiens
ccttctcaccagctgc

SEQ ID NO: 2897484 - DNA, 18 bp, Homo sapiens
ccttctcaccagctgcaa

SEQ ID NO: 2897485 - DNA, 13 bp, Homo sapiens
ccttctcagctct

SEQ ID NO: 2897486 - DNA, 14 bp, Homo sapiens
ccttctcaggctgg

SEQ ID NO: 2897487 - DNA, 19 bp, Homo sapiens
ccttctccaaaggctctgt

SEQ ID NO: 2897488 - DNA, 15 bp, Homo sapiens
ccttctccctgggaa

SEQ ID NO: 2897489 - DNA, 22 bp, Homo sapiens
ccttctcggagctggcccaggg

SEQ ID NO: 2897490 - DNA, 14 bp, Homo sapiens
ccttctctcagctc

SEQ ID NO: 2897491 - DNA, 20 bp, Homo sapiens
ccttctctcagctcccaggc

SEQ ID NO: 2897492 - DNA, 21 bp, Homo sapiens
ccttctctcagctcccaggcc

SEQ ID NO: 2897493 - DNA, 17 bp, Homo sapiens
ccttctcttctcttctt

SEQ ID NO: 2897494 - DNA, 19 bp, Homo sapiens
ccttctcttctcttctttg

SEQ ID NO: 2897495 - DNA, 13 bp, Homo sapiens
ccttctctttaaa

SEQ ID NO: 2897496 - DNA, 20 bp, Homo sapiens
ccttctgaaaatatttacat

SEQ ID NO: 2897497 - DNA, 23 bp, Homo sapiens
ccttctgaagtgtgtccatcctg

SEQ ID NO: 2897498 - DNA, 21 bp, Homo sapiens
ccttctgaggacattccaaga

SEQ ID NO: 2897499 - DNA, 22 bp, Homo sapiens
ccttctgatcttggaaaaacag

SEQ ID NO: 2897500 - DNA, 13 bp, Homo sapiens
ccttctgctactg

SEQ ID NO: 2897501 - DNA, 11 bp, Homo sapiens
ccttctgctgt

SEQ ID NO: 2897502 - DNA, 14 bp, Homo sapiens
ccttctgcttgtcc

SEQ ID NO: 2897503 - DNA, 13 bp, Homo sapiens
ccttctgctttct

SEQ ID NO: 2897504 - DNA, 19 bp, Homo sapiens
ccttctgtccctcacagca

SEQ ID NO: 2897505 - DNA, 14 bp, Homo sapiens
ccttctgtgaagaa

SEQ ID NO: 2897506 - DNA, 17 bp, Homo sapiens
ccttctgtgaagaagcc

SEQ ID NO: 2897507 - DNA, 19 bp, Homo sapiens
ccttctgtgaagaagccct

SEQ ID NO: 2897508 - DNA, 23 bp, Homo sapiens
ccttctgtgctcatgtttggaaa

SEQ ID NO: 2897509 - DNA, 18 bp, Homo sapiens
ccttcttatatctgaaga

SEQ ID NO: 2897510 - DNA, 17 bp, Homo sapiens
ccttcttccaaggagca

SEQ ID NO: 2897511 - DNA, 22 bp, Homo sapiens
ccttcttcctcaagtcttgaca

SEQ ID NO: 2897512 - DNA, 17 bp, Homo sapiens
ccttctttaccttcatt

SEQ ID NO: 2897513 - DNA, 11 bp, Homo sapiens
ccttgaaaaca

SEQ ID NO: 2897514 - DNA, 22 bp, Homo sapiens
ccttgaaaacaaacaaatcaaa

SEQ ID NO: 2897515 - DNA, 21 bp, Homo sapiens
ccttgaaatacctgtttcttt

SEQ ID NO: 2897516 - DNA, 15 bp, Homo sapiens
ccttgaacctcatta

SEQ ID NO: 2897517 - DNA, 21 bp, Homo sapiens
ccttgaagacatatcatgtgt

SEQ ID NO: 2897518 - DNA, 16 bp, Homo sapiens
ccttgaagactccctg

SEQ ID NO: 2897519 - DNA, 22 bp, Homo sapiens
ccttgaagactccctgatccca

SEQ ID NO: 2897520 - DNA, 12 bp, Homo sapiens
ccttgaatgtgg

SEQ ID NO: 2897521 - DNA, 13 bp, Homo sapiens
ccttgacagagca

SEQ ID NO: 2897522 - DNA, 17 bp, Homo sapiens
ccttgacctttgtacag

SEQ ID NO: 2897523 - DNA, 21 bp, Homo sapiens
ccttgacctttgtacagccca

SEQ ID NO: 2897524 - DNA, 13 bp, Homo sapiens
ccttgactgaagc

SEQ ID NO: 2897525 - DNA, 21 bp, Homo sapiens
ccttgactgttgatgtactga

SEQ ID NO: 2897526 - DNA, 17 bp, Homo sapiens
ccttgagcagaatacaa

SEQ ID NO: 2897527 - DNA, 21 bp, Homo sapiens
ccttgaggaaacaacagcttt

SEQ ID NO: 2897528 - DNA, 14 bp, Homo sapiens
ccttgaggagaagt

SEQ ID NO: 2897529 - DNA, 15 bp, Homo sapiens
ccttgattttcttct

SEQ ID NO: 2897530 - DNA, 20 bp, Homo sapiens
ccttgattttcttctttgtg

SEQ ID NO: 2897531 - DNA, 14 bp, Homo sapiens
ccttgcacatagta

SEQ ID NO: 2897532 - DNA, 13 bp, Homo sapiens
ccttgcacctgca

SEQ ID NO: 2897533 - DNA, 12 bp, Homo sapiens
ccttgcatttgt

SEQ ID NO: 2897534 - DNA, 19 bp, Homo sapiens
ctagtcaccgacagcggcc

SEQ ID NO: 2897535 - DNA, 15 bp, Homo sapiens
ctagtcactggcagc

SEQ ID NO: 2897536 - DNA, 16 bp, Homo sapiens
ctagtcagagagagtg

SEQ ID NO: 2897537 - DNA, 20 bp, Homo sapiens
ctagtcccccaaagggcctc

SEQ ID NO: 2897538 - DNA, 22 bp, Homo sapiens
ctagtcccccaaagggcctcct

SEQ ID NO: 2897539 - DNA, 17 bp, Homo sapiens
ctagtcctagtgaacct

SEQ ID NO: 2897540 - DNA, 20 bp, Homo sapiens
ctagtcctcacttctagatc

SEQ ID NO: 2897541 - DNA, 13 bp, Homo sapiens
ctagtcctttata

SEQ ID NO: 2897542 - DNA, 15 bp, Homo sapiens
ctagtcgacactaag

SEQ ID NO: 2897543 - DNA, 21 bp, Homo sapiens
ctagtctctatcattaaagtt

SEQ ID NO: 2897544 - DNA, 22 bp, Homo sapiens
ctagtctctatcattaaagttc

SEQ ID NO: 2897545 - DNA, 16 bp, Homo sapiens
ctagtgagtcagcacc

SEQ ID NO: 2897546 - DNA, 18 bp, Homo sapiens
ctagtgagtcagcacctt

SEQ ID NO: 2897547 - DNA, 18 bp, Homo sapiens
ctagtgccccagactgag

SEQ ID NO: 2897548 - DNA, 20 bp, Homo sapiens
ctagtgccccagactgagct

SEQ ID NO: 2897549 - DNA, 17 bp, Homo sapiens
ctagtgccttctaaagg

SEQ ID NO: 2897550 - DNA, 14 bp, Homo sapiens
ctagtgccttgccc

SEQ ID NO: 2897551 - DNA, 22 bp, Homo sapiens
ctagtgccttgcccacaggtgc

SEQ ID NO: 2897552 - DNA, 22 bp, Homo sapiens
ctagtgctccatagtttggcat

SEQ ID NO: 2897553 - DNA, 22 bp, Homo sapiens
ctagtgctttccttttttaaaa

SEQ ID NO: 2897554 - DNA, 23 bp, Homo sapiens
ctagtgctttccttttttaaaaa

SEQ ID NO: 2897555 - DNA, 20 bp, Homo sapiens
ctagtggacgtaggatattt

SEQ ID NO: 2897556 - DNA, 23 bp, Homo sapiens
ctagtggggtctccctctcctgc

SEQ ID NO: 2897557 - DNA, 19 bp, Homo sapiens
ctagtggggtgaacagctg

SEQ ID NO: 2897558 - DNA, 19 bp, Homo sapiens
ctagtgtacctcctctcag

SEQ ID NO: 2897559 - DNA, 21 bp, Homo sapiens
ctagtgtacctcctctcagtg

SEQ ID NO: 2897560 - DNA, 22 bp, Homo sapiens
ctagtgtccgcataagaaaaag

SEQ ID NO: 2897561 - DNA, 13 bp, Homo sapiens
ctagttattggat

SEQ ID NO: 2897562 - DNA, 16 bp, Homo sapiens
ctagttctcttatctt

SEQ ID NO: 2897563 - DNA, 14 bp, Homo sapiens
ctagttctgccagg

SEQ ID NO: 2897564 - DNA, 11 bp, Homo sapiens
ctagtttcctg

SEQ ID NO: 2897565 - DNA, 12 bp, Homo sapiens
ctagtttttaat

SEQ ID NO: 2897566 - DNA, 14 bp, Homo sapiens
ctagttttttttct

SEQ ID NO: 2897567 - DNA, 17 bp, Homo sapiens
ctagttttttttctagt

SEQ ID NO: 2897568 - DNA, 13 bp, Homo sapiens
ctataaaacaggt

SEQ ID NO: 2897569 - DNA, 24 bp, Homo sapiens
ctataaaatgcagtaacattctac

SEQ ID NO: 2897570 - DNA, 12 bp, Homo sapiens
ctataaaatgcc

SEQ ID NO: 2897571 - DNA, 16 bp, Homo sapiens
ctataaaatgcccatt

SEQ ID NO: 2897572 - DNA, 18 bp, Homo sapiens
ctataaaatgtcttcaag

SEQ ID NO: 2897573 - DNA, 13 bp, Homo sapiens
ctataaagctgtt

SEQ ID NO: 2897574 - DNA, 9 bp, Homo sapiens
ctataaata

SEQ ID NO: 2897575 - DNA, 12 bp, Homo sapiens
ctataaatacaa

SEQ ID NO: 2897576 - DNA, 18 bp, Homo sapiens
ctataaatacaaatctgt

SEQ ID NO: 2897577 - DNA, 14 bp, Homo sapiens
ctataaattaagaa

SEQ ID NO: 2897578 - DNA, 17 bp, Homo sapiens
ctataaattttttgaaa

SEQ ID NO: 2897579 - DNA, 21 bp, Homo sapiens
ctataaattttttgaaacaca

SEQ ID NO: 2897580 - DNA, 13 bp, Homo sapiens
ctataacaaaaaa

SEQ ID NO: 2897581 - DNA, 16 bp, Homo sapiens
ctataacaaaaaaaga

SEQ ID NO: 2897582 - DNA, 22 bp, Homo sapiens
ctataacaaaaaaagaaaagag

SEQ ID NO: 2897583 - DNA, 17 bp, Homo sapiens
ctataagaactttgagc

SEQ ID NO: 2897584 - DNA, 15 bp, Homo sapiens
ctataatcccagcta

SEQ ID NO: 2897585 - DNA, 17 bp, Homo sapiens
ctataatcccagctact

SEQ ID NO: 2897586 - DNA, 15 bp, Homo sapiens
ctataatgtgcctgg

SEQ ID NO: 2897587 - DNA, 18 bp, Homo sapiens
ctataattctatactgtt

SEQ ID NO: 2897588 - DNA, 13 bp, Homo sapiens
ctatacaaatata

SEQ ID NO: 2897589 - DNA, 14 bp, Homo sapiens
ctatacctgtgcct

SEQ ID NO: 2897590 - DNA, 17 bp, Homo sapiens
ctatactggaaatgtaa

SEQ ID NO: 2897591 - DNA, 19 bp, Homo sapiens
ctatagaaatgtattttga

SEQ ID NO: 2897592 - DNA, 20 bp, Homo sapiens
ctatagaaatgtattttgaa

SEQ ID NO: 2897593 - DNA, 14 bp, Homo sapiens
ctataggaaagtct

SEQ ID NO: 2897594 - DNA, 13 bp, Homo sapiens
ctatagttctaga

SEQ ID NO: 2897595 - DNA, 11 bp, Homo sapiens
ctatagttttt

SEQ ID NO: 2897596 - DNA, 15 bp, Homo sapiens
ctatataaaatgtgg

SEQ ID NO: 2897597 - DNA, 15 bp, Homo sapiens
ctatataagacatta

SEQ ID NO: 2897598 - DNA, 17 bp, Homo sapiens
ctatatagacttggaga

SEQ ID NO: 2897599 - DNA, 15 bp, Homo sapiens
ctatatatgtgtatg

SEQ ID NO: 2897600 - DNA, 17 bp, Homo sapiens
ctatatatgtgtatgta

SEQ ID NO: 2897601 - DNA, 21 bp, Homo sapiens
ctatatcaataaattccatgt

SEQ ID NO: 2897602 - DNA, 18 bp, Homo sapiens
ctatatgattaaagaaaa

SEQ ID NO: 2897603 - DNA, 21 bp, Homo sapiens
ctatatgcacccctggaacca

SEQ ID NO: 2897604 - DNA, 14 bp, Homo sapiens
ctatattgatttaa

SEQ ID NO: 2897605 - DNA, 15 bp, Homo sapiens
ctatattgatttaaa

SEQ ID NO: 2897606 - DNA, 16 bp, Homo sapiens
ctatattgatttaaaa

SEQ ID NO: 2897607 - DNA, 23 bp, Homo sapiens
ctatattgatttaaaagtgtatt

SEQ ID NO: 2897608 - DNA, 14 bp, Homo sapiens
ctatatttgagcac

SEQ ID NO: 2897609 - DNA, 22 bp, Homo sapiens
ctatatttgggcctgctccaga

SEQ ID NO: 2897610 - DNA, 14 bp, Homo sapiens
ctatattttaatag

SEQ ID NO: 2897611 - DNA, 14 bp, Homo sapiens
ctatcaaaattgcc

SEQ ID NO: 2897612 - DNA, 17 bp, Homo sapiens
ctatcaaccccagacac

SEQ ID NO: 2897613 - DNA, 21 bp, Homo sapiens
ctatcaaccccagacactggt

SEQ ID NO: 2897614 - DNA, 23 bp, Homo sapiens
ctatcaagaggctgagacaggag

SEQ ID NO: 2897615 - DNA, 19 bp, Homo sapiens
ctatcacacactttctctt

SEQ ID NO: 2897616 - DNA, 19 bp, Homo sapiens
ctatcacctcgagaagtaa

SEQ ID NO: 2897617 - DNA, 19 bp, Homo sapiens
ctatcactgacacatcagc

SEQ ID NO: 2897618 - DNA, 19 bp, Homo sapiens
ctatcattgcttcctcctc

SEQ ID NO: 2897619 - DNA, 21 bp, Homo sapiens
ctatccacactgtcaaacagg

SEQ ID NO: 2897620 - DNA, 12 bp, Homo sapiens
ctatccacccag

SEQ ID NO: 2897621 - DNA, 15 bp, Homo sapiens
ctatccacccagccc

SEQ ID NO: 2897622 - DNA, 18 bp, Homo sapiens
ctatccctaacaggctgt

SEQ ID NO: 2897623 - DNA, 12 bp, Homo sapiens
ctatcctctctc

SEQ ID NO: 2897624 - DNA, 15 bp, Homo sapiens
ctatcgttattataa

SEQ ID NO: 2897625 - DNA, 17 bp, Homo sapiens
ctatcgttattataaat

SEQ ID NO: 2897626 - DNA, 18 bp, Homo sapiens
ctatctactaagtttcct

SEQ ID NO: 2897627 - DNA, 15 bp, Homo sapiens
ctatctgcaatgttt

SEQ ID NO: 2897628 - DNA, 22 bp, Homo sapiens
ctatctggtcaacctcctggac

SEQ ID NO: 2897629 - DNA, 16 bp, Homo sapiens
ctatctgtttacagtg

SEQ ID NO: 2897630 - DNA, 17 bp, Homo sapiens
ctatctgtttacagtgt

SEQ ID NO: 2897631 - DNA, 13 bp, Homo sapiens
ctatcttaatttt

SEQ ID NO: 2897632 - DNA, 22 bp, Homo sapiens
ctatcttaattttggttgtatt

SEQ ID NO: 2897633 - DNA, 18 bp, Homo sapiens
ctatcttctttggacttc

SEQ ID NO: 2897634 - DNA, 22 bp, Homo sapiens
ctatcttctttggacttctgaa

SEQ ID NO: 2897635 - DNA, 16 bp, Homo sapiens
ctatcttttatttcat

SEQ ID NO: 2897636 - DNA, 18 bp, Homo sapiens
ctatcttttatttcattc

SEQ ID NO: 2897637 - DNA, 20 bp, Homo sapiens
ctatcttttttagtgttaaa

SEQ ID NO: 2897638 - DNA, 16 bp, Homo sapiens
ctatgaaaggaataaa

SEQ ID NO: 2897639 - DNA, 15 bp, Homo sapiens
ctatgaatgctttgc

SEQ ID NO: 2897640 - DNA, 16 bp, Homo sapiens
ctatgagctaaatgtc

SEQ ID NO: 2897641 - DNA, 18 bp, Homo sapiens
ctaactccctcctcacac

SEQ ID NO: 2897642 - DNA, 19 bp, Homo sapiens
ctaactccctcctcacact

SEQ ID NO: 2897643 - DNA, 13 bp, Homo sapiens
ctaacttcataga

SEQ ID NO: 2897644 - DNA, 23 bp, Homo sapiens
ctaacttcctgtgcctttcctat

SEQ ID NO: 2897645 - DNA, 14 bp, Homo sapiens
ctaagaagtggggc

SEQ ID NO: 2897646 - DNA, 17 bp, Homo sapiens
ctaagaatacagctttc

SEQ ID NO: 2897647 - DNA, 20 bp, Homo sapiens
ctaagaatacagctttctga

SEQ ID NO: 2897648 - DNA, 15 bp, Homo sapiens
ctaagaatgaggaat

SEQ ID NO: 2897649 - DNA, 19 bp, Homo sapiens
ctaagaatttcactgtctt

SEQ ID NO: 2897650 - DNA, 13 bp, Homo sapiens
ctaagactcaaat

SEQ ID NO: 2897651 - DNA, 20 bp, Homo sapiens
ctaagactcaaatgttctaa

SEQ ID NO: 2897652 - DNA, 12 bp, Homo sapiens
ctaagactcccg

SEQ ID NO: 2897653 - DNA, 20 bp, Homo sapiens
ctaagactcccgccccgggc

SEQ ID NO: 2897654 - DNA, 23 bp, Homo sapiens
ctaagacttactctaagatctta

SEQ ID NO: 2897655 - DNA, 21 bp, Homo sapiens
ctaagacttcagtcctggtct

SEQ ID NO: 2897656 - DNA, 20 bp, Homo sapiens
ctaagagctagcgctgccgc

SEQ ID NO: 2897657 - DNA, 16 bp, Homo sapiens
ctaagatcttagattc

SEQ ID NO: 2897658 - DNA, 17 bp, Homo sapiens
ctaagatcttagattct

SEQ ID NO: 2897659 - DNA, 15 bp, Homo sapiens
ctaagatgacattgc

SEQ ID NO: 2897660 - DNA, 20 bp, Homo sapiens
ctaagatgacattgctaaga

SEQ ID NO: 2897661 - DNA, 18 bp, Homo sapiens
ctaagatgtgatattcta

SEQ ID NO: 2897662 - DNA, 22 bp, Homo sapiens
ctaagatgtgatattctaagac

SEQ ID NO: 2897663 - DNA, 13 bp, Homo sapiens
ctaagattctaga

SEQ ID NO: 2897664 - DNA, 14 bp, Homo sapiens
ctaagcaagtgagt

SEQ ID NO: 2897665 - DNA, 12 bp, Homo sapiens
ctaagcagagga

SEQ ID NO: 2897666 - DNA, 19 bp, Homo sapiens
ctaagcagaggaggggccg

SEQ ID NO: 2897667 - DNA, 16 bp, Homo sapiens
ctaagcagccaggagg

SEQ ID NO: 2897668 - DNA, 22 bp, Homo sapiens
ctaagcagccaggagggacctg

SEQ ID NO: 2897669 - DNA, 19 bp, Homo sapiens
ctaagcagttttgtaaatg

SEQ ID NO: 2897670 - DNA, 20 bp, Homo sapiens
ctaagcagttttgtaaatgt

SEQ ID NO: 2897671 - DNA, 14 bp, Homo sapiens
ctaagcatctaagt

SEQ ID NO: 2897672 - DNA, 16 bp, Homo sapiens
ctaagcatgtagccag

SEQ ID NO: 2897673 - DNA, 13 bp, Homo sapiens
ctaagccaagctg

SEQ ID NO: 2897674 - DNA, 16 bp, Homo sapiens
ctaaggacatttccca

SEQ ID NO: 2897675 - DNA, 13 bp, Homo sapiens
ctaaggagcatga

SEQ ID NO: 2897676 - DNA, 19 bp, Homo sapiens
ctaaggagcgctagtgcct

SEQ ID NO: 2897677 - DNA, 17 bp, Homo sapiens
ctaaggaggggaaaaaa

SEQ ID NO: 2897678 - DNA, 17 bp, Homo sapiens
ctaaggatacctgcttt

SEQ ID NO: 2897679 - DNA, 17 bp, Homo sapiens
ctaaggccctttttcct

SEQ ID NO: 2897680 - DNA, 18 bp, Homo sapiens
ctaaggctctatgagtct

SEQ ID NO: 2897681 - DNA, 20 bp, Homo sapiens
ctaaggctctatgagtctag

SEQ ID NO: 2897682 - DNA, 21 bp, Homo sapiens
ctaaggctctatgagtctaga

SEQ ID NO: 2897683 - DNA, 22 bp, Homo sapiens
ctaaggctctatgagtctagat

SEQ ID NO: 2897684 - DNA, 11 bp, Homo sapiens
ctaaggctctg

SEQ ID NO: 2897685 - DNA, 19 bp, Homo sapiens
ctaaggctctgagagtcta

SEQ ID NO: 2897686 - DNA, 21 bp, Homo sapiens
ctaaggctctgagagtctaga

SEQ ID NO: 2897687 - DNA, 17 bp, Homo sapiens
ctaaggctgtttgcttc

SEQ ID NO: 2897688 - DNA, 20 bp, Homo sapiens
ctaagggaggcacttcctcc

SEQ ID NO: 2897689 - DNA, 14 bp, Homo sapiens
ctaagggcagccct

SEQ ID NO: 2897690 - DNA, 16 bp, Homo sapiens
ctaagggcagccctcc

SEQ ID NO: 2897691 - DNA, 13 bp, Homo sapiens
ctaaggggcccgg

SEQ ID NO: 2897692 - DNA, 18 bp, Homo sapiens
ctaaggggcccggccagc

SEQ ID NO: 2897693 - DNA, 17 bp, Homo sapiens
ctaagggtcgaaagctc

SEQ ID NO: 2897694 - DNA, 18 bp, Homo sapiens
ctaagggtcgaaagctct

SEQ ID NO: 2897695 - DNA, 19 bp, Homo sapiens
ctaagggtcgaaagctcta

SEQ ID NO: 2897696 - DNA, 22 bp, Homo sapiens
ctaagggtcgaaagctctagaa

SEQ ID NO: 2897697 - DNA, 20 bp, Homo sapiens
ctaaggtccggtgttctaag

SEQ ID NO: 2897698 - DNA, 15 bp, Homo sapiens
ctaaggtgactttct

SEQ ID NO: 2897699 - DNA, 18 bp, Homo sapiens
ctaaggtgactttctgaa

SEQ ID NO: 2897700 - DNA, 13 bp, Homo sapiens
ctaaggttctaag

SEQ ID NO: 2897701 - DNA, 14 bp, Homo sapiens
ctaaggttctaagg

SEQ ID NO: 2897702 - DNA, 15 bp, Homo sapiens
ctaaggttctaaggc

SEQ ID NO: 2897703 - DNA, 16 bp, Homo sapiens
ctaaggttctaaggcc

SEQ ID NO: 2897704 - DNA, 15 bp, Homo sapiens
ctaagtcctttatgt

SEQ ID NO: 2897705 - DNA, 14 bp, Homo sapiens
ctaagtctttccat

SEQ ID NO: 2897706 - DNA, 19 bp, Homo sapiens
ctaagtgatttccacaggt

SEQ ID NO: 2897707 - DNA, 12 bp, Homo sapiens
ctaagtgggaca

SEQ ID NO: 2897708 - DNA, 21 bp, Homo sapiens
ctaagttataagactctcaca

SEQ ID NO: 2897709 - DNA, 14 bp, Homo sapiens
ctaagttattttat

SEQ ID NO: 2897710 - DNA, 17 bp, Homo sapiens
ctacagctatgaagaaa

SEQ ID NO: 2897711 - DNA, 19 bp, Homo sapiens
ctacagctttgatccctga

SEQ ID NO: 2897712 - DNA, 21 bp, Homo sapiens
ctacagctttgggtcattttt

SEQ ID NO: 2897713 - DNA, 15 bp, Homo sapiens
ctacagtcaggaaag

SEQ ID NO: 2897714 - DNA, 17 bp, Homo sapiens
ctacatgagaacaaaca

SEQ ID NO: 2897715 - DNA, 21 bp, Homo sapiens
ctacatgaggaactgtagatg

SEQ ID NO: 2897716 - DNA, 17 bp, Homo sapiens
ctacatgatgctaaagg

SEQ ID NO: 2897717 - DNA, 12 bp, Homo sapiens
ctacattcattt

SEQ ID NO: 2897718 - DNA, 23 bp, Homo sapiens
ctacatttaaacaagtattttat

SEQ ID NO: 2897719 - DNA, 17 bp, Homo sapiens
ctacatttgtttgtatt

SEQ ID NO: 2897720 - DNA, 18 bp, Homo sapiens
ctacatttgtttgtattc

SEQ ID NO: 2897721 - DNA, 21 bp, Homo sapiens
ctacattttgctctgtgaact

SEQ ID NO: 2897722 - DNA, 21 bp, Homo sapiens
ctaccagcgtatatataagaa

SEQ ID NO: 2897723 - DNA, 22 bp, Homo sapiens
ctaccagtgcaggctggccagc

SEQ ID NO: 2897724 - DNA, 19 bp, Homo sapiens
ctaccatgaacagaaaaca

SEQ ID NO: 2897725 - DNA, 21 bp, Homo sapiens
ctaccattgctgttctacttt

SEQ ID NO: 2897726 - DNA, 16 bp, Homo sapiens
ctacccaaatctaaat

SEQ ID NO: 2897727 - DNA, 18 bp, Homo sapiens
ctacccagtcatgtactg

SEQ ID NO: 2897728 - DNA, 13 bp, Homo sapiens
ctaccccctgtgc

SEQ ID NO: 2897729 - DNA, 14 bp, Homo sapiens
ctacccctgccctg

SEQ ID NO: 2897730 - DNA, 15 bp, Homo sapiens
ctacccgcagagttc

SEQ ID NO: 2897731 - DNA, 20 bp, Homo sapiens
ctaccctgagatctgcacag

SEQ ID NO: 2897732 - DNA, 18 bp, Homo sapiens
ctaccctgagctgaggca

SEQ ID NO: 2897733 - DNA, 17 bp, Homo sapiens
ctaccctgtgctaagca

SEQ ID NO: 2897734 - DNA, 14 bp, Homo sapiens
ctaccgagttcaag

SEQ ID NO: 2897735 - DNA, 15 bp, Homo sapiens
ctaccgatggtccca

SEQ ID NO: 2897736 - DNA, 17 bp, Homo sapiens
ctaccgatggtcccagg

SEQ ID NO: 2897737 - DNA, 19 bp, Homo sapiens
ctaccgcatggcagctggg

SEQ ID NO: 2897738 - DNA, 22 bp, Homo sapiens
ctaccgcatggcagctgggccc

SEQ ID NO: 2897739 - DNA, 23 bp, Homo sapiens
ctaccgcatggcagctgggccca

SEQ ID NO: 2897740 - DNA, 22 bp, Homo sapiens
ctaccgggttctcctgatttga

SEQ ID NO: 2897741 - DNA, 20 bp, Homo sapiens
ctacctagaagtaagaagag

SEQ ID NO: 2897742 - DNA, 16 bp, Homo sapiens
ctacctagtctccact

SEQ ID NO: 2897743 - DNA, 20 bp, Homo sapiens
ctacctatagaaatgtattt

SEQ ID NO: 2897744 - DNA, 12 bp, Homo sapiens
ctacctccctcc

SEQ ID NO: 2897745 - DNA, 20 bp, Homo sapiens
ctacctgacactcccttggg

SEQ ID NO: 2897746 - DNA, 21 bp, Homo sapiens
ctacctgttgagcatcacaga

SEQ ID NO: 2897747 - DNA, 20 bp, Homo sapiens
ctaccttccccagacttgca

SEQ ID NO: 2897748 - DNA, 13 bp, Homo sapiens
ctaccttctttgg

SEQ ID NO: 2897749 - DNA, 14 bp, Homo sapiens
ctaccttctttggc

SEQ ID NO: 2897750 - DNA, 21 bp, Homo sapiens
ctaccttggttcccccactga

SEQ ID NO: 2897751 - DNA, 19 bp, Homo sapiens
ctaccttttgataaaatgt

SEQ ID NO: 2897752 - DNA, 19 bp, Homo sapiens
ctacgcgatagtctctgtt

SEQ ID NO: 2897753 - DNA, 19 bp, Homo sapiens
ctacgtttgcaccgcctgc

SEQ ID NO: 2897754 - DNA, 15 bp, Homo sapiens
ctactaagttatttt

SEQ ID NO: 2897755 - DNA, 15 bp, Homo sapiens
ctactaagtttcctt

SEQ ID NO: 2897756 - DNA, 22 bp, Homo sapiens
ctactaatgtgatgctttcatt

SEQ ID NO: 2897757 - DNA, 12 bp, Homo sapiens
ctactaattcca

SEQ ID NO: 2897758 - DNA, 19 bp, Homo sapiens
ctactatttaaatccttgg

SEQ ID NO: 2897759 - DNA, 16 bp, Homo sapiens
ctactcagcagccctc

SEQ ID NO: 2897760 - DNA, 17 bp, Homo sapiens
ctactcagcagccctcc

SEQ ID NO: 2897761 - DNA, 22 bp, Homo sapiens
ctactcagcagccctcctcacc

SEQ ID NO: 2897762 - DNA, 13 bp, Homo sapiens
ctactcaggaggc

SEQ ID NO: 2897763 - DNA, 20 bp, Homo sapiens
ctactccgcagctctagtcc

SEQ ID NO: 2897764 - DNA, 15 bp, Homo sapiens
ctactcgagcccacc

SEQ ID NO: 2897765 - DNA, 21 bp, Homo sapiens
ctactctggaccaaggagcat

SEQ ID NO: 2897766 - DNA, 19 bp, Homo sapiens
ctactctgttccttcacat

SEQ ID NO: 2897767 - DNA, 15 bp, Homo sapiens
ctactcttaagccat

SEQ ID NO: 2897768 - DNA, 17 bp, Homo sapiens
ctactcttaagccatct

SEQ ID NO: 2897769 - DNA, 13 bp, Homo sapiens
ctactcttttgaa

SEQ ID NO: 2897770 - DNA, 17 bp, Homo sapiens
ctactcttttgaagtgt

SEQ ID NO: 2897771 - DNA, 19 bp, Homo sapiens
ctactcttttgaagtgttt

SEQ ID NO: 2897772 - DNA, 22 bp, Homo sapiens
ctactgaaacttacctgagaac

SEQ ID NO: 2897773 - DNA, 15 bp, Homo sapiens
ctactgcccctctcc

SEQ ID NO: 2897774 - DNA, 17 bp, Homo sapiens
ctactgcccctctccga

SEQ ID NO: 2897775 - DNA, 13 bp, Homo sapiens
ctactgctaatga

SEQ ID NO: 2897776 - DNA, 22 bp, Homo sapiens
ctactgcttcctctgaatatta

SEQ ID NO: 2897777 - DNA, 18 bp, Homo sapiens
ctactggcatagtttcat

SEQ ID NO: 2897778 - DNA, 14 bp, Homo sapiens
ctactgggagccta

SEQ ID NO: 2897779 - DNA, 18 bp, Homo sapiens
ctactgggagcctaccca

SEQ ID NO: 2897780 - DNA, 18 bp, Homo sapiens
ctactggggaggctgagg

SEQ ID NO: 2897781 - DNA, 20 bp, Homo sapiens
ctactggggaggctgaggca

SEQ ID NO: 2897782 - DNA, 22 bp, Homo sapiens
ctactggtgtaatctcaatgca

SEQ ID NO: 2897783 - DNA, 19 bp, Homo sapiens
ctactgtccctctcagtgc

SEQ ID NO: 2897784 - DNA, 20 bp, Homo sapiens
ctactgtccctctcagtgcc

SEQ ID NO: 2897785 - DNA, 20 bp, Homo sapiens
ctactgtgtgtgtgaatgaa

SEQ ID NO: 2897786 - DNA, 17 bp, Homo sapiens
ctagatacctaaaacat

SEQ ID NO: 2897787 - DNA, 23 bp, Homo sapiens
ctagatcatttgttctgggagta

SEQ ID NO: 2897788 - DNA, 22 bp, Homo sapiens
ctagatccaggcttctcccgga

SEQ ID NO: 2897789 - DNA, 17 bp, Homo sapiens
ctagatgaagttttaca

SEQ ID NO: 2897790 - DNA, 22 bp, Homo sapiens
ctagatgacataaaatttacat

SEQ ID NO: 2897791 - DNA, 17 bp, Homo sapiens
ctagatgcaagtctctt

SEQ ID NO: 2897792 - DNA, 17 bp, Homo sapiens
ctagatggaccccagca

SEQ ID NO: 2897793 - DNA, 16 bp, Homo sapiens
ctagatggctcctctc

SEQ ID NO: 2897794 - DNA, 18 bp, Homo sapiens
ctagatggctcctctcag

SEQ ID NO: 2897795 - DNA, 23 bp, Homo sapiens
ctagatgtttattcttctagagt

SEQ ID NO: 2897796 - DNA, 12 bp, Homo sapiens
ctagattaaaat

SEQ ID NO: 2897797 - DNA, 21 bp, Homo sapiens
ctagattatatcaaagtattt

SEQ ID NO: 2897798 - DNA, 14 bp, Homo sapiens
ctagattcaaaggt

SEQ ID NO: 2897799 - DNA, 16 bp, Homo sapiens
ctagattcaaaggttc

SEQ ID NO: 2897800 - DNA, 22 bp, Homo sapiens
ctagattggagtggggaagtgt

SEQ ID NO: 2897801 - DNA, 19 bp, Homo sapiens
ctagatttctagaaaagct

SEQ ID NO: 2897802 - DNA, 18 bp, Homo sapiens
ctagcacatgcttcaata

SEQ ID NO: 2897803 - DNA, 12 bp, Homo sapiens
ctagcagcaccg

SEQ ID NO: 2897804 - DNA, 20 bp, Homo sapiens
ctagcagcaccgttctgtgc

SEQ ID NO: 2897805 - DNA, 21 bp, Homo sapiens
ctagcagcaccgttctgtgca

SEQ ID NO: 2897806 - DNA, 13 bp, Homo sapiens
ctagcaggccccc

SEQ ID NO: 2897807 - DNA, 19 bp, Homo sapiens
ctagcaggccccctaggat

SEQ ID NO: 2897808 - DNA, 15 bp, Homo sapiens
ctagcatgccaacaa

SEQ ID NO: 2897809 - DNA, 18 bp, Homo sapiens
ctagccaccgcctcctac

SEQ ID NO: 2897810 - DNA, 18 bp, Homo sapiens
ctagcccaggggaatgta

SEQ ID NO: 2897811 - DNA, 13 bp, Homo sapiens
ctagccctgggac

SEQ ID NO: 2897812 - DNA, 20 bp, Homo sapiens
ctagccgctgccctgggtcc

SEQ ID NO: 2897813 - DNA, 18 bp, Homo sapiens
ctagccggaaggccgagg

SEQ ID NO: 2897814 - DNA, 19 bp, Homo sapiens
ctagcctggggcttgaatt

SEQ ID NO: 2897815 - DNA, 22 bp, Homo sapiens
ctagcctggggcttgaatttgc

SEQ ID NO: 2897816 - DNA, 18 bp, Homo sapiens
ctagccttagtcaataaa

SEQ ID NO: 2897817 - DNA, 22 bp, Homo sapiens
ctagcgctgccgcaccccagag

SEQ ID NO: 2897818 - DNA, 23 bp, Homo sapiens
ctagctagaagtgggccaggaca

SEQ ID NO: 2897819 - DNA, 16 bp, Homo sapiens
ctagctagccagccaa

SEQ ID NO: 2897820 - DNA, 16 bp, Homo sapiens
ctagctatcaagaggc

SEQ ID NO: 2897821 - DNA, 18 bp, Homo sapiens
ctagctcctcctcctggg

SEQ ID NO: 2897822 - DNA, 20 bp, Homo sapiens
ctagctctatgtttacaaat

SEQ ID NO: 2897823 - DNA, 23 bp, Homo sapiens
ctagctctatgtttacaaatgga

SEQ ID NO: 2897824 - DNA, 20 bp, Homo sapiens
ctagctctatttacttctaa

SEQ ID NO: 2897825 - DNA, 14 bp, Homo sapiens
ctagctcttgggcc

SEQ ID NO: 2897826 - DNA, 15 bp, Homo sapiens
ctagctcttgggcct

SEQ ID NO: 2897827 - DNA, 19 bp, Homo sapiens
ctagctcttgggcctgacc

SEQ ID NO: 2897828 - DNA, 22 bp, Homo sapiens
ctagctcttgggcctgacctcc

SEQ ID NO: 2897829 - DNA, 21 bp, Homo sapiens
ctagctgctacaaagaagaca

SEQ ID NO: 2897830 - DNA, 14 bp, Homo sapiens
ctagctggatttgt

SEQ ID NO: 2897831 - DNA, 22 bp, Homo sapiens
ctagctgggggtgggccaggct

SEQ ID NO: 2897832 - DNA, 16 bp, Homo sapiens
ctagctgtatgatttg

SEQ ID NO: 2897833 - DNA, 11 bp, Homo sapiens
ctaggaagaat

SEQ ID NO: 2897834 - DNA, 15 bp, Homo sapiens
ctaggaagaatttta

SEQ ID NO: 2897835 - DNA, 17 bp, Homo sapiens
ctaggacgttggcctca

SEQ ID NO: 2897836 - DNA, 24 bp, Homo sapiens
ctaggacgttggcctcagggccag

SEQ ID NO: 2897837 - DNA, 16 bp, Homo sapiens
ctaggagctgggagga

SEQ ID NO: 2897838 - DNA, 19 bp, Homo sapiens
ctaggagtcaactggctgg

SEQ ID NO: 2897839 - DNA, 17 bp, Homo sapiens
ctaggataacttgcttt

SEQ ID NO: 2897840 - DNA, 22 bp, Homo sapiens
ctaggataacttgctttcttct

SEQ ID NO: 2897841 - DNA, 22 bp, Homo sapiens
ctaggatagctaactgtaaatc

SEQ ID NO: 2897842 - DNA, 13 bp, Homo sapiens
ctaggattctaaa

SEQ ID NO: 2897843 - DNA, 16 bp, Homo sapiens
ctaggatttgaacact

SEQ ID NO: 2897844 - DNA, 17 bp, Homo sapiens
ctaggatttgaacactt

SEQ ID NO: 2897845 - DNA, 16 bp, Homo sapiens
ctaggccactcctcca

SEQ ID NO: 2897846 - DNA, 19 bp, Homo sapiens
ctaggccactcctccaaag

SEQ ID NO: 2897847 - DNA, 14 bp, Homo sapiens
ctaggcccctgtgt

SEQ ID NO: 2897848 - DNA, 19 bp, Homo sapiens
ctaggcccttggggtggcg

SEQ ID NO: 2897849 - DNA, 19 bp, Homo sapiens
ctaggcctcagccagagaa

SEQ ID NO: 2897850 - DNA, 23 bp, Homo sapiens
ctaggcctctcacctctgtgcct

SEQ ID NO: 2897851 - DNA, 13 bp, Homo sapiens
ctagggcagggtg

SEQ ID NO: 2897852 - DNA, 21 bp, Homo sapiens
ctagggcagggtgggagccgg

SEQ ID NO: 2897853 - DNA, 17 bp, Homo sapiens
ctagggccaagcccagc

SEQ ID NO: 2897854 - DNA, 20 bp, Homo sapiens
ctagggcctcggaggctcct

SEQ ID NO: 2897855 - DNA, 22 bp, Homo sapiens
ctagggcctcggaggctcctcc

SEQ ID NO: 2897856 - DNA, 16 bp, Homo sapiens
ctaggggaaggactgg

SEQ ID NO: 2897857 - DNA, 20 bp, Homo sapiens
ctaggggaaggactggccgt

SEQ ID NO: 2897858 - DNA, 20 bp, Homo sapiens
ctaggggcttggtcctaggg

SEQ ID NO: 2897859 - DNA, 23 bp, Homo sapiens
ctagggggagccccttctgctca

SEQ ID NO: 2897860 - DNA, 18 bp, Homo sapiens
ctagggttttggcctgcc

SEQ ID NO: 2897861 - DNA, 22 bp, Homo sapiens
ctaggtatcattcaactctcca

SEQ ID NO: 2897862 - DNA, 14 bp, Homo sapiens
ctaggtcataaaga

SEQ ID NO: 2897863 - DNA, 13 bp, Homo sapiens
ctaggtgcagctc

SEQ ID NO: 2897864 - DNA, 19 bp, Homo sapiens
ctaggtgctaaaattcaga

SEQ ID NO: 2897865 - DNA, 14 bp, Homo sapiens
ctaggttctgtaga

SEQ ID NO: 2897866 - DNA, 21 bp, Homo sapiens
ctaggttctgtagagccaatt

SEQ ID NO: 2897867 - DNA, 22 bp, Homo sapiens
ctaggttctgtagagccaatta

SEQ ID NO: 2897868 - DNA, 21 bp, Homo sapiens
ctagtacataattgattaaaa

SEQ ID NO: 2897869 - DNA, 18 bp, Homo sapiens
ctagtatgaaagctgggg

SEQ ID NO: 2897870 - DNA, 15 bp, Homo sapiens
ccttttacccctgca

SEQ ID NO: 2897871 - DNA, 20 bp, Homo sapiens
ccttttatcaataaagcact

SEQ ID NO: 2897872 - DNA, 21 bp, Homo sapiens
ccttttccaaatgcccaagga

SEQ ID NO: 2897873 - DNA, 14 bp, Homo sapiens
ccttttctatgttg

SEQ ID NO: 2897874 - DNA, 16 bp, Homo sapiens
ccttttctatgttgct

SEQ ID NO: 2897875 - DNA, 15 bp, Homo sapiens
ccttttctggcaccg

SEQ ID NO: 2897876 - DNA, 18 bp, Homo sapiens
ccttttctgtctctctct

SEQ ID NO: 2897877 - DNA, 14 bp, Homo sapiens
cgcctgcctcctgg

SEQ ID NO: 2897878 - DNA, 16 bp, Homo sapiens
cgcctgcctcctggct

SEQ ID NO: 2897879 - DNA, 14 bp, Homo sapiens
cgcctgcctgccac

SEQ ID NO: 2897880 - DNA, 18 bp, Homo sapiens
cgcctgcctgccaccctg

SEQ ID NO: 2897881 - DNA, 15 bp, Homo sapiens
cgcctgccttttcta

SEQ ID NO: 2897882 - DNA, 15 bp, Homo sapiens
cgctttggcctgagt

SEQ ID NO: 2897883 - DNA, 17 bp, Homo sapiens
cggaaaccttggtgtag

SEQ ID NO: 2897884 - DNA, 12 bp, Homo sapiens
cggaaagcagct

SEQ ID NO: 2897885 - DNA, 12 bp, Homo sapiens
cggaaaggtatt

SEQ ID NO: 2897886 - DNA, 20 bp, Homo sapiens
cggaaaggtatttgggaaac

SEQ ID NO: 2897887 - DNA, 14 bp, Homo sapiens
cggaaattaaagtt

SEQ ID NO: 2897888 - DNA, 19 bp, Homo sapiens
cggaacccaagcttagaac

SEQ ID NO: 2897889 - DNA, 20 bp, Homo sapiens
cggaaccgcccaggatcaga

SEQ ID NO: 2897890 - DNA, 12 bp, Homo sapiens
cggaagcctgtc

SEQ ID NO: 2897891 - DNA, 16 bp, Homo sapiens
cggaagcctgtcctca

SEQ ID NO: 2897892 - DNA, 21 bp, Homo sapiens
cggaataaactagagaaggga

SEQ ID NO: 2897893 - DNA, 21 bp, Homo sapiens
cggaatcctgtcgattagact

SEQ ID NO: 2897894 - DNA, 20 bp, Homo sapiens
cggacaagacccccagcact

SEQ ID NO: 2897895 - DNA, 13 bp, Homo sapiens
cggacacccaggg

SEQ ID NO: 2897896 - DNA, 17 bp, Homo sapiens
cggacaccgtggcctgg

SEQ ID NO: 2897897 - DNA, 19 bp, Homo sapiens
cggacaccgtggcctgggc

SEQ ID NO: 2897898 - DNA, 19 bp, Homo sapiens
cggacacttctcaggaaat

SEQ ID NO: 2897899 - DNA, 14 bp, Homo sapiens
cggacagtcggaaa

SEQ ID NO: 2897900 - DNA, 17 bp, Homo sapiens
cggacatggtctgtcct

SEQ ID NO: 2897901 - DNA, 18 bp, Homo sapiens
cggacctggactagggcc

SEQ ID NO: 2897902 - DNA, 17 bp, Homo sapiens
cggagaaattctcttta

SEQ ID NO: 2897903 - DNA, 18 bp, Homo sapiens
cggagaacatgaatcaaa

SEQ ID NO: 2897904 - DNA, 14 bp, Homo sapiens
cggagacctcctga

SEQ ID NO: 2897905 - DNA, 20 bp, Homo sapiens
cggagatagatgactttgca

SEQ ID NO: 2897906 - DNA, 22 bp, Homo sapiens
cggagatagatgactttgcaga

SEQ ID NO: 2897907 - DNA, 17 bp, Homo sapiens
cggagccactcctctga

SEQ ID NO: 2897908 - DNA, 18 bp, Homo sapiens
cggagccactcctctgac

SEQ ID NO: 2897909 - DNA, 21 bp, Homo sapiens
cggagccactcctctgactca

SEQ ID NO: 2897910 - DNA, 20 bp, Homo sapiens
cggagccgggaaagaagagc

SEQ ID NO: 2897911 - DNA, 19 bp, Homo sapiens
cggagctgcccctctctgg

SEQ ID NO: 2897912 - DNA, 11 bp, Homo sapiens
cggagctgcct

SEQ ID NO: 2897913 - DNA, 13 bp, Homo sapiens
cggagctgcctgc

SEQ ID NO: 2897914 - DNA, 14 bp, Homo sapiens
cggagctgcctgca

SEQ ID NO: 2897915 - DNA, 17 bp, Homo sapiens
cggagctgcctgcagca

SEQ ID NO: 2897916 - DNA, 16 bp, Homo sapiens
cggagctgctgagtga

SEQ ID NO: 2897917 - DNA, 16 bp, Homo sapiens
cggagctggccccgcc

SEQ ID NO: 2897918 - DNA, 21 bp, Homo sapiens
cgggaagggcatgcacgggca

SEQ ID NO: 2897919 - DNA, 17 bp, Homo sapiens
cgggaatattgtttctt

SEQ ID NO: 2897920 - DNA, 19 bp, Homo sapiens
cgggacaccgtggggaagg

SEQ ID NO: 2897921 - DNA, 21 bp, Homo sapiens
cgggacatcacagggtgggcc

SEQ ID NO: 2897922 - DNA, 22 bp, Homo sapiens
cgggacatcacagggtgggcct

SEQ ID NO: 2897923 - DNA, 17 bp, Homo sapiens
cgggacccggcggccct

SEQ ID NO: 2897924 - DNA, 13 bp, Homo sapiens
cgggacctggtgc

SEQ ID NO: 2897925 - DNA, 13 bp, Homo sapiens
cgggagaaaagac

SEQ ID NO: 2897926 - DNA, 15 bp, Homo sapiens
cgggagaagccacct

SEQ ID NO: 2897927 - DNA, 16 bp, Homo sapiens
cgggagaagccacctt

SEQ ID NO: 2897928 - DNA, 14 bp, Homo sapiens
cgggagagccaggc

SEQ ID NO: 2897929 - DNA, 16 bp, Homo sapiens
cgggagaggggacgca

SEQ ID NO: 2897930 - DNA, 17 bp, Homo sapiens
cgggagcctgaccctca

SEQ ID NO: 2897931 - DNA, 10 bp, Homo sapiens
cgggagctgg

SEQ ID NO: 2897932 - DNA, 21 bp, Homo sapiens
cgggagggagtctcaggagga

SEQ ID NO: 2897933 - DNA, 17 bp, Homo sapiens
cgggagtgacccagcta

SEQ ID NO: 2897934 - DNA, 13 bp, Homo sapiens
cgggatcctgccc

SEQ ID NO: 2897935 - DNA, 17 bp, Homo sapiens
cgggcaagtgagagggg

SEQ ID NO: 2897936 - DNA, 20 bp, Homo sapiens
cgggcaagtgagaggggagg

SEQ ID NO: 2897937 - DNA, 21 bp, Homo sapiens
cgggcaagtgagaggggaggg

SEQ ID NO: 2897938 - DNA, 10 bp, Homo sapiens
cgggcagaaa

SEQ ID NO: 2897939 - DNA, 22 bp, Homo sapiens
cgggcaggggagccagggtaga

SEQ ID NO: 2897940 - DNA, 17 bp, Homo sapiens
cgggcagtcgctgcagg

SEQ ID NO: 2897941 - DNA, 18 bp, Homo sapiens
cgggcatgcacacggctg

SEQ ID NO: 2897942 - DNA, 23 bp, Homo sapiens
cgggcatgcacacggctggtcac

SEQ ID NO: 2897943 - DNA, 18 bp, Homo sapiens
cgggcatgtctgcctgga

SEQ ID NO: 2897944 - DNA, 20 bp, Homo sapiens
cgggcatgtctgcctggagt

SEQ ID NO: 2897945 - DNA, 13 bp, Homo sapiens
cgggccacagggc

SEQ ID NO: 2897946 - DNA, 14 bp, Homo sapiens
cgggccacagggca

SEQ ID NO: 2897947 - DNA, 14 bp, Homo sapiens
cgggcccagcactt

SEQ ID NO: 2897948 - DNA, 13 bp, Homo sapiens
cgggcccagggac

SEQ ID NO: 2897949 - DNA, 14 bp, Homo sapiens
cgggcccccaccgc

SEQ ID NO: 2897950 - DNA, 19 bp, Homo sapiens
cgggccgacggagccggga

SEQ ID NO: 2897951 - DNA, 15 bp, Homo sapiens
cgggccggacctgag

SEQ ID NO: 2897952 - DNA, 23 bp, Homo sapiens
cgggccgtctcccttggcccaga

SEQ ID NO: 2897953 - DNA, 14 bp, Homo sapiens
cgggcctgtacagt

SEQ ID NO: 2897954 - DNA, 17 bp, Homo sapiens
cgggcctgtacagtctg

SEQ ID NO: 2897955 - DNA, 17 bp, Homo sapiens
cgggcggtcctgcacag

SEQ ID NO: 2897956 - DNA, 17 bp, Homo sapiens
cgggctgagggcatctc

SEQ ID NO: 2897957 - DNA, 16 bp, Homo sapiens
cgggctggccctgtgc

SEQ ID NO: 2897958 - DNA, 21 bp, Homo sapiens
cgggctggctgcttgcagcca

SEQ ID NO: 2897959 - DNA, 22 bp, Homo sapiens
cgggctttgtgtgaaggcagag

SEQ ID NO: 2897960 - DNA, 15 bp, Homo sapiens
cggggaactcctgga

SEQ ID NO: 2897961 - DNA, 16 bp, Homo sapiens
cggggacaggctggaa

SEQ ID NO: 2897962 - DNA, 21 bp, Homo sapiens
cgtataccgtgccactttcca

SEQ ID NO: 2897963 - DNA, 22 bp, Homo sapiens
cgtataccgtgccactttccac

SEQ ID NO: 2897964 - DNA, 15 bp, Homo sapiens
cgtatagctgtattg

SEQ ID NO: 2897965 - DNA, 23 bp, Homo sapiens
cgtatatataagaaagacatctt

SEQ ID NO: 2897966 - DNA, 19 bp, Homo sapiens
cgtatgcatttttttagtt

SEQ ID NO: 2897967 - DNA, 18 bp, Homo sapiens
cgtattccccttcccact

SEQ ID NO: 2897968 - DNA, 21 bp, Homo sapiens
cgtcaaaacagattgtttgca

SEQ ID NO: 2897969 - DNA, 16 bp, Homo sapiens
cgtcacccaaaagcac

SEQ ID NO: 2897970 - DNA, 18 bp, Homo sapiens
cgtcacccttggtagagt

SEQ ID NO: 2897971 - DNA, 17 bp, Homo sapiens
cgtcaggggtgcacagt

SEQ ID NO: 2897972 - DNA, 21 bp, Homo sapiens
cgtcatgggccccccatgcat

SEQ ID NO: 2897973 - DNA, 19 bp, Homo sapiens
cgtccaccaggcctcactg

SEQ ID NO: 2897974 - DNA, 12 bp, Homo sapiens
cgtccactgtca

SEQ ID NO: 2897975 - DNA, 14 bp, Homo sapiens
cgtccactgtcaag

SEQ ID NO: 2897976 - DNA, 16 bp, Homo sapiens
cgtccagctgcccttc

SEQ ID NO: 2897977 - DNA, 21 bp, Homo sapiens
cgtccaggccgcgccctttcc

SEQ ID NO: 2897978 - DNA, 14 bp, Homo sapiens
cgtccatctctctc

SEQ ID NO: 2897979 - DNA, 15 bp, Homo sapiens
cgtcccaagatgttg

SEQ ID NO: 2897980 - DNA, 18 bp, Homo sapiens
cgtcccagcggcctcagg

SEQ ID NO: 2897981 - DNA, 22 bp, Homo sapiens
cgtcccctcccccacccctgct

SEQ ID NO: 2897982 - DNA, 17 bp, Homo sapiens
cgtcctccccctgccag

SEQ ID NO: 2897983 - DNA, 22 bp, Homo sapiens
cgtcctccccctgccagtgcct

SEQ ID NO: 2897984 - DNA, 12 bp, Homo sapiens
cgtcctcctctg

SEQ ID NO: 2897985 - DNA, 23 bp, Homo sapiens
cgtcctgtccacacccagctcag

SEQ ID NO: 2897986 - DNA, 18 bp, Homo sapiens
cgtcctttcacacatctg

SEQ ID NO: 2897987 - DNA, 13 bp, Homo sapiens
cgtcggagctgcc

SEQ ID NO: 2897988 - DNA, 17 bp, Homo sapiens
cgtcggagctgcctgca

SEQ ID NO: 2897989 - DNA, 22 bp, Homo sapiens
cgtcggagctgcctgcagcaca

SEQ ID NO: 2897990 - DNA, 20 bp, Homo sapiens
cgtcgtgtgctgaagacatg

SEQ ID NO: 2897991 - DNA, 20 bp, Homo sapiens
cgtctcacatttttacttgg

SEQ ID NO: 2897992 - DNA, 20 bp, Homo sapiens
cgtctcccttggcccagaga

SEQ ID NO: 2897993 - DNA, 14 bp, Homo sapiens
cgtctctctgcctg

SEQ ID NO: 2897994 - DNA, 15 bp, Homo sapiens
cgtctctctgcctgc

SEQ ID NO: 2897995 - DNA, 19 bp, Homo sapiens
cgtctctctgcctgctggg

SEQ ID NO: 2897996 - DNA, 20 bp, Homo sapiens
cgtctctctgcctgctgggc

SEQ ID NO: 2897997 - DNA, 14 bp, Homo sapiens
cgtctctgtcctcg

SEQ ID NO: 2897998 - DNA, 16 bp, Homo sapiens
cgtctgactccctccc

SEQ ID NO: 2897999 - DNA, 18 bp, Homo sapiens
cgtctgactccctcccca

SEQ ID NO: 2898000 - DNA, 21 bp, Homo sapiens
cgtctgactccctccccaccc

SEQ ID NO: 2898001 - DNA, 23 bp, Homo sapiens
cgtctgcgattttatctgttaac

SEQ ID NO: 2898002 - DNA, 16 bp, Homo sapiens
cgtctggcgagccctt

SEQ ID NO: 2898003 - DNA, 17 bp, Homo sapiens
cgtctggggttcagccc

SEQ ID NO: 2898004 - DNA, 19 bp, Homo sapiens
cgtctggggttcagcccct

SEQ ID NO: 2898005 - DNA, 14 bp, Homo sapiens
cgtctgtccatctg

SEQ ID NO: 2898006 - DNA, 21 bp, Homo sapiens
cgtctgtgtgtgacccctcct

SEQ ID NO: 2898007 - DNA, 14 bp, Homo sapiens
cgtctgttccccct

SEQ ID NO: 2898008 - DNA, 16 bp, Homo sapiens
cgtcttcagctgcatt

SEQ ID NO: 2898009 - DNA, 18 bp, Homo sapiens
cgtcttcatctccctgcc

SEQ ID NO: 2898010 - DNA, 13 bp, Homo sapiens
cgtcttccttctt

SEQ ID NO: 2898011 - DNA, 15 bp, Homo sapiens
cgtctttaagagact

SEQ ID NO: 2898012 - DNA, 15 bp, Homo sapiens
cgtgaaaacggagct

SEQ ID NO: 2898013 - DNA, 17 bp, Homo sapiens
cgtgaaaacggagctga

SEQ ID NO: 2898014 - DNA, 17 bp, Homo sapiens
cgtgttacccactgcca

SEQ ID NO: 2898015 - DNA, 12 bp, Homo sapiens
cgtgttcctttg

SEQ ID NO: 2898016 - DNA, 12 bp, Homo sapiens
cgtgtttgtgtt

SEQ ID NO: 2898017 - DNA, 21 bp, Homo sapiens
cgtgttttattcctgtatgtt

SEQ ID NO: 2898018 - DNA, 13 bp, Homo sapiens
cgtgttttcaagg

SEQ ID NO: 2898019 - DNA, 21 bp, Homo sapiens
cgttaaaagtgtacaagttgc

SEQ ID NO: 2898020 - DNA, 18 bp, Homo sapiens
cgttataaagtgtgccac

SEQ ID NO: 2898021 - DNA, 14 bp, Homo sapiens
cgttattataaatg

SEQ ID NO: 2898022 - DNA, 15 bp, Homo sapiens
cgttattataaatgt

SEQ ID NO: 2898023 - DNA, 20 bp, Homo sapiens
cgttattataaatgttagtt

SEQ ID NO: 2898024 - DNA, 13 bp, Homo sapiens
cgttcagggaggg

SEQ ID NO: 2898025 - DNA, 14 bp, Homo sapiens
cgttccccacccct

SEQ ID NO: 2898026 - DNA, 16 bp, Homo sapiens
cgttcgcctctggccc

SEQ ID NO: 2898027 - DNA, 20 bp, Homo sapiens
cgttcgcctctggccctggg

SEQ ID NO: 2898028 - DNA, 14 bp, Homo sapiens
cgttctaaatatga

SEQ ID NO: 2898029 - DNA, 14 bp, Homo sapiens
cgttctgctcatca

SEQ ID NO: 2898030 - DNA, 20 bp, Homo sapiens
cgttctgtactgttactggg

SEQ ID NO: 2898031 - DNA, 19 bp, Homo sapiens
cgttcttaggctgctggga

SEQ ID NO: 2898032 - DNA, 16 bp, Homo sapiens
cgttgatgtaatgaaa

SEQ ID NO: 2898033 - DNA, 17 bp, Homo sapiens
cgttgccctaattcatc

SEQ ID NO: 2898034 - DNA, 14 bp, Homo sapiens
cgttgccgcagcgg

SEQ ID NO: 2898035 - DNA, 14 bp, Homo sapiens
cgttggatttaaaa

SEQ ID NO: 2898036 - DNA, 16 bp, Homo sapiens
cgttggcctcagggcc

SEQ ID NO: 2898037 - DNA, 23 bp, Homo sapiens
cgttggtctctgcatttttctgc

SEQ ID NO: 2898038 - DNA, 14 bp, Homo sapiens
cgttggtttgtgtt

SEQ ID NO: 2898039 - DNA, 17 bp, Homo sapiens
cgttgtccctacaggag

SEQ ID NO: 2898040 - DNA, 17 bp, Homo sapiens
cgttgtctgtggatggt

SEQ ID NO: 2898041 - DNA, 18 bp, Homo sapiens
cgttgtttacttaaagat

SEQ ID NO: 2898042 - DNA, 17 bp, Homo sapiens
cgtttaatgtttataca

SEQ ID NO: 2898043 - DNA, 17 bp, Homo sapiens
cgtttactatgcctgtg

SEQ ID NO: 2898044 - DNA, 20 bp, Homo sapiens
cgtttactatgcctgtgtct

SEQ ID NO: 2898045 - DNA, 18 bp, Homo sapiens
cgtttagtgccaatgttg

SEQ ID NO: 2898046 - DNA, 22 bp, Homo sapiens
cgtttatatttttttaactgtg

SEQ ID NO: 2898047 - DNA, 13 bp, Homo sapiens
cgtttcatcaggc

SEQ ID NO: 2898048 - DNA, 19 bp, Homo sapiens
cgtttgcaccgcctgccct

SEQ ID NO: 2898049 - DNA, 20 bp, Homo sapiens
cgtttgcaccgcctgccctc

SEQ ID NO: 2898050 - DNA, 14 bp, Homo sapiens
cgtttgctgtgcca

SEQ ID NO: 2898051 - DNA, 22 bp, Homo sapiens
cgtttggtcttaggtcttcctg

SEQ ID NO: 2898052 - DNA, 13 bp, Homo sapiens
cgtttgtgcagaa

SEQ ID NO: 2898053 - DNA, 17 bp, Homo sapiens
cgtttgtgcagaatctc

SEQ ID NO: 2898054 - DNA, 12 bp, Homo sapiens
cgttttgcctgt

SEQ ID NO: 2898055 - DNA, 13 bp, Homo sapiens
cgtttttcaagaa

SEQ ID NO: 2898056 - DNA, 17 bp, Homo sapiens
ctaaaaaaaaaaaagta

SEQ ID NO: 2898057 - DNA, 20 bp, Homo sapiens
ctaaaaaaaaaaaagtatta

SEQ ID NO: 2898058 - DNA, 14 bp, Homo sapiens
ctaaaaaaaaaaac

SEQ ID NO: 2898059 - DNA, 15 bp, Homo sapiens
ctaaaaagatgtaat

SEQ ID NO: 2898060 - DNA, 13 bp, Homo sapiens
ctaaaaataagaa

SEQ ID NO: 2898061 - DNA, 23 bp, Homo sapiens
ctaaaaatatgcagaatctctgc

SEQ ID NO: 2898062 - DNA, 12 bp, Homo sapiens
ctaaaaatgaag

SEQ ID NO: 2898063 - DNA, 17 bp, Homo sapiens
ctaaaacaataaaattt

SEQ ID NO: 2898064 - DNA, 15 bp, Homo sapiens
ctaaaagaatttaaa

SEQ ID NO: 2898065 - DNA, 12 bp, Homo sapiens
ctaaaagcacac

SEQ ID NO: 2898066 - DNA, 23 bp, Homo sapiens
ctaaaagtgggcttgattctgca

SEQ ID NO: 2898067 - DNA, 13 bp, Homo sapiens
ctaaaataaacct

SEQ ID NO: 2898068 - DNA, 17 bp, Homo sapiens
ctaaaatcccaccagaa

SEQ ID NO: 2898069 - DNA, 22 bp, Homo sapiens
ctaaaatcttatagttctaggc

SEQ ID NO: 2898070 - DNA, 18 bp, Homo sapiens
ctaaaatgtgatgttcta

SEQ ID NO: 2898071 - DNA, 19 bp, Homo sapiens
ctaaacactgcgctttatt

SEQ ID NO: 2898072 - DNA, 19 bp, Homo sapiens
ctaaacccaatccaaatgg

SEQ ID NO: 2898073 - DNA, 19 bp, Homo sapiens
ctaaaccccagattcttca

SEQ ID NO: 2898074 - DNA, 14 bp, Homo sapiens
ctaaacctcaggcc

SEQ ID NO: 2898075 - DNA, 19 bp, Homo sapiens
caacttagatctctcctgc

SEQ ID NO: 2898076 - DNA, 14 bp, Homo sapiens
caacttatttaaaa

SEQ ID NO: 2898077 - DNA, 18 bp, Homo sapiens
caacttcaagtgcatgct

SEQ ID NO: 2898078 - DNA, 18 bp, Homo sapiens
caacttccctgttcttta

SEQ ID NO: 2898079 - DNA, 19 bp, Homo sapiens
caacttctacttctgccct

SEQ ID NO: 2898080 - DNA, 19 bp, Homo sapiens
caacttgaacttcacctgc

SEQ ID NO: 2898081 - DNA, 18 bp, Homo sapiens
caacttgaagaaacgctt

SEQ ID NO: 2898082 - DNA, 14 bp, Homo sapiens
caacttgcttatca

SEQ ID NO: 2898083 - DNA, 13 bp, Homo sapiens
caacttgcttcta

SEQ ID NO: 2898084 - DNA, 22 bp, Homo sapiens
caacttgcttctaaatgcccag

SEQ ID NO: 2898085 - DNA, 19 bp, Homo sapiens
caacttggaaaaagaaaga

SEQ ID NO: 2898086 - DNA, 11 bp, Homo sapiens
caactttcttc

SEQ ID NO: 2898087 - DNA, 12 bp, Homo sapiens
caactttgaata

SEQ ID NO: 2898088 - DNA, 17 bp, Homo sapiens
caactttgaataaagaa

SEQ ID NO: 2898089 - DNA, 18 bp, Homo sapiens
caactttttattgccttc

SEQ ID NO: 2898090 - DNA, 15 bp, Homo sapiens
caactttttccaagt

SEQ ID NO: 2898091 - DNA, 20 bp, Homo sapiens
caagaaaactcaaagaatgt

SEQ ID NO: 2898092 - DNA, 22 bp, Homo sapiens
caagaaaattgcctttaaaact

SEQ ID NO: 2898093 - DNA, 18 bp, Homo sapiens
caagaaacactgcctgcc

SEQ ID NO: 2898094 - DNA, 22 bp, Homo sapiens
caagaaagaaacccgacagagg

SEQ ID NO: 2898095 - DNA, 19 bp, Homo sapiens
caagaaataaaaggaagcc

SEQ ID NO: 2898096 - DNA, 20 bp, Homo sapiens
caagaactcatcactgtggc

SEQ ID NO: 2898097 - DNA, 21 bp, Homo sapiens
caagaaggcaacttgaagaaa

SEQ ID NO: 2898098 - DNA, 22 bp, Homo sapiens
caagaagtcagagaaaacactt

SEQ ID NO: 2898099 - DNA, 14 bp, Homo sapiens
caagaatccacatt

SEQ ID NO: 2898100 - DNA, 18 bp, Homo sapiens
caagaatccacatttcta

SEQ ID NO: 2898101 - DNA, 19 bp, Homo sapiens
caagaatccacatttctaa

SEQ ID NO: 2898102 - DNA, 21 bp, Homo sapiens
caagaatccacatttctaaaa

SEQ ID NO: 2898103 - DNA, 22 bp, Homo sapiens
caagaatccacatttctaaaat

SEQ ID NO: 2898104 - DNA, 23 bp, Homo sapiens
caagaatgacggaataagagacc

SEQ ID NO: 2898105 - DNA, 19 bp, Homo sapiens
caagaatggaagcctgaac

SEQ ID NO: 2898106 - DNA, 21 bp, Homo sapiens
caagaatttcctgttggattt

SEQ ID NO: 2898107 - DNA, 21 bp, Homo sapiens
caagacagctcttcttgaaaa

SEQ ID NO: 2898108 - DNA, 13 bp, Homo sapiens
caagaccagcctg

SEQ ID NO: 2898109 - DNA, 16 bp, Homo sapiens
caagaccagcctgtcc

SEQ ID NO: 2898110 - DNA, 16 bp, Homo sapiens
caagacccaagtagct

SEQ ID NO: 2898111 - DNA, 14 bp, Homo sapiens
caagacctcatctc

SEQ ID NO: 2898112 - DNA, 17 bp, Homo sapiens
caagactagcctggcca

SEQ ID NO: 2898113 - DNA, 14 bp, Homo sapiens
caagactctagagt

SEQ ID NO: 2898114 - DNA, 21 bp, Homo sapiens
caagactctagagtccaaggt

SEQ ID NO: 2898115 - DNA, 13 bp, Homo sapiens
caagactgcctcc

SEQ ID NO: 2898116 - DNA, 15 bp, Homo sapiens
caagactgggctgta

SEQ ID NO: 2898117 - DNA, 11 bp, Homo sapiens
caagagaaggg

SEQ ID NO: 2898118 - DNA, 12 bp, Homo sapiens
caagagaagggc

SEQ ID NO: 2898119 - DNA, 15 bp, Homo sapiens
caagagaagggctta

SEQ ID NO: 2898120 - DNA, 19 bp, Homo sapiens
caagagacccttcaaactt

SEQ ID NO: 2898121 - DNA, 21 bp, Homo sapiens
caagagagaacctaactgtat

SEQ ID NO: 2898122 - DNA, 18 bp, Homo sapiens
caagagagacatggaaaa

SEQ ID NO: 2898123 - DNA, 18 bp, Homo sapiens
caagagaggaaggacccc

SEQ ID NO: 2898124 - DNA, 18 bp, Homo sapiens
caagagatattttgggca

SEQ ID NO: 2898125 - DNA, 14 bp, Homo sapiens
caagagattgctaa

SEQ ID NO: 2898126 - DNA, 23 bp, Homo sapiens
caagagcctgagagtgaggtgga

SEQ ID NO: 2898127 - DNA, 12 bp, Homo sapiens
caagagccttgg

SEQ ID NO: 2898128 - DNA, 21 bp, Homo sapiens
caagagccttggtgtccacct

SEQ ID NO: 2898129 - DNA, 15 bp, Homo sapiens
caagaggaatgaaaa

SEQ ID NO: 2898130 - DNA, 14 bp, Homo sapiens
caagaggagatcca

SEQ ID NO: 2898131 - DNA, 21 bp, Homo sapiens
caagaggcaggttagaagaac

SEQ ID NO: 2898132 - DNA, 20 bp, Homo sapiens
caagaggcgtgtgcaggccg

SEQ ID NO: 2898133 - DNA, 17 bp, Homo sapiens
caagaggctgagacagg

SEQ ID NO: 2898134 - DNA, 18 bp, Homo sapiens
caagagtccccagactct

SEQ ID NO: 2898135 - DNA, 23 bp, Homo sapiens
caagagtccccagactctgccta

SEQ ID NO: 2898136 - DNA, 15 bp, Homo sapiens
caagagtctctccag

SEQ ID NO: 2898137 - DNA, 20 bp, Homo sapiens
caagagtctctccagcctca

SEQ ID NO: 2898138 - DNA, 15 bp, Homo sapiens
caagatatggacaca

SEQ ID NO: 2898139 - DNA, 21 bp, Homo sapiens
caagatattttaaaatctgtc

SEQ ID NO: 2898140 - DNA, 15 bp, Homo sapiens
caagatcattcagtg

SEQ ID NO: 2898141 - DNA, 13 bp, Homo sapiens
caagatcgcacca

SEQ ID NO: 2898142 - DNA, 12 bp, Homo sapiens
caagattagaag

SEQ ID NO: 2898143 - DNA, 16 bp, Homo sapiens
caagattaggaagtca

SEQ ID NO: 2898144 - DNA, 10 bp, Homo sapiens
caagattccg

SEQ ID NO: 2898145 - DNA, 13 bp, Homo sapiens
caagattctagat

SEQ ID NO: 2898146 - DNA, 14 bp, Homo sapiens
caagattctagatg

SEQ ID NO: 2898147 - DNA, 17 bp, Homo sapiens
caagattctgaaacatt

SEQ ID NO: 2898148 - DNA, 19 bp, Homo sapiens
caagattgaaatttgaact

SEQ ID NO: 2898149 - DNA, 17 bp, Homo sapiens
caagattggaaagacag

SEQ ID NO: 2898150 - DNA, 20 bp, Homo sapiens
caagattttagggcttttat

SEQ ID NO: 2898151 - DNA, 16 bp, Homo sapiens
caagcaaaaggagaga

SEQ ID NO: 2898152 - DNA, 18 bp, Homo sapiens
caagcaaacagggtggcc

SEQ ID NO: 2898153 - DNA, 13 bp, Homo sapiens
caagcaagactga

SEQ ID NO: 2898154 - DNA, 15 bp, Homo sapiens
caagcaagttctgag

SEQ ID NO: 2898155 - DNA, 13 bp, Homo sapiens
caagcaatcctcc

SEQ ID NO: 2898156 - DNA, 13 bp, Homo sapiens
caagcacagcagc

SEQ ID NO: 2898157 - DNA, 14 bp, Homo sapiens
caagcacagcagcc

SEQ ID NO: 2898158 - DNA, 11 bp, Homo sapiens
caagcagagga

SEQ ID NO: 2898159 - DNA, 14 bp, Homo sapiens
caagcagaggacca

SEQ ID NO: 2898160 - DNA, 21 bp, Homo sapiens
caagcagaggaccagggcctt

SEQ ID NO: 2898161 - DNA, 17 bp, Homo sapiens
caagcaggaaatgaaaa

SEQ ID NO: 2898162 - DNA, 13 bp, Homo sapiens
caagcaggaagct

SEQ ID NO: 2898163 - DNA, 19 bp, Homo sapiens
caagcaggcgctgtgctat

SEQ ID NO: 2898164 - DNA, 15 bp, Homo sapiens
caagcatattggaaa

SEQ ID NO: 2898165 - DNA, 22 bp, Homo sapiens
caagcatattttgtggcatttg

SEQ ID NO: 2898166 - DNA, 13 bp, Homo sapiens
caagcatcattgt

SEQ ID NO: 2898167 - DNA, 14 bp, Homo sapiens
caagccaagcagcc

SEQ ID NO: 2898168 - DNA, 20 bp, Homo sapiens
caagccaccgcagctgctgc

SEQ ID NO: 2898169 - DNA, 22 bp, Homo sapiens
caagccaccgcagctgctgcca

SEQ ID NO: 2898170 - DNA, 23 bp, Homo sapiens
caagccaccgcagctgctgccac

SEQ ID NO: 2898171 - DNA, 13 bp, Homo sapiens
caagccagaactt

SEQ ID NO: 2898172 - DNA, 14 bp, Homo sapiens
caagccagctggag

SEQ ID NO: 2898173 - DNA, 17 bp, Homo sapiens
caagcccaaatttaatt

SEQ ID NO: 2898174 - DNA, 17 bp, Homo sapiens
caagcccagcactgctt

SEQ ID NO: 2898175 - DNA, 16 bp, Homo sapiens
caagccccatcctgcc

SEQ ID NO: 2898176 - DNA, 14 bp, Homo sapiens
caagccccctggca

SEQ ID NO: 2898177 - DNA, 22 bp, Homo sapiens
caagcctgcagtcatcttgacc

SEQ ID NO: 2898178 - DNA, 19 bp, Homo sapiens
caagcctgcctcgccttgt

SEQ ID NO: 2898179 - DNA, 19 bp, Homo sapiens
caagcctgtgcaaaaaaat

SEQ ID NO: 2898180 - DNA, 16 bp, Homo sapiens
caagcgattctcctgc

SEQ ID NO: 2898181 - DNA, 16 bp, Homo sapiens
caagctcacagttcct

SEQ ID NO: 2898182 - DNA, 20 bp, Homo sapiens
caagctcacagttcctcgcc

SEQ ID NO: 2898183 - DNA, 21 bp, Homo sapiens
caagctcacagttcctcgccc

SEQ ID NO: 2898184 - DNA, 16 bp, Homo sapiens
caagctcccaagagct

SEQ ID NO: 2898185 - DNA, 13 bp, Homo sapiens
caagctcttgttt

SEQ ID NO: 2898186 - DNA, 14 bp, Homo sapiens
caagctcttgtttc

SEQ ID NO: 2898187 - DNA, 15 bp, Homo sapiens
caagctcttgtttct

SEQ ID NO: 2898188 - DNA, 18 bp, Homo sapiens
caagctgagctggcttcg

SEQ ID NO: 2898189 - DNA, 12 bp, Homo sapiens
caagctgcctct

SEQ ID NO: 2898190 - DNA, 23 bp, Homo sapiens
caagctgcctctgacagcagcct

SEQ ID NO: 2898191 - DNA, 23 bp, Homo sapiens
caagctggctggggtggcctgtg

SEQ ID NO: 2898192 - DNA, 17 bp, Homo sapiens
caagctgtgttacttga

SEQ ID NO: 2898193 - DNA, 23 bp, Homo sapiens
caagctgtgttcatccagctact

SEQ ID NO: 2898194 - DNA, 19 bp, Homo sapiens
caagctgttaaagatattt

SEQ ID NO: 2898195 - DNA, 19 bp, Homo sapiens
caagcttcaatatttttct

SEQ ID NO: 2898196 - DNA, 15 bp, Homo sapiens
caaggaaaaacaggt

SEQ ID NO: 2898197 - DNA, 22 bp, Homo sapiens
caaggaactaatttcttctcct

SEQ ID NO: 2898198 - DNA, 18 bp, Homo sapiens
caaggaacttgaaaaata

SEQ ID NO: 2898199 - DNA, 12 bp, Homo sapiens
caaggaagaaaa

SEQ ID NO: 2898200 - DNA, 15 bp, Homo sapiens
caaggaaggacttac

SEQ ID NO: 2898201 - DNA, 14 bp, Homo sapiens
caaggaataaatga

SEQ ID NO: 2898202 - DNA, 21 bp, Homo sapiens
caaggacttccacatttttgc

SEQ ID NO: 2898203 - DNA, 21 bp, Homo sapiens
caaggagaatatgataaaaca

SEQ ID NO: 2898204 - DNA, 18 bp, Homo sapiens
caaggagaggagttcttt

SEQ ID NO: 2898205 - DNA, 22 bp, Homo sapiens
caaggagaggagttctttggct

SEQ ID NO: 2898206 - DNA, 13 bp, Homo sapiens
caaggagcagaga

SEQ ID NO: 2898207 - DNA, 13 bp, Homo sapiens
caaggaggaaaaa

SEQ ID NO: 2898208 - DNA, 20 bp, Homo sapiens
caaggagggtgagtgcaagg

SEQ ID NO: 2898209 - DNA, 23 bp, Homo sapiens
caaggatagatgctggcccaggg

SEQ ID NO: 2898210 - DNA, 17 bp, Homo sapiens
caaggatatcagagctg

SEQ ID NO: 2898211 - DNA, 18 bp, Homo sapiens
caaggatgccttagcatg

SEQ ID NO: 2898212 - DNA, 14 bp, Homo sapiens
caacaagagcgaaa

SEQ ID NO: 2898213 - DNA, 20 bp, Homo sapiens
caacaaggacaactttatgt

SEQ ID NO: 2898214 - DNA, 21 bp, Homo sapiens
caacaaggacaactttatgta

SEQ ID NO: 2898215 - DNA, 18 bp, Homo sapiens
caacaatcctagtgcttt

SEQ ID NO: 2898216 - DNA, 17 bp, Homo sapiens
caacaatgagtggacaa

SEQ ID NO: 2898217 - DNA, 13 bp, Homo sapiens
caacaatttctac

SEQ ID NO: 2898218 - DNA, 18 bp, Homo sapiens
caacaatttctactttga

SEQ ID NO: 2898219 - DNA, 18 bp, Homo sapiens
caacacaacatttgtgtc

SEQ ID NO: 2898220 - DNA, 15 bp, Homo sapiens
caacacaagaaaact

SEQ ID NO: 2898221 - DNA, 13 bp, Homo sapiens
caacacagcctgg

SEQ ID NO: 2898222 - DNA, 17 bp, Homo sapiens
caacaccccgcctgcct

SEQ ID NO: 2898223 - DNA, 19 bp, Homo sapiens
caacaccccgcctgcctcc

SEQ ID NO: 2898224 - DNA, 16 bp, Homo sapiens
caacacgcaggagcac

SEQ ID NO: 2898225 - DNA, 18 bp, Homo sapiens
caacactacttccctgcc

SEQ ID NO: 2898226 - DNA, 12 bp, Homo sapiens
caacactgccag

SEQ ID NO: 2898227 - DNA, 13 bp, Homo sapiens
caacactgccagc

SEQ ID NO: 2898228 - DNA, 20 bp, Homo sapiens
caacactgggaaacagaggc

SEQ ID NO: 2898229 - DNA, 13 bp, Homo sapiens
caacactgtgggt

SEQ ID NO: 2898230 - DNA, 24 bp, Homo sapiens
caacacttccagcatttagctggc

SEQ ID NO: 2898231 - DNA, 14 bp, Homo sapiens
caacagaaaacaat

SEQ ID NO: 2898232 - DNA, 17 bp, Homo sapiens
caacagaaagagggaca

SEQ ID NO: 2898233 - DNA, 14 bp, Homo sapiens
caacagaatgaaaa

SEQ ID NO: 2898234 - DNA, 15 bp, Homo sapiens
caacagaatgaaaaa

SEQ ID NO: 2898235 - DNA, 16 bp, Homo sapiens
caacagaatgaaaaat

SEQ ID NO: 2898236 - DNA, 17 bp, Homo sapiens
caacagaatgaaaaatg

SEQ ID NO: 2898237 - DNA, 20 bp, Homo sapiens
caacagaatgaaaaatgaaa

SEQ ID NO: 2898238 - DNA, 16 bp, Homo sapiens
caacagagagaaaaag

SEQ ID NO: 2898239 - DNA, 22 bp, Homo sapiens
caacagagaggaccaacatcca

SEQ ID NO: 2898240 - DNA, 17 bp, Homo sapiens
caacagatacctctcag

SEQ ID NO: 2898241 - DNA, 23 bp, Homo sapiens
caacagatctggaacctcagcct

SEQ ID NO: 2898242 - DNA, 20 bp, Homo sapiens
caacagatttgtgaactcag

SEQ ID NO: 2898243 - DNA, 12 bp, Homo sapiens
caacagcacttt

SEQ ID NO: 2898244 - DNA, 16 bp, Homo sapiens
caacagccaacagcta

SEQ ID NO: 2898245 - DNA, 14 bp, Homo sapiens
caacagcctcactt

SEQ ID NO: 2898246 - DNA, 20 bp, Homo sapiens
caacagctacaacagcctca

SEQ ID NO: 2898247 - DNA, 14 bp, Homo sapiens
caacaggaggacaa

SEQ ID NO: 2898248 - DNA, 17 bp, Homo sapiens
caacaggaggacaattc

SEQ ID NO: 2898249 - DNA, 19 bp, Homo sapiens
caacaggaggacaattcat

SEQ ID NO: 2898250 - DNA, 22 bp, Homo sapiens
caacaggaggacaattcatgaa

SEQ ID NO: 2898251 - DNA, 12 bp, Homo sapiens
caacagtcatgt

SEQ ID NO: 2898252 - DNA, 16 bp, Homo sapiens
caacagtgaagacaga

SEQ ID NO: 2898253 - DNA, 12 bp, Homo sapiens
caacagtgctaa

SEQ ID NO: 2898254 - DNA, 13 bp, Homo sapiens
caacagtgtgaag

SEQ ID NO: 2898255 - DNA, 17 bp, Homo sapiens
caacagtgtgaagttag

SEQ ID NO: 2898256 - DNA, 18 bp, Homo sapiens
caacagtgtgaagttaga

SEQ ID NO: 2898257 - DNA, 22 bp, Homo sapiens
caacagtgtgaagttagaattc

SEQ ID NO: 2898258 - DNA, 20 bp, Homo sapiens
caacagttttcctatgcttt

SEQ ID NO: 2898259 - DNA, 13 bp, Homo sapiens
caacataaaactc

SEQ ID NO: 2898260 - DNA, 14 bp, Homo sapiens
caacatataaaata

SEQ ID NO: 2898261 - DNA, 19 bp, Homo sapiens
caacatcacacagtatact

SEQ ID NO: 2898262 - DNA, 15 bp, Homo sapiens
caacatcccattgcc

SEQ ID NO: 2898263 - DNA, 19 bp, Homo sapiens
caacatcccattgccctgg

SEQ ID NO: 2898264 - DNA, 13 bp, Homo sapiens
caacatctagcaa

SEQ ID NO: 2898265 - DNA, 14 bp, Homo sapiens
caacatctgagtgc

SEQ ID NO: 2898266 - DNA, 19 bp, Homo sapiens
caacatggatacatatttc

SEQ ID NO: 2898267 - DNA, 13 bp, Homo sapiens
caacatggcttct

SEQ ID NO: 2898268 - DNA, 17 bp, Homo sapiens
caacatggcttctcctt

SEQ ID NO: 2898269 - DNA, 22 bp, Homo sapiens
caacatggcttctcctttggca

SEQ ID NO: 2898270 - DNA, 17 bp, Homo sapiens
caacatgtatctgtcta

SEQ ID NO: 2898271 - DNA, 23 bp, Homo sapiens
caacatgtatctgtctactttct

SEQ ID NO: 2898272 - DNA, 19 bp, Homo sapiens
caacatgtatgtggataca

SEQ ID NO: 2898273 - DNA, 20 bp, Homo sapiens
caacattaaaacaatattgt

SEQ ID NO: 2898274 - DNA, 16 bp, Homo sapiens
caacattcttgtgtct

SEQ ID NO: 2898275 - DNA, 16 bp, Homo sapiens
caacattgtgatgtat

SEQ ID NO: 2898276 - DNA, 20 bp, Homo sapiens
caacattgttcacctttgta

SEQ ID NO: 2898277 - DNA, 23 bp, Homo sapiens
caacattgttcacctttgtagca

SEQ ID NO: 2898278 - DNA, 21 bp, Homo sapiens
caacatttatatattgtctgt

SEQ ID NO: 2898279 - DNA, 21 bp, Homo sapiens
caaccaccaccttatacatca

SEQ ID NO: 2898280 - DNA, 21 bp, Homo sapiens
caaccacctaggcaatgaaga

SEQ ID NO: 2898281 - DNA, 16 bp, Homo sapiens
caaccacgcaggaagc

SEQ ID NO: 2898282 - DNA, 12 bp, Homo sapiens
caaccagacaga

SEQ ID NO: 2898283 - DNA, 11 bp, Homo sapiens
caaccagcctt

SEQ ID NO: 2898284 - DNA, 16 bp, Homo sapiens
caaccccaccctgttt

SEQ ID NO: 2898285 - DNA, 20 bp, Homo sapiens
caaccccctcgcctcctact

SEQ ID NO: 2898286 - DNA, 19 bp, Homo sapiens
caaccccgcggcccagacc

SEQ ID NO: 2898287 - DNA, 19 bp, Homo sapiens
caaccccttaagccctggc

SEQ ID NO: 2898288 - DNA, 21 bp, Homo sapiens
caaccccttaagccctggccc

SEQ ID NO: 2898289 - DNA, 13 bp, Homo sapiens
caaccctctggaa

SEQ ID NO: 2898290 - DNA, 20 bp, Homo sapiens
caacccttctcctcttgtaa

SEQ ID NO: 2898291 - DNA, 21 bp, Homo sapiens
caacccttctcctcttgtaaa

SEQ ID NO: 2898292 - DNA, 13 bp, Homo sapiens
caaccggctttgt

SEQ ID NO: 2898293 - DNA, 17 bp, Homo sapiens
caacctaacctgtgtct

SEQ ID NO: 2898294 - DNA, 12 bp, Homo sapiens
caacctactgtc

SEQ ID NO: 2898295 - DNA, 21 bp, Homo sapiens
caacctactgtctaagcagtt

SEQ ID NO: 2898296 - DNA, 19 bp, Homo sapiens
caacctagccaacatggtg

SEQ ID NO: 2898297 - DNA, 14 bp, Homo sapiens
caacctctgcctcc

SEQ ID NO: 2898298 - DNA, 20 bp, Homo sapiens
caacctctgcctcctgggtt

SEQ ID NO: 2898299 - DNA, 17 bp, Homo sapiens
caacctctgcttcccag

SEQ ID NO: 2898300 - DNA, 20 bp, Homo sapiens
caacctctgcttcccaggtt

SEQ ID NO: 2898301 - DNA, 17 bp, Homo sapiens
caacctcttctggctca

SEQ ID NO: 2898302 - DNA, 13 bp, Homo sapiens
caacctcttggcc

SEQ ID NO: 2898303 - DNA, 20 bp, Homo sapiens
caacctgaccaacatggaga

SEQ ID NO: 2898304 - DNA, 21 bp, Homo sapiens
caacctgcctgacatttggag

SEQ ID NO: 2898305 - DNA, 14 bp, Homo sapiens
caacctgtccttac

SEQ ID NO: 2898306 - DNA, 23 bp, Homo sapiens
caacctgtccttactcagagctg

SEQ ID NO: 2898307 - DNA, 17 bp, Homo sapiens
caaccttagatgttcta

SEQ ID NO: 2898308 - DNA, 20 bp, Homo sapiens
caaccttcctttttttaaat

SEQ ID NO: 2898309 - DNA, 14 bp, Homo sapiens
caaccttgtttaat

SEQ ID NO: 2898310 - DNA, 22 bp, Homo sapiens
caacctttcccatttcgtgtaa

SEQ ID NO: 2898311 - DNA, 12 bp, Homo sapiens
caacgaggaagc

SEQ ID NO: 2898312 - DNA, 13 bp, Homo sapiens
caacgaggaagcc

SEQ ID NO: 2898313 - DNA, 15 bp, Homo sapiens
caacgccagtggcaa

SEQ ID NO: 2898314 - DNA, 21 bp, Homo sapiens
caacgccgccttggccttgca

SEQ ID NO: 2898315 - DNA, 23 bp, Homo sapiens
caacgctgaagcggtcagactgg

SEQ ID NO: 2898316 - DNA, 21 bp, Homo sapiens
caacggagagcgcctgcccct

SEQ ID NO: 2898317 - DNA, 13 bp, Homo sapiens
caacgtgcaactg

SEQ ID NO: 2898318 - DNA, 21 bp, Homo sapiens
caactaacccttaaaaatgca

SEQ ID NO: 2898319 - DNA, 16 bp, Homo sapiens
caactacccaaaacaa

SEQ ID NO: 2898320 - DNA, 20 bp, Homo sapiens
caactacccaaaacaagcct

SEQ ID NO: 2898321 - DNA, 20 bp, Homo sapiens
caactacccccagctgtgct

SEQ ID NO: 2898322 - DNA, 18 bp, Homo sapiens
caactagcccctggggtg

SEQ ID NO: 2898323 - DNA, 18 bp, Homo sapiens
caactatattatcatgca

SEQ ID NO: 2898324 - DNA, 16 bp, Homo sapiens
caactatggatcagaa

SEQ ID NO: 2898325 - DNA, 21 bp, Homo sapiens
caactattttcagatgtgaac

SEQ ID NO: 2898326 - DNA, 23 bp, Homo sapiens
caactcagtccctaaaaacacag

SEQ ID NO: 2898327 - DNA, 14 bp, Homo sapiens
caactccaacctct

SEQ ID NO: 2898328 - DNA, 15 bp, Homo sapiens
aaaagaaataataat

SEQ ID NO: 2898329 - DNA, 13 bp, Homo sapiens
aaaagaaatcaat

SEQ ID NO: 2898330 - DNA, 20 bp, Homo sapiens
aaaagaaattatctttagtt

SEQ ID NO: 2898331 - DNA, 23 bp, Homo sapiens
aaaagaaattatctttagttgaa

SEQ ID NO: 2898332 - DNA, 14 bp, Homo sapiens
aaaagaagcacttt

SEQ ID NO: 2898333 - DNA, 20 bp, Homo sapiens
aaaagaatcggcagtatttt

SEQ ID NO: 2898334 - DNA, 20 bp, Homo sapiens
aaaagaatgggcagttacat

SEQ ID NO: 2898335 - DNA, 20 bp, Homo sapiens
aaaagaattctggtcctgtt

SEQ ID NO: 2898336 - DNA, 13 bp, Homo sapiens
aaaagacaaacac

SEQ ID NO: 2898337 - DNA, 16 bp, Homo sapiens
aaaagacaaatatgta

SEQ ID NO: 2898338 - DNA, 15 bp, Homo sapiens
aaaagacaagtgctc

SEQ ID NO: 2898339 - DNA, 14 bp, Homo sapiens
aaaagacaattctt

SEQ ID NO: 2898340 - DNA, 19 bp, Homo sapiens
aaaagacactggtgtatct

SEQ ID NO: 2898341 - DNA, 13 bp, Homo sapiens
aaaagacagggct

SEQ ID NO: 2898342 - DNA, 15 bp, Homo sapiens
aaaagacgatgttta

SEQ ID NO: 2898343 - DNA, 19 bp, Homo sapiens
aaaagacgatgtttatgtt

SEQ ID NO: 2898344 - DNA, 21 bp, Homo sapiens
aaaagacgatgtttatgttct

SEQ ID NO: 2898345 - DNA, 13 bp, Homo sapiens
aaaagactctttt

SEQ ID NO: 2898346 - DNA, 21 bp, Homo sapiens
aaaagactggatttgcagaag

SEQ ID NO: 2898347 - DNA, 20 bp, Homo sapiens
aaaagacttccctaacactt

SEQ ID NO: 2898348 - DNA, 21 bp, Homo sapiens
aaaagagagcagagaatataa

SEQ ID NO: 2898349 - DNA, 12 bp, Homo sapiens
aaaagagctggg

SEQ ID NO: 2898350 - DNA, 19 bp, Homo sapiens
aaaagaggatgatttcaga

SEQ ID NO: 2898351 - DNA, 21 bp, Homo sapiens
aaaagagtagaaagcttgaaa

SEQ ID NO: 2898352 - DNA, 12 bp, Homo sapiens
aaaagataagaa

SEQ ID NO: 2898353 - DNA, 15 bp, Homo sapiens
aaaagatgtaataat

SEQ ID NO: 2898354 - DNA, 13 bp, Homo sapiens
aaaagattcattt

SEQ ID NO: 2898355 - DNA, 13 bp, Homo sapiens
aaaagattctgaa

SEQ ID NO: 2898356 - DNA, 16 bp, Homo sapiens
aaaagattctgtgtca

SEQ ID NO: 2898357 - DNA, 21 bp, Homo sapiens
aaaagatttttaaaatgaatc

SEQ ID NO: 2898358 - DNA, 22 bp, Homo sapiens
aaaagcaaatggaaaatgtata

SEQ ID NO: 2898359 - DNA, 16 bp, Homo sapiens
aaaagcacttgaagaa

SEQ ID NO: 2898360 - DNA, 14 bp, Homo sapiens
aaaagcaggaaata

SEQ ID NO: 2898361 - DNA, 16 bp, Homo sapiens
aaaagcatctgccaca

SEQ ID NO: 2898362 - DNA, 20 bp, Homo sapiens
aaaagcatgatgggaaaata

SEQ ID NO: 2898363 - DNA, 18 bp, Homo sapiens
aaaagccaagaggctgca

SEQ ID NO: 2898364 - DNA, 21 bp, Homo sapiens
aaaagcccacctgaaagcctg

SEQ ID NO: 2898365 - DNA, 12 bp, Homo sapiens
aaaagcctcagc

SEQ ID NO: 2898366 - DNA, 23 bp, Homo sapiens
aaaagccttacagttatcctgca

SEQ ID NO: 2898367 - DNA, 20 bp, Homo sapiens
aaaagcgtctttaagagact

SEQ ID NO: 2898368 - DNA, 20 bp, Homo sapiens
aaaagctatggtgagatgca

SEQ ID NO: 2898369 - DNA, 13 bp, Homo sapiens
aaaagctgtgtct

SEQ ID NO: 2898370 - DNA, 14 bp, Homo sapiens
aaaagcttccatga

SEQ ID NO: 2898371 - DNA, 16 bp, Homo sapiens
aaaagctttttgatgt

SEQ ID NO: 2898372 - DNA, 15 bp, Homo sapiens
aaaaggaaaaaaaga

SEQ ID NO: 2898373 - DNA, 13 bp, Homo sapiens
aaaaggaaagaaa

SEQ ID NO: 2898374 - DNA, 21 bp, Homo sapiens
aaaaggagagattattaaatc

SEQ ID NO: 2898375 - DNA, 16 bp, Homo sapiens
aaaaggagcgggcagg

SEQ ID NO: 2898376 - DNA, 18 bp, Homo sapiens
aaaaggagcgggcagggc

SEQ ID NO: 2898377 - DNA, 21 bp, Homo sapiens
aaaaggaggggacgggacaga

SEQ ID NO: 2898378 - DNA, 15 bp, Homo sapiens
aaaaggatacataat

SEQ ID NO: 2898379 - DNA, 19 bp, Homo sapiens
aaaaggatattatctacct

SEQ ID NO: 2898380 - DNA, 20 bp, Homo sapiens
aaaaggatctttgtggccaa

SEQ ID NO: 2898381 - DNA, 23 bp, Homo sapiens
aaaaggatctttgtggccaagga

SEQ ID NO: 2898382 - DNA, 16 bp, Homo sapiens
aaaaggattaggcaaa

SEQ ID NO: 2898383 - DNA, 18 bp, Homo sapiens
aaaaggatttttatcttt

SEQ ID NO: 2898384 - DNA, 14 bp, Homo sapiens
aaaaggcattgttt

SEQ ID NO: 2898385 - DNA, 15 bp, Homo sapiens
aaaaggccaaacctc

SEQ ID NO: 2898386 - DNA, 19 bp, Homo sapiens
aaaaggctgtgctgccctg

SEQ ID NO: 2898387 - DNA, 15 bp, Homo sapiens
aaaagggtcaaacct

SEQ ID NO: 2898388 - DNA, 17 bp, Homo sapiens
aaaagggtcaaacctgt

SEQ ID NO: 2898389 - DNA, 18 bp, Homo sapiens
aaaaggtataaataataa

SEQ ID NO: 2898390 - DNA, 18 bp, Homo sapiens
aaaagtaactggttgtca

SEQ ID NO: 2898391 - DNA, 20 bp, Homo sapiens
aaaagtaactggttgtcacc

SEQ ID NO: 2898392 - DNA, 15 bp, Homo sapiens
aaaagtcacaatgtt

SEQ ID NO: 2898393 - DNA, 16 bp, Homo sapiens
aaaagtcacaatgttc

SEQ ID NO: 2898394 - DNA, 19 bp, Homo sapiens
aaaagtcacaatgttcttt

SEQ ID NO: 2898395 - DNA, 18 bp, Homo sapiens
aaaagtccaattttaatt

SEQ ID NO: 2898396 - DNA, 22 bp, Homo sapiens
aaaagtccaattttaatttagt

SEQ ID NO: 2898397 - DNA, 16 bp, Homo sapiens
aaaagtgacagatgtt

SEQ ID NO: 2898398 - DNA, 17 bp, Homo sapiens
aaaagtgacagatgtta

SEQ ID NO: 2898399 - DNA, 18 bp, Homo sapiens
aaaagtgcctcaagagga

SEQ ID NO: 2898400 - DNA, 20 bp, Homo sapiens
aaaagtgcctcaagaggaat

SEQ ID NO: 2898401 - DNA, 17 bp, Homo sapiens
aaaagtggcctctttgt

SEQ ID NO: 2898402 - DNA, 12 bp, Homo sapiens
aaaagtgtacaa

SEQ ID NO: 2898403 - DNA, 14 bp, Homo sapiens
aaaagtgtacaagt

SEQ ID NO: 2898404 - DNA, 23 bp, Homo sapiens
aaaagttaatgcttaagagggaa

SEQ ID NO: 2898405 - DNA, 12 bp, Homo sapiens
aaaagttattta

SEQ ID NO: 2898406 - DNA, 14 bp, Homo sapiens
aaaagttgaaatta

SEQ ID NO: 2898407 - DNA, 22 bp, Homo sapiens
aaaagttgcaaagtggaattaa

SEQ ID NO: 2898408 - DNA, 13 bp, Homo sapiens
aaaagttgttcaa

SEQ ID NO: 2898409 - DNA, 15 bp, Homo sapiens
aaaagttgttcaact

SEQ ID NO: 2898410 - DNA, 15 bp, Homo sapiens
aaaagtttctattta

SEQ ID NO: 2898411 - DNA, 17 bp, Homo sapiens
aaaagtttgccagaagt

SEQ ID NO: 2898412 - DNA, 23 bp, Homo sapiens
aaaagtttgtcctttaactatca

SEQ ID NO: 2898413 - DNA, 18 bp, Homo sapiens
aaaagtttgttactttga

SEQ ID NO: 2898414 - DNA, 19 bp, Homo sapiens
aaaagtttgttactttgaa

SEQ ID NO: 2898415 - DNA, 21 bp, Homo sapiens
aaaagttttttttttgtttgt

SEQ ID NO: 2898416 - DNA, 14 bp, Homo sapiens
aaaataaaaagtta

SEQ ID NO: 2898417 - DNA, 17 bp, Homo sapiens
aaaataaagctgttctc

SEQ ID NO: 2898418 - DNA, 16 bp, Homo sapiens
aaaataaataaaagcc

SEQ ID NO: 2898419 - DNA, 18 bp, Homo sapiens
aaaataactatcaggcag

SEQ ID NO: 2898420 - DNA, 19 bp, Homo sapiens
aaaataactatcaggcaga

SEQ ID NO: 2898421 - DNA, 22 bp, Homo sapiens
aaaataactatcaggcagaaga

SEQ ID NO: 2898422 - DNA, 16 bp, Homo sapiens
aaaataagaatagaaa

SEQ ID NO: 2898423 - DNA, 18 bp, Homo sapiens
aaaataatctggtgttct

SEQ ID NO: 2898424 - DNA, 18 bp, Homo sapiens
aaaatacaaaaatcagcc

SEQ ID NO: 2898425 - DNA, 17 bp, Homo sapiens
aaaatacaaaaatttgc

SEQ ID NO: 2898426 - DNA, 19 bp, Homo sapiens
aaaatactttttctaatga

SEQ ID NO: 2898427 - DNA, 16 bp, Homo sapiens
aaaatagaaaagttat

SEQ ID NO: 2898428 - DNA, 21 bp, Homo sapiens
aaaatagagcttttaaaaatg

SEQ ID NO: 2898429 - DNA, 17 bp, Homo sapiens
aaaatagaggctttgag

SEQ ID NO: 2898430 - DNA, 19 bp, Homo sapiens
aaaatagaggctttgagca

SEQ ID NO: 2898431 - DNA, 18 bp, Homo sapiens
aaaataggatttcttaaa

SEQ ID NO: 2898432 - DNA, 13 bp, Homo sapiens
aaaataggcagga

SEQ ID NO: 2898433 - DNA, 16 bp, Homo sapiens
aaaatagggtccttga

SEQ ID NO: 2898434 - DNA, 20 bp, Homo sapiens
aaaatagggtccttgaaaca

SEQ ID NO: 2898435 - DNA, 12 bp, Homo sapiens
aaaatatactgt

SEQ ID NO: 2898436 - DNA, 15 bp, Homo sapiens
aaaatatactgtaaa

SEQ ID NO: 2898437 - DNA, 23 bp, Homo sapiens
aaaatatactgtaaagaaagaga

SEQ ID NO: 2898438 - DNA, 12 bp, Homo sapiens
aaaatatatgta

SEQ ID NO: 2898439 - DNA, 13 bp, Homo sapiens
aaaatatatgtat

SEQ ID NO: 2898440 - DNA, 16 bp, Homo sapiens
aaaatatatgttgaat

SEQ ID NO: 2898441 - DNA, 20 bp, Homo sapiens
aaaatatatgttgaatgtta

SEQ ID NO: 2898442 - DNA, 18 bp, Homo sapiens
aaaatatccctttttcac

SEQ ID NO: 2898443 - DNA, 20 bp, Homo sapiens
aaaatatcctttcatcaatg

SEQ ID NO: 2898444 - DNA, 18 bp, Homo sapiens
aaaatatctgaaatgtga

SEQ ID NO: 2898445 - DNA, 19 bp, Homo sapiens
aaaatatttaaaaatgtct

SEQ ID NO: 2898446 - DNA, 20 bp, Homo sapiens
aaaatatttaaaaatgtctt

SEQ ID NO: 2898447 - DNA, 17 bp, Homo sapiens
aaaatatttcagatatc

SEQ ID NO: 2898448 - DNA, 20 bp, Homo sapiens
aaaatatttcagatatcaaa

SEQ ID NO: 2898449 - DNA, 23 bp, Homo sapiens
aaaatattttttatatatacagt

SEQ ID NO: 2898450 - DNA, 14 bp, Homo sapiens
aaaatcaaactgta

SEQ ID NO: 2898451 - DNA, 15 bp, Homo sapiens
aaaatcaattaacca

SEQ ID NO: 2898452 - DNA, 21 bp, Homo sapiens
caaagccatatggacactgtg

SEQ ID NO: 2898453 - DNA, 14 bp, Homo sapiens
caaagcccatgccc

SEQ ID NO: 2898454 - DNA, 12 bp, Homo sapiens
caaagccctgcc

SEQ ID NO: 2898455 - DNA, 14 bp, Homo sapiens
caaagccctgcctc

SEQ ID NO: 2898456 - DNA, 14 bp, Homo sapiens
caaagcgaatttta

SEQ ID NO: 2898457 - DNA, 16 bp, Homo sapiens
caaagcgcccacccag

SEQ ID NO: 2898458 - DNA, 17 bp, Homo sapiens
caaagcgcccacccagg

SEQ ID NO: 2898459 - DNA, 19 bp, Homo sapiens
caaagctctgtggccacat

SEQ ID NO: 2898460 - DNA, 13 bp, Homo sapiens
caaagctgagcct

SEQ ID NO: 2898461 - DNA, 14 bp, Homo sapiens
caaagctgagcctg

SEQ ID NO: 2898462 - DNA, 16 bp, Homo sapiens
caaagcttagcaggag

SEQ ID NO: 2898463 - DNA, 22 bp, Homo sapiens
caaagcttagcaggagaggaga

SEQ ID NO: 2898464 - DNA, 22 bp, Homo sapiens
caaaggaaaatagtaatgtttt

SEQ ID NO: 2898465 - DNA, 18 bp, Homo sapiens
caaaggaaatccaaaaaa

SEQ ID NO: 2898466 - DNA, 20 bp, Homo sapiens
caaaggagacaaagcaggag

SEQ ID NO: 2898467 - DNA, 21 bp, Homo sapiens
caaaggagacaaagcaggagt

SEQ ID NO: 2898468 - DNA, 10 bp, Homo sapiens
caaaggagca

SEQ ID NO: 2898469 - DNA, 18 bp, Homo sapiens
caaaggaggacaagaccc

SEQ ID NO: 2898470 - DNA, 20 bp, Homo sapiens
caaaggattaattgctgcaa

SEQ ID NO: 2898471 - DNA, 23 bp, Homo sapiens
caaaggatttgatgcttttctct

SEQ ID NO: 2898472 - DNA, 20 bp, Homo sapiens
caaaggcacagtgaaggctg

SEQ ID NO: 2898473 - DNA, 15 bp, Homo sapiens
caaaggcagaggaat

SEQ ID NO: 2898474 - DNA, 12 bp, Homo sapiens
caaaggctctgt

SEQ ID NO: 2898475 - DNA, 21 bp, Homo sapiens
caaagggcacagcatctgtag

SEQ ID NO: 2898476 - DNA, 22 bp, Homo sapiens
caaagggcatgggtcgggagag

SEQ ID NO: 2898477 - DNA, 14 bp, Homo sapiens
caaagggcccagat

SEQ ID NO: 2898478 - DNA, 22 bp, Homo sapiens
caaaggggaggcatcagtgtcc

SEQ ID NO: 2898479 - DNA, 17 bp, Homo sapiens
caaagggtccagaagga

SEQ ID NO: 2898480 - DNA, 23 bp, Homo sapiens
caaagggtgaagctatttatctg

SEQ ID NO: 2898481 - DNA, 16 bp, Homo sapiens
caaagggttttaatgt

SEQ ID NO: 2898482 - DNA, 21 bp, Homo sapiens
caaaggttctaggtttcaaag

SEQ ID NO: 2898483 - DNA, 14 bp, Homo sapiens
caaagtaaaagaaa

SEQ ID NO: 2898484 - DNA, 15 bp, Homo sapiens
caaagtaaactgtgt

SEQ ID NO: 2898485 - DNA, 12 bp, Homo sapiens
caaagtactgta

SEQ ID NO: 2898486 - DNA, 14 bp, Homo sapiens
caaagtactgtaag

SEQ ID NO: 2898487 - DNA, 23 bp, Homo sapiens
caaagtagattcttacaaggccc

SEQ ID NO: 2898488 - DNA, 15 bp, Homo sapiens
caaagtattgtaaat

SEQ ID NO: 2898489 - DNA, 22 bp, Homo sapiens
caaagtatttttttcactgttt

SEQ ID NO: 2898490 - DNA, 13 bp, Homo sapiens
caaagtcccttcc

SEQ ID NO: 2898491 - DNA, 19 bp, Homo sapiens
caaagtcccttcctgcttc

SEQ ID NO: 2898492 - DNA, 19 bp, Homo sapiens
caaagtcctttttttccat

SEQ ID NO: 2898493 - DNA, 13 bp, Homo sapiens
caaagtctccaga

SEQ ID NO: 2898494 - DNA, 12 bp, Homo sapiens
caaagtctctaa

SEQ ID NO: 2898495 - DNA, 15 bp, Homo sapiens
caaagtctctaattc

SEQ ID NO: 2898496 - DNA, 16 bp, Homo sapiens
caaagtgccaaagaaa

SEQ ID NO: 2898497 - DNA, 16 bp, Homo sapiens
caaagtgctgagatta

SEQ ID NO: 2898498 - DNA, 19 bp, Homo sapiens
caaagtgctgagattacag

SEQ ID NO: 2898499 - DNA, 21 bp, Homo sapiens
caaagtggaaaggatcacaga

SEQ ID NO: 2898500 - DNA, 22 bp, Homo sapiens
caaagttaattgtatttatgta

SEQ ID NO: 2898501 - DNA, 14 bp, Homo sapiens
caaagttccagttt

SEQ ID NO: 2898502 - DNA, 20 bp, Homo sapiens
caaagttctattttattaat

SEQ ID NO: 2898503 - DNA, 16 bp, Homo sapiens
caaataaaaaacagaa

SEQ ID NO: 2898504 - DNA, 22 bp, Homo sapiens
caaataatttgaactttggaac

SEQ ID NO: 2898505 - DNA, 18 bp, Homo sapiens
caaatactcatgtgtatg

SEQ ID NO: 2898506 - DNA, 13 bp, Homo sapiens
caaatagcaaatg

SEQ ID NO: 2898507 - DNA, 22 bp, Homo sapiens
caaatagcaaatgaaaaagtca

SEQ ID NO: 2898508 - DNA, 15 bp, Homo sapiens
caaatagcacttgac

SEQ ID NO: 2898509 - DNA, 18 bp, Homo sapiens
caaatagccccagactgg

SEQ ID NO: 2898510 - DNA, 22 bp, Homo sapiens
caaatagccccagactgggccc

SEQ ID NO: 2898511 - DNA, 16 bp, Homo sapiens
caaatataaatcttaa

SEQ ID NO: 2898512 - DNA, 21 bp, Homo sapiens
caaatataacaagtataatta

SEQ ID NO: 2898513 - DNA, 13 bp, Homo sapiens
caaatatgtagaa

SEQ ID NO: 2898514 - DNA, 17 bp, Homo sapiens
caaatatgttaaagttt

SEQ ID NO: 2898515 - DNA, 17 bp, Homo sapiens
caaatattagcaaagaa

SEQ ID NO: 2898516 - DNA, 13 bp, Homo sapiens
caaatcaaacaca

SEQ ID NO: 2898517 - DNA, 17 bp, Homo sapiens
caaatcaataagaaggt

SEQ ID NO: 2898518 - DNA, 23 bp, Homo sapiens
caaatcagtcagtgcaaatgtca

SEQ ID NO: 2898519 - DNA, 12 bp, Homo sapiens
caaatcatgttt

SEQ ID NO: 2898520 - DNA, 16 bp, Homo sapiens
caaatccgaacctcct

SEQ ID NO: 2898521 - DNA, 21 bp, Homo sapiens
caaatccgaacctcctctgtg

SEQ ID NO: 2898522 - DNA, 16 bp, Homo sapiens
caaatccgccagtgtt

SEQ ID NO: 2898523 - DNA, 11 bp, Homo sapiens
caaatccttgg

SEQ ID NO: 2898524 - DNA, 21 bp, Homo sapiens
caaatccttggagtcccaggg

SEQ ID NO: 2898525 - DNA, 20 bp, Homo sapiens
caaatccttgtgggaaaaga

SEQ ID NO: 2898526 - DNA, 22 bp, Homo sapiens
caaatcctttctgccccccagg

SEQ ID NO: 2898527 - DNA, 23 bp, Homo sapiens
caaatctatttaattaggaaaaa

SEQ ID NO: 2898528 - DNA, 18 bp, Homo sapiens
caaatctgtataaatgtc

SEQ ID NO: 2898529 - DNA, 20 bp, Homo sapiens
caaatctgtataaatgtcta

SEQ ID NO: 2898530 - DNA, 15 bp, Homo sapiens
caaatctgtcctctg

SEQ ID NO: 2898531 - DNA, 19 bp, Homo sapiens
caaatctgtcctctgtagt

SEQ ID NO: 2898532 - DNA, 20 bp, Homo sapiens
caaatctgtcctctgtagta

SEQ ID NO: 2898533 - DNA, 18 bp, Homo sapiens
caaatctttctgtaaaca

SEQ ID NO: 2898534 - DNA, 21 bp, Homo sapiens
caaatctttctgtaaacagaa

SEQ ID NO: 2898535 - DNA, 22 bp, Homo sapiens
caaatgaatgttgtctgtttgt

SEQ ID NO: 2898536 - DNA, 21 bp, Homo sapiens
caaatgagcatctcaaatgtt

SEQ ID NO: 2898537 - DNA, 13 bp, Homo sapiens
caaatgagccatg

SEQ ID NO: 2898538 - DNA, 21 bp, Homo sapiens
caaatgatagaactgtactgt

SEQ ID NO: 2898539 - DNA, 22 bp, Homo sapiens
caaatgcagggattgctgccac

SEQ ID NO: 2898540 - DNA, 18 bp, Homo sapiens
caaatgcagtatatttct

SEQ ID NO: 2898541 - DNA, 17 bp, Homo sapiens
caaatgcattcatgttt

SEQ ID NO: 2898542 - DNA, 22 bp, Homo sapiens
caaatgctgtgcaaacagtgta

SEQ ID NO: 2898543 - DNA, 15 bp, Homo sapiens
caaatggaaaatgta

SEQ ID NO: 2898544 - DNA, 21 bp, Homo sapiens
caaatggaaaatgtatatttt

SEQ ID NO: 2898545 - DNA, 20 bp, Homo sapiens
caaatggagctttctgtata

SEQ ID NO: 2898546 - DNA, 19 bp, Homo sapiens
caaatggcgtctggaagtc

SEQ ID NO: 2898547 - DNA, 21 bp, Homo sapiens
caaatggcgtctggaagtcca

SEQ ID NO: 2898548 - DNA, 12 bp, Homo sapiens
caaatggctctg

SEQ ID NO: 2898549 - DNA, 15 bp, Homo sapiens
caaatggctctgtga

SEQ ID NO: 2898550 - DNA, 16 bp, Homo sapiens
caaatggctctgtgaa

SEQ ID NO: 2898551 - DNA, 15 bp, Homo sapiens
caaatggggccagat

SEQ ID NO: 2898552 - DNA, 13 bp, Homo sapiens
caaatggtaggca

SEQ ID NO: 2898553 - DNA, 23 bp, Homo sapiens
caaatggttccagatacttcagc

SEQ ID NO: 2898554 - DNA, 17 bp, Homo sapiens
caaatgtaaacattttc

SEQ ID NO: 2898555 - DNA, 15 bp, Homo sapiens
caaatgtgaagatgc

SEQ ID NO: 2898556 - DNA, 14 bp, Homo sapiens
caaatgtgtcccag

SEQ ID NO: 2898557 - DNA, 13 bp, Homo sapiens
caaatgttatgca

SEQ ID NO: 2898558 - DNA, 21 bp, Homo sapiens
caaatgttatgcataaagtca

SEQ ID NO: 2898559 - DNA, 14 bp, Homo sapiens
caaatgttctaagt

SEQ ID NO: 2898560 - DNA, 21 bp, Homo sapiens
caaatgttctaagtttctaag

SEQ ID NO: 2898561 - DNA, 10 bp, Homo sapiens
caaatgttga

SEQ ID NO: 2898562 - DNA, 20 bp, Homo sapiens
caaattaaagtgctgtttag

SEQ ID NO: 2898563 - DNA, 14 bp, Homo sapiens
caaattaatatttg

SEQ ID NO: 2898564 - DNA, 17 bp, Homo sapiens
caaattagccagacatg

SEQ ID NO: 2898565 - DNA, 15 bp, Homo sapiens
caaattattaatgaa

SEQ ID NO: 2898566 - DNA, 17 bp, Homo sapiens
caaattattaatgaaaa

SEQ ID NO: 2898567 - DNA, 16 bp, Homo sapiens
caaattctgaatattt

SEQ ID NO: 2898568 - DNA, 14 bp, Homo sapiens
caaattcttttgaa

SEQ ID NO: 2898569 - DNA, 22 bp, Homo sapiens
caaattgcacagaagtcctgta

SEQ ID NO: 2898570 - DNA, 15 bp, Homo sapiens
caaattgcactgaag

SEQ ID NO: 2898571 - DNA, 18 bp, Homo sapiens
caaattgcactgaagttt

SEQ ID NO: 2898572 - DNA, 22 bp, Homo sapiens
caaattggctaaagtgcatttt

SEQ ID NO: 2898573 - DNA, 14 bp, Homo sapiens
caaattgtggagcc

SEQ ID NO: 2898574 - DNA, 15 bp, Homo sapiens
caaatttaatgtaga

SEQ ID NO: 2898575 - DNA, 21 bp, Homo sapiens
caaatttagaaactaattgac

SEQ ID NO: 2898576 - DNA, 20 bp, Homo sapiens
caaggattacagaaactgat

SEQ ID NO: 2898577 - DNA, 23 bp, Homo sapiens
caaggcaggaggagctgataatg

SEQ ID NO: 2898578 - DNA, 15 bp, Homo sapiens
caaggccagggacag

SEQ ID NO: 2898579 - DNA, 22 bp, Homo sapiens
caaggccccgagctcagggcag

SEQ ID NO: 2898580 - DNA, 14 bp, Homo sapiens
caaggcccctgaca

SEQ ID NO: 2898581 - DNA, 20 bp, Homo sapiens
caaggccgctgttcacccac

SEQ ID NO: 2898582 - DNA, 12 bp, Homo sapiens
caaggcctggtc

SEQ ID NO: 2898583 - DNA, 15 bp, Homo sapiens
caaggcctggtctgg

SEQ ID NO: 2898584 - DNA, 16 bp, Homo sapiens
caaggcctggtctggg

SEQ ID NO: 2898585 - DNA, 12 bp, Homo sapiens
caaggccttaag

SEQ ID NO: 2898586 - DNA, 13 bp, Homo sapiens
caaggcggtgctt

SEQ ID NO: 2898587 - DNA, 16 bp, Homo sapiens
caaggctcagaaggaa

SEQ ID NO: 2898588 - DNA, 22 bp, Homo sapiens
caaggctcagaaggaatggtgc

SEQ ID NO: 2898589 - DNA, 19 bp, Homo sapiens
caaggctcctgatcattct

SEQ ID NO: 2898590 - DNA, 22 bp, Homo sapiens
caaggctgtgtttagattgtat

SEQ ID NO: 2898591 - DNA, 14 bp, Homo sapiens
caaggctgttgcat

SEQ ID NO: 2898592 - DNA, 14 bp, Homo sapiens
caagggaaggggcc

SEQ ID NO: 2898593 - DNA, 15 bp, Homo sapiens
caagggaaggggcct

SEQ ID NO: 2898594 - DNA, 19 bp, Homo sapiens
caagggaaggggcctccct

SEQ ID NO: 2898595 - DNA, 20 bp, Homo sapiens
caagggaaggggcctccctc

SEQ ID NO: 2898596 - DNA, 15 bp, Homo sapiens
caagggacaggaagg

SEQ ID NO: 2898597 - DNA, 19 bp, Homo sapiens
caagggactagtgagtcag

SEQ ID NO: 2898598 - DNA, 22 bp, Homo sapiens
caagggactagtgagtcagcac

SEQ ID NO: 2898599 - DNA, 20 bp, Homo sapiens
caagggatctggtcctaccc

SEQ ID NO: 2898600 - DNA, 12 bp, Homo sapiens
caagggcccaga

SEQ ID NO: 2898601 - DNA, 13 bp, Homo sapiens
caagggcctggac

SEQ ID NO: 2898602 - DNA, 15 bp, Homo sapiens
caagggggaaggctg

SEQ ID NO: 2898603 - DNA, 15 bp, Homo sapiens
caagggggcagaggg

SEQ ID NO: 2898604 - DNA, 22 bp, Homo sapiens
caagggggcggggactgctggc

SEQ ID NO: 2898605 - DNA, 20 bp, Homo sapiens
caaggggtggccgggcacag

SEQ ID NO: 2898606 - DNA, 16 bp, Homo sapiens
caagggtctagggaga

SEQ ID NO: 2898607 - DNA, 17 bp, Homo sapiens
caagggtctagggagag

SEQ ID NO: 2898608 - DNA, 12 bp, Homo sapiens
caagggtggcag

SEQ ID NO: 2898609 - DNA, 11 bp, Homo sapiens
caaggtacagc

SEQ ID NO: 2898610 - DNA, 21 bp, Homo sapiens
caaggtcctctgtcagtcaca

SEQ ID NO: 2898611 - DNA, 12 bp, Homo sapiens
caaggtctcaca

SEQ ID NO: 2898612 - DNA, 15 bp, Homo sapiens
caaggtctcacactc

SEQ ID NO: 2898613 - DNA, 17 bp, Homo sapiens
caaggtgaaatgaagca

SEQ ID NO: 2898614 - DNA, 21 bp, Homo sapiens
caaggtgaaatgaagcaacag

SEQ ID NO: 2898615 - DNA, 21 bp, Homo sapiens
caaggtgacagaaggaccagc

SEQ ID NO: 2898616 - DNA, 13 bp, Homo sapiens
caaggtgtccctg

SEQ ID NO: 2898617 - DNA, 16 bp, Homo sapiens
caaggtgtccctgcct

SEQ ID NO: 2898618 - DNA, 17 bp, Homo sapiens
caaggtgtccctgcctt

SEQ ID NO: 2898619 - DNA, 19 bp, Homo sapiens
caaggttactcagcagcag

SEQ ID NO: 2898620 - DNA, 23 bp, Homo sapiens
caaggttactcagcagcagagag

SEQ ID NO: 2898621 - DNA, 18 bp, Homo sapiens
caaggttcaacttattaa

SEQ ID NO: 2898622 - DNA, 14 bp, Homo sapiens
caaggttccacaga

SEQ ID NO: 2898623 - DNA, 16 bp, Homo sapiens
caaggttccacagagt

SEQ ID NO: 2898624 - DNA, 17 bp, Homo sapiens
caaggttccacagagta

SEQ ID NO: 2898625 - DNA, 20 bp, Homo sapiens
caaggtttaaagagtctaga

SEQ ID NO: 2898626 - DNA, 22 bp, Homo sapiens
caaggtttaggctggtggccca

SEQ ID NO: 2898627 - DNA, 12 bp, Homo sapiens
caagtaaaagaa

SEQ ID NO: 2898628 - DNA, 21 bp, Homo sapiens
caagtaagagactcagcctgc

SEQ ID NO: 2898629 - DNA, 20 bp, Homo sapiens
caagtaagaggctggagttg

SEQ ID NO: 2898630 - DNA, 14 bp, Homo sapiens
caagtactgctgta

SEQ ID NO: 2898631 - DNA, 16 bp, Homo sapiens
caagtactgctgtaaa

SEQ ID NO: 2898632 - DNA, 22 bp, Homo sapiens
caagtagaacaaaaactattat

SEQ ID NO: 2898633 - DNA, 20 bp, Homo sapiens
caagtagctgctaccttctt

SEQ ID NO: 2898634 - DNA, 17 bp, Homo sapiens
caagtataaagtcagga

SEQ ID NO: 2898635 - DNA, 18 bp, Homo sapiens
caagtatagcctatggca

SEQ ID NO: 2898636 - DNA, 14 bp, Homo sapiens
caagtcatgtaaat

SEQ ID NO: 2898637 - DNA, 19 bp, Homo sapiens
caagtcatgtaaatactgt

SEQ ID NO: 2898638 - DNA, 12 bp, Homo sapiens
caagtcattttt

SEQ ID NO: 2898639 - DNA, 15 bp, Homo sapiens
caagtcatttttgtt

SEQ ID NO: 2898640 - DNA, 18 bp, Homo sapiens
caagtcccagacaaggag

SEQ ID NO: 2898641 - DNA, 17 bp, Homo sapiens
caagtcccccaagacct

SEQ ID NO: 2898642 - DNA, 18 bp, Homo sapiens
caagtcctgactgggctg

SEQ ID NO: 2898643 - DNA, 13 bp, Homo sapiens
caagtctggatct

SEQ ID NO: 2898644 - DNA, 13 bp, Homo sapiens
caagtctgtgttc

SEQ ID NO: 2898645 - DNA, 20 bp, Homo sapiens
caagtctgtttactgcaagg

SEQ ID NO: 2898646 - DNA, 16 bp, Homo sapiens
caagtgaacaaaataa

SEQ ID NO: 2898647 - DNA, 14 bp, Homo sapiens
caagtgaccaggga

SEQ ID NO: 2898648 - DNA, 21 bp, Homo sapiens
caagtgaccagggaagtgtgt

SEQ ID NO: 2898649 - DNA, 18 bp, Homo sapiens
caagtgactctcctgcct

SEQ ID NO: 2898650 - DNA, 23 bp, Homo sapiens
caagtgagtctggtggaggagct

SEQ ID NO: 2898651 - DNA, 20 bp, Homo sapiens
caagtgattctcctgcctca

SEQ ID NO: 2898652 - DNA, 21 bp, Homo sapiens
caagtgattctcctgcctcag

SEQ ID NO: 2898653 - DNA, 17 bp, Homo sapiens
caagtgcatgctctctg

SEQ ID NO: 2898654 - DNA, 18 bp, Homo sapiens
caagtgccaagacacagc

SEQ ID NO: 2898655 - DNA, 21 bp, Homo sapiens
caagtgctcaagcagcaaaat

SEQ ID NO: 2898656 - DNA, 13 bp, Homo sapiens
caagtgctggccc

SEQ ID NO: 2898657 - DNA, 19 bp, Homo sapiens
caagtgctgtttgggcagg

SEQ ID NO: 2898658 - DNA, 16 bp, Homo sapiens
caagtggaagccactg

SEQ ID NO: 2898659 - DNA, 22 bp, Homo sapiens
caagtggaagccactggaccac

SEQ ID NO: 2898660 - DNA, 21 bp, Homo sapiens
caagtggaccttaggccttcc

SEQ ID NO: 2898661 - DNA, 15 bp, Homo sapiens
caagtggactcaggg

SEQ ID NO: 2898662 - DNA, 15 bp, Homo sapiens
caagtggatgggaat

SEQ ID NO: 2898663 - DNA, 19 bp, Homo sapiens
caagtgggagatgaaaacc

SEQ ID NO: 2898664 - DNA, 13 bp, Homo sapiens
caagtgggggcag

SEQ ID NO: 2898665 - DNA, 14 bp, Homo sapiens
caagtgggggcaga

SEQ ID NO: 2898666 - DNA, 20 bp, Homo sapiens
caagtgggggcagagggcag

SEQ ID NO: 2898667 - DNA, 19 bp, Homo sapiens
caagtggtggtaaccctgg

SEQ ID NO: 2898668 - DNA, 22 bp, Homo sapiens
caagtggtggtaaccctggtgg

SEQ ID NO: 2898669 - DNA, 16 bp, Homo sapiens
caagtgtaaaatattt

SEQ ID NO: 2898670 - DNA, 14 bp, Homo sapiens
caagtgtattttaa

SEQ ID NO: 2898671 - DNA, 13 bp, Homo sapiens
caagtgtctggag

SEQ ID NO: 2898672 - DNA, 22 bp, Homo sapiens
caagtgtgcatattgtacactt

SEQ ID NO: 2898673 - DNA, 19 bp, Homo sapiens
caagtgttctaaaatgaaa

SEQ ID NO: 2898674 - DNA, 12 bp, Homo sapiens
caagttctaaga

SEQ ID NO: 2898675 - DNA, 14 bp, Homo sapiens
caagttctaagatt

SEQ ID NO: 2898676 - DNA, 21 bp, Homo sapiens
caagttctaagattctaatga

SEQ ID NO: 2898677 - DNA, 19 bp, Homo sapiens
caagttctttttaaaatcc

SEQ ID NO: 2898678 - DNA, 17 bp, Homo sapiens
caagttgaagactttgt

SEQ ID NO: 2898679 - DNA, 23 bp, Homo sapiens
caagttgtttaactgtgcatgtg

SEQ ID NO: 2898680 - DNA, 12 bp, Homo sapiens
caagttgtttat

SEQ ID NO: 2898681 - DNA, 14 bp, Homo sapiens
caagtttatatata

SEQ ID NO: 2898682 - DNA, 19 bp, Homo sapiens
caagtttgaccagtgcagt

SEQ ID NO: 2898683 - DNA, 15 bp, Homo sapiens
caataaaaataaatc

SEQ ID NO: 2898684 - DNA, 14 bp, Homo sapiens
caataaaaatcata

SEQ ID NO: 2898685 - DNA, 14 bp, Homo sapiens
caataaaaccaagc

SEQ ID NO: 2898686 - DNA, 18 bp, Homo sapiens
caataaaatttttttaaa

SEQ ID NO: 2898687 - DNA, 20 bp, Homo sapiens
caataaaatttttttggtct

SEQ ID NO: 2898688 - DNA, 19 bp, Homo sapiens
caataaaattttttttcat

SEQ ID NO: 2898689 - DNA, 12 bp, Homo sapiens
caataaacgatt

SEQ ID NO: 2898690 - DNA, 16 bp, Homo sapiens
caataaacgatttaat

SEQ ID NO: 2898691 - DNA, 17 bp, Homo sapiens
caataaacgatttaatt

SEQ ID NO: 2898692 - DNA, 14 bp, Homo sapiens
caataaacttagag

SEQ ID NO: 2898693 - DNA, 22 bp, Homo sapiens
caataaacttagaggaaaatga

SEQ ID NO: 2898694 - DNA, 13 bp, Homo sapiens
caataaagaagag

SEQ ID NO: 2898695 - DNA, 12 bp, Homo sapiens
caataaaggaac

SEQ ID NO: 2898696 - DNA, 12 bp, Homo sapiens
caataaatgaat

SEQ ID NO: 2898697 - DNA, 16 bp, Homo sapiens
caataaatgtctgttg

SEQ ID NO: 2898698 - DNA, 12 bp, Homo sapiens
caataacttcta

SEQ ID NO: 2898699 - DNA, 22 bp, Homo sapiens
caataacttctatattttaata

SEQ ID NO: 2898700 - DNA, 16 bp, Homo sapiens
caataataaaaaacaa

SEQ ID NO: 2898701 - DNA, 13 bp, Homo sapiens
caataataaagat

SEQ ID NO: 2898702 - DNA, 23 bp, Homo sapiens
caataataaagtacttgactacc

SEQ ID NO: 2898703 - DNA, 23 bp, Homo sapiens
caataatgcagtatggtacattt

SEQ ID NO: 2898704 - DNA, 12 bp, Homo sapiens
caatacaaaatg

SEQ ID NO: 2898705 - DNA, 14 bp, Homo sapiens
caatacaaaatgta

SEQ ID NO: 2898706 - DNA, 13 bp, Homo sapiens
caatacattgttc

SEQ ID NO: 2898707 - DNA, 18 bp, Homo sapiens
caatacctacaataaact

SEQ ID NO: 2898708 - DNA, 14 bp, Homo sapiens
caatacctcttgga

SEQ ID NO: 2898709 - DNA, 21 bp, Homo sapiens
caatacgggagtgacccagct

SEQ ID NO: 2898710 - DNA, 17 bp, Homo sapiens
caatacgtttgtgcaga

SEQ ID NO: 2898711 - DNA, 17 bp, Homo sapiens
caatactcataatgtga

SEQ ID NO: 2898712 - DNA, 18 bp, Homo sapiens
caatactcataatgtgaa

SEQ ID NO: 2898713 - DNA, 21 bp, Homo sapiens
caattgttgacagttctgaag

SEQ ID NO: 2898714 - DNA, 24 bp, Homo sapiens
caattgttgacagttctgaagaat

SEQ ID NO: 2898715 - DNA, 14 bp, Homo sapiens
caatttaaaacaat

SEQ ID NO: 2898716 - DNA, 15 bp, Homo sapiens
caatttaaacccatt

SEQ ID NO: 2898717 - DNA, 18 bp, Homo sapiens
caatttaaacccatttta

SEQ ID NO: 2898718 - DNA, 18 bp, Homo sapiens
caatttactttttaaaca

SEQ ID NO: 2898719 - DNA, 16 bp, Homo sapiens
caatttcaaggttcta

SEQ ID NO: 2898720 - DNA, 19 bp, Homo sapiens
caatttcaaggttctaacc

SEQ ID NO: 2898721 - DNA, 11 bp, Homo sapiens
caatttcagca

SEQ ID NO: 2898722 - DNA, 20 bp, Homo sapiens
caatttctactttgaagtca

SEQ ID NO: 2898723 - DNA, 21 bp, Homo sapiens
caatttctactttgaagtcat

SEQ ID NO: 2898724 - DNA, 17 bp, Homo sapiens
caatttctttaaaaaag

SEQ ID NO: 2898725 - DNA, 20 bp, Homo sapiens
caatttctttaaaaaagaaa

SEQ ID NO: 2898726 - DNA, 13 bp, Homo sapiens
caatttgcctctg

SEQ ID NO: 2898727 - DNA, 17 bp, Homo sapiens
caatttgggcttcctgt

SEQ ID NO: 2898728 - DNA, 19 bp, Homo sapiens
caatttgtaaaaacagcat

SEQ ID NO: 2898729 - DNA, 16 bp, Homo sapiens
caatttgtaattttag

SEQ ID NO: 2898730 - DNA, 14 bp, Homo sapiens
caatttgtctccta

SEQ ID NO: 2898731 - DNA, 16 bp, Homo sapiens
caatttgttaacagag

SEQ ID NO: 2898732 - DNA, 17 bp, Homo sapiens
caatttgttaacagagc

SEQ ID NO: 2898733 - DNA, 23 bp, Homo sapiens
caattttaatttagtaaatgtta

SEQ ID NO: 2898734 - DNA, 12 bp, Homo sapiens
caattttcaggt

SEQ ID NO: 2898735 - DNA, 20 bp, Homo sapiens
caattttcattaaacttgaa

SEQ ID NO: 2898736 - DNA, 13 bp, Homo sapiens
caattttgtatcc

SEQ ID NO: 2898737 - DNA, 13 bp, Homo sapiens
caatttttcttta

SEQ ID NO: 2898738 - DNA, 16 bp, Homo sapiens
caatttttttttgtta

SEQ ID NO: 2898739 - DNA, 14 bp, Homo sapiens
cacaaaaaggagcg

SEQ ID NO: 2898740 - DNA, 21 bp, Homo sapiens
cacaaacacattgttattttc

SEQ ID NO: 2898741 - DNA, 16 bp, Homo sapiens
cacaaacggagcccct

SEQ ID NO: 2898742 - DNA, 17 bp, Homo sapiens
cacaaacggagcccctg

SEQ ID NO: 2898743 - DNA, 22 bp, Homo sapiens
cacaaactctatcggagaacat

SEQ ID NO: 2898744 - DNA, 12 bp, Homo sapiens
cacaaactgtaa

SEQ ID NO: 2898745 - DNA, 15 bp, Homo sapiens
cacaaagcaaaggca

SEQ ID NO: 2898746 - DNA, 16 bp, Homo sapiens
cacaaagcaaaggcag

SEQ ID NO: 2898747 - DNA, 17 bp, Homo sapiens
cacaaagcggctctaaa

SEQ ID NO: 2898748 - DNA, 21 bp, Homo sapiens
cacaaaggatttgatgctttt

SEQ ID NO: 2898749 - DNA, 13 bp, Homo sapiens
cacaaagggccca

SEQ ID NO: 2898750 - DNA, 16 bp, Homo sapiens
cacaaagggcccagat

SEQ ID NO: 2898751 - DNA, 15 bp, Homo sapiens
cacaaatgaaaatga

SEQ ID NO: 2898752 - DNA, 20 bp, Homo sapiens
cacaaattattaatgaaaat

SEQ ID NO: 2898753 - DNA, 19 bp, Homo sapiens
cacaacaaaaggaagactg

SEQ ID NO: 2898754 - DNA, 19 bp, Homo sapiens
cacaaccctctggaagtgg

SEQ ID NO: 2898755 - DNA, 18 bp, Homo sapiens
cacaacctactctgcaaa

SEQ ID NO: 2898756 - DNA, 17 bp, Homo sapiens
cacaaccttgcagtatt

SEQ ID NO: 2898757 - DNA, 15 bp, Homo sapiens
cacaactatcaaaat

SEQ ID NO: 2898758 - DNA, 17 bp, Homo sapiens
cacaagaatcacttgaa

SEQ ID NO: 2898759 - DNA, 23 bp, Homo sapiens
cacaagacccaagtagctgctac

SEQ ID NO: 2898760 - DNA, 18 bp, Homo sapiens
cacaagattcccagagac

SEQ ID NO: 2898761 - DNA, 15 bp, Homo sapiens
cacaagctgcctctg

SEQ ID NO: 2898762 - DNA, 17 bp, Homo sapiens
cacaagctgcctctgac

SEQ ID NO: 2898763 - DNA, 18 bp, Homo sapiens
cacaaggaataaatgaga

SEQ ID NO: 2898764 - DNA, 16 bp, Homo sapiens
cacaaggacttcctgt

SEQ ID NO: 2898765 - DNA, 22 bp, Homo sapiens
cacaaggatagatgctggccca

SEQ ID NO: 2898766 - DNA, 18 bp, Homo sapiens
cacaaggcctggtctggg

SEQ ID NO: 2898767 - DNA, 19 bp, Homo sapiens
cacaaggcctggtctggga

SEQ ID NO: 2898768 - DNA, 17 bp, Homo sapiens
cacaagggaaggacaga

SEQ ID NO: 2898769 - DNA, 22 bp, Homo sapiens
cacaagggaaggacagaaagga

SEQ ID NO: 2898770 - DNA, 16 bp, Homo sapiens
cacaaggtcatggcca

SEQ ID NO: 2898771 - DNA, 18 bp, Homo sapiens
cacaaggtcatggccaca

SEQ ID NO: 2898772 - DNA, 22 bp, Homo sapiens
cacaaggtcatggccacactgt

SEQ ID NO: 2898773 - DNA, 22 bp, Homo sapiens
cacaagtaagagactcagcctg

SEQ ID NO: 2898774 - DNA, 19 bp, Homo sapiens
cacaagtatatacttttaa

SEQ ID NO: 2898775 - DNA, 16 bp, Homo sapiens
cacaagtgaaaaacat

SEQ ID NO: 2898776 - DNA, 21 bp, Homo sapiens
cacaagtgccgcaaattgtac

SEQ ID NO: 2898777 - DNA, 21 bp, Homo sapiens
cacaagtggtggtaaccctgg

SEQ ID NO: 2898778 - DNA, 18 bp, Homo sapiens
cacaataaaaccaagcct

SEQ ID NO: 2898779 - DNA, 23 bp, Homo sapiens
cacaataaaaccaagcctctgga

SEQ ID NO: 2898780 - DNA, 18 bp, Homo sapiens
cacaataagagtctcctt

SEQ ID NO: 2898781 - DNA, 21 bp, Homo sapiens
cacaatacctacaataaactg

SEQ ID NO: 2898782 - DNA, 14 bp, Homo sapiens
cacactacaccaca

SEQ ID NO: 2898783 - DNA, 16 bp, Homo sapiens
cacactacaccacaca

SEQ ID NO: 2898784 - DNA, 23 bp, Homo sapiens
cacactacaccacacacaacagc

SEQ ID NO: 2898785 - DNA, 14 bp, Homo sapiens
cacactatgtgtgt

SEQ ID NO: 2898786 - DNA, 22 bp, Homo sapiens
cacactccaagatatggacaca

SEQ ID NO: 2898787 - DNA, 14 bp, Homo sapiens
cacactccatcagc

SEQ ID NO: 2898788 - DNA, 15 bp, Homo sapiens
cacactccatcagct

SEQ ID NO: 2898789 - DNA, 22 bp, Homo sapiens
cacactcctcctgccagctctg

SEQ ID NO: 2898790 - DNA, 23 bp, Homo sapiens
cacactccttccccttgtccctg

SEQ ID NO: 2898791 - DNA, 18 bp, Homo sapiens
cacactgatgcttagatg

SEQ ID NO: 2898792 - DNA, 14 bp, Homo sapiens
cacactgccttatt

SEQ ID NO: 2898793 - DNA, 17 bp, Homo sapiens
cacactgccttattaca

SEQ ID NO: 2898794 - DNA, 13 bp, Homo sapiens
cacactggactcc

SEQ ID NO: 2898795 - DNA, 19 bp, Homo sapiens
cacactggactccggccct

SEQ ID NO: 2898796 - DNA, 20 bp, Homo sapiens
cacactggactccggccctc

SEQ ID NO: 2898797 - DNA, 14 bp, Homo sapiens
cacactggttctca

SEQ ID NO: 2898798 - DNA, 18 bp, Homo sapiens
cacactggttctcaatga

SEQ ID NO: 2898799 - DNA, 22 bp, Homo sapiens
cacactgtcatgcttcatcatt

SEQ ID NO: 2898800 - DNA, 12 bp, Homo sapiens
cacactgtgaca

SEQ ID NO: 2898801 - DNA, 22 bp, Homo sapiens
cacactgtgacacactacacca

SEQ ID NO: 2898802 - DNA, 22 bp, Homo sapiens
cacacttactgtaagacattag

SEQ ID NO: 2898803 - DNA, 13 bp, Homo sapiens
cacacttgtgcca

SEQ ID NO: 2898804 - DNA, 18 bp, Homo sapiens
cacacttgtgccagcccg

SEQ ID NO: 2898805 - DNA, 15 bp, Homo sapiens
cacactttctcttca

SEQ ID NO: 2898806 - DNA, 21 bp, Homo sapiens
cacactttctcttcaatgaaa

SEQ ID NO: 2898807 - DNA, 12 bp, Homo sapiens
cacagaaaatat

SEQ ID NO: 2898808 - DNA, 19 bp, Homo sapiens
cacagaaaatatactgtaa

SEQ ID NO: 2898809 - DNA, 20 bp, Homo sapiens
cacagaaaatatactgtaaa

SEQ ID NO: 2898810 - DNA, 22 bp, Homo sapiens
cacagaaaatatactgtaaaga

SEQ ID NO: 2898811 - DNA, 16 bp, Homo sapiens
cacagaaacactgcct

SEQ ID NO: 2898812 - DNA, 18 bp, Homo sapiens
cacagaaacactgccttt

SEQ ID NO: 2898813 - DNA, 16 bp, Homo sapiens
cacagaaaccaatttt

SEQ ID NO: 2898814 - DNA, 15 bp, Homo sapiens
cacagaagcctagga

SEQ ID NO: 2898815 - DNA, 17 bp, Homo sapiens
cacagaaggtgaacttt

SEQ ID NO: 2898816 - DNA, 18 bp, Homo sapiens
cacagaaggtgaactttg

SEQ ID NO: 2898817 - DNA, 18 bp, Homo sapiens
cacagactcaaatgctca

SEQ ID NO: 2898818 - DNA, 22 bp, Homo sapiens
cacagactcatcctgaacagca

SEQ ID NO: 2898819 - DNA, 16 bp, Homo sapiens
cacagactcttccacc

SEQ ID NO: 2898820 - DNA, 18 bp, Homo sapiens
cacagactcttccaccag

SEQ ID NO: 2898821 - DNA, 22 bp, Homo sapiens
cacagactcttccaccagagca

SEQ ID NO: 2898822 - DNA, 23 bp, Homo sapiens
cacagactcttccaccagagcag

SEQ ID NO: 2898823 - DNA, 16 bp, Homo sapiens
cacagactgccccagc

SEQ ID NO: 2898824 - DNA, 17 bp, Homo sapiens
cacagagaagacaaaat

SEQ ID NO: 2898825 - DNA, 16 bp, Homo sapiens
cacagagcacgcctgc

SEQ ID NO: 2898826 - DNA, 18 bp, Homo sapiens
cacagagcacgcctgcca

SEQ ID NO: 2898827 - DNA, 21 bp, Homo sapiens
cacagagcacgcctgccatct

SEQ ID NO: 2898828 - DNA, 21 bp, Homo sapiens
cacagaggcagcccgcacacc

SEQ ID NO: 2898829 - DNA, 21 bp, Homo sapiens
cacagagttttttaaacaaat

SEQ ID NO: 2898830 - DNA, 18 bp, Homo sapiens
cacagatatctttttcat

SEQ ID NO: 2898831 - DNA, 20 bp, Homo sapiens
cacagatgagttatctaaga

SEQ ID NO: 2898832 - DNA, 15 bp, Homo sapiens
cacagatgctggcct

SEQ ID NO: 2898833 - DNA, 17 bp, Homo sapiens
cacagatgctggcctct

SEQ ID NO: 2898834 - DNA, 18 bp, Homo sapiens
cacagatgctggcctctt

SEQ ID NO: 2898835 - DNA, 19 bp, Homo sapiens
cacagattcccaggccagg

SEQ ID NO: 2898836 - DNA, 20 bp, Homo sapiens
cacagattcccaggccaggg

SEQ ID NO: 2898837 - DNA, 23 bp, Homo sapiens
cacagattcccaggccagggctg

SEQ ID NO: 2898838 - DNA, 21 bp, Homo sapiens
cacagattgtttctatacaaa

SEQ ID NO: 2898839 - DNA, 16 bp, Homo sapiens
cacagcaattttgtat

SEQ ID NO: 2898840 - DNA, 17 bp, Homo sapiens
cacagcaattttgtatc

SEQ ID NO: 2898841 - DNA, 19 bp, Homo sapiens
cacagcaccagaatgtata

SEQ ID NO: 2898842 - DNA, 23 bp, Homo sapiens
cacatcttaaagctaaaaatgaa

SEQ ID NO: 2898843 - DNA, 18 bp, Homo sapiens
cacatgaagaaatactgc

SEQ ID NO: 2898844 - DNA, 24 bp, Homo sapiens
cacatgaatcccacccacatgtga

SEQ ID NO: 2898845 - DNA, 16 bp, Homo sapiens
cacatgagataatatg

SEQ ID NO: 2898846 - DNA, 17 bp, Homo sapiens
cacatgcatacacacac

SEQ ID NO: 2898847 - DNA, 14 bp, Homo sapiens
cacatgccccaggc

SEQ ID NO: 2898848 - DNA, 12 bp, Homo sapiens
cacatgcttcaa

SEQ ID NO: 2898849 - DNA, 17 bp, Homo sapiens
cacatggaaacccatag

SEQ ID NO: 2898850 - DNA, 13 bp, Homo sapiens
cacatggagctct

SEQ ID NO: 2898851 - DNA, 13 bp, Homo sapiens
cacatggctgggg

SEQ ID NO: 2898852 - DNA, 14 bp, Homo sapiens
cacatggctggggg

SEQ ID NO: 2898853 - DNA, 23 bp, Homo sapiens
cacatggctgggggagggactgc

SEQ ID NO: 2898854 - DNA, 13 bp, Homo sapiens
cacatgtgacaca

SEQ ID NO: 2898855 - DNA, 17 bp, Homo sapiens
cacatgtggccatggcc

SEQ ID NO: 2898856 - DNA, 18 bp, Homo sapiens
cacattaaaagacaaata

SEQ ID NO: 2898857 - DNA, 14 bp, Homo sapiens
cacattaactgttg

SEQ ID NO: 2898858 - DNA, 16 bp, Homo sapiens
cacattatccctctgg

SEQ ID NO: 2898859 - DNA, 22 bp, Homo sapiens
cacattcttaacacatgtcctt

SEQ ID NO: 2898860 - DNA, 17 bp, Homo sapiens
cacattcttataaatat

SEQ ID NO: 2898861 - DNA, 18 bp, Homo sapiens
cacattgtgcttggcccc

SEQ ID NO: 2898862 - DNA, 20 bp, Homo sapiens
cacattgttattttcagtga

SEQ ID NO: 2898863 - DNA, 15 bp, Homo sapiens
cacattgttttaaaa

SEQ ID NO: 2898864 - DNA, 17 bp, Homo sapiens
cacatttagtctcttta

SEQ ID NO: 2898865 - DNA, 18 bp, Homo sapiens
cacatttagtctctttat

SEQ ID NO: 2898866 - DNA, 19 bp, Homo sapiens
cacatttagtctctttatt

SEQ ID NO: 2898867 - DNA, 18 bp, Homo sapiens
cacatttggcttacagta

SEQ ID NO: 2898868 - DNA, 14 bp, Homo sapiens
cacatttgttgcac

SEQ ID NO: 2898869 - DNA, 12 bp, Homo sapiens
cacattttaaca

SEQ ID NO: 2898870 - DNA, 19 bp, Homo sapiens
cacattttggttcttctca

SEQ ID NO: 2898871 - DNA, 17 bp, Homo sapiens
cacatttttgcacagat

SEQ ID NO: 2898872 - DNA, 23 bp, Homo sapiens
cacatttttgcacagattatgct

SEQ ID NO: 2898873 - DNA, 22 bp, Homo sapiens
caccaaagttctaataatttct

SEQ ID NO: 2898874 - DNA, 21 bp, Homo sapiens
caccaaattgttatttgcact

SEQ ID NO: 2898875 - DNA, 14 bp, Homo sapiens
caccaacatcccat

SEQ ID NO: 2898876 - DNA, 17 bp, Homo sapiens
caccaacatcccattgc

SEQ ID NO: 2898877 - DNA, 23 bp, Homo sapiens
caccaacatcccattgccctggt

SEQ ID NO: 2898878 - DNA, 14 bp, Homo sapiens
caccaagcacagca

SEQ ID NO: 2898879 - DNA, 18 bp, Homo sapiens
caccaagcacagcagcct

SEQ ID NO: 2898880 - DNA, 21 bp, Homo sapiens
caccaagcaggaaatgaaaat

SEQ ID NO: 2898881 - DNA, 12 bp, Homo sapiens
caccaaggaaac

SEQ ID NO: 2898882 - DNA, 20 bp, Homo sapiens
caccaaggaaacgctacctc

SEQ ID NO: 2898883 - DNA, 17 bp, Homo sapiens
caccaaggtctcacact

SEQ ID NO: 2898884 - DNA, 21 bp, Homo sapiens
caccaattggataaagcagct

SEQ ID NO: 2898885 - DNA, 20 bp, Homo sapiens
caccacaattctccctatct

SEQ ID NO: 2898886 - DNA, 15 bp, Homo sapiens
caccacacacaacag

SEQ ID NO: 2898887 - DNA, 21 bp, Homo sapiens
caccacatcttgtcttttccc

SEQ ID NO: 2898888 - DNA, 14 bp, Homo sapiens
caccaccaggtctc

SEQ ID NO: 2898889 - DNA, 19 bp, Homo sapiens
caccacccaacctgtcctt

SEQ ID NO: 2898890 - DNA, 17 bp, Homo sapiens
caccaccgagctctgtg

SEQ ID NO: 2898891 - DNA, 20 bp, Homo sapiens
caccaccttatacatcactt

SEQ ID NO: 2898892 - DNA, 13 bp, Homo sapiens
caccaccttccca

SEQ ID NO: 2898893 - DNA, 14 bp, Homo sapiens
caccaccttcccag

SEQ ID NO: 2898894 - DNA, 19 bp, Homo sapiens
caccccttcgacatgctgc

SEQ ID NO: 2898895 - DNA, 21 bp, Homo sapiens
caccccttcgacatgctgcca

SEQ ID NO: 2898896 - DNA, 18 bp, Homo sapiens
cacccgccttcagcctcc

SEQ ID NO: 2898897 - DNA, 18 bp, Homo sapiens
caccctaccttccccaga

SEQ ID NO: 2898898 - DNA, 22 bp, Homo sapiens
caccctaccttccccagacttg

SEQ ID NO: 2898899 - DNA, 23 bp, Homo sapiens
caccctaccttccccagacttgc

SEQ ID NO: 2898900 - DNA, 18 bp, Homo sapiens
caccctcaacctcttctg

SEQ ID NO: 2898901 - DNA, 17 bp, Homo sapiens
caccctcattctactga

SEQ ID NO: 2898902 - DNA, 14 bp, Homo sapiens
caccctcccggaat

SEQ ID NO: 2898903 - DNA, 12 bp, Homo sapiens
caccctcctggc

SEQ ID NO: 2898904 - DNA, 18 bp, Homo sapiens
caccctcctggcctcaga

SEQ ID NO: 2898905 - DNA, 13 bp, Homo sapiens
caccctctgtccc

SEQ ID NO: 2898906 - DNA, 18 bp, Homo sapiens
caccctctgtccccacga

SEQ ID NO: 2898907 - DNA, 19 bp, Homo sapiens
caccctctgtccccacgag

SEQ ID NO: 2898908 - DNA, 17 bp, Homo sapiens
caccctgcccacccccg

SEQ ID NO: 2898909 - DNA, 17 bp, Homo sapiens
caccctgccctcatggg

SEQ ID NO: 2898910 - DNA, 20 bp, Homo sapiens
caccctgccctcatgggacc

SEQ ID NO: 2898911 - DNA, 12 bp, Homo sapiens
caccctgcctgc

SEQ ID NO: 2898912 - DNA, 16 bp, Homo sapiens
caccctgcctgctgtg

SEQ ID NO: 2898913 - DNA, 22 bp, Homo sapiens
caccctgcctgctgtggagccc

SEQ ID NO: 2898914 - DNA, 14 bp, Homo sapiens
caccctggccacca

SEQ ID NO: 2898915 - DNA, 11 bp, Homo sapiens
caccctggcct

SEQ ID NO: 2898916 - DNA, 20 bp, Homo sapiens
caccctgggtttggcccctg

SEQ ID NO: 2898917 - DNA, 19 bp, Homo sapiens
caccctgtttggattttta

SEQ ID NO: 2898918 - DNA, 22 bp, Homo sapiens
caccctgtttggatttttaatt

SEQ ID NO: 2898919 - DNA, 14 bp, Homo sapiens
cacccttccctgcc

SEQ ID NO: 2898920 - DNA, 15 bp, Homo sapiens
cacccttccctgcct

SEQ ID NO: 2898921 - DNA, 21 bp, Homo sapiens
cacccttccctgcctccagct

SEQ ID NO: 2898922 - DNA, 16 bp, Homo sapiens
cacccttcctggccca

SEQ ID NO: 2898923 - DNA, 19 bp, Homo sapiens
cacccttcctggcccaggc

SEQ ID NO: 2898924 - DNA, 19 bp, Homo sapiens
cacccttgccatcccaagc

SEQ ID NO: 2898925 - DNA, 20 bp, Homo sapiens
cacccttggtagagtttatt

SEQ ID NO: 2898926 - DNA, 19 bp, Homo sapiens
caccctttcatagagaggc

SEQ ID NO: 2898927 - DNA, 22 bp, Homo sapiens
caccctttcatagagaggcctg

SEQ ID NO: 2898928 - DNA, 15 bp, Homo sapiens
cacccttttccagct

SEQ ID NO: 2898929 - DNA, 18 bp, Homo sapiens
caccgaccccgggccgga

SEQ ID NO: 2898930 - DNA, 15 bp, Homo sapiens
caccgacccgaggcc

SEQ ID NO: 2898931 - DNA, 14 bp, Homo sapiens
caccgactgcccag

SEQ ID NO: 2898932 - DNA, 16 bp, Homo sapiens
caccgactgcccagcc

SEQ ID NO: 2898933 - DNA, 19 bp, Homo sapiens
caccgactgcccagccact

SEQ ID NO: 2898934 - DNA, 21 bp, Homo sapiens
caccgagagtagccgagagcc

SEQ ID NO: 2898935 - DNA, 23 bp, Homo sapiens
caccgagctctgtgggaaaaaag

SEQ ID NO: 2898936 - DNA, 16 bp, Homo sapiens
caccgaggggcctttg

SEQ ID NO: 2898937 - DNA, 19 bp, Homo sapiens
cactcattgctgagcctct

SEQ ID NO: 2898938 - DNA, 18 bp, Homo sapiens
cactccaagccccctggc

SEQ ID NO: 2898939 - DNA, 20 bp, Homo sapiens
cactccaagccccctggcag

SEQ ID NO: 2898940 - DNA, 14 bp, Homo sapiens
cactccaccaccca

SEQ ID NO: 2898941 - DNA, 15 bp, Homo sapiens
cactccaccacccaa

SEQ ID NO: 2898942 - DNA, 18 bp, Homo sapiens
cactccaccacccaaaag

SEQ ID NO: 2898943 - DNA, 22 bp, Homo sapiens
cactccagcctgggtcacagag

SEQ ID NO: 2898944 - DNA, 15 bp, Homo sapiens
cactcccacccagtc

SEQ ID NO: 2898945 - DNA, 16 bp, Homo sapiens
cactcccactgccagg

SEQ ID NO: 2898946 - DNA, 14 bp, Homo sapiens
cactcccccaggat

SEQ ID NO: 2898947 - DNA, 19 bp, Homo sapiens
cactccccgaagtcttttg

SEQ ID NO: 2898948 - DNA, 16 bp, Homo sapiens
cactcccctccactct

SEQ ID NO: 2898949 - DNA, 16 bp, Homo sapiens
cactcccgggatgggt

SEQ ID NO: 2898950 - DNA, 14 bp, Homo sapiens
cactccctaggccc

SEQ ID NO: 2898951 - DNA, 19 bp, Homo sapiens
cactccctccagcacaaac

SEQ ID NO: 2898952 - DNA, 13 bp, Homo sapiens
cactccctcctgg

SEQ ID NO: 2898953 - DNA, 23 bp, Homo sapiens
cactccctcctggagctctgtgg

SEQ ID NO: 2898954 - DNA, 15 bp, Homo sapiens
cactccctggccttg

SEQ ID NO: 2898955 - DNA, 19 bp, Homo sapiens
cactcccttcccataagct

SEQ ID NO: 2898956 - DNA, 13 bp, Homo sapiens
cactcccttgggc

SEQ ID NO: 2898957 - DNA, 16 bp, Homo sapiens
cactcctcagggcagc

SEQ ID NO: 2898958 - DNA, 14 bp, Homo sapiens
cactcctcctgcca

SEQ ID NO: 2898959 - DNA, 16 bp, Homo sapiens
cactcctcctgccagc

SEQ ID NO: 2898960 - DNA, 20 bp, Homo sapiens
cactcctctgactcagggct

SEQ ID NO: 2898961 - DNA, 23 bp, Homo sapiens
cactcctctgactcagggctcct

SEQ ID NO: 2898962 - DNA, 17 bp, Homo sapiens
cactcctgatttttatc

SEQ ID NO: 2898963 - DNA, 15 bp, Homo sapiens
cactcctgccagccc

SEQ ID NO: 2898964 - DNA, 11 bp, Homo sapiens
cactcctggag

SEQ ID NO: 2898965 - DNA, 18 bp, Homo sapiens
cactccttccccttgtcc

SEQ ID NO: 2898966 - DNA, 11 bp, Homo sapiens
cactccttgca

SEQ ID NO: 2898967 - DNA, 14 bp, Homo sapiens
cactcgcgtgttcc

SEQ ID NO: 2898968 - DNA, 11 bp, Homo sapiens
cactctagatt

SEQ ID NO: 2898969 - DNA, 15 bp, Homo sapiens
cactctcccttgtac

SEQ ID NO: 2898970 - DNA, 15 bp, Homo sapiens
cactctccttgcagt

SEQ ID NO: 2898971 - DNA, 17 bp, Homo sapiens
cactctccttgcagttc

SEQ ID NO: 2898972 - DNA, 14 bp, Homo sapiens
cactctctgcccct

SEQ ID NO: 2898973 - DNA, 23 bp, Homo sapiens
cactctctgcccctaaagatggg

SEQ ID NO: 2898974 - DNA, 16 bp, Homo sapiens
cactctgagtgtttta

SEQ ID NO: 2898975 - DNA, 16 bp, Homo sapiens
cactctgatagaatta

SEQ ID NO: 2898976 - DNA, 17 bp, Homo sapiens
cactctgccctctgctg

SEQ ID NO: 2898977 - DNA, 19 bp, Homo sapiens
cactctgcggcccgggccg

SEQ ID NO: 2898978 - DNA, 15 bp, Homo sapiens
cactctgctcgcctt

SEQ ID NO: 2898979 - DNA, 18 bp, Homo sapiens
cactctgctcgccttagc

SEQ ID NO: 2898980 - DNA, 14 bp, Homo sapiens
cactctgctgcctg

SEQ ID NO: 2898981 - DNA, 20 bp, Homo sapiens
cactctggcggtggccacag

SEQ ID NO: 2898982 - DNA, 14 bp, Homo sapiens
cactctgggctcca

SEQ ID NO: 2898983 - DNA, 15 bp, Homo sapiens
cactctgggctccag

SEQ ID NO: 2898984 - DNA, 16 bp, Homo sapiens
cactctgggctccaga

SEQ ID NO: 2898985 - DNA, 20 bp, Homo sapiens
cactctgttatttagactca

SEQ ID NO: 2898986 - DNA, 17 bp, Homo sapiens
cactctgttgcccaggc

SEQ ID NO: 2898987 - DNA, 22 bp, Homo sapiens
cactcttcctcatcctgcttct

SEQ ID NO: 2898988 - DNA, 14 bp, Homo sapiens
cactcttcctgagt

SEQ ID NO: 2898989 - DNA, 21 bp, Homo sapiens
cactcttctctccaaggaaat

SEQ ID NO: 2898990 - DNA, 20 bp, Homo sapiens
cactcttgaagtccaggact

SEQ ID NO: 2898991 - DNA, 13 bp, Homo sapiens
cactcttgactca

SEQ ID NO: 2898992 - DNA, 15 bp, Homo sapiens
cactcttggagcctg

SEQ ID NO: 2898993 - DNA, 17 bp, Homo sapiens
cactcttggagcctgca

SEQ ID NO: 2898994 - DNA, 19 bp, Homo sapiens
cactcttggagcctgcaga

SEQ ID NO: 2898995 - DNA, 11 bp, Homo sapiens
cactcttggct

SEQ ID NO: 2898996 - DNA, 22 bp, Homo sapiens
cactcttgtggatgttttaatt

SEQ ID NO: 2898997 - DNA, 17 bp, Homo sapiens
cactcttgttcccacac

SEQ ID NO: 2898998 - DNA, 14 bp, Homo sapiens
cactcttttataca

SEQ ID NO: 2898999 - DNA, 14 bp, Homo sapiens
cactgaaaaaatac

SEQ ID NO: 2899000 - DNA, 18 bp, Homo sapiens
cactgaaaacatctggaa

SEQ ID NO: 2899001 - DNA, 19 bp, Homo sapiens
cactgaaaagctttcctga

SEQ ID NO: 2899002 - DNA, 22 bp, Homo sapiens
cactgaaaagctttcctgacaa

SEQ ID NO: 2899003 - DNA, 17 bp, Homo sapiens
cactgaaatctgtcaag

SEQ ID NO: 2899004 - DNA, 19 bp, Homo sapiens
cactgaagaaaccttcaga

SEQ ID NO: 2899005 - DNA, 17 bp, Homo sapiens
cactgaagcccagacct

SEQ ID NO: 2899006 - DNA, 19 bp, Homo sapiens
cactgaagggaatcacatc

SEQ ID NO: 2899007 - DNA, 18 bp, Homo sapiens
cactgaagtgcttgcaga

SEQ ID NO: 2899008 - DNA, 17 bp, Homo sapiens
cactgaagtttttgaaa

SEQ ID NO: 2899009 - DNA, 18 bp, Homo sapiens
cactgaagtttttgaaat

SEQ ID NO: 2899010 - DNA, 20 bp, Homo sapiens
cactgaagtttttgaaatac

SEQ ID NO: 2899011 - DNA, 19 bp, Homo sapiens
cactgaattggaacttttc

SEQ ID NO: 2899012 - DNA, 19 bp, Homo sapiens
cactgacacaaaaagtaga

SEQ ID NO: 2899013 - DNA, 21 bp, Homo sapiens
cactgaccccccccattagaa

SEQ ID NO: 2899014 - DNA, 18 bp, Homo sapiens
cactgagataccagcgag

SEQ ID NO: 2899015 - DNA, 14 bp, Homo sapiens
cactgagctctgcc

SEQ ID NO: 2899016 - DNA, 17 bp, Homo sapiens
cactgagctctgcctca

SEQ ID NO: 2899017 - DNA, 14 bp, Homo sapiens
cactgaggcaggga

SEQ ID NO: 2899018 - DNA, 19 bp, Homo sapiens
cactgaggcctgagaccca

SEQ ID NO: 2899019 - DNA, 14 bp, Homo sapiens
cactgagggcagtc

SEQ ID NO: 2899020 - DNA, 22 bp, Homo sapiens
cactgagtttctatttagacac

SEQ ID NO: 2899021 - DNA, 15 bp, Homo sapiens
cactgagttttccat

SEQ ID NO: 2899022 - DNA, 13 bp, Homo sapiens
cactgatattcag

SEQ ID NO: 2899023 - DNA, 15 bp, Homo sapiens
cactgatattcagaa

SEQ ID NO: 2899024 - DNA, 19 bp, Homo sapiens
cactgatctgaacatctgg

SEQ ID NO: 2899025 - DNA, 12 bp, Homo sapiens
cactgatgctgc

SEQ ID NO: 2899026 - DNA, 14 bp, Homo sapiens
cactgatttggaga

SEQ ID NO: 2899027 - DNA, 17 bp, Homo sapiens
cactgcaacttctgcct

SEQ ID NO: 2899028 - DNA, 15 bp, Homo sapiens
cactgcaagagcctt

SEQ ID NO: 2899029 - DNA, 20 bp, Homo sapiens
cactgcaagctccaactccc

SEQ ID NO: 2899030 - DNA, 20 bp, Homo sapiens
cactgcaagtccttttgtaa

SEQ ID NO: 2899031 - DNA, 21 bp, Homo sapiens
cactgcaagtccttttgtaaa

SEQ ID NO: 2899032 - DNA, 19 bp, Homo sapiens
cactgcaatcctgtctttc

SEQ ID NO: 2899033 - DNA, 17 bp, Homo sapiens
cactgcactcaacctta

SEQ ID NO: 2899034 - DNA, 24 bp, Homo sapiens
cactgcactccagcctgagtgaca

SEQ ID NO: 2899035 - DNA, 19 bp, Homo sapiens
cactgcagcctcaacctcc

SEQ ID NO: 2899036 - DNA, 16 bp, Homo sapiens
cactgcaggccccgct

SEQ ID NO: 2899037 - DNA, 19 bp, Homo sapiens
cactgcatggctcccacag

SEQ ID NO: 2899038 - DNA, 12 bp, Homo sapiens
cactgccactgg

SEQ ID NO: 2899039 - DNA, 22 bp, Homo sapiens
cactgccattacccagtgccga

SEQ ID NO: 2899040 - DNA, 17 bp, Homo sapiens
cactgcccatggacagg

SEQ ID NO: 2899041 - DNA, 22 bp, Homo sapiens
cactgcccatggcatgtctttg

SEQ ID NO: 2899042 - DNA, 16 bp, Homo sapiens
cactgccccaggactg

SEQ ID NO: 2899043 - DNA, 12 bp, Homo sapiens
cactgcctcctc

SEQ ID NO: 2899044 - DNA, 13 bp, Homo sapiens
cactgcctcctcc

SEQ ID NO: 2899045 - DNA, 23 bp, Homo sapiens
cactgcctcctccctggctgcag

SEQ ID NO: 2899046 - DNA, 11 bp, Homo sapiens
cactgcctggg

SEQ ID NO: 2899047 - DNA, 18 bp, Homo sapiens
cactggcagactgtgtaa

SEQ ID NO: 2899048 - DNA, 19 bp, Homo sapiens
cactggcagactgtgtaaa

SEQ ID NO: 2899049 - DNA, 21 bp, Homo sapiens
cactggcagactgtgtaaaat

SEQ ID NO: 2899050 - DNA, 13 bp, Homo sapiens
cactggcagcccc

SEQ ID NO: 2899051 - DNA, 14 bp, Homo sapiens
cactggcagcccca

SEQ ID NO: 2899052 - DNA, 13 bp, Homo sapiens
cactggcagcctg

SEQ ID NO: 2899053 - DNA, 15 bp, Homo sapiens
cactggcagcctgca

SEQ ID NO: 2899054 - DNA, 21 bp, Homo sapiens
cactggcataaatctgaagtg

SEQ ID NO: 2899055 - DNA, 21 bp, Homo sapiens
cactggcatttttagctcctt

SEQ ID NO: 2899056 - DNA, 17 bp, Homo sapiens
cactggcccctgagatc

SEQ ID NO: 2899057 - DNA, 19 bp, Homo sapiens
cactggcgaggtgcggcca

SEQ ID NO: 2899058 - DNA, 22 bp, Homo sapiens
cactggcgccttctcggagctg

SEQ ID NO: 2899059 - DNA, 23 bp, Homo sapiens
cactgggaagctggagtgctgct

SEQ ID NO: 2899060 - DNA, 11 bp, Homo sapiens
cactgggcccc

SEQ ID NO: 2899061 - DNA, 18 bp, Homo sapiens
cactgggcgtctgactcc

SEQ ID NO: 2899062 - DNA, 16 bp, Homo sapiens
cactggggattgggcc

SEQ ID NO: 2899063 - DNA, 17 bp, Homo sapiens
cactggggattgggccc

SEQ ID NO: 2899064 - DNA, 18 bp, Homo sapiens
cactggggattgggcccc

SEQ ID NO: 2899065 - DNA, 19 bp, Homo sapiens
cactggggtccagggagca

SEQ ID NO: 2899066 - DNA, 13 bp, Homo sapiens
cactgggtgccaa

SEQ ID NO: 2899067 - DNA, 17 bp, Homo sapiens
cactgggtggtggcctg

SEQ ID NO: 2899068 - DNA, 23 bp, Homo sapiens
cactggtctgggaagactgttgt

SEQ ID NO: 2899069 - DNA, 19 bp, Homo sapiens
cactggtggtttttgctct

SEQ ID NO: 2899070 - DNA, 21 bp, Homo sapiens
cactgtacaaatgacactgca

SEQ ID NO: 2899071 - DNA, 13 bp, Homo sapiens
cactgtacagttt

SEQ ID NO: 2899072 - DNA, 17 bp, Homo sapiens
cactgtaccatatagca

SEQ ID NO: 2899073 - DNA, 20 bp, Homo sapiens
cactgtaggtatagaagatc

SEQ ID NO: 2899074 - DNA, 16 bp, Homo sapiens
cactgtagttctaaga

SEQ ID NO: 2899075 - DNA, 20 bp, Homo sapiens
cactgtagttctaagactca

SEQ ID NO: 2899076 - DNA, 16 bp, Homo sapiens
cactgtcatgcttcat

SEQ ID NO: 2899077 - DNA, 13 bp, Homo sapiens
cactgtccaccac

SEQ ID NO: 2899078 - DNA, 14 bp, Homo sapiens
cactgtccctcctg

SEQ ID NO: 2899079 - DNA, 16 bp, Homo sapiens
cactgtccctcctggt

SEQ ID NO: 2899080 - DNA, 13 bp, Homo sapiens
cactgtctgagag

SEQ ID NO: 2899081 - DNA, 21 bp, Homo sapiens
cactgtctgtacctaaagcaa

SEQ ID NO: 2899082 - DNA, 22 bp, Homo sapiens
cactgtctgtacctaaagcaat

SEQ ID NO: 2899083 - DNA, 14 bp, Homo sapiens
cactgtcttttaaa

SEQ ID NO: 2899084 - DNA, 20 bp, Homo sapiens
cactgtcttttaaaaaacaa

SEQ ID NO: 2899085 - DNA, 12 bp, Homo sapiens
cactgtcttttt

SEQ ID NO: 2899086 - DNA, 13 bp, Homo sapiens
cactgtgaaggac

SEQ ID NO: 2899087 - DNA, 15 bp, Homo sapiens
cactgtgaaggaccc

SEQ ID NO: 2899088 - DNA, 17 bp, Homo sapiens
cactgtgaaggaccctt

SEQ ID NO: 2899089 - DNA, 18 bp, Homo sapiens
cactgtgaatcctggcaa

SEQ ID NO: 2899090 - DNA, 20 bp, Homo sapiens
cactgtgaatcctggcaaga

SEQ ID NO: 2899091 - DNA, 15 bp, Homo sapiens
cactgtgacacacta

SEQ ID NO: 2899092 - DNA, 14 bp, Homo sapiens
cactgtgaccccca

SEQ ID NO: 2899093 - DNA, 15 bp, Homo sapiens
cactgtgacccccag

SEQ ID NO: 2899094 - DNA, 22 bp, Homo sapiens
cactgtgacccccagctccggc

SEQ ID NO: 2899095 - DNA, 22 bp, Homo sapiens
cactgtgagctcccaggtgcag

SEQ ID NO: 2899096 - DNA, 16 bp, Homo sapiens
cactgtgctattacaa

SEQ ID NO: 2899097 - DNA, 16 bp, Homo sapiens
cactgtgctccaacct

SEQ ID NO: 2899098 - DNA, 18 bp, Homo sapiens
cactgtgctccaacctga

SEQ ID NO: 2899099 - DNA, 16 bp, Homo sapiens
cactgtggaagtccct

SEQ ID NO: 2899100 - DNA, 15 bp, Homo sapiens
cactgtggctgtctg

SEQ ID NO: 2899101 - DNA, 17 bp, Homo sapiens
cactgtgggaaggccag

SEQ ID NO: 2899102 - DNA, 15 bp, Homo sapiens
cactgtgggtgtgtg

SEQ ID NO: 2899103 - DNA, 19 bp, Homo sapiens
cactgtggtaaatgccaca

SEQ ID NO: 2899104 - DNA, 15 bp, Homo sapiens
cactgtgtctctatg

SEQ ID NO: 2899105 - DNA, 20 bp, Homo sapiens
cactgtgtctctatgtgaat

SEQ ID NO: 2899106 - DNA, 19 bp, Homo sapiens
cactgtgtttctgtgctcc

SEQ ID NO: 2899107 - DNA, 22 bp, Homo sapiens
cactgtgtttctgtgctccaag

SEQ ID NO: 2899108 - DNA, 16 bp, Homo sapiens
cactgttcatgctggc

SEQ ID NO: 2899109 - DNA, 19 bp, Homo sapiens
cactgttgagaccttgtgg

SEQ ID NO: 2899110 - DNA, 20 bp, Homo sapiens
cactgttgcagtggcctggc

SEQ ID NO: 2899111 - DNA, 15 bp, Homo sapiens
cactgtttgttttta

SEQ ID NO: 2899112 - DNA, 23 bp, Homo sapiens
cactgttttaaaagatcatagtt

SEQ ID NO: 2899113 - DNA, 14 bp, Homo sapiens
cactgtttttccat

SEQ ID NO: 2899114 - DNA, 11 bp, Homo sapiens
cacttaatatt

SEQ ID NO: 2899115 - DNA, 13 bp, Homo sapiens
cacttaatattag

SEQ ID NO: 2899116 - DNA, 20 bp, Homo sapiens
cacttaatattagcttgctt

SEQ ID NO: 2899117 - DNA, 20 bp, Homo sapiens
cacttaccgccctgcgggcc

SEQ ID NO: 2899118 - DNA, 23 bp, Homo sapiens
cacttaccgccctgcgggccaca

SEQ ID NO: 2899119 - DNA, 23 bp, Homo sapiens
cacttataaggtgttttctgtgt

SEQ ID NO: 2899120 - DNA, 20 bp, Homo sapiens
cacttatttatgaacctgcc

SEQ ID NO: 2899121 - DNA, 17 bp, Homo sapiens
cacttcaaggtgacaga

SEQ ID NO: 2899122 - DNA, 16 bp, Homo sapiens
cacttcattgagagtt

SEQ ID NO: 2899123 - DNA, 22 bp, Homo sapiens
cacttcattgagagttttgtct

SEQ ID NO: 2899124 - DNA, 12 bp, Homo sapiens
cacttccctgct

SEQ ID NO: 2899125 - DNA, 15 bp, Homo sapiens
cacttccctgctgcc

SEQ ID NO: 2899126 - DNA, 15 bp, Homo sapiens
cacttcctcccctcg

SEQ ID NO: 2899127 - DNA, 15 bp, Homo sapiens
cacttcctgttttaa

SEQ ID NO: 2899128 - DNA, 18 bp, Homo sapiens
cacttcctgttttaagca

SEQ ID NO: 2899129 - DNA, 18 bp, Homo sapiens
cacttcgaaattctgagt

SEQ ID NO: 2899130 - DNA, 17 bp, Homo sapiens
cacttcggccagagctg

SEQ ID NO: 2899131 - DNA, 17 bp, Homo sapiens
cacttctagatctcagc

SEQ ID NO: 2899132 - DNA, 20 bp, Homo sapiens
cacttctagatctcagccat

SEQ ID NO: 2899133 - DNA, 20 bp, Homo sapiens
cacttctagggtatgggaaa

SEQ ID NO: 2899134 - DNA, 15 bp, Homo sapiens
cacttctcaggaaat

SEQ ID NO: 2899135 - DNA, 16 bp, Homo sapiens
cacttctcatcacaca

SEQ ID NO: 2899136 - DNA, 14 bp, Homo sapiens
cacttctctgggtc

SEQ ID NO: 2899137 - DNA, 13 bp, Homo sapiens
cacttctggtccc

SEQ ID NO: 2899138 - DNA, 16 bp, Homo sapiens
cacttctgtcctgtga

SEQ ID NO: 2899139 - DNA, 13 bp, Homo sapiens
cacttctgtgcca

SEQ ID NO: 2899140 - DNA, 19 bp, Homo sapiens
cacttctttatactctctt

SEQ ID NO: 2899141 - DNA, 19 bp, Homo sapiens
cacttctttgcagagcctt

SEQ ID NO: 2899142 - DNA, 14 bp, Homo sapiens
cacttgatgtttcc

SEQ ID NO: 2899143 - DNA, 17 bp, Homo sapiens
cacttgatgtttcctgg

SEQ ID NO: 2899144 - DNA, 18 bp, Homo sapiens
cacttgatgtttcctgga

SEQ ID NO: 2899145 - DNA, 21 bp, Homo sapiens
cacttgatgtttcctggaagc

SEQ ID NO: 2899146 - DNA, 20 bp, Homo sapiens
cacttgcagaggagcccagt

SEQ ID NO: 2899147 - DNA, 23 bp, Homo sapiens
cacttgcagaggagcccagtggg

SEQ ID NO: 2899148 - DNA, 15 bp, Homo sapiens
cacttgccagggctc

SEQ ID NO: 2899149 - DNA, 18 bp, Homo sapiens
cacttgccagggctctgg

SEQ ID NO: 2899150 - DNA, 13 bp, Homo sapiens
cacttgccctgct

SEQ ID NO: 2899151 - DNA, 18 bp, Homo sapiens
cacttggagatctttgct

SEQ ID NO: 2899152 - DNA, 17 bp, Homo sapiens
cacttggccagttttct

SEQ ID NO: 2899153 - DNA, 19 bp, Homo sapiens
cacttggtaattgtactaa

SEQ ID NO: 2899154 - DNA, 20 bp, Homo sapiens
cacttggtcctacctattat

SEQ ID NO: 2899155 - DNA, 18 bp, Homo sapiens
cacttggtctgccaggcc

SEQ ID NO: 2899156 - DNA, 15 bp, Homo sapiens
cacttggtgctggga

SEQ ID NO: 2899157 - DNA, 21 bp, Homo sapiens
cacttgtatatacgcatctat

SEQ ID NO: 2899158 - DNA, 14 bp, Homo sapiens
cacttgtccagctg

SEQ ID NO: 2899159 - DNA, 15 bp, Homo sapiens
cacttgtccagctga

SEQ ID NO: 2899160 - DNA, 20 bp, Homo sapiens
cacttgtcccactatctggg

SEQ ID NO: 2899161 - DNA, 17 bp, Homo sapiens
cacttgtgattatttat

SEQ ID NO: 2899162 - DNA, 13 bp, Homo sapiens
cacttgtgccagc

SEQ ID NO: 2899163 - DNA, 14 bp, Homo sapiens
cacttgtgggtcct

SEQ ID NO: 2899164 - DNA, 20 bp, Homo sapiens
cactttagaaagccagcacc

SEQ ID NO: 2899165 - DNA, 17 bp, Homo sapiens
cagacagatgaggcttt

SEQ ID NO: 2899166 - DNA, 18 bp, Homo sapiens
cagacagatgaggctttc

SEQ ID NO: 2899167 - DNA, 21 bp, Homo sapiens
cagacagctccaccctggccg

SEQ ID NO: 2899168 - DNA, 15 bp, Homo sapiens
cagacagctgctcag

SEQ ID NO: 2899169 - DNA, 18 bp, Homo sapiens
cagacagctgctcagagc

SEQ ID NO: 2899170 - DNA, 23 bp, Homo sapiens
cagacagctgctcagagccaagg

SEQ ID NO: 2899171 - DNA, 13 bp, Homo sapiens
cagacaggagaaa

SEQ ID NO: 2899172 - DNA, 21 bp, Homo sapiens
cagacaggagaaatgcatcca

SEQ ID NO: 2899173 - DNA, 20 bp, Homo sapiens
cagacaggcggggcccagcg

SEQ ID NO: 2899174 - DNA, 16 bp, Homo sapiens
cagacaggtccctccc

SEQ ID NO: 2899175 - DNA, 21 bp, Homo sapiens
cagacaggttttcacataaat

SEQ ID NO: 2899176 - DNA, 20 bp, Homo sapiens
cagacagtcgctcagtctgt

SEQ ID NO: 2899177 - DNA, 18 bp, Homo sapiens
cagacagtgttttgcaca

SEQ ID NO: 2899178 - DNA, 17 bp, Homo sapiens
cagacagttcttttcta

SEQ ID NO: 2899179 - DNA, 18 bp, Homo sapiens
cagacatccttgcagttt

SEQ ID NO: 2899180 - DNA, 18 bp, Homo sapiens
cagacatgccacaaggac

SEQ ID NO: 2899181 - DNA, 23 bp, Homo sapiens
cagacatggtggcatgcacctgc

SEQ ID NO: 2899182 - DNA, 21 bp, Homo sapiens
cagacccagcccgcggcctgg

SEQ ID NO: 2899183 - DNA, 14 bp, Homo sapiens
cagaccccagcggc

SEQ ID NO: 2899184 - DNA, 15 bp, Homo sapiens
cagacccccagtgta

SEQ ID NO: 2899185 - DNA, 15 bp, Homo sapiens
cagaccccctggaga

SEQ ID NO: 2899186 - DNA, 16 bp, Homo sapiens
cagaccccgagccacc

SEQ ID NO: 2899187 - DNA, 12 bp, Homo sapiens
cagacctctgga

SEQ ID NO: 2899188 - DNA, 22 bp, Homo sapiens
cagacctgatcctggaggccca

SEQ ID NO: 2899189 - DNA, 18 bp, Homo sapiens
cagacctggaatgtaagt

SEQ ID NO: 2899190 - DNA, 19 bp, Homo sapiens
cagacctgttagcagacag

SEQ ID NO: 2899191 - DNA, 16 bp, Homo sapiens
cagacgcctgaggaac

SEQ ID NO: 2899192 - DNA, 14 bp, Homo sapiens
cagacgtctgcctt

SEQ ID NO: 2899193 - DNA, 19 bp, Homo sapiens
cagactcacaacctgaacc

SEQ ID NO: 2899194 - DNA, 14 bp, Homo sapiens
cagactcagacatt

SEQ ID NO: 2899195 - DNA, 14 bp, Homo sapiens
cagactcagctctg

SEQ ID NO: 2899196 - DNA, 20 bp, Homo sapiens
cagactcatcctgaacagca

SEQ ID NO: 2899197 - DNA, 16 bp, Homo sapiens
cagactcctgaggaca

SEQ ID NO: 2899198 - DNA, 22 bp, Homo sapiens
cagactcgattcatattgaata

SEQ ID NO: 2899199 - DNA, 22 bp, Homo sapiens
cagactcttccaccagagcagg

SEQ ID NO: 2899200 - DNA, 18 bp, Homo sapiens
cagactctttatgcttgc

SEQ ID NO: 2899201 - DNA, 19 bp, Homo sapiens
cagactctttatgcttgca

SEQ ID NO: 2899202 - DNA, 15 bp, Homo sapiens
cagactgagctctcc

SEQ ID NO: 2899203 - DNA, 16 bp, Homo sapiens
cagactgagctctcca

SEQ ID NO: 2899204 - DNA, 17 bp, Homo sapiens
cagactgagctctccag

SEQ ID NO: 2899205 - DNA, 18 bp, Homo sapiens
cagactgagctctccagg

SEQ ID NO: 2899206 - DNA, 20 bp, Homo sapiens
cagactgagctctccaggcc

SEQ ID NO: 2899207 - DNA, 21 bp, Homo sapiens
cagactgagctctccaggcca

SEQ ID NO: 2899208 - DNA, 14 bp, Homo sapiens
cagactgccccagc

SEQ ID NO: 2899209 - DNA, 22 bp, Homo sapiens
cagactgccccagccaacgaga

SEQ ID NO: 2899210 - DNA, 20 bp, Homo sapiens
cagactggaggtcgaagcaa

SEQ ID NO: 2899211 - DNA, 21 bp, Homo sapiens
cagactggaggtcgaagcaat

SEQ ID NO: 2899212 - DNA, 17 bp, Homo sapiens
cagactgggcccaggca

SEQ ID NO: 2899213 - DNA, 15 bp, Homo sapiens
cagacttcacactgc

SEQ ID NO: 2899214 - DNA, 12 bp, Homo sapiens
cagacttcccac

SEQ ID NO: 2899215 - DNA, 14 bp, Homo sapiens
cagacttcccagct

SEQ ID NO: 2899216 - DNA, 15 bp, Homo sapiens
cagacttcccagcta

SEQ ID NO: 2899217 - DNA, 20 bp, Homo sapiens
cagacttgccatgtgactct

SEQ ID NO: 2899218 - DNA, 14 bp, Homo sapiens
cagacttggctcag

SEQ ID NO: 2899219 - DNA, 19 bp, Homo sapiens
cagactttggaaaatgcat

SEQ ID NO: 2899220 - DNA, 15 bp, Homo sapiens
cagagaaaacacttt

SEQ ID NO: 2899221 - DNA, 22 bp, Homo sapiens
cagagaaaacactttcctggat

SEQ ID NO: 2899222 - DNA, 22 bp, Homo sapiens
cagagaaaatgagaaaggacag

SEQ ID NO: 2899223 - DNA, 23 bp, Homo sapiens
cagagaaaatgagaaaggacaga

SEQ ID NO: 2899224 - DNA, 15 bp, Homo sapiens
cagagaaagcacaat

SEQ ID NO: 2899225 - DNA, 20 bp, Homo sapiens
cagagaaagttggtgctgct

SEQ ID NO: 2899226 - DNA, 23 bp, Homo sapiens
cagagaagctataaattcctctt

SEQ ID NO: 2899227 - DNA, 13 bp, Homo sapiens
cagagaaggcagg

SEQ ID NO: 2899228 - DNA, 14 bp, Homo sapiens
cagagaaggcagga

SEQ ID NO: 2899229 - DNA, 20 bp, Homo sapiens
cagagaaggcaggaatgtgt

SEQ ID NO: 2899230 - DNA, 11 bp, Homo sapiens
cagagaagggc

SEQ ID NO: 2899231 - DNA, 21 bp, Homo sapiens
cagagaagggctcctgcaggc

SEQ ID NO: 2899232 - DNA, 18 bp, Homo sapiens
cagagaagtgacagggaa

SEQ ID NO: 2899233 - DNA, 19 bp, Homo sapiens
cagagaagtgacagggaag

SEQ ID NO: 2899234 - DNA, 21 bp, Homo sapiens
cagagaagtgacagggaagct

SEQ ID NO: 2899235 - DNA, 22 bp, Homo sapiens
cagagaatataacatgaaatga

SEQ ID NO: 2899236 - DNA, 16 bp, Homo sapiens
cagagaatatgtctgc

SEQ ID NO: 2899237 - DNA, 13 bp, Homo sapiens
cagagacacctgc

SEQ ID NO: 2899238 - DNA, 17 bp, Homo sapiens
cagagacacctgcacct

SEQ ID NO: 2899239 - DNA, 16 bp, Homo sapiens
cagagacatacttgaa

SEQ ID NO: 2899240 - DNA, 17 bp, Homo sapiens
cagagacatacttgaag

SEQ ID NO: 2899241 - DNA, 20 bp, Homo sapiens
cagagacatacttgaagggc

SEQ ID NO: 2899242 - DNA, 23 bp, Homo sapiens
cagagacatacttgaagggccag

SEQ ID NO: 2899243 - DNA, 22 bp, Homo sapiens
cagagacatgtggcagcaggca

SEQ ID NO: 2899244 - DNA, 17 bp, Homo sapiens
cagagacctccctgttc

SEQ ID NO: 2899245 - DNA, 18 bp, Homo sapiens
cagagacctttgcccaca

SEQ ID NO: 2899246 - DNA, 20 bp, Homo sapiens
cagagagtacactgtgtctc

SEQ ID NO: 2899247 - DNA, 22 bp, Homo sapiens
cagagataaataaaagatagca

SEQ ID NO: 2899248 - DNA, 22 bp, Homo sapiens
cagagatagtggggagacttct

SEQ ID NO: 2899249 - DNA, 17 bp, Homo sapiens
cagagatatctatgaaa

SEQ ID NO: 2899250 - DNA, 21 bp, Homo sapiens
cagagatccaaaagaagcccc

SEQ ID NO: 2899251 - DNA, 23 bp, Homo sapiens
cagagatccaaaagaagccccca

SEQ ID NO: 2899252 - DNA, 13 bp, Homo sapiens
cagagatgcctcc

SEQ ID NO: 2899253 - DNA, 15 bp, Homo sapiens
cagagatgcctccac

SEQ ID NO: 2899254 - DNA, 23 bp, Homo sapiens
cagagattgtagtatttagtata

SEQ ID NO: 2899255 - DNA, 21 bp, Homo sapiens
cagagcaaaaatgtaaaaaac

SEQ ID NO: 2899256 - DNA, 22 bp, Homo sapiens
cagagcaaaaatgtaaaaaaca

SEQ ID NO: 2899257 - DNA, 23 bp, Homo sapiens
cagagcaaaaatgtaaaaaacaa

SEQ ID NO: 2899258 - DNA, 16 bp, Homo sapiens
cagagcaaagcgccca

SEQ ID NO: 2899259 - DNA, 12 bp, Homo sapiens
cagagcacgcct

SEQ ID NO: 2899260 - DNA, 17 bp, Homo sapiens
cagagcacgcctgccat

SEQ ID NO: 2899261 - DNA, 19 bp, Homo sapiens
cagagcagctaactccgag

SEQ ID NO: 2899262 - DNA, 17 bp, Homo sapiens
cagagcaggggctgctg

SEQ ID NO: 2899263 - DNA, 20 bp, Homo sapiens
cagagcaggggctgctgggg

SEQ ID NO: 2899264 - DNA, 21 bp, Homo sapiens
cagagcagtgggcctggccag

SEQ ID NO: 2899265 - DNA, 20 bp, Homo sapiens
cagagccaaggggcttcagg

SEQ ID NO: 2899266 - DNA, 13 bp, Homo sapiens
cagagccacacat

SEQ ID NO: 2899267 - DNA, 23 bp, Homo sapiens
cagagccaggggggtgaggagct

SEQ ID NO: 2899268 - DNA, 11 bp, Homo sapiens
cagagcccagc

SEQ ID NO: 2899269 - DNA, 17 bp, Homo sapiens
cagagcccagcccagga

SEQ ID NO: 2899270 - DNA, 18 bp, Homo sapiens
cagagcccagcccaggag

SEQ ID NO: 2899271 - DNA, 14 bp, Homo sapiens
cagagcccagctcc

SEQ ID NO: 2899272 - DNA, 15 bp, Homo sapiens
cagagcccagctctt

SEQ ID NO: 2899273 - DNA, 16 bp, Homo sapiens
cagagcccaggggaga

SEQ ID NO: 2899274 - DNA, 18 bp, Homo sapiens
cagagccggcatccttgc

SEQ ID NO: 2899275 - DNA, 20 bp, Homo sapiens
cagagccggcatccttgcct

SEQ ID NO: 2899276 - DNA, 23 bp, Homo sapiens
cagagccggcatccttgcctgtc

SEQ ID NO: 2899277 - DNA, 19 bp, Homo sapiens
cagagccgtggtcctttgg

SEQ ID NO: 2899278 - DNA, 23 bp, Homo sapiens
cagagcctgtccccgccttccct

SEQ ID NO: 2899279 - DNA, 18 bp, Homo sapiens
cagagcgagactccatct

SEQ ID NO: 2899280 - DNA, 22 bp, Homo sapiens
cagagcgataatacactattat

SEQ ID NO: 2899281 - DNA, 14 bp, Homo sapiens
cagagctctgaccc

SEQ ID NO: 2899282 - DNA, 21 bp, Homo sapiens
cagagctctgacccacagcct

SEQ ID NO: 2899283 - DNA, 11 bp, Homo sapiens
cagagctgcct

SEQ ID NO: 2899284 - DNA, 12 bp, Homo sapiens
cagagctgcctc

SEQ ID NO: 2899285 - DNA, 15 bp, Homo sapiens
cagagctgcctcccc

SEQ ID NO: 2899286 - DNA, 16 bp, Homo sapiens
cagagctgcctcccca

SEQ ID NO: 2899287 - DNA, 17 bp, Homo sapiens
cagagctgcctccccaa

SEQ ID NO: 2899288 - DNA, 19 bp, Homo sapiens
cagagctgcctccccaatc

SEQ ID NO: 2899289 - DNA, 20 bp, Homo sapiens
cagagctgcctccccaatcc

SEQ ID NO: 2899290 - DNA, 10 bp, Homo sapiens
cagagctgcg

SEQ ID NO: 2899291 - DNA, 13 bp, Homo sapiens
cagagctgcttct

SEQ ID NO: 2899292 - DNA, 13 bp, Homo sapiens
cagagcttccctg

SEQ ID NO: 2899293 - DNA, 17 bp, Homo sapiens
cagagctttggtctgtg

SEQ ID NO: 2899294 - DNA, 24 bp, Homo sapiens
cagagcttttcgaactgtgctccc

SEQ ID NO: 2899295 - DNA, 18 bp, Homo sapiens
cagaggaaggggccagag

SEQ ID NO: 2899296 - DNA, 16 bp, Homo sapiens
caggatagagactgga

SEQ ID NO: 2899297 - DNA, 20 bp, Homo sapiens
caggatcagattgcatgtga

SEQ ID NO: 2899298 - DNA, 23 bp, Homo sapiens
caggatcagattgcatgtgactc

SEQ ID NO: 2899299 - DNA, 12 bp, Homo sapiens
caggatcagcca

SEQ ID NO: 2899300 - DNA, 18 bp, Homo sapiens
caggatcatcatttaaaa

SEQ ID NO: 2899301 - DNA, 19 bp, Homo sapiens
caggatgaccacgcacctc

SEQ ID NO: 2899302 - DNA, 14 bp, Homo sapiens
caggatgaggacag

SEQ ID NO: 2899303 - DNA, 15 bp, Homo sapiens
caggatgtgtttgct

SEQ ID NO: 2899304 - DNA, 18 bp, Homo sapiens
caggatgtgtttgctttc

SEQ ID NO: 2899305 - DNA, 21 bp, Homo sapiens
caggatttatacatacagaga

SEQ ID NO: 2899306 - DNA, 14 bp, Homo sapiens
caggatttgcacag

SEQ ID NO: 2899307 - DNA, 17 bp, Homo sapiens
caggatttgctgggaga

SEQ ID NO: 2899308 - DNA, 17 bp, Homo sapiens
caggatttggttgttta

SEQ ID NO: 2899309 - DNA, 11 bp, Homo sapiens
caggattttta

SEQ ID NO: 2899310 - DNA, 21 bp, Homo sapiens
caggcaataatattttctgtg

SEQ ID NO: 2899311 - DNA, 24 bp, Homo sapiens
caggcaattctcctgcctttgcct

SEQ ID NO: 2899312 - DNA, 13 bp, Homo sapiens
caggcacacagct

SEQ ID NO: 2899313 - DNA, 13 bp, Homo sapiens
caggcacaggtca

SEQ ID NO: 2899314 - DNA, 16 bp, Homo sapiens
caggcacgaacccacc

SEQ ID NO: 2899315 - DNA, 19 bp, Homo sapiens
caggcacgaacccacctgc

SEQ ID NO: 2899316 - DNA, 20 bp, Homo sapiens
caggcacgaacccacctgct

SEQ ID NO: 2899317 - DNA, 19 bp, Homo sapiens
caggcactctcctgtctga

SEQ ID NO: 2899318 - DNA, 20 bp, Homo sapiens
caggcactgagaatgatagt

SEQ ID NO: 2899319 - DNA, 21 bp, Homo sapiens
caggcactgcaaaccgccacc

SEQ ID NO: 2899320 - DNA, 19 bp, Homo sapiens
caggcagagctgagggccc

SEQ ID NO: 2899321 - DNA, 18 bp, Homo sapiens
caggcagataactgctgt

SEQ ID NO: 2899322 - DNA, 14 bp, Homo sapiens
caggcagatccagg

SEQ ID NO: 2899323 - DNA, 14 bp, Homo sapiens
caggcagcactgac

SEQ ID NO: 2899324 - DNA, 13 bp, Homo sapiens
caggcagcctgga

SEQ ID NO: 2899325 - DNA, 18 bp, Homo sapiens
caggcagcgcctgtcccc

SEQ ID NO: 2899326 - DNA, 20 bp, Homo sapiens
caggcagcgcctgtcccctc

SEQ ID NO: 2899327 - DNA, 21 bp, Homo sapiens
caggcagcgcctgtcccctca

SEQ ID NO: 2899328 - DNA, 22 bp, Homo sapiens
caggcagcgcctgtcccctcac

SEQ ID NO: 2899329 - DNA, 18 bp, Homo sapiens
caggcaggctcccaggga

SEQ ID NO: 2899330 - DNA, 17 bp, Homo sapiens
caggcagggctgactct

SEQ ID NO: 2899331 - DNA, 23 bp, Homo sapiens
caggcagggctgactctaggtgc

SEQ ID NO: 2899332 - DNA, 18 bp, Homo sapiens
caggcaggggtgagagca

SEQ ID NO: 2899333 - DNA, 15 bp, Homo sapiens
caggcagggtgcagt

SEQ ID NO: 2899334 - DNA, 19 bp, Homo sapiens
caggcaggtctgcaagggc

SEQ ID NO: 2899335 - DNA, 17 bp, Homo sapiens
caggcagtgtcttaagg

SEQ ID NO: 2899336 - DNA, 17 bp, Homo sapiens
caggcatggacatgcag

SEQ ID NO: 2899337 - DNA, 17 bp, Homo sapiens
caggcatggctggtgcc

SEQ ID NO: 2899338 - DNA, 18 bp, Homo sapiens
caggcatggctggtgcct

SEQ ID NO: 2899339 - DNA, 17 bp, Homo sapiens
caggccaagaaacgtct

SEQ ID NO: 2899340 - DNA, 13 bp, Homo sapiens
caggccagagcca

SEQ ID NO: 2899341 - DNA, 14 bp, Homo sapiens
caggccagggctcc

SEQ ID NO: 2899342 - DNA, 13 bp, Homo sapiens
caggccagggctg

SEQ ID NO: 2899343 - DNA, 14 bp, Homo sapiens
caggccagggctgg

SEQ ID NO: 2899344 - DNA, 13 bp, Homo sapiens
caggccaggtggg

SEQ ID NO: 2899345 - DNA, 15 bp, Homo sapiens
caggccaggtgggcg

SEQ ID NO: 2899346 - DNA, 16 bp, Homo sapiens
caggccatgtggcctg

SEQ ID NO: 2899347 - DNA, 21 bp, Homo sapiens
caggccatgtggcctgcccag

SEQ ID NO: 2899348 - DNA, 16 bp, Homo sapiens
caggcccaaggctccc

SEQ ID NO: 2899349 - DNA, 17 bp, Homo sapiens
caggcccaaggctcccg

SEQ ID NO: 2899350 - DNA, 22 bp, Homo sapiens
caggcccaccggatgctgtgcc

SEQ ID NO: 2899351 - DNA, 14 bp, Homo sapiens
caggcccactcagg

SEQ ID NO: 2899352 - DNA, 16 bp, Homo sapiens
caggccccaggaagcc

SEQ ID NO: 2899353 - DNA, 17 bp, Homo sapiens
caggccccaggaagccg

SEQ ID NO: 2899354 - DNA, 13 bp, Homo sapiens
caggcccccacca

SEQ ID NO: 2899355 - DNA, 16 bp, Homo sapiens
caggcccccaccacac

SEQ ID NO: 2899356 - DNA, 17 bp, Homo sapiens
caggcccccaccacaca

SEQ ID NO: 2899357 - DNA, 22 bp, Homo sapiens
caggcccccaccacacatccca

SEQ ID NO: 2899358 - DNA, 23 bp, Homo sapiens
caggcccccaccacacatcccag

SEQ ID NO: 2899359 - DNA, 14 bp, Homo sapiens
caggccccctagga

SEQ ID NO: 2899360 - DNA, 17 bp, Homo sapiens
caggccccgcttgtcca

SEQ ID NO: 2899361 - DNA, 18 bp, Homo sapiens
caggccccgcttgtccag

SEQ ID NO: 2899362 - DNA, 21 bp, Homo sapiens
caggccccgtgaggcaatggg

SEQ ID NO: 2899363 - DNA, 12 bp, Homo sapiens
caggcccctctc

SEQ ID NO: 2899364 - DNA, 14 bp, Homo sapiens
caggcccctgggtt

SEQ ID NO: 2899365 - DNA, 15 bp, Homo sapiens
caggcccctgggttt

SEQ ID NO: 2899366 - DNA, 19 bp, Homo sapiens
caggcccggcgcggtggct

SEQ ID NO: 2899367 - DNA, 14 bp, Homo sapiens
caggcccggggctg

SEQ ID NO: 2899368 - DNA, 16 bp, Homo sapiens
caggcccgtcggagct

SEQ ID NO: 2899369 - DNA, 22 bp, Homo sapiens
caggcccgtcggagctgcctgc

SEQ ID NO: 2899370 - DNA, 23 bp, Homo sapiens
caggcccgtcggagctgcctgca

SEQ ID NO: 2899371 - DNA, 19 bp, Homo sapiens
caggcccgtctgtccatct

SEQ ID NO: 2899372 - DNA, 21 bp, Homo sapiens
caggcccgtctgtccatctgc

SEQ ID NO: 2899373 - DNA, 22 bp, Homo sapiens
caggcccgtctgtccatctgcc

SEQ ID NO: 2899374 - DNA, 15 bp, Homo sapiens
caggccctcagctgt

SEQ ID NO: 2899375 - DNA, 18 bp, Homo sapiens
caggccctcagctgtcgg

SEQ ID NO: 2899376 - DNA, 13 bp, Homo sapiens
caggccctcccac

SEQ ID NO: 2899377 - DNA, 20 bp, Homo sapiens
caggccctcccaccacccca

SEQ ID NO: 2899378 - DNA, 21 bp, Homo sapiens
caggccctcccaccaccccat

SEQ ID NO: 2899379 - DNA, 13 bp, Homo sapiens
caggccctctgcc

SEQ ID NO: 2899380 - DNA, 13 bp, Homo sapiens
cagggcagcgcca

SEQ ID NO: 2899381 - DNA, 14 bp, Homo sapiens
cagggcagcgccag

SEQ ID NO: 2899382 - DNA, 17 bp, Homo sapiens
cagggcagctgcctggc

SEQ ID NO: 2899383 - DNA, 18 bp, Homo sapiens
cagggcagctgcctggcc

SEQ ID NO: 2899384 - DNA, 20 bp, Homo sapiens
cagggcagctgcctggccat

SEQ ID NO: 2899385 - DNA, 21 bp, Homo sapiens
cagggcagctgcctggccatg

SEQ ID NO: 2899386 - DNA, 13 bp, Homo sapiens
cagggcagggccc

SEQ ID NO: 2899387 - DNA, 12 bp, Homo sapiens
cagggcagtggc

SEQ ID NO: 2899388 - DNA, 23 bp, Homo sapiens
cagggccacgctccagctgcccc

SEQ ID NO: 2899389 - DNA, 21 bp, Homo sapiens
cagggccagcaggcagcgcct

SEQ ID NO: 2899390 - DNA, 15 bp, Homo sapiens
cagggccaggaagga

SEQ ID NO: 2899391 - DNA, 16 bp, Homo sapiens
cagggccatggctcag

SEQ ID NO: 2899392 - DNA, 13 bp, Homo sapiens
cagggcccagagc

SEQ ID NO: 2899393 - DNA, 22 bp, Homo sapiens
cagggcccagagcccagctcca

SEQ ID NO: 2899394 - DNA, 16 bp, Homo sapiens
cagggcccaggccatg

SEQ ID NO: 2899395 - DNA, 20 bp, Homo sapiens
cagggcccaggccatgtggc

SEQ ID NO: 2899396 - DNA, 17 bp, Homo sapiens
cagggcccaggcctgga

SEQ ID NO: 2899397 - DNA, 15 bp, Homo sapiens
cagggcccccatctc

SEQ ID NO: 2899398 - DNA, 16 bp, Homo sapiens
cagggccgccagggag

SEQ ID NO: 2899399 - DNA, 21 bp, Homo sapiens
cagggcctagctgctacaaag

SEQ ID NO: 2899400 - DNA, 21 bp, Homo sapiens
cagggcctgagcctggccagc

SEQ ID NO: 2899401 - DNA, 11 bp, Homo sapiens
cagggcctggt

SEQ ID NO: 2899402 - DNA, 12 bp, Homo sapiens
cagggcctggtt

SEQ ID NO: 2899403 - DNA, 19 bp, Homo sapiens
cagggcctggttgaagaag

SEQ ID NO: 2899404 - DNA, 18 bp, Homo sapiens
cagggccttgcccagaga

SEQ ID NO: 2899405 - DNA, 11 bp, Homo sapiens
cagggcctttt

SEQ ID NO: 2899406 - DNA, 21 bp, Homo sapiens
cagggcgggcagagggctgga

SEQ ID NO: 2899407 - DNA, 20 bp, Homo sapiens
cagggcgggggggggggcgg

SEQ ID NO: 2899408 - DNA, 23 bp, Homo sapiens
cagggcgggggggggggcggtgt

SEQ ID NO: 2899409 - DNA, 17 bp, Homo sapiens
cagggctaagagctagc

SEQ ID NO: 2899410 - DNA, 14 bp, Homo sapiens
cagggctaccctga

SEQ ID NO: 2899411 - DNA, 18 bp, Homo sapiens
cagggctaccctgagctg

SEQ ID NO: 2899412 - DNA, 22 bp, Homo sapiens
cagggctaccctgagctgaggc

SEQ ID NO: 2899413 - DNA, 23 bp, Homo sapiens
cagggctaccctgagctgaggca

SEQ ID NO: 2899414 - DNA, 24 bp, Homo sapiens
cagggctaccctgagctgaggcag

SEQ ID NO: 2899415 - DNA, 13 bp, Homo sapiens
cagggctcctggg

SEQ ID NO: 2899416 - DNA, 16 bp, Homo sapiens
cagggctcctgtggca

SEQ ID NO: 2899417 - DNA, 15 bp, Homo sapiens
cagggctctgggggc

SEQ ID NO: 2899418 - DNA, 18 bp, Homo sapiens
cagggctctgggggcaga

SEQ ID NO: 2899419 - DNA, 21 bp, Homo sapiens
cagggctctgggggcagattt

SEQ ID NO: 2899420 - DNA, 16 bp, Homo sapiens
cagggctgggtcacag

SEQ ID NO: 2899421 - DNA, 22 bp, Homo sapiens
cagggctgggtcacaggaagga

SEQ ID NO: 2899422 - DNA, 12 bp, Homo sapiens
cagggctggttt

SEQ ID NO: 2899423 - DNA, 14 bp, Homo sapiens
cagggctggtttgt

SEQ ID NO: 2899424 - DNA, 18 bp, Homo sapiens
caggggaagctgctaggg

SEQ ID NO: 2899425 - DNA, 21 bp, Homo sapiens
caggggacaagggaggcagtg

SEQ ID NO: 2899426 - DNA, 22 bp, Homo sapiens
caggggacactggccccacagg

SEQ ID NO: 2899427 - DNA, 12 bp, Homo sapiens
caggggaccaga

SEQ ID NO: 2899428 - DNA, 12 bp, Homo sapiens
caggggactggg

SEQ ID NO: 2899429 - DNA, 17 bp, Homo sapiens
caggggagaatgcagcc

SEQ ID NO: 2899430 - DNA, 20 bp, Homo sapiens
caggggagaatgcagcccac

SEQ ID NO: 2899431 - DNA, 20 bp, Homo sapiens
caggggatggggtgggggga

SEQ ID NO: 2899432 - DNA, 21 bp, Homo sapiens
caggggatggggtggggggac

SEQ ID NO: 2899433 - DNA, 23 bp, Homo sapiens
caggggatgtttacctggtgctc

SEQ ID NO: 2899434 - DNA, 14 bp, Homo sapiens
caggggattttatt

SEQ ID NO: 2899435 - DNA, 22 bp, Homo sapiens
caggggcagccacaccactgcc

SEQ ID NO: 2899436 - DNA, 15 bp, Homo sapiens
caggggcaggaggga

SEQ ID NO: 2899437 - DNA, 17 bp, Homo sapiens
caggggcgggtggatca

SEQ ID NO: 2899438 - DNA, 18 bp, Homo sapiens
cagggggcaactgacatt

SEQ ID NO: 2899439 - DNA, 22 bp, Homo sapiens
caggggggtcggaagcctgtcc

SEQ ID NO: 2899440 - DNA, 21 bp, Homo sapiens
cagggggtggagagaccagcc

SEQ ID NO: 2899441 - DNA, 16 bp, Homo sapiens
caggggtaccaggcac

SEQ ID NO: 2899442 - DNA, 13 bp, Homo sapiens
cagaggagcccag

SEQ ID NO: 2899443 - DNA, 15 bp, Homo sapiens
cagaggagcccagcg

SEQ ID NO: 2899444 - DNA, 17 bp, Homo sapiens
cagaggagcccagtggg

SEQ ID NO: 2899445 - DNA, 19 bp, Homo sapiens
cagaggaggggacttgtag

SEQ ID NO: 2899446 - DNA, 13 bp, Homo sapiens
cagaggaggggcc

SEQ ID NO: 2899447 - DNA, 15 bp, Homo sapiens
cagaggatgagctct

SEQ ID NO: 2899448 - DNA, 17 bp, Homo sapiens
cagaggatgagctctac

SEQ ID NO: 2899449 - DNA, 19 bp, Homo sapiens
cagaggatgctctttccca

SEQ ID NO: 2899450 - DNA, 21 bp, Homo sapiens
cagaggattgctgccccatca

SEQ ID NO: 2899451 - DNA, 18 bp, Homo sapiens
cagaggccaacactgtgg

SEQ ID NO: 2899452 - DNA, 21 bp, Homo sapiens
cagaggcctcttttcctgaag

SEQ ID NO: 2899453 - DNA, 17 bp, Homo sapiens
cagaggcgcactgtgac

SEQ ID NO: 2899454 - DNA, 15 bp, Homo sapiens
cagaggcgtcccgca

SEQ ID NO: 2899455 - DNA, 13 bp, Homo sapiens
cagaggctggagg

SEQ ID NO: 2899456 - DNA, 17 bp, Homo sapiens
cagaggctggaggcagg

SEQ ID NO: 2899457 - DNA, 21 bp, Homo sapiens
cagaggctggaggcagggcct

SEQ ID NO: 2899458 - DNA, 21 bp, Homo sapiens
cagagggaccaaattgcttct

SEQ ID NO: 2899459 - DNA, 18 bp, Homo sapiens
cagagggatctaggtctt

SEQ ID NO: 2899460 - DNA, 12 bp, Homo sapiens
cagagggcacat

SEQ ID NO: 2899461 - DNA, 20 bp, Homo sapiens
cagagggcacatgaacagct

SEQ ID NO: 2899462 - DNA, 16 bp, Homo sapiens
cagagggcgctcctgt

SEQ ID NO: 2899463 - DNA, 15 bp, Homo sapiens
cagagggctggaggc

SEQ ID NO: 2899464 - DNA, 19 bp, Homo sapiens
cagagggctggaggcccag

SEQ ID NO: 2899465 - DNA, 20 bp, Homo sapiens
cagagggctggaggcccagg

SEQ ID NO: 2899466 - DNA, 17 bp, Homo sapiens
cagaggggagcagcggc

SEQ ID NO: 2899467 - DNA, 15 bp, Homo sapiens
cagagggtggctgga

SEQ ID NO: 2899468 - DNA, 19 bp, Homo sapiens
cagagggtgggtgttcata

SEQ ID NO: 2899469 - DNA, 17 bp, Homo sapiens
cagagggtgtcctgcac

SEQ ID NO: 2899470 - DNA, 13 bp, Homo sapiens
cagaggtaaaaaa

SEQ ID NO: 2899471 - DNA, 16 bp, Homo sapiens
cagaggtaaaaaaaag

SEQ ID NO: 2899472 - DNA, 17 bp, Homo sapiens
cagaggtaccctgggtg

SEQ ID NO: 2899473 - DNA, 13 bp, Homo sapiens
cagaggtctccca

SEQ ID NO: 2899474 - DNA, 14 bp, Homo sapiens
cagaggtgcttcac

SEQ ID NO: 2899475 - DNA, 21 bp, Homo sapiens
cagaggtgcttcaccctgagt

SEQ ID NO: 2899476 - DNA, 21 bp, Homo sapiens
cagaggttgtagtgagccaag

SEQ ID NO: 2899477 - DNA, 13 bp, Homo sapiens
cagagtaagacat

SEQ ID NO: 2899478 - DNA, 15 bp, Homo sapiens
cagagtaagacattg

SEQ ID NO: 2899479 - DNA, 13 bp, Homo sapiens
cagagtatcttta

SEQ ID NO: 2899480 - DNA, 19 bp, Homo sapiens
cagagtcacaagcctcgag

SEQ ID NO: 2899481 - DNA, 22 bp, Homo sapiens
cagagtcacaagcctcgaggtg

SEQ ID NO: 2899482 - DNA, 18 bp, Homo sapiens
cagagtccctgcctggac

SEQ ID NO: 2899483 - DNA, 15 bp, Homo sapiens
cagagtcggaacgga

SEQ ID NO: 2899484 - DNA, 18 bp, Homo sapiens
cagagtctataacagaaa

SEQ ID NO: 2899485 - DNA, 13 bp, Homo sapiens
cagagtctcgctc

SEQ ID NO: 2899486 - DNA, 11 bp, Homo sapiens
cagagtgaacc

SEQ ID NO: 2899487 - DNA, 23 bp, Homo sapiens
cagagtgacacccaagagggctg

SEQ ID NO: 2899488 - DNA, 15 bp, Homo sapiens
cagagtgagacccag

SEQ ID NO: 2899489 - DNA, 18 bp, Homo sapiens
cagagtgagaccctgtct

SEQ ID NO: 2899490 - DNA, 16 bp, Homo sapiens
cagagtgagactccat

SEQ ID NO: 2899491 - DNA, 22 bp, Homo sapiens
cagagtgcaagaagtctggcca

SEQ ID NO: 2899492 - DNA, 12 bp, Homo sapiens
cagagtggaggc

SEQ ID NO: 2899493 - DNA, 17 bp, Homo sapiens
cagagtggccacggccc

SEQ ID NO: 2899494 - DNA, 18 bp, Homo sapiens
cagagtggccacggccca

SEQ ID NO: 2899495 - DNA, 22 bp, Homo sapiens
cagagtggccacggcccaggga

SEQ ID NO: 2899496 - DNA, 19 bp, Homo sapiens
cagagtgtagccaggtccc

SEQ ID NO: 2899497 - DNA, 22 bp, Homo sapiens
cagagtgtccctttttgcaggg

SEQ ID NO: 2899498 - DNA, 18 bp, Homo sapiens
cagagtgtggactctggt

SEQ ID NO: 2899499 - DNA, 23 bp, Homo sapiens
cagagtgtggccttcggacaact

SEQ ID NO: 2899500 - DNA, 12 bp, Homo sapiens
cagagttaaaat

SEQ ID NO: 2899501 - DNA, 16 bp, Homo sapiens
cagagttaaaatgttt

SEQ ID NO: 2899502 - DNA, 19 bp, Homo sapiens
cagagttaaaatgtttact

SEQ ID NO: 2899503 - DNA, 20 bp, Homo sapiens
cagagttaaaatgtttactg

SEQ ID NO: 2899504 - DNA, 22 bp, Homo sapiens
cagagttaaaatgtttactgta

SEQ ID NO: 2899505 - DNA, 15 bp, Homo sapiens
cagagttaaagcata

SEQ ID NO: 2899506 - DNA, 21 bp, Homo sapiens
cagagttctatactgtaaagc

SEQ ID NO: 2899507 - DNA, 19 bp, Homo sapiens
cagagttctgtgaagagga

SEQ ID NO: 2899508 - DNA, 20 bp, Homo sapiens
cagagttgacatgagattta

SEQ ID NO: 2899509 - DNA, 13 bp, Homo sapiens
cagagtttggata

SEQ ID NO: 2899510 - DNA, 22 bp, Homo sapiens
cagagtttggttaatcagtgtt

SEQ ID NO: 2899511 - DNA, 22 bp, Homo sapiens
cagagtttgtgtgttgtcttga

SEQ ID NO: 2899512 - DNA, 19 bp, Homo sapiens
cagagttttttaaacaaat

SEQ ID NO: 2899513 - DNA, 14 bp, Homo sapiens
cagataactgctgt

SEQ ID NO: 2899514 - DNA, 15 bp, Homo sapiens
cagataatccctgta

SEQ ID NO: 2899515 - DNA, 16 bp, Homo sapiens
cagataatgtgaaaat

SEQ ID NO: 2899516 - DNA, 20 bp, Homo sapiens
cagatacgggggctgtgact

SEQ ID NO: 2899517 - DNA, 21 bp, Homo sapiens
cagatacgggggctgtgactc

SEQ ID NO: 2899518 - DNA, 14 bp, Homo sapiens
cagatactgctgtg

SEQ ID NO: 2899519 - DNA, 15 bp, Homo sapiens
cagatacttcagctt

SEQ ID NO: 2899520 - DNA, 16 bp, Homo sapiens
cagatagaaagcatta

SEQ ID NO: 2899521 - DNA, 12 bp, Homo sapiens
cagatatctttt

SEQ ID NO: 2899522 - DNA, 18 bp, Homo sapiens
cagatatgaacagggccc

SEQ ID NO: 2899523 - DNA, 20 bp, Homo sapiens
cagatattacagcttatttt

SEQ ID NO: 2899524 - DNA, 21 bp, Homo sapiens
cagatattccctcttgtcctt

SEQ ID NO: 2899525 - DNA, 15 bp, Homo sapiens
cagatcactcctgga

SEQ ID NO: 2899526 - DNA, 15 bp, Homo sapiens
cagatcatccagaag

SEQ ID NO: 2899527 - DNA, 20 bp, Homo sapiens
cagatcatctggggacctgg

SEQ ID NO: 2899528 - DNA, 13 bp, Homo sapiens
cagatccaaggcc

SEQ ID NO: 2899529 - DNA, 17 bp, Homo sapiens
cagatccagcctggggt

SEQ ID NO: 2899530 - DNA, 12 bp, Homo sapiens
cagatccaggac

SEQ ID NO: 2899531 - DNA, 23 bp, Homo sapiens
cagatccagggacagaggcccca

SEQ ID NO: 2899532 - DNA, 23 bp, Homo sapiens
cagatcctccatttttgttggga

SEQ ID NO: 2899533 - DNA, 16 bp, Homo sapiens
cagatccttgtttcaa

SEQ ID NO: 2899534 - DNA, 15 bp, Homo sapiens
cagatctcatgtcct

SEQ ID NO: 2899535 - DNA, 21 bp, Homo sapiens
cagatctgcaccaccatgccc

SEQ ID NO: 2899536 - DNA, 20 bp, Homo sapiens
cagatctggaacctcagcct

SEQ ID NO: 2899537 - DNA, 21 bp, Homo sapiens
cagatctggaacctcagcctg

SEQ ID NO: 2899538 - DNA, 23 bp, Homo sapiens
cagatctggaacctcagcctggc

SEQ ID NO: 2899539 - DNA, 14 bp, Homo sapiens
cagatcttggactc

SEQ ID NO: 2899540 - DNA, 22 bp, Homo sapiens
cagatcttggactcatgaggag

SEQ ID NO: 2899541 - DNA, 15 bp, Homo sapiens
cagatgaatgtattt

SEQ ID NO: 2899542 - DNA, 23 bp, Homo sapiens
cagatgactatgcagaggcctgg

SEQ ID NO: 2899543 - DNA, 18 bp, Homo sapiens
cagatgatgctttggaag

SEQ ID NO: 2899544 - DNA, 18 bp, Homo sapiens
cagatgcaaagaggcaag

SEQ ID NO: 2899545 - DNA, 17 bp, Homo sapiens
cagatgcagggcagtca

SEQ ID NO: 2899546 - DNA, 16 bp, Homo sapiens
cagatgcggggacagg

SEQ ID NO: 2899547 - DNA, 17 bp, Homo sapiens
cagatgcggggacaggc

SEQ ID NO: 2899548 - DNA, 20 bp, Homo sapiens
cagatgcgttcgcctctggc

SEQ ID NO: 2899549 - DNA, 13 bp, Homo sapiens
cagatgctcttgg

SEQ ID NO: 2899550 - DNA, 14 bp, Homo sapiens
cagatgctgagcca

SEQ ID NO: 2899551 - DNA, 17 bp, Homo sapiens
cagatgctgatgttcag

SEQ ID NO: 2899552 - DNA, 22 bp, Homo sapiens
cagatgctgatgttcagtgtaa

SEQ ID NO: 2899553 - DNA, 14 bp, Homo sapiens
cagatgctggcctc

SEQ ID NO: 2899554 - DNA, 15 bp, Homo sapiens
cagatgctggcctct

SEQ ID NO: 2899555 - DNA, 12 bp, Homo sapiens
cagatgcttctg

SEQ ID NO: 2899556 - DNA, 13 bp, Homo sapiens
cagatgcttctgg

SEQ ID NO: 2899557 - DNA, 17 bp, Homo sapiens
cagatgcttctgggaga

SEQ ID NO: 2899558 - DNA, 14 bp, Homo sapiens
cagatgctttcctg

SEQ ID NO: 2899559 - DNA, 14 bp, Homo sapiens
cagatggaaccgca

SEQ ID NO: 2899560 - DNA, 15 bp, Homo sapiens
cagatggacgcaggc

SEQ ID NO: 2899561 - DNA, 16 bp, Homo sapiens
cagatggacgcaggcc

SEQ ID NO: 2899562 - DNA, 18 bp, Homo sapiens
cagatggactccagcctg

SEQ ID NO: 2899563 - DNA, 15 bp, Homo sapiens
cagatggacttgaaa

SEQ ID NO: 2899564 - DNA, 16 bp, Homo sapiens
cagatggacttgaaaa

SEQ ID NO: 2899565 - DNA, 22 bp, Homo sapiens
cagatggccactgctcttgtga

SEQ ID NO: 2899566 - DNA, 14 bp, Homo sapiens
cagatgtaatgttt

SEQ ID NO: 2899567 - DNA, 15 bp, Homo sapiens
cagatgtaatgtttt

SEQ ID NO: 2899568 - DNA, 22 bp, Homo sapiens
cagtaggtgcccagaataagtt

SEQ ID NO: 2899569 - DNA, 15 bp, Homo sapiens
cagtagtaccttgtt

SEQ ID NO: 2899570 - DNA, 23 bp, Homo sapiens
cagtagtcttgatgaccaaagtc

SEQ ID NO: 2899571 - DNA, 23 bp, Homo sapiens
cagtataattgagttttcagtgg

SEQ ID NO: 2899572 - DNA, 19 bp, Homo sapiens
cagtatcaaggctgacttg

SEQ ID NO: 2899573 - DNA, 13 bp, Homo sapiens
cagtatcatgccc

SEQ ID NO: 2899574 - DNA, 19 bp, Homo sapiens
cagtatcatgccctgtgca

SEQ ID NO: 2899575 - DNA, 20 bp, Homo sapiens
cagtatcatgccctgtgcaa

SEQ ID NO: 2899576 - DNA, 18 bp, Homo sapiens
cagtatctatatatgtgt

SEQ ID NO: 2899577 - DNA, 22 bp, Homo sapiens
cagtatctatatatgtgtatgt

SEQ ID NO: 2899578 - DNA, 23 bp, Homo sapiens
cagtatctatatatgtgtatgta

SEQ ID NO: 2899579 - DNA, 16 bp, Homo sapiens
cagtatggtacatttt

SEQ ID NO: 2899580 - DNA, 18 bp, Homo sapiens
cagtatggtacatttttc

SEQ ID NO: 2899581 - DNA, 17 bp, Homo sapiens
cagtatgttttacactg

SEQ ID NO: 2899582 - DNA, 18 bp, Homo sapiens
cagtattaaactctcctt

SEQ ID NO: 2899583 - DNA, 19 bp, Homo sapiens
cagtattaaactctccttt

SEQ ID NO: 2899584 - DNA, 22 bp, Homo sapiens
cagtattactgctgctgtgctt

SEQ ID NO: 2899585 - DNA, 13 bp, Homo sapiens
cagtattttctgt

SEQ ID NO: 2899586 - DNA, 15 bp, Homo sapiens
cagtattttctgttt

SEQ ID NO: 2899587 - DNA, 23 bp, Homo sapiens
cagtattttctgtttttatgttt

SEQ ID NO: 2899588 - DNA, 16 bp, Homo sapiens
cagtcaacctgggcaa

SEQ ID NO: 2899589 - DNA, 13 bp, Homo sapiens
cagtcacagccac

SEQ ID NO: 2899590 - DNA, 14 bp, Homo sapiens
cagtcacagccacc

SEQ ID NO: 2899591 - DNA, 22 bp, Homo sapiens
cagtcactcagccatttctaag

SEQ ID NO: 2899592 - DNA, 22 bp, Homo sapiens
cagtcagctcttcatctgccca

SEQ ID NO: 2899593 - DNA, 12 bp, Homo sapiens
cagtcatcatct

SEQ ID NO: 2899594 - DNA, 23 bp, Homo sapiens
cagtcattatgagaggcaatgat

SEQ ID NO: 2899595 - DNA, 21 bp, Homo sapiens
cagtcattatttaaagcacat

SEQ ID NO: 2899596 - DNA, 22 bp, Homo sapiens
cagtcattgtaacctcgtgtct

SEQ ID NO: 2899597 - DNA, 21 bp, Homo sapiens
cagtccacagctgaagagcaa

SEQ ID NO: 2899598 - DNA, 10 bp, Homo sapiens
cagtccagag

SEQ ID NO: 2899599 - DNA, 12 bp, Homo sapiens
cagtccagagct

SEQ ID NO: 2899600 - DNA, 15 bp, Homo sapiens
cagtccagagctttt

SEQ ID NO: 2899601 - DNA, 18 bp, Homo sapiens
cagtccagagcttttcag

SEQ ID NO: 2899602 - DNA, 14 bp, Homo sapiens
cagtccatgctcca

SEQ ID NO: 2899603 - DNA, 16 bp, Homo sapiens
cagtcccaaatccttc

SEQ ID NO: 2899604 - DNA, 18 bp, Homo sapiens
cagtcccaaatccttccc

SEQ ID NO: 2899605 - DNA, 23 bp, Homo sapiens
cagtcccgggagaaaagacggat

SEQ ID NO: 2899606 - DNA, 14 bp, Homo sapiens
cagtcctaacaaat

SEQ ID NO: 2899607 - DNA, 17 bp, Homo sapiens
cagtcctgctggcctgc

SEQ ID NO: 2899608 - DNA, 18 bp, Homo sapiens
cagtcctgctggcctgct

SEQ ID NO: 2899609 - DNA, 19 bp, Homo sapiens
cagtcctggtctgctcagg

SEQ ID NO: 2899610 - DNA, 20 bp, Homo sapiens
cagtcctggtctgctcagga

SEQ ID NO: 2899611 - DNA, 16 bp, Homo sapiens
cagtccttaatgtcac

SEQ ID NO: 2899612 - DNA, 15 bp, Homo sapiens
cagtccttccacctc

SEQ ID NO: 2899613 - DNA, 12 bp, Homo sapiens
cagtcgccctgt

SEQ ID NO: 2899614 - DNA, 16 bp, Homo sapiens
cagtcgccctgttctt

SEQ ID NO: 2899615 - DNA, 16 bp, Homo sapiens
cagtcgcttgccaaag

SEQ ID NO: 2899616 - DNA, 18 bp, Homo sapiens
cagtcgcttgccaaagca

SEQ ID NO: 2899617 - DNA, 16 bp, Homo sapiens
cagtcggcatgccagg

SEQ ID NO: 2899618 - DNA, 15 bp, Homo sapiens
cagtcgggagagcca

SEQ ID NO: 2899619 - DNA, 19 bp, Homo sapiens
cagtctaagtaagtgtctg

SEQ ID NO: 2899620 - DNA, 18 bp, Homo sapiens
cagtctacttctgtgtct

SEQ ID NO: 2899621 - DNA, 21 bp, Homo sapiens
cagtctcaagaggcagagttc

SEQ ID NO: 2899622 - DNA, 15 bp, Homo sapiens
cagtctcaattttgt

SEQ ID NO: 2899623 - DNA, 17 bp, Homo sapiens
cagtctccgcctcctga

SEQ ID NO: 2899624 - DNA, 12 bp, Homo sapiens
cagtctctgagc

SEQ ID NO: 2899625 - DNA, 18 bp, Homo sapiens
cagtctctgccttgcctt

SEQ ID NO: 2899626 - DNA, 23 bp, Homo sapiens
cagtctctgctccacctttcagc

SEQ ID NO: 2899627 - DNA, 17 bp, Homo sapiens
cagtctgaagctcgcat

SEQ ID NO: 2899628 - DNA, 12 bp, Homo sapiens
cagtctgaccct

SEQ ID NO: 2899629 - DNA, 15 bp, Homo sapiens
cagtctgtattttcc

SEQ ID NO: 2899630 - DNA, 14 bp, Homo sapiens
cagtctgtcttctg

SEQ ID NO: 2899631 - DNA, 16 bp, Homo sapiens
cagtctgttcactgca

SEQ ID NO: 2899632 - DNA, 17 bp, Homo sapiens
cagtcttaatactttat

SEQ ID NO: 2899633 - DNA, 15 bp, Homo sapiens
cagtcttccatttgc

SEQ ID NO: 2899634 - DNA, 13 bp, Homo sapiens
cagtcttcctctt

SEQ ID NO: 2899635 - DNA, 19 bp, Homo sapiens
cagtcttcctcttagcctc

SEQ ID NO: 2899636 - DNA, 20 bp, Homo sapiens
cagtcttcctcttagcctct

SEQ ID NO: 2899637 - DNA, 11 bp, Homo sapiens
cagtcttgctc

SEQ ID NO: 2899638 - DNA, 16 bp, Homo sapiens
cagtcttggctcactg

SEQ ID NO: 2899639 - DNA, 18 bp, Homo sapiens
cagtctttcatgtgtgcc

SEQ ID NO: 2899640 - DNA, 15 bp, Homo sapiens
cagtctttcccccag

SEQ ID NO: 2899641 - DNA, 14 bp, Homo sapiens
cagtgaaacacttg

SEQ ID NO: 2899642 - DNA, 20 bp, Homo sapiens
cagtgaaagtcaattcagtg

SEQ ID NO: 2899643 - DNA, 16 bp, Homo sapiens
cagtgaacagtttgga

SEQ ID NO: 2899644 - DNA, 14 bp, Homo sapiens
cagtgaagacagaa

SEQ ID NO: 2899645 - DNA, 20 bp, Homo sapiens
cagtgaagacgtcaggggca

SEQ ID NO: 2899646 - DNA, 15 bp, Homo sapiens
cagtgaagatgcagg

SEQ ID NO: 2899647 - DNA, 17 bp, Homo sapiens
cagtgaatgattcagtg

SEQ ID NO: 2899648 - DNA, 17 bp, Homo sapiens
cagtgaatttttgcaat

SEQ ID NO: 2899649 - DNA, 19 bp, Homo sapiens
cagtgaatttttgcaataa

SEQ ID NO: 2899650 - DNA, 20 bp, Homo sapiens
cagtgaatttttgcaataat

SEQ ID NO: 2899651 - DNA, 16 bp, Homo sapiens
cagtgacactggacca

SEQ ID NO: 2899652 - DNA, 21 bp, Homo sapiens
cagtgacactggaccaggtcc

SEQ ID NO: 2899653 - DNA, 12 bp, Homo sapiens
cagtgacagcta

SEQ ID NO: 2899654 - DNA, 14 bp, Homo sapiens
cagtgacctgagga

SEQ ID NO: 2899655 - DNA, 19 bp, Homo sapiens
cagtgacctgaggaagcgt

SEQ ID NO: 2899656 - DNA, 20 bp, Homo sapiens
cagtgacgtgactcagagct

SEQ ID NO: 2899657 - DNA, 21 bp, Homo sapiens
cagtgacgtgactcagagctt

SEQ ID NO: 2899658 - DNA, 18 bp, Homo sapiens
cagtgactgaaaccattt

SEQ ID NO: 2899659 - DNA, 13 bp, Homo sapiens
cagtgagctgaga

SEQ ID NO: 2899660 - DNA, 15 bp, Homo sapiens
cagtgagctgagatc

SEQ ID NO: 2899661 - DNA, 21 bp, Homo sapiens
cagtgagggagggctgtcatc

SEQ ID NO: 2899662 - DNA, 21 bp, Homo sapiens
cagtgagtggccccacctgtg

SEQ ID NO: 2899663 - DNA, 23 bp, Homo sapiens
cagtgatatggtactaaggagaa

SEQ ID NO: 2899664 - DNA, 14 bp, Homo sapiens
cagtgatgatgcat

SEQ ID NO: 2899665 - DNA, 16 bp, Homo sapiens
cagtgatgatgcatgg

SEQ ID NO: 2899666 - DNA, 21 bp, Homo sapiens
cagtgatgatgcatggaggac

SEQ ID NO: 2899667 - DNA, 24 bp, Homo sapiens
cagtgatgcctgcccgcaccctgg

SEQ ID NO: 2899668 - DNA, 18 bp, Homo sapiens
cagtgatgctggatgctc

SEQ ID NO: 2899669 - DNA, 13 bp, Homo sapiens
cagtgcaaaatgt

SEQ ID NO: 2899670 - DNA, 14 bp, Homo sapiens
cagtgcaaaatgtc

SEQ ID NO: 2899671 - DNA, 15 bp, Homo sapiens
cagtgcaaaatgtct

SEQ ID NO: 2899672 - DNA, 17 bp, Homo sapiens
cagtgcaaaatgtcttg

SEQ ID NO: 2899673 - DNA, 19 bp, Homo sapiens
cagtgcaaaatgtcttgtg

SEQ ID NO: 2899674 - DNA, 15 bp, Homo sapiens
cagtgcaacctctgc

SEQ ID NO: 2899675 - DNA, 19 bp, Homo sapiens
cagtgcaacctctgcttcc

SEQ ID NO: 2899676 - DNA, 22 bp, Homo sapiens
cagtgcaggctggccagccgct

SEQ ID NO: 2899677 - DNA, 22 bp, Homo sapiens
cagtgcagtttctaagcatgta

SEQ ID NO: 2899678 - DNA, 22 bp, Homo sapiens
cagtgcatccccacgacccctg

SEQ ID NO: 2899679 - DNA, 22 bp, Homo sapiens
cagtgcatgacgtttaaggcca

SEQ ID NO: 2899680 - DNA, 18 bp, Homo sapiens
cagtgcatggtggccaga

SEQ ID NO: 2899681 - DNA, 21 bp, Homo sapiens
cagtgcatggtggccagaggt

SEQ ID NO: 2899682 - DNA, 11 bp, Homo sapiens
cagtgccaact

SEQ ID NO: 2899683 - DNA, 19 bp, Homo sapiens
cagtgccaactgtggctgg

SEQ ID NO: 2899684 - DNA, 23 bp, Homo sapiens
cagtgccagcccctgctggctgg

SEQ ID NO: 2899685 - DNA, 16 bp, Homo sapiens
cagtgccagctccctc

SEQ ID NO: 2899686 - DNA, 12 bp, Homo sapiens
cagtgcccccac

SEQ ID NO: 2899687 - DNA, 20 bp, Homo sapiens
cagtgcccccactgaccaga

SEQ ID NO: 2899688 - DNA, 22 bp, Homo sapiens
cagtgcccccactgaccagaac

SEQ ID NO: 2899689 - DNA, 17 bp, Homo sapiens
cagtgccttacctcctg

SEQ ID NO: 2899690 - DNA, 19 bp, Homo sapiens
cagtgccttacctcctgcc

SEQ ID NO: 2899691 - DNA, 22 bp, Homo sapiens
cagtgccttacctcctgcccag

SEQ ID NO: 2899692 - DNA, 23 bp, Homo sapiens
cagtgccttacctcctgcccagg

SEQ ID NO: 2899693 - DNA, 13 bp, Homo sapiens
cagtgccttctct

SEQ ID NO: 2899694 - DNA, 18 bp, Homo sapiens
cagtgccttctctcagct

SEQ ID NO: 2899695 - DNA, 21 bp, Homo sapiens
cagtgccttctctcagctccc

SEQ ID NO: 2899696 - DNA, 16 bp, Homo sapiens
cagtgctaaaaatggg

SEQ ID NO: 2899697 - DNA, 20 bp, Homo sapiens
cagtgctaaaaatgggactt

SEQ ID NO: 2899698 - DNA, 22 bp, Homo sapiens
cagtgctaaaaatgggacttct

SEQ ID NO: 2899699 - DNA, 14 bp, Homo sapiens
cagtgctccctcac

SEQ ID NO: 2899700 - DNA, 15 bp, Homo sapiens
cagtgctctgcctct

SEQ ID NO: 2899701 - DNA, 13 bp, Homo sapiens
cagtgctgcccat

SEQ ID NO: 2899702 - DNA, 15 bp, Homo sapiens
cagtgctgcccatga

SEQ ID NO: 2899703 - DNA, 22 bp, Homo sapiens
cagtgctgctgaactaatttct

SEQ ID NO: 2899704 - DNA, 18 bp, Homo sapiens
cagtgtttctgaatgttt

SEQ ID NO: 2899705 - DNA, 15 bp, Homo sapiens
cagtgtttgtatacc

SEQ ID NO: 2899706 - DNA, 15 bp, Homo sapiens
cagtgtttttgtaaa

SEQ ID NO: 2899707 - DNA, 18 bp, Homo sapiens
cagtgttttttaggaaaa

SEQ ID NO: 2899708 - DNA, 19 bp, Homo sapiens
cagttaaaaaaaattttaa

SEQ ID NO: 2899709 - DNA, 23 bp, Homo sapiens
cagttaacgtcacccaaaagcac

SEQ ID NO: 2899710 - DNA, 13 bp, Homo sapiens
cagttaaggaaag

SEQ ID NO: 2899711 - DNA, 16 bp, Homo sapiens
cagttaagtattttga

SEQ ID NO: 2899712 - DNA, 13 bp, Homo sapiens
cagttacagaaag

SEQ ID NO: 2899713 - DNA, 22 bp, Homo sapiens
cagttacatgcatacttcaaaa

SEQ ID NO: 2899714 - DNA, 14 bp, Homo sapiens
cagttactcagccc

SEQ ID NO: 2899715 - DNA, 19 bp, Homo sapiens
cagttactcagccctgggc

SEQ ID NO: 2899716 - DNA, 15 bp, Homo sapiens
cagttactctgaagg

SEQ ID NO: 2899717 - DNA, 23 bp, Homo sapiens
cagttactgtgaatgttccccac

SEQ ID NO: 2899718 - DNA, 21 bp, Homo sapiens
cagttacttaagattcagttt

SEQ ID NO: 2899719 - DNA, 19 bp, Homo sapiens
cagttagttagaattggaa

SEQ ID NO: 2899720 - DNA, 21 bp, Homo sapiens
cagttagttagaattggaaat

SEQ ID NO: 2899721 - DNA, 16 bp, Homo sapiens
cagttatcctgcaagg

SEQ ID NO: 2899722 - DNA, 20 bp, Homo sapiens
cagttatcctgcaagggaca

SEQ ID NO: 2899723 - DNA, 16 bp, Homo sapiens
cagttatctaagttaa

SEQ ID NO: 2899724 - DNA, 18 bp, Homo sapiens
cagttattggtggaatct

SEQ ID NO: 2899725 - DNA, 20 bp, Homo sapiens
cagttattggtggaatcttt

SEQ ID NO: 2899726 - DNA, 21 bp, Homo sapiens
cagttcaaaattctaaatgta

SEQ ID NO: 2899727 - DNA, 23 bp, Homo sapiens
cagttcacttctttgcagagcct

SEQ ID NO: 2899728 - DNA, 14 bp, Homo sapiens
cagttcataaacaa

SEQ ID NO: 2899729 - DNA, 23 bp, Homo sapiens
cagttcataaatttgttgtcatg

SEQ ID NO: 2899730 - DNA, 17 bp, Homo sapiens
cagttcctcgccctggg

SEQ ID NO: 2899731 - DNA, 20 bp, Homo sapiens
cagttcgcctggagccctcc

SEQ ID NO: 2899732 - DNA, 22 bp, Homo sapiens
cagttcggtgagctacaaatgc

SEQ ID NO: 2899733 - DNA, 18 bp, Homo sapiens
cagttctagtttgcattc

SEQ ID NO: 2899734 - DNA, 19 bp, Homo sapiens
cagttctagtttgcattcc

SEQ ID NO: 2899735 - DNA, 14 bp, Homo sapiens
cagttctgaagaat

SEQ ID NO: 2899736 - DNA, 18 bp, Homo sapiens
cagttctgtcatatgtta

SEQ ID NO: 2899737 - DNA, 21 bp, Homo sapiens
cagttcttagattcaggggaa

SEQ ID NO: 2899738 - DNA, 21 bp, Homo sapiens
cagttcttcccccttcacata

SEQ ID NO: 2899739 - DNA, 16 bp, Homo sapiens
cagttctttgggccag

SEQ ID NO: 2899740 - DNA, 22 bp, Homo sapiens
cagttctttgggccagacatgc

SEQ ID NO: 2899741 - DNA, 19 bp, Homo sapiens
cagttgccgcttctggtta

SEQ ID NO: 2899742 - DNA, 15 bp, Homo sapiens
cagttgctaaacact

SEQ ID NO: 2899743 - DNA, 21 bp, Homo sapiens
cagttgctaaacactgcgctt

SEQ ID NO: 2899744 - DNA, 19 bp, Homo sapiens
cagttgcttcttcagctga

SEQ ID NO: 2899745 - DNA, 22 bp, Homo sapiens
cagttggagttttttgtaccaa

SEQ ID NO: 2899746 - DNA, 21 bp, Homo sapiens
cagttggccctttaatatttc

SEQ ID NO: 2899747 - DNA, 16 bp, Homo sapiens
cagttggccttcagaa

SEQ ID NO: 2899748 - DNA, 22 bp, Homo sapiens
cagttgggtttcacgagtgttc

SEQ ID NO: 2899749 - DNA, 23 bp, Homo sapiens
cagttgtagggttacagagacct

SEQ ID NO: 2899750 - DNA, 23 bp, Homo sapiens
cagttgtccagatcactgaattg

SEQ ID NO: 2899751 - DNA, 22 bp, Homo sapiens
cagttgtggtgtgagtatcaga

SEQ ID NO: 2899752 - DNA, 18 bp, Homo sapiens
cagttgtggtgtgccatg

SEQ ID NO: 2899753 - DNA, 17 bp, Homo sapiens
cagttgtgtttgttgct

SEQ ID NO: 2899754 - DNA, 22 bp, Homo sapiens
cagttgtgtttgttgctggctt

SEQ ID NO: 2899755 - DNA, 12 bp, Homo sapiens
cagtttaacaga

SEQ ID NO: 2899756 - DNA, 18 bp, Homo sapiens
cagtttaagatgacactt

SEQ ID NO: 2899757 - DNA, 11 bp, Homo sapiens
cagtttaattc

SEQ ID NO: 2899758 - DNA, 23 bp, Homo sapiens
cagtttacaggaaagatgcattt

SEQ ID NO: 2899759 - DNA, 15 bp, Homo sapiens
cagtttactttgcca

SEQ ID NO: 2899760 - DNA, 16 bp, Homo sapiens
cagtttatcattcaag

SEQ ID NO: 2899761 - DNA, 18 bp, Homo sapiens
cagtttatcattcaagtg

SEQ ID NO: 2899762 - DNA, 21 bp, Homo sapiens
cagtttattaaatctgaattt

SEQ ID NO: 2899763 - DNA, 22 bp, Homo sapiens
cagtttcttacaaataaagttt

SEQ ID NO: 2899764 - DNA, 14 bp, Homo sapiens
cagtttcttttctt

SEQ ID NO: 2899765 - DNA, 20 bp, Homo sapiens
cagtttgaaattctgaattt

SEQ ID NO: 2899766 - DNA, 21 bp, Homo sapiens
cagtttgaaattctgaatttg

SEQ ID NO: 2899767 - DNA, 24 bp, Homo sapiens
cagtttgaatgcagtctgtccagg

SEQ ID NO: 2899768 - DNA, 20 bp, Homo sapiens
cagtttgtggcatcttgcca

SEQ ID NO: 2899769 - DNA, 18 bp, Homo sapiens
cagtttgtttcctgtctg

SEQ ID NO: 2899770 - DNA, 14 bp, Homo sapiens
cagttttaacaaat

SEQ ID NO: 2899771 - DNA, 14 bp, Homo sapiens
cagttttcccactt

SEQ ID NO: 2899772 - DNA, 18 bp, Homo sapiens
cagttttcggaaacactg

SEQ ID NO: 2899773 - DNA, 20 bp, Homo sapiens
cagttttgacctaacatacc

SEQ ID NO: 2899774 - DNA, 13 bp, Homo sapiens
cagttttgctgct

SEQ ID NO: 2899775 - DNA, 19 bp, Homo sapiens
cagttttgctgctataatt

SEQ ID NO: 2899776 - DNA, 16 bp, Homo sapiens
cagttttgtaaatgta

SEQ ID NO: 2899777 - DNA, 24 bp, Homo sapiens
cagttttgtaaatgtactggtaat

SEQ ID NO: 2899778 - DNA, 12 bp, Homo sapiens
cagttttgtaag

SEQ ID NO: 2899779 - DNA, 18 bp, Homo sapiens
cagttttgtaagccctct

SEQ ID NO: 2899780 - DNA, 22 bp, Homo sapiens
cagtttttgacatttatattaa

SEQ ID NO: 2899781 - DNA, 19 bp, Homo sapiens
cataaaaagcagaatttta

SEQ ID NO: 2899782 - DNA, 22 bp, Homo sapiens
cataaaaagcagaattttaatg

SEQ ID NO: 2899783 - DNA, 22 bp, Homo sapiens
cataaaagggtcaaacctgtag

SEQ ID NO: 2899784 - DNA, 18 bp, Homo sapiens
cataaacacaactgactc

SEQ ID NO: 2899785 - DNA, 21 bp, Homo sapiens
cataaagaagcaataaagaag

SEQ ID NO: 2899786 - DNA, 16 bp, Homo sapiens
cataaaggtaaaacaa

SEQ ID NO: 2899787 - DNA, 14 bp, Homo sapiens
cataaatgcagccc

SEQ ID NO: 2899788 - DNA, 16 bp, Homo sapiens
cataaattaatgattc

SEQ ID NO: 2899789 - DNA, 18 bp, Homo sapiens
catcacccaggctggagt

SEQ ID NO: 2899790 - DNA, 16 bp, Homo sapiens
catcacctctttgccc

SEQ ID NO: 2899791 - DNA, 14 bp, Homo sapiens
catcacctgcctgt

SEQ ID NO: 2899792 - DNA, 19 bp, Homo sapiens
catcaccttaggcagggaa

SEQ ID NO: 2899793 - DNA, 20 bp, Homo sapiens
catcaccttaggcagggaag

SEQ ID NO: 2899794 - DNA, 20 bp, Homo sapiens
catcaccttcctcctgtagt

SEQ ID NO: 2899795 - DNA, 17 bp, Homo sapiens
catcacgtgtactggct

SEQ ID NO: 2899796 - DNA, 16 bp, Homo sapiens
catcactcgcaggacc

SEQ ID NO: 2899797 - DNA, 20 bp, Homo sapiens
catcactcgcaggaccaagg

SEQ ID NO: 2899798 - DNA, 17 bp, Homo sapiens
catcactgagttttcca

SEQ ID NO: 2899799 - DNA, 13 bp, Homo sapiens
catcactgtggct

SEQ ID NO: 2899800 - DNA, 17 bp, Homo sapiens
catcactgtggctgtct

SEQ ID NO: 2899801 - DNA, 11 bp, Homo sapiens
catcacttcct

SEQ ID NO: 2899802 - DNA, 11 bp, Homo sapiens
catcagaagga

SEQ ID NO: 2899803 - DNA, 23 bp, Homo sapiens
catcagaaggagaaggaaggaga

SEQ ID NO: 2899804 - DNA, 19 bp, Homo sapiens
catcagaagtaactcccac

SEQ ID NO: 2899805 - DNA, 22 bp, Homo sapiens
catcagaagtaactcccactcc

SEQ ID NO: 2899806 - DNA, 17 bp, Homo sapiens
catcagcaatgcttctc

SEQ ID NO: 2899807 - DNA, 15 bp, Homo sapiens
catcagcatgttttc

SEQ ID NO: 2899808 - DNA, 12 bp, Homo sapiens
catcagccagct

SEQ ID NO: 2899809 - DNA, 14 bp, Homo sapiens
catcagccattttt

SEQ ID NO: 2899810 - DNA, 18 bp, Homo sapiens
catcagctaaacaccacg

SEQ ID NO: 2899811 - DNA, 18 bp, Homo sapiens
catcaggagttccagtgc

SEQ ID NO: 2899812 - DNA, 15 bp, Homo sapiens
catcagtccctatgt

SEQ ID NO: 2899813 - DNA, 17 bp, Homo sapiens
catcagtgccagcccct

SEQ ID NO: 2899814 - DNA, 16 bp, Homo sapiens
catcagtgctccctca

SEQ ID NO: 2899815 - DNA, 16 bp, Homo sapiens
catcatccctccctgc

SEQ ID NO: 2899816 - DNA, 17 bp, Homo sapiens
catcatccctccctgcc

SEQ ID NO: 2899817 - DNA, 13 bp, Homo sapiens
catcatctcctgc

SEQ ID NO: 2899818 - DNA, 20 bp, Homo sapiens
catcatctcctgccttcctc

SEQ ID NO: 2899819 - DNA, 13 bp, Homo sapiens
catcatctctgcc

SEQ ID NO: 2899820 - DNA, 17 bp, Homo sapiens
catcatctctgcctttg

SEQ ID NO: 2899821 - DNA, 18 bp, Homo sapiens
catcatctctgcctttga

SEQ ID NO: 2899822 - DNA, 22 bp, Homo sapiens
catcatctctgcctttgagtgt

SEQ ID NO: 2899823 - DNA, 16 bp, Homo sapiens
catcatctcttgataa

SEQ ID NO: 2899824 - DNA, 22 bp, Homo sapiens
catcatctcttgataaaggaga

SEQ ID NO: 2899825 - DNA, 16 bp, Homo sapiens
catcatgaactggctt

SEQ ID NO: 2899826 - DNA, 13 bp, Homo sapiens
catcatgcctgac

SEQ ID NO: 2899827 - DNA, 21 bp, Homo sapiens
catcatggaaagactgggaca

SEQ ID NO: 2899828 - DNA, 18 bp, Homo sapiens
catcatgttgaccaggct

SEQ ID NO: 2899829 - DNA, 14 bp, Homo sapiens
catcattagaacaa

SEQ ID NO: 2899830 - DNA, 16 bp, Homo sapiens
catcattccctctcat

SEQ ID NO: 2899831 - DNA, 14 bp, Homo sapiens
catcattctctgtc

SEQ ID NO: 2899832 - DNA, 17 bp, Homo sapiens
catcattctctgtctca

SEQ ID NO: 2899833 - DNA, 21 bp, Homo sapiens
catcattctctgtctcatcca

SEQ ID NO: 2899834 - DNA, 20 bp, Homo sapiens
catcattggataaatttgaa

SEQ ID NO: 2899835 - DNA, 21 bp, Homo sapiens
catcattgtccccatgcaaca

SEQ ID NO: 2899836 - DNA, 18 bp, Homo sapiens
catcatttaaaaaaaaag

SEQ ID NO: 2899837 - DNA, 13 bp, Homo sapiens
catcatttcagcc

SEQ ID NO: 2899838 - DNA, 13 bp, Homo sapiens
catcatttgggat

SEQ ID NO: 2899839 - DNA, 17 bp, Homo sapiens
catcattttctccacct

SEQ ID NO: 2899840 - DNA, 16 bp, Homo sapiens
catccaaccttcccaa

SEQ ID NO: 2899841 - DNA, 15 bp, Homo sapiens
catccaactccagga

SEQ ID NO: 2899842 - DNA, 15 bp, Homo sapiens
catccaagtggcata

SEQ ID NO: 2899843 - DNA, 13 bp, Homo sapiens
catccagagtccc

SEQ ID NO: 2899844 - DNA, 17 bp, Homo sapiens
catccagagtccctgcc

SEQ ID NO: 2899845 - DNA, 15 bp, Homo sapiens
catccagcagtctct

SEQ ID NO: 2899846 - DNA, 19 bp, Homo sapiens
catccagcagtctctgcct

SEQ ID NO: 2899847 - DNA, 20 bp, Homo sapiens
catccagcagtctctgcctt

SEQ ID NO: 2899848 - DNA, 15 bp, Homo sapiens
catccagctacttag

SEQ ID NO: 2899849 - DNA, 16 bp, Homo sapiens
catccagctacttagc

SEQ ID NO: 2899850 - DNA, 21 bp, Homo sapiens
catccagctacttagctggcc

SEQ ID NO: 2899851 - DNA, 14 bp, Homo sapiens
catccagcttgcca

SEQ ID NO: 2899852 - DNA, 20 bp, Homo sapiens
catccaggctggccagtgct

SEQ ID NO: 2899853 - DNA, 16 bp, Homo sapiens
catccataaagaagca

SEQ ID NO: 2899854 - DNA, 19 bp, Homo sapiens
catccatagtaactgacat

SEQ ID NO: 2899855 - DNA, 18 bp, Homo sapiens
catccatagtagtatgat

SEQ ID NO: 2899856 - DNA, 22 bp, Homo sapiens
catccatgcggagtccattatt

SEQ ID NO: 2899857 - DNA, 17 bp, Homo sapiens
catccatgtacttccct

SEQ ID NO: 2899858 - DNA, 23 bp, Homo sapiens
catccatgtacttccctcttgaa

SEQ ID NO: 2899859 - DNA, 23 bp, Homo sapiens
catccatgtgctagtcactggca

SEQ ID NO: 2899860 - DNA, 18 bp, Homo sapiens
catccatgttccgagaag

SEQ ID NO: 2899861 - DNA, 14 bp, Homo sapiens
catccattcctcag

SEQ ID NO: 2899862 - DNA, 16 bp, Homo sapiens
catcccaagcccagtg

SEQ ID NO: 2899863 - DNA, 15 bp, Homo sapiens
catcccactggatct

SEQ ID NO: 2899864 - DNA, 19 bp, Homo sapiens
catcccactggatctggct

SEQ ID NO: 2899865 - DNA, 21 bp, Homo sapiens
catcccagacaggtccctccc

SEQ ID NO: 2899866 - DNA, 19 bp, Homo sapiens
catcccagcccaatccagg

SEQ ID NO: 2899867 - DNA, 16 bp, Homo sapiens
catcccattgccctgg

SEQ ID NO: 2899868 - DNA, 17 bp, Homo sapiens
catccccagagcccagc

SEQ ID NO: 2899869 - DNA, 18 bp, Homo sapiens
catccccagagcccagct

SEQ ID NO: 2899870 - DNA, 20 bp, Homo sapiens
catccccatcggccctgtcc

SEQ ID NO: 2899871 - DNA, 19 bp, Homo sapiens
catccccgcagtgtgcact

SEQ ID NO: 2899872 - DNA, 22 bp, Homo sapiens
catccccttacccttagaatcc

SEQ ID NO: 2899873 - DNA, 17 bp, Homo sapiens
catcccgagcacctcca

SEQ ID NO: 2899874 - DNA, 18 bp, Homo sapiens
catccctgcttctggcgc

SEQ ID NO: 2899875 - DNA, 23 bp, Homo sapiens
catccgcagactgcttggccaga

SEQ ID NO: 2899876 - DNA, 13 bp, Homo sapiens
catccgcaggtgc

SEQ ID NO: 2899877 - DNA, 14 bp, Homo sapiens
catccgcaggtgct

SEQ ID NO: 2899878 - DNA, 20 bp, Homo sapiens
catccgcgtgtgcctgtgtg

SEQ ID NO: 2899879 - DNA, 17 bp, Homo sapiens
catccgtagttccctga

SEQ ID NO: 2899880 - DNA, 20 bp, Homo sapiens
catccgtgctatgacatgga

SEQ ID NO: 2899881 - DNA, 20 bp, Homo sapiens
catcctaatcatccaatgct

SEQ ID NO: 2899882 - DNA, 19 bp, Homo sapiens
catcctaccccctgtgcct

SEQ ID NO: 2899883 - DNA, 19 bp, Homo sapiens
catcctattacttttcatc

SEQ ID NO: 2899884 - DNA, 19 bp, Homo sapiens
catcctcaagatcattcag

SEQ ID NO: 2899885 - DNA, 21 bp, Homo sapiens
catcctccacgttctgctcat

SEQ ID NO: 2899886 - DNA, 15 bp, Homo sapiens
catcctccagccctg

SEQ ID NO: 2899887 - DNA, 17 bp, Homo sapiens
catcctccagccctgcc

SEQ ID NO: 2899888 - DNA, 23 bp, Homo sapiens
catcctccccaccagagctgcct

SEQ ID NO: 2899889 - DNA, 11 bp, Homo sapiens
catcctcctcc

SEQ ID NO: 2899890 - DNA, 14 bp, Homo sapiens
catcctcctcctca

SEQ ID NO: 2899891 - DNA, 20 bp, Homo sapiens
catcctcctctccatgcaag

SEQ ID NO: 2899892 - DNA, 21 bp, Homo sapiens
catcctcctctccatgcaagt

SEQ ID NO: 2899893 - DNA, 15 bp, Homo sapiens
catcgtcttttagtt

SEQ ID NO: 2899894 - DNA, 19 bp, Homo sapiens
catctaaattgatcattca

SEQ ID NO: 2899895 - DNA, 14 bp, Homo sapiens
catctaattcttat

SEQ ID NO: 2899896 - DNA, 21 bp, Homo sapiens
catctactcttttgaagtgtt

SEQ ID NO: 2899897 - DNA, 14 bp, Homo sapiens
catctagcaaatgt

SEQ ID NO: 2899898 - DNA, 14 bp, Homo sapiens
catctataaattgt

SEQ ID NO: 2899899 - DNA, 20 bp, Homo sapiens
catctatgggagagtgtcaa

SEQ ID NO: 2899900 - DNA, 14 bp, Homo sapiens
catctatgtgaata

SEQ ID NO: 2899901 - DNA, 15 bp, Homo sapiens
catctcaaatgtttt

SEQ ID NO: 2899902 - DNA, 23 bp, Homo sapiens
catctccagcattctcagccaca

SEQ ID NO: 2899903 - DNA, 22 bp, Homo sapiens
catctccatgtagaataaatga

SEQ ID NO: 2899904 - DNA, 20 bp, Homo sapiens
catctcccaaagtgctggga

SEQ ID NO: 2899905 - DNA, 18 bp, Homo sapiens
catctccctgccatcccc

SEQ ID NO: 2899906 - DNA, 20 bp, Homo sapiens
catctccctgccatccccct

SEQ ID NO: 2899907 - DNA, 19 bp, Homo sapiens
catctccgcctccacactg

SEQ ID NO: 2899908 - DNA, 20 bp, Homo sapiens
catctccgcctccacactga

SEQ ID NO: 2899909 - DNA, 16 bp, Homo sapiens
catctcctgccttcct

SEQ ID NO: 2899910 - DNA, 22 bp, Homo sapiens
catctcctgccttcctcctggg

SEQ ID NO: 2899911 - DNA, 17 bp, Homo sapiens
catctcgctccctccca

SEQ ID NO: 2899912 - DNA, 22 bp, Homo sapiens
catctcgctccctcccaggact

SEQ ID NO: 2899913 - DNA, 17 bp, Homo sapiens
catctcggggctgctgt

SEQ ID NO: 2899914 - DNA, 13 bp, Homo sapiens
catctctctgccc

SEQ ID NO: 2899915 - DNA, 15 bp, Homo sapiens
catctctctgcccaa

SEQ ID NO: 2899916 - DNA, 15 bp, Homo sapiens
catctctgagtgtct

SEQ ID NO: 2899917 - DNA, 20 bp, Homo sapiens
catctctgagtgtctctgcc

SEQ ID NO: 2899918 - DNA, 15 bp, Homo sapiens
catctctgtcagtgt

SEQ ID NO: 2899919 - DNA, 18 bp, Homo sapiens
catctctgtcagtgtgaa

SEQ ID NO: 2899920 - DNA, 23 bp, Homo sapiens
catctctgttcttttcccgcctc

SEQ ID NO: 2899921 - DNA, 21 bp, Homo sapiens
catctcttcctccgaggccag

SEQ ID NO: 2899922 - DNA, 14 bp, Homo sapiens
catctctttaaaaa

SEQ ID NO: 2899923 - DNA, 19 bp, Homo sapiens
catctgaaggggcaaattc

SEQ ID NO: 2899924 - DNA, 21 bp, Homo sapiens
catctgaaggggcaaattctt

SEQ ID NO: 2899925 - DNA, 22 bp, Homo sapiens
catctgaatgaaaataactgaa

SEQ ID NO: 2899926 - DNA, 23 bp, Homo sapiens
catctgaatgaaaataactgaac

SEQ ID NO: 2899927 - DNA, 15 bp, Homo sapiens
catctgacaaattca

SEQ ID NO: 2899928 - DNA, 14 bp, Homo sapiens
catctgaccagcag

SEQ ID NO: 2899929 - DNA, 15 bp, Homo sapiens
catctgaccagcagc

SEQ ID NO: 2899930 - DNA, 13 bp, Homo sapiens
catctgaccatct

SEQ ID NO: 2899931 - DNA, 15 bp, Homo sapiens
catctgagccagcac

SEQ ID NO: 2899932 - DNA, 16 bp, Homo sapiens
catctgagccagcacc

SEQ ID NO: 2899933 - DNA, 17 bp, Homo sapiens
catctgaggcatccagc

SEQ ID NO: 2899934 - DNA, 20 bp, Homo sapiens
catctgaggtcctgtgatct

SEQ ID NO: 2899935 - DNA, 23 bp, Homo sapiens
catctgaggtcctgtgatcttat

SEQ ID NO: 2899936 - DNA, 14 bp, Homo sapiens
catctgataaagtt

SEQ ID NO: 2899937 - DNA, 17 bp, Homo sapiens
catctgataatttcaca

SEQ ID NO: 2899938 - DNA, 19 bp, Homo sapiens
catctgataatttcacaga

SEQ ID NO: 2899939 - DNA, 13 bp, Homo sapiens
catctgcaggcac

SEQ ID NO: 2899940 - DNA, 20 bp, Homo sapiens
catctgcaggcaccgggctg

SEQ ID NO: 2899941 - DNA, 22 bp, Homo sapiens
catctgcccaactgtgtagcat

SEQ ID NO: 2899942 - DNA, 12 bp, Homo sapiens
catctgcccgcc

SEQ ID NO: 2899943 - DNA, 14 bp, Homo sapiens
catctgcccgcctg

SEQ ID NO: 2899944 - DNA, 19 bp, Homo sapiens
catctgcccgcctgcccac

SEQ ID NO: 2899945 - DNA, 20 bp, Homo sapiens
catctgcccgcctgcccacc

SEQ ID NO: 2899946 - DNA, 23 bp, Homo sapiens
catctgcccgcctgcccacctgc

SEQ ID NO: 2899947 - DNA, 17 bp, Homo sapiens
catctgctactgtgtca

SEQ ID NO: 2899948 - DNA, 18 bp, Homo sapiens
catctgctactgtgtcag

SEQ ID NO: 2899949 - DNA, 19 bp, Homo sapiens
catctgctgcacatagcag

SEQ ID NO: 2899950 - DNA, 21 bp, Homo sapiens
catctggaaggggatcccacc

SEQ ID NO: 2899951 - DNA, 17 bp, Homo sapiens
catctggctgcctttgc

SEQ ID NO: 2899952 - DNA, 12 bp, Homo sapiens
catctgggaaag

SEQ ID NO: 2899953 - DNA, 14 bp, Homo sapiens
catctgggtgccct

SEQ ID NO: 2899954 - DNA, 23 bp, Homo sapiens
catctgggttgccatggcaatgg

SEQ ID NO: 2899955 - DNA, 22 bp, Homo sapiens
catctggttgaatggcttttct

SEQ ID NO: 2899956 - DNA, 12 bp, Homo sapiens
catctgtacaaa

SEQ ID NO: 2899957 - DNA, 15 bp, Homo sapiens
catctgtacttggtc

SEQ ID NO: 2899958 - DNA, 17 bp, Homo sapiens
catctgtagtcagccga

SEQ ID NO: 2899959 - DNA, 22 bp, Homo sapiens
catctgtccacatccccagagc

SEQ ID NO: 2899960 - DNA, 19 bp, Homo sapiens
catctgtccatcctcctct

SEQ ID NO: 2899961 - DNA, 16 bp, Homo sapiens
catctgtccctccggg

SEQ ID NO: 2899962 - DNA, 18 bp, Homo sapiens
catctgtccctccgggac

SEQ ID NO: 2899963 - DNA, 20 bp, Homo sapiens
catctgtccctccgggacct

SEQ ID NO: 2899964 - DNA, 17 bp, Homo sapiens
catctgtccgtccagag

SEQ ID NO: 2899965 - DNA, 19 bp, Homo sapiens
catctgtccgtccagagcc

SEQ ID NO: 2899966 - DNA, 18 bp, Homo sapiens
catctgtctaaagataga

SEQ ID NO: 2899967 - DNA, 16 bp, Homo sapiens
catctgtgactataaa

SEQ ID NO: 2899968 - DNA, 17 bp, Homo sapiens
catctgtgactataaag

SEQ ID NO: 2899969 - DNA, 22 bp, Homo sapiens
catctgtgactataaagctgtt

SEQ ID NO: 2899970 - DNA, 13 bp, Homo sapiens
catctgtgcaggg

SEQ ID NO: 2899971 - DNA, 17 bp, Homo sapiens
catctgtgcagggctgg

SEQ ID NO: 2899972 - DNA, 13 bp, Homo sapiens
catctgtgcctgt

SEQ ID NO: 2899973 - DNA, 17 bp, Homo sapiens
catctgtgcctgtctgt

SEQ ID NO: 2899974 - DNA, 16 bp, Homo sapiens
catctgtgtctctgga

SEQ ID NO: 2899975 - DNA, 22 bp, Homo sapiens
catctgtgtctctggaacccag

SEQ ID NO: 2899976 - DNA, 10 bp, Homo sapiens
catctgtgtg

SEQ ID NO: 2899977 - DNA, 16 bp, Homo sapiens
catctgtgtgcgtggc

SEQ ID NO: 2899978 - DNA, 22 bp, Homo sapiens
catctgtttacactctttgcca

SEQ ID NO: 2899979 - DNA, 21 bp, Homo sapiens
catctgtttgtagccacaagc

SEQ ID NO: 2899980 - DNA, 18 bp, Homo sapiens
catcttaaaaatattgtc

SEQ ID NO: 2899981 - DNA, 19 bp, Homo sapiens
catcttaaatcttaaaagt

SEQ ID NO: 2899982 - DNA, 14 bp, Homo sapiens
catcttactgaagg

SEQ ID NO: 2899983 - DNA, 16 bp, Homo sapiens
catcttcactgcaatt

SEQ ID NO: 2899984 - DNA, 14 bp, Homo sapiens
catcttcagcttct

SEQ ID NO: 2899985 - DNA, 11 bp, Homo sapiens
catcttcatat

SEQ ID NO: 2899986 - DNA, 15 bp, Homo sapiens
catcttcatataaac

SEQ ID NO: 2899987 - DNA, 13 bp, Homo sapiens
catcttccagaag

SEQ ID NO: 2899988 - DNA, 18 bp, Homo sapiens
catcttcccgcctcagcc

SEQ ID NO: 2899989 - DNA, 13 bp, Homo sapiens
catcttccctgcc

SEQ ID NO: 2899990 - DNA, 15 bp, Homo sapiens
catcttcgggaccag

SEQ ID NO: 2899991 - DNA, 15 bp, Homo sapiens
catcttcgtcttcac

SEQ ID NO: 2899992 - DNA, 21 bp, Homo sapiens
catcttctaaacccaatccaa

SEQ ID NO: 2899993 - DNA, 14 bp, Homo sapiens
catcttctccatct

SEQ ID NO: 2899994 - DNA, 21 bp, Homo sapiens
catcttctccccgaggctgcc

SEQ ID NO: 2899995 - DNA, 22 bp, Homo sapiens
catcttctttttgaaatcagca

SEQ ID NO: 2899996 - DNA, 22 bp, Homo sapiens
catcttgccaagggtccctgtg

SEQ ID NO: 2899997 - DNA, 23 bp, Homo sapiens
catcttgcctccaggtgcagagg

SEQ ID NO: 2899998 - DNA, 14 bp, Homo sapiens
catcttggcagggt

SEQ ID NO: 2899999 - DNA, 20 bp, Homo sapiens
catcttggggacatctcttt

SEQ ID NO: 2900000 - DNA, 12 bp, Homo sapiens
catcttgtcttt

SEQ ID NO: 2900001 - DNA, 16 bp, Homo sapiens
catcttgtcttttccc

SEQ ID NO: 2900002 - DNA, 14 bp, Homo sapiens
catctttgcctctc

SEQ ID NO: 2900003 - DNA, 15 bp, Homo sapiens
catcttttaaagaaa

SEQ ID NO: 2900004 - DNA, 12 bp, Homo sapiens
catcttttaatc

SEQ ID NO: 2900005 - DNA, 17 bp, Homo sapiens
cattggacccttccatg

SEQ ID NO: 2900006 - DNA, 17 bp, Homo sapiens
cattggatacagcagta

SEQ ID NO: 2900007 - DNA, 18 bp, Homo sapiens
cattggctatttaaaact

SEQ ID NO: 2900008 - DNA, 19 bp, Homo sapiens
cattggctatttaaaactt

SEQ ID NO: 2900009 - DNA, 22 bp, Homo sapiens
cattggctcttgaactgagctt

SEQ ID NO: 2900010 - DNA, 17 bp, Homo sapiens
cattgggtctattccag

SEQ ID NO: 2900011 - DNA, 13 bp, Homo sapiens
ccaacccccatct

SEQ ID NO: 2900012 - DNA, 15 bp, Homo sapiens
ccaaccccgcggccc

SEQ ID NO: 2900013 - DNA, 20 bp, Homo sapiens
ccaacccctcccccacgtct

SEQ ID NO: 2900014 - DNA, 19 bp, Homo sapiens
ccaaccccttaagccctgg

SEQ ID NO: 2900015 - DNA, 16 bp, Homo sapiens
ccaacctaacctgtgt

SEQ ID NO: 2900016 - DNA, 23 bp, Homo sapiens
ccaacctgaaggtcccctggcag

SEQ ID NO: 2900017 - DNA, 13 bp, Homo sapiens
ccaacctgaccaa

SEQ ID NO: 2900018 - DNA, 18 bp, Homo sapiens
ccaacctgcaaagatctg

SEQ ID NO: 2900019 - DNA, 12 bp, Homo sapiens
ccaaccttccca

SEQ ID NO: 2900020 - DNA, 20 bp, Homo sapiens
ccaaccttcctttttttaaa

SEQ ID NO: 2900021 - DNA, 14 bp, Homo sapiens
ccaaccttgtttaa

SEQ ID NO: 2900022 - DNA, 13 bp, Homo sapiens
ccaacgccgcctt

SEQ ID NO: 2900023 - DNA, 24 bp, Homo sapiens
ccaacggcaagggaacaagtactt

SEQ ID NO: 2900024 - DNA, 22 bp, Homo sapiens
ccaacgtttggaagatcctgtg

SEQ ID NO: 2900025 - DNA, 17 bp, Homo sapiens
ccaactactatctcaga

SEQ ID NO: 2900026 - DNA, 15 bp, Homo sapiens
ccaactagcccctgg

SEQ ID NO: 2900027 - DNA, 14 bp, Homo sapiens
ccaactcccttctg

SEQ ID NO: 2900028 - DNA, 17 bp, Homo sapiens
ccaactcccttctgctt

SEQ ID NO: 2900029 - DNA, 15 bp, Homo sapiens
ccaactcctggaagc

SEQ ID NO: 2900030 - DNA, 22 bp, Homo sapiens
ccaactctaaagccaagcactt

SEQ ID NO: 2900031 - DNA, 16 bp, Homo sapiens
ccaactgcctccttgc

SEQ ID NO: 2900032 - DNA, 13 bp, Homo sapiens
ccaactgtatata

SEQ ID NO: 2900033 - DNA, 16 bp, Homo sapiens
ccaactgtggctggtc

SEQ ID NO: 2900034 - DNA, 17 bp, Homo sapiens
ccaacttggctgcagga

SEQ ID NO: 2900035 - DNA, 17 bp, Homo sapiens
ccaactttttcatagta

SEQ ID NO: 2900036 - DNA, 16 bp, Homo sapiens
ccaactttttccaagt

SEQ ID NO: 2900037 - DNA, 21 bp, Homo sapiens
ccaagaatgtacgtccagcct

SEQ ID NO: 2900038 - DNA, 13 bp, Homo sapiens
ccaagacaagacc

SEQ ID NO: 2900039 - DNA, 22 bp, Homo sapiens
ccaagaccatttgtagtgagcg

SEQ ID NO: 2900040 - DNA, 21 bp, Homo sapiens
ccaagactctagagtccaagg

SEQ ID NO: 2900041 - DNA, 22 bp, Homo sapiens
ccaagagaaggtggacctggca

SEQ ID NO: 2900042 - DNA, 23 bp, Homo sapiens
ccaagagaaggtggacctggcag

SEQ ID NO: 2900043 - DNA, 20 bp, Homo sapiens
ccaagagaggaaggacccct

SEQ ID NO: 2900044 - DNA, 22 bp, Homo sapiens
ccaagagaggaaggacccctca

SEQ ID NO: 2900045 - DNA, 23 bp, Homo sapiens
ccaagagaggaaggacccctcac

SEQ ID NO: 2900046 - DNA, 16 bp, Homo sapiens
ccaagagcctgagagt

SEQ ID NO: 2900047 - DNA, 15 bp, Homo sapiens
ccaagaggctgcagc

SEQ ID NO: 2900048 - DNA, 20 bp, Homo sapiens
ccaagagtcacttctaataa

SEQ ID NO: 2900049 - DNA, 15 bp, Homo sapiens
ccaagagtctaaaga

SEQ ID NO: 2900050 - DNA, 17 bp, Homo sapiens
ccaagatcgcaccactg

SEQ ID NO: 2900051 - DNA, 17 bp, Homo sapiens
ccaagattctagatgat

SEQ ID NO: 2900052 - DNA, 16 bp, Homo sapiens
ccaagattttgaagga

SEQ ID NO: 2900053 - DNA, 17 bp, Homo sapiens
ccaagcacagcagcctg

SEQ ID NO: 2900054 - DNA, 20 bp, Homo sapiens
ccaagcacagtggtggcagg

SEQ ID NO: 2900055 - DNA, 23 bp, Homo sapiens
ccaagcacagtggtggcagggcc

SEQ ID NO: 2900056 - DNA, 12 bp, Homo sapiens
ccaagcagccaa

SEQ ID NO: 2900057 - DNA, 18 bp, Homo sapiens
ccaagcagccaagctcct

SEQ ID NO: 2900058 - DNA, 13 bp, Homo sapiens
ccaagcaggaagc

SEQ ID NO: 2900059 - DNA, 14 bp, Homo sapiens
ccaagcaggaagct

SEQ ID NO: 2900060 - DNA, 20 bp, Homo sapiens
ccaagcaggaagctcagact

SEQ ID NO: 2900061 - DNA, 15 bp, Homo sapiens
ccaagccaccgcagc

SEQ ID NO: 2900062 - DNA, 12 bp, Homo sapiens
ccaagccactga

SEQ ID NO: 2900063 - DNA, 19 bp, Homo sapiens
ccaagccccctggcagctg

SEQ ID NO: 2900064 - DNA, 21 bp, Homo sapiens
ccaagccccctggcagctgcc

SEQ ID NO: 2900065 - DNA, 18 bp, Homo sapiens
ccaagctcacagttcctc

SEQ ID NO: 2900066 - DNA, 19 bp, Homo sapiens
ccaagctcacagttcctcg

SEQ ID NO: 2900067 - DNA, 19 bp, Homo sapiens
ccaagctccttgggaggcc

SEQ ID NO: 2900068 - DNA, 14 bp, Homo sapiens
ccaagctggctggg

SEQ ID NO: 2900069 - DNA, 17 bp, Homo sapiens
ccaagctgtgttcatcc

SEQ ID NO: 2900070 - DNA, 19 bp, Homo sapiens
ccaagctttcaaacatgtt

SEQ ID NO: 2900071 - DNA, 16 bp, Homo sapiens
ccaaggaaaactgcat

SEQ ID NO: 2900072 - DNA, 14 bp, Homo sapiens
ccaaggaaggagcc

SEQ ID NO: 2900073 - DNA, 19 bp, Homo sapiens
ccaaggaaggagcccctga

SEQ ID NO: 2900074 - DNA, 17 bp, Homo sapiens
ccaaggacttccacatt

SEQ ID NO: 2900075 - DNA, 14 bp, Homo sapiens
ccaaggagcagaga

SEQ ID NO: 2900076 - DNA, 20 bp, Homo sapiens
ccaaggcatatcatgctttg

SEQ ID NO: 2900077 - DNA, 16 bp, Homo sapiens
ccaaggccagggacag

SEQ ID NO: 2900078 - DNA, 16 bp, Homo sapiens
ccaaggccgcggccca

SEQ ID NO: 2900079 - DNA, 17 bp, Homo sapiens
ccaaggccgcggcccag

SEQ ID NO: 2900080 - DNA, 20 bp, Homo sapiens
ccaaggccgcggcccagacc

SEQ ID NO: 2900081 - DNA, 17 bp, Homo sapiens
ccaaggctgtgtttaga

SEQ ID NO: 2900082 - DNA, 21 bp, Homo sapiens
ccaagggatctggtcctaccc

SEQ ID NO: 2900083 - DNA, 19 bp, Homo sapiens
ccaaggggaatcagaactc

SEQ ID NO: 2900084 - DNA, 14 bp, Homo sapiens
ccaagggggcgggg

SEQ ID NO: 2900085 - DNA, 16 bp, Homo sapiens
ccaagggggcggggac

SEQ ID NO: 2900086 - DNA, 17 bp, Homo sapiens
ccaagggggcggggact

SEQ ID NO: 2900087 - DNA, 20 bp, Homo sapiens
ccaaggggtggccgggcaca

SEQ ID NO: 2900088 - DNA, 22 bp, Homo sapiens
ccaaggggtggccgggcacagt

SEQ ID NO: 2900089 - DNA, 20 bp, Homo sapiens
ccaaggtctcacactcctcc

SEQ ID NO: 2900090 - DNA, 23 bp, Homo sapiens
ccaaggtgcatatagaaaacaaa

SEQ ID NO: 2900091 - DNA, 12 bp, Homo sapiens
ccaaggtgctgg

SEQ ID NO: 2900092 - DNA, 15 bp, Homo sapiens
ccaaggtgctggact

SEQ ID NO: 2900093 - DNA, 14 bp, Homo sapiens
ccaaggtgggcgga

SEQ ID NO: 2900094 - DNA, 19 bp, Homo sapiens
ccaaggtttaaagagtcta

SEQ ID NO: 2900095 - DNA, 17 bp, Homo sapiens
ccaagtcaggccaggtg

SEQ ID NO: 2900096 - DNA, 16 bp, Homo sapiens
ccaagtcatttttgtt

SEQ ID NO: 2900097 - DNA, 16 bp, Homo sapiens
ccaagtctacttcact

SEQ ID NO: 2900098 - DNA, 13 bp, Homo sapiens
ccaagtcttctcc

SEQ ID NO: 2900099 - DNA, 17 bp, Homo sapiens
ccaagtgaccagggaag

SEQ ID NO: 2900100 - DNA, 13 bp, Homo sapiens
ccaagtgcctgct

SEQ ID NO: 2900101 - DNA, 20 bp, Homo sapiens
ccaagtgctggcccacccag

SEQ ID NO: 2900102 - DNA, 15 bp, Homo sapiens
ccaagtgtattttaa

SEQ ID NO: 2900103 - DNA, 17 bp, Homo sapiens
ccaagtgtattttaaaa

SEQ ID NO: 2900104 - DNA, 20 bp, Homo sapiens
ccaagtgtgcatattgtaca

SEQ ID NO: 2900105 - DNA, 16 bp, Homo sapiens
ccaagttgagactcgg

SEQ ID NO: 2900106 - DNA, 18 bp, Homo sapiens
ccaagtttgacttgtata

SEQ ID NO: 2900107 - DNA, 15 bp, Homo sapiens
ccaatagctgcccat

SEQ ID NO: 2900108 - DNA, 13 bp, Homo sapiens
ccaatatatgtat

SEQ ID NO: 2900109 - DNA, 19 bp, Homo sapiens
ccaatatcctcgctcccgg

SEQ ID NO: 2900110 - DNA, 17 bp, Homo sapiens
ccaatattattaaaatc

SEQ ID NO: 2900111 - DNA, 21 bp, Homo sapiens
ccaatcaatttaaatgtttac

SEQ ID NO: 2900112 - DNA, 22 bp, Homo sapiens
ccaatccaggtacgcacagaca

SEQ ID NO: 2900113 - DNA, 23 bp, Homo sapiens
ccaatccaggtacgcacagacag

SEQ ID NO: 2900114 - DNA, 17 bp, Homo sapiens
ccaatccatttggcaga

SEQ ID NO: 2900115 - DNA, 13 bp, Homo sapiens
ccaatcctatgtt

SEQ ID NO: 2900116 - DNA, 12 bp, Homo sapiens
ccaatcctcccc

SEQ ID NO: 2900117 - DNA, 21 bp, Homo sapiens
ccaatctatgtcgtgttttca

SEQ ID NO: 2900118 - DNA, 22 bp, Homo sapiens
ccaatctggacacttctttata

SEQ ID NO: 2900119 - DNA, 23 bp, Homo sapiens
ccaatcttagtttctaaccaaag

SEQ ID NO: 2900120 - DNA, 18 bp, Homo sapiens
ccaatgagacttgccttc

SEQ ID NO: 2900121 - DNA, 22 bp, Homo sapiens
ccaatggaatgtgatgttcatg

SEQ ID NO: 2900122 - DNA, 16 bp, Homo sapiens
ccaatggtgtttttct

SEQ ID NO: 2900123 - DNA, 17 bp, Homo sapiens
ccaatgtaccgtttcct

SEQ ID NO: 2900124 - DNA, 12 bp, Homo sapiens
ccaatgtcttga

SEQ ID NO: 2900125 - DNA, 15 bp, Homo sapiens
ccaatgtgaaagatt

SEQ ID NO: 2900126 - DNA, 22 bp, Homo sapiens
ccaattatttgactttaattta

SEQ ID NO: 2900127 - DNA, 24 bp, Homo sapiens
ccaattcctcatcctcagatgctc

SEQ ID NO: 2900128 - DNA, 13 bp, Homo sapiens
ccaattgcctctt

SEQ ID NO: 2900129 - DNA, 23 bp, Homo sapiens
ccaattttttgttcttcagagat

SEQ ID NO: 2900130 - DNA, 23 bp, Homo sapiens
ccacaaaataaccaatcctggac

SEQ ID NO: 2900131 - DNA, 15 bp, Homo sapiens
ccacaaacggagccc

SEQ ID NO: 2900132 - DNA, 23 bp, Homo sapiens
ccacaaacggagcccctgaaagc

SEQ ID NO: 2900133 - DNA, 14 bp, Homo sapiens
ccacaaactgtaat

SEQ ID NO: 2900134 - DNA, 16 bp, Homo sapiens
ccacaaagcaaaggca

SEQ ID NO: 2900135 - DNA, 15 bp, Homo sapiens
ccacaactattttca

SEQ ID NO: 2900136 - DNA, 20 bp, Homo sapiens
ccacaagattcccagagaca

SEQ ID NO: 2900137 - DNA, 24 bp, Homo sapiens
ccacaagattcccagagacaggaa

SEQ ID NO: 2900138 - DNA, 21 bp, Homo sapiens
ccacaaggcctggtctgggag

SEQ ID NO: 2900139 - DNA, 21 bp, Homo sapiens
ccacaagtgccgcaaattgta

SEQ ID NO: 2900140 - DNA, 23 bp, Homo sapiens
ccacaatttctttaaaaaagaaa

SEQ ID NO: 2900141 - DNA, 22 bp, Homo sapiens
ccacacaaggatagatgctggc

SEQ ID NO: 2900142 - DNA, 13 bp, Homo sapiens
ccacacacaacag

SEQ ID NO: 2900143 - DNA, 22 bp, Homo sapiens
ccacacacaacagccaacagct

SEQ ID NO: 2900144 - DNA, 13 bp, Homo sapiens
ccacacacacaca

SEQ ID NO: 2900145 - DNA, 14 bp, Homo sapiens
ccacacacacacac

SEQ ID NO: 2900146 - DNA, 18 bp, Homo sapiens
ccacacacacagaaaata

SEQ ID NO: 2900147 - DNA, 19 bp, Homo sapiens
ccacacacacagaaaatat

SEQ ID NO: 2900148 - DNA, 17 bp, Homo sapiens
ccacacacactccttcc

SEQ ID NO: 2900149 - DNA, 21 bp, Homo sapiens
ccacacacactccttcccctt

SEQ ID NO: 2900150 - DNA, 12 bp, Homo sapiens
ccacacacaggt

SEQ ID NO: 2900151 - DNA, 18 bp, Homo sapiens
ccacacatcccagcccaa

SEQ ID NO: 2900152 - DNA, 16 bp, Homo sapiens
ccacaccagcctcctg

SEQ ID NO: 2900153 - DNA, 19 bp, Homo sapiens
ccacaccccaacacttcca

SEQ ID NO: 2900154 - DNA, 13 bp, Homo sapiens
ccacaccctgcct

SEQ ID NO: 2900155 - DNA, 16 bp, Homo sapiens
ccacacctgcagtgcc

SEQ ID NO: 2900156 - DNA, 13 bp, Homo sapiens
ccacacctgcctg

SEQ ID NO: 2900157 - DNA, 20 bp, Homo sapiens
ccacacgcaggcggccaggg

SEQ ID NO: 2900158 - DNA, 15 bp, Homo sapiens
ccacactatgtgtgt

SEQ ID NO: 2900159 - DNA, 14 bp, Homo sapiens
ccacactcagcaca

SEQ ID NO: 2900160 - DNA, 17 bp, Homo sapiens
ccacactgaccaagtgc

SEQ ID NO: 2900161 - DNA, 18 bp, Homo sapiens
ccacactgaccaagtgct

SEQ ID NO: 2900162 - DNA, 19 bp, Homo sapiens
ccacactgatccagccctg

SEQ ID NO: 2900163 - DNA, 14 bp, Homo sapiens
ccacactggactcc

SEQ ID NO: 2900164 - DNA, 13 bp, Homo sapiens
ccacactgtgaca

SEQ ID NO: 2900165 - DNA, 20 bp, Homo sapiens
ccacacttgtgccagcccgg

SEQ ID NO: 2900166 - DNA, 23 bp, Homo sapiens
ccacagacaatacgtttgataat

SEQ ID NO: 2900167 - DNA, 14 bp, Homo sapiens
ccacagactgcccc

SEQ ID NO: 2900168 - DNA, 20 bp, Homo sapiens
ccacagactgccccagccaa

SEQ ID NO: 2900169 - DNA, 22 bp, Homo sapiens
ccacagagtgtagccaggtccc

SEQ ID NO: 2900170 - DNA, 19 bp, Homo sapiens
ccacagattgtttctatac

SEQ ID NO: 2900171 - DNA, 20 bp, Homo sapiens
ccacagcaaccccaggctga

SEQ ID NO: 2900172 - DNA, 15 bp, Homo sapiens
ccacagcccccaccc

SEQ ID NO: 2900173 - DNA, 19 bp, Homo sapiens
ccacagcccccaccccagc

SEQ ID NO: 2900174 - DNA, 23 bp, Homo sapiens
ccacagcccccgggacaccgtgg

SEQ ID NO: 2900175 - DNA, 13 bp, Homo sapiens
ccacagccctagt

SEQ ID NO: 2900176 - DNA, 19 bp, Homo sapiens
ccacagccctagtatgaaa

SEQ ID NO: 2900177 - DNA, 16 bp, Homo sapiens
ccacagcctgggaagg

SEQ ID NO: 2900178 - DNA, 21 bp, Homo sapiens
ccacagcgtgctggcgacact

SEQ ID NO: 2900179 - DNA, 16 bp, Homo sapiens
ccacagctcccacccc

SEQ ID NO: 2900180 - DNA, 16 bp, Homo sapiens
ccacagctgaagagca

SEQ ID NO: 2900181 - DNA, 19 bp, Homo sapiens
ccacaggaacggccctgca

SEQ ID NO: 2900182 - DNA, 16 bp, Homo sapiens
ccacaggacatttctc

SEQ ID NO: 2900183 - DNA, 18 bp, Homo sapiens
ccacaggacgaatgcata

SEQ ID NO: 2900184 - DNA, 15 bp, Homo sapiens
ccacaggagccctgc

SEQ ID NO: 2900185 - DNA, 16 bp, Homo sapiens
ccacaggagccctgct

SEQ ID NO: 2900186 - DNA, 20 bp, Homo sapiens
ccacaggagttgtgagccct

SEQ ID NO: 2900187 - DNA, 18 bp, Homo sapiens
ccacaggcacattaactg

SEQ ID NO: 2900188 - DNA, 11 bp, Homo sapiens
ccacagggcac

SEQ ID NO: 2900189 - DNA, 19 bp, Homo sapiens
ccacagggcacctgccacc

SEQ ID NO: 2900190 - DNA, 14 bp, Homo sapiens
ccacaggtctagac

SEQ ID NO: 2900191 - DNA, 22 bp, Homo sapiens
ccacaggtgcgggaccatctga

SEQ ID NO: 2900192 - DNA, 14 bp, Homo sapiens
ccacaggtgtgagc

SEQ ID NO: 2900193 - DNA, 17 bp, Homo sapiens
ccacaggtgtgagccac

SEQ ID NO: 2900194 - DNA, 17 bp, Homo sapiens
ccacagtagtcttgatg

SEQ ID NO: 2900195 - DNA, 14 bp, Homo sapiens
ccacatcaaagagg

SEQ ID NO: 2900196 - DNA, 15 bp, Homo sapiens
ccacatccccagagc

SEQ ID NO: 2900197 - DNA, 17 bp, Homo sapiens
ccacatccccagagccc

SEQ ID NO: 2900198 - DNA, 18 bp, Homo sapiens
ccacatccccagagccca

SEQ ID NO: 2900199 - DNA, 20 bp, Homo sapiens
ccacatccccagagcccagc

SEQ ID NO: 2900200 - DNA, 20 bp, Homo sapiens
ccacatcccgggacgcagca

SEQ ID NO: 2900201 - DNA, 13 bp, Homo sapiens
ccacatcctccac

SEQ ID NO: 2900202 - DNA, 17 bp, Homo sapiens
ccacatggtgtggccat

SEQ ID NO: 2900203 - DNA, 21 bp, Homo sapiens
ccacatggtgtggccatcact

SEQ ID NO: 2900204 - DNA, 13 bp, Homo sapiens
ccacatgtccagc

SEQ ID NO: 2900205 - DNA, 15 bp, Homo sapiens
ccacatgtgacacat

SEQ ID NO: 2900206 - DNA, 19 bp, Homo sapiens
ccacatgtgacacatatgc

SEQ ID NO: 2900207 - DNA, 14 bp, Homo sapiens
ccacattagaactt

SEQ ID NO: 2900208 - DNA, 15 bp, Homo sapiens
ccacatttagtatcc

SEQ ID NO: 2900209 - DNA, 17 bp, Homo sapiens
ccacatttagtctcttt

SEQ ID NO: 2900210 - DNA, 14 bp, Homo sapiens
ccacatttctaaaa

SEQ ID NO: 2900211 - DNA, 15 bp, Homo sapiens
ccacattttaggatc

SEQ ID NO: 2900212 - DNA, 17 bp, Homo sapiens
ccaccaaccccgcggcc

SEQ ID NO: 2900213 - DNA, 20 bp, Homo sapiens
ccaccaactttttccaagtc

SEQ ID NO: 2900214 - DNA, 17 bp, Homo sapiens
ccaccaagagggacgcc

SEQ ID NO: 2900215 - DNA, 18 bp, Homo sapiens
ccaccaaggtctcacact

SEQ ID NO: 2900216 - DNA, 17 bp, Homo sapiens
ccaccacacatcccagc

SEQ ID NO: 2900217 - DNA, 20 bp, Homo sapiens
ccaccacacatcccagccca

SEQ ID NO: 2900218 - DNA, 15 bp, Homo sapiens
ccaccacacctggct

SEQ ID NO: 2900219 - DNA, 21 bp, Homo sapiens
ccaccacactgatccagccct

SEQ ID NO: 2900220 - DNA, 23 bp, Homo sapiens
ccaccacagcttatggcatctca

SEQ ID NO: 2900221 - DNA, 12 bp, Homo sapiens
ccaccacctagg

SEQ ID NO: 2900222 - DNA, 18 bp, Homo sapiens
ccaccacctaggccactc

SEQ ID NO: 2900223 - DNA, 20 bp, Homo sapiens
ccaccacctaggccactcct

SEQ ID NO: 2900224 - DNA, 21 bp, Homo sapiens
ccaccacgatgtggccctggc

SEQ ID NO: 2900225 - DNA, 15 bp, Homo sapiens
ccaccagagcagggg

SEQ ID NO: 2900226 - DNA, 19 bp, Homo sapiens
ccaccagagcaggggctgc

SEQ ID NO: 2900227 - DNA, 21 bp, Homo sapiens
ccaccaggagcacctggaccc

SEQ ID NO: 2900228 - DNA, 13 bp, Homo sapiens
ccaccaggtctcc

SEQ ID NO: 2900229 - DNA, 16 bp, Homo sapiens
ccaccaggtgcctttc

SEQ ID NO: 2900230 - DNA, 19 bp, Homo sapiens
ccaccaggtgcctttcaaa

SEQ ID NO: 2900231 - DNA, 21 bp, Homo sapiens
ccaccatgcacccctgatgtt

SEQ ID NO: 2900232 - DNA, 14 bp, Homo sapiens
ccaccatgcccagc

SEQ ID NO: 2900233 - DNA, 19 bp, Homo sapiens
ccacccaaaccccttccca

SEQ ID NO: 2900234 - DNA, 23 bp, Homo sapiens
ccacccaaaccccttcccacgac

SEQ ID NO: 2900235 - DNA, 15 bp, Homo sapiens
ccacccaagagagga

SEQ ID NO: 2900236 - DNA, 19 bp, Homo sapiens
ccacccacctccctgcctc

SEQ ID NO: 2900237 - DNA, 14 bp, Homo sapiens
ccacccacgtggag

SEQ ID NO: 2900238 - DNA, 18 bp, Homo sapiens
ccacccacgtggagacag

SEQ ID NO: 2900239 - DNA, 13 bp, Homo sapiens
ccacccagctcca

SEQ ID NO: 2900240 - DNA, 17 bp, Homo sapiens
ccacccagctccaggcc

SEQ ID NO: 2900241 - DNA, 22 bp, Homo sapiens
ccacccaggaagggagggagct

SEQ ID NO: 2900242 - DNA, 12 bp, Homo sapiens
ccaccccagcac

SEQ ID NO: 2900243 - DNA, 16 bp, Homo sapiens
ccacccccagccctgg

SEQ ID NO: 2900244 - DNA, 18 bp, Homo sapiens
ccacccccaggacccctg

SEQ ID NO: 2900245 - DNA, 21 bp, Homo sapiens
ccacccccaggtttttgccca

SEQ ID NO: 2900246 - DNA, 23 bp, Homo sapiens
ccacccccaggtttttgcccatc

SEQ ID NO: 2900247 - DNA, 13 bp, Homo sapiens
ccacccccctccc

SEQ ID NO: 2900248 - DNA, 16 bp, Homo sapiens
ccaccccctccccagg

SEQ ID NO: 2900249 - DNA, 18 bp, Homo sapiens
ccaccccctccccagggg

SEQ ID NO: 2900250 - DNA, 12 bp, Homo sapiens
ccacccccttca

SEQ ID NO: 2900251 - DNA, 22 bp, Homo sapiens
ccacccccttcagtgcccacca

SEQ ID NO: 2900252 - DNA, 14 bp, Homo sapiens
ccacccctgccact

SEQ ID NO: 2900253 - DNA, 20 bp, Homo sapiens
ccacccctgccactcaccct

SEQ ID NO: 2900254 - DNA, 22 bp, Homo sapiens
ccaccccttcgacatgctgcca

SEQ ID NO: 2900255 - DNA, 17 bp, Homo sapiens
ccaccctaagggcagcc

SEQ ID NO: 2900256 - DNA, 16 bp, Homo sapiens
ccaccctagcctccac

SEQ ID NO: 2900257 - DNA, 13 bp, Homo sapiens
ccaccctgcccac

SEQ ID NO: 2900258 - DNA, 22 bp, Homo sapiens
ccaccctggccgagtccaagct

SEQ ID NO: 2900259 - DNA, 20 bp, Homo sapiens
ccaccctgggtttggcccct

SEQ ID NO: 2900260 - DNA, 14 bp, Homo sapiens
ccacccttccctgc

SEQ ID NO: 2900261 - DNA, 16 bp, Homo sapiens
ccacccttccctgcct

SEQ ID NO: 2900262 - DNA, 18 bp, Homo sapiens
ccacccttccctgcctcc

SEQ ID NO: 2900263 - DNA, 21 bp, Homo sapiens
ccacccttccctgcctccagc

SEQ ID NO: 2900264 - DNA, 14 bp, Homo sapiens
ccaccgagctctgt

SEQ ID NO: 2900265 - DNA, 17 bp, Homo sapiens
ccaccgagctctgtggg

SEQ ID NO: 2900266 - DNA, 12 bp, Homo sapiens
ccaccgcagctg

SEQ ID NO: 2900267 - DNA, 13 bp, Homo sapiens
ccaccgcagctgc

SEQ ID NO: 2900268 - DNA, 17 bp, Homo sapiens
ccaccgcagctgctgcc

SEQ ID NO: 2900269 - DNA, 17 bp, Homo sapiens
ccaccgcccagagaccc

SEQ ID NO: 2900270 - DNA, 18 bp, Homo sapiens
ccaccgccggggtcctgg

SEQ ID NO: 2900271 - DNA, 20 bp, Homo sapiens
ccaccgccggggtcctggga

SEQ ID NO: 2900272 - DNA, 13 bp, Homo sapiens
ccaccgctgccta

SEQ ID NO: 2900273 - DNA, 15 bp, Homo sapiens
ccaccgctgcctaag

SEQ ID NO: 2900274 - DNA, 20 bp, Homo sapiens
ccaccgggcatgtctgcctg

SEQ ID NO: 2900275 - DNA, 22 bp, Homo sapiens
ccaccgggcatgtctgcctgga

SEQ ID NO: 2900276 - DNA, 24 bp, Homo sapiens
ccaccgggcatgtctgcctggagt

SEQ ID NO: 2900277 - DNA, 14 bp, Homo sapiens
ccaccgggctgcag

SEQ ID NO: 2900278 - DNA, 18 bp, Homo sapiens
ccaccgggctgcaggtgc

SEQ ID NO: 2900279 - DNA, 17 bp, Homo sapiens
ccaccgggggtggctct

SEQ ID NO: 2900280 - DNA, 18 bp, Homo sapiens
ccaccgggggtggctctg

SEQ ID NO: 2900281 - DNA, 19 bp, Homo sapiens
ccaccgggggtggctctgt

SEQ ID NO: 2900282 - DNA, 23 bp, Homo sapiens
ccacctacttttctttcctcaga

SEQ ID NO: 2900283 - DNA, 13 bp, Homo sapiens
ccacctagcagca

SEQ ID NO: 2900284 - DNA, 17 bp, Homo sapiens
ccacctaggccactcct

SEQ ID NO: 2900285 - DNA, 18 bp, Homo sapiens
ccacctaggccactcctc

SEQ ID NO: 2900286 - DNA, 22 bp, Homo sapiens
ccacctaggccactcctccaaa

SEQ ID NO: 2900287 - DNA, 15 bp, Homo sapiens
ccacctagtgcccca

SEQ ID NO: 2900288 - DNA, 19 bp, Homo sapiens
ccacctagtgccccagact

SEQ ID NO: 2900289 - DNA, 22 bp, Homo sapiens
ccacctatccctaacaggctgt

SEQ ID NO: 2900290 - DNA, 18 bp, Homo sapiens
ccacctcacaactccttc

SEQ ID NO: 2900291 - DNA, 16 bp, Homo sapiens
ccacctcagccttgga

SEQ ID NO: 2900292 - DNA, 18 bp, Homo sapiens
ccacctccctgcctccag

SEQ ID NO: 2900293 - DNA, 14 bp, Homo sapiens
ccacctcggccctc

SEQ ID NO: 2900294 - DNA, 18 bp, Homo sapiens
ccacctctccctgaccct

SEQ ID NO: 2900295 - DNA, 17 bp, Homo sapiens
ccacctctctgtctttt

SEQ ID NO: 2900296 - DNA, 22 bp, Homo sapiens
ccacctctcttttcctctctgt

SEQ ID NO: 2900297 - DNA, 16 bp, Homo sapiens
ccacctgaaagcctgt

SEQ ID NO: 2900298 - DNA, 20 bp, Homo sapiens
ccacctgaaagcctgtctct

SEQ ID NO: 2900299 - DNA, 15 bp, Homo sapiens
ccacctgctgagaga

SEQ ID NO: 2900300 - DNA, 22 bp, Homo sapiens
ccacctggacgaagagcaggcc

SEQ ID NO: 2900301 - DNA, 12 bp, Homo sapiens
ccacctggcccc

SEQ ID NO: 2900302 - DNA, 13 bp, Homo sapiens
ccacctgggctgg

SEQ ID NO: 2900303 - DNA, 19 bp, Homo sapiens
ccacctgtcaaacaaagcc

SEQ ID NO: 2900304 - DNA, 20 bp, Homo sapiens
ccacctgtcaaacaaagcca

SEQ ID NO: 2900305 - DNA, 22 bp, Homo sapiens
ccacctgtcaaacaaagccaga

SEQ ID NO: 2900306 - DNA, 22 bp, Homo sapiens
ccaccttatacatcacttcctg

SEQ ID NO: 2900307 - DNA, 16 bp, Homo sapiens
ccaccttcccacccct

SEQ ID NO: 2900308 - DNA, 14 bp, Homo sapiens
ccaccttgattttc

SEQ ID NO: 2900309 - DNA, 16 bp, Homo sapiens
ccaccttggagcattt

SEQ ID NO: 2900310 - DNA, 17 bp, Homo sapiens
ccacctttcagcccacg

SEQ ID NO: 2900311 - DNA, 22 bp, Homo sapiens
ccacgacaaaaacaagactgcc

SEQ ID NO: 2900312 - DNA, 23 bp, Homo sapiens
ccacgacccctgcctcgagggcc

SEQ ID NO: 2900313 - DNA, 12 bp, Homo sapiens
ccacgagggctg

SEQ ID NO: 2900314 - DNA, 14 bp, Homo sapiens
ccacgagggctggc

SEQ ID NO: 2900315 - DNA, 17 bp, Homo sapiens
ccacgaggggacccatg

SEQ ID NO: 2900316 - DNA, 17 bp, Homo sapiens
ccacgatgtggccctgg

SEQ ID NO: 2900317 - DNA, 18 bp, Homo sapiens
ccacgcacctccacgcca

SEQ ID NO: 2900318 - DNA, 15 bp, Homo sapiens
ccacgccactgcctc

SEQ ID NO: 2900319 - DNA, 14 bp, Homo sapiens
ccacgccttgacct

SEQ ID NO: 2900320 - DNA, 12 bp, Homo sapiens
ccacgctccagc

SEQ ID NO: 2900321 - DNA, 22 bp, Homo sapiens
ccacgggacatcacagggtggg

SEQ ID NO: 2900322 - DNA, 14 bp, Homo sapiens
ccacggggaccact

SEQ ID NO: 2900323 - DNA, 17 bp, Homo sapiens
ccacggggaccactggg

SEQ ID NO: 2900324 - DNA, 21 bp, Homo sapiens
ccacggggaccactgggcccc

SEQ ID NO: 2900325 - DNA, 23 bp, Homo sapiens
ccacggggaccactgggcccctc

SEQ ID NO: 2900326 - DNA, 16 bp, Homo sapiens
ccacgtaccaagccac

SEQ ID NO: 2900327 - DNA, 20 bp, Homo sapiens
ccacgtaccaagccaccgca

SEQ ID NO: 2900328 - DNA, 20 bp, Homo sapiens
ccacgtattccccttcccac

SEQ ID NO: 2900329 - DNA, 14 bp, Homo sapiens
ccacgtctctctgc

SEQ ID NO: 2900330 - DNA, 17 bp, Homo sapiens
ccacgtctctctgcctg

SEQ ID NO: 2900331 - DNA, 19 bp, Homo sapiens
ccacgtctctctgcctgct

SEQ ID NO: 2900332 - DNA, 21 bp, Homo sapiens
ccacgtctctctgcctgctgg

SEQ ID NO: 2900333 - DNA, 23 bp, Homo sapiens
ccacgtctctctgcctgctgggc

SEQ ID NO: 2900334 - DNA, 15 bp, Homo sapiens
ccacgtgccaggccc

SEQ ID NO: 2900335 - DNA, 23 bp, Homo sapiens
ccacgtgccaggcccggggctgg

SEQ ID NO: 2900336 - DNA, 15 bp, Homo sapiens
ccacgttcagggagg

SEQ ID NO: 2900337 - DNA, 16 bp, Homo sapiens
ccacgttcagggaggg

SEQ ID NO: 2900338 - DNA, 13 bp, Homo sapiens
ccactaatgcaaa

SEQ ID NO: 2900339 - DNA, 20 bp, Homo sapiens
ccactataaaatgtcttcaa

SEQ ID NO: 2900340 - DNA, 14 bp, Homo sapiens
ccactatctgggtg

SEQ ID NO: 2900341 - DNA, 13 bp, Homo sapiens
ccactcaacagag

SEQ ID NO: 2900342 - DNA, 17 bp, Homo sapiens
ccactcaagccaagcag

SEQ ID NO: 2900343 - DNA, 17 bp, Homo sapiens
ccactcacccttcctgg

SEQ ID NO: 2900344 - DNA, 14 bp, Homo sapiens
ccactcacctttct

SEQ ID NO: 2900345 - DNA, 21 bp, Homo sapiens
ccactcacctttctccactgg

SEQ ID NO: 2900346 - DNA, 22 bp, Homo sapiens
ccactcacctttctccactggg

SEQ ID NO: 2900347 - DNA, 19 bp, Homo sapiens
ccactcatgtgactctttc

SEQ ID NO: 2900348 - DNA, 18 bp, Homo sapiens
ccactccaagccccctgg

SEQ ID NO: 2900349 - DNA, 20 bp, Homo sapiens
ccactccaagccccctggca

SEQ ID NO: 2900350 - DNA, 15 bp, Homo sapiens
ccactccccggcatg

SEQ ID NO: 2900351 - DNA, 15 bp, Homo sapiens
ccactcctccctccg

SEQ ID NO: 2900352 - DNA, 12 bp, Homo sapiens
ccactcctctaa

SEQ ID NO: 2900353 - DNA, 23 bp, Homo sapiens
ccactcctctcaactgcctcagc

SEQ ID NO: 2900354 - DNA, 16 bp, Homo sapiens
ccactcctgccagccc

SEQ ID NO: 2900355 - DNA, 15 bp, Homo sapiens
ccactctaccagtgc

SEQ ID NO: 2900356 - DNA, 23 bp, Homo sapiens
ccactctaccagtgcaggctggc

SEQ ID NO: 2900357 - DNA, 17 bp, Homo sapiens
ccactctctaccagata

SEQ ID NO: 2900358 - DNA, 15 bp, Homo sapiens
ccactctgcctgcct

SEQ ID NO: 2900359 - DNA, 12 bp, Homo sapiens
ccactctgctgc

SEQ ID NO: 2900360 - DNA, 17 bp, Homo sapiens
ccactgaaaagctttcc

SEQ ID NO: 2900361 - DNA, 14 bp, Homo sapiens
ccactgaaatctgt

SEQ ID NO: 2900362 - DNA, 20 bp, Homo sapiens
ccactgaattgacatgaccc

SEQ ID NO: 2900363 - DNA, 22 bp, Homo sapiens
ccactgaattgacatgaccctc

SEQ ID NO: 2900364 - DNA, 13 bp, Homo sapiens
ccactgaccagaa

SEQ ID NO: 2900365 - DNA, 17 bp, Homo sapiens
ccactgagctctgcctc

SEQ ID NO: 2900366 - DNA, 18 bp, Homo sapiens
ccactgagctctgcctca

SEQ ID NO: 2900367 - DNA, 19 bp, Homo sapiens
ccactgagctctgcctcaa

SEQ ID NO: 2900368 - DNA, 13 bp, Homo sapiens
ccactgagggcag

SEQ ID NO: 2900369 - DNA, 15 bp, Homo sapiens
ccactgcactccagc

SEQ ID NO: 2900370 - DNA, 13 bp, Homo sapiens
ccactgcaggccc

SEQ ID NO: 2900371 - DNA, 21 bp, Homo sapiens
ccactgccaggattttgtatt

SEQ ID NO: 2900372 - DNA, 12 bp, Homo sapiens
ccactgcctcct

SEQ ID NO: 2900373 - DNA, 13 bp, Homo sapiens
ccactgcctcctc

SEQ ID NO: 2900374 - DNA, 17 bp, Homo sapiens
ccactgctcgaaatggc

SEQ ID NO: 2900375 - DNA, 11 bp, Homo sapiens
ccactggaagg

SEQ ID NO: 2900376 - DNA, 16 bp, Homo sapiens
ccactggaaggagcac

SEQ ID NO: 2900377 - DNA, 21 bp, Homo sapiens
ccactggaggggtcatccttg

SEQ ID NO: 2900378 - DNA, 18 bp, Homo sapiens
ccactggcacatttttct

SEQ ID NO: 2900379 - DNA, 15 bp, Homo sapiens
ccactgggcacctgc

SEQ ID NO: 2900380 - DNA, 19 bp, Homo sapiens
ccactgggcacctgcgcac

SEQ ID NO: 2900381 - DNA, 22 bp, Homo sapiens
ccactgggcacctgcgcacagg

SEQ ID NO: 2900382 - DNA, 12 bp, Homo sapiens
ccactggggaaa

SEQ ID NO: 2900383 - DNA, 22 bp, Homo sapiens
ccactggggaaataacagctgt

SEQ ID NO: 2900384 - DNA, 18 bp, Homo sapiens
ccactggtaacatgtgac

SEQ ID NO: 2900385 - DNA, 20 bp, Homo sapiens
ccactggtccccaacaatgt

SEQ ID NO: 2900386 - DNA, 15 bp, Homo sapiens
ccactgtcctgggcc

SEQ ID NO: 2900387 - DNA, 19 bp, Homo sapiens
ccactgtcctgggcctgca

SEQ ID NO: 2900388 - DNA, 19 bp, Homo sapiens
ccactgtgtttctgtgctc

SEQ ID NO: 2900389 - DNA, 14 bp, Homo sapiens
ccacttctcatcac

SEQ ID NO: 2900390 - DNA, 23 bp, Homo sapiens
ccacttctcatcacacacatgga

SEQ ID NO: 2900391 - DNA, 13 bp, Homo sapiens
ccacttctctggg

SEQ ID NO: 2900392 - DNA, 10 bp, Homo sapiens
ccacttctgg

SEQ ID NO: 2900393 - DNA, 16 bp, Homo sapiens
ccacttgccagggctc

SEQ ID NO: 2900394 - DNA, 19 bp, Homo sapiens
ccacttgtcccactatctg

SEQ ID NO: 2900395 - DNA, 13 bp, Homo sapiens
ccacttgtgggtc

SEQ ID NO: 2900396 - DNA, 21 bp, Homo sapiens
ccacttgtgggtcctggggtc

SEQ ID NO: 2900397 - DNA, 23 bp, Homo sapiens
ccactttccaccaactttttcca

SEQ ID NO: 2900398 - DNA, 17 bp, Homo sapiens
ccactttcttattctgt

SEQ ID NO: 2900399 - DNA, 16 bp, Homo sapiens
ccagaaaacaaaactg

SEQ ID NO: 2900400 - DNA, 18 bp, Homo sapiens
ccagaaacctgggagaga

SEQ ID NO: 2900401 - DNA, 16 bp, Homo sapiens
ccagaaagaaaatgaa

SEQ ID NO: 2900402 - DNA, 17 bp, Homo sapiens
ccagaacacactccatc

SEQ ID NO: 2900403 - DNA, 22 bp, Homo sapiens
ccagaacacactccatcagctt

SEQ ID NO: 2900404 - DNA, 20 bp, Homo sapiens
ccagaacgtggctctgctgg

SEQ ID NO: 2900405 - DNA, 20 bp, Homo sapiens
ccagaagcagagagcacagc

SEQ ID NO: 2900406 - DNA, 22 bp, Homo sapiens
ccagaagcctccttacattaaa

SEQ ID NO: 2900407 - DNA, 23 bp, Homo sapiens
ccagaagcctccttacattaaaa

SEQ ID NO: 2900408 - DNA, 13 bp, Homo sapiens
ccagaaggaaggt

SEQ ID NO: 2900409 - DNA, 17 bp, Homo sapiens
ccagaaggatttcttgt

SEQ ID NO: 2900410 - DNA, 18 bp, Homo sapiens
ccagaaggatttcttgta

SEQ ID NO: 2900411 - DNA, 19 bp, Homo sapiens
ccagaagtaacttattttg

SEQ ID NO: 2900412 - DNA, 19 bp, Homo sapiens
ccagaagtattgtttacat

SEQ ID NO: 2900413 - DNA, 23 bp, Homo sapiens
ccagaagttgtggatttcagttt

SEQ ID NO: 2900414 - DNA, 21 bp, Homo sapiens
ccagaataagttattgcagtt

SEQ ID NO: 2900415 - DNA, 23 bp, Homo sapiens
ccagaataagttattgcagttta

SEQ ID NO: 2900416 - DNA, 14 bp, Homo sapiens
ccagaatgtgctgc

SEQ ID NO: 2900417 - DNA, 17 bp, Homo sapiens
ccagaatgtgctgcctt

SEQ ID NO: 2900418 - DNA, 14 bp, Homo sapiens
ccagacaaggagag

SEQ ID NO: 2900419 - DNA, 20 bp, Homo sapiens
ccagacaatgttgtgtttgg

SEQ ID NO: 2900420 - DNA, 15 bp, Homo sapiens
ccagacacaggccct

SEQ ID NO: 2900421 - DNA, 16 bp, Homo sapiens
ccagacacccaggact

SEQ ID NO: 2900422 - DNA, 12 bp, Homo sapiens
ccagacactggt

SEQ ID NO: 2900423 - DNA, 17 bp, Homo sapiens
ccagacagacaacactg

SEQ ID NO: 2900424 - DNA, 16 bp, Homo sapiens
ccagacagctgctcag

SEQ ID NO: 2900425 - DNA, 23 bp, Homo sapiens
ccagacccagcccgcggcctgga

SEQ ID NO: 2900426 - DNA, 12 bp, Homo sapiens
ccagaccccctg

SEQ ID NO: 2900427 - DNA, 15 bp, Homo sapiens
ccagacctgatcctg

SEQ ID NO: 2900428 - DNA, 16 bp, Homo sapiens
ccagacctgatcctgg

SEQ ID NO: 2900429 - DNA, 17 bp, Homo sapiens
ccagacctgatcctgga

SEQ ID NO: 2900430 - DNA, 18 bp, Homo sapiens
ccagacctgatcctggag

SEQ ID NO: 2900431 - DNA, 19 bp, Homo sapiens
ccagacctgatcctggagg

SEQ ID NO: 2900432 - DNA, 21 bp, Homo sapiens
ccagacctgatcctggaggcc

SEQ ID NO: 2900433 - DNA, 16 bp, Homo sapiens
ccagactacttgggag

SEQ ID NO: 2900434 - DNA, 15 bp, Homo sapiens
ccagactctgcctag

SEQ ID NO: 2900435 - DNA, 15 bp, Homo sapiens
ccagactgagctctc

SEQ ID NO: 2900436 - DNA, 20 bp, Homo sapiens
ccagactgagctctccaggc

SEQ ID NO: 2900437 - DNA, 22 bp, Homo sapiens
ccagactgagctctccaggcca

SEQ ID NO: 2900438 - DNA, 24 bp, Homo sapiens
ccagactgagctctccaggccagg

SEQ ID NO: 2900439 - DNA, 19 bp, Homo sapiens
ccagactgggcccaggcag

SEQ ID NO: 2900440 - DNA, 21 bp, Homo sapiens
ccagactgggcccaggcaggt

SEQ ID NO: 2900441 - DNA, 23 bp, Homo sapiens
ccagactgggcccaggcaggtct

SEQ ID NO: 2900442 - DNA, 21 bp, Homo sapiens
ccagcagtctctgccttgcct

SEQ ID NO: 2900443 - DNA, 15 bp, Homo sapiens
ccagcatcacctgcc

SEQ ID NO: 2900444 - DNA, 18 bp, Homo sapiens
ccagcatcacctgcctgt

SEQ ID NO: 2900445 - DNA, 12 bp, Homo sapiens
ccagcatctctg

SEQ ID NO: 2900446 - DNA, 14 bp, Homo sapiens
ccagcatggatgaa

SEQ ID NO: 2900447 - DNA, 13 bp, Homo sapiens
ccagcattctcag

SEQ ID NO: 2900448 - DNA, 16 bp, Homo sapiens
ccagcattctcagcca

SEQ ID NO: 2900449 - DNA, 16 bp, Homo sapiens
ccagcatttagctggc

SEQ ID NO: 2900450 - DNA, 17 bp, Homo sapiens
ccagcatttagctggcc

SEQ ID NO: 2900451 - DNA, 20 bp, Homo sapiens
ccagcatttagctggccaca

SEQ ID NO: 2900452 - DNA, 21 bp, Homo sapiens
ccagccaaggataccggacac

SEQ ID NO: 2900453 - DNA, 17 bp, Homo sapiens
ccagccacccctcagat

SEQ ID NO: 2900454 - DNA, 15 bp, Homo sapiens
ccagccacccctgcc

SEQ ID NO: 2900455 - DNA, 16 bp, Homo sapiens
ccagccacccctgcca

SEQ ID NO: 2900456 - DNA, 19 bp, Homo sapiens
ccagccactccaagccccc

SEQ ID NO: 2900457 - DNA, 22 bp, Homo sapiens
ccagccagaacgtggctctgct

SEQ ID NO: 2900458 - DNA, 23 bp, Homo sapiens
ccagccagaacgtggctctgctg

SEQ ID NO: 2900459 - DNA, 14 bp, Homo sapiens
ccagccagccaccc

SEQ ID NO: 2900460 - DNA, 15 bp, Homo sapiens
ccagccagccacccc

SEQ ID NO: 2900461 - DNA, 14 bp, Homo sapiens
ccagccagccactc

SEQ ID NO: 2900462 - DNA, 15 bp, Homo sapiens
ccagccaggccctgc

SEQ ID NO: 2900463 - DNA, 20 bp, Homo sapiens
ccagccagtgacctgaggaa

SEQ ID NO: 2900464 - DNA, 18 bp, Homo sapiens
ccagcccaatccaggtac

SEQ ID NO: 2900465 - DNA, 13 bp, Homo sapiens
ccagcccacagag

SEQ ID NO: 2900466 - DNA, 13 bp, Homo sapiens
ccagcccagagcc

SEQ ID NO: 2900467 - DNA, 14 bp, Homo sapiens
ccagcccagagccc

SEQ ID NO: 2900468 - DNA, 17 bp, Homo sapiens
ccagcccagagcccggt

SEQ ID NO: 2900469 - DNA, 12 bp, Homo sapiens
ccagcccagccc

SEQ ID NO: 2900470 - DNA, 21 bp, Homo sapiens
ccagcccattctctctcctgt

SEQ ID NO: 2900471 - DNA, 16 bp, Homo sapiens
ccagccccgctcccac

SEQ ID NO: 2900472 - DNA, 24 bp, Homo sapiens
ccagccccgctcccacctagtgcc

SEQ ID NO: 2900473 - DNA, 14 bp, Homo sapiens
ccagcccctgctgg

SEQ ID NO: 2900474 - DNA, 23 bp, Homo sapiens
ccagcccctgctggctggtgcct

SEQ ID NO: 2900475 - DNA, 13 bp, Homo sapiens
ccagcccctggcc

SEQ ID NO: 2900476 - DNA, 14 bp, Homo sapiens
ccagcccgcggcct

SEQ ID NO: 2900477 - DNA, 18 bp, Homo sapiens
ccagcccgcggcctggac

SEQ ID NO: 2900478 - DNA, 17 bp, Homo sapiens
ccagcccggaggggact

SEQ ID NO: 2900479 - DNA, 21 bp, Homo sapiens
ccagcccggctcggcccagca

SEQ ID NO: 2900480 - DNA, 13 bp, Homo sapiens
ccagccctcatcc

SEQ ID NO: 2900481 - DNA, 13 bp, Homo sapiens
ccagccctccctg

SEQ ID NO: 2900482 - DNA, 14 bp, Homo sapiens
ccagccctgagttc

SEQ ID NO: 2900483 - DNA, 13 bp, Homo sapiens
ccagcccttgaat

SEQ ID NO: 2900484 - DNA, 21 bp, Homo sapiens
ccagccgctctcctgccacat

SEQ ID NO: 2900485 - DNA, 20 bp, Homo sapiens
ccagcctcacagatgctggc

SEQ ID NO: 2900486 - DNA, 22 bp, Homo sapiens
ccagcctcacagatgctggcct

SEQ ID NO: 2900487 - DNA, 23 bp, Homo sapiens
ccagcctctcctccttgggcagg

SEQ ID NO: 2900488 - DNA, 15 bp, Homo sapiens
ccagcctgagtgaca

SEQ ID NO: 2900489 - DNA, 22 bp, Homo sapiens
ccagcctgagtgacagagcgag

SEQ ID NO: 2900490 - DNA, 20 bp, Homo sapiens
ccagcctgcctggcaggctg

SEQ ID NO: 2900491 - DNA, 21 bp, Homo sapiens
ccagcctgcctggcaggctgt

SEQ ID NO: 2900492 - DNA, 11 bp, Homo sapiens
ccagcctggcc

SEQ ID NO: 2900493 - DNA, 17 bp, Homo sapiens
ccagcctggccaacatg

SEQ ID NO: 2900494 - DNA, 16 bp, Homo sapiens
ccagcctgggaggcac

SEQ ID NO: 2900495 - DNA, 18 bp, Homo sapiens
ccagcctgggaggcacag

SEQ ID NO: 2900496 - DNA, 23 bp, Homo sapiens
ccagcctgggaggcacagcaaac

SEQ ID NO: 2900497 - DNA, 22 bp, Homo sapiens
ccagcctgggtcacagagtgag

SEQ ID NO: 2900498 - DNA, 14 bp, Homo sapiens
ggcctgtcctccaa

SEQ ID NO: 2900499 - DNA, 11 bp, Homo sapiens
ggcctgtgagg

SEQ ID NO: 2900500 - DNA, 15 bp, Homo sapiens
ggcctgtgaggggcc

SEQ ID NO: 2900501 - DNA, 21 bp, Homo sapiens
ggcctgtgaggggcccctggc

SEQ ID NO: 2900502 - DNA, 14 bp, Homo sapiens
ggcctgtggggagc

SEQ ID NO: 2900503 - DNA, 17 bp, Homo sapiens
ggcctgtgtggaggcct

SEQ ID NO: 2900504 - DNA, 12 bp, Homo sapiens
ggccttaagctt

SEQ ID NO: 2900505 - DNA, 14 bp, Homo sapiens
ggccttaataaata

SEQ ID NO: 2900506 - DNA, 18 bp, Homo sapiens
ggccttcgattttaaata

SEQ ID NO: 2900507 - DNA, 16 bp, Homo sapiens
ggccttgaagactccc

SEQ ID NO: 2900508 - DNA, 15 bp, Homo sapiens
ggccttgcagctggc

SEQ ID NO: 2900509 - DNA, 18 bp, Homo sapiens
ggccttgcagctggccca

SEQ ID NO: 2900510 - DNA, 19 bp, Homo sapiens
ggccttgcagctggcccac

SEQ ID NO: 2900511 - DNA, 15 bp, Homo sapiens
ggccttgcccagaga

SEQ ID NO: 2900512 - DNA, 13 bp, Homo sapiens
ggccttgcccgtc

SEQ ID NO: 2900513 - DNA, 15 bp, Homo sapiens
ggccttgctgactct

SEQ ID NO: 2900514 - DNA, 18 bp, Homo sapiens
ggccttgctgactctctg

SEQ ID NO: 2900515 - DNA, 21 bp, Homo sapiens
ggccttgctgactctctgagc

SEQ ID NO: 2900516 - DNA, 24 bp, Homo sapiens
ggccttggggtgggggccaggcct

SEQ ID NO: 2900517 - DNA, 18 bp, Homo sapiens
ggccttggtatgtgccag

SEQ ID NO: 2900518 - DNA, 12 bp, Homo sapiens
ggccttgtccca

SEQ ID NO: 2900519 - DNA, 17 bp, Homo sapiens
ggccttgtgtgtcaggc

SEQ ID NO: 2900520 - DNA, 23 bp, Homo sapiens
ggcctttgctgcccttggtttct

SEQ ID NO: 2900521 - DNA, 13 bp, Homo sapiens
ggccttttccaaa

SEQ ID NO: 2900522 - DNA, 15 bp, Homo sapiens
ggccttttccaaatg

SEQ ID NO: 2900523 - DNA, 16 bp, Homo sapiens
ggccttttctggcacc

SEQ ID NO: 2900524 - DNA, 16 bp, Homo sapiens
ggcgacactcagggca

SEQ ID NO: 2900525 - DNA, 23 bp, Homo sapiens
ggcgacactcagggcagctgcct

SEQ ID NO: 2900526 - DNA, 17 bp, Homo sapiens
ggcgacgcggttttttc

SEQ ID NO: 2900527 - DNA, 15 bp, Homo sapiens
ggcgagcccttagcc

SEQ ID NO: 2900528 - DNA, 14 bp, Homo sapiens
ggcgagcctgactc

SEQ ID NO: 2900529 - DNA, 19 bp, Homo sapiens
ggcgagcctgactctgttg

SEQ ID NO: 2900530 - DNA, 21 bp, Homo sapiens
ggcgatcgcggcggagctggc

SEQ ID NO: 2900531 - DNA, 15 bp, Homo sapiens
ggcgccaactgctga

SEQ ID NO: 2900532 - DNA, 22 bp, Homo sapiens
ggcgcccagcagcctgccagca

SEQ ID NO: 2900533 - DNA, 21 bp, Homo sapiens
ggcgccccgcacctgtacagt

SEQ ID NO: 2900534 - DNA, 18 bp, Homo sapiens
ggcgcccgcacccacccg

SEQ ID NO: 2900535 - DNA, 15 bp, Homo sapiens
ggcgccctggacttg

SEQ ID NO: 2900536 - DNA, 23 bp, Homo sapiens
ggcgcctataatcccagctactg

SEQ ID NO: 2900537 - DNA, 12 bp, Homo sapiens
ggcgcctgccct

SEQ ID NO: 2900538 - DNA, 19 bp, Homo sapiens
ggcgcctgccctgcccaag

SEQ ID NO: 2900539 - DNA, 20 bp, Homo sapiens
ggcgcctgccctgcccaagt

SEQ ID NO: 2900540 - DNA, 20 bp, Homo sapiens
ggcgcctggagagcgaggag

SEQ ID NO: 2900541 - DNA, 18 bp, Homo sapiens
ggcgccttctcggagctg

SEQ ID NO: 2900542 - DNA, 18 bp, Homo sapiens
ggcgcggcctcccgagga

SEQ ID NO: 2900543 - DNA, 23 bp, Homo sapiens
ggcgcgggcccctcacctggtac

SEQ ID NO: 2900544 - DNA, 23 bp, Homo sapiens
ggcgctacaaaataaagctgttc

SEQ ID NO: 2900545 - DNA, 20 bp, Homo sapiens
ggcggacaaaagggccaggt

SEQ ID NO: 2900546 - DNA, 14 bp, Homo sapiens
ggcggagctggccc

SEQ ID NO: 2900547 - DNA, 17 bp, Homo sapiens
ggcggagctggccccgc

SEQ ID NO: 2900548 - DNA, 16 bp, Homo sapiens
ggcggatcacaaggtc

SEQ ID NO: 2900549 - DNA, 13 bp, Homo sapiens
ggcggcagacaca

SEQ ID NO: 2900550 - DNA, 18 bp, Homo sapiens
ggcggccagggcggccag

SEQ ID NO: 2900551 - DNA, 21 bp, Homo sapiens
ggcggccctgctgaagctgct

SEQ ID NO: 2900552 - DNA, 20 bp, Homo sapiens
ggcggctactcagcagccct

SEQ ID NO: 2900553 - DNA, 23 bp, Homo sapiens
ggcggctactcagcagccctcct

SEQ ID NO: 2900554 - DNA, 17 bp, Homo sapiens
ggcgggcagagggctgg

SEQ ID NO: 2900555 - DNA, 17 bp, Homo sapiens
ggcgggcagccaggctg

SEQ ID NO: 2900556 - DNA, 21 bp, Homo sapiens
ggcgggcagtcgctgcaggga

SEQ ID NO: 2900557 - DNA, 18 bp, Homo sapiens
ggcgggcccagaccggct

SEQ ID NO: 2900558 - DNA, 12 bp, Homo sapiens
ggcggggcccag

SEQ ID NO: 2900559 - DNA, 11 bp, Homo sapiens
ggcgggggcac

SEQ ID NO: 2900560 - DNA, 14 bp, Homo sapiens
ggcggggtgtggtg

SEQ ID NO: 2900561 - DNA, 20 bp, Homo sapiens
ggcgggtccacttgccaggg

SEQ ID NO: 2900562 - DNA, 14 bp, Homo sapiens
ggcgggtggctgca

SEQ ID NO: 2900563 - DNA, 15 bp, Homo sapiens
ggcggtcctgcacag

SEQ ID NO: 2900564 - DNA, 16 bp, Homo sapiens
ggcggtcctgcacaga

SEQ ID NO: 2900565 - DNA, 17 bp, Homo sapiens
ggcggtcctgcacagat

SEQ ID NO: 2900566 - DNA, 16 bp, Homo sapiens
ggcggtgtcaggtccc

SEQ ID NO: 2900567 - DNA, 19 bp, Homo sapiens
ggcggtgtcaggtcccagc

SEQ ID NO: 2900568 - DNA, 13 bp, Homo sapiens
ggcgtcagagaga

SEQ ID NO: 2900569 - DNA, 17 bp, Homo sapiens
ggcgtcagagagacccg

SEQ ID NO: 2900570 - DNA, 23 bp, Homo sapiens
ggcgtcagagagacccgggaagg

SEQ ID NO: 2900571 - DNA, 16 bp, Homo sapiens
ggcgtcaggggtgcac

SEQ ID NO: 2900572 - DNA, 18 bp, Homo sapiens
ggcgtcaggggtgcacag

SEQ ID NO: 2900573 - DNA, 19 bp, Homo sapiens
ggcgtcaggggtgcacagt

SEQ ID NO: 2900574 - DNA, 21 bp, Homo sapiens
ggcgtcaggggtgcacagtcc

SEQ ID NO: 2900575 - DNA, 17 bp, Homo sapiens
ggcgtccaggccgcgcc

SEQ ID NO: 2900576 - DNA, 19 bp, Homo sapiens
ggcgtctgactccctcccc

SEQ ID NO: 2900577 - DNA, 20 bp, Homo sapiens
ggcgtctgactccctcccca

SEQ ID NO: 2900578 - DNA, 15 bp, Homo sapiens
ggcgtgactcaccca

SEQ ID NO: 2900579 - DNA, 14 bp, Homo sapiens
ggcgtgactcagca

SEQ ID NO: 2900580 - DNA, 20 bp, Homo sapiens
ggcgtggagactggcaggcg

SEQ ID NO: 2900581 - DNA, 17 bp, Homo sapiens
ggcgtggagggaggccc

SEQ ID NO: 2900582 - DNA, 18 bp, Homo sapiens
ggcccagggagggtgagc

SEQ ID NO: 2900583 - DNA, 14 bp, Homo sapiens
ggcccagggcccag

SEQ ID NO: 2900584 - DNA, 21 bp, Homo sapiens
ggcccagggcccagagcccag

SEQ ID NO: 2900585 - DNA, 22 bp, Homo sapiens
ggcccagggcccagagcccagc

SEQ ID NO: 2900586 - DNA, 15 bp, Homo sapiens
ggcccagggggcctg

SEQ ID NO: 2900587 - DNA, 19 bp, Homo sapiens
ggcccagggggcctggagc

SEQ ID NO: 2900588 - DNA, 18 bp, Homo sapiens
ggcccagtgcatggtggc

SEQ ID NO: 2900589 - DNA, 13 bp, Homo sapiens
ggcccatctgtcc

SEQ ID NO: 2900590 - DNA, 17 bp, Homo sapiens
ggcccatgttgagccat

SEQ ID NO: 2900591 - DNA, 17 bp, Homo sapiens
ggccccacaaggcctgg

SEQ ID NO: 2900592 - DNA, 23 bp, Homo sapiens
ggccccacaaggcctggtctggg

SEQ ID NO: 2900593 - DNA, 14 bp, Homo sapiens
ggccccaccaccta

SEQ ID NO: 2900594 - DNA, 17 bp, Homo sapiens
ggccccacctgtgtccc

SEQ ID NO: 2900595 - DNA, 12 bp, Homo sapiens
ggccccactggg

SEQ ID NO: 2900596 - DNA, 17 bp, Homo sapiens
ggccccagcacctcagc

SEQ ID NO: 2900597 - DNA, 20 bp, Homo sapiens
ggccccagcacctcagcctg

SEQ ID NO: 2900598 - DNA, 18 bp, Homo sapiens
ggccccaggaaaggccca

SEQ ID NO: 2900599 - DNA, 16 bp, Homo sapiens
ggccccaggacctggc

SEQ ID NO: 2900600 - DNA, 22 bp, Homo sapiens
ggccccaggcattgccaagggc

SEQ ID NO: 2900601 - DNA, 12 bp, Homo sapiens
ggccccaggccc

SEQ ID NO: 2900602 - DNA, 22 bp, Homo sapiens
ggccccatcgccccaccgcagc

SEQ ID NO: 2900603 - DNA, 22 bp, Homo sapiens
ggcccccaccacacatcccagc

SEQ ID NO: 2900604 - DNA, 11 bp, Homo sapiens
ggcccccaccg

SEQ ID NO: 2900605 - DNA, 19 bp, Homo sapiens
ggcccccaccgccggggtc

SEQ ID NO: 2900606 - DNA, 22 bp, Homo sapiens
ggcccccagagacctttgccca

SEQ ID NO: 2900607 - DNA, 16 bp, Homo sapiens
ggcccccctgccctgt

SEQ ID NO: 2900608 - DNA, 15 bp, Homo sapiens
ggccccctcagctct

SEQ ID NO: 2900609 - DNA, 11 bp, Homo sapiens
ggccccctgcc

SEQ ID NO: 2900610 - DNA, 16 bp, Homo sapiens
ggccccgccctcaggc

SEQ ID NO: 2900611 - DNA, 14 bp, Homo sapiens
ggccccgccgcctg

SEQ ID NO: 2900612 - DNA, 21 bp, Homo sapiens
ggccccgcttgtccagcgcct

SEQ ID NO: 2900613 - DNA, 18 bp, Homo sapiens
ggcccctcaccctctgtc

SEQ ID NO: 2900614 - DNA, 21 bp, Homo sapiens
ggcccctcaccctctgtcccc

SEQ ID NO: 2900615 - DNA, 14 bp, Homo sapiens
ggcccctcacctgg

SEQ ID NO: 2900616 - DNA, 22 bp, Homo sapiens
ggcccctcaggggaagctgcta

SEQ ID NO: 2900617 - DNA, 23 bp, Homo sapiens
ggcccctcaggggaagctgctag

SEQ ID NO: 2900618 - DNA, 22 bp, Homo sapiens
ggcccctcccacacccaaagct

SEQ ID NO: 2900619 - DNA, 16 bp, Homo sapiens
ggcccctccccctgag

SEQ ID NO: 2900620 - DNA, 15 bp, Homo sapiens
ggcccctcccctcag

SEQ ID NO: 2900621 - DNA, 18 bp, Homo sapiens
ggcccctcccctcagagc

SEQ ID NO: 2900622 - DNA, 13 bp, Homo sapiens
ggcccctctcctc

SEQ ID NO: 2900623 - DNA, 22 bp, Homo sapiens
ggcccctctcctccgtggcaca

SEQ ID NO: 2900624 - DNA, 23 bp, Homo sapiens
ggcccctctcctccgtggcacat

SEQ ID NO: 2900625 - DNA, 10 bp, Homo sapiens
ggcccctgga

SEQ ID NO: 2900626 - DNA, 14 bp, Homo sapiens
ggcccctggcccag

SEQ ID NO: 2900627 - DNA, 17 bp, Homo sapiens
ggcccctggcccaggag

SEQ ID NO: 2900628 - DNA, 19 bp, Homo sapiens
ggcccctggcccaggagga

SEQ ID NO: 2900629 - DNA, 13 bp, Homo sapiens
ggcccctggcccc

SEQ ID NO: 2900630 - DNA, 16 bp, Homo sapiens
ggcccctgggtttctt

SEQ ID NO: 2900631 - DNA, 20 bp, Homo sapiens
ggcccctttgggccctgcat

SEQ ID NO: 2900632 - DNA, 21 bp, Homo sapiens
ggcccgcagcctggcatctgt

SEQ ID NO: 2900633 - DNA, 15 bp, Homo sapiens
ggcccgcggcctgca

SEQ ID NO: 2900634 - DNA, 22 bp, Homo sapiens
ggcccgcggcctgcaccgaccc

SEQ ID NO: 2900635 - DNA, 23 bp, Homo sapiens
ggcccggagctgcccctctctgg

SEQ ID NO: 2900636 - DNA, 13 bp, Homo sapiens
ggcccggcagggc

SEQ ID NO: 2900637 - DNA, 16 bp, Homo sapiens
ggcccggcccctcacc

SEQ ID NO: 2900638 - DNA, 19 bp, Homo sapiens
ggcccggcccctcaccctc

SEQ ID NO: 2900639 - DNA, 15 bp, Homo sapiens
ggcccgggccgaccc

SEQ ID NO: 2900640 - DNA, 13 bp, Homo sapiens
ggcccggggctgg

SEQ ID NO: 2900641 - DNA, 22 bp, Homo sapiens
ggcccggggctggcggctactc

SEQ ID NO: 2900642 - DNA, 14 bp, Homo sapiens
ggcccggtgcagct

SEQ ID NO: 2900643 - DNA, 16 bp, Homo sapiens
ggcccgtcggagctgc

SEQ ID NO: 2900644 - DNA, 20 bp, Homo sapiens
ggcccgtcggagctgcctgc

SEQ ID NO: 2900645 - DNA, 19 bp, Homo sapiens
ggcccgtctgtccatctgc

SEQ ID NO: 2900646 - DNA, 16 bp, Homo sapiens
ggccctaattcagcca

SEQ ID NO: 2900647 - DNA, 21 bp, Homo sapiens
ggccctaattcagccatgtac

SEQ ID NO: 2900648 - DNA, 14 bp, Homo sapiens
ggccctcactcttg

SEQ ID NO: 2900649 - DNA, 16 bp, Homo sapiens
ggccctcagtgcatcc

SEQ ID NO: 2900650 - DNA, 20 bp, Homo sapiens
ggccctcattaatgacactt

SEQ ID NO: 2900651 - DNA, 17 bp, Homo sapiens
ggccctcccaccacccc

SEQ ID NO: 2900652 - DNA, 18 bp, Homo sapiens
ggccctcccaccacccca

SEQ ID NO: 2900653 - DNA, 14 bp, Homo sapiens
ggccctccctgcgc

SEQ ID NO: 2900654 - DNA, 20 bp, Homo sapiens
ggccctccctgcgcttcctg

SEQ ID NO: 2900655 - DNA, 19 bp, Homo sapiens
ggccctccctgttccccag

SEQ ID NO: 2900656 - DNA, 14 bp, Homo sapiens
ggccctctctgctc

SEQ ID NO: 2900657 - DNA, 21 bp, Homo sapiens
ggccctctctgctctgcgtgt

SEQ ID NO: 2900658 - DNA, 19 bp, Homo sapiens
ggccctctgcctgcactcc

SEQ ID NO: 2900659 - DNA, 18 bp, Homo sapiens
ggccctctggagtggcca

SEQ ID NO: 2900660 - DNA, 20 bp, Homo sapiens
ggccctgactgtcagggagg

SEQ ID NO: 2900661 - DNA, 23 bp, Homo sapiens
ggccctgcacaggtggctgtttc

SEQ ID NO: 2900662 - DNA, 16 bp, Homo sapiens
ggccctgcaggagcag

SEQ ID NO: 2900663 - DNA, 18 bp, Homo sapiens
ggccctgcaggagcaggg

SEQ ID NO: 2900664 - DNA, 15 bp, Homo sapiens
ggccctgcaggctgc

SEQ ID NO: 2900665 - DNA, 10 bp, Homo sapiens
ggccctgcat

SEQ ID NO: 2900666 - DNA, 21 bp, Homo sapiens
ggccctgccagtggggaagga

SEQ ID NO: 2900667 - DNA, 14 bp, Homo sapiens
ggccctgcccctcc

SEQ ID NO: 2900668 - DNA, 17 bp, Homo sapiens
ggccctgcccctccccc

SEQ ID NO: 2900669 - DNA, 21 bp, Homo sapiens
ggccctgcccctccccctacc

SEQ ID NO: 2900670 - DNA, 16 bp, Homo sapiens
ggccctgcccctccct

SEQ ID NO: 2900671 - DNA, 14 bp, Homo sapiens
ggccctgccttctt

SEQ ID NO: 2900672 - DNA, 19 bp, Homo sapiens
ggccctgctgaagctgctg

SEQ ID NO: 2900673 - DNA, 16 bp, Homo sapiens
ggccctgctgcccctc

SEQ ID NO: 2900674 - DNA, 22 bp, Homo sapiens
ggccctgctgcccctccctgcc

SEQ ID NO: 2900675 - DNA, 14 bp, Homo sapiens
ggccctggaagagt

SEQ ID NO: 2900676 - DNA, 16 bp, Homo sapiens
ggccctggagggcaga

SEQ ID NO: 2900677 - DNA, 15 bp, Homo sapiens
ggccctggcctgctg

SEQ ID NO: 2900678 - DNA, 22 bp, Homo sapiens
ggccctggcctgctgggctctc

SEQ ID NO: 2900679 - DNA, 13 bp, Homo sapiens
ggccctgggcccg

SEQ ID NO: 2900680 - DNA, 17 bp, Homo sapiens
ggccctggtcctggcct

SEQ ID NO: 2900681 - DNA, 20 bp, Homo sapiens
ggccctggttcctgctgtcc

SEQ ID NO: 2900682 - DNA, 14 bp, Homo sapiens
ggccctgtccagcc

SEQ ID NO: 2900683 - DNA, 19 bp, Homo sapiens
ggccctgtccagcccccag

SEQ ID NO: 2900684 - DNA, 21 bp, Homo sapiens
ggccctgtggagtccagctct

SEQ ID NO: 2900685 - DNA, 15 bp, Homo sapiens
ggccctgtgtgcagg

SEQ ID NO: 2900686 - DNA, 20 bp, Homo sapiens
ggcccttcccctcccccact

SEQ ID NO: 2900687 - DNA, 19 bp, Homo sapiens
ggcccttcctcctccacca

SEQ ID NO: 2900688 - DNA, 16 bp, Homo sapiens
ggcccttggggtggcg

SEQ ID NO: 2900689 - DNA, 19 bp, Homo sapiens
ggccgacaccactcctgcc

SEQ ID NO: 2900690 - DNA, 20 bp, Homo sapiens
ggccgacaccactcctgcca

SEQ ID NO: 2900691 - DNA, 22 bp, Homo sapiens
ggccgacaccactcctgccagc

SEQ ID NO: 2900692 - DNA, 18 bp, Homo sapiens
ggccgaccctgcggcctc

SEQ ID NO: 2900693 - DNA, 22 bp, Homo sapiens
ggccgaccctgcggcctccacc

SEQ ID NO: 2900694 - DNA, 19 bp, Homo sapiens
ggccgagctggtttcctgc

SEQ ID NO: 2900695 - DNA, 13 bp, Homo sapiens
ggccgagtccaag

SEQ ID NO: 2900696 - DNA, 17 bp, Homo sapiens
ggccgcattccctgagt

SEQ ID NO: 2900697 - DNA, 16 bp, Homo sapiens
ggccgccatctgcgca

SEQ ID NO: 2900698 - DNA, 14 bp, Homo sapiens
ggccgcccctgagg

SEQ ID NO: 2900699 - DNA, 16 bp, Homo sapiens
ggccgcccctgaggct

SEQ ID NO: 2900700 - DNA, 20 bp, Homo sapiens
ggccgccgctgaccctgggc

SEQ ID NO: 2900701 - DNA, 22 bp, Homo sapiens
ggccgccgctgaccctgggcct

SEQ ID NO: 2900702 - DNA, 19 bp, Homo sapiens
ggccgcgcgtccagctgcc

SEQ ID NO: 2900703 - DNA, 19 bp, Homo sapiens
ggccgcggccctggggcgg

SEQ ID NO: 2900704 - DNA, 18 bp, Homo sapiens
ggccgcggcctccccgag

SEQ ID NO: 2900705 - DNA, 18 bp, Homo sapiens
ggccgcgtgccgggcccc

SEQ ID NO: 2900706 - DNA, 22 bp, Homo sapiens
ggccgctgccacccacctccct

SEQ ID NO: 2900707 - DNA, 23 bp, Homo sapiens
ggccgctgccacccacctccctg

SEQ ID NO: 2900708 - DNA, 16 bp, Homo sapiens
ggccggacctgagccc

SEQ ID NO: 2900709 - DNA, 17 bp, Homo sapiens
ggccggacgcaggtgct

SEQ ID NO: 2900710 - DNA, 19 bp, Homo sapiens
ggccggacgcaggtgctgc

SEQ ID NO: 2900711 - DNA, 19 bp, Homo sapiens
ggccggccagccagccact

SEQ ID NO: 2900712 - DNA, 15 bp, Homo sapiens
ggccggccctgcccc

SEQ ID NO: 2900713 - DNA, 17 bp, Homo sapiens
ggccggccctgcccctc

SEQ ID NO: 2900714 - DNA, 14 bp, Homo sapiens
ggccggccctgtgt

SEQ ID NO: 2900715 - DNA, 16 bp, Homo sapiens
ggccggggatggatct

SEQ ID NO: 2900716 - DNA, 19 bp, Homo sapiens
ggccgggtcaccctgtgac

SEQ ID NO: 2900717 - DNA, 17 bp, Homo sapiens
ggccgtggcttgggctg

SEQ ID NO: 2900718 - DNA, 16 bp, Homo sapiens
gctcccttggctttga

SEQ ID NO: 2900719 - DNA, 21 bp, Homo sapiens
gctcccttttacattctgtgt

SEQ ID NO: 2900720 - DNA, 16 bp, Homo sapiens
gctcccttttgtcctt

SEQ ID NO: 2900721 - DNA, 13 bp, Homo sapiens
gctccgacctctc

SEQ ID NO: 2900722 - DNA, 19 bp, Homo sapiens
gctccgacctctctcagcc

SEQ ID NO: 2900723 - DNA, 13 bp, Homo sapiens
gctccgaggactg

SEQ ID NO: 2900724 - DNA, 15 bp, Homo sapiens
gctccgaggactgga

SEQ ID NO: 2900725 - DNA, 21 bp, Homo sapiens
gctccgaggactggactgttt

SEQ ID NO: 2900726 - DNA, 14 bp, Homo sapiens
gctccgtggactgc

SEQ ID NO: 2900727 - DNA, 17 bp, Homo sapiens
gctcctaaagtaacatc

SEQ ID NO: 2900728 - DNA, 13 bp, Homo sapiens
gctcctagaggga

SEQ ID NO: 2900729 - DNA, 18 bp, Homo sapiens
gctcctccagggccacgt

SEQ ID NO: 2900730 - DNA, 22 bp, Homo sapiens
gctcctccagggccacgtgcca

SEQ ID NO: 2900731 - DNA, 14 bp, Homo sapiens
gctcctcccctgcc

SEQ ID NO: 2900732 - DNA, 21 bp, Homo sapiens
gctcctccctccctctgccgg

SEQ ID NO: 2900733 - DNA, 13 bp, Homo sapiens
gctcctccctctg

SEQ ID NO: 2900734 - DNA, 20 bp, Homo sapiens
gctcctccctctgcctcatc

SEQ ID NO: 2900735 - DNA, 23 bp, Homo sapiens
gctcctccctctgcctcatcctc

SEQ ID NO: 2900736 - DNA, 16 bp, Homo sapiens
gctcctcctccctgca

SEQ ID NO: 2900737 - DNA, 18 bp, Homo sapiens
gctcctcctccctgcatc

SEQ ID NO: 2900738 - DNA, 19 bp, Homo sapiens
ggcaggagaatcacttgaa

SEQ ID NO: 2900739 - DNA, 17 bp, Homo sapiens
ggcaggaggagctgcct

SEQ ID NO: 2900740 - DNA, 14 bp, Homo sapiens
ggcaggagggaggt

SEQ ID NO: 2900741 - DNA, 18 bp, Homo sapiens
ggcaggagtcaccatgca

SEQ ID NO: 2900742 - DNA, 19 bp, Homo sapiens
ggcaggagtcaccatgcaa

SEQ ID NO: 2900743 - DNA, 21 bp, Homo sapiens
ggcaggagtcaccatgcaagg

SEQ ID NO: 2900744 - DNA, 19 bp, Homo sapiens
ggcaggagttgggggcagg

SEQ ID NO: 2900745 - DNA, 20 bp, Homo sapiens
ggcaggagttgggggcaggt

SEQ ID NO: 2900746 - DNA, 22 bp, Homo sapiens
ggcaggcatggctggtgcctga

SEQ ID NO: 2900747 - DNA, 13 bp, Homo sapiens
ggcaggcctttcc

SEQ ID NO: 2900748 - DNA, 15 bp, Homo sapiens
ggcaggcctttccta

SEQ ID NO: 2900749 - DNA, 20 bp, Homo sapiens
ggcaggcgtgactcagcagc

SEQ ID NO: 2900750 - DNA, 16 bp, Homo sapiens
ggcaggcgtgtggcag

SEQ ID NO: 2900751 - DNA, 18 bp, Homo sapiens
ggcaggcgtgtggcagcc

SEQ ID NO: 2900752 - DNA, 22 bp, Homo sapiens
ggcagggacccggggtctcctg

SEQ ID NO: 2900753 - DNA, 18 bp, Homo sapiens
ggcagggccaacccttct

SEQ ID NO: 2900754 - DNA, 24 bp, Homo sapiens
ggcagggccactcaacagagagga

SEQ ID NO: 2900755 - DNA, 17 bp, Homo sapiens
ggcagggccaggctggt

SEQ ID NO: 2900756 - DNA, 18 bp, Homo sapiens
ggcagggccaggctggtc

SEQ ID NO: 2900757 - DNA, 16 bp, Homo sapiens
ggcagggccccaggca

SEQ ID NO: 2900758 - DNA, 19 bp, Homo sapiens
ggcagggcctagctgctac

SEQ ID NO: 2900759 - DNA, 19 bp, Homo sapiens
ggcagggcgggcagagggc

SEQ ID NO: 2900760 - DNA, 20 bp, Homo sapiens
ggcaggggacaagggaggca

SEQ ID NO: 2900761 - DNA, 14 bp, Homo sapiens
ggcaggggagccag

SEQ ID NO: 2900762 - DNA, 15 bp, Homo sapiens
ggcaggggtgagagc

SEQ ID NO: 2900763 - DNA, 15 bp, Homo sapiens
ggcagggtgggagcc

SEQ ID NO: 2900764 - DNA, 16 bp, Homo sapiens
ggcaggtcactgtcac

SEQ ID NO: 2900765 - DNA, 17 bp, Homo sapiens
ggcaggtcactgtcact

SEQ ID NO: 2900766 - DNA, 18 bp, Homo sapiens
ggcaggtcaggaccagga

SEQ ID NO: 2900767 - DNA, 22 bp, Homo sapiens
ggcaggtcctagtcgggcaggg

SEQ ID NO: 2900768 - DNA, 23 bp, Homo sapiens
ggcaggtcctagtcgggcagggc

SEQ ID NO: 2900769 - DNA, 20 bp, Homo sapiens
ggcaggtctgcaagggccca

SEQ ID NO: 2900770 - DNA, 19 bp, Homo sapiens
ggcaggtggcctctgctgg

SEQ ID NO: 2900771 - DNA, 22 bp, Homo sapiens
ggcaggtggcctctgctggtct

SEQ ID NO: 2900772 - DNA, 17 bp, Homo sapiens
ggcaggtgggagctgaa

SEQ ID NO: 2900773 - DNA, 15 bp, Homo sapiens
ggcaggttagaagaa

SEQ ID NO: 2900774 - DNA, 14 bp, Homo sapiens
ggcagtaggccggt

SEQ ID NO: 2900775 - DNA, 20 bp, Homo sapiens
ggcagtcattggctgtctcc

SEQ ID NO: 2900776 - DNA, 16 bp, Homo sapiens
ggcagtcgcacacaca

SEQ ID NO: 2900777 - DNA, 12 bp, Homo sapiens
ggcagtgccagc

SEQ ID NO: 2900778 - DNA, 13 bp, Homo sapiens
ggcagtgccagcc

SEQ ID NO: 2900779 - DNA, 13 bp, Homo sapiens
ggcagtgccatgg

SEQ ID NO: 2900780 - DNA, 14 bp, Homo sapiens
ggcagtgcccacca

SEQ ID NO: 2900781 - DNA, 15 bp, Homo sapiens
ggcagtgcccaccat

SEQ ID NO: 2900782 - DNA, 19 bp, Homo sapiens
ggcagtgcccaccatgcac

SEQ ID NO: 2900783 - DNA, 22 bp, Homo sapiens
ggcagtgcccaccatgcacccc

SEQ ID NO: 2900784 - DNA, 12 bp, Homo sapiens
ggcagtggccac

SEQ ID NO: 2900785 - DNA, 15 bp, Homo sapiens
ggcagtgtttgtata

SEQ ID NO: 2900786 - DNA, 15 bp, Homo sapiens
ggcagttctgggtgc

SEQ ID NO: 2900787 - DNA, 19 bp, Homo sapiens
ggcagtttttaaaattggc

SEQ ID NO: 2900788 - DNA, 13 bp, Homo sapiens
ggcatagctacgt

SEQ ID NO: 2900789 - DNA, 19 bp, Homo sapiens
ggcatatacagtgaagagt

SEQ ID NO: 2900790 - DNA, 23 bp, Homo sapiens
ggcatcaccttaggcagggaagt

SEQ ID NO: 2900791 - DNA, 16 bp, Homo sapiens
ggcatccagagtccct

SEQ ID NO: 2900792 - DNA, 18 bp, Homo sapiens
ggcatccagcagtctctg

SEQ ID NO: 2900793 - DNA, 18 bp, Homo sapiens
ggcatccagggctgccag

SEQ ID NO: 2900794 - DNA, 23 bp, Homo sapiens
ggcatccttgcctgtctaaagcc

SEQ ID NO: 2900795 - DNA, 16 bp, Homo sapiens
ggcatctccatgtaga

SEQ ID NO: 2900796 - DNA, 13 bp, Homo sapiens
ggcatctctgagt

SEQ ID NO: 2900797 - DNA, 19 bp, Homo sapiens
ggagtcagccaggagctgt

SEQ ID NO: 2900798 - DNA, 15 bp, Homo sapiens
ggagtccagctctac

SEQ ID NO: 2900799 - DNA, 14 bp, Homo sapiens
ggagtcccagagct

SEQ ID NO: 2900800 - DNA, 21 bp, Homo sapiens
ggagtctccctccgactccag

SEQ ID NO: 2900801 - DNA, 14 bp, Homo sapiens
ggagtgacccagct

SEQ ID NO: 2900802 - DNA, 21 bp, Homo sapiens
ggagtgaggaaggcaggaaga

SEQ ID NO: 2900803 - DNA, 20 bp, Homo sapiens
ggagtgcaatgacacagtct

SEQ ID NO: 2900804 - DNA, 18 bp, Homo sapiens
ggagtgcagaacacctgg

SEQ ID NO: 2900805 - DNA, 21 bp, Homo sapiens
ggagtgcccccagcccagagc

SEQ ID NO: 2900806 - DNA, 20 bp, Homo sapiens
ggagtgctgcttgtgcctcc

SEQ ID NO: 2900807 - DNA, 13 bp, Homo sapiens
ggagtggaaggtg

SEQ ID NO: 2900808 - DNA, 19 bp, Homo sapiens
ggagtggggtagaggaaga

SEQ ID NO: 2900809 - DNA, 13 bp, Homo sapiens
ggagtgtcctctt

SEQ ID NO: 2900810 - DNA, 19 bp, Homo sapiens
ggagtgtgagccacctaag

SEQ ID NO: 2900811 - DNA, 21 bp, Homo sapiens
ggagtgtgtcagagcccaggg

SEQ ID NO: 2900812 - DNA, 22 bp, Homo sapiens
ggagtgtgtcagagcccagggg

SEQ ID NO: 2900813 - DNA, 14 bp, Homo sapiens
ggagtgttatgtat

SEQ ID NO: 2900814 - DNA, 20 bp, Homo sapiens
ggagtgttccccttccactg

SEQ ID NO: 2900815 - DNA, 16 bp, Homo sapiens
ggagttaagacctggc

SEQ ID NO: 2900816 - DNA, 17 bp, Homo sapiens
ggagttccagcaaacaa

SEQ ID NO: 2900817 - DNA, 13 bp, Homo sapiens
ggagttcctgctc

SEQ ID NO: 2900818 - DNA, 20 bp, Homo sapiens
ggagttgatcgcctttccca

SEQ ID NO: 2900819 - DNA, 17 bp, Homo sapiens
ggagttgatctggaacc

SEQ ID NO: 2900820 - DNA, 14 bp, Homo sapiens
ggagtttaaaaaca

SEQ ID NO: 2900821 - DNA, 21 bp, Homo sapiens
ggagtttaaaaacatttttta

SEQ ID NO: 2900822 - DNA, 13 bp, Homo sapiens
ggagtttctctct

SEQ ID NO: 2900823 - DNA, 19 bp, Homo sapiens
ggagtttgagaccaggctg

SEQ ID NO: 2900824 - DNA, 13 bp, Homo sapiens
ggataaaaaagaa

SEQ ID NO: 2900825 - DNA, 15 bp, Homo sapiens
ggataaaaaggaagg

SEQ ID NO: 2900826 - DNA, 17 bp, Homo sapiens
ggataaaaaggaaggag

SEQ ID NO: 2900827 - DNA, 15 bp, Homo sapiens
ggataaactgagcct

SEQ ID NO: 2900828 - DNA, 16 bp, Homo sapiens
ggataataaaaattgt

SEQ ID NO: 2900829 - DNA, 14 bp, Homo sapiens
ggataatgaaataa

SEQ ID NO: 2900830 - DNA, 21 bp, Homo sapiens
ggataatgaaataatcagtga

SEQ ID NO: 2900831 - DNA, 20 bp, Homo sapiens
ggataatgctgttgcctcat

SEQ ID NO: 2900832 - DNA, 23 bp, Homo sapiens
ggatacaggttactaccctcacc

SEQ ID NO: 2900833 - DNA, 16 bp, Homo sapiens
ggataccagctcaggg

SEQ ID NO: 2900834 - DNA, 18 bp, Homo sapiens
ggatacttatatggaaat

SEQ ID NO: 2900835 - DNA, 19 bp, Homo sapiens
ggatagatgctggcccagg

SEQ ID NO: 2900836 - DNA, 17 bp, Homo sapiens
ggatagccttgaaaaca

SEQ ID NO: 2900837 - DNA, 22 bp, Homo sapiens
ggataggactccatttctttct

SEQ ID NO: 2900838 - DNA, 16 bp, Homo sapiens
ggatagtctgggtcag

SEQ ID NO: 2900839 - DNA, 21 bp, Homo sapiens
ggatagtctgggtcagaccca

SEQ ID NO: 2900840 - DNA, 23 bp, Homo sapiens
ggatcaaagttctgctttctccc

SEQ ID NO: 2900841 - DNA, 13 bp, Homo sapiens
ggatcaattttca

SEQ ID NO: 2900842 - DNA, 22 bp, Homo sapiens
ggatcaattttcattaaacttg

SEQ ID NO: 2900843 - DNA, 16 bp, Homo sapiens
ggatcagattgcatgt

SEQ ID NO: 2900844 - DNA, 19 bp, Homo sapiens
ggatcatgaaagtagacag

SEQ ID NO: 2900845 - DNA, 13 bp, Homo sapiens
ggatcccaaagca

SEQ ID NO: 2900846 - DNA, 14 bp, Homo sapiens
ggatcccacagccc

SEQ ID NO: 2900847 - DNA, 16 bp, Homo sapiens
ggatcccatcaaagaa

SEQ ID NO: 2900848 - DNA, 16 bp, Homo sapiens
ggatcccctgtcccct

SEQ ID NO: 2900849 - DNA, 17 bp, Homo sapiens
ggatccctcccccccat

SEQ ID NO: 2900850 - DNA, 23 bp, Homo sapiens
ggatcctcagttctcaaatgtgt

SEQ ID NO: 2900851 - DNA, 11 bp, Homo sapiens
ggatcctgccc

SEQ ID NO: 2900852 - DNA, 13 bp, Homo sapiens
ggatccttcccaa

SEQ ID NO: 2900853 - DNA, 15 bp, Homo sapiens
ggatccttcccaagg

SEQ ID NO: 2900854 - DNA, 16 bp, Homo sapiens
ggatccttcccaaggt

SEQ ID NO: 2900855 - DNA, 12 bp, Homo sapiens
ggatctaccagc

SEQ ID NO: 2900856 - DNA, 13 bp, Homo sapiens
ggatctaccagca

SEQ ID NO: 2900857 - DNA, 13 bp, Homo sapiens
ggatctgctccaa

SEQ ID NO: 2900858 - DNA, 17 bp, Homo sapiens
ggatcttatttggaatt

SEQ ID NO: 2900859 - DNA, 22 bp, Homo sapiens
ggatcttatttggaattgacat

SEQ ID NO: 2900860 - DNA, 23 bp, Homo sapiens
ggatcttatttggaattgacatt

SEQ ID NO: 2900861 - DNA, 15 bp, Homo sapiens
ggatctttgtggcca

SEQ ID NO: 2900862 - DNA, 17 bp, Homo sapiens
ggatctttgtggccaag

SEQ ID NO: 2900863 - DNA, 22 bp, Homo sapiens
ggatgattgcttgagctcagga

SEQ ID NO: 2900864 - DNA, 21 bp, Homo sapiens
ggatgatttcagaaggagaag

SEQ ID NO: 2900865 - DNA, 18 bp, Homo sapiens
ggatgcaggctcccctga

SEQ ID NO: 2900866 - DNA, 17 bp, Homo sapiens
ggatgcattcgagatgg

SEQ ID NO: 2900867 - DNA, 17 bp, Homo sapiens
ggatgccagggccgacc

SEQ ID NO: 2900868 - DNA, 20 bp, Homo sapiens
ggatgctatttcagccaatc

SEQ ID NO: 2900869 - DNA, 12 bp, Homo sapiens
ggatgctgctgt

SEQ ID NO: 2900870 - DNA, 17 bp, Homo sapiens
ggatggaagcaggacag

SEQ ID NO: 2900871 - DNA, 14 bp, Homo sapiens
ggatggaggagaag

SEQ ID NO: 2900872 - DNA, 21 bp, Homo sapiens
ggatggcaggacgtgggctgg

SEQ ID NO: 2900873 - DNA, 14 bp, Homo sapiens
ggatggcaggatcc

SEQ ID NO: 2900874 - DNA, 18 bp, Homo sapiens
ggatgggcagcccaacag

SEQ ID NO: 2900875 - DNA, 23 bp, Homo sapiens
ggatggtgacttttgaagaacaa

SEQ ID NO: 2900876 - DNA, 12 bp, Homo sapiens
ggatggtgtctc

SEQ ID NO: 2900877 - DNA, 15 bp, Homo sapiens
ggatggtgttcaaaa

SEQ ID NO: 2900878 - DNA, 16 bp, Homo sapiens
ggatgtaaacagtgcc

SEQ ID NO: 2900879 - DNA, 18 bp, Homo sapiens
ggatgtaaacagtgcctg

SEQ ID NO: 2900880 - DNA, 20 bp, Homo sapiens
ggatgtaaacagtgcctgct

SEQ ID NO: 2900881 - DNA, 16 bp, Homo sapiens
ggatgtacatttccaa

SEQ ID NO: 2900882 - DNA, 14 bp, Homo sapiens
ggatgtctgccaat

SEQ ID NO: 2900883 - DNA, 16 bp, Homo sapiens
ggatgtgagcagaaga

SEQ ID NO: 2900884 - DNA, 23 bp, Homo sapiens
ggatgttggccaccaggtgcctt

SEQ ID NO: 2900885 - DNA, 21 bp, Homo sapiens
ggattaaacttatgaatgttt

SEQ ID NO: 2900886 - DNA, 17 bp, Homo sapiens
ggattacagaaactgat

SEQ ID NO: 2900887 - DNA, 19 bp, Homo sapiens
ggattacagaaactgatgc

SEQ ID NO: 2900888 - DNA, 21 bp, Homo sapiens
ggattcaggaatgtgtggcct

SEQ ID NO: 2900889 - DNA, 16 bp, Homo sapiens
ggattccaaagcattt

SEQ ID NO: 2900890 - DNA, 15 bp, Homo sapiens
ggattcgcttgagtt

SEQ ID NO: 2900891 - DNA, 17 bp, Homo sapiens
ggattggggtccctcta

SEQ ID NO: 2900892 - DNA, 12 bp, Homo sapiens
ggatttcttagg

SEQ ID NO: 2900893 - DNA, 17 bp, Homo sapiens
ggatttctttatataag

SEQ ID NO: 2900894 - DNA, 19 bp, Homo sapiens
ggatttgatgcttttctct

SEQ ID NO: 2900895 - DNA, 13 bp, Homo sapiens
ggatttggttgtt

SEQ ID NO: 2900896 - DNA, 17 bp, Homo sapiens
ggatttgtccaaacagg

SEQ ID NO: 2900897 - DNA, 23 bp, Homo sapiens
ggattttaaactagatgacctca

SEQ ID NO: 2900898 - DNA, 18 bp, Homo sapiens
ggattttctagtttcctg

SEQ ID NO: 2900899 - DNA, 10 bp, Homo sapiens
ggatttttag

SEQ ID NO: 2900900 - DNA, 16 bp, Homo sapiens
ggatttttagaattaa

SEQ ID NO: 2900901 - DNA, 16 bp, Homo sapiens
ggatttttcagaaaaa

SEQ ID NO: 2900902 - DNA, 13 bp, Homo sapiens
ggatttttgagtc

SEQ ID NO: 2900903 - DNA, 12 bp, Homo sapiens
ggcaaaggcaga

SEQ ID NO: 2900904 - DNA, 21 bp, Homo sapiens
ggcaacagaaaacaattgttc

SEQ ID NO: 2900905 - DNA, 14 bp, Homo sapiens
ggcaacagatctgg

SEQ ID NO: 2900906 - DNA, 15 bp, Homo sapiens
ggcaacagatctgga

SEQ ID NO: 2900907 - DNA, 16 bp, Homo sapiens
ggcaaccactaagaat

SEQ ID NO: 2900908 - DNA, 19 bp, Homo sapiens
ggcaaccactaagaattca

SEQ ID NO: 2900909 - DNA, 23 bp, Homo sapiens
ggcaactctggctccaggcagaa

SEQ ID NO: 2900910 - DNA, 17 bp, Homo sapiens
ggcaacttgaagaaacg

SEQ ID NO: 2900911 - DNA, 21 bp, Homo sapiens
ggcaagaaagcttgagtctca

SEQ ID NO: 2900912 - DNA, 11 bp, Homo sapiens
ggcaaggaaag

SEQ ID NO: 2900913 - DNA, 18 bp, Homo sapiens
ggcaagtgagaggggagg

SEQ ID NO: 2900914 - DNA, 19 bp, Homo sapiens
ggcaagtgagaggggaggg

SEQ ID NO: 2900915 - DNA, 17 bp, Homo sapiens
ggcaagtggatgggaat

SEQ ID NO: 2900916 - DNA, 17 bp, Homo sapiens
ggcaagtgtaaaaagat

SEQ ID NO: 2900917 - DNA, 18 bp, Homo sapiens
ggcaataatattttctgt

SEQ ID NO: 2900918 - DNA, 21 bp, Homo sapiens
ggcaatgggagctgaggccac

SEQ ID NO: 2900919 - DNA, 13 bp, Homo sapiens
ggcaatttagaaa

SEQ ID NO: 2900920 - DNA, 17 bp, Homo sapiens
ggcacaaagggcccaga

SEQ ID NO: 2900921 - DNA, 15 bp, Homo sapiens
ggcacaagaatcact

SEQ ID NO: 2900922 - DNA, 12 bp, Homo sapiens
ggcacacgcctc

SEQ ID NO: 2900923 - DNA, 16 bp, Homo sapiens
ggcacaggaaacagca

SEQ ID NO: 2900924 - DNA, 20 bp, Homo sapiens
ggcacaggaggcaggcatgg

SEQ ID NO: 2900925 - DNA, 19 bp, Homo sapiens
ggcacaggagtgtcctctt

SEQ ID NO: 2900926 - DNA, 20 bp, Homo sapiens
ggcacaggagtgtcctcttc

SEQ ID NO: 2900927 - DNA, 14 bp, Homo sapiens
ggcacatctgtcct

SEQ ID NO: 2900928 - DNA, 14 bp, Homo sapiens
ggcacatggctggg

SEQ ID NO: 2900929 - DNA, 16 bp, Homo sapiens
ggcacatggctggggg

SEQ ID NO: 2900930 - DNA, 22 bp, Homo sapiens
ggcacattaactgttgcacttt

SEQ ID NO: 2900931 - DNA, 18 bp, Homo sapiens
ggcacattgagctgtgca

SEQ ID NO: 2900932 - DNA, 15 bp, Homo sapiens
ggcaccagtccctgt

SEQ ID NO: 2900933 - DNA, 18 bp, Homo sapiens
ggcacccaagacctcagg

SEQ ID NO: 2900934 - DNA, 20 bp, Homo sapiens
gctgcggacaccgtggcctg

SEQ ID NO: 2900935 - DNA, 17 bp, Homo sapiens
gctgcggtgggcagcca

SEQ ID NO: 2900936 - DNA, 23 bp, Homo sapiens
gctgctacaaagaagacatgttt

SEQ ID NO: 2900937 - DNA, 15 bp, Homo sapiens
gctgctatagcctgg

SEQ ID NO: 2900938 - DNA, 18 bp, Homo sapiens
gctgctcattccacactg

SEQ ID NO: 2900939 - DNA, 22 bp, Homo sapiens
gctgctcattccacactgttga

SEQ ID NO: 2900940 - DNA, 17 bp, Homo sapiens
gcttattgtgtgcgctg

SEQ ID NO: 2900941 - DNA, 23 bp, Homo sapiens
gcttattgtgtgcgctgcctggc

SEQ ID NO: 2900942 - DNA, 16 bp, Homo sapiens
gcttatttttctgtga

SEQ ID NO: 2900943 - DNA, 18 bp, Homo sapiens
gcttcagatgtggagcca

SEQ ID NO: 2900944 - DNA, 15 bp, Homo sapiens
gcttcagctccagcc

SEQ ID NO: 2900945 - DNA, 18 bp, Homo sapiens
ggagccatggaaggtgcc

SEQ ID NO: 2900946 - DNA, 14 bp, Homo sapiens
ggagcccactgtcc

SEQ ID NO: 2900947 - DNA, 17 bp, Homo sapiens
ggagcccactgtcctgg

SEQ ID NO: 2900948 - DNA, 18 bp, Homo sapiens
ggagcccactgtcctggg

SEQ ID NO: 2900949 - DNA, 22 bp, Homo sapiens
ggagcccactgtcctgggcctg

SEQ ID NO: 2900950 - DNA, 16 bp, Homo sapiens
ggagcccagccctccc

SEQ ID NO: 2900951 - DNA, 19 bp, Homo sapiens
ggagcccagccctccccat

SEQ ID NO: 2900952 - DNA, 20 bp, Homo sapiens
ggagcccagcggcccaagag

SEQ ID NO: 2900953 - DNA, 23 bp, Homo sapiens
ggagcccagcggcccaagagccc

SEQ ID NO: 2900954 - DNA, 12 bp, Homo sapiens
ggagcccagtgg

SEQ ID NO: 2900955 - DNA, 14 bp, Homo sapiens
ggagccccactgcc

SEQ ID NO: 2900956 - DNA, 12 bp, Homo sapiens
ggagccccatct

SEQ ID NO: 2900957 - DNA, 16 bp, Homo sapiens
ggagccccatctgtct

SEQ ID NO: 2900958 - DNA, 16 bp, Homo sapiens
ggagccccattcctgg

SEQ ID NO: 2900959 - DNA, 17 bp, Homo sapiens
ggagccccattcctggg

SEQ ID NO: 2900960 - DNA, 21 bp, Homo sapiens
ggagcccctcctcccccggct

SEQ ID NO: 2900961 - DNA, 21 bp, Homo sapiens
ggagcccctgaaagcctcacg

SEQ ID NO: 2900962 - DNA, 14 bp, Homo sapiens
ggagcccctgagtc

SEQ ID NO: 2900963 - DNA, 21 bp, Homo sapiens
ggagccccttctgctcagctc

SEQ ID NO: 2900964 - DNA, 19 bp, Homo sapiens
ggagcccgcactgtcccag

SEQ ID NO: 2900965 - DNA, 18 bp, Homo sapiens
ggagccgagggcgtcaga

SEQ ID NO: 2900966 - DNA, 21 bp, Homo sapiens
ggagccgggaaagaagagccg

SEQ ID NO: 2900967 - DNA, 16 bp, Homo sapiens
ggagcctagaagctgg

SEQ ID NO: 2900968 - DNA, 23 bp, Homo sapiens
ggagcctctgcagtcgcttgcca

SEQ ID NO: 2900969 - DNA, 20 bp, Homo sapiens
ggagcctttggttctggcca

SEQ ID NO: 2900970 - DNA, 16 bp, Homo sapiens
ggagccttttaactgt

SEQ ID NO: 2900971 - DNA, 22 bp, Homo sapiens
ggagcgaactcccccgaagaag

SEQ ID NO: 2900972 - DNA, 17 bp, Homo sapiens
ggagcgctagtgccttg

SEQ ID NO: 2900973 - DNA, 18 bp, Homo sapiens
ggagcgctagtgccttgc

SEQ ID NO: 2900974 - DNA, 16 bp, Homo sapiens
ggagcggcgccctgga

SEQ ID NO: 2900975 - DNA, 19 bp, Homo sapiens
ggagcggcgccctggactt

SEQ ID NO: 2900976 - DNA, 20 bp, Homo sapiens
ggagcggcgccctggacttg

SEQ ID NO: 2900977 - DNA, 13 bp, Homo sapiens
ggagcggctgctc

SEQ ID NO: 2900978 - DNA, 21 bp, Homo sapiens
ggagcggctgctcgcccagga

SEQ ID NO: 2900979 - DNA, 22 bp, Homo sapiens
ggagcggctgctcgcccaggaa

SEQ ID NO: 2900980 - DNA, 14 bp, Homo sapiens
ggagcgggcagggc

SEQ ID NO: 2900981 - DNA, 19 bp, Homo sapiens
ggagcgtgtggctgtgccc

SEQ ID NO: 2900982 - DNA, 17 bp, Homo sapiens
ggagcgtttgctgtgcc

SEQ ID NO: 2900983 - DNA, 17 bp, Homo sapiens
ggagctagttctcagct

SEQ ID NO: 2900984 - DNA, 11 bp, Homo sapiens
ggagctctgcg

SEQ ID NO: 2900985 - DNA, 14 bp, Homo sapiens
ggagctctgcgcca

SEQ ID NO: 2900986 - DNA, 15 bp, Homo sapiens
ggagctctgcgccag

SEQ ID NO: 2900987 - DNA, 13 bp, Homo sapiens
ggagctgaggcct

SEQ ID NO: 2900988 - DNA, 17 bp, Homo sapiens
ggagctgaggcctccct

SEQ ID NO: 2900989 - DNA, 18 bp, Homo sapiens
ggagctgaggcctccctt

SEQ ID NO: 2900990 - DNA, 15 bp, Homo sapiens
ggagctgagggaggg

SEQ ID NO: 2900991 - DNA, 16 bp, Homo sapiens
ggagctgagggaggga

SEQ ID NO: 2900992 - DNA, 21 bp, Homo sapiens
ggagctgagggagggagccat

SEQ ID NO: 2900993 - DNA, 22 bp, Homo sapiens
ggagctgcccctctctgggcct

SEQ ID NO: 2900994 - DNA, 13 bp, Homo sapiens
ggagctgcctgca

SEQ ID NO: 2900995 - DNA, 17 bp, Homo sapiens
ggagctgcctgcagcac

SEQ ID NO: 2900996 - DNA, 19 bp, Homo sapiens
ggagctgctatagcctggg

SEQ ID NO: 2900997 - DNA, 15 bp, Homo sapiens
ggagctgctgagtga

SEQ ID NO: 2900998 - DNA, 12 bp, Homo sapiens
ggagctggccca

SEQ ID NO: 2900999 - DNA, 15 bp, Homo sapiens
ggagctggccccgcc

SEQ ID NO: 2901000 - DNA, 12 bp, Homo sapiens
ggagctgggccc

SEQ ID NO: 2901001 - DNA, 17 bp, Homo sapiens
ggagctggggatccctc

SEQ ID NO: 2901002 - DNA, 17 bp, Homo sapiens
ggagctggtgacagcct

SEQ ID NO: 2901003 - DNA, 21 bp, Homo sapiens
ggagctggttcctctctccca

SEQ ID NO: 2901004 - DNA, 18 bp, Homo sapiens
ggagctgtcaccaaggaa

SEQ ID NO: 2901005 - DNA, 19 bp, Homo sapiens
ggagcttcccacacctgcc

SEQ ID NO: 2901006 - DNA, 20 bp, Homo sapiens
ggagcttcccacacctgcct

SEQ ID NO: 2901007 - DNA, 21 bp, Homo sapiens
ggagcttcccacacctgcctg

SEQ ID NO: 2901008 - DNA, 22 bp, Homo sapiens
ggagcttcccacacctgcctgc

SEQ ID NO: 2901009 - DNA, 23 bp, Homo sapiens
ggagcttctggggtccccagggc

SEQ ID NO: 2901010 - DNA, 13 bp, Homo sapiens
ggagctttctgta

SEQ ID NO: 2901011 - DNA, 17 bp, Homo sapiens
ggagctttcttgtttct

SEQ ID NO: 2901012 - DNA, 13 bp, Homo sapiens
ggaggaaagacaa

SEQ ID NO: 2901013 - DNA, 16 bp, Homo sapiens
ggaggaaagggcctgg

SEQ ID NO: 2901014 - DNA, 19 bp, Homo sapiens
ggaggaaagggcctggcca

SEQ ID NO: 2901015 - DNA, 23 bp, Homo sapiens
ggaggaaatttgaatgggtccat

SEQ ID NO: 2901016 - DNA, 14 bp, Homo sapiens
ggaggaagagagag

SEQ ID NO: 2901017 - DNA, 22 bp, Homo sapiens
ggaggacagtgggaactggagg

SEQ ID NO: 2901018 - DNA, 13 bp, Homo sapiens
ggaggagaccagc

SEQ ID NO: 2901019 - DNA, 17 bp, Homo sapiens
ggaggagctgagggagg

SEQ ID NO: 2901020 - DNA, 18 bp, Homo sapiens
ggaggaggcatggaaacc

SEQ ID NO: 2901021 - DNA, 20 bp, Homo sapiens
ggaggagggcaggcatcggg

SEQ ID NO: 2901022 - DNA, 20 bp, Homo sapiens
ggaggatcttttgaacccag

SEQ ID NO: 2901023 - DNA, 17 bp, Homo sapiens
ggaggcaaatggcactg

SEQ ID NO: 2901024 - DNA, 20 bp, Homo sapiens
ggaggcaaatggcactgcag

SEQ ID NO: 2901025 - DNA, 14 bp, Homo sapiens
ggaggcaagccctg

SEQ ID NO: 2901026 - DNA, 20 bp, Homo sapiens
ggaggcagaggttgcagtga

SEQ ID NO: 2901027 - DNA, 20 bp, Homo sapiens
ggaggcagatgtggggctga

SEQ ID NO: 2901028 - DNA, 13 bp, Homo sapiens
ggaggcagggcct

SEQ ID NO: 2901029 - DNA, 21 bp, Homo sapiens
ggaggcagggccttgcccaga

SEQ ID NO: 2901030 - DNA, 13 bp, Homo sapiens
ggaggcaggggac

SEQ ID NO: 2901031 - DNA, 22 bp, Homo sapiens
ggaggccaagcagtgcctgcct

SEQ ID NO: 2901032 - DNA, 16 bp, Homo sapiens
ggaggcccaggctggg

SEQ ID NO: 2901033 - DNA, 15 bp, Homo sapiens
ggaggccccaggggg

SEQ ID NO: 2901034 - DNA, 17 bp, Homo sapiens
ggaggcccgtccggcag

SEQ ID NO: 2901035 - DNA, 17 bp, Homo sapiens
ggaggccttccagggac

SEQ ID NO: 2901036 - DNA, 17 bp, Homo sapiens
ggaggccttggggtggg

SEQ ID NO: 2901037 - DNA, 18 bp, Homo sapiens
ggaggccttggggtgggg

SEQ ID NO: 2901038 - DNA, 21 bp, Homo sapiens
ggaggccttggggtgggggcc

SEQ ID NO: 2901039 - DNA, 20 bp, Homo sapiens
ggaggcggcactccaaccta

SEQ ID NO: 2901040 - DNA, 20 bp, Homo sapiens
ggaggcgggggctgcccttg

SEQ ID NO: 2901041 - DNA, 20 bp, Homo sapiens
ggaggctaaagcccagagac

SEQ ID NO: 2901042 - DNA, 14 bp, Homo sapiens
ggaggctcagccca

SEQ ID NO: 2901043 - DNA, 15 bp, Homo sapiens
ggaggctcagcccac

SEQ ID NO: 2901044 - DNA, 15 bp, Homo sapiens
ggaggctcaggtccc

SEQ ID NO: 2901045 - DNA, 18 bp, Homo sapiens
ggaggctccagagggcac

SEQ ID NO: 2901046 - DNA, 16 bp, Homo sapiens
ggaggctcctccctct

SEQ ID NO: 2901047 - DNA, 19 bp, Homo sapiens
ggaggctcctccctctgcc

SEQ ID NO: 2901048 - DNA, 16 bp, Homo sapiens
ggaggctgagacagga

SEQ ID NO: 2901049 - DNA, 15 bp, Homo sapiens
ggaggctgaggcagg

SEQ ID NO: 2901050 - DNA, 23 bp, Homo sapiens
ggaggctgcactggagccacagg

SEQ ID NO: 2901051 - DNA, 16 bp, Homo sapiens
ggaggctgcagccagg

SEQ ID NO: 2901052 - DNA, 18 bp, Homo sapiens
ggaggctgcagccaggcc

SEQ ID NO: 2901053 - DNA, 14 bp, Homo sapiens
ggaggctgccctga

SEQ ID NO: 2901054 - DNA, 20 bp, Homo sapiens
ggaggctttaagctccagct

SEQ ID NO: 2901055 - DNA, 13 bp, Homo sapiens
ggagggagctgag

SEQ ID NO: 2901056 - DNA, 17 bp, Homo sapiens
ggagggagctgaggcct

SEQ ID NO: 2901057 - DNA, 18 bp, Homo sapiens
ggagggagctgaggcctc

SEQ ID NO: 2901058 - DNA, 13 bp, Homo sapiens
ggagggaggcccc

SEQ ID NO: 2901059 - DNA, 14 bp, Homo sapiens
ggagggcagagaca

SEQ ID NO: 2901060 - DNA, 13 bp, Homo sapiens
ggagggcaggcat

SEQ ID NO: 2901061 - DNA, 17 bp, Homo sapiens
ggagggcgtgactcacc

SEQ ID NO: 2901062 - DNA, 22 bp, Homo sapiens
ggaggggacttgtaggaatctg

SEQ ID NO: 2901063 - DNA, 13 bp, Homo sapiens
ggaggggcctagg

SEQ ID NO: 2901064 - DNA, 16 bp, Homo sapiens
ggaggggcctttgctg

SEQ ID NO: 2901065 - DNA, 24 bp, Homo sapiens
ggagggggcggcagggctgggcct

SEQ ID NO: 2901066 - DNA, 15 bp, Homo sapiens
ggagggtgagctggt

SEQ ID NO: 2901067 - DNA, 15 bp, Homo sapiens
ggagggtttctctcc

SEQ ID NO: 2901068 - DNA, 17 bp, Homo sapiens
ggagggtttctctccca

SEQ ID NO: 2901069 - DNA, 15 bp, Homo sapiens
ggaggtcgaagcaat

SEQ ID NO: 2901070 - DNA, 17 bp, Homo sapiens
ggaggtctcgtcccagc

SEQ ID NO: 2901071 - DNA, 17 bp, Homo sapiens
ggaggtgattccagtga

SEQ ID NO: 2901072 - DNA, 20 bp, Homo sapiens
ggaggtggaggttgcagtga

SEQ ID NO: 2901073 - DNA, 17 bp, Homo sapiens
ggaggtggcactaggga

SEQ ID NO: 2901074 - DNA, 12 bp, Homo sapiens
ggaggtgggagg

SEQ ID NO: 2901075 - DNA, 13 bp, Homo sapiens
ggaggtgggggct

SEQ ID NO: 2901076 - DNA, 19 bp, Homo sapiens
ggaggtgtgatagagcctt

SEQ ID NO: 2901077 - DNA, 21 bp, Homo sapiens
ggaggtgtgatagagcctttg

SEQ ID NO: 2901078 - DNA, 14 bp, Homo sapiens
ggaggtgttcactg

SEQ ID NO: 2901079 - DNA, 12 bp, Homo sapiens
ggagtacaaggc

SEQ ID NO: 2901080 - DNA, 13 bp, Homo sapiens
ggagtcacacagt

SEQ ID NO: 2901081 - DNA, 15 bp, Homo sapiens
ggagtcaccatgcaa

SEQ ID NO: 2901082 - DNA, 13 bp, Homo sapiens
gcctccagctcag

SEQ ID NO: 2901083 - DNA, 15 bp, Homo sapiens
gcctccagctcagca

SEQ ID NO: 2901084 - DNA, 16 bp, Homo sapiens
gcctccaggtgcagag

SEQ ID NO: 2901085 - DNA, 14 bp, Homo sapiens
gcctccagtgcagt

SEQ ID NO: 2901086 - DNA, 13 bp, Homo sapiens
gcctcccaaagtg

SEQ ID NO: 2901087 - DNA, 13 bp, Homo sapiens
gcctcccacagac

SEQ ID NO: 2901088 - DNA, 12 bp, Homo sapiens
gcctcccactgg

SEQ ID NO: 2901089 - DNA, 14 bp, Homo sapiens
gcctcccactgggg

SEQ ID NO: 2901090 - DNA, 12 bp, Homo sapiens
gcctcccaggtt

SEQ ID NO: 2901091 - DNA, 14 bp, Homo sapiens
gcctcccatcccgc

SEQ ID NO: 2901092 - DNA, 12 bp, Homo sapiens
gcctccccacct

SEQ ID NO: 2901093 - DNA, 16 bp, Homo sapiens
gcctccccacctccag

SEQ ID NO: 2901094 - DNA, 18 bp, Homo sapiens
gcctcccctctccttcct

SEQ ID NO: 2901095 - DNA, 18 bp, Homo sapiens
gcctcccctgccagggca

SEQ ID NO: 2901096 - DNA, 20 bp, Homo sapiens
gcctccctagttagcatcca

SEQ ID NO: 2901097 - DNA, 18 bp, Homo sapiens
gcctccctccgtccctct

SEQ ID NO: 2901098 - DNA, 15 bp, Homo sapiens
gcctccctctcttcc

SEQ ID NO: 2901099 - DNA, 23 bp, Homo sapiens
gcctccctctcttccgggagctg

SEQ ID NO: 2901100 - DNA, 20 bp, Homo sapiens
gcctcccttcccagtgggct

SEQ ID NO: 2901101 - DNA, 13 bp, Homo sapiens
gcctccgcacctg

SEQ ID NO: 2901102 - DNA, 14 bp, Homo sapiens
gcctccgcacctga

SEQ ID NO: 2901103 - DNA, 20 bp, Homo sapiens
gcctccgcttatcctgctag

SEQ ID NO: 2901104 - DNA, 21 bp, Homo sapiens
gcctccgcttatcctgctagc

SEQ ID NO: 2901105 - DNA, 22 bp, Homo sapiens
gcctccggggttcagcctcctg

SEQ ID NO: 2901106 - DNA, 14 bp, Homo sapiens
gcctcctccctggc

SEQ ID NO: 2901107 - DNA, 23 bp, Homo sapiens
gcctcctctctcagtttttatat

SEQ ID NO: 2901108 - DNA, 17 bp, Homo sapiens
gcctcctctctccctgc

SEQ ID NO: 2901109 - DNA, 23 bp, Homo sapiens
gcctcctctctccctgcctcaca

SEQ ID NO: 2901110 - DNA, 13 bp, Homo sapiens
gcctcctgctctg

SEQ ID NO: 2901111 - DNA, 19 bp, Homo sapiens
gcctcctggcccaggtgag

SEQ ID NO: 2901112 - DNA, 14 bp, Homo sapiens
gcctcctggctcag

SEQ ID NO: 2901113 - DNA, 20 bp, Homo sapiens
gcctccttgccagccccacc

SEQ ID NO: 2901114 - DNA, 22 bp, Homo sapiens
gcctccttgccagccccacccc

SEQ ID NO: 2901115 - DNA, 16 bp, Homo sapiens
gcctcgaaacacagaa

SEQ ID NO: 2901116 - DNA, 14 bp, Homo sapiens
gcctcgaaagtgtc

SEQ ID NO: 2901117 - DNA, 15 bp, Homo sapiens
gcctcgaaagtgtca

SEQ ID NO: 2901118 - DNA, 17 bp, Homo sapiens
gcctcgagggccgcctg

SEQ ID NO: 2901119 - DNA, 19 bp, Homo sapiens
gcctcgagggccgcctgcc

SEQ ID NO: 2901120 - DNA, 15 bp, Homo sapiens
gcctcgcacaggccc

SEQ ID NO: 2901121 - DNA, 16 bp, Homo sapiens
gcctcgcacaggccct

SEQ ID NO: 2901122 - DNA, 18 bp, Homo sapiens
gcctcgcacttgcagagg

SEQ ID NO: 2901123 - DNA, 12 bp, Homo sapiens
gcctcgcctgcc

SEQ ID NO: 2901124 - DNA, 17 bp, Homo sapiens
gcctcgcctgccctcct

SEQ ID NO: 2901125 - DNA, 15 bp, Homo sapiens
gcctcgccttgtgtt

SEQ ID NO: 2901126 - DNA, 15 bp, Homo sapiens
gcctcggaggctcct

SEQ ID NO: 2901127 - DNA, 18 bp, Homo sapiens
gcctcggaggctcctccc

SEQ ID NO: 2901128 - DNA, 21 bp, Homo sapiens
gcctcggaggctcctccctct

SEQ ID NO: 2901129 - DNA, 23 bp, Homo sapiens
gcctcggaggctcctccctctgc

SEQ ID NO: 2901130 - DNA, 20 bp, Homo sapiens
gcctcggcagaactctctgt

SEQ ID NO: 2901131 - DNA, 20 bp, Homo sapiens
gcctcggcttttctcagctg

SEQ ID NO: 2901132 - DNA, 20 bp, Homo sapiens
gcctcggttgattgtgcatg

SEQ ID NO: 2901133 - DNA, 16 bp, Homo sapiens
gcctctaactccctcc

SEQ ID NO: 2901134 - DNA, 23 bp, Homo sapiens
gcctctacctgacactcccttgg

SEQ ID NO: 2901135 - DNA, 21 bp, Homo sapiens
gcctctccactcatgtgactc

SEQ ID NO: 2901136 - DNA, 24 bp, Homo sapiens
gcctctccctgcactccctcctgg

SEQ ID NO: 2901137 - DNA, 12 bp, Homo sapiens
gcctctcctttg

SEQ ID NO: 2901138 - DNA, 16 bp, Homo sapiens
gcctctcctttgtata

SEQ ID NO: 2901139 - DNA, 16 bp, Homo sapiens
gcctctcttcactgct

SEQ ID NO: 2901140 - DNA, 19 bp, Homo sapiens
gcctctcttcactgctaca

SEQ ID NO: 2901141 - DNA, 17 bp, Homo sapiens
gcctctgacagcagcct

SEQ ID NO: 2901142 - DNA, 22 bp, Homo sapiens
gcctctgacagcagcctgtgag

SEQ ID NO: 2901143 - DNA, 23 bp, Homo sapiens
gcctctgacagcagcctgtgagg

SEQ ID NO: 2901144 - DNA, 19 bp, Homo sapiens
gcctctgagcttctaaact

SEQ ID NO: 2901145 - DNA, 14 bp, Homo sapiens
gcctctgattttct

SEQ ID NO: 2901146 - DNA, 17 bp, Homo sapiens
gcctctgattttctcca

SEQ ID NO: 2901147 - DNA, 21 bp, Homo sapiens
gcctctgcagtcgcttgccaa

SEQ ID NO: 2901148 - DNA, 14 bp, Homo sapiens
gcctctgctggtct

SEQ ID NO: 2901149 - DNA, 22 bp, Homo sapiens
gcctctgctggtctctggctct

SEQ ID NO: 2901150 - DNA, 14 bp, Homo sapiens
gcctctggatctag

SEQ ID NO: 2901151 - DNA, 12 bp, Homo sapiens
gcctctgggtca

SEQ ID NO: 2901152 - DNA, 22 bp, Homo sapiens
gcctctgtctagcatgccaaca

SEQ ID NO: 2901153 - DNA, 21 bp, Homo sapiens
gcctctgtgtagccgccctga

SEQ ID NO: 2901154 - DNA, 20 bp, Homo sapiens
gcctcttctcttgacagtct

SEQ ID NO: 2901155 - DNA, 14 bp, Homo sapiens
gcctcttctgggag

SEQ ID NO: 2901156 - DNA, 18 bp, Homo sapiens
gcctcttctgggagggca

SEQ ID NO: 2901157 - DNA, 21 bp, Homo sapiens
gcctcttggataccagctcag

SEQ ID NO: 2901158 - DNA, 23 bp, Homo sapiens
gcctcttggataccagctcaggg

SEQ ID NO: 2901159 - DNA, 12 bp, Homo sapiens
gcctcttggcac

SEQ ID NO: 2901160 - DNA, 15 bp, Homo sapiens
gcctcttggcacctg

SEQ ID NO: 2901161 - DNA, 19 bp, Homo sapiens
gcctcttggcacctgccta

SEQ ID NO: 2901162 - DNA, 19 bp, Homo sapiens
gcctcttttcctgaagaaa

SEQ ID NO: 2901163 - DNA, 15 bp, Homo sapiens
gcctgaaacccattt

SEQ ID NO: 2901164 - DNA, 19 bp, Homo sapiens
gccttacagttatcctgca

SEQ ID NO: 2901165 - DNA, 15 bp, Homo sapiens
gccttacctcctgcc

SEQ ID NO: 2901166 - DNA, 20 bp, Homo sapiens
gccttacctcctgcccagga

SEQ ID NO: 2901167 - DNA, 13 bp, Homo sapiens
gccttactgttga

SEQ ID NO: 2901168 - DNA, 23 bp, Homo sapiens
gccttagaaacacataaattatg

SEQ ID NO: 2901169 - DNA, 22 bp, Homo sapiens
gccttagcatgtgactcctgaa

SEQ ID NO: 2901170 - DNA, 15 bp, Homo sapiens
gccttagcttcagga

SEQ ID NO: 2901171 - DNA, 19 bp, Homo sapiens
gccttagcttcaggaacct

SEQ ID NO: 2901172 - DNA, 20 bp, Homo sapiens
gccttagtcaataaacttgt

SEQ ID NO: 2901173 - DNA, 22 bp, Homo sapiens
gccttatctaaatcaccagaga

SEQ ID NO: 2901174 - DNA, 13 bp, Homo sapiens
gccttatgagaac

SEQ ID NO: 2901175 - DNA, 17 bp, Homo sapiens
gccttcactgtgctcca

SEQ ID NO: 2901176 - DNA, 21 bp, Homo sapiens
gccttcactgtgctccaacct

SEQ ID NO: 2901177 - DNA, 19 bp, Homo sapiens
gccttcacttttctgagtt

SEQ ID NO: 2901178 - DNA, 18 bp, Homo sapiens
gccttcagcagcagctca

SEQ ID NO: 2901179 - DNA, 21 bp, Homo sapiens
gccttcagcagcagctcacac

SEQ ID NO: 2901180 - DNA, 18 bp, Homo sapiens
gccttcattaaatgtttg

SEQ ID NO: 2901181 - DNA, 21 bp, Homo sapiens
gccttccccttgaacctcatt

SEQ ID NO: 2901182 - DNA, 18 bp, Homo sapiens
gccttccctcactcttcc

SEQ ID NO: 2901183 - DNA, 19 bp, Homo sapiens
gccttccctcactcttcct

SEQ ID NO: 2901184 - DNA, 21 bp, Homo sapiens
gccttccctcactcttcctca

SEQ ID NO: 2901185 - DNA, 22 bp, Homo sapiens
gccttccctcactcttcctcat

SEQ ID NO: 2901186 - DNA, 19 bp, Homo sapiens
gccttcctaagcctgtggc

SEQ ID NO: 2901187 - DNA, 20 bp, Homo sapiens
gccttcctaagcctgtggct

SEQ ID NO: 2901188 - DNA, 21 bp, Homo sapiens
gccttcctaagcctgtggctg

SEQ ID NO: 2901189 - DNA, 22 bp, Homo sapiens
gccttcctaagcctgtggctgt

SEQ ID NO: 2901190 - DNA, 14 bp, Homo sapiens
gccttcctcctggg

SEQ ID NO: 2901191 - DNA, 13 bp, Homo sapiens
gccttcctctctc

SEQ ID NO: 2901192 - DNA, 16 bp, Homo sapiens
gccttcctctctccag

SEQ ID NO: 2901193 - DNA, 18 bp, Homo sapiens
gccttcctctctccagat

SEQ ID NO: 2901194 - DNA, 15 bp, Homo sapiens
gccttctaaaggtgt

SEQ ID NO: 2901195 - DNA, 12 bp, Homo sapiens
gccttctcacca

SEQ ID NO: 2901196 - DNA, 19 bp, Homo sapiens
gccttctcaccagctgcaa

SEQ ID NO: 2901197 - DNA, 21 bp, Homo sapiens
gccttctcaccagctgcaaag

SEQ ID NO: 2901198 - DNA, 22 bp, Homo sapiens
gccttctcaccagctgcaaagt

SEQ ID NO: 2901199 - DNA, 19 bp, Homo sapiens
gccttctcagctctccacc

SEQ ID NO: 2901200 - DNA, 20 bp, Homo sapiens
gccttctcagggacttctgc

SEQ ID NO: 2901201 - DNA, 22 bp, Homo sapiens
gccttctcggagctggcccagg

SEQ ID NO: 2901202 - DNA, 14 bp, Homo sapiens
gccttctctcagct

SEQ ID NO: 2901203 - DNA, 18 bp, Homo sapiens
gccttctctcagctccca

SEQ ID NO: 2901204 - DNA, 22 bp, Homo sapiens
gccttctctcagctcccaggcc

SEQ ID NO: 2901205 - DNA, 24 bp, Homo sapiens
gccttctctcagctcccaggccaa

SEQ ID NO: 2901206 - DNA, 19 bp, Homo sapiens
gccttcttatatctgaaga

SEQ ID NO: 2901207 - DNA, 21 bp, Homo sapiens
gccttcttatatctgaagatt

SEQ ID NO: 2901208 - DNA, 23 bp, Homo sapiens
gccttcttcggggaactcctgga

SEQ ID NO: 2901209 - DNA, 23 bp, Homo sapiens
gccttcttttgggggtcaacagt

SEQ ID NO: 2901210 - DNA, 15 bp, Homo sapiens
gccttgaagacagag

SEQ ID NO: 2901211 - DNA, 16 bp, Homo sapiens
gccttgcagctggccc

SEQ ID NO: 2901212 - DNA, 18 bp, Homo sapiens
gccttgcagctggcccac

SEQ ID NO: 2901213 - DNA, 20 bp, Homo sapiens
gccttgccacatctgtgtct

SEQ ID NO: 2901214 - DNA, 13 bp, Homo sapiens
gccttgccagaga

SEQ ID NO: 2901215 - DNA, 14 bp, Homo sapiens
gccttgcccagaga

SEQ ID NO: 2901216 - DNA, 15 bp, Homo sapiens
gccttgcccagagat

SEQ ID NO: 2901217 - DNA, 16 bp, Homo sapiens
gccttgcccagagatg

SEQ ID NO: 2901218 - DNA, 23 bp, Homo sapiens
gccttgctgactctctgagctgg

SEQ ID NO: 2901219 - DNA, 22 bp, Homo sapiens
gccttgctgccaagtcctgcct

SEQ ID NO: 2901220 - DNA, 15 bp, Homo sapiens
gccttgctgtagaga

SEQ ID NO: 2901221 - DNA, 12 bp, Homo sapiens
gccttgcttctt

SEQ ID NO: 2901222 - DNA, 14 bp, Homo sapiens
gccttggctcagac

SEQ ID NO: 2901223 - DNA, 17 bp, Homo sapiens
gccttgggcctttcagt

SEQ ID NO: 2901224 - DNA, 19 bp, Homo sapiens
gccttgggggggctgcctt

SEQ ID NO: 2901225 - DNA, 21 bp, Homo sapiens
gccttgggggggctgcctttg

SEQ ID NO: 2901226 - DNA, 19 bp, Homo sapiens
gccttgggtttctgtgcag

SEQ ID NO: 2901227 - DNA, 17 bp, Homo sapiens
gccttggtatgtgccag

SEQ ID NO: 2901228 - DNA, 21 bp, Homo sapiens
gccttggtatgtgccaggctt

SEQ ID NO: 2901229 - DNA, 16 bp, Homo sapiens
gccttggtgtccacct

SEQ ID NO: 2901230 - DNA, 19 bp, Homo sapiens
gccttggtgtccacctggc

SEQ ID NO: 2901231 - DNA, 21 bp, Homo sapiens
gccttgtgtcctcctgttccg

SEQ ID NO: 2901232 - DNA, 14 bp, Homo sapiens
gccttgtgtgtcag

SEQ ID NO: 2901233 - DNA, 21 bp, Homo sapiens
gccttgtgtgtcaggccctct

SEQ ID NO: 2901234 - DNA, 20 bp, Homo sapiens
gcctttacatggacagaatt

SEQ ID NO: 2901235 - DNA, 19 bp, Homo sapiens
gcctttagcttaagaggcc

SEQ ID NO: 2901236 - DNA, 15 bp, Homo sapiens
gcctttatctcagcc

SEQ ID NO: 2901237 - DNA, 16 bp, Homo sapiens
gcctttatctcagcca

SEQ ID NO: 2901238 - DNA, 22 bp, Homo sapiens
gcctttatctcagccatccgca

SEQ ID NO: 2901239 - DNA, 15 bp, Homo sapiens
gcctttcaaatttag

SEQ ID NO: 2901240 - DNA, 15 bp, Homo sapiens
gcctttcctacaggg

SEQ ID NO: 2901241 - DNA, 14 bp, Homo sapiens
gcctttgaatgtta

SEQ ID NO: 2901242 - DNA, 17 bp, Homo sapiens
gcctttgatcaggtggg

SEQ ID NO: 2901243 - DNA, 15 bp, Homo sapiens
gcctttgctgccctt

SEQ ID NO: 2901244 - DNA, 18 bp, Homo sapiens
gcctttggacttgtcccg

SEQ ID NO: 2901245 - DNA, 16 bp, Homo sapiens
gcctttggcagagttc

SEQ ID NO: 2901246 - DNA, 16 bp, Homo sapiens
gcctttgggtcctggg

SEQ ID NO: 2901247 - DNA, 20 bp, Homo sapiens
gcctttgtggtgggcgctgg

SEQ ID NO: 2901248 - DNA, 14 bp, Homo sapiens
gcctttgttctggg

SEQ ID NO: 2901249 - DNA, 14 bp, Homo sapiens
gccttttaattttt

SEQ ID NO: 2901250 - DNA, 13 bp, Homo sapiens
gccttttccctta

SEQ ID NO: 2901251 - DNA, 15 bp, Homo sapiens
gccttttctggcacc

SEQ ID NO: 2901252 - DNA, 13 bp, Homo sapiens
gccttttcttttc

SEQ ID NO: 2901253 - DNA, 16 bp, Homo sapiens
gccttttgcagaagag

SEQ ID NO: 2901254 - DNA, 19 bp, Homo sapiens
gcgaacatcttcatataaa

SEQ ID NO: 2901255 - DNA, 17 bp, Homo sapiens
gcgaattgtagaattgt

SEQ ID NO: 2901256 - DNA, 13 bp, Homo sapiens
gcgacactcaggg

SEQ ID NO: 2901257 - DNA, 19 bp, Homo sapiens
gcgacactcagggcagctg

SEQ ID NO: 2901258 - DNA, 20 bp, Homo sapiens
gcgacactcagggcagctgc

SEQ ID NO: 2901259 - DNA, 18 bp, Homo sapiens
gcgacactgggaggccag

SEQ ID NO: 2901260 - DNA, 23 bp, Homo sapiens
gcgacctctccatcttcagcttc

SEQ ID NO: 2901261 - DNA, 21 bp, Homo sapiens
gcgactaatttcaaaatgctt

SEQ ID NO: 2901262 - DNA, 20 bp, Homo sapiens
gcgagaacctaagtttcagt

SEQ ID NO: 2901263 - DNA, 14 bp, Homo sapiens
gcgagactccatct

SEQ ID NO: 2901264 - DNA, 14 bp, Homo sapiens
gcgagccacaggaa

SEQ ID NO: 2901265 - DNA, 13 bp, Homo sapiens
gcgagcccttagc

SEQ ID NO: 2901266 - DNA, 23 bp, Homo sapiens
gcgagctctcaaatccctctcca

SEQ ID NO: 2901267 - DNA, 17 bp, Homo sapiens
gcgaggaaaaacaacaa

SEQ ID NO: 2901268 - DNA, 13 bp, Homo sapiens
gcgaggaggcgcg

SEQ ID NO: 2901269 - DNA, 15 bp, Homo sapiens
gcgaggaggctccag

SEQ ID NO: 2901270 - DNA, 16 bp, Homo sapiens
gcgaggaggctccaga

SEQ ID NO: 2901271 - DNA, 23 bp, Homo sapiens
gcgaggcctctctcaggagcagg

SEQ ID NO: 2901272 - DNA, 16 bp, Homo sapiens
gcgaggtcaacagaga

SEQ ID NO: 2901273 - DNA, 19 bp, Homo sapiens
gcgaggtcaacagagaagg

SEQ ID NO: 2901274 - DNA, 12 bp, Homo sapiens
gcgcaaacttta

SEQ ID NO: 2901275 - DNA, 15 bp, Homo sapiens
gcgcaaagggcatgg

SEQ ID NO: 2901276 - DNA, 22 bp, Homo sapiens
gcgcaaagggcatgggtcggga

SEQ ID NO: 2901277 - DNA, 23 bp, Homo sapiens
gcgcaagcctgtaatcccagcta

SEQ ID NO: 2901278 - DNA, 18 bp, Homo sapiens
gcgcaatctcgccttcct

SEQ ID NO: 2901279 - DNA, 19 bp, Homo sapiens
gcgcacttaccgccctgcg

SEQ ID NO: 2901280 - DNA, 22 bp, Homo sapiens
gcgcagggtggtggtattctgt

SEQ ID NO: 2901281 - DNA, 23 bp, Homo sapiens
gcgcagggtggtggtattctgtc

SEQ ID NO: 2901282 - DNA, 13 bp, Homo sapiens
gcgccaccatgcc

SEQ ID NO: 2901283 - DNA, 15 bp, Homo sapiens
gcgccaggcagagct

SEQ ID NO: 2901284 - DNA, 16 bp, Homo sapiens
gcgccaggcagagctg

SEQ ID NO: 2901285 - DNA, 22 bp, Homo sapiens
gcgccaggctgaccacagcaca

SEQ ID NO: 2901286 - DNA, 14 bp, Homo sapiens
gcgccagggcccag

SEQ ID NO: 2901287 - DNA, 19 bp, Homo sapiens
gcgccagggcccaggccat

SEQ ID NO: 2901288 - DNA, 13 bp, Homo sapiens
gcgcccagcagcc

SEQ ID NO: 2901289 - DNA, 14 bp, Homo sapiens
gcgcccagcagcct

SEQ ID NO: 2901290 - DNA, 20 bp, Homo sapiens
gcgcccagcagcctgccagc

SEQ ID NO: 2901291 - DNA, 19 bp, Homo sapiens
gcgcccagtccttccacct

SEQ ID NO: 2901292 - DNA, 15 bp, Homo sapiens
gcgcccccctcccag

SEQ ID NO: 2901293 - DNA, 17 bp, Homo sapiens
gcgcccccctcccagag

SEQ ID NO: 2901294 - DNA, 23 bp, Homo sapiens
gcggtcctgcacagattcccagg

SEQ ID NO: 2901295 - DNA, 16 bp, Homo sapiens
gcggtgctgtcctcag

SEQ ID NO: 2901296 - DNA, 19 bp, Homo sapiens
gcggtggccacagcgtgct

SEQ ID NO: 2901297 - DNA, 23 bp, Homo sapiens
gcggtgtcaggtcccagcgagcc

SEQ ID NO: 2901298 - DNA, 18 bp, Homo sapiens
gcggtgtggaccgaggaa

SEQ ID NO: 2901299 - DNA, 12 bp, Homo sapiens
gcgtattctgtg

SEQ ID NO: 2901300 - DNA, 15 bp, Homo sapiens
gcgtattctgtggcc

SEQ ID NO: 2901301 - DNA, 16 bp, Homo sapiens
gcgtattctgtggccg

SEQ ID NO: 2901302 - DNA, 21 bp, Homo sapiens
gcgtcagagagacccgggaag

SEQ ID NO: 2901303 - DNA, 14 bp, Homo sapiens
gcgtcccaagatgt

SEQ ID NO: 2901304 - DNA, 20 bp, Homo sapiens
gcgtccgccgcgtgtgcgtg

SEQ ID NO: 2901305 - DNA, 14 bp, Homo sapiens
gcgtcctcctctgt

SEQ ID NO: 2901306 - DNA, 13 bp, Homo sapiens
gcgtcctgccctg

SEQ ID NO: 2901307 - DNA, 21 bp, Homo sapiens
gcgtcctgccctgccccctcg

SEQ ID NO: 2901308 - DNA, 14 bp, Homo sapiens
gcgtctgactccct

SEQ ID NO: 2901309 - DNA, 17 bp, Homo sapiens
gcgtcttcatctccctg

SEQ ID NO: 2901310 - DNA, 21 bp, Homo sapiens
gcgtcttcatctccctgccat

SEQ ID NO: 2901311 - DNA, 17 bp, Homo sapiens
gcgtctttaagagactc

SEQ ID NO: 2901312 - DNA, 19 bp, Homo sapiens
gcgtgatcaaagccacact

SEQ ID NO: 2901313 - DNA, 16 bp, Homo sapiens
gcgtgccgggccccca

SEQ ID NO: 2901314 - DNA, 22 bp, Homo sapiens
gcgtgccgggcccccaccgccg

SEQ ID NO: 2901315 - DNA, 21 bp, Homo sapiens
gcgtggaactcgtgtctggca

SEQ ID NO: 2901316 - DNA, 13 bp, Homo sapiens
gcgtggactctgc

SEQ ID NO: 2901317 - DNA, 14 bp, Homo sapiens
gcgtggactctgca

SEQ ID NO: 2901318 - DNA, 17 bp, Homo sapiens
gcgtggactctgcacat

SEQ ID NO: 2901319 - DNA, 18 bp, Homo sapiens
gcgtggactctgcacatg

SEQ ID NO: 2901320 - DNA, 19 bp, Homo sapiens
gcgtggagactggcaggcg

SEQ ID NO: 2901321 - DNA, 14 bp, Homo sapiens
gcgtggattaaact

SEQ ID NO: 2901322 - DNA, 20 bp, Homo sapiens
gcgtgtccccggggcccagg

SEQ ID NO: 2901323 - DNA, 17 bp, Homo sapiens
gcgtgtccgtctgtctg

SEQ ID NO: 2901324 - DNA, 16 bp, Homo sapiens
gcgtgtgcaggccgac

SEQ ID NO: 2901325 - DNA, 15 bp, Homo sapiens
gctgacagctcttca

SEQ ID NO: 2901326 - DNA, 13 bp, Homo sapiens
gctgacagctgct

SEQ ID NO: 2901327 - DNA, 14 bp, Homo sapiens
gctgacagctgctc

SEQ ID NO: 2901328 - DNA, 19 bp, Homo sapiens
gctgacagtttgtggcatc

SEQ ID NO: 2901329 - DNA, 16 bp, Homo sapiens
gctgacattcacctgc

SEQ ID NO: 2901330 - DNA, 16 bp, Homo sapiens
gctgaccacagcacag

SEQ ID NO: 2901331 - DNA, 17 bp, Homo sapiens
gctgaccacagcacagc

SEQ ID NO: 2901332 - DNA, 19 bp, Homo sapiens
gctgaccacagcacagcca

SEQ ID NO: 2901333 - DNA, 15 bp, Homo sapiens
gctgacccaccaagg

SEQ ID NO: 2901334 - DNA, 15 bp, Homo sapiens
gctgacccagtccct

SEQ ID NO: 2901335 - DNA, 19 bp, Homo sapiens
gctgacccagtccctgggg

SEQ ID NO: 2901336 - DNA, 18 bp, Homo sapiens
gctgaccccctcccccca

SEQ ID NO: 2901337 - DNA, 12 bp, Homo sapiens
gctgaccctgtg

SEQ ID NO: 2901338 - DNA, 15 bp, Homo sapiens
gctgaccctgtgccc

SEQ ID NO: 2901339 - DNA, 17 bp, Homo sapiens
gctgaccctgtgcccca

SEQ ID NO: 2901340 - DNA, 19 bp, Homo sapiens
gcagatgcaatgactcagg

SEQ ID NO: 2901341 - DNA, 17 bp, Homo sapiens
gcagatggcagggctga

SEQ ID NO: 2901342 - DNA, 19 bp, Homo sapiens
gcagatggccactgctctt

SEQ ID NO: 2901343 - DNA, 22 bp, Homo sapiens
gcagatgtgcagcagattggaa

SEQ ID NO: 2901344 - DNA, 16 bp, Homo sapiens
gcagattggaaggaga

SEQ ID NO: 2901345 - DNA, 20 bp, Homo sapiens
gcagattggaaggagacaca

SEQ ID NO: 2901346 - DNA, 22 bp, Homo sapiens
gcagattggaaggagacacaga

SEQ ID NO: 2901347 - DNA, 17 bp, Homo sapiens
gcagatttctgccttga

SEQ ID NO: 2901348 - DNA, 22 bp, Homo sapiens
gcagatttgtggggacctcagc

SEQ ID NO: 2901349 - DNA, 13 bp, Homo sapiens
gcagcaaaatcct

SEQ ID NO: 2901350 - DNA, 23 bp, Homo sapiens
gcagcaaaatccttacttccagc

SEQ ID NO: 2901351 - DNA, 14 bp, Homo sapiens
gcagcaaattttca

SEQ ID NO: 2901352 - DNA, 14 bp, Homo sapiens
gcagcaagaaaaaa

SEQ ID NO: 2901353 - DNA, 14 bp, Homo sapiens
gcagcactgctgcc

SEQ ID NO: 2901354 - DNA, 15 bp, Homo sapiens
gcagcactgctgcct

SEQ ID NO: 2901355 - DNA, 16 bp, Homo sapiens
gcagcactgctgcctc

SEQ ID NO: 2901356 - DNA, 16 bp, Homo sapiens
gcagcagagagccctg

SEQ ID NO: 2901357 - DNA, 17 bp, Homo sapiens
gcagcagagagccctgg

SEQ ID NO: 2901358 - DNA, 22 bp, Homo sapiens
gcagcagagagccctgggtgac

SEQ ID NO: 2901359 - DNA, 12 bp, Homo sapiens
gcagcagggcta

SEQ ID NO: 2901360 - DNA, 19 bp, Homo sapiens
gcagcagtgtgaggccagg

SEQ ID NO: 2901361 - DNA, 13 bp, Homo sapiens
gcagcagttgagg

SEQ ID NO: 2901362 - DNA, 19 bp, Homo sapiens
gcagcatcccagccttgag

SEQ ID NO: 2901363 - DNA, 23 bp, Homo sapiens
gcagccacacgcaggcggccagg

SEQ ID NO: 2901364 - DNA, 13 bp, Homo sapiens
gcagccagcccag

SEQ ID NO: 2901365 - DNA, 17 bp, Homo sapiens
gcagccagcccagccca

SEQ ID NO: 2901366 - DNA, 13 bp, Homo sapiens
gcagccaggaggg

SEQ ID NO: 2901367 - DNA, 14 bp, Homo sapiens
gcagccaggaggga

SEQ ID NO: 2901368 - DNA, 16 bp, Homo sapiens
gcagccaggagggacc

SEQ ID NO: 2901369 - DNA, 17 bp, Homo sapiens
gcagccaggagggacct

SEQ ID NO: 2901370 - DNA, 23 bp, Homo sapiens
gcagccaggatgactagatcctg

SEQ ID NO: 2901371 - DNA, 13 bp, Homo sapiens
gcagccaggcctc

SEQ ID NO: 2901372 - DNA, 20 bp, Homo sapiens
gcagccaggcctcgcctgcc

SEQ ID NO: 2901373 - DNA, 13 bp, Homo sapiens
gcagccaggctgg

SEQ ID NO: 2901374 - DNA, 17 bp, Homo sapiens
gcagccaggctgggccg

SEQ ID NO: 2901375 - DNA, 17 bp, Homo sapiens
gcagcccaacagcactt

SEQ ID NO: 2901376 - DNA, 14 bp, Homo sapiens
gcagcccaccagga

SEQ ID NO: 2901377 - DNA, 20 bp, Homo sapiens
gcagcccaccctgctgctgg

SEQ ID NO: 2901378 - DNA, 19 bp, Homo sapiens
gcagcccatttctccagaa

SEQ ID NO: 2901379 - DNA, 20 bp, Homo sapiens
gcagcccccgcgccctccct

SEQ ID NO: 2901380 - DNA, 21 bp, Homo sapiens
gcagccccggcaactctggct

SEQ ID NO: 2901381 - DNA, 10 bp, Homo sapiens
gcagccctcc

SEQ ID NO: 2901382 - DNA, 15 bp, Homo sapiens
gcagccctcctcacc

SEQ ID NO: 2901383 - DNA, 13 bp, Homo sapiens
gcagccctcctta

SEQ ID NO: 2901384 - DNA, 12 bp, Homo sapiens
gcagccctctgc

SEQ ID NO: 2901385 - DNA, 16 bp, Homo sapiens
gcagccgctgagcgag

SEQ ID NO: 2901386 - DNA, 15 bp, Homo sapiens
gcagccggagggagg

SEQ ID NO: 2901387 - DNA, 22 bp, Homo sapiens
gcagcctccagttgtagcaggt

SEQ ID NO: 2901388 - DNA, 18 bp, Homo sapiens
gcagcctcccatccaggg

SEQ ID NO: 2901389 - DNA, 21 bp, Homo sapiens
gcagcctccggggttcagcct

SEQ ID NO: 2901390 - DNA, 23 bp, Homo sapiens
gcagcctcgcacaggccctagct

SEQ ID NO: 2901391 - DNA, 16 bp, Homo sapiens
gcagcctctcttcact

SEQ ID NO: 2901392 - DNA, 13 bp, Homo sapiens
gcagcctgccagc

SEQ ID NO: 2901393 - DNA, 23 bp, Homo sapiens
gcagcctgcgccaccgcccagag

SEQ ID NO: 2901394 - DNA, 17 bp, Homo sapiens
gcagcctggcatctgtg

SEQ ID NO: 2901395 - DNA, 17 bp, Homo sapiens
gcagcctggggctggcc

SEQ ID NO: 2901396 - DNA, 24 bp, Homo sapiens
gcagcctggtcactaggcatcacc

SEQ ID NO: 2901397 - DNA, 19 bp, Homo sapiens
gcagcctgtgagggagtgc

SEQ ID NO: 2901398 - DNA, 14 bp, Homo sapiens
gcagcgccaggctg

SEQ ID NO: 2901399 - DNA, 16 bp, Homo sapiens
gcagcgcctgtcccct

SEQ ID NO: 2901400 - DNA, 14 bp, Homo sapiens
gcagcgcgcaggcc

SEQ ID NO: 2901401 - DNA, 16 bp, Homo sapiens
gcagcgcgcaggcctg

SEQ ID NO: 2901402 - DNA, 17 bp, Homo sapiens
gcagcgcgcaggcctgc

SEQ ID NO: 2901403 - DNA, 13 bp, Homo sapiens
gcagcggctctgg

SEQ ID NO: 2901404 - DNA, 18 bp, Homo sapiens
gcagcggtgggaaggaaa

SEQ ID NO: 2901405 - DNA, 19 bp, Homo sapiens
gcagctaactccgagagca

SEQ ID NO: 2901406 - DNA, 22 bp, Homo sapiens
gcagctaactccgagagcagtg

SEQ ID NO: 2901407 - DNA, 18 bp, Homo sapiens
gcagctcaagagatccca

SEQ ID NO: 2901408 - DNA, 19 bp, Homo sapiens
gcagctcaggttgtagtgg

SEQ ID NO: 2901409 - DNA, 14 bp, Homo sapiens
gcagctctgccttc

SEQ ID NO: 2901410 - DNA, 12 bp, Homo sapiens
gcagctgcccct

SEQ ID NO: 2901411 - DNA, 14 bp, Homo sapiens
gcagctgcccctcc

SEQ ID NO: 2901412 - DNA, 14 bp, Homo sapiens
gcagctgcccctgg

SEQ ID NO: 2901413 - DNA, 17 bp, Homo sapiens
gcagctgcccctggcac

SEQ ID NO: 2901414 - DNA, 18 bp, Homo sapiens
gcagctgcccctggcacc

SEQ ID NO: 2901415 - DNA, 16 bp, Homo sapiens
gcagctgcctggccat

SEQ ID NO: 2901416 - DNA, 11 bp, Homo sapiens
gcagctgctgc

SEQ ID NO: 2901417 - DNA, 13 bp, Homo sapiens
gcagctgctgcca

SEQ ID NO: 2901418 - DNA, 18 bp, Homo sapiens
gcagctggactgctgctg

SEQ ID NO: 2901419 - DNA, 19 bp, Homo sapiens
gcagctggcccactgctgg

SEQ ID NO: 2901420 - DNA, 14 bp, Homo sapiens
gcagctgggcccac

SEQ ID NO: 2901421 - DNA, 15 bp, Homo sapiens
gcagctgggcccaca

SEQ ID NO: 2901422 - DNA, 16 bp, Homo sapiens
gcagctgggcccacag

SEQ ID NO: 2901423 - DNA, 22 bp, Homo sapiens
gcagctgtcccttgcttgcctg

SEQ ID NO: 2901424 - DNA, 17 bp, Homo sapiens
gcaggaagctcagactg

SEQ ID NO: 2901425 - DNA, 12 bp, Homo sapiens
gcaggaaggaaa

SEQ ID NO: 2901426 - DNA, 13 bp, Homo sapiens
gcaggaaggaaaa

SEQ ID NO: 2901427 - DNA, 11 bp, Homo sapiens
gcaggaaggct

SEQ ID NO: 2901428 - DNA, 18 bp, Homo sapiens
gcaggaccaagggggcgg

SEQ ID NO: 2901429 - DNA, 21 bp, Homo sapiens
gcaggaccttcgggctgtgcc

SEQ ID NO: 2901430 - DNA, 13 bp, Homo sapiens
gcaggactccagg

SEQ ID NO: 2901431 - DNA, 23 bp, Homo sapiens
gcaggagaatcgcttgaacctgg

SEQ ID NO: 2901432 - DNA, 23 bp, Homo sapiens
gcaggagaggagagccagagaag

SEQ ID NO: 2901433 - DNA, 17 bp, Homo sapiens
gcaggagcagggcggct

SEQ ID NO: 2901434 - DNA, 22 bp, Homo sapiens
gcaggagctagttctcagcttg

SEQ ID NO: 2901435 - DNA, 16 bp, Homo sapiens
gcaggaggccaggccg

SEQ ID NO: 2901436 - DNA, 15 bp, Homo sapiens
gcaggagggaggtgc

SEQ ID NO: 2901437 - DNA, 23 bp, Homo sapiens
gcaggagtcaccatgcaagggtg

SEQ ID NO: 2901438 - DNA, 21 bp, Homo sapiens
gcaggagtggaaggtgaggcg

SEQ ID NO: 2901439 - DNA, 18 bp, Homo sapiens
gcaggagttgggggcagg

SEQ ID NO: 2901440 - DNA, 20 bp, Homo sapiens
gcaggatctcagatcactgc

SEQ ID NO: 2901441 - DNA, 20 bp, Homo sapiens
gcaggatgaccacgcacctc

SEQ ID NO: 2901442 - DNA, 16 bp, Homo sapiens
gcaggatttgttctct

SEQ ID NO: 2901443 - DNA, 17 bp, Homo sapiens
gcaggatttgttctctg

SEQ ID NO: 2901444 - DNA, 22 bp, Homo sapiens
gcaggatttttagagcattaaa

SEQ ID NO: 2901445 - DNA, 19 bp, Homo sapiens
gcaggcaccaacaactcag

SEQ ID NO: 2901446 - DNA, 14 bp, Homo sapiens
gcaggcaccgggct

SEQ ID NO: 2901447 - DNA, 20 bp, Homo sapiens
gcaggcaccgggctggctgc

SEQ ID NO: 2901448 - DNA, 19 bp, Homo sapiens
gcaggcgtgtggcagccac

SEQ ID NO: 2901449 - DNA, 20 bp, Homo sapiens
gcaggcgtgtggcagccaca

SEQ ID NO: 2901450 - DNA, 12 bp, Homo sapiens
gcaggctgattt

SEQ ID NO: 2901451 - DNA, 16 bp, Homo sapiens
gcaggctgcaggaggg

SEQ ID NO: 2901452 - DNA, 12 bp, Homo sapiens
gcaggctggcca

SEQ ID NO: 2901453 - DNA, 17 bp, Homo sapiens
gcaggctgtctggccag

SEQ ID NO: 2901454 - DNA, 21 bp, Homo sapiens
gcagggaaaattatttgcata

SEQ ID NO: 2901455 - DNA, 21 bp, Homo sapiens
gcagggaagtgtaagaaacac

SEQ ID NO: 2901456 - DNA, 23 bp, Homo sapiens
gcagggacccggggtctcctgga

SEQ ID NO: 2901457 - DNA, 15 bp, Homo sapiens
gcagggagagttggg

SEQ ID NO: 2901458 - DNA, 13 bp, Homo sapiens
gcagggagcacca

SEQ ID NO: 2901459 - DNA, 20 bp, Homo sapiens
gcagggagcaccacggccag

SEQ ID NO: 2901460 - DNA, 16 bp, Homo sapiens
gcagggagctgggccc

SEQ ID NO: 2901461 - DNA, 22 bp, Homo sapiens
gcagggagctgggcccgacatg

SEQ ID NO: 2901462 - DNA, 12 bp, Homo sapiens
gcagggcacaga

SEQ ID NO: 2901463 - DNA, 17 bp, Homo sapiens
gcagggcacagatgacc

SEQ ID NO: 2901464 - DNA, 23 bp, Homo sapiens
gcagggcacagatgaccaaagtc

SEQ ID NO: 2901465 - DNA, 13 bp, Homo sapiens
gcagggccaggct

SEQ ID NO: 2901466 - DNA, 16 bp, Homo sapiens
gcagggccaggctggt

SEQ ID NO: 2901467 - DNA, 19 bp, Homo sapiens
gcagggcccctgaccctcc

SEQ ID NO: 2901468 - DNA, 23 bp, Homo sapiens
gcagggcccctgaccctcccggc

SEQ ID NO: 2901469 - DNA, 23 bp, Homo sapiens
gcagggccgccagggagacctgg

SEQ ID NO: 2901470 - DNA, 20 bp, Homo sapiens
gcagggccgcgagaggccga

SEQ ID NO: 2901471 - DNA, 22 bp, Homo sapiens
gcagggccgcgagaggccgagc

SEQ ID NO: 2901472 - DNA, 21 bp, Homo sapiens
gcagggcctagctgctacaaa

SEQ ID NO: 2901473 - DNA, 19 bp, Homo sapiens
gcagggccttgcccagaga

SEQ ID NO: 2901474 - DNA, 22 bp, Homo sapiens
gcagggctaccctgagctgagg

SEQ ID NO: 2901475 - DNA, 23 bp, Homo sapiens
gcagggctaccctgagctgaggc

SEQ ID NO: 2901476 - DNA, 13 bp, Homo sapiens
gcagggctgagga

SEQ ID NO: 2901477 - DNA, 14 bp, Homo sapiens
gcagggctgaggat

SEQ ID NO: 2901478 - DNA, 13 bp, Homo sapiens
gcagggctgggcc

SEQ ID NO: 2901479 - DNA, 22 bp, Homo sapiens
gcaggggacaagggaggcagtg

SEQ ID NO: 2901480 - DNA, 15 bp, Homo sapiens
gcaggggactgggcc

SEQ ID NO: 2901481 - DNA, 16 bp, Homo sapiens
gcaggggactgggcca

SEQ ID NO: 2901482 - DNA, 13 bp, Homo sapiens
gcaggggagccag

SEQ ID NO: 2901483 - DNA, 15 bp, Homo sapiens
gcaggggagccaggg

SEQ ID NO: 2901484 - DNA, 20 bp, Homo sapiens
gcaggggccgggggcagtct

SEQ ID NO: 2901485 - DNA, 18 bp, Homo sapiens
gcaggggctgctgggggc

SEQ ID NO: 2901486 - DNA, 22 bp, Homo sapiens
gcaggggctgctgggggctccc

SEQ ID NO: 2901487 - DNA, 18 bp, Homo sapiens
gcagggggtgaaggcagg

SEQ ID NO: 2901488 - DNA, 19 bp, Homo sapiens
gcagggggtgaaggcagga

SEQ ID NO: 2901489 - DNA, 20 bp, Homo sapiens
gcagggggtgaaggcaggag

SEQ ID NO: 2901490 - DNA, 22 bp, Homo sapiens
gcaggggtggctgcctcattta

SEQ ID NO: 2901491 - DNA, 21 bp, Homo sapiens
gcagggtcctcttctgggcct

SEQ ID NO: 2901492 - DNA, 14 bp, Homo sapiens
gcagggtctctgct

SEQ ID NO: 2901493 - DNA, 16 bp, Homo sapiens
gcagggtctctgctcc

SEQ ID NO: 2901494 - DNA, 18 bp, Homo sapiens
gcagggtctctgctccag

SEQ ID NO: 2901495 - DNA, 19 bp, Homo sapiens
gcagggtctctgctccagc

SEQ ID NO: 2901496 - DNA, 15 bp, Homo sapiens
gcagggtgggagccg

SEQ ID NO: 2901497 - DNA, 14 bp, Homo sapiens
gcagggtttgagca

SEQ ID NO: 2901498 - DNA, 22 bp, Homo sapiens
gcagggtttgagcacaatctgt

SEQ ID NO: 2901499 - DNA, 14 bp, Homo sapiens
gcaggtcaggacca

SEQ ID NO: 2901500 - DNA, 17 bp, Homo sapiens
gcaggtcaggaccagga

SEQ ID NO: 2901501 - DNA, 23 bp, Homo sapiens
gcaggtcaggaccaggacccagg

SEQ ID NO: 2901502 - DNA, 21 bp, Homo sapiens
gcaggtctgcaagggcccaga

SEQ ID NO: 2901503 - DNA, 13 bp, Homo sapiens
gcaggtgctgctg

SEQ ID NO: 2901504 - DNA, 17 bp, Homo sapiens
gcaggtgctggtcccgg

SEQ ID NO: 2901505 - DNA, 19 bp, Homo sapiens
gcaggtggccgcccctgag

SEQ ID NO: 2901506 - DNA, 15 bp, Homo sapiens
gcaggtggcctctgc

SEQ ID NO: 2901507 - DNA, 15 bp, Homo sapiens
gcaggtgggagctga

SEQ ID NO: 2901508 - DNA, 17 bp, Homo sapiens
gcaggtggggagactgg

SEQ ID NO: 2901509 - DNA, 23 bp, Homo sapiens
gcaggtggggtgatggccagagg

SEQ ID NO: 2901510 - DNA, 18 bp, Homo sapiens
gcaggttcccaagctcag

SEQ ID NO: 2901511 - DNA, 20 bp, Homo sapiens
gcaggttcttcttcctgaag

SEQ ID NO: 2901512 - DNA, 22 bp, Homo sapiens
gcaggttcttcttcctgaagct

SEQ ID NO: 2901513 - DNA, 22 bp, Homo sapiens
gcaggttggcaaacgggcttga

SEQ ID NO: 2901514 - DNA, 19 bp, Homo sapiens
gcagtagacattttaacaa

SEQ ID NO: 2901515 - DNA, 21 bp, Homo sapiens
gcagtagacattttaacaaga

SEQ ID NO: 2901516 - DNA, 18 bp, Homo sapiens
gcagtagattttctttaa

SEQ ID NO: 2901517 - DNA, 13 bp, Homo sapiens
gcagtcagccctg

SEQ ID NO: 2901518 - DNA, 20 bp, Homo sapiens
gcagtcaggggtcaggtgtc

SEQ ID NO: 2901519 - DNA, 17 bp, Homo sapiens
gcagtcatcaacaatga

SEQ ID NO: 2901520 - DNA, 14 bp, Homo sapiens
gcagtcatctactt

SEQ ID NO: 2901521 - DNA, 17 bp, Homo sapiens
gcagtcatctacttttt

SEQ ID NO: 2901522 - DNA, 23 bp, Homo sapiens
gcagtcatcttgaccaagcagga

SEQ ID NO: 2901523 - DNA, 14 bp, Homo sapiens
gcagtccagagctt

SEQ ID NO: 2901524 - DNA, 18 bp, Homo sapiens
gcagtccagagcttttca

SEQ ID NO: 2901525 - DNA, 20 bp, Homo sapiens
gcagtccagagcttttcagc

SEQ ID NO: 2901526 - DNA, 13 bp, Homo sapiens
gcagtcccgggag

SEQ ID NO: 2901527 - DNA, 13 bp, Homo sapiens
gcagtccctgctt

SEQ ID NO: 2901528 - DNA, 17 bp, Homo sapiens
gcagtcgcacacacatt

SEQ ID NO: 2901529 - DNA, 18 bp, Homo sapiens
gcagtcgctgcagggagc

SEQ ID NO: 2901530 - DNA, 16 bp, Homo sapiens
gcagtctacttctgtg

SEQ ID NO: 2901531 - DNA, 22 bp, Homo sapiens
gcagtctacttctgtgtctgtc

SEQ ID NO: 2901532 - DNA, 17 bp, Homo sapiens
gcagtctgtccaggctc

SEQ ID NO: 2901533 - DNA, 12 bp, Homo sapiens
gcagtcttgctc

SEQ ID NO: 2901534 - DNA, 14 bp, Homo sapiens
gcagtcttgctctg

SEQ ID NO: 2901535 - DNA, 12 bp, Homo sapiens
gcagtctttccc

SEQ ID NO: 2901536 - DNA, 14 bp, Homo sapiens
gcagtctttccccc

SEQ ID NO: 2901537 - DNA, 17 bp, Homo sapiens
gcagtctttcccccagg

SEQ ID NO: 2901538 - DNA, 12 bp, Homo sapiens
gcagtgaagtgt

SEQ ID NO: 2901539 - DNA, 18 bp, Homo sapiens
gcagtgactgtggccatg

SEQ ID NO: 2901540 - DNA, 20 bp, Homo sapiens
gcagtgcacatctgacccag

SEQ ID NO: 2901541 - DNA, 12 bp, Homo sapiens
gcagtgccagcc

SEQ ID NO: 2901542 - DNA, 14 bp, Homo sapiens
gcagtgcccaccat

SEQ ID NO: 2901543 - DNA, 15 bp, Homo sapiens
gcagtggcctggccg

SEQ ID NO: 2901544 - DNA, 18 bp, Homo sapiens
gcagtgggagggtaccag

SEQ ID NO: 2901545 - DNA, 15 bp, Homo sapiens
gcagtgggcaggtgg

SEQ ID NO: 2901546 - DNA, 15 bp, Homo sapiens
gcagtgggcctggcc

SEQ ID NO: 2901547 - DNA, 17 bp, Homo sapiens
gcagtggggtcaagctg

SEQ ID NO: 2901548 - DNA, 19 bp, Homo sapiens
gcagtggggtcaagctgag

SEQ ID NO: 2901549 - DNA, 22 bp, Homo sapiens
gcagtggggtcaagctgagctg

SEQ ID NO: 2901550 - DNA, 20 bp, Homo sapiens
gcccccaccccagcacagct

SEQ ID NO: 2901551 - DNA, 22 bp, Homo sapiens
gcccccaccgccggggtcctgg

SEQ ID NO: 2901552 - DNA, 20 bp, Homo sapiens
gcccccaccgggctgcaggt

SEQ ID NO: 2901553 - DNA, 20 bp, Homo sapiens
gcccccaccgtgggcaggga

SEQ ID NO: 2901554 - DNA, 15 bp, Homo sapiens
gcccccacttttcta

SEQ ID NO: 2901555 - DNA, 17 bp, Homo sapiens
gcccccagacagctgct

SEQ ID NO: 2901556 - DNA, 18 bp, Homo sapiens
gcccccagacagctgctc

SEQ ID NO: 2901557 - DNA, 22 bp, Homo sapiens
gcccccagagacctttgcccac

SEQ ID NO: 2901558 - DNA, 14 bp, Homo sapiens
gcccccagctggcc

SEQ ID NO: 2901559 - DNA, 17 bp, Homo sapiens
gcccccaggcctgccct

SEQ ID NO: 2901560 - DNA, 18 bp, Homo sapiens
gcccccaggcctgccctg

SEQ ID NO: 2901561 - DNA, 17 bp, Homo sapiens
gcccccccccacccctg

SEQ ID NO: 2901562 - DNA, 16 bp, Homo sapiens
gcccccgccccctccc

SEQ ID NO: 2901563 - DNA, 23 bp, Homo sapiens
gcccccgcgccctccctccgcct

SEQ ID NO: 2901564 - DNA, 15 bp, Homo sapiens
gcccccgggacaccg

SEQ ID NO: 2901565 - DNA, 19 bp, Homo sapiens
gccccctcaccccagctcc

SEQ ID NO: 2901566 - DNA, 18 bp, Homo sapiens
gccccctcgggggcctgt

SEQ ID NO: 2901567 - DNA, 20 bp, Homo sapiens
gccccctcgggggcctgtgg

SEQ ID NO: 2901568 - DNA, 12 bp, Homo sapiens
gccccctgccct

SEQ ID NO: 2901569 - DNA, 19 bp, Homo sapiens
gccccctgccctcccctct

SEQ ID NO: 2901570 - DNA, 21 bp, Homo sapiens
gccccctggcagctgcccctc

SEQ ID NO: 2901571 - DNA, 19 bp, Homo sapiens
gccccctggcctctgtgcc

SEQ ID NO: 2901572 - DNA, 16 bp, Homo sapiens
gccccgagagcaggct

SEQ ID NO: 2901573 - DNA, 20 bp, Homo sapiens
gccccgagagcaggctcgac

SEQ ID NO: 2901574 - DNA, 15 bp, Homo sapiens
gccccgcacctgtac

SEQ ID NO: 2901575 - DNA, 15 bp, Homo sapiens
gccccgcaggcctgc

SEQ ID NO: 2901576 - DNA, 14 bp, Homo sapiens
gccccgcctgacct

SEQ ID NO: 2901577 - DNA, 13 bp, Homo sapiens
gccccgcgtggaa

SEQ ID NO: 2901578 - DNA, 14 bp, Homo sapiens
gccccgctcccacc

SEQ ID NO: 2901579 - DNA, 22 bp, Homo sapiens
gccccgctgtgtcctccctccc

SEQ ID NO: 2901580 - DNA, 18 bp, Homo sapiens
gccccgcttgtccagcgc

SEQ ID NO: 2901581 - DNA, 19 bp, Homo sapiens
gccccgcttgtccagcgcc

SEQ ID NO: 2901582 - DNA, 23 bp, Homo sapiens
gccccggcaactctggctccagg

SEQ ID NO: 2901583 - DNA, 14 bp, Homo sapiens
gccccgggctggcc

SEQ ID NO: 2901584 - DNA, 20 bp, Homo sapiens
gccccgggctggccctgtgc

SEQ ID NO: 2901585 - DNA, 17 bp, Homo sapiens
gcccctaaagatgggag

SEQ ID NO: 2901586 - DNA, 17 bp, Homo sapiens
gcccctaatcacatgtg

SEQ ID NO: 2901587 - DNA, 17 bp, Homo sapiens
gcccctacccctgccct

SEQ ID NO: 2901588 - DNA, 18 bp, Homo sapiens
gcccctacccctgccctg

SEQ ID NO: 2901589 - DNA, 15 bp, Homo sapiens
gcccctcagagactg

SEQ ID NO: 2901590 - DNA, 23 bp, Homo sapiens
gcccctcaggggaagctgctagg

SEQ ID NO: 2901591 - DNA, 18 bp, Homo sapiens
gcccctccccctaccgca

SEQ ID NO: 2901592 - DNA, 14 bp, Homo sapiens
gcccctcccctcag

SEQ ID NO: 2901593 - DNA, 17 bp, Homo sapiens
gcccctcccctcagagc

SEQ ID NO: 2901594 - DNA, 23 bp, Homo sapiens
gcccctcccctcagagcccatgg

SEQ ID NO: 2901595 - DNA, 17 bp, Homo sapiens
gcccctccctagatcca

SEQ ID NO: 2901596 - DNA, 21 bp, Homo sapiens
gcccctccctagatccaggct

SEQ ID NO: 2901597 - DNA, 15 bp, Homo sapiens
gcccctccctgcctc

SEQ ID NO: 2901598 - DNA, 12 bp, Homo sapiens
gcccctcctctg

SEQ ID NO: 2901599 - DNA, 14 bp, Homo sapiens
gcccctcctctgcc

SEQ ID NO: 2901600 - DNA, 15 bp, Homo sapiens
gcccctcctctgcca

SEQ ID NO: 2901601 - DNA, 17 bp, Homo sapiens
gcccctcctctgccacc

SEQ ID NO: 2901602 - DNA, 20 bp, Homo sapiens
gcccctcctctgccacctcc

SEQ ID NO: 2901603 - DNA, 23 bp, Homo sapiens
gcccctcctctgccacctcccct

SEQ ID NO: 2901604 - DNA, 15 bp, Homo sapiens
gcccctcctggagca

SEQ ID NO: 2901605 - DNA, 21 bp, Homo sapiens
gcccctcctggagcagaaagt

SEQ ID NO: 2901606 - DNA, 18 bp, Homo sapiens
gcccctcgaccctgtgca

SEQ ID NO: 2901607 - DNA, 19 bp, Homo sapiens
gcccctcgaccctgtgcag

SEQ ID NO: 2901608 - DNA, 14 bp, Homo sapiens
gcccctctcctccg

SEQ ID NO: 2901609 - DNA, 22 bp, Homo sapiens
gcccctctcctccgtggcacat

SEQ ID NO: 2901610 - DNA, 15 bp, Homo sapiens
gcccctgagtccgcc

SEQ ID NO: 2901611 - DNA, 17 bp, Homo sapiens
gcccctgagtccgcctg

SEQ ID NO: 2901612 - DNA, 18 bp, Homo sapiens
gcccctgagtccgcctgc

SEQ ID NO: 2901613 - DNA, 13 bp, Homo sapiens
gccctcactcttg

SEQ ID NO: 2901614 - DNA, 11 bp, Homo sapiens
gccctcagtgc

SEQ ID NO: 2901615 - DNA, 12 bp, Homo sapiens
gccctcatcccg

SEQ ID NO: 2901616 - DNA, 21 bp, Homo sapiens
gccctcatgggacctgccctc

SEQ ID NO: 2901617 - DNA, 14 bp, Homo sapiens
gccctcccactttg

SEQ ID NO: 2901618 - DNA, 12 bp, Homo sapiens
gccctcccaggc

SEQ ID NO: 2901619 - DNA, 21 bp, Homo sapiens
gccctcccaggctctcaacag

SEQ ID NO: 2901620 - DNA, 14 bp, Homo sapiens
gccctccccaggaa

SEQ ID NO: 2901621 - DNA, 18 bp, Homo sapiens
gccctcccctctctgcac

SEQ ID NO: 2901622 - DNA, 19 bp, Homo sapiens
gccctcccctctctgcacc

SEQ ID NO: 2901623 - DNA, 20 bp, Homo sapiens
gccctcccgcaccttcctcc

SEQ ID NO: 2901624 - DNA, 15 bp, Homo sapiens
gccctccctgcgctt

SEQ ID NO: 2901625 - DNA, 16 bp, Homo sapiens
gccctccctgcgcttc

SEQ ID NO: 2901626 - DNA, 21 bp, Homo sapiens
gccctccctgcgcttcctgag

SEQ ID NO: 2901627 - DNA, 20 bp, Homo sapiens
gccctccctgttccccagag

SEQ ID NO: 2901628 - DNA, 22 bp, Homo sapiens
gccctccctgttccccagagaa

SEQ ID NO: 2901629 - DNA, 16 bp, Homo sapiens
gccctccgacctctct

SEQ ID NO: 2901630 - DNA, 24 bp, Homo sapiens
gccctcctaccctgcgcccagtcc

SEQ ID NO: 2901631 - DNA, 12 bp, Homo sapiens
gccctcctctcc

SEQ ID NO: 2901632 - DNA, 13 bp, Homo sapiens
gccctcctctccc

SEQ ID NO: 2901633 - DNA, 17 bp, Homo sapiens
gccctcctctcccgtct

SEQ ID NO: 2901634 - DNA, 10 bp, Homo sapiens
gccctccttc

SEQ ID NO: 2901635 - DNA, 21 bp, Homo sapiens
gccctcgtgcctgggggagag

SEQ ID NO: 2901636 - DNA, 22 bp, Homo sapiens
gccctcgtgcctgggggagaga

SEQ ID NO: 2901637 - DNA, 14 bp, Homo sapiens
gccctctagggcag

SEQ ID NO: 2901638 - DNA, 19 bp, Homo sapiens
gccctctcatcgtctttta

SEQ ID NO: 2901639 - DNA, 22 bp, Homo sapiens
gccctctccctctaggctctgc

SEQ ID NO: 2901640 - DNA, 15 bp, Homo sapiens
gccctctctgcaccg

SEQ ID NO: 2901641 - DNA, 17 bp, Homo sapiens
gccctctctgcaccgga

SEQ ID NO: 2901642 - DNA, 12 bp, Homo sapiens
gccctctgcctg

SEQ ID NO: 2901643 - DNA, 14 bp, Homo sapiens
gccctctgcctgca

SEQ ID NO: 2901644 - DNA, 15 bp, Homo sapiens
gccctctgcctgcac

SEQ ID NO: 2901645 - DNA, 16 bp, Homo sapiens
gccctctgcctgcact

SEQ ID NO: 2901646 - DNA, 18 bp, Homo sapiens
gccctctgcctgcactcc

SEQ ID NO: 2901647 - DNA, 23 bp, Homo sapiens
gccctctgcctgcactccctggc

SEQ ID NO: 2901648 - DNA, 16 bp, Homo sapiens
gccctctgctgctgcc

SEQ ID NO: 2901649 - DNA, 14 bp, Homo sapiens
gccctctggagtgg

SEQ ID NO: 2901650 - DNA, 18 bp, Homo sapiens
gccctctggagtggccac

SEQ ID NO: 2901651 - DNA, 22 bp, Homo sapiens
gccctctggagtggccactaag

SEQ ID NO: 2901652 - DNA, 20 bp, Homo sapiens
gccctctgtctgtcttctcc

SEQ ID NO: 2901653 - DNA, 21 bp, Homo sapiens
gccctctgtctgtcttctcct

SEQ ID NO: 2901654 - DNA, 20 bp, Homo sapiens
gccctgaatttcttcttttc

SEQ ID NO: 2901655 - DNA, 22 bp, Homo sapiens
gccctgactgtcagggagggcc

SEQ ID NO: 2901656 - DNA, 12 bp, Homo sapiens
gccctgagacct

SEQ ID NO: 2901657 - DNA, 15 bp, Homo sapiens
gccctgaggggctgg

SEQ ID NO: 2901658 - DNA, 21 bp, Homo sapiens
gccctgaggggctggggaggg

SEQ ID NO: 2901659 - DNA, 22 bp, Homo sapiens
gccctgcaggctgcaggagggc

SEQ ID NO: 2901660 - DNA, 15 bp, Homo sapiens
gccctgcatgggcca

SEQ ID NO: 2901661 - DNA, 23 bp, Homo sapiens
gccctgccactcaatgggagaat

SEQ ID NO: 2901662 - DNA, 16 bp, Homo sapiens
gccctgcccaagtgac

SEQ ID NO: 2901663 - DNA, 21 bp, Homo sapiens
gccctgcccaagtgaccaggg

SEQ ID NO: 2901664 - DNA, 20 bp, Homo sapiens
gccctgcccaccctccctcc

SEQ ID NO: 2901665 - DNA, 22 bp, Homo sapiens
gccctgcccctccccctaccgc

SEQ ID NO: 2901666 - DNA, 15 bp, Homo sapiens
gccctgcccctccct

SEQ ID NO: 2901667 - DNA, 13 bp, Homo sapiens
gccctgcctctgt

SEQ ID NO: 2901668 - DNA, 20 bp, Homo sapiens
gccctgcgggccacagggca

SEQ ID NO: 2901669 - DNA, 13 bp, Homo sapiens
gccctgctccctc

SEQ ID NO: 2901670 - DNA, 14 bp, Homo sapiens
gccctgctcctaag

SEQ ID NO: 2901671 - DNA, 20 bp, Homo sapiens
gccctgctgaagctgctgca

SEQ ID NO: 2901672 - DNA, 22 bp, Homo sapiens
gccctgctgaagctgctgcagc

SEQ ID NO: 2901673 - DNA, 18 bp, Homo sapiens
gccctgctgcttcctaac

SEQ ID NO: 2901674 - DNA, 20 bp, Homo sapiens
gccctgctttatcaggggac

SEQ ID NO: 2901675 - DNA, 17 bp, Homo sapiens
gccctggaagagtcctc

SEQ ID NO: 2901676 - DNA, 14 bp, Homo sapiens
gccctggacttggt

SEQ ID NO: 2901677 - DNA, 13 bp, Homo sapiens
gccctggagggca

SEQ ID NO: 2901678 - DNA, 19 bp, Homo sapiens
gccctggagggcagagaca

SEQ ID NO: 2901679 - DNA, 13 bp, Homo sapiens
gccctggaggtgg

SEQ ID NO: 2901680 - DNA, 18 bp, Homo sapiens
gccctggaggtggctgag

SEQ ID NO: 2901681 - DNA, 16 bp, Homo sapiens
gccctggcagggggca

SEQ ID NO: 2901682 - DNA, 17 bp, Homo sapiens
gccctggcagggggcat

SEQ ID NO: 2901683 - DNA, 13 bp, Homo sapiens
gccctggcctgct

SEQ ID NO: 2901684 - DNA, 15 bp, Homo sapiens
gccctggcctgctgg

SEQ ID NO: 2901685 - DNA, 17 bp, Homo sapiens
gccctggcctgctgggc

SEQ ID NO: 2901686 - DNA, 17 bp, Homo sapiens
gccctggcgggtggctg

SEQ ID NO: 2901687 - DNA, 18 bp, Homo sapiens
gccctggcgggtggctgc

SEQ ID NO: 2901688 - DNA, 17 bp, Homo sapiens
gccctgggatcactgtg

SEQ ID NO: 2901689 - DNA, 17 bp, Homo sapiens
gccctgggtcctgcctg

SEQ ID NO: 2901690 - DNA, 19 bp, Homo sapiens
gccctgggtcctgcctgca

SEQ ID NO: 2901691 - DNA, 21 bp, Homo sapiens
gccctgggtctaaggggttgg

SEQ ID NO: 2901692 - DNA, 14 bp, Homo sapiens
gccctggtaaaata

SEQ ID NO: 2901693 - DNA, 14 bp, Homo sapiens
gccctggtcctggc

SEQ ID NO: 2901694 - DNA, 16 bp, Homo sapiens
gccctggtcctggcct

SEQ ID NO: 2901695 - DNA, 18 bp, Homo sapiens
gccctggtgctcctgccc

SEQ ID NO: 2901696 - DNA, 12 bp, Homo sapiens
gccctggttcct

SEQ ID NO: 2901697 - DNA, 12 bp, Homo sapiens
gccctgtccagc

SEQ ID NO: 2901698 - DNA, 14 bp, Homo sapiens
gccctgtccagccc

SEQ ID NO: 2901699 - DNA, 15 bp, Homo sapiens
gccctgtcctgccat

SEQ ID NO: 2901700 - DNA, 16 bp, Homo sapiens
gccctgtgcagacctt

SEQ ID NO: 2901701 - DNA, 20 bp, Homo sapiens
gccctgtgccccttgacaac

SEQ ID NO: 2901702 - DNA, 19 bp, Homo sapiens
gccctgtgccgcactctgg

SEQ ID NO: 2901703 - DNA, 23 bp, Homo sapiens
gccctgtggagtccagctctact

SEQ ID NO: 2901704 - DNA, 19 bp, Homo sapiens
gccctgtgggaccccaggc

SEQ ID NO: 2901705 - DNA, 21 bp, Homo sapiens
gccctgttgacacaggtcttt

SEQ ID NO: 2901706 - DNA, 14 bp, Homo sapiens
gccctgttgtgcca

SEQ ID NO: 2901707 - DNA, 16 bp, Homo sapiens
gccctgttgtgccaca

SEQ ID NO: 2901708 - DNA, 18 bp, Homo sapiens
gccctgtttcctgctgct

SEQ ID NO: 2901709 - DNA, 19 bp, Homo sapiens
gccctgtttcctgctgctt

SEQ ID NO: 2901710 - DNA, 21 bp, Homo sapiens
gcccttagccttgctgtagag

SEQ ID NO: 2901711 - DNA, 19 bp, Homo sapiens
gcccttatctgtgctcagg

SEQ ID NO: 2901712 - DNA, 17 bp, Homo sapiens
gcccttcagtccctgag

SEQ ID NO: 2901713 - DNA, 14 bp, Homo sapiens
gcccttcccctccc

SEQ ID NO: 2901714 - DNA, 23 bp, Homo sapiens
gcccttcccctcccccactcctc

SEQ ID NO: 2901715 - DNA, 14 bp, Homo sapiens
gcccttgggccacc

SEQ ID NO: 2901716 - DNA, 15 bp, Homo sapiens
gcccttggggtggcg

SEQ ID NO: 2901717 - DNA, 18 bp, Homo sapiens
gcccttggtttctggggg

SEQ ID NO: 2901718 - DNA, 13 bp, Homo sapiens
gcccttgtttata

SEQ ID NO: 2901719 - DNA, 19 bp, Homo sapiens
gccctttccacgaaatcct

SEQ ID NO: 2901720 - DNA, 21 bp, Homo sapiens
gccctttccccgacgcccacc

SEQ ID NO: 2901721 - DNA, 20 bp, Homo sapiens
gccctttgcatcgtcccctc

SEQ ID NO: 2901722 - DNA, 13 bp, Homo sapiens
gccctttgcctgt

SEQ ID NO: 2901723 - DNA, 16 bp, Homo sapiens
gcccttttccagcctc

SEQ ID NO: 2901724 - DNA, 21 bp, Homo sapiens
gcccttttcctgggccttctc

SEQ ID NO: 2901725 - DNA, 22 bp, Homo sapiens
gcccttttcctgggccttctca

SEQ ID NO: 2901726 - DNA, 14 bp, Homo sapiens
gccgaattgtggtg

SEQ ID NO: 2901727 - DNA, 19 bp, Homo sapiens
gccgacaccactcctgcca

SEQ ID NO: 2901728 - DNA, 20 bp, Homo sapiens
gccgacaccactcctgccag

SEQ ID NO: 2901729 - DNA, 22 bp, Homo sapiens
gccgacaccactcctgccagcc

SEQ ID NO: 2901730 - DNA, 23 bp, Homo sapiens
gccgacaccactcctgccagccc

SEQ ID NO: 2901731 - DNA, 24 bp, Homo sapiens
gccgacagtcggtgaccccatcac

SEQ ID NO: 2901732 - DNA, 15 bp, Homo sapiens
gccgacatccctccc

SEQ ID NO: 2901733 - DNA, 12 bp, Homo sapiens
gccgaccagagg

SEQ ID NO: 2901734 - DNA, 12 bp, Homo sapiens
gccgaccctgcg

SEQ ID NO: 2901735 - DNA, 17 bp, Homo sapiens
gccgaccctgcggcctc

SEQ ID NO: 2901736 - DNA, 23 bp, Homo sapiens
gccgactcccccaaccaaggaag

SEQ ID NO: 2901737 - DNA, 14 bp, Homo sapiens
gccgactgcgctgc

SEQ ID NO: 2901738 - DNA, 19 bp, Homo sapiens
gccgagacagaccctctgc

SEQ ID NO: 2901739 - DNA, 17 bp, Homo sapiens
gccgagagcctgctccc

SEQ ID NO: 2901740 - DNA, 14 bp, Homo sapiens
gccgagctggtttc

SEQ ID NO: 2901741 - DNA, 18 bp, Homo sapiens
gccgagggcgtcagagag

SEQ ID NO: 2901742 - DNA, 18 bp, Homo sapiens
gccgagtccaagctggga

SEQ ID NO: 2901743 - DNA, 14 bp, Homo sapiens
gccgatagagggac

SEQ ID NO: 2901744 - DNA, 22 bp, Homo sapiens
gccgatagagggacggccaaga

SEQ ID NO: 2901745 - DNA, 22 bp, Homo sapiens
gccgatatactctagatgaagt

SEQ ID NO: 2901746 - DNA, 17 bp, Homo sapiens
gccgcaaaccacactgg

SEQ ID NO: 2901747 - DNA, 22 bp, Homo sapiens
gccgcaaaccacactggactcc

SEQ ID NO: 2901748 - DNA, 14 bp, Homo sapiens
gccgcaagggcctg

SEQ ID NO: 2901749 - DNA, 15 bp, Homo sapiens
gccgcaagggcctgg

SEQ ID NO: 2901750 - DNA, 16 bp, Homo sapiens
gccgcaagggcctgga

SEQ ID NO: 2901751 - DNA, 16 bp, Homo sapiens
gccgcaccccagagtg

SEQ ID NO: 2901752 - DNA, 14 bp, Homo sapiens
gccgcacgcctctc

SEQ ID NO: 2901753 - DNA, 12 bp, Homo sapiens
gccgcactctgg

SEQ ID NO: 2901754 - DNA, 16 bp, Homo sapiens
gccgcagcggcgtcag

SEQ ID NO: 2901755 - DNA, 14 bp, Homo sapiens
gccgcagcggtggg

SEQ ID NO: 2901756 - DNA, 15 bp, Homo sapiens
gccgcatcttctcca

SEQ ID NO: 2901757 - DNA, 15 bp, Homo sapiens
gccgcattccctgag

SEQ ID NO: 2901758 - DNA, 16 bp, Homo sapiens
gccgcattccctgagt

SEQ ID NO: 2901759 - DNA, 14 bp, Homo sapiens
gccgccatctgcgc

SEQ ID NO: 2901760 - DNA, 16 bp, Homo sapiens
gccgccatctgcgcag

SEQ ID NO: 2901761 - DNA, 23 bp, Homo sapiens
gccgccattctgcagagtatttg

SEQ ID NO: 2901762 - DNA, 11 bp, Homo sapiens
gccgcccctga

SEQ ID NO: 2901763 - DNA, 15 bp, Homo sapiens
gccgcccctgaggct

SEQ ID NO: 2901764 - DNA, 15 bp, Homo sapiens
gccgccgcccgctgg

SEQ ID NO: 2901765 - DNA, 14 bp, Homo sapiens
gccgccgctgaccc

SEQ ID NO: 2901766 - DNA, 13 bp, Homo sapiens
gccgcctcaatgt

SEQ ID NO: 2901767 - DNA, 12 bp, Homo sapiens
gccgcctgcctt

SEQ ID NO: 2901768 - DNA, 13 bp, Homo sapiens
gccgcgagaggcc

SEQ ID NO: 2901769 - DNA, 16 bp, Homo sapiens
gccgcgcgtccagctg

SEQ ID NO: 2901770 - DNA, 15 bp, Homo sapiens
gccgcggccctgggg

SEQ ID NO: 2901771 - DNA, 21 bp, Homo sapiens
gccgcgtggtgccatccccag

SEQ ID NO: 2901772 - DNA, 14 bp, Homo sapiens
gccgctcgatgcct

SEQ ID NO: 2901773 - DNA, 16 bp, Homo sapiens
gccgctctcctgccac

SEQ ID NO: 2901774 - DNA, 18 bp, Homo sapiens
gccgctgaccctgggcct

SEQ ID NO: 2901775 - DNA, 19 bp, Homo sapiens
gccgctgccctgggtcctg

SEQ ID NO: 2901776 - DNA, 17 bp, Homo sapiens
gccgctgttcacccaca

SEQ ID NO: 2901777 - DNA, 14 bp, Homo sapiens
gccgctttgatgga

SEQ ID NO: 2901778 - DNA, 18 bp, Homo sapiens
gccgctttgatggaggag

SEQ ID NO: 2901779 - DNA, 18 bp, Homo sapiens
gccggacacttctcagga

SEQ ID NO: 2901780 - DNA, 21 bp, Homo sapiens
gccggacacttctcaggaaat

SEQ ID NO: 2901781 - DNA, 13 bp, Homo sapiens
gccggagaggaag

SEQ ID NO: 2901782 - DNA, 18 bp, Homo sapiens
gccggagaggaagagaca

SEQ ID NO: 2901783 - DNA, 11 bp, Homo sapiens
gccggccagcc

SEQ ID NO: 2901784 - DNA, 14 bp, Homo sapiens
gccggccagccagc

SEQ ID NO: 2901785 - DNA, 12 bp, Homo sapiens
gccggccctgcc

SEQ ID NO: 2901786 - DNA, 15 bp, Homo sapiens
gccggccctgcccct

SEQ ID NO: 2901787 - DNA, 15 bp, Homo sapiens
gccggccctgtgtgc

SEQ ID NO: 2901788 - DNA, 16 bp, Homo sapiens
gccggccctgtgtgca

SEQ ID NO: 2901789 - DNA, 18 bp, Homo sapiens
gccggccctgtgtgcagg

SEQ ID NO: 2901790 - DNA, 17 bp, Homo sapiens
gccggcgagccctgtgg

SEQ ID NO: 2901791 - DNA, 18 bp, Homo sapiens
gccggcgagccctgtgga

SEQ ID NO: 2901792 - DNA, 22 bp, Homo sapiens
gccggctatgaaagggagcgag

SEQ ID NO: 2901793 - DNA, 13 bp, Homo sapiens
gccggctggaaat

SEQ ID NO: 2901794 - DNA, 17 bp, Homo sapiens
gccggctggcctggagg

SEQ ID NO: 2901795 - DNA, 20 bp, Homo sapiens
gccggctggcctggaggctc

SEQ ID NO: 2901796 - DNA, 22 bp, Homo sapiens
gccggctggcctggaggctcag

SEQ ID NO: 2901797 - DNA, 18 bp, Homo sapiens
gccggctgtgctcagaga

SEQ ID NO: 2901798 - DNA, 18 bp, Homo sapiens
gccggctttcagggcagc

SEQ ID NO: 2901799 - DNA, 19 bp, Homo sapiens
gccgggaccccgagcctgg

SEQ ID NO: 2901800 - DNA, 16 bp, Homo sapiens
gccgggaccctcaggt

SEQ ID NO: 2901801 - DNA, 13 bp, Homo sapiens
gccgggagcctga

SEQ ID NO: 2901802 - DNA, 22 bp, Homo sapiens
gccgggcacattgagctgtgca

SEQ ID NO: 2901803 - DNA, 17 bp, Homo sapiens
gccgggcatggtggcag

SEQ ID NO: 2901804 - DNA, 12 bp, Homo sapiens
gccggggaagag

SEQ ID NO: 2901805 - DNA, 12 bp, Homo sapiens
gccggggagggg

SEQ ID NO: 2901806 - DNA, 21 bp, Homo sapiens
gccggggatggatcttttcta

SEQ ID NO: 2901807 - DNA, 13 bp, Homo sapiens
gccggggtcctgg

SEQ ID NO: 2901808 - DNA, 21 bp, Homo sapiens
gccgggtctgcctcttctggg

SEQ ID NO: 2901809 - DNA, 14 bp, Homo sapiens
gccgtatcaaatgg

SEQ ID NO: 2901810 - DNA, 17 bp, Homo sapiens
gccgtcaaggaaagggc

SEQ ID NO: 2901811 - DNA, 12 bp, Homo sapiens
gccgtctctgga

SEQ ID NO: 2901812 - DNA, 23 bp, Homo sapiens
gccgtctggcgagcccttagcct

SEQ ID NO: 2901813 - DNA, 13 bp, Homo sapiens
gccgtctgtcctc

SEQ ID NO: 2901814 - DNA, 15 bp, Homo sapiens
gccgtcttctgccct

SEQ ID NO: 2901815 - DNA, 21 bp, Homo sapiens
gccgtgctcgccccagcaggt

SEQ ID NO: 2901816 - DNA, 14 bp, Homo sapiens
gccgttactctcca

SEQ ID NO: 2901817 - DNA, 13 bp, Homo sapiens
gccgttgtttact

SEQ ID NO: 2901818 - DNA, 22 bp, Homo sapiens
gcctaaaagtgggcttgattct

SEQ ID NO: 2901819 - DNA, 17 bp, Homo sapiens
gcctaacctgccgagag

SEQ ID NO: 2901820 - DNA, 15 bp, Homo sapiens
gcctaagacatgtaa

SEQ ID NO: 2901821 - DNA, 20 bp, Homo sapiens
gacaccactcctgccagccc

SEQ ID NO: 2901822 - DNA, 22 bp, Homo sapiens
gacaccactgagctctgcctca

SEQ ID NO: 2901823 - DNA, 23 bp, Homo sapiens
gacaccactgagctctgcctcaa

SEQ ID NO: 2901824 - DNA, 22 bp, Homo sapiens
gacaccatcttttgtgagatgt

SEQ ID NO: 2901825 - DNA, 14 bp, Homo sapiens
gacacccaaagggt

SEQ ID NO: 2901826 - DNA, 18 bp, Homo sapiens
gacacccaagagggctgc

SEQ ID NO: 2901827 - DNA, 14 bp, Homo sapiens
gacacccaggactt

SEQ ID NO: 2901828 - DNA, 16 bp, Homo sapiens
gacaccgtggcctggg

SEQ ID NO: 2901829 - DNA, 22 bp, Homo sapiens
gacaccgtggggaaggggtgca

SEQ ID NO: 2901830 - DNA, 16 bp, Homo sapiens
gacacctaggctaggg

SEQ ID NO: 2901831 - DNA, 19 bp, Homo sapiens
gacacctgcacctcccccc

SEQ ID NO: 2901832 - DNA, 11 bp, Homo sapiens
gacacctttga

SEQ ID NO: 2901833 - DNA, 18 bp, Homo sapiens
gacacgccgtctgtcctc

SEQ ID NO: 2901834 - DNA, 23 bp, Homo sapiens
gacacgcgcccccctcccagagg

SEQ ID NO: 2901835 - DNA, 14 bp, Homo sapiens
gacactaagaatga

SEQ ID NO: 2901836 - DNA, 19 bp, Homo sapiens
gacactcagaccagagaag

SEQ ID NO: 2901837 - DNA, 18 bp, Homo sapiens
gacactcagggcagctgc

SEQ ID NO: 2901838 - DNA, 23 bp, Homo sapiens
gacactcagggcagctgcctggc

SEQ ID NO: 2901839 - DNA, 13 bp, Homo sapiens
gacactcccaccc

SEQ ID NO: 2901840 - DNA, 15 bp, Homo sapiens
gacactctccttgca

SEQ ID NO: 2901841 - DNA, 18 bp, Homo sapiens
gacactctccttgcagtt

SEQ ID NO: 2901842 - DNA, 14 bp, Homo sapiens
gacactgcctgggc

SEQ ID NO: 2901843 - DNA, 18 bp, Homo sapiens
gacactggccccacagga

SEQ ID NO: 2901844 - DNA, 14 bp, Homo sapiens
gaggctgaggcaca

SEQ ID NO: 2901845 - DNA, 13 bp, Homo sapiens
gaggctgaggcag

SEQ ID NO: 2901846 - DNA, 16 bp, Homo sapiens
gaggctgaggctggca

SEQ ID NO: 2901847 - DNA, 14 bp, Homo sapiens
gaggctgcacttgt

SEQ ID NO: 2901848 - DNA, 16 bp, Homo sapiens
gaggctgcagccaggc

SEQ ID NO: 2901849 - DNA, 18 bp, Homo sapiens
gaggctgcagccaggcca

SEQ ID NO: 2901850 - DNA, 18 bp, Homo sapiens
gaggctgcagccaggcct

SEQ ID NO: 2901851 - DNA, 19 bp, Homo sapiens
gaggctgcagtcagccctg

SEQ ID NO: 2901852 - DNA, 23 bp, Homo sapiens
gaggctgccccacccctccccat

SEQ ID NO: 2901853 - DNA, 13 bp, Homo sapiens
gaggctgccccag

SEQ ID NO: 2901854 - DNA, 22 bp, Homo sapiens
gaggctgccccaggccggagcc

SEQ ID NO: 2901855 - DNA, 16 bp, Homo sapiens
gaggctgccctgaggg

SEQ ID NO: 2901856 - DNA, 23 bp, Homo sapiens
gaggctgccgagacagaccctct

SEQ ID NO: 2901857 - DNA, 20 bp, Homo sapiens
gaggctgcctccgcacctga

SEQ ID NO: 2901858 - DNA, 18 bp, Homo sapiens
gaggctgcctgctgtgct

SEQ ID NO: 2901859 - DNA, 14 bp, Homo sapiens
gaggctgctgccat

SEQ ID NO: 2901860 - DNA, 19 bp, Homo sapiens
gaggctggaggcagggcct

SEQ ID NO: 2901861 - DNA, 23 bp, Homo sapiens
gaggctggttttgatggctgggt

SEQ ID NO: 2901862 - DNA, 15 bp, Homo sapiens
gaggctgtgtccctg

SEQ ID NO: 2901863 - DNA, 17 bp, Homo sapiens
gaggctgtgtccctgct

SEQ ID NO: 2901864 - DNA, 23 bp, Homo sapiens
gaggctgtgtccctgctggggtc

SEQ ID NO: 2901865 - DNA, 24 bp, Homo sapiens
gaggctgtgtccctgctggggtct

SEQ ID NO: 2901866 - DNA, 22 bp, Homo sapiens
gaggcttcttcagatcagtgct

SEQ ID NO: 2901867 - DNA, 16 bp, Homo sapiens
gaggctttaaaaagaa

SEQ ID NO: 2901868 - DNA, 19 bp, Homo sapiens
gaggctttaagctccagct

SEQ ID NO: 2901869 - DNA, 14 bp, Homo sapiens
gaggctttccatgg

SEQ ID NO: 2901870 - DNA, 14 bp, Homo sapiens
gaggctttggattt

SEQ ID NO: 2901871 - DNA, 15 bp, Homo sapiens
gaggctttggcccaa

SEQ ID NO: 2901872 - DNA, 22 bp, Homo sapiens
gagggaaactgtgaatgcttct

SEQ ID NO: 2901873 - DNA, 18 bp, Homo sapiens
gagggaacagacaggaga

SEQ ID NO: 2901874 - DNA, 24 bp, Homo sapiens
gagggacataagataaaatgatgt

SEQ ID NO: 2901875 - DNA, 18 bp, Homo sapiens
gagggaccaaattgcttc

SEQ ID NO: 2901876 - DNA, 14 bp, Homo sapiens
gagggaccgagccc

SEQ ID NO: 2901877 - DNA, 13 bp, Homo sapiens
gagggacctctcc

SEQ ID NO: 2901878 - DNA, 14 bp, Homo sapiens
gagggacctctccc

SEQ ID NO: 2901879 - DNA, 18 bp, Homo sapiens
gagggacctctcccaggg

SEQ ID NO: 2901880 - DNA, 21 bp, Homo sapiens
gagggacctgcatctaagcat

SEQ ID NO: 2901881 - DNA, 14 bp, Homo sapiens
gagggacgcctggg

SEQ ID NO: 2901882 - DNA, 16 bp, Homo sapiens
gagggacgcctggggg

SEQ ID NO: 2901883 - DNA, 16 bp, Homo sapiens
gagggactgctgaccc

SEQ ID NO: 2901884 - DNA, 23 bp, Homo sapiens
gagggagctccaactcagaaggg

SEQ ID NO: 2901885 - DNA, 14 bp, Homo sapiens
gagggagctgaggc

SEQ ID NO: 2901886 - DNA, 16 bp, Homo sapiens
gagggagctgaggcct

SEQ ID NO: 2901887 - DNA, 17 bp, Homo sapiens
gagggaggcaagccctg

SEQ ID NO: 2901888 - DNA, 13 bp, Homo sapiens
gagggagtgcaga

SEQ ID NO: 2901889 - DNA, 16 bp, Homo sapiens
gagggagtgcagaaca

SEQ ID NO: 2901890 - DNA, 21 bp, Homo sapiens
gagggagtgcagaacacctgg

SEQ ID NO: 2901891 - DNA, 16 bp, Homo sapiens
gagggatcattttctg

SEQ ID NO: 2901892 - DNA, 17 bp, Homo sapiens
gagggcacatgaacagc

SEQ ID NO: 2901893 - DNA, 15 bp, Homo sapiens
gagggcaccaccaag

SEQ ID NO: 2901894 - DNA, 15 bp, Homo sapiens
gagggcaccagggac

SEQ ID NO: 2901895 - DNA, 17 bp, Homo sapiens
gagggcaccagggactc

SEQ ID NO: 2901896 - DNA, 15 bp, Homo sapiens
gagggcagaggctgg

SEQ ID NO: 2901897 - DNA, 16 bp, Homo sapiens
gagggcagcagggcta

SEQ ID NO: 2901898 - DNA, 19 bp, Homo sapiens
gagggcagcagggctaccc

SEQ ID NO: 2901899 - DNA, 15 bp, Homo sapiens
gagggccagggaggc

SEQ ID NO: 2901900 - DNA, 14 bp, Homo sapiens
gagggcctctgcct

SEQ ID NO: 2901901 - DNA, 23 bp, Homo sapiens
gagggcgtggggaatgggcaggt

SEQ ID NO: 2901902 - DNA, 18 bp, Homo sapiens
gagggctcagaagagcag

SEQ ID NO: 2901903 - DNA, 19 bp, Homo sapiens
gagggctggaggcccaggc

SEQ ID NO: 2901904 - DNA, 23 bp, Homo sapiens
gagggctggaggcccaggctggg

SEQ ID NO: 2901905 - DNA, 18 bp, Homo sapiens
gagggctggctggcctca

SEQ ID NO: 2901906 - DNA, 23 bp, Homo sapiens
gagggctttcagcgcccccaggc

SEQ ID NO: 2901907 - DNA, 16 bp, Homo sapiens
gaggggacccatgggg

SEQ ID NO: 2901908 - DNA, 16 bp, Homo sapiens
gaggggacgcaggccc

SEQ ID NO: 2901909 - DNA, 22 bp, Homo sapiens
gaggggacgcaggcccctctcc

SEQ ID NO: 2901910 - DNA, 15 bp, Homo sapiens
gaggggacgggcaag

SEQ ID NO: 2901911 - DNA, 16 bp, Homo sapiens
gaggggacgggcaagt

SEQ ID NO: 2901912 - DNA, 20 bp, Homo sapiens
gaggggcccctggcccagga

SEQ ID NO: 2901913 - DNA, 20 bp, Homo sapiens
gaggggcccggtggcggcag

SEQ ID NO: 2901914 - DNA, 23 bp, Homo sapiens
gaggggcccggtggcggcagggc

SEQ ID NO: 2901915 - DNA, 20 bp, Homo sapiens
gaggggccctccgagggtgc

SEQ ID NO: 2901916 - DNA, 22 bp, Homo sapiens
gaggggccggccctgtgtgcag

SEQ ID NO: 2901917 - DNA, 17 bp, Homo sapiens
gaggggcctaggcctca

SEQ ID NO: 2901918 - DNA, 23 bp, Homo sapiens
gaggggcctaggcctcagccaga

SEQ ID NO: 2901919 - DNA, 20 bp, Homo sapiens
gaggggcctttgctgccctt

SEQ ID NO: 2901920 - DNA, 13 bp, Homo sapiens
gaggggctccccg

SEQ ID NO: 2901921 - DNA, 14 bp, Homo sapiens
gagggggagagggc

SEQ ID NO: 2901922 - DNA, 16 bp, Homo sapiens
gagggggcacggcagg

SEQ ID NO: 2901923 - DNA, 13 bp, Homo sapiens
gagggggcggcag

SEQ ID NO: 2901924 - DNA, 17 bp, Homo sapiens
gagggggcggcagggct

SEQ ID NO: 2901925 - DNA, 20 bp, Homo sapiens
gaggggttccttccacttct

SEQ ID NO: 2901926 - DNA, 15 bp, Homo sapiens
gagggtctggagaag

SEQ ID NO: 2901927 - DNA, 24 bp, Homo sapiens
gagggtctggagaagcagtgagcc

SEQ ID NO: 2901928 - DNA, 22 bp, Homo sapiens
gagggtctgggaaatgagcagg

SEQ ID NO: 2901929 - DNA, 23 bp, Homo sapiens
gagggtcttggttccagcctgcc

SEQ ID NO: 2901930 - DNA, 15 bp, Homo sapiens
gagggtgagaggaag

SEQ ID NO: 2901931 - DNA, 15 bp, Homo sapiens
gagggtgagtgcaag

SEQ ID NO: 2901932 - DNA, 21 bp, Homo sapiens
gagggtgccatccacatttta

SEQ ID NO: 2901933 - DNA, 17 bp, Homo sapiens
gagggtggctggagtga

SEQ ID NO: 2901934 - DNA, 12 bp, Homo sapiens
gagggtgggagg

SEQ ID NO: 2901935 - DNA, 17 bp, Homo sapiens
gagggtgggaggggcca

SEQ ID NO: 2901936 - DNA, 20 bp, Homo sapiens
gagggtgggaggggccatgc

SEQ ID NO: 2901937 - DNA, 13 bp, Homo sapiens
gagggtgtcctgc

SEQ ID NO: 2901938 - DNA, 18 bp, Homo sapiens
gagggttcacacagccca

SEQ ID NO: 2901939 - DNA, 19 bp, Homo sapiens
gagggttcacacagcccag

SEQ ID NO: 2901940 - DNA, 23 bp, Homo sapiens
gagggttcatcatccctccctgc

SEQ ID NO: 2901941 - DNA, 18 bp, Homo sapiens
gagggttgattaaggcag

SEQ ID NO: 2901942 - DNA, 12 bp, Homo sapiens
gaggtaaaaaaa

SEQ ID NO: 2901943 - DNA, 16 bp, Homo sapiens
gaggtaagggaggagg

SEQ ID NO: 2901944 - DNA, 14 bp, Homo sapiens
gaggtactggtccc

SEQ ID NO: 2901945 - DNA, 18 bp, Homo sapiens
gaggtatggaaagaacca

SEQ ID NO: 2901946 - DNA, 15 bp, Homo sapiens
gaggtcaacagagaa

SEQ ID NO: 2901947 - DNA, 16 bp, Homo sapiens
gaggtcaacagagaag

SEQ ID NO: 2901948 - DNA, 17 bp, Homo sapiens
gaggtccaagattctgg

SEQ ID NO: 2901949 - DNA, 21 bp, Homo sapiens
gaggtcctgtgatcttatttt

SEQ ID NO: 2901950 - DNA, 21 bp, Homo sapiens
gaggtcgaagcaatcagcaaa

SEQ ID NO: 2901951 - DNA, 14 bp, Homo sapiens
gaggtgaaaatgaa

SEQ ID NO: 2901952 - DNA, 23 bp, Homo sapiens
gaggtgaacaagcaaacccagac

SEQ ID NO: 2901953 - DNA, 20 bp, Homo sapiens
gaggtgctggtagctgaggg

SEQ ID NO: 2901954 - DNA, 12 bp, Homo sapiens
gaggtgcttcac

SEQ ID NO: 2901955 - DNA, 20 bp, Homo sapiens
gaggtggaagagggctgcaa

SEQ ID NO: 2901956 - DNA, 20 bp, Homo sapiens
gaggtggaagccctccttcc

SEQ ID NO: 2901957 - DNA, 18 bp, Homo sapiens
gaggtggaattattttaa

SEQ ID NO: 2901958 - DNA, 13 bp, Homo sapiens
gaggtggcctcct

SEQ ID NO: 2901959 - DNA, 18 bp, Homo sapiens
gaggtggcctccttgctt

SEQ ID NO: 2901960 - DNA, 15 bp, Homo sapiens
gaggtgggaggccag

SEQ ID NO: 2901961 - DNA, 16 bp, Homo sapiens
gaggtgtctggcctga

SEQ ID NO: 2901962 - DNA, 20 bp, Homo sapiens
gaggtgtctggcctgaggtc

SEQ ID NO: 2901963 - DNA, 18 bp, Homo sapiens
gaggttaaagcaaaccag

SEQ ID NO: 2901964 - DNA, 15 bp, Homo sapiens
gaggttcaaaagtaa

SEQ ID NO: 2901965 - DNA, 14 bp, Homo sapiens
gaggttgagtgagc

SEQ ID NO: 2901966 - DNA, 15 bp, Homo sapiens
gaggttgataacttt

SEQ ID NO: 2901967 - DNA, 18 bp, Homo sapiens
gaggttgataactttgct

SEQ ID NO: 2901968 - DNA, 15 bp, Homo sapiens
gaggttgcagtgagc

SEQ ID NO: 2901969 - DNA, 19 bp, Homo sapiens
gaggttgtagtgagccaag

SEQ ID NO: 2901970 - DNA, 18 bp, Homo sapiens
gaggttgtagtgagccca

SEQ ID NO: 2901971 - DNA, 22 bp, Homo sapiens
gaggtttcaccatgatggccag

SEQ ID NO: 2901972 - DNA, 13 bp, Homo sapiens
gagtaagacattg

SEQ ID NO: 2901973 - DNA, 12 bp, Homo sapiens
gagtaagtatta

SEQ ID NO: 2901974 - DNA, 19 bp, Homo sapiens
gagtacagacgtctcaaga

SEQ ID NO: 2901975 - DNA, 18 bp, Homo sapiens
gagtacattgtgcccttg

SEQ ID NO: 2901976 - DNA, 22 bp, Homo sapiens
gagtacattgtgcccttgattt

SEQ ID NO: 2901977 - DNA, 20 bp, Homo sapiens
gagtactatatttgtgaata

SEQ ID NO: 2901978 - DNA, 17 bp, Homo sapiens
gagtactgtgggcaatt

SEQ ID NO: 2901979 - DNA, 22 bp, Homo sapiens
gagtactgttaagaataataaa

SEQ ID NO: 2901980 - DNA, 19 bp, Homo sapiens
gagtagccgattttagagt

SEQ ID NO: 2901981 - DNA, 17 bp, Homo sapiens
gagtagggcttagtgtt

SEQ ID NO: 2901982 - DNA, 12 bp, Homo sapiens
gagtatctttac

SEQ ID NO: 2901983 - DNA, 19 bp, Homo sapiens
gagtatgtgtttgtgtgtg

SEQ ID NO: 2901984 - DNA, 21 bp, Homo sapiens
gagtatttggaagcaacgtgt

SEQ ID NO: 2901985 - DNA, 14 bp, Homo sapiens
gagtcaagttgttc

SEQ ID NO: 2901986 - DNA, 19 bp, Homo sapiens
gagtcaatcccctcattca

SEQ ID NO: 2901987 - DNA, 15 bp, Homo sapiens
gagtcacaagcctcg

SEQ ID NO: 2901988 - DNA, 13 bp, Homo sapiens
gagtcaccatgca

SEQ ID NO: 2901989 - DNA, 14 bp, Homo sapiens
gagtcaccatgcaa

SEQ ID NO: 2901990 - DNA, 16 bp, Homo sapiens
gagtcaccatgcaagg

SEQ ID NO: 2901991 - DNA, 18 bp, Homo sapiens
gagtcagctgaccccctc

SEQ ID NO: 2901992 - DNA, 16 bp, Homo sapiens
gagtcaggcaattgat

SEQ ID NO: 2901993 - DNA, 18 bp, Homo sapiens
gagtcatttgagtctctt

SEQ ID NO: 2901994 - DNA, 12 bp, Homo sapiens
gagtccagctct

SEQ ID NO: 2901995 - DNA, 14 bp, Homo sapiens
gagtccatcagcct

SEQ ID NO: 2901996 - DNA, 21 bp, Homo sapiens
gagtccatttcccacatcttt

SEQ ID NO: 2901997 - DNA, 14 bp, Homo sapiens
gagtcccagagctg

SEQ ID NO: 2901998 - DNA, 20 bp, Homo sapiens
gagtcccaggggcagccaca

SEQ ID NO: 2901999 - DNA, 23 bp, Homo sapiens
gagtcccaggggcagccacacca

SEQ ID NO: 2902000 - DNA, 20 bp, Homo sapiens
gagtccccgggcatctttgg

SEQ ID NO: 2902001 - DNA, 14 bp, Homo sapiens
gagtccctggcaag

SEQ ID NO: 2902002 - DNA, 15 bp, Homo sapiens
gagtccctggcaaga

SEQ ID NO: 2902003 - DNA, 19 bp, Homo sapiens
gagtcccttttcattctcc

SEQ ID NO: 2902004 - DNA, 20 bp, Homo sapiens
gagtcgtcactctctattgt

SEQ ID NO: 2902005 - DNA, 13 bp, Homo sapiens
gagtctaaagatg

SEQ ID NO: 2902006 - DNA, 21 bp, Homo sapiens
gagtctaaagatggagtttct

SEQ ID NO: 2902007 - DNA, 18 bp, Homo sapiens
gagtctaatagtctttgc

SEQ ID NO: 2902008 - DNA, 21 bp, Homo sapiens
gagtctagattcaaaggttct

SEQ ID NO: 2902009 - DNA, 22 bp, Homo sapiens
gagtctccctccgactccagat

SEQ ID NO: 2902010 - DNA, 14 bp, Homo sapiens
gagtctccttctct

SEQ ID NO: 2902011 - DNA, 15 bp, Homo sapiens
gagtctccttctctt

SEQ ID NO: 2902012 - DNA, 17 bp, Homo sapiens
gagtctccttctcttct

SEQ ID NO: 2902013 - DNA, 19 bp, Homo sapiens
gagtctccttctcttctct

SEQ ID NO: 2902014 - DNA, 20 bp, Homo sapiens
gagtctcgctctgtcgccca

SEQ ID NO: 2902015 - DNA, 20 bp, Homo sapiens
gagtctctccagcctcacag

SEQ ID NO: 2902016 - DNA, 21 bp, Homo sapiens
gagtctctggctcagctgtgg

SEQ ID NO: 2902017 - DNA, 14 bp, Homo sapiens
gagtctgaagcaga

SEQ ID NO: 2902018 - DNA, 15 bp, Homo sapiens
gagtctgaagcagat

SEQ ID NO: 2902019 - DNA, 23 bp, Homo sapiens
gagtctgaagcagatgcaaagag

SEQ ID NO: 2902020 - DNA, 23 bp, Homo sapiens
gagtctgccccacatgtggccat

SEQ ID NO: 2902021 - DNA, 20 bp, Homo sapiens
gagtctggcaaacatgtgca

SEQ ID NO: 2902022 - DNA, 19 bp, Homo sapiens
gagtctggtggaggagctg

SEQ ID NO: 2902023 - DNA, 22 bp, Homo sapiens
gagtctgttgtgtgtcatgcca

SEQ ID NO: 2902024 - DNA, 16 bp, Homo sapiens
gagtctttggttctaa

SEQ ID NO: 2902025 - DNA, 22 bp, Homo sapiens
gagtctttggttctaaggacct

SEQ ID NO: 2902026 - DNA, 17 bp, Homo sapiens
gagtgaatgccagtgtg

SEQ ID NO: 2902027 - DNA, 21 bp, Homo sapiens
gagtgacacccaagagggctg

SEQ ID NO: 2902028 - DNA, 22 bp, Homo sapiens
gagtgacacccaagagggctgc

SEQ ID NO: 2902029 - DNA, 15 bp, Homo sapiens
gagtgagacccagga

SEQ ID NO: 2902030 - DNA, 18 bp, Homo sapiens
gagtgagacccaggagcc

SEQ ID NO: 2902031 - DNA, 13 bp, Homo sapiens
gagtgagactcca

SEQ ID NO: 2902032 - DNA, 15 bp, Homo sapiens
gagtgatatggagca

SEQ ID NO: 2902033 - DNA, 17 bp, Homo sapiens
gagtgcagaacacctgg

SEQ ID NO: 2902034 - DNA, 20 bp, Homo sapiens
gagtgcagaacacctggccg

SEQ ID NO: 2902035 - DNA, 16 bp, Homo sapiens
gagtgcagagaaagaa

SEQ ID NO: 2902036 - DNA, 22 bp, Homo sapiens
gagtgcaggggatggggtgggg

SEQ ID NO: 2902037 - DNA, 14 bp, Homo sapiens
gagtgcagtcctga

SEQ ID NO: 2902038 - DNA, 14 bp, Homo sapiens
gagtgccttttgca

SEQ ID NO: 2902039 - DNA, 17 bp, Homo sapiens
gagtgcggcgtggagac

SEQ ID NO: 2902040 - DNA, 18 bp, Homo sapiens
gagtgcggcgtggagact

SEQ ID NO: 2902041 - DNA, 23 bp, Homo sapiens
gagtgcggcgtggagactggcag

SEQ ID NO: 2902042 - DNA, 17 bp, Homo sapiens
gagtgcgtgtgagaaga

SEQ ID NO: 2902043 - DNA, 11 bp, Homo sapiens
gagtgctaagt

SEQ ID NO: 2902044 - DNA, 11 bp, Homo sapiens
gagtgctctga

SEQ ID NO: 2902045 - DNA, 13 bp, Homo sapiens
gagtggaaggtga

SEQ ID NO: 2902046 - DNA, 19 bp, Homo sapiens
gagtggactgttccctgag

SEQ ID NO: 2902047 - DNA, 18 bp, Homo sapiens
gagtggatgatgtttcgt

SEQ ID NO: 2902048 - DNA, 18 bp, Homo sapiens
gagtggatgctgtgctac

SEQ ID NO: 2902049 - DNA, 11 bp, Homo sapiens
gagtggcatgt

SEQ ID NO: 2902050 - DNA, 11 bp, Homo sapiens
gagtggccagc

SEQ ID NO: 2902051 - DNA, 15 bp, Homo sapiens
gagtggccagcgcca

SEQ ID NO: 2902052 - DNA, 17 bp, Homo sapiens
gagtggccagcgccagg

SEQ ID NO: 2902053 - DNA, 19 bp, Homo sapiens
gagtggccagcgccagggc

SEQ ID NO: 2902054 - DNA, 21 bp, Homo sapiens
gagtggccagcgccagggccc

SEQ ID NO: 2902055 - DNA, 16 bp, Homo sapiens
gagtggcctagagcac

SEQ ID NO: 2902056 - DNA, 17 bp, Homo sapiens
gagtggggtagaggaag

SEQ ID NO: 2902057 - DNA, 20 bp, Homo sapiens
gagtggttgggctgtgcctg

SEQ ID NO: 2902058 - DNA, 20 bp, Homo sapiens
gagtgtccctttttgcaggg

SEQ ID NO: 2902059 - DNA, 17 bp, Homo sapiens
gagtgtcctggctgtga

SEQ ID NO: 2902060 - DNA, 16 bp, Homo sapiens
gagtgtctctgcctgg

SEQ ID NO: 2902061 - DNA, 21 bp, Homo sapiens
gagtgtctttccacggagcca

SEQ ID NO: 2902062 - DNA, 23 bp, Homo sapiens
gagtgtgctgctgtaagaaatct

SEQ ID NO: 2902063 - DNA, 15 bp, Homo sapiens
gagtgtggactctgg

SEQ ID NO: 2902064 - DNA, 18 bp, Homo sapiens
gagtgtgtcagagcccag

SEQ ID NO: 2902065 - DNA, 13 bp, Homo sapiens
gagtgttcctgtg

SEQ ID NO: 2902066 - DNA, 17 bp, Homo sapiens
gagtgtttgggggacgt

SEQ ID NO: 2902067 - DNA, 13 bp, Homo sapiens
gagttaaaatgtt

SEQ ID NO: 2902068 - DNA, 13 bp, Homo sapiens
gagttagccatcc

SEQ ID NO: 2902069 - DNA, 17 bp, Homo sapiens
gagttaggaatgagaag

SEQ ID NO: 2902070 - DNA, 14 bp, Homo sapiens
gagttcaactacat

SEQ ID NO: 2902071 - DNA, 22 bp, Homo sapiens
gagttcaataaatgtctgttga

SEQ ID NO: 2902072 - DNA, 21 bp, Homo sapiens
gagttcagagtccttaaaatg

SEQ ID NO: 2902073 - DNA, 19 bp, Homo sapiens
gagttcaggtagctgcccc

SEQ ID NO: 2902074 - DNA, 22 bp, Homo sapiens
gagttcaggtagctgcccctgg

SEQ ID NO: 2902075 - DNA, 12 bp, Homo sapiens
gagttccagtca

SEQ ID NO: 2902076 - DNA, 13 bp, Homo sapiens
gagttcctgctcc

SEQ ID NO: 2902077 - DNA, 16 bp, Homo sapiens
gagttcctgctccgtg

SEQ ID NO: 2902078 - DNA, 18 bp, Homo sapiens
gagttcgagaccagcctg

SEQ ID NO: 2902079 - DNA, 14 bp, Homo sapiens
gagttctgtgaaga

SEQ ID NO: 2902080 - DNA, 15 bp, Homo sapiens
gagttcttgtgccat

SEQ ID NO: 2902081 - DNA, 12 bp, Homo sapiens
gagttctttgca

SEQ ID NO: 2902082 - DNA, 19 bp, Homo sapiens
gagttgatctggaacccag

SEQ ID NO: 2902083 - DNA, 20 bp, Homo sapiens
gagttgatctggaacccaga

SEQ ID NO: 2902084 - DNA, 17 bp, Homo sapiens
gagttgccccgtctctg

SEQ ID NO: 2902085 - DNA, 13 bp, Homo sapiens
gagttggagtgag

SEQ ID NO: 2902086 - DNA, 18 bp, Homo sapiens
gagttgtgagccctctag

SEQ ID NO: 2902087 - DNA, 13 bp, Homo sapiens
gagtttaaaaatc

SEQ ID NO: 2902088 - DNA, 16 bp, Homo sapiens
gagtttaaattgtaat

SEQ ID NO: 2902089 - DNA, 14 bp, Homo sapiens
gagtttacaaagat

SEQ ID NO: 2902090 - DNA, 18 bp, Homo sapiens
gagtttatacagtgtaca

SEQ ID NO: 2902091 - DNA, 20 bp, Homo sapiens
gagtttatacagtgtacatg

SEQ ID NO: 2902092 - DNA, 23 bp, Homo sapiens
gagtttatttttttgatggctaa

SEQ ID NO: 2902093 - DNA, 14 bp, Homo sapiens
gagtttcagctgga

SEQ ID NO: 2902094 - DNA, 12 bp, Homo sapiens
gagtttcagctt

SEQ ID NO: 2902095 - DNA, 14 bp, Homo sapiens
gagtttcccttcct

SEQ ID NO: 2902096 - DNA, 13 bp, Homo sapiens
gagtttctattta

SEQ ID NO: 2902097 - DNA, 20 bp, Homo sapiens
gagtttgagaccagcctggc

SEQ ID NO: 2902098 - DNA, 19 bp, Homo sapiens
gagtttgctgttttaaatt

SEQ ID NO: 2902099 - DNA, 15 bp, Homo sapiens
gagtttgtgtgtctt

SEQ ID NO: 2902100 - DNA, 21 bp, Homo sapiens
gagttttccatggcaggaagg

SEQ ID NO: 2902101 - DNA, 12 bp, Homo sapiens
gagttttcttat

SEQ ID NO: 2902102 - DNA, 13 bp, Homo sapiens
gagttttcttata

SEQ ID NO: 2902103 - DNA, 16 bp, Homo sapiens
gagttttttgtaccaa

SEQ ID NO: 2902104 - DNA, 18 bp, Homo sapiens
gataaaaaagaaaacatt

SEQ ID NO: 2902105 - DNA, 14 bp, Homo sapiens
gataaaaaggaagg

SEQ ID NO: 2902106 - DNA, 19 bp, Homo sapiens
gataaaaaggaaggagaga

SEQ ID NO: 2902107 - DNA, 20 bp, Homo sapiens
gataaaaaggaaggagagat

SEQ ID NO: 2902108 - DNA, 12 bp, Homo sapiens
gataaaatgatg

SEQ ID NO: 2902109 - DNA, 22 bp, Homo sapiens
gataaaattatagatgggaatg

SEQ ID NO: 2902110 - DNA, 16 bp, Homo sapiens
gataaaccaataaatc

SEQ ID NO: 2902111 - DNA, 16 bp, Homo sapiens
gataaagatttcttga

SEQ ID NO: 2902112 - DNA, 15 bp, Homo sapiens
gataaagtttctcag

SEQ ID NO: 2902113 - DNA, 19 bp, Homo sapiens
gataaataaaagatagcaa

SEQ ID NO: 2902114 - DNA, 22 bp, Homo sapiens
gataaatattatattatatata

SEQ ID NO: 2902115 - DNA, 11 bp, Homo sapiens
gataacaaaga

SEQ ID NO: 2902116 - DNA, 12 bp, Homo sapiens
gataacaaagat

SEQ ID NO: 2902117 - DNA, 18 bp, Homo sapiens
gataacaaagatatcttt

SEQ ID NO: 2902118 - DNA, 14 bp, Homo sapiens
gataacattttcaa

SEQ ID NO: 2902119 - DNA, 14 bp, Homo sapiens
gataagattgaaat

SEQ ID NO: 2902120 - DNA, 14 bp, Homo sapiens
gataaggacatgat

SEQ ID NO: 2902121 - DNA, 20 bp, Homo sapiens
gataaggacatgatgctttt

SEQ ID NO: 2902122 - DNA, 15 bp, Homo sapiens
gataaggggtggggg

SEQ ID NO: 2902123 - DNA, 22 bp, Homo sapiens
gataaggggtgggggagaaaaa

SEQ ID NO: 2902124 - DNA, 17 bp, Homo sapiens
gataaggtaaaatgcca

SEQ ID NO: 2902125 - DNA, 23 bp, Homo sapiens
gataagttcttatgccatgttaa

SEQ ID NO: 2902126 - DNA, 13 bp, Homo sapiens
gataataataata

SEQ ID NO: 2902127 - DNA, 14 bp, Homo sapiens
gataatacattccg

SEQ ID NO: 2902128 - DNA, 13 bp, Homo sapiens
gataatagattct

SEQ ID NO: 2902129 - DNA, 22 bp, Homo sapiens
gataatagttttttcttttaac

SEQ ID NO: 2902130 - DNA, 17 bp, Homo sapiens
gataatatgagaatcag

SEQ ID NO: 2902131 - DNA, 16 bp, Homo sapiens
gataatcttttacatt

SEQ ID NO: 2902132 - DNA, 16 bp, Homo sapiens
gataatgaaataatca

SEQ ID NO: 2902133 - DNA, 19 bp, Homo sapiens
gataatgctgttgcctcat

SEQ ID NO: 2902134 - DNA, 18 bp, Homo sapiens
gataattgcattcatctt

SEQ ID NO: 2902135 - DNA, 14 bp, Homo sapiens
gataatttcaggga

SEQ ID NO: 2902136 - DNA, 19 bp, Homo sapiens
gatacaaacactacagaca

SEQ ID NO: 2902137 - DNA, 18 bp, Homo sapiens
gatacagcagtagacatt

SEQ ID NO: 2902138 - DNA, 17 bp, Homo sapiens
gatacagtcaacaagcc

SEQ ID NO: 2902139 - DNA, 14 bp, Homo sapiens
gatacagtgttttt

SEQ ID NO: 2902140 - DNA, 21 bp, Homo sapiens
gatacatacaccagcattcct

SEQ ID NO: 2902141 - DNA, 21 bp, Homo sapiens
gatacatccaaagcagacagc

SEQ ID NO: 2902142 - DNA, 20 bp, Homo sapiens
gataccacttttcattgcaa

SEQ ID NO: 2902143 - DNA, 21 bp, Homo sapiens
gatacctaaaacataagatca

SEQ ID NO: 2902144 - DNA, 18 bp, Homo sapiens
gatacctgctttggaagc

SEQ ID NO: 2902145 - DNA, 14 bp, Homo sapiens
gatactcaaagtgg

SEQ ID NO: 2902146 - DNA, 14 bp, Homo sapiens
gatacttacatgtt

SEQ ID NO: 2902147 - DNA, 22 bp, Homo sapiens
gatacttctgaaataaatgttc

SEQ ID NO: 2902148 - DNA, 22 bp, Homo sapiens
gatagaactgtactgttttctg

SEQ ID NO: 2902149 - DNA, 12 bp, Homo sapiens
gatagaatgaca

SEQ ID NO: 2902150 - DNA, 17 bp, Homo sapiens
gatagatgactttgcag

SEQ ID NO: 2902151 - DNA, 12 bp, Homo sapiens
gatagatgctgg

SEQ ID NO: 2902152 - DNA, 15 bp, Homo sapiens
gatagatgtttgact

SEQ ID NO: 2902153 - DNA, 20 bp, Homo sapiens
gatagatgtttgactttaaa

SEQ ID NO: 2902154 - DNA, 15 bp, Homo sapiens
gatagatttgacctc

SEQ ID NO: 2902155 - DNA, 20 bp, Homo sapiens
gatagcaagtgaatttttct

SEQ ID NO: 2902156 - DNA, 20 bp, Homo sapiens
gatagctaactgtaaatcat

SEQ ID NO: 2902157 - DNA, 21 bp, Homo sapiens
gatagctcaatactctctgag

SEQ ID NO: 2902158 - DNA, 23 bp, Homo sapiens
gatagcttcaccccaatcccagc

SEQ ID NO: 2902159 - DNA, 14 bp, Homo sapiens
gatagtctgggtca

SEQ ID NO: 2902160 - DNA, 23 bp, Homo sapiens
gatagtgggcaccccactgcaat

SEQ ID NO: 2902161 - DNA, 12 bp, Homo sapiens
gatagttactgt

SEQ ID NO: 2902162 - DNA, 14 bp, Homo sapiens
gatagttttctaga

SEQ ID NO: 2902163 - DNA, 22 bp, Homo sapiens
gatataaatactgacaatgtat

SEQ ID NO: 2902164 - DNA, 23 bp, Homo sapiens
gatataaatactgacaatgtatt

SEQ ID NO: 2902165 - DNA, 17 bp, Homo sapiens
gatatactctagatgaa

SEQ ID NO: 2902166 - DNA, 21 bp, Homo sapiens
gatatatcagtgttgtctcat

SEQ ID NO: 2902167 - DNA, 18 bp, Homo sapiens
gatatcagagctgggaaa

SEQ ID NO: 2902168 - DNA, 14 bp, Homo sapiens
gatatccatctttt

SEQ ID NO: 2902169 - DNA, 20 bp, Homo sapiens
gatatcggtgctatgtgttt

SEQ ID NO: 2902170 - DNA, 14 bp, Homo sapiens
gatatcttttcttt

SEQ ID NO: 2902171 - DNA, 23 bp, Homo sapiens
gatatgaacagggcccaggcctg

SEQ ID NO: 2902172 - DNA, 18 bp, Homo sapiens
gatatgcagttttcctta

SEQ ID NO: 2902173 - DNA, 20 bp, Homo sapiens
gatatgtatgttgtgaatta

SEQ ID NO: 2902174 - DNA, 19 bp, Homo sapiens
gatattaaaatttggtgct

SEQ ID NO: 2902175 - DNA, 24 bp, Homo sapiens
gatattatctacctgttctgtagc

SEQ ID NO: 2902176 - DNA, 16 bp, Homo sapiens
gatattatgtggcttt

SEQ ID NO: 2902177 - DNA, 20 bp, Homo sapiens
gatattccccccacttaaga

SEQ ID NO: 2902178 - DNA, 12 bp, Homo sapiens
gatattctaaga

SEQ ID NO: 2902179 - DNA, 12 bp, Homo sapiens
gatattggaaga

SEQ ID NO: 2902180 - DNA, 15 bp, Homo sapiens
gatatttatgtatct

SEQ ID NO: 2902181 - DNA, 20 bp, Homo sapiens
gatatttcgtttggtcttag

SEQ ID NO: 2902182 - DNA, 16 bp, Homo sapiens
gatatttcttgctttc

SEQ ID NO: 2902183 - DNA, 18 bp, Homo sapiens
gatattttccctacctaa

SEQ ID NO: 2902184 - DNA, 13 bp, Homo sapiens
gatcaatgaaatg

SEQ ID NO: 2902185 - DNA, 12 bp, Homo sapiens
gatcaatgacag

SEQ ID NO: 2902186 - DNA, 14 bp, Homo sapiens
gatcaatgacagag

SEQ ID NO: 2902187 - DNA, 18 bp, Homo sapiens
gatcaattatagtttctg

SEQ ID NO: 2902188 - DNA, 13 bp, Homo sapiens
gatcacaaaaaca

SEQ ID NO: 2902189 - DNA, 19 bp, Homo sapiens
gatcacctgaggtcaggag

SEQ ID NO: 2902190 - DNA, 18 bp, Homo sapiens
gatcacgatgtaaattat

SEQ ID NO: 2902191 - DNA, 13 bp, Homo sapiens
gatcactcctgga

SEQ ID NO: 2902192 - DNA, 23 bp, Homo sapiens
gatcagagccgtggtcctttggg

SEQ ID NO: 2902193 - DNA, 21 bp, Homo sapiens
gatcagatgctccaagattct

SEQ ID NO: 2902194 - DNA, 14 bp, Homo sapiens
gatcagcaaaaaga

SEQ ID NO: 2902195 - DNA, 13 bp, Homo sapiens
gatcagcaatgaa

SEQ ID NO: 2902196 - DNA, 16 bp, Homo sapiens
gatcaggcacaggtca

SEQ ID NO: 2902197 - DNA, 17 bp, Homo sapiens
gatcaggcacaggtcag

SEQ ID NO: 2902198 - DNA, 13 bp, Homo sapiens
gatcaggtgggga

SEQ ID NO: 2902199 - DNA, 14 bp, Homo sapiens
gatcaggtggggag

SEQ ID NO: 2902200 - DNA, 20 bp, Homo sapiens
gatcagtgtaccatttgcct

SEQ ID NO: 2902201 - DNA, 13 bp, Homo sapiens
gatcataaggctt

SEQ ID NO: 2902202 - DNA, 19 bp, Homo sapiens
gatcatacagttatgtggg

SEQ ID NO: 2902203 - DNA, 23 bp, Homo sapiens
gatcatcatttaaaaaaaaagaa

SEQ ID NO: 2902204 - DNA, 16 bp, Homo sapiens
gatcatcgccagaggt

SEQ ID NO: 2902205 - DNA, 19 bp, Homo sapiens
gatcatctttgctgaatgt

SEQ ID NO: 2902206 - DNA, 19 bp, Homo sapiens
gatcatgtactttttagta

SEQ ID NO: 2902207 - DNA, 18 bp, Homo sapiens
gatcatgttttggtgaaa

SEQ ID NO: 2902208 - DNA, 21 bp, Homo sapiens
gatcatttttaactgattctt

SEQ ID NO: 2902209 - DNA, 20 bp, Homo sapiens
gatccaaaagaagcccccag

SEQ ID NO: 2902210 - DNA, 12 bp, Homo sapiens
gatccaaagact

SEQ ID NO: 2902211 - DNA, 19 bp, Homo sapiens
gatccaaatgctgtgcaaa

SEQ ID NO: 2902212 - DNA, 15 bp, Homo sapiens
gatccaagctaagca

SEQ ID NO: 2902213 - DNA, 22 bp, Homo sapiens
gatccaagctaagcactgccac

SEQ ID NO: 2902214 - DNA, 19 bp, Homo sapiens
gatccaaggccgcggccca

SEQ ID NO: 2902215 - DNA, 18 bp, Homo sapiens
gatccacccacctcagcc

SEQ ID NO: 2902216 - DNA, 20 bp, Homo sapiens
gatccacccacctcagcctc

SEQ ID NO: 2902217 - DNA, 12 bp, Homo sapiens
gatccagcctgg

SEQ ID NO: 2902218 - DNA, 23 bp, Homo sapiens
gatccagctgtgtgttttcaatc

SEQ ID NO: 2902219 - DNA, 12 bp, Homo sapiens
gatccagggaca

SEQ ID NO: 2902220 - DNA, 15 bp, Homo sapiens
gatccagggacagag

SEQ ID NO: 2902221 - DNA, 16 bp, Homo sapiens
gatccatgtagcagga

SEQ ID NO: 2902222 - DNA, 19 bp, Homo sapiens
gatccatgtagcaggactg

SEQ ID NO: 2902223 - DNA, 18 bp, Homo sapiens
gatcccaacactgccagc

SEQ ID NO: 2902224 - DNA, 13 bp, Homo sapiens
gatcccacagccc

SEQ ID NO: 2902225 - DNA, 15 bp, Homo sapiens
gatcccacagcccta

SEQ ID NO: 2902226 - DNA, 20 bp, Homo sapiens
gatcccagctcactgcaacc

SEQ ID NO: 2902227 - DNA, 21 bp, Homo sapiens
gatcccatatttacttactgc

SEQ ID NO: 2902228 - DNA, 15 bp, Homo sapiens
gatcccatcaaagaa

SEQ ID NO: 2902229 - DNA, 15 bp, Homo sapiens
gatcccatgagctcc

SEQ ID NO: 2902230 - DNA, 23 bp, Homo sapiens
gatcccctgtcccctggggctgg

SEQ ID NO: 2902231 - DNA, 20 bp, Homo sapiens
gatcccctttggttttacta

SEQ ID NO: 2902232 - DNA, 19 bp, Homo sapiens
gatcccgcgtagtgtcagt

SEQ ID NO: 2902233 - DNA, 17 bp, Homo sapiens
gatcccgttttccccat

SEQ ID NO: 2902234 - DNA, 12 bp, Homo sapiens
gatccctcatct

SEQ ID NO: 2902235 - DNA, 14 bp, Homo sapiens
gatccctcatctgt

SEQ ID NO: 2902236 - DNA, 23 bp, Homo sapiens
gatccctcccccccatgcactgt

SEQ ID NO: 2902237 - DNA, 17 bp, Homo sapiens
gatccctggccactgaa

SEQ ID NO: 2902238 - DNA, 19 bp, Homo sapiens
gatccctgtctttcctaag

SEQ ID NO: 2902239 - DNA, 21 bp, Homo sapiens
gatccgcctacctcagcctcc

SEQ ID NO: 2902240 - DNA, 16 bp, Homo sapiens
gatcctaagcatctaa

SEQ ID NO: 2902241 - DNA, 18 bp, Homo sapiens
gatcctaagggctcaccg

SEQ ID NO: 2902242 - DNA, 12 bp, Homo sapiens
gatcctcagtgc

SEQ ID NO: 2902243 - DNA, 15 bp, Homo sapiens
gatcctcagttctca

SEQ ID NO: 2902244 - DNA, 15 bp, Homo sapiens
gatcctgagctgctg

SEQ ID NO: 2902245 - DNA, 12 bp, Homo sapiens
gatcctgccccc

SEQ ID NO: 2902246 - DNA, 16 bp, Homo sapiens
gatcctgcccccaagt

SEQ ID NO: 2902247 - DNA, 17 bp, Homo sapiens
gatcctggaggctgcct

SEQ ID NO: 2902248 - DNA, 23 bp, Homo sapiens
gatcctgggtggtctgcaggcag

SEQ ID NO: 2902249 - DNA, 15 bp, Homo sapiens
gatcctgggtttcca

SEQ ID NO: 2902250 - DNA, 22 bp, Homo sapiens
gatccttcccaaggtacagctg

SEQ ID NO: 2902251 - DNA, 17 bp, Homo sapiens
gatcgaaccgttttgaa

SEQ ID NO: 2902252 - DNA, 23 bp, Homo sapiens
gatcgaggcatggggcatgtcct

SEQ ID NO: 2902253 - DNA, 18 bp, Homo sapiens
gatcgcaccactgcactc

SEQ ID NO: 2902254 - DNA, 15 bp, Homo sapiens
gatcgctcccttggc

SEQ ID NO: 2902255 - DNA, 17 bp, Homo sapiens
gatcgctcccttggctt

SEQ ID NO: 2902256 - DNA, 19 bp, Homo sapiens
gatcgtgacgctgaataaa

SEQ ID NO: 2902257 - DNA, 20 bp, Homo sapiens
gatcgtgacgctgaataaat

SEQ ID NO: 2902258 - DNA, 22 bp, Homo sapiens
gatcgtgacgctgaataaatgt

SEQ ID NO: 2902259 - DNA, 14 bp, Homo sapiens
gatctaaggctgtt

SEQ ID NO: 2902260 - DNA, 13 bp, Homo sapiens
gatctacatgaat

SEQ ID NO: 2902261 - DNA, 23 bp, Homo sapiens
gatctacatgaggaactgtagat

SEQ ID NO: 2902262 - DNA, 18 bp, Homo sapiens
gatctaccagcataaata

SEQ ID NO: 2902263 - DNA, 13 bp, Homo sapiens
gatctaggtcttg

SEQ ID NO: 2902264 - DNA, 15 bp, Homo sapiens
gatctatgttgtttg

SEQ ID NO: 2902265 - DNA, 15 bp, Homo sapiens
gatctcactctgccc

SEQ ID NO: 2902266 - DNA, 17 bp, Homo sapiens
gatctcagctcactgca

SEQ ID NO: 2902267 - DNA, 19 bp, Homo sapiens
gatctcagctcactgcaag

SEQ ID NO: 2902268 - DNA, 13 bp, Homo sapiens
gatctcatgtcct

SEQ ID NO: 2902269 - DNA, 21 bp, Homo sapiens
gatctcattggacccttccat

SEQ ID NO: 2902270 - DNA, 17 bp, Homo sapiens
gatctccaattgcctct

SEQ ID NO: 2902271 - DNA, 15 bp, Homo sapiens
gatctccctgccgcc

SEQ ID NO: 2902272 - DNA, 20 bp, Homo sapiens
gatctccctgccgcctcaat

SEQ ID NO: 2902273 - DNA, 16 bp, Homo sapiens
gatctcggctcagtgc

SEQ ID NO: 2902274 - DNA, 12 bp, Homo sapiens
gatctctgcagg

SEQ ID NO: 2902275 - DNA, 20 bp, Homo sapiens
gatctgcacagtcagaagga

SEQ ID NO: 2902276 - DNA, 13 bp, Homo sapiens
gatctgctttctg

SEQ ID NO: 2902277 - DNA, 16 bp, Homo sapiens
gatctgctttctgttc

SEQ ID NO: 2902278 - DNA, 14 bp, Homo sapiens
gatctggaacccag

SEQ ID NO: 2902279 - DNA, 16 bp, Homo sapiens
gatctggaacccagac

SEQ ID NO: 2902280 - DNA, 20 bp, Homo sapiens
gatctggaacccagactcag

SEQ ID NO: 2902281 - DNA, 17 bp, Homo sapiens
gatctggaacctcagcc

SEQ ID NO: 2902282 - DNA, 20 bp, Homo sapiens
gatctggaacctcagcctgg

SEQ ID NO: 2902283 - DNA, 17 bp, Homo sapiens
gatctggaagggccaag

SEQ ID NO: 2902284 - DNA, 22 bp, Homo sapiens
gatctggaagggccaaggtctg

SEQ ID NO: 2902285 - DNA, 12 bp, Homo sapiens
gatctggcatgt

SEQ ID NO: 2902286 - DNA, 17 bp, Homo sapiens
gatctgggaccctttcc

SEQ ID NO: 2902287 - DNA, 23 bp, Homo sapiens
gatctgggaccctttccttcctt

SEQ ID NO: 2902288 - DNA, 15 bp, Homo sapiens
gatctggtcctaccc

SEQ ID NO: 2902289 - DNA, 16 bp, Homo sapiens
gatctggtcctaccca

SEQ ID NO: 2902290 - DNA, 15 bp, Homo sapiens
gatctgtcctcagcc

SEQ ID NO: 2902291 - DNA, 14 bp, Homo sapiens
gatctgtttccaaa

SEQ ID NO: 2902292 - DNA, 13 bp, Homo sapiens
gatcttaaagatc

SEQ ID NO: 2902293 - DNA, 13 bp, Homo sapiens
gatcttagattct

SEQ ID NO: 2902294 - DNA, 22 bp, Homo sapiens
gatcttatttggaattgacatt

SEQ ID NO: 2902295 - DNA, 14 bp, Homo sapiens
gatcttatttttct

SEQ ID NO: 2902296 - DNA, 16 bp, Homo sapiens
gatcttcaatttggat

SEQ ID NO: 2902297 - DNA, 23 bp, Homo sapiens
gatcttcaggatgcacggtttct

SEQ ID NO: 2902298 - DNA, 21 bp, Homo sapiens
gatcttccagaagctgtactt

SEQ ID NO: 2902299 - DNA, 19 bp, Homo sapiens
gatcttgagcaagttcctt

SEQ ID NO: 2902300 - DNA, 21 bp, Homo sapiens
gatctttatatttcaataaat

SEQ ID NO: 2902301 - DNA, 23 bp, Homo sapiens
gatctttcgttggttgtttctct

SEQ ID NO: 2902302 - DNA, 13 bp, Homo sapiens
gatctttgcttcc

SEQ ID NO: 2902303 - DNA, 21 bp, Homo sapiens
gatctttggacagaagcagct

SEQ ID NO: 2902304 - DNA, 15 bp, Homo sapiens
gatctttgtggccaa

SEQ ID NO: 2902305 - DNA, 18 bp, Homo sapiens
gatgaaggctgtgaaaaa

SEQ ID NO: 2902306 - DNA, 16 bp, Homo sapiens
gatgaagttttacatt

SEQ ID NO: 2902307 - DNA, 17 bp, Homo sapiens
gatgaagttttacattg

SEQ ID NO: 2902308 - DNA, 21 bp, Homo sapiens
gatgaatagaagttttaaatt

SEQ ID NO: 2902309 - DNA, 16 bp, Homo sapiens
gatgaatctacatttg

SEQ ID NO: 2902310 - DNA, 13 bp, Homo sapiens
gatgaatgagaat

SEQ ID NO: 2902311 - DNA, 17 bp, Homo sapiens
gatgacaagatggtaca

SEQ ID NO: 2902312 - DNA, 22 bp, Homo sapiens
gatgacataaaatttacattta

SEQ ID NO: 2902313 - DNA, 20 bp, Homo sapiens
gatgacatgcactcagctct

SEQ ID NO: 2902314 - DNA, 14 bp, Homo sapiens
gatgacattgctaa

SEQ ID NO: 2902315 - DNA, 20 bp, Homo sapiens
gatgacccctaccccctcat

SEQ ID NO: 2902316 - DNA, 20 bp, Homo sapiens
gatgactggcattttataga

SEQ ID NO: 2902317 - DNA, 23 bp, Homo sapiens
gatgagactccactcaggtgcac

SEQ ID NO: 2902318 - DNA, 11 bp, Homo sapiens
gatgagctcta

SEQ ID NO: 2902319 - DNA, 14 bp, Homo sapiens
gatgagctgggccg

SEQ ID NO: 2902320 - DNA, 20 bp, Homo sapiens
gatgagcttagggtgttttt

SEQ ID NO: 2902321 - DNA, 13 bp, Homo sapiens
gatgaggacagag

SEQ ID NO: 2902322 - DNA, 23 bp, Homo sapiens
gatgataaaaggaatctggcatt

SEQ ID NO: 2902323 - DNA, 12 bp, Homo sapiens
gatgataataat

SEQ ID NO: 2902324 - DNA, 18 bp, Homo sapiens
gatgatacaagattagaa

SEQ ID NO: 2902325 - DNA, 14 bp, Homo sapiens
gatgatacagtgtt

SEQ ID NO: 2902326 - DNA, 22 bp, Homo sapiens
gatgatccagagacatgtggca

SEQ ID NO: 2902327 - DNA, 15 bp, Homo sapiens
gatgatggtgttttg

SEQ ID NO: 2902328 - DNA, 15 bp, Homo sapiens
gatgatgtggttttt

SEQ ID NO: 2902329 - DNA, 15 bp, Homo sapiens
gatgattcaggtgca

SEQ ID NO: 2902330 - DNA, 16 bp, Homo sapiens
gatgattcaggtgcag

SEQ ID NO: 2902331 - DNA, 17 bp, Homo sapiens
gatgatttaaaagggaa

SEQ ID NO: 2902332 - DNA, 16 bp, Homo sapiens
gatgcaaagaggcaag

SEQ ID NO: 2902333 - DNA, 19 bp, Homo sapiens
gatgcaaatagcaaaacta

SEQ ID NO: 2902334 - DNA, 13 bp, Homo sapiens
gatgcaaccaaaa

SEQ ID NO: 2902335 - DNA, 21 bp, Homo sapiens
gatgcaaggattacagaaact

SEQ ID NO: 2902336 - DNA, 16 bp, Homo sapiens
gatgcacatccctgga

SEQ ID NO: 2902337 - DNA, 17 bp, Homo sapiens
gatgcacggtttctgtt

SEQ ID NO: 2902338 - DNA, 12 bp, Homo sapiens
gatgcagccttc

SEQ ID NO: 2902339 - DNA, 16 bp, Homo sapiens
gatgcaggctcccctg

SEQ ID NO: 2902340 - DNA, 14 bp, Homo sapiens
gatgcagggcagtc

SEQ ID NO: 2902341 - DNA, 15 bp, Homo sapiens
gatgcagggcagtca

SEQ ID NO: 2902342 - DNA, 20 bp, Homo sapiens
gatgcatgatccagctgtgt

SEQ ID NO: 2902343 - DNA, 13 bp, Homo sapiens
gatgcatggagat

SEQ ID NO: 2902344 - DNA, 19 bp, Homo sapiens
gatgcattctgataggagg

SEQ ID NO: 2902345 - DNA, 15 bp, Homo sapiens
gatgccacacaagga

SEQ ID NO: 2902346 - DNA, 19 bp, Homo sapiens
gatgccactcctccctccg

SEQ ID NO: 2902347 - DNA, 14 bp, Homo sapiens
gatgccaggttcta

SEQ ID NO: 2902348 - DNA, 18 bp, Homo sapiens
gatgccgaggtaaaagtt

SEQ ID NO: 2902349 - DNA, 16 bp, Homo sapiens
gatgcctccaccgctg

SEQ ID NO: 2902350 - DNA, 16 bp, Homo sapiens
gatgcctggcctgcca

SEQ ID NO: 2902351 - DNA, 14 bp, Homo sapiens
gatgcctttgctgt

SEQ ID NO: 2902352 - DNA, 16 bp, Homo sapiens
gatgcgcagccccatc

SEQ ID NO: 2902353 - DNA, 14 bp, Homo sapiens
gatgcgtattctgt

SEQ ID NO: 2902354 - DNA, 22 bp, Homo sapiens
gatgctcagttgctaaacactg

SEQ ID NO: 2902355 - DNA, 15 bp, Homo sapiens
gatgctcagttttaa

SEQ ID NO: 2902356 - DNA, 19 bp, Homo sapiens
gatgctccaagattctaga

SEQ ID NO: 2902357 - DNA, 22 bp, Homo sapiens
gatgctccaagattctagatga

SEQ ID NO: 2902358 - DNA, 13 bp, Homo sapiens
gatgctccttggg

SEQ ID NO: 2902359 - DNA, 15 bp, Homo sapiens
gatgctctttcaatg

SEQ ID NO: 2902360 - DNA, 17 bp, Homo sapiens
gatgctctttcccagga

SEQ ID NO: 2902361 - DNA, 19 bp, Homo sapiens
gatgctctttcccaggacg

SEQ ID NO: 2902362 - DNA, 23 bp, Homo sapiens
gatgctgaaataaactagggttt

SEQ ID NO: 2902363 - DNA, 21 bp, Homo sapiens
gatgctgacattcacctgccc

SEQ ID NO: 2902364 - DNA, 12 bp, Homo sapiens
gatgctgacctc

SEQ ID NO: 2902365 - DNA, 13 bp, Homo sapiens
gatgctgagccat

SEQ ID NO: 2902366 - DNA, 18 bp, Homo sapiens
gatgctgatgttcagtgt

SEQ ID NO: 2902367 - DNA, 15 bp, Homo sapiens
gatgctgctggcctc

SEQ ID NO: 2902368 - DNA, 16 bp, Homo sapiens
gatgctgctggcctcc

SEQ ID NO: 2902369 - DNA, 18 bp, Homo sapiens
gatgctgctggcctccct

SEQ ID NO: 2902370 - DNA, 14 bp, Homo sapiens
gatgctggatgctc

SEQ ID NO: 2902371 - DNA, 22 bp, Homo sapiens
gatgctggatgtctgccaattt

SEQ ID NO: 2902372 - DNA, 12 bp, Homo sapiens
gatgctggccca

SEQ ID NO: 2902373 - DNA, 14 bp, Homo sapiens
gatgctggcccagg

SEQ ID NO: 2902374 - DNA, 15 bp, Homo sapiens
gatgctggcccaggg

SEQ ID NO: 2902375 - DNA, 21 bp, Homo sapiens
gatgctggcccagggcccaga

SEQ ID NO: 2902376 - DNA, 11 bp, Homo sapiens
gatgctggcct

SEQ ID NO: 2902377 - DNA, 12 bp, Homo sapiens
gatgctggcctc

SEQ ID NO: 2902378 - DNA, 14 bp, Homo sapiens
gatgctggcctctt

SEQ ID NO: 2902379 - DNA, 22 bp, Homo sapiens
gatgctggcctcttggcacctg

SEQ ID NO: 2902380 - DNA, 19 bp, Homo sapiens
gatgctgggagttctaaca

SEQ ID NO: 2902381 - DNA, 13 bp, Homo sapiens
gatgctgtgcctg

SEQ ID NO: 2902382 - DNA, 21 bp, Homo sapiens
gatgctgtgctacgtgtgaaa

SEQ ID NO: 2902383 - DNA, 14 bp, Homo sapiens
gatgctgtttgaca

SEQ ID NO: 2902384 - DNA, 20 bp, Homo sapiens
gatgctttaccaaacagcaa

SEQ ID NO: 2902385 - DNA, 14 bp, Homo sapiens
gatgcttttctctc

SEQ ID NO: 2902386 - DNA, 19 bp, Homo sapiens
gatgcttttctctcagcat

SEQ ID NO: 2902387 - DNA, 16 bp, Homo sapiens
gatgcttttgtctaat

SEQ ID NO: 2902388 - DNA, 22 bp, Homo sapiens
gatggaaaaaccacccccaaat

SEQ ID NO: 2902389 - DNA, 14 bp, Homo sapiens
gatggaaaaataaa

SEQ ID NO: 2902390 - DNA, 19 bp, Homo sapiens
gatggaaccgcaggaagct

SEQ ID NO: 2902391 - DNA, 20 bp, Homo sapiens
gatggaaccgcaggaagctg

SEQ ID NO: 2902392 - DNA, 20 bp, Homo sapiens
gatggaagaaaatggaatta

SEQ ID NO: 2902393 - DNA, 18 bp, Homo sapiens
gatggacagtttgtttcc

SEQ ID NO: 2902394 - DNA, 15 bp, Homo sapiens
gatggacgcaggccc

SEQ ID NO: 2902395 - DNA, 18 bp, Homo sapiens
gatggacgcaggccctgt

SEQ ID NO: 2902396 - DNA, 14 bp, Homo sapiens
gatggacttgaaaa

SEQ ID NO: 2902397 - DNA, 14 bp, Homo sapiens
gatggaggagaaga

SEQ ID NO: 2902398 - DNA, 18 bp, Homo sapiens
gatggagttcttgtgcca

SEQ ID NO: 2902399 - DNA, 15 bp, Homo sapiens
gatggagtttctaag

SEQ ID NO: 2902400 - DNA, 17 bp, Homo sapiens
gatggagtttctctctt

SEQ ID NO: 2902401 - DNA, 17 bp, Homo sapiens
gatggcaacagatctgg

SEQ ID NO: 2902402 - DNA, 15 bp, Homo sapiens
gatggcatcctgtga

SEQ ID NO: 2902403 - DNA, 12 bp, Homo sapiens
gatggccagagg

SEQ ID NO: 2902404 - DNA, 22 bp, Homo sapiens
gatggcccttcctcctccacca

SEQ ID NO: 2902405 - DNA, 23 bp, Homo sapiens
gatggcccttcctcctccaccac

SEQ ID NO: 2902406 - DNA, 21 bp, Homo sapiens
gatggcggggatctgggaggg

SEQ ID NO: 2902407 - DNA, 23 bp, Homo sapiens
gatggctgggtccttgggcctgg

SEQ ID NO: 2902408 - DNA, 18 bp, Homo sapiens
gatgggaaaaactgcagt

SEQ ID NO: 2902409 - DNA, 18 bp, Homo sapiens
gatgggaaaatatttcct

SEQ ID NO: 2902410 - DNA, 18 bp, Homo sapiens
gatgggaatgaagcttgt

SEQ ID NO: 2902411 - DNA, 17 bp, Homo sapiens
gatgggagtctccctcc

SEQ ID NO: 2902412 - DNA, 13 bp, Homo sapiens
gatgggattctgg

SEQ ID NO: 2902413 - DNA, 14 bp, Homo sapiens
gatgggcagcccaa

SEQ ID NO: 2902414 - DNA, 23 bp, Homo sapiens
gatgggcagcccaacagcacttt

SEQ ID NO: 2902415 - DNA, 20 bp, Homo sapiens
gatgggcatatgtgtcagtg

SEQ ID NO: 2902416 - DNA, 15 bp, Homo sapiens
gatgggctccccagg

SEQ ID NO: 2902417 - DNA, 23 bp, Homo sapiens
gatgggcttttgttctgaggggt

SEQ ID NO: 2902418 - DNA, 13 bp, Homo sapiens
gatggggaaggag

SEQ ID NO: 2902419 - DNA, 14 bp, Homo sapiens
gatggggaaggagg

SEQ ID NO: 2902420 - DNA, 14 bp, Homo sapiens
gatggggaggaaga

SEQ ID NO: 2902421 - DNA, 21 bp, Homo sapiens
gatggggaggaagagagagac

SEQ ID NO: 2902422 - DNA, 16 bp, Homo sapiens
gatgggggaactcaga

SEQ ID NO: 2902423 - DNA, 20 bp, Homo sapiens
gatgggggaactcagatcca

SEQ ID NO: 2902424 - DNA, 22 bp, Homo sapiens
gatgggggaactcagatccagg

SEQ ID NO: 2902425 - DNA, 21 bp, Homo sapiens
gatgggggagtctgaagcaga

SEQ ID NO: 2902426 - DNA, 23 bp, Homo sapiens
gatggggggggatgtggatcagg

SEQ ID NO: 2902427 - DNA, 16 bp, Homo sapiens
gatgggtgaaggctgg

SEQ ID NO: 2902428 - DNA, 15 bp, Homo sapiens
gatggtcccaggaag

SEQ ID NO: 2902429 - DNA, 16 bp, Homo sapiens
gatggtcccaggaagc

SEQ ID NO: 2902430 - DNA, 17 bp, Homo sapiens
gatggtctggtctatgt

SEQ ID NO: 2902431 - DNA, 16 bp, Homo sapiens
gatggtgctgcccagg

SEQ ID NO: 2902432 - DNA, 13 bp, Homo sapiens
gatggtgggatgt

SEQ ID NO: 2902433 - DNA, 13 bp, Homo sapiens
gatggtgggcttc

SEQ ID NO: 2902434 - DNA, 20 bp, Homo sapiens
gatggtgtagccctcccact

SEQ ID NO: 2902435 - DNA, 24 bp, Homo sapiens
gatggtgttcaaaaaacttgtaaa

SEQ ID NO: 2902436 - DNA, 20 bp, Homo sapiens
gatgtaaacagtgcctgctg

SEQ ID NO: 2902437 - DNA, 23 bp, Homo sapiens
gatgtaaatcgggaaggatggga

SEQ ID NO: 2902438 - DNA, 13 bp, Homo sapiens
gatgtaatgtttt

SEQ ID NO: 2902439 - DNA, 22 bp, Homo sapiens
gatgtacatttccaaattcaca

SEQ ID NO: 2902440 - DNA, 17 bp, Homo sapiens
gatgtagaaacaatatt

SEQ ID NO: 2902441 - DNA, 14 bp, Homo sapiens
gatgtagcttgaga

SEQ ID NO: 2902442 - DNA, 21 bp, Homo sapiens
gatgtagggtaaggtgccttc

SEQ ID NO: 2902443 - DNA, 14 bp, Homo sapiens
gatgtatattcctt

SEQ ID NO: 2902444 - DNA, 21 bp, Homo sapiens
gatgtatattcctttgaagat

SEQ ID NO: 2902445 - DNA, 19 bp, Homo sapiens
gatgtatgcagctatctgg

SEQ ID NO: 2902446 - DNA, 20 bp, Homo sapiens
gatgtattagtagagcaacc

SEQ ID NO: 2902447 - DNA, 16 bp, Homo sapiens
gatgtcatttgagcag

SEQ ID NO: 2902448 - DNA, 21 bp, Homo sapiens
gatgtctctgacaaagtgtgt

SEQ ID NO: 2902449 - DNA, 22 bp, Homo sapiens
gatgtctgccaatttttgcctt

SEQ ID NO: 2902450 - DNA, 14 bp, Homo sapiens
gatgtgagcagaag

SEQ ID NO: 2902451 - DNA, 16 bp, Homo sapiens
gatgtgagtgtgtgtg

SEQ ID NO: 2902452 - DNA, 19 bp, Homo sapiens
gatgtgatatattcctaaa

SEQ ID NO: 2902453 - DNA, 18 bp, Homo sapiens
gatgtgattgtggaatgg

SEQ ID NO: 2902454 - DNA, 16 bp, Homo sapiens
gatgtgctttgtggct

SEQ ID NO: 2902455 - DNA, 12 bp, Homo sapiens
gatgtggccctg

SEQ ID NO: 2902456 - DNA, 19 bp, Homo sapiens
gatgtggggctgagctggg

SEQ ID NO: 2902457 - DNA, 23 bp, Homo sapiens
gatgtgggtctttttctcttctg

SEQ ID NO: 2902458 - DNA, 18 bp, Homo sapiens
gatgtgtggactgtggca

SEQ ID NO: 2902459 - DNA, 20 bp, Homo sapiens
gatgtgttgaccggctgccg

SEQ ID NO: 2902460 - DNA, 16 bp, Homo sapiens
gatgtgtttgctttct

SEQ ID NO: 2902461 - DNA, 13 bp, Homo sapiens
gatgtgtttttgt

SEQ ID NO: 2902462 - DNA, 18 bp, Homo sapiens
gatgttaacacattttgt

SEQ ID NO: 2902463 - DNA, 19 bp, Homo sapiens
gatgttaacacattttgta

SEQ ID NO: 2902464 - DNA, 22 bp, Homo sapiens
gatgttaacacattttgtataa

SEQ ID NO: 2902465 - DNA, 22 bp, Homo sapiens
gatgttatacatcaatatgtat

SEQ ID NO: 2902466 - DNA, 15 bp, Homo sapiens
gatgttatcttaaca

SEQ ID NO: 2902467 - DNA, 13 bp, Homo sapiens
gatgttcagtgta

SEQ ID NO: 2902468 - DNA, 15 bp, Homo sapiens
gatgttcagtgtaat

SEQ ID NO: 2902469 - DNA, 23 bp, Homo sapiens
gatgttcagtgtaatttctttgc

SEQ ID NO: 2902470 - DNA, 14 bp, Homo sapiens
gatgttcatttaga

SEQ ID NO: 2902471 - DNA, 12 bp, Homo sapiens
gatgttctaagg

SEQ ID NO: 2902472 - DNA, 19 bp, Homo sapiens
gatgttctaagtctttcca

SEQ ID NO: 2902473 - DNA, 16 bp, Homo sapiens
gatgttgataatttca

SEQ ID NO: 2902474 - DNA, 20 bp, Homo sapiens
gatgtttatgttcttataga

SEQ ID NO: 2902475 - DNA, 14 bp, Homo sapiens
gatgtttattcttc

SEQ ID NO: 2902476 - DNA, 18 bp, Homo sapiens
gatgtttattcttctaga

SEQ ID NO: 2902477 - DNA, 19 bp, Homo sapiens
gatgtttattcttctagag

SEQ ID NO: 2902478 - DNA, 19 bp, Homo sapiens
gatgtttccagacttcctt

SEQ ID NO: 2902479 - DNA, 13 bp, Homo sapiens
gatgtttcctgga

SEQ ID NO: 2902480 - DNA, 14 bp, Homo sapiens
gatgtttcctggaa

SEQ ID NO: 2902481 - DNA, 15 bp, Homo sapiens
gatgtttcctggaag

SEQ ID NO: 2902482 - DNA, 18 bp, Homo sapiens
gatgttttaattccatga

SEQ ID NO: 2902483 - DNA, 21 bp, Homo sapiens
gatgttttacgcaaggaagga

SEQ ID NO: 2902484 - DNA, 22 bp, Homo sapiens
gatgttttacgcaaggaaggac

SEQ ID NO: 2902485 - DNA, 15 bp, Homo sapiens
gattaaacttatgaa

SEQ ID NO: 2902486 - DNA, 17 bp, Homo sapiens
gattaaacttatgaatg

SEQ ID NO: 2902487 - DNA, 14 bp, Homo sapiens
gattaacaatgtat

SEQ ID NO: 2902488 - DNA, 16 bp, Homo sapiens
gattaacaatgtattt

SEQ ID NO: 2902489 - DNA, 12 bp, Homo sapiens
gattaacatttg

SEQ ID NO: 2902490 - DNA, 16 bp, Homo sapiens
gattaactgtgaataa

SEQ ID NO: 2902491 - DNA, 17 bp, Homo sapiens
gattaagtacaagcaca

SEQ ID NO: 2902492 - DNA, 14 bp, Homo sapiens
gattaatttcatca

SEQ ID NO: 2902493 - DNA, 20 bp, Homo sapiens
gattaatttgcatctgaaat

SEQ ID NO: 2902494 - DNA, 15 bp, Homo sapiens
gattacataatctgt

SEQ ID NO: 2902495 - DNA, 14 bp, Homo sapiens
gattacctcctgag

SEQ ID NO: 2902496 - DNA, 17 bp, Homo sapiens
gattacctcctgagaaa

SEQ ID NO: 2902497 - DNA, 19 bp, Homo sapiens
gattagactggacagcttg

SEQ ID NO: 2902498 - DNA, 20 bp, Homo sapiens
gattagactggacagcttgt

SEQ ID NO: 2902499 - DNA, 23 bp, Homo sapiens
gattagataatcttttacattga

SEQ ID NO: 2902500 - DNA, 17 bp, Homo sapiens
gattagtataatatttc

SEQ ID NO: 2902501 - DNA, 14 bp, Homo sapiens
gattataaatgttt

SEQ ID NO: 2902502 - DNA, 13 bp, Homo sapiens
gattatagattct

SEQ ID NO: 2902503 - DNA, 18 bp, Homo sapiens
gattatagattctaaaga

SEQ ID NO: 2902504 - DNA, 22 bp, Homo sapiens
gattatagattctaaagattct

SEQ ID NO: 2902505 - DNA, 16 bp, Homo sapiens
gattatctatttgtgt

SEQ ID NO: 2902506 - DNA, 16 bp, Homo sapiens
gattatgactaaagta

SEQ ID NO: 2902507 - DNA, 15 bp, Homo sapiens
gattatggttttgtg

SEQ ID NO: 2902508 - DNA, 18 bp, Homo sapiens
gattatttaaatgctttt

SEQ ID NO: 2902509 - DNA, 15 bp, Homo sapiens
gattcaaaatattta

SEQ ID NO: 2902510 - DNA, 18 bp, Homo sapiens
gattcaaaatatttaaaa

SEQ ID NO: 2902511 - DNA, 15 bp, Homo sapiens
gattcaaaggttcta

SEQ ID NO: 2902512 - DNA, 18 bp, Homo sapiens
gattcacaatgaaatgct

SEQ ID NO: 2902513 - DNA, 22 bp, Homo sapiens
gattcacaatgaaatgctctcc

SEQ ID NO: 2902514 - DNA, 16 bp, Homo sapiens
gattcaggggaagggc

SEQ ID NO: 2902515 - DNA, 18 bp, Homo sapiens
gattcaggggaagggcag

SEQ ID NO: 2902516 - DNA, 20 bp, Homo sapiens
gattcaggggaagggcaggc

SEQ ID NO: 2902517 - DNA, 18 bp, Homo sapiens
gattcaggtgcagaggaa

SEQ ID NO: 2902518 - DNA, 20 bp, Homo sapiens
gattcagttttcccactttt

SEQ ID NO: 2902519 - DNA, 10 bp, Homo sapiens
gattcatttt

SEQ ID NO: 2902520 - DNA, 13 bp, Homo sapiens
gattccaaaccag

SEQ ID NO: 2902521 - DNA, 16 bp, Homo sapiens
gattccaaaccaggac

SEQ ID NO: 2902522 - DNA, 19 bp, Homo sapiens
gattccaaagagtagaatt

SEQ ID NO: 2902523 - DNA, 14 bp, Homo sapiens
gattccaaccttcc

SEQ ID NO: 2902524 - DNA, 18 bp, Homo sapiens
gattccaaccttcctttt

SEQ ID NO: 2902525 - DNA, 23 bp, Homo sapiens
gattcccactgccgctgcccgct

SEQ ID NO: 2902526 - DNA, 13 bp, Homo sapiens
gattcccagagac

SEQ ID NO: 2902527 - DNA, 14 bp, Homo sapiens
gattcccaggccag

SEQ ID NO: 2902528 - DNA, 15 bp, Homo sapiens
gattcccaggccagg

SEQ ID NO: 2902529 - DNA, 16 bp, Homo sapiens
gattcccaggccaggg

SEQ ID NO: 2902530 - DNA, 18 bp, Homo sapiens
gattcccaggccagggct

SEQ ID NO: 2902531 - DNA, 20 bp, Homo sapiens
gattccccatctcaggccag

SEQ ID NO: 2902532 - DNA, 18 bp, Homo sapiens
gattccccctgccctgtg

SEQ ID NO: 2902533 - DNA, 21 bp, Homo sapiens
gattcccggagggaaactgtg

SEQ ID NO: 2902534 - DNA, 15 bp, Homo sapiens
gattccggatcctaa

SEQ ID NO: 2902535 - DNA, 20 bp, Homo sapiens
gattcctgtaaatgtgacaa

SEQ ID NO: 2902536 - DNA, 15 bp, Homo sapiens
gattcctttcctgtg

SEQ ID NO: 2902537 - DNA, 12 bp, Homo sapiens
gattcgctgtcc

SEQ ID NO: 2902538 - DNA, 15 bp, Homo sapiens
gattcgctgtcccct

SEQ ID NO: 2902539 - DNA, 18 bp, Homo sapiens
gattcgctgtcccctcag

SEQ ID NO: 2902540 - DNA, 15 bp, Homo sapiens
gattcgcttttggta

SEQ ID NO: 2902541 - DNA, 12 bp, Homo sapiens
gattctaaaatg

SEQ ID NO: 2902542 - DNA, 13 bp, Homo sapiens
gattctaaagatt

SEQ ID NO: 2902543 - DNA, 14 bp, Homo sapiens
gattctaaagattc

SEQ ID NO: 2902544 - DNA, 15 bp, Homo sapiens
gattctaaagattct

SEQ ID NO: 2902545 - DNA, 16 bp, Homo sapiens
gattctaaagattcta

SEQ ID NO: 2902546 - DNA, 20 bp, Homo sapiens
gattctaaagattctatagt

SEQ ID NO: 2902547 - DNA, 19 bp, Homo sapiens
gattctaacatattgccat

SEQ ID NO: 2902548 - DNA, 15 bp, Homo sapiens
gattctaatgatgat

SEQ ID NO: 2902549 - DNA, 21 bp, Homo sapiens
gattctagatcagatgctcca

SEQ ID NO: 2902550 - DNA, 17 bp, Homo sapiens
gattctagcctgcactt

SEQ ID NO: 2902551 - DNA, 15 bp, Homo sapiens
gattctatagttcta

SEQ ID NO: 2902552 - DNA, 18 bp, Homo sapiens
gattctatagttctagac

SEQ ID NO: 2902553 - DNA, 19 bp, Homo sapiens
gattctcctgcctcagctt

SEQ ID NO: 2902554 - DNA, 16 bp, Homo sapiens
gattctctgcccagcc

SEQ ID NO: 2902555 - DNA, 22 bp, Homo sapiens
gattctctggctgtaaggctct

SEQ ID NO: 2902556 - DNA, 13 bp, Homo sapiens
gattctgagagct

SEQ ID NO: 2902557 - DNA, 19 bp, Homo sapiens
gattctgataatgctcact

SEQ ID NO: 2902558 - DNA, 19 bp, Homo sapiens
gattctggacagtcagctc

SEQ ID NO: 2902559 - DNA, 21 bp, Homo sapiens
gattctggacagtcagctctt

SEQ ID NO: 2902560 - DNA, 15 bp, Homo sapiens
gattctgtggaacaa

SEQ ID NO: 2902561 - DNA, 21 bp, Homo sapiens
gattctgtgtcagagcccagc

SEQ ID NO: 2902562 - DNA, 18 bp, Homo sapiens
gattctgttctacttgat

SEQ ID NO: 2902563 - DNA, 20 bp, Homo sapiens
gattcttctgtgtttataaa

SEQ ID NO: 2902564 - DNA, 14 bp, Homo sapiens
gattgaaaactttt

SEQ ID NO: 2902565 - DNA, 19 bp, Homo sapiens
gattgaaaacttttctcag

SEQ ID NO: 2902566 - DNA, 20 bp, Homo sapiens
gattgaaaacttttctcaga

SEQ ID NO: 2902567 - DNA, 16 bp, Homo sapiens
gattgacagctttgct

SEQ ID NO: 2902568 - DNA, 19 bp, Homo sapiens
gattgacagctttgctgct

SEQ ID NO: 2902569 - DNA, 14 bp, Homo sapiens
gattgagaagttca

SEQ ID NO: 2902570 - DNA, 21 bp, Homo sapiens
gattgaggataaaaaggaagg

SEQ ID NO: 2902571 - DNA, 22 bp, Homo sapiens
gattgaggataaaaaggaagga

SEQ ID NO: 2902572 - DNA, 15 bp, Homo sapiens
gattgatttgaagaa

SEQ ID NO: 2902573 - DNA, 14 bp, Homo sapiens
gattgcaatttgca

SEQ ID NO: 2902574 - DNA, 21 bp, Homo sapiens
gattgcaatttgcacaagttt

SEQ ID NO: 2902575 - DNA, 22 bp, Homo sapiens
gattgcaatttgcacaagtttt

SEQ ID NO: 2902576 - DNA, 17 bp, Homo sapiens
gattgctaattgctgtt

SEQ ID NO: 2902577 - DNA, 21 bp, Homo sapiens
gattgctgccccatcagtgct

SEQ ID NO: 2902578 - DNA, 16 bp, Homo sapiens
gattggaaagacagga

SEQ ID NO: 2902579 - DNA, 19 bp, Homo sapiens
gattggaaggagacacaga

SEQ ID NO: 2902580 - DNA, 21 bp, Homo sapiens
gattggaaggagacacagatg

SEQ ID NO: 2902581 - DNA, 13 bp, Homo sapiens
gattggccctgcc

SEQ ID NO: 2902582 - DNA, 16 bp, Homo sapiens
gattggccctgcccct

SEQ ID NO: 2902583 - DNA, 17 bp, Homo sapiens
gattgggcccctgccag

SEQ ID NO: 2902584 - DNA, 18 bp, Homo sapiens
gattgtacgtagccacag

SEQ ID NO: 2902585 - DNA, 17 bp, Homo sapiens
gattgtcagccacctcc

SEQ ID NO: 2902586 - DNA, 19 bp, Homo sapiens
gattgtcctcatttctcca

SEQ ID NO: 2902587 - DNA, 18 bp, Homo sapiens
gattgtttctatacaaat

SEQ ID NO: 2902588 - DNA, 22 bp, Homo sapiens
gattgttttttaaaaatggata

SEQ ID NO: 2902589 - DNA, 20 bp, Homo sapiens
gatttaaaaatgccaaaact

SEQ ID NO: 2902590 - DNA, 16 bp, Homo sapiens
gatttaaacaaacaaa

SEQ ID NO: 2902591 - DNA, 20 bp, Homo sapiens
gatttaagttacaatgtttt

SEQ ID NO: 2902592 - DNA, 16 bp, Homo sapiens
gatttaatagtgttaa

SEQ ID NO: 2902593 - DNA, 19 bp, Homo sapiens
gatttaatagtgttaatca

SEQ ID NO: 2902594 - DNA, 20 bp, Homo sapiens
gatttaatagtgttaatcaa

SEQ ID NO: 2902595 - DNA, 21 bp, Homo sapiens
gatttaatagtgttaatcaat

SEQ ID NO: 2902596 - DNA, 22 bp, Homo sapiens
gatttaatagtgttaatcaatt

SEQ ID NO: 2902597 - DNA, 23 bp, Homo sapiens
gatttaatagtgttaatcaattt

SEQ ID NO: 2902598 - DNA, 20 bp, Homo sapiens
gatttagcaatgctgtgaat

SEQ ID NO: 2902599 - DNA, 21 bp, Homo sapiens
gatttagcaatgctgtgaata

SEQ ID NO: 2902600 - DNA, 20 bp, Homo sapiens
gatttaggagaagccaggaa

SEQ ID NO: 2902601 - DNA, 18 bp, Homo sapiens
gatttatacatacagaga

SEQ ID NO: 2902602 - DNA, 14 bp, Homo sapiens
gatttattgaaatt

SEQ ID NO: 2902603 - DNA, 15 bp, Homo sapiens
gatttatttgtttga

SEQ ID NO: 2902604 - DNA, 23 bp, Homo sapiens
gatttatttttaatatgttgact

SEQ ID NO: 2902605 - DNA, 22 bp, Homo sapiens
gatttcaacatggatacatatt

SEQ ID NO: 2902606 - DNA, 12 bp, Homo sapiens
gatttcagccat

SEQ ID NO: 2902607 - DNA, 19 bp, Homo sapiens
gatttcagtaatgtcttca

SEQ ID NO: 2902608 - DNA, 13 bp, Homo sapiens
gatttcctcctcc

SEQ ID NO: 2902609 - DNA, 23 bp, Homo sapiens
gatttcctcctcccagtgccttc

SEQ ID NO: 2902610 - DNA, 22 bp, Homo sapiens
gatttcctgctttgggaagccg

SEQ ID NO: 2902611 - DNA, 17 bp, Homo sapiens
gatttccttgaatgtgg

SEQ ID NO: 2902612 - DNA, 19 bp, Homo sapiens
gatttcctttatactgtga

SEQ ID NO: 2902613 - DNA, 19 bp, Homo sapiens
gatttctagaaaagcttcc

SEQ ID NO: 2902614 - DNA, 19 bp, Homo sapiens
gatttcttaaatctttctt

SEQ ID NO: 2902615 - DNA, 19 bp, Homo sapiens
gatttcttttcttcctggc

SEQ ID NO: 2902616 - DNA, 19 bp, Homo sapiens
gatttgaagaacatgtgag

SEQ ID NO: 2902617 - DNA, 20 bp, Homo sapiens
gatttgacctcctccctgtt

SEQ ID NO: 2902618 - DNA, 24 bp, Homo sapiens
gatttgatgcttttctctcagcat

SEQ ID NO: 2902619 - DNA, 18 bp, Homo sapiens
gatttgccacatcttaaa

SEQ ID NO: 2902620 - DNA, 23 bp, Homo sapiens
gatttgctcagtgtctggctgca

SEQ ID NO: 2902621 - DNA, 14 bp, Homo sapiens
gatttggttgttta

SEQ ID NO: 2902622 - DNA, 11 bp, Homo sapiens
gatttgtgaac

SEQ ID NO: 2902623 - DNA, 18 bp, Homo sapiens
gatttgttttgaattttg

SEQ ID NO: 2902624 - DNA, 23 bp, Homo sapiens
gattttaaactagatgacctcat

SEQ ID NO: 2902625 - DNA, 14 bp, Homo sapiens
gattttaactctgt

SEQ ID NO: 2902626 - DNA, 15 bp, Homo sapiens
gattttacaaattaa

SEQ ID NO: 2902627 - DNA, 21 bp, Homo sapiens
gattttacaaattaatatttg

SEQ ID NO: 2902628 - DNA, 19 bp, Homo sapiens
gattttaggagctaaggct

SEQ ID NO: 2902629 - DNA, 13 bp, Homo sapiens
gattttatctgtt

SEQ ID NO: 2902630 - DNA, 21 bp, Homo sapiens
gattttatttttgcaaaataa

SEQ ID NO: 2902631 - DNA, 21 bp, Homo sapiens
gattttcttctttgtggtctt

SEQ ID NO: 2902632 - DNA, 20 bp, Homo sapiens
gattttctttaaaagaatgg

SEQ ID NO: 2902633 - DNA, 21 bp, Homo sapiens
gattttggggttgtgttgtca

SEQ ID NO: 2902634 - DNA, 22 bp, Homo sapiens
gattttgtaggttattttatat

SEQ ID NO: 2902635 - DNA, 16 bp, Homo sapiens
gattttgtattgccat

SEQ ID NO: 2902636 - DNA, 18 bp, Homo sapiens
gatttttactgtgtttta

SEQ ID NO: 2902637 - DNA, 20 bp, Homo sapiens
gatttttattaactgctttt

SEQ ID NO: 2902638 - DNA, 19 bp, Homo sapiens
gattttttaaaaaaaatgt

SEQ ID NO: 2902639 - DNA, 23 bp, Homo sapiens
gattttttaaaaaaaatgtgaaa

SEQ ID NO: 2902640 - DNA, 16 bp, Homo sapiens
gattttttgttcttgt

SEQ ID NO: 2902641 - DNA, 20 bp, Homo sapiens
gcaaaaaactcgaggactgt

SEQ ID NO: 2902642 - DNA, 21 bp, Homo sapiens
gcaaaaaagtccaattttaat

SEQ ID NO: 2902643 - DNA, 15 bp, Homo sapiens
gcaaaaacatgtatg

SEQ ID NO: 2902644 - DNA, 22 bp, Homo sapiens
gcaaaaacatgtatgtgcattt

SEQ ID NO: 2902645 - DNA, 12 bp, Homo sapiens
gcaaaaataatt

SEQ ID NO: 2902646 - DNA, 13 bp, Homo sapiens
gcaaaaatgtaaa

SEQ ID NO: 2902647 - DNA, 14 bp, Homo sapiens
gcaaaacttttaaa

SEQ ID NO: 2902648 - DNA, 20 bp, Homo sapiens
gcaaaaggatctttgtggcc

SEQ ID NO: 2902649 - DNA, 21 bp, Homo sapiens
gcaaaaggatctttgtggcca

SEQ ID NO: 2902650 - DNA, 21 bp, Homo sapiens
gcaaaaggcggtgagagagga

SEQ ID NO: 2902651 - DNA, 22 bp, Homo sapiens
gcaaaagtggggctaaatgaag

SEQ ID NO: 2902652 - DNA, 17 bp, Homo sapiens
gcaaaatccaaactgct

SEQ ID NO: 2902653 - DNA, 21 bp, Homo sapiens
gcaaaatccaaactgctgtct

SEQ ID NO: 2902654 - DNA, 23 bp, Homo sapiens
gcaaaatccaaactgctgtctct

SEQ ID NO: 2902655 - DNA, 19 bp, Homo sapiens
gcaaaatccttacttccag

SEQ ID NO: 2902656 - DNA, 21 bp, Homo sapiens
gcaaaatccttacttccagca

SEQ ID NO: 2902657 - DNA, 18 bp, Homo sapiens
gcaaaatcgccataggcc

SEQ ID NO: 2902658 - DNA, 20 bp, Homo sapiens
gcaaaatgatagttttctag

SEQ ID NO: 2902659 - DNA, 13 bp, Homo sapiens
gcaaaatgctctt

SEQ ID NO: 2902660 - DNA, 15 bp, Homo sapiens
gcaaaccacactgga

SEQ ID NO: 2902661 - DNA, 22 bp, Homo sapiens
gcaaaccacactggactccggc

SEQ ID NO: 2902662 - DNA, 15 bp, Homo sapiens
gcaaacccagacggc

SEQ ID NO: 2902663 - DNA, 18 bp, Homo sapiens
gcaaacgctgcctgcccg

SEQ ID NO: 2902664 - DNA, 17 bp, Homo sapiens
gcaaacgctgcctgccg

SEQ ID NO: 2902665 - DNA, 16 bp, Homo sapiens
gcaaacttgtatctga

SEQ ID NO: 2902666 - DNA, 22 bp, Homo sapiens
gcaaactttaacaggttttctt

SEQ ID NO: 2902667 - DNA, 13 bp, Homo sapiens
gcaaagaggcaag

SEQ ID NO: 2902668 - DNA, 19 bp, Homo sapiens
gcaaagatctgtcctcagc

SEQ ID NO: 2902669 - DNA, 20 bp, Homo sapiens
gcaaagatctgtcctcagcc

SEQ ID NO: 2902670 - DNA, 18 bp, Homo sapiens
gcaaagcatcggtcatgt

SEQ ID NO: 2902671 - DNA, 23 bp, Homo sapiens
gcaaagcatcggtcatgtgtgta

SEQ ID NO: 2902672 - DNA, 17 bp, Homo sapiens
gcaaagcgcccacccag

SEQ ID NO: 2902673 - DNA, 19 bp, Homo sapiens
gcaaagcgcccacccaggt

SEQ ID NO: 2902674 - DNA, 16 bp, Homo sapiens
gcaaagctctgtggcc

SEQ ID NO: 2902675 - DNA, 18 bp, Homo sapiens
gcaaaggagacaaagcag

SEQ ID NO: 2902676 - DNA, 21 bp, Homo sapiens
gcaaaggagacaaagcaggag

SEQ ID NO: 2902677 - DNA, 12 bp, Homo sapiens
gcaaaggagccg

SEQ ID NO: 2902678 - DNA, 15 bp, Homo sapiens
gcaaaggcagaggaa

SEQ ID NO: 2902679 - DNA, 12 bp, Homo sapiens
gcaaaggcagtc

SEQ ID NO: 2902680 - DNA, 23 bp, Homo sapiens
gcaaagggcatgggtcgggagag

SEQ ID NO: 2902681 - DNA, 19 bp, Homo sapiens
gcaaaggttccaactgtat

SEQ ID NO: 2902682 - DNA, 21 bp, Homo sapiens
gcaaaggttccaactgtatat

SEQ ID NO: 2902683 - DNA, 12 bp, Homo sapiens
gcaaagtactgt

SEQ ID NO: 2902684 - DNA, 21 bp, Homo sapiens
gcaaagtctccagaagaaaat

SEQ ID NO: 2902685 - DNA, 12 bp, Homo sapiens
gcaaagtgtttt

SEQ ID NO: 2902686 - DNA, 17 bp, Homo sapiens
gcaaagtgttttgtacc

SEQ ID NO: 2902687 - DNA, 19 bp, Homo sapiens
gcaaataatttcctggtgt

SEQ ID NO: 2902688 - DNA, 15 bp, Homo sapiens
gcaaatcagaaactt

SEQ ID NO: 2902689 - DNA, 20 bp, Homo sapiens
gcaaatcagaaacttgtgaa

SEQ ID NO: 2902690 - DNA, 20 bp, Homo sapiens
gcaaatctttctgtaaacag

SEQ ID NO: 2902691 - DNA, 15 bp, Homo sapiens
gcaaatgcattctat

SEQ ID NO: 2902692 - DNA, 21 bp, Homo sapiens
gcaaatgtcagatacaatgta

SEQ ID NO: 2902693 - DNA, 12 bp, Homo sapiens
gcaaatgtgtac

SEQ ID NO: 2902694 - DNA, 16 bp, Homo sapiens
gcaaatgtttaaacat

SEQ ID NO: 2902695 - DNA, 17 bp, Homo sapiens
gcaaatgtttaaacatt

SEQ ID NO: 2902696 - DNA, 16 bp, Homo sapiens
gcaaattcttttgaat

SEQ ID NO: 2902697 - DNA, 17 bp, Homo sapiens
gcaaattcttttgaatt

SEQ ID NO: 2902698 - DNA, 20 bp, Homo sapiens
gcaacaaggtcctctgtcag

SEQ ID NO: 2902699 - DNA, 15 bp, Homo sapiens
gcaacacagcctggg

SEQ ID NO: 2902700 - DNA, 23 bp, Homo sapiens
gcaacacagcctgggccccagct

SEQ ID NO: 2902701 - DNA, 13 bp, Homo sapiens
gcaacagatctgg

SEQ ID NO: 2902702 - DNA, 16 bp, Homo sapiens
gcaacagatctggaac

SEQ ID NO: 2902703 - DNA, 14 bp, Homo sapiens
gcaacattcattgc

SEQ ID NO: 2902704 - DNA, 18 bp, Homo sapiens
gcaaccataagacaaact

SEQ ID NO: 2902705 - DNA, 19 bp, Homo sapiens
gcaacctacctgttgagca

SEQ ID NO: 2902706 - DNA, 22 bp, Homo sapiens
gcaaccttgcatccatctgggc

SEQ ID NO: 2902707 - DNA, 13 bp, Homo sapiens
gcaacgtgttaat

SEQ ID NO: 2902708 - DNA, 19 bp, Homo sapiens
gcaacgtgttaattataaa

SEQ ID NO: 2902709 - DNA, 15 bp, Homo sapiens
gcaactaactaacca

SEQ ID NO: 2902710 - DNA, 21 bp, Homo sapiens
gcaactcgccctgtttggcat

SEQ ID NO: 2902711 - DNA, 14 bp, Homo sapiens
gcaactctggctcc

SEQ ID NO: 2902712 - DNA, 21 bp, Homo sapiens
gcaactctggctccaggcaga

SEQ ID NO: 2902713 - DNA, 15 bp, Homo sapiens
gcaactcttgattat

SEQ ID NO: 2902714 - DNA, 21 bp, Homo sapiens
gcaacttagatctctcctgca

SEQ ID NO: 2902715 - DNA, 19 bp, Homo sapiens
gcaacttgaagaaacgctt

SEQ ID NO: 2902716 - DNA, 17 bp, Homo sapiens
gcaacttttcttggaac

SEQ ID NO: 2902717 - DNA, 19 bp, Homo sapiens
gcaagaaaaaaaaatgcca

SEQ ID NO: 2902718 - DNA, 20 bp, Homo sapiens
gcaagaagtctggccatttt

SEQ ID NO: 2902719 - DNA, 13 bp, Homo sapiens
gcaagagccttgg

SEQ ID NO: 2902720 - DNA, 23 bp, Homo sapiens
gcaagagccttggtgtccacctg

SEQ ID NO: 2902721 - DNA, 13 bp, Homo sapiens
gcaagattaggaa

SEQ ID NO: 2902722 - DNA, 23 bp, Homo sapiens
gcaagattggaaagacaggaaga

SEQ ID NO: 2902723 - DNA, 19 bp, Homo sapiens
gcaagcaaacagggtggcc

SEQ ID NO: 2902724 - DNA, 13 bp, Homo sapiens
gcaagcagaggac

SEQ ID NO: 2902725 - DNA, 14 bp, Homo sapiens
gcaagcagaggacc

SEQ ID NO: 2902726 - DNA, 16 bp, Homo sapiens
gcaagcatgcttgtga

SEQ ID NO: 2902727 - DNA, 17 bp, Homo sapiens
gcaagccatggagtgag

SEQ ID NO: 2902728 - DNA, 17 bp, Homo sapiens
gcaagcccacctcggcc

SEQ ID NO: 2902729 - DNA, 23 bp, Homo sapiens
gcaagccctgttgacacaggtct

SEQ ID NO: 2902730 - DNA, 13 bp, Homo sapiens
gcaagctagaact

SEQ ID NO: 2902731 - DNA, 13 bp, Homo sapiens
gcaagctgggtaa

SEQ ID NO: 2902732 - DNA, 13 bp, Homo sapiens
gcaagctgtgtta

SEQ ID NO: 2902733 - DNA, 10 bp, Homo sapiens
gcaaggaaag

SEQ ID NO: 2902734 - DNA, 20 bp, Homo sapiens
gcaaggaatgactcatgcct

SEQ ID NO: 2902735 - DNA, 15 bp, Homo sapiens
gcaaggattacagaa

SEQ ID NO: 2902736 - DNA, 19 bp, Homo sapiens
gcaaggattacagaaactg

SEQ ID NO: 2902737 - DNA, 23 bp, Homo sapiens
gcaaggcggtggacttgaacttt

SEQ ID NO: 2902738 - DNA, 14 bp, Homo sapiens
gcaaggctgaggtg

SEQ ID NO: 2902739 - DNA, 15 bp, Homo sapiens
gcaagggacaggaag

SEQ ID NO: 2902740 - DNA, 16 bp, Homo sapiens
gcaagggcccagagtg

SEQ ID NO: 2902741 - DNA, 12 bp, Homo sapiens
gcaagggcctgg

SEQ ID NO: 2902742 - DNA, 14 bp, Homo sapiens
gcaagggtgacatc

SEQ ID NO: 2902743 - DNA, 22 bp, Homo sapiens
gcaaggtctcgggggtccggaa

SEQ ID NO: 2902744 - DNA, 17 bp, Homo sapiens
gcaaggtgtccctgcct

SEQ ID NO: 2902745 - DNA, 19 bp, Homo sapiens
gcaaggtgtccctgccttc

SEQ ID NO: 2902746 - DNA, 13 bp, Homo sapiens
gcaaggttccaca

SEQ ID NO: 2902747 - DNA, 17 bp, Homo sapiens
gcaaggttccacagagt

SEQ ID NO: 2902748 - DNA, 21 bp, Homo sapiens
gcaagtcccagacaaggagag

SEQ ID NO: 2902749 - DNA, 15 bp, Homo sapiens
gcaagtccttttgta

SEQ ID NO: 2902750 - DNA, 19 bp, Homo sapiens
gcaagtccttttgtaaagt

SEQ ID NO: 2902751 - DNA, 13 bp, Homo sapiens
gcaagtcttaaca

SEQ ID NO: 2902752 - DNA, 16 bp, Homo sapiens
gcaagtgagaggggag

SEQ ID NO: 2902753 - DNA, 17 bp, Homo sapiens
gcaagtgagaggggagg

SEQ ID NO: 2902754 - DNA, 18 bp, Homo sapiens
gcaagtgagaggggaggg

SEQ ID NO: 2902755 - DNA, 20 bp, Homo sapiens
gcaagtgagtctggtggagg

SEQ ID NO: 2902756 - DNA, 23 bp, Homo sapiens
gcaagtgctgtttgggcaggagt

SEQ ID NO: 2902757 - DNA, 16 bp, Homo sapiens
gcaagtggatgggaat

SEQ ID NO: 2902758 - DNA, 23 bp, Homo sapiens
gcaagtggatgggaatttgtcag

SEQ ID NO: 2902759 - DNA, 13 bp, Homo sapiens
gcaagtgtctgga

SEQ ID NO: 2902760 - DNA, 22 bp, Homo sapiens
gcaagttcaagggctctttctc

SEQ ID NO: 2902761 - DNA, 19 bp, Homo sapiens
gcaataaatctgacccagt

SEQ ID NO: 2902762 - DNA, 21 bp, Homo sapiens
gcaataacttctatattttaa

SEQ ID NO: 2902763 - DNA, 16 bp, Homo sapiens
gcaataataaagtact

SEQ ID NO: 2902764 - DNA, 20 bp, Homo sapiens
gcaataatattttctgtgta

SEQ ID NO: 2902765 - DNA, 13 bp, Homo sapiens
gcaataatgcagt

SEQ ID NO: 2902766 - DNA, 19 bp, Homo sapiens
gcaatacgtttgtgcagaa

SEQ ID NO: 2902767 - DNA, 14 bp, Homo sapiens
gcaatactgcttaa

SEQ ID NO: 2902768 - DNA, 12 bp, Homo sapiens
gcaatagaaaca

SEQ ID NO: 2902769 - DNA, 13 bp, Homo sapiens
gcaatagaaacaa

SEQ ID NO: 2902770 - DNA, 19 bp, Homo sapiens
gcaatagaagtgctcccct

SEQ ID NO: 2902771 - DNA, 13 bp, Homo sapiens
gcaatatgaagtt

SEQ ID NO: 2902772 - DNA, 12 bp, Homo sapiens
gcaatctttgaa

SEQ ID NO: 2902773 - DNA, 22 bp, Homo sapiens
gcaatgtagaggggaaaagaga

SEQ ID NO: 2902774 - DNA, 13 bp, Homo sapiens
gcaatgtgatttt

SEQ ID NO: 2902775 - DNA, 18 bp, Homo sapiens
gcaattatttaaagaaag

SEQ ID NO: 2902776 - DNA, 16 bp, Homo sapiens
gcaattggaataatca

SEQ ID NO: 2902777 - DNA, 18 bp, Homo sapiens
gcaattgtggatcttgag

SEQ ID NO: 2902778 - DNA, 13 bp, Homo sapiens
gcaatttcaaggt

SEQ ID NO: 2902779 - DNA, 18 bp, Homo sapiens
gcaatttcaaggttctaa

SEQ ID NO: 2902780 - DNA, 13 bp, Homo sapiens
gcacaaaacccag

SEQ ID NO: 2902781 - DNA, 20 bp, Homo sapiens
gcacaaaatgatggcagtgg

SEQ ID NO: 2902782 - DNA, 19 bp, Homo sapiens
gcacaaaatggattttagt

SEQ ID NO: 2902783 - DNA, 14 bp, Homo sapiens
gcacaaacacaagg

SEQ ID NO: 2902784 - DNA, 21 bp, Homo sapiens
gcacaaacttgtgagcatcag

SEQ ID NO: 2902785 - DNA, 17 bp, Homo sapiens
gcacaactgttgatggt

SEQ ID NO: 2902786 - DNA, 21 bp, Homo sapiens
gcacaaggccttgcctggcct

SEQ ID NO: 2902787 - DNA, 20 bp, Homo sapiens
gcacaataaaaccaagcctc

SEQ ID NO: 2902788 - DNA, 23 bp, Homo sapiens
gcacaataaaaccaagcctctgg

SEQ ID NO: 2902789 - DNA, 17 bp, Homo sapiens
gcacaatattgaacttt

SEQ ID NO: 2902790 - DNA, 15 bp, Homo sapiens
gcacaatttaaaaca

SEQ ID NO: 2902791 - DNA, 18 bp, Homo sapiens
gcacaatttttttttgtt

SEQ ID NO: 2902792 - DNA, 18 bp, Homo sapiens
gcacacagaggggagtca

SEQ ID NO: 2902793 - DNA, 15 bp, Homo sapiens
gcacacagcggctgc

SEQ ID NO: 2902794 - DNA, 13 bp, Homo sapiens
gcacacagctact

SEQ ID NO: 2902795 - DNA, 21 bp, Homo sapiens
gcacacagggtggtggcacat

SEQ ID NO: 2902796 - DNA, 14 bp, Homo sapiens
gcacacatcaccag

SEQ ID NO: 2902797 - DNA, 18 bp, Homo sapiens
gcacacatcaccaggtgc

SEQ ID NO: 2902798 - DNA, 14 bp, Homo sapiens
gcacacctctggct

SEQ ID NO: 2902799 - DNA, 15 bp, Homo sapiens
gcacacctctggctg

SEQ ID NO: 2902800 - DNA, 19 bp, Homo sapiens
gcacacgcctcccactggg

SEQ ID NO: 2902801 - DNA, 17 bp, Homo sapiens
gcacacggctggtcact

SEQ ID NO: 2902802 - DNA, 20 bp, Homo sapiens
gcacacggctggtcactctg

SEQ ID NO: 2902803 - DNA, 21 bp, Homo sapiens
gcacacggctggtcactctgc

SEQ ID NO: 2902804 - DNA, 16 bp, Homo sapiens
gcacactctggtcttg

SEQ ID NO: 2902805 - DNA, 22 bp, Homo sapiens
gcacactttgccatattttcac

SEQ ID NO: 2902806 - DNA, 16 bp, Homo sapiens
gcacagaagtcctgta

SEQ ID NO: 2902807 - DNA, 18 bp, Homo sapiens
gcacagattcccaggcca

SEQ ID NO: 2902808 - DNA, 20 bp, Homo sapiens
gcacagattcccaggccagg

SEQ ID NO: 2902809 - DNA, 23 bp, Homo sapiens
gcacagattcccaggccagggct

SEQ ID NO: 2902810 - DNA, 13 bp, Homo sapiens
gcacagcaaactg

SEQ ID NO: 2902811 - DNA, 11 bp, Homo sapiens
gcacagccagc

SEQ ID NO: 2902812 - DNA, 13 bp, Homo sapiens
gcacagccagccc

SEQ ID NO: 2902813 - DNA, 22 bp, Homo sapiens
gcacagccagcccaaaccttgg

SEQ ID NO: 2902814 - DNA, 13 bp, Homo sapiens
gcacagctcccgg

SEQ ID NO: 2902815 - DNA, 11 bp, Homo sapiens
gcacagctcct

SEQ ID NO: 2902816 - DNA, 21 bp, Homo sapiens
gcacaggacatgcggtagcca

SEQ ID NO: 2902817 - DNA, 18 bp, Homo sapiens
gcacagggtttggcccaa

SEQ ID NO: 2902818 - DNA, 23 bp, Homo sapiens
gcacaggtcaggggtgacacaga

SEQ ID NO: 2902819 - DNA, 14 bp, Homo sapiens
gcacagtccacagc

SEQ ID NO: 2902820 - DNA, 22 bp, Homo sapiens
gcacagtggcgcatgcctgtaa

SEQ ID NO: 2902821 - DNA, 22 bp, Homo sapiens
gcacagtggtggcagggcctag

SEQ ID NO: 2902822 - DNA, 16 bp, Homo sapiens
gcacatactacctaga

SEQ ID NO: 2902823 - DNA, 22 bp, Homo sapiens
gcacatactacctagaagtaag

SEQ ID NO: 2902824 - DNA, 20 bp, Homo sapiens
gcacatagtgggccttcatt

SEQ ID NO: 2902825 - DNA, 16 bp, Homo sapiens
gcacatatacacacac

SEQ ID NO: 2902826 - DNA, 17 bp, Homo sapiens
gcacatatacacacaca

SEQ ID NO: 2902827 - DNA, 18 bp, Homo sapiens
gcacatatggactctgca

SEQ ID NO: 2902828 - DNA, 13 bp, Homo sapiens
gcacatcacctct

SEQ ID NO: 2902829 - DNA, 13 bp, Homo sapiens
gcacatccctgga

SEQ ID NO: 2902830 - DNA, 20 bp, Homo sapiens
gcacatctggatgccttccc

SEQ ID NO: 2902831 - DNA, 14 bp, Homo sapiens
gcacatctgtcctg

SEQ ID NO: 2902832 - DNA, 13 bp, Homo sapiens
gcacatgtcttgt

SEQ ID NO: 2902833 - DNA, 20 bp, Homo sapiens
gcacatgtcttgtacatgtg

SEQ ID NO: 2902834 - DNA, 21 bp, Homo sapiens
gcacatgtcttgtacatgtgt

SEQ ID NO: 2902835 - DNA, 13 bp, Homo sapiens
gcacattaactgt

SEQ ID NO: 2902836 - DNA, 18 bp, Homo sapiens
gcacattttgacacaatg

SEQ ID NO: 2902837 - DNA, 13 bp, Homo sapiens
gcaccaccatgcc

SEQ ID NO: 2902838 - DNA, 14 bp, Homo sapiens
gcaccacggccaga

SEQ ID NO: 2902839 - DNA, 17 bp, Homo sapiens
gcaccactgcactccag

SEQ ID NO: 2902840 - DNA, 20 bp, Homo sapiens
gcaccactgcactccagcct

SEQ ID NO: 2902841 - DNA, 21 bp, Homo sapiens
gcaccactgcactccagcctg

SEQ ID NO: 2902842 - DNA, 15 bp, Homo sapiens
gcaccagacacccag

SEQ ID NO: 2902843 - DNA, 19 bp, Homo sapiens
gcaccagacacccaggact

SEQ ID NO: 2902844 - DNA, 21 bp, Homo sapiens
gcaccagacacccaggactta

SEQ ID NO: 2902845 - DNA, 17 bp, Homo sapiens
gcaccagcgaagggagt

SEQ ID NO: 2902846 - DNA, 20 bp, Homo sapiens
gcaccaggcacgaacccacc

SEQ ID NO: 2902847 - DNA, 21 bp, Homo sapiens
gcaccaggcacgaacccacct

SEQ ID NO: 2902848 - DNA, 23 bp, Homo sapiens
gcaccaggcacgaacccacctgc

SEQ ID NO: 2902849 - DNA, 22 bp, Homo sapiens
gcaccagggactcggcccaggg

SEQ ID NO: 2902850 - DNA, 23 bp, Homo sapiens
gcaccagggttgaccccagagga

SEQ ID NO: 2902851 - DNA, 17 bp, Homo sapiens
gcaccatccgccagggc

SEQ ID NO: 2902852 - DNA, 18 bp, Homo sapiens
gcaccatccgccagggcc

SEQ ID NO: 2902853 - DNA, 22 bp, Homo sapiens
gcaccattgctgctccttagct

SEQ ID NO: 2902854 - DNA, 17 bp, Homo sapiens
gcacccaagacctcagg

SEQ ID NO: 2902855 - DNA, 21 bp, Homo sapiens
gcacccaagacctcagggcac

SEQ ID NO: 2902856 - DNA, 13 bp, Homo sapiens
gcacccaccctgg

SEQ ID NO: 2902857 - DNA, 12 bp, Homo sapiens
gcacccagaaca

SEQ ID NO: 2902858 - DNA, 20 bp, Homo sapiens
gcacccaggaggggaacact

SEQ ID NO: 2902859 - DNA, 17 bp, Homo sapiens
gcaccccatgctgttga

SEQ ID NO: 2902860 - DNA, 12 bp, Homo sapiens
gcacccctggaa

SEQ ID NO: 2902861 - DNA, 19 bp, Homo sapiens
gcaccctcttctcctctgg

SEQ ID NO: 2902862 - DNA, 21 bp, Homo sapiens
gcaccctcttctcctctggct

SEQ ID NO: 2902863 - DNA, 18 bp, Homo sapiens
gcaccctgccctcatggg

SEQ ID NO: 2902864 - DNA, 15 bp, Homo sapiens
gcaccctggcctggt

SEQ ID NO: 2902865 - DNA, 16 bp, Homo sapiens
gcaccctggcctggtc

SEQ ID NO: 2902866 - DNA, 19 bp, Homo sapiens
gcaccgaccccgggccgga

SEQ ID NO: 2902867 - DNA, 19 bp, Homo sapiens
gcaccgacccgaggcccag

SEQ ID NO: 2902868 - DNA, 14 bp, Homo sapiens
gcaccgcctgccct

SEQ ID NO: 2902869 - DNA, 21 bp, Homo sapiens
gcaccgcctgccctcccgcac

SEQ ID NO: 2902870 - DNA, 15 bp, Homo sapiens
gcaccgggctggctg

SEQ ID NO: 2902871 - DNA, 17 bp, Homo sapiens
gcaccgggctggctgct

SEQ ID NO: 2902872 - DNA, 14 bp, Homo sapiens
gcaccggggcctgg

SEQ ID NO: 2902873 - DNA, 22 bp, Homo sapiens
gcacctaatccaggcagatcca

SEQ ID NO: 2902874 - DNA, 23 bp, Homo sapiens
gcacctaatccaggcagatccag

SEQ ID NO: 2902875 - DNA, 13 bp, Homo sapiens
gcacctcagcctg

SEQ ID NO: 2902876 - DNA, 15 bp, Homo sapiens
gcacctccacgccac

SEQ ID NO: 2902877 - DNA, 14 bp, Homo sapiens
gcacctcccatcct

SEQ ID NO: 2902878 - DNA, 13 bp, Homo sapiens
gcacctcccccca

SEQ ID NO: 2902879 - DNA, 23 bp, Homo sapiens
gcacctccccccactgcaggccc

SEQ ID NO: 2902880 - DNA, 21 bp, Homo sapiens
gcacctgaccgctgcccaggt

SEQ ID NO: 2902881 - DNA, 19 bp, Homo sapiens
gcacctgcaatcccagcta

SEQ ID NO: 2902882 - DNA, 16 bp, Homo sapiens
gcacctgccagaggat

SEQ ID NO: 2902883 - DNA, 18 bp, Homo sapiens
gcacctgccagaggatgc

SEQ ID NO: 2902884 - DNA, 18 bp, Homo sapiens
gcacctgcctagctcttg

SEQ ID NO: 2902885 - DNA, 18 bp, Homo sapiens
gcacctgcctcagctacc

SEQ ID NO: 2902886 - DNA, 14 bp, Homo sapiens
gcacctgcctcagg

SEQ ID NO: 2902887 - DNA, 16 bp, Homo sapiens
gcacctgcgcacaggt

SEQ ID NO: 2902888 - DNA, 19 bp, Homo sapiens
gcacctggaccccctgccc

SEQ ID NO: 2902889 - DNA, 12 bp, Homo sapiens
gcacctgtacag

SEQ ID NO: 2902890 - DNA, 13 bp, Homo sapiens
gcacctgtacagt

SEQ ID NO: 2902891 - DNA, 16 bp, Homo sapiens
gcacctgtagtcccag

SEQ ID NO: 2902892 - DNA, 20 bp, Homo sapiens
gcacctgtcggtggctgcct

SEQ ID NO: 2902893 - DNA, 17 bp, Homo sapiens
gcaccttcctcctcccc

SEQ ID NO: 2902894 - DNA, 14 bp, Homo sapiens
gcaccttgctgcag

SEQ ID NO: 2902895 - DNA, 17 bp, Homo sapiens
gcaccttgctgcagtgt

SEQ ID NO: 2902896 - DNA, 22 bp, Homo sapiens
gcaccttggcccaggagctctg

SEQ ID NO: 2902897 - DNA, 15 bp, Homo sapiens
gcaccttgtgcctgg

SEQ ID NO: 2902898 - DNA, 20 bp, Homo sapiens
gcaccttgtgtctgtacacg

SEQ ID NO: 2902899 - DNA, 14 bp, Homo sapiens
gcacgcacctgtag

SEQ ID NO: 2902900 - DNA, 15 bp, Homo sapiens
gcacgcacctgtagt

SEQ ID NO: 2902901 - DNA, 16 bp, Homo sapiens
gcacgcacctgtagtc

SEQ ID NO: 2902902 - DNA, 21 bp, Homo sapiens
gcacgcctgccatcttctccc

SEQ ID NO: 2902903 - DNA, 21 bp, Homo sapiens
gcacgcggcagcacctctgag

SEQ ID NO: 2902904 - DNA, 23 bp, Homo sapiens
gcacggccccgaagggcccccac

SEQ ID NO: 2902905 - DNA, 21 bp, Homo sapiens
gcacggcccggcccctcaccc

SEQ ID NO: 2902906 - DNA, 18 bp, Homo sapiens
gcacggtgactctgtcca

SEQ ID NO: 2902907 - DNA, 14 bp, Homo sapiens
gcacggttcaatgg

SEQ ID NO: 2902908 - DNA, 18 bp, Homo sapiens
gcacggttcaatggtaga

SEQ ID NO: 2902909 - DNA, 17 bp, Homo sapiens
gcacggtttctgttctg

SEQ ID NO: 2902910 - DNA, 20 bp, Homo sapiens
gcacggtttctgttctgccc

SEQ ID NO: 2902911 - DNA, 16 bp, Homo sapiens
gcacgttgctgccagt

SEQ ID NO: 2902912 - DNA, 15 bp, Homo sapiens
gcacgttgcttcagg

SEQ ID NO: 2902913 - DNA, 20 bp, Homo sapiens
gcactagaagtggtttcctg

SEQ ID NO: 2902914 - DNA, 14 bp, Homo sapiens
gcactcaggctctc

SEQ ID NO: 2902915 - DNA, 17 bp, Homo sapiens
gcactcaggctctccat

SEQ ID NO: 2902916 - DNA, 20 bp, Homo sapiens
gcactccaacctaacctgtg

SEQ ID NO: 2902917 - DNA, 12 bp, Homo sapiens
gcactccagcct

SEQ ID NO: 2902918 - DNA, 13 bp, Homo sapiens
gcactccagcctg

SEQ ID NO: 2902919 - DNA, 14 bp, Homo sapiens
gcactccagcctga

SEQ ID NO: 2902920 - DNA, 18 bp, Homo sapiens
gcactccagcctgggtca

SEQ ID NO: 2902921 - DNA, 12 bp, Homo sapiens
gcactcccccag

SEQ ID NO: 2902922 - DNA, 15 bp, Homo sapiens
gcactcccccaggat

SEQ ID NO: 2902923 - DNA, 13 bp, Homo sapiens
gcactcccgggat

SEQ ID NO: 2902924 - DNA, 13 bp, Homo sapiens
gcactccctggcc

SEQ ID NO: 2902925 - DNA, 12 bp, Homo sapiens
gcactcctgatt

SEQ ID NO: 2902926 - DNA, 13 bp, Homo sapiens
gcactctagattc

SEQ ID NO: 2902927 - DNA, 23 bp, Homo sapiens
gcactctcaccccaagcggcctt

SEQ ID NO: 2902928 - DNA, 16 bp, Homo sapiens
gcactctcctgtctga

SEQ ID NO: 2902929 - DNA, 14 bp, Homo sapiens
gcactctgttattt

SEQ ID NO: 2902930 - DNA, 18 bp, Homo sapiens
gcactgaagtttttgaaa

SEQ ID NO: 2902931 - DNA, 20 bp, Homo sapiens
gcactgaagtttttgaaata

SEQ ID NO: 2902932 - DNA, 23 bp, Homo sapiens
gcactgaagtttttgaaatacct

SEQ ID NO: 2902933 - DNA, 18 bp, Homo sapiens
gcactgatgctgcccctc

SEQ ID NO: 2902934 - DNA, 22 bp, Homo sapiens
gcactgatgctgcccctcatct

SEQ ID NO: 2902935 - DNA, 14 bp, Homo sapiens
gcactgccactggg

SEQ ID NO: 2902936 - DNA, 19 bp, Homo sapiens
gcactggaaccacctggac

SEQ ID NO: 2902937 - DNA, 17 bp, Homo sapiens
gcactggagccacaggc

SEQ ID NO: 2902938 - DNA, 22 bp, Homo sapiens
gcactggagctgggaggtctcg

SEQ ID NO: 2902939 - DNA, 22 bp, Homo sapiens
gcactgggcgtctgactccctc

SEQ ID NO: 2902940 - DNA, 23 bp, Homo sapiens
gcactgggcgtctgactccctcc

SEQ ID NO: 2902941 - DNA, 23 bp, Homo sapiens
gcactgtcccagtagccaaggcc

SEQ ID NO: 2902942 - DNA, 11 bp, Homo sapiens
gcactgtgaag

SEQ ID NO: 2902943 - DNA, 18 bp, Homo sapiens
gcactgtgaaggaccctt

SEQ ID NO: 2902944 - DNA, 18 bp, Homo sapiens
gcactgtgaatcctggca

SEQ ID NO: 2902945 - DNA, 19 bp, Homo sapiens
gcactgtgaatcctggcaa

SEQ ID NO: 2902946 - DNA, 22 bp, Homo sapiens
gcactgtgccccgcgggctttg

SEQ ID NO: 2902947 - DNA, 19 bp, Homo sapiens
gcactgtgttcacactttt

SEQ ID NO: 2902948 - DNA, 14 bp, Homo sapiens
gcactgtttttcca

SEQ ID NO: 2902949 - DNA, 23 bp, Homo sapiens
gcacttaaacagaagcagaggct

SEQ ID NO: 2902950 - DNA, 13 bp, Homo sapiens
gcacttaatatta

SEQ ID NO: 2902951 - DNA, 21 bp, Homo sapiens
gcacttaatattagcttgctt

SEQ ID NO: 2902952 - DNA, 22 bp, Homo sapiens
gcacttaatattagcttgctta

SEQ ID NO: 2902953 - DNA, 18 bp, Homo sapiens
gcacttaccgccctgcgg

SEQ ID NO: 2902954 - DNA, 18 bp, Homo sapiens
gcacttatttaatgccga

SEQ ID NO: 2902955 - DNA, 18 bp, Homo sapiens
gcacttcatctggctgcc

SEQ ID NO: 2902956 - DNA, 23 bp, Homo sapiens
gcacttcatctggctgcctttgc

SEQ ID NO: 2902957 - DNA, 23 bp, Homo sapiens
gcacttcattgagagttttgtct

SEQ ID NO: 2902958 - DNA, 11 bp, Homo sapiens
gcacttccctg

SEQ ID NO: 2902959 - DNA, 13 bp, Homo sapiens
gcacttccctgct

SEQ ID NO: 2902960 - DNA, 14 bp, Homo sapiens
gcacttcctcccct

SEQ ID NO: 2902961 - DNA, 19 bp, Homo sapiens
gcacttcctcccctcgccc

SEQ ID NO: 2902962 - DNA, 16 bp, Homo sapiens
gcacttgcagaggagc

SEQ ID NO: 2902963 - DNA, 20 bp, Homo sapiens
gcacttgcagaggagcccag

SEQ ID NO: 2902964 - DNA, 23 bp, Homo sapiens
gcacttgcagaggagcccagtgg

SEQ ID NO: 2902965 - DNA, 15 bp, Homo sapiens
gcacttgcctgggtc

SEQ ID NO: 2902966 - DNA, 17 bp, Homo sapiens
gcacttgtgattattta

SEQ ID NO: 2902967 - DNA, 23 bp, Homo sapiens
gcacttgtgattatttattattt

SEQ ID NO: 2902968 - DNA, 20 bp, Homo sapiens
gcactttagtgattgctttt

SEQ ID NO: 2902969 - DNA, 19 bp, Homo sapiens
gcactttagtgtattttct

SEQ ID NO: 2902970 - DNA, 21 bp, Homo sapiens
gcactttgagaggctgaggtg

SEQ ID NO: 2902971 - DNA, 14 bp, Homo sapiens
gcactttgggaggc

SEQ ID NO: 2902972 - DNA, 15 bp, Homo sapiens
gcactttgtaaattc

SEQ ID NO: 2902973 - DNA, 11 bp, Homo sapiens
gcagaaaaaaa

SEQ ID NO: 2902974 - DNA, 16 bp, Homo sapiens
gcagaaaagcacctgc

SEQ ID NO: 2902975 - DNA, 16 bp, Homo sapiens
gcagaaaccttgtttg

SEQ ID NO: 2902976 - DNA, 21 bp, Homo sapiens
gcagaaaggaaaagattcctg

SEQ ID NO: 2902977 - DNA, 18 bp, Homo sapiens
gcagaaataggttagagt

SEQ ID NO: 2902978 - DNA, 15 bp, Homo sapiens
gcagaacacctggcc

SEQ ID NO: 2902979 - DNA, 14 bp, Homo sapiens
gcagaacagccatt

SEQ ID NO: 2902980 - DNA, 15 bp, Homo sapiens
gcagaactgctgggg

SEQ ID NO: 2902981 - DNA, 13 bp, Homo sapiens
gcagaagaaagga

SEQ ID NO: 2902982 - DNA, 15 bp, Homo sapiens
gcagaagaaaggaac

SEQ ID NO: 2902983 - DNA, 16 bp, Homo sapiens
gcagaagaaaggaaca

SEQ ID NO: 2902984 - DNA, 15 bp, Homo sapiens
gcagaagaatctttc

SEQ ID NO: 2902985 - DNA, 12 bp, Homo sapiens
gcagaagagggt

SEQ ID NO: 2902986 - DNA, 14 bp, Homo sapiens
gcagaagagggtgt

SEQ ID NO: 2902987 - DNA, 16 bp, Homo sapiens
gcagaagagggtgtgt

SEQ ID NO: 2902988 - DNA, 15 bp, Homo sapiens
gcagaagcaataata

SEQ ID NO: 2902989 - DNA, 22 bp, Homo sapiens
gcagaaggacaggtctctgaga

SEQ ID NO: 2902990 - DNA, 15 bp, Homo sapiens
gcagaaggagagtga

SEQ ID NO: 2902991 - DNA, 13 bp, Homo sapiens
gcagaatcctggg

SEQ ID NO: 2902992 - DNA, 14 bp, Homo sapiens
gcagaatcctgggc

SEQ ID NO: 2902993 - DNA, 17 bp, Homo sapiens
gcagaatggaggcaggg

SEQ ID NO: 2902994 - DNA, 17 bp, Homo sapiens
gcagaattttaatgtga

SEQ ID NO: 2902995 - DNA, 15 bp, Homo sapiens
gcagacagaagtgta

SEQ ID NO: 2902996 - DNA, 12 bp, Homo sapiens
gcagacctctgg

SEQ ID NO: 2902997 - DNA, 14 bp, Homo sapiens
gcagaccttactca

SEQ ID NO: 2902998 - DNA, 16 bp, Homo sapiens
gcagactgcttggcca

SEQ ID NO: 2902999 - DNA, 23 bp, Homo sapiens
gcagactgtgtaaaatgtaatgc

SEQ ID NO: 2903000 - DNA, 13 bp, Homo sapiens
gcagagaaagaaa

SEQ ID NO: 2903001 - DNA, 12 bp, Homo sapiens
gcagagaatata

SEQ ID NO: 2903002 - DNA, 17 bp, Homo sapiens
gcagagaggtggccacc

SEQ ID NO: 2903003 - DNA, 14 bp, Homo sapiens
gcagagataaataa

SEQ ID NO: 2903004 - DNA, 16 bp, Homo sapiens
gcagagcccaagggaa

SEQ ID NO: 2903005 - DNA, 23 bp, Homo sapiens
ctctgcctctaactccctcctca

SEQ ID NO: 2903006 - DNA, 12 bp, Homo sapiens
ctctgcctgcac

SEQ ID NO: 2903007 - DNA, 21 bp, Homo sapiens
ctctgcctgcactccctggcc

SEQ ID NO: 2903008 - DNA, 24 bp, Homo sapiens
ctctgcctgcactccctggccttg

SEQ ID NO: 2903009 - DNA, 14 bp, Homo sapiens
ctctgcctgctggg

SEQ ID NO: 2903010 - DNA, 18 bp, Homo sapiens
ctctgcctgctgggctct

SEQ ID NO: 2903011 - DNA, 17 bp, Homo sapiens
ctctgcctggagcaggg

SEQ ID NO: 2903012 - DNA, 11 bp, Homo sapiens
ctctgcctggg

SEQ ID NO: 2903013 - DNA, 13 bp, Homo sapiens
ctctgccttgcct

SEQ ID NO: 2903014 - DNA, 23 bp, Homo sapiens
ctctgccttgcctttagcccctc

SEQ ID NO: 2903015 - DNA, 22 bp, Homo sapiens
ctctgcctttgcaccacgggac

SEQ ID NO: 2903016 - DNA, 23 bp, Homo sapiens
ctctgcctttgcaccacgggaca

SEQ ID NO: 2903017 - DNA, 13 bp, Homo sapiens
ctctgcgccaggc

SEQ ID NO: 2903018 - DNA, 20 bp, Homo sapiens
ctctgcgccaggcagagctg

SEQ ID NO: 2903019 - DNA, 20 bp, Homo sapiens
ctctgcggatagcatttggt

SEQ ID NO: 2903020 - DNA, 15 bp, Homo sapiens
ctctgcggcccgggc

SEQ ID NO: 2903021 - DNA, 22 bp, Homo sapiens
ctctgcgtgtcacctgtgcttc

SEQ ID NO: 2903022 - DNA, 15 bp, Homo sapiens
ctctgctgctgcccg

SEQ ID NO: 2903023 - DNA, 21 bp, Homo sapiens
ctctgcttccatggcttcctg

SEQ ID NO: 2903024 - DNA, 22 bp, Homo sapiens
ctctgcttccatggcttcctga

SEQ ID NO: 2903025 - DNA, 13 bp, Homo sapiens
ctctgcttcccag

SEQ ID NO: 2903026 - DNA, 18 bp, Homo sapiens
ctctgcttctcggggtcc

SEQ ID NO: 2903027 - DNA, 13 bp, Homo sapiens
ctctgctttctga

SEQ ID NO: 2903028 - DNA, 13 bp, Homo sapiens
ctctggaaagaaa

SEQ ID NO: 2903029 - DNA, 19 bp, Homo sapiens
ctctggaccaaggagcatc

SEQ ID NO: 2903030 - DNA, 14 bp, Homo sapiens
ctctggagcccctc

SEQ ID NO: 2903031 - DNA, 24 bp, Homo sapiens
ctctggatcccgttcagaaaacca

SEQ ID NO: 2903032 - DNA, 17 bp, Homo sapiens
ctctggatctagaaggg

SEQ ID NO: 2903033 - DNA, 13 bp, Homo sapiens
ctctggcatttgt

SEQ ID NO: 2903034 - DNA, 16 bp, Homo sapiens
ctctggcgacagtttt

SEQ ID NO: 2903035 - DNA, 23 bp, Homo sapiens
ctctggcggtggccacagcgtgc

SEQ ID NO: 2903036 - DNA, 20 bp, Homo sapiens
ctctggctcagctgtggtcc

SEQ ID NO: 2903037 - DNA, 23 bp, Homo sapiens
ctctggctcagctgtggtcccac

SEQ ID NO: 2903038 - DNA, 16 bp, Homo sapiens
ctctggctccaggcag

SEQ ID NO: 2903039 - DNA, 16 bp, Homo sapiens
ctctggctctacgttt

SEQ ID NO: 2903040 - DNA, 11 bp, Homo sapiens
ctctggctctg

SEQ ID NO: 2903041 - DNA, 14 bp, Homo sapiens
ctctggctctgttc

SEQ ID NO: 2903042 - DNA, 19 bp, Homo sapiens
ctctggctgtaaggctcta

SEQ ID NO: 2903043 - DNA, 14 bp, Homo sapiens
ctctggcttggcct

SEQ ID NO: 2903044 - DNA, 11 bp, Homo sapiens
ctctgggcagg

SEQ ID NO: 2903045 - DNA, 20 bp, Homo sapiens
ctctgggccgggcctggggc

SEQ ID NO: 2903046 - DNA, 20 bp, Homo sapiens
ctctgggtcagtggtccaca

SEQ ID NO: 2903047 - DNA, 16 bp, Homo sapiens
ctctgggtcccggggt

SEQ ID NO: 2903048 - DNA, 23 bp, Homo sapiens
ctctgggtttacaacaaacactg

SEQ ID NO: 2903049 - DNA, 13 bp, Homo sapiens
ctctggtgcctcc

SEQ ID NO: 2903050 - DNA, 14 bp, Homo sapiens
ctctggtgcctcca

SEQ ID NO: 2903051 - DNA, 18 bp, Homo sapiens
ctctggtgcctccagagg

SEQ ID NO: 2903052 - DNA, 13 bp, Homo sapiens
ctctgtaaaagtg

SEQ ID NO: 2903053 - DNA, 23 bp, Homo sapiens
ctctgtaaccacctctctgtctt

SEQ ID NO: 2903054 - DNA, 19 bp, Homo sapiens
ctctgtaagatatcccagc

SEQ ID NO: 2903055 - DNA, 12 bp, Homo sapiens
ctctgtactttt

SEQ ID NO: 2903056 - DNA, 20 bp, Homo sapiens
ctctgtatattgggctcaga

SEQ ID NO: 2903057 - DNA, 21 bp, Homo sapiens
ctctgtatattgggctcagag

SEQ ID NO: 2903058 - DNA, 22 bp, Homo sapiens
ctctgtatcaggacccagagga

SEQ ID NO: 2903059 - DNA, 15 bp, Homo sapiens
ctctgtcaccctggc

SEQ ID NO: 2903060 - DNA, 16 bp, Homo sapiens
ctctgtcaccctggcc

SEQ ID NO: 2903061 - DNA, 14 bp, Homo sapiens
ctctgtcagtgtga

SEQ ID NO: 2903062 - DNA, 21 bp, Homo sapiens
ctctgtccacttgtgggtcct

SEQ ID NO: 2903063 - DNA, 23 bp, Homo sapiens
ctctgtccccacgaggggaccca

SEQ ID NO: 2903064 - DNA, 13 bp, Homo sapiens
ctctgtccccagg

SEQ ID NO: 2903065 - DNA, 15 bp, Homo sapiens
ctctgtcccttgctg

SEQ ID NO: 2903066 - DNA, 17 bp, Homo sapiens
ctctgtcctgttaggcc

SEQ ID NO: 2903067 - DNA, 20 bp, Homo sapiens
ctctgtctagcatgccaaca

SEQ ID NO: 2903068 - DNA, 15 bp, Homo sapiens
ctctgtctcatccat

SEQ ID NO: 2903069 - DNA, 16 bp, Homo sapiens
ctctgtctctgtggaa

SEQ ID NO: 2903070 - DNA, 15 bp, Homo sapiens
ctctgtctgtctctc

SEQ ID NO: 2903071 - DNA, 16 bp, Homo sapiens
ctctgtctgtcttctc

SEQ ID NO: 2903072 - DNA, 18 bp, Homo sapiens
ctctgtcttctctccact

SEQ ID NO: 2903073 - DNA, 14 bp, Homo sapiens
ctctgtcttctgga

SEQ ID NO: 2903074 - DNA, 14 bp, Homo sapiens
ctctgtctttttcc

SEQ ID NO: 2903075 - DNA, 20 bp, Homo sapiens
ctctgtctttttccttcctg

SEQ ID NO: 2903076 - DNA, 14 bp, Homo sapiens
ctctgtgaccaatg

SEQ ID NO: 2903077 - DNA, 23 bp, Homo sapiens
ctctgtgacccacttctcatcac

SEQ ID NO: 2903078 - DNA, 14 bp, Homo sapiens
ctctgtgccttggt

SEQ ID NO: 2903079 - DNA, 22 bp, Homo sapiens
ctctgtggaaaagccatctcag

SEQ ID NO: 2903080 - DNA, 13 bp, Homo sapiens
ctctgtggggctg

SEQ ID NO: 2903081 - DNA, 16 bp, Homo sapiens
ctctgtgggtctctgg

SEQ ID NO: 2903082 - DNA, 21 bp, Homo sapiens
ctctgtggtggttcattccac

SEQ ID NO: 2903083 - DNA, 13 bp, Homo sapiens
ctctgtggtgtct

SEQ ID NO: 2903084 - DNA, 22 bp, Homo sapiens
ctctgtgtaaccagctcagtgt

SEQ ID NO: 2903085 - DNA, 14 bp, Homo sapiens
ctctgtgtatttat

SEQ ID NO: 2903086 - DNA, 17 bp, Homo sapiens
ctctgtgtatttatata

SEQ ID NO: 2903087 - DNA, 18 bp, Homo sapiens
ctctgtgtatttatataa

SEQ ID NO: 2903088 - DNA, 20 bp, Homo sapiens
ctctgtgtatttatataaaa

SEQ ID NO: 2903089 - DNA, 18 bp, Homo sapiens
ctctgtgtctaagattct

SEQ ID NO: 2903090 - DNA, 19 bp, Homo sapiens
ctctgtgtctaagattcta

SEQ ID NO: 2903091 - DNA, 22 bp, Homo sapiens
ctctgtgtctaagattctagat

SEQ ID NO: 2903092 - DNA, 23 bp, Homo sapiens
ctctgtgtctaagattctagatc

SEQ ID NO: 2903093 - DNA, 22 bp, Homo sapiens
ctctgttatcagctgggcagtg

SEQ ID NO: 2903094 - DNA, 15 bp, Homo sapiens
ctctgttcagtgtaa

SEQ ID NO: 2903095 - DNA, 15 bp, Homo sapiens
ctctgttccatgtct

SEQ ID NO: 2903096 - DNA, 15 bp, Homo sapiens
ctctgttcctcaatg

SEQ ID NO: 2903097 - DNA, 16 bp, Homo sapiens
ctctgttgaatattta

SEQ ID NO: 2903098 - DNA, 17 bp, Homo sapiens
ctctgttgactggctgt

SEQ ID NO: 2903099 - DNA, 19 bp, Homo sapiens
ctctgttgactggctgtgt

SEQ ID NO: 2903100 - DNA, 16 bp, Homo sapiens
ctctgttgatctaccc

SEQ ID NO: 2903101 - DNA, 23 bp, Homo sapiens
ctctgttgatctacccgtgcctg

SEQ ID NO: 2903102 - DNA, 20 bp, Homo sapiens
ctctgttgcccaggctggag

SEQ ID NO: 2903103 - DNA, 11 bp, Homo sapiens
ctctgttgcct

SEQ ID NO: 2903104 - DNA, 13 bp, Homo sapiens
ctctgttgcctcc

SEQ ID NO: 2903105 - DNA, 17 bp, Homo sapiens
ctctgttgcctcctctc

SEQ ID NO: 2903106 - DNA, 19 bp, Homo sapiens
ctctgttgcctcctctctc

SEQ ID NO: 2903107 - DNA, 19 bp, Homo sapiens
ctctgtttagtaaatacat

SEQ ID NO: 2903108 - DNA, 16 bp, Homo sapiens
ctctgtttgcttttga

SEQ ID NO: 2903109 - DNA, 21 bp, Homo sapiens
ctcttaaatctcttaaactct

SEQ ID NO: 2903110 - DNA, 19 bp, Homo sapiens
ctcttaacttaccattcct

SEQ ID NO: 2903111 - DNA, 21 bp, Homo sapiens
ctcttaagccatcttggtaaa

SEQ ID NO: 2903112 - DNA, 22 bp, Homo sapiens
ctcttaagccatcttggtaaat

SEQ ID NO: 2903113 - DNA, 15 bp, Homo sapiens
ctcttacttccccca

SEQ ID NO: 2903114 - DNA, 23 bp, Homo sapiens
ctgaactaagttttgtgtgtata

SEQ ID NO: 2903115 - DNA, 13 bp, Homo sapiens
ctgaactagagct

SEQ ID NO: 2903116 - DNA, 18 bp, Homo sapiens
ctgaactgaggccttgtg

SEQ ID NO: 2903117 - DNA, 15 bp, Homo sapiens
ctgaactgtgtgtaa

SEQ ID NO: 2903118 - DNA, 21 bp, Homo sapiens
ctgaactgttaagaaatctgt

SEQ ID NO: 2903119 - DNA, 14 bp, Homo sapiens
ctgaactttgaaga

SEQ ID NO: 2903120 - DNA, 21 bp, Homo sapiens
ctgaactttgggaagccttta

SEQ ID NO: 2903121 - DNA, 15 bp, Homo sapiens
ctgaagaaccagtcc

SEQ ID NO: 2903122 - DNA, 23 bp, Homo sapiens
ctgaagacaccgttcattcaggc

SEQ ID NO: 2903123 - DNA, 14 bp, Homo sapiens
ctgaagacctacca

SEQ ID NO: 2903124 - DNA, 14 bp, Homo sapiens
ctgaagagcaaggt

SEQ ID NO: 2903125 - DNA, 14 bp, Homo sapiens
ctgaagagtcctct

SEQ ID NO: 2903126 - DNA, 20 bp, Homo sapiens
ctgaagatggcatcctgtga

SEQ ID NO: 2903127 - DNA, 13 bp, Homo sapiens
ctgaagatggctt

SEQ ID NO: 2903128 - DNA, 21 bp, Homo sapiens
ctgaagatttatttttaatat

SEQ ID NO: 2903129 - DNA, 14 bp, Homo sapiens
ctgaagcagatgca

SEQ ID NO: 2903130 - DNA, 15 bp, Homo sapiens
ctgaagccctcccag

SEQ ID NO: 2903131 - DNA, 18 bp, Homo sapiens
ctgaagcgaacatcttca

SEQ ID NO: 2903132 - DNA, 19 bp, Homo sapiens
ctgaagcgaacatcttcat

SEQ ID NO: 2903133 - DNA, 16 bp, Homo sapiens
ctgaagcggtcagact

SEQ ID NO: 2903134 - DNA, 20 bp, Homo sapiens
ctgaagctgctgcagccctg

SEQ ID NO: 2903135 - DNA, 13 bp, Homo sapiens
ctgaagctgctgt

SEQ ID NO: 2903136 - DNA, 19 bp, Homo sapiens
ctgaagcttatgtttctta

SEQ ID NO: 2903137 - DNA, 20 bp, Homo sapiens
ctgaagggaaggcaaaggca

SEQ ID NO: 2903138 - DNA, 15 bp, Homo sapiens
ctgaaggggccatga

SEQ ID NO: 2903139 - DNA, 17 bp, Homo sapiens
ctgaaggtaaaattgaa

SEQ ID NO: 2903140 - DNA, 15 bp, Homo sapiens
ctgaaggtcccctgg

SEQ ID NO: 2903141 - DNA, 19 bp, Homo sapiens
ctgaaggtcccctggcagt

SEQ ID NO: 2903142 - DNA, 13 bp, Homo sapiens
ctgaagtatgaag

SEQ ID NO: 2903143 - DNA, 12 bp, Homo sapiens
ctgaagtgcttg

SEQ ID NO: 2903144 - DNA, 17 bp, Homo sapiens
ctgaagtggttcagtct

SEQ ID NO: 2903145 - DNA, 20 bp, Homo sapiens
ctgaagtggttcagtctaga

SEQ ID NO: 2903146 - DNA, 16 bp, Homo sapiens
ctgaagtttttgaaat

SEQ ID NO: 2903147 - DNA, 14 bp, Homo sapiens
ctgaataaaccaag

SEQ ID NO: 2903148 - DNA, 16 bp, Homo sapiens
ctgaataaaccaagac

SEQ ID NO: 2903149 - DNA, 22 bp, Homo sapiens
ctgaataaatacccattgaact

SEQ ID NO: 2903150 - DNA, 18 bp, Homo sapiens
ctgcatgtggcttctctg

SEQ ID NO: 2903151 - DNA, 14 bp, Homo sapiens
ctgcatgtgtatat

SEQ ID NO: 2903152 - DNA, 21 bp, Homo sapiens
ctgcattcctgtaacttttaa

SEQ ID NO: 2903153 - DNA, 21 bp, Homo sapiens
ctgcattctgcctctctagga

SEQ ID NO: 2903154 - DNA, 17 bp, Homo sapiens
ctgcattgagaactgca

SEQ ID NO: 2903155 - DNA, 20 bp, Homo sapiens
ctgcatttcacatgccttgc

SEQ ID NO: 2903156 - DNA, 17 bp, Homo sapiens
ctgcatttcggtggcta

SEQ ID NO: 2903157 - DNA, 18 bp, Homo sapiens
ctgcatttcggtggctag

SEQ ID NO: 2903158 - DNA, 17 bp, Homo sapiens
ctgcatttttctgcaga

SEQ ID NO: 2903159 - DNA, 14 bp, Homo sapiens
ctgccaagccccat

SEQ ID NO: 2903160 - DNA, 14 bp, Homo sapiens
ctgccaagtcctgc

SEQ ID NO: 2903161 - DNA, 15 bp, Homo sapiens
ctgccaagtcctgcc

SEQ ID NO: 2903162 - DNA, 17 bp, Homo sapiens
ctgccaagtcctgcctt

SEQ ID NO: 2903163 - DNA, 20 bp, Homo sapiens
ctgccaagtcctgcctttgg

SEQ ID NO: 2903164 - DNA, 16 bp, Homo sapiens
ctgccacattagaact

SEQ ID NO: 2903165 - DNA, 19 bp, Homo sapiens
ctgccaccaaatctgtcta

SEQ ID NO: 2903166 - DNA, 12 bp, Homo sapiens
ctgccaccagca

SEQ ID NO: 2903167 - DNA, 18 bp, Homo sapiens
ctgccacccacctccctg

SEQ ID NO: 2903168 - DNA, 19 bp, Homo sapiens
ctgccacccacctccctgc

SEQ ID NO: 2903169 - DNA, 20 bp, Homo sapiens
ctgccacccacctccctgcc

SEQ ID NO: 2903170 - DNA, 22 bp, Homo sapiens
ctgccaccctgccccttgccat

SEQ ID NO: 2903171 - DNA, 16 bp, Homo sapiens
ctgccaccctgggcct

SEQ ID NO: 2903172 - DNA, 19 bp, Homo sapiens
ctgccaccgactgcccagc

SEQ ID NO: 2903173 - DNA, 13 bp, Homo sapiens
ctgccacctcccc

SEQ ID NO: 2903174 - DNA, 14 bp, Homo sapiens
ctgccacctcccct

SEQ ID NO: 2903175 - DNA, 22 bp, Homo sapiens
ctgccacctcccctatccaccc

SEQ ID NO: 2903176 - DNA, 19 bp, Homo sapiens
ctgccacgtgccttaggaa

SEQ ID NO: 2903177 - DNA, 15 bp, Homo sapiens
ctgccactcaatggg

SEQ ID NO: 2903178 - DNA, 13 bp, Homo sapiens
ctgccactcaccc

SEQ ID NO: 2903179 - DNA, 15 bp, Homo sapiens
ctgccactcaccctt

SEQ ID NO: 2903180 - DNA, 16 bp, Homo sapiens
ctgccactcaggccca

SEQ ID NO: 2903181 - DNA, 12 bp, Homo sapiens
ctgccactctgc

SEQ ID NO: 2903182 - DNA, 13 bp, Homo sapiens
ctgccactctgct

SEQ ID NO: 2903183 - DNA, 14 bp, Homo sapiens
ctgccactctgctg

SEQ ID NO: 2903184 - DNA, 17 bp, Homo sapiens
ctgccactctgctgcct

SEQ ID NO: 2903185 - DNA, 13 bp, Homo sapiens
ctgccactgggca

SEQ ID NO: 2903186 - DNA, 18 bp, Homo sapiens
ctgccactgggcacctgc

SEQ ID NO: 2903187 - DNA, 24 bp, Homo sapiens
ctgccactgggcacctgcgcacag

SEQ ID NO: 2903188 - DNA, 22 bp, Homo sapiens
ctgccagacactgcgccccgcc

SEQ ID NO: 2903189 - DNA, 17 bp, Homo sapiens
ctgccagaccccctgga

SEQ ID NO: 2903190 - DNA, 21 bp, Homo sapiens
ctgccagatgctgatgttcag

SEQ ID NO: 2903191 - DNA, 21 bp, Homo sapiens
ctgccagcagttactgtgaat

SEQ ID NO: 2903192 - DNA, 22 bp, Homo sapiens
ctgccagcccggctcggcccag

SEQ ID NO: 2903193 - DNA, 20 bp, Homo sapiens
ctgccaggaaacaagggaag

SEQ ID NO: 2903194 - DNA, 21 bp, Homo sapiens
ctgccaggaaacaagggaagg

SEQ ID NO: 2903195 - DNA, 15 bp, Homo sapiens
ctgccaggattttgt

SEQ ID NO: 2903196 - DNA, 22 bp, Homo sapiens
ctgccaggattttgtattgcca

SEQ ID NO: 2903197 - DNA, 23 bp, Homo sapiens
ctgccaggcccccaccacacatc

SEQ ID NO: 2903198 - DNA, 12 bp, Homo sapiens
ctgccagggcag

SEQ ID NO: 2903199 - DNA, 13 bp, Homo sapiens
ctgccagggcagg

SEQ ID NO: 2903200 - DNA, 15 bp, Homo sapiens
ctgccagggcagggc

SEQ ID NO: 2903201 - DNA, 11 bp, Homo sapiens
ctgccagggcc

SEQ ID NO: 2903202 - DNA, 12 bp, Homo sapiens
ctgccagggctt

SEQ ID NO: 2903203 - DNA, 17 bp, Homo sapiens
ctgccagtcgggagagc

SEQ ID NO: 2903204 - DNA, 18 bp, Homo sapiens
ctgccagtctcactgtgg

SEQ ID NO: 2903205 - DNA, 14 bp, Homo sapiens
ctgccagtgcctta

SEQ ID NO: 2903206 - DNA, 17 bp, Homo sapiens
ctgccagtgccttacct

SEQ ID NO: 2903207 - DNA, 21 bp, Homo sapiens
ctgccagtggggaaggaggcc

SEQ ID NO: 2903208 - DNA, 24 bp, Homo sapiens
ctgccatccccctctcacgccacc

SEQ ID NO: 2903209 - DNA, 23 bp, Homo sapiens
ctgccatcttagtttggattctt

SEQ ID NO: 2903210 - DNA, 17 bp, Homo sapiens
ctgccatcttctccccg

SEQ ID NO: 2903211 - DNA, 17 bp, Homo sapiens
ctgcccaaaaatatggt

SEQ ID NO: 2903212 - DNA, 16 bp, Homo sapiens
ctgcccaactttcatt

SEQ ID NO: 2903213 - DNA, 23 bp, Homo sapiens
ctgcccaagtgaccagggaagtg

SEQ ID NO: 2903214 - DNA, 14 bp, Homo sapiens
ctgcccacccccgg

SEQ ID NO: 2903215 - DNA, 14 bp, Homo sapiens
ctgcccacctgcct

SEQ ID NO: 2903216 - DNA, 18 bp, Homo sapiens
ctgcccacctgcctggcc

SEQ ID NO: 2903217 - DNA, 19 bp, Homo sapiens
ctgcccacctgcctggccg

SEQ ID NO: 2903218 - DNA, 12 bp, Homo sapiens
ctgcccacctgt

SEQ ID NO: 2903219 - DNA, 12 bp, Homo sapiens
ctgcccagccac

SEQ ID NO: 2903220 - DNA, 18 bp, Homo sapiens
ctgcccagccacccctca

SEQ ID NO: 2903221 - DNA, 19 bp, Homo sapiens
ctgcccagccacccctcag

SEQ ID NO: 2903222 - DNA, 19 bp, Homo sapiens
ctgcccagccactccaagc

SEQ ID NO: 2903223 - DNA, 15 bp, Homo sapiens
ctgcccagccgggca

SEQ ID NO: 2903224 - DNA, 12 bp, Homo sapiens
ctgcccagcctc

SEQ ID NO: 2903225 - DNA, 23 bp, Homo sapiens
ctgcccagcctggggcaaaccta

SEQ ID NO: 2903226 - DNA, 12 bp, Homo sapiens
ctgcccaggaga

SEQ ID NO: 2903227 - DNA, 17 bp, Homo sapiens
ctgcccaggagagccag

SEQ ID NO: 2903228 - DNA, 21 bp, Homo sapiens
ctgcccaggagagccagccct

SEQ ID NO: 2903229 - DNA, 12 bp, Homo sapiens
ctgcccaggtgg

SEQ ID NO: 2903230 - DNA, 13 bp, Homo sapiens
ctgcccaggtggg

SEQ ID NO: 2903231 - DNA, 23 bp, Homo sapiens
ctgcccaggtggggtttcctgca

SEQ ID NO: 2903232 - DNA, 21 bp, Homo sapiens
ctgccccaactcctggaagct

SEQ ID NO: 2903233 - DNA, 12 bp, Homo sapiens
ctgccccaggcc

SEQ ID NO: 2903234 - DNA, 23 bp, Homo sapiens
ctgccccaggccggagcccagat

SEQ ID NO: 2903235 - DNA, 12 bp, Homo sapiens
ctgcccccaagt

SEQ ID NO: 2903236 - DNA, 17 bp, Homo sapiens
ctgccccccagggctag

SEQ ID NO: 2903237 - DNA, 22 bp, Homo sapiens
ctgccccggcccctccccctga

SEQ ID NO: 2903238 - DNA, 23 bp, Homo sapiens
ctgccccggggaggggcgctcgc

SEQ ID NO: 2903239 - DNA, 15 bp, Homo sapiens
ctgcccctcccagaa

SEQ ID NO: 2903240 - DNA, 16 bp, Homo sapiens
ctgcccctcccagaac

SEQ ID NO: 2903241 - DNA, 18 bp, Homo sapiens
ctgcccctccccctaccg

SEQ ID NO: 2903242 - DNA, 15 bp, Homo sapiens
ctgcccctccctaga

SEQ ID NO: 2903243 - DNA, 19 bp, Homo sapiens
ctgcccctccctagatcca

SEQ ID NO: 2903244 - DNA, 20 bp, Homo sapiens
ctgcccctccctagatccag

SEQ ID NO: 2903245 - DNA, 17 bp, Homo sapiens
ctgcccctcctggagca

SEQ ID NO: 2903246 - DNA, 17 bp, Homo sapiens
ctgcccctctctgggcc

SEQ ID NO: 2903247 - DNA, 18 bp, Homo sapiens
ctgcccctctctgggcct

SEQ ID NO: 2903248 - DNA, 22 bp, Homo sapiens
ctgcccctctctgggcctcaga

SEQ ID NO: 2903249 - DNA, 23 bp, Homo sapiens
ctgcccctctctgggcctcagag

SEQ ID NO: 2903250 - DNA, 11 bp, Homo sapiens
ctgcccctggc

SEQ ID NO: 2903251 - DNA, 12 bp, Homo sapiens
ctgcccctggca

SEQ ID NO: 2903252 - DNA, 16 bp, Homo sapiens
ctgcccctgtgcctct

SEQ ID NO: 2903253 - DNA, 18 bp, Homo sapiens
ctgcccgcagacctctgg

SEQ ID NO: 2903254 - DNA, 21 bp, Homo sapiens
ctgcccgcctgcccacctgcc

SEQ ID NO: 2903255 - DNA, 18 bp, Homo sapiens
ctgcccgggagctcagga

SEQ ID NO: 2903256 - DNA, 14 bp, Homo sapiens
ctgcccgtgtacat

SEQ ID NO: 2903257 - DNA, 17 bp, Homo sapiens
ctgccctaacctgacag

SEQ ID NO: 2903258 - DNA, 10 bp, Homo sapiens
ctgccctccc

SEQ ID NO: 2903259 - DNA, 19 bp, Homo sapiens
ctgccctcccgcaccttcc

SEQ ID NO: 2903260 - DNA, 16 bp, Homo sapiens
ctgccctcctctcccg

SEQ ID NO: 2903261 - DNA, 17 bp, Homo sapiens
ctgccctcctctcccgt

SEQ ID NO: 2903262 - DNA, 12 bp, Homo sapiens
ctgccctcgcac

SEQ ID NO: 2903263 - DNA, 14 bp, Homo sapiens
ctgccctctgctgc

SEQ ID NO: 2903264 - DNA, 15 bp, Homo sapiens
ctgccctctgctgct

SEQ ID NO: 2903265 - DNA, 14 bp, Homo sapiens
ctgccctgcccaag

SEQ ID NO: 2903266 - DNA, 13 bp, Homo sapiens
ctgccctgccccc

SEQ ID NO: 2903267 - DNA, 18 bp, Homo sapiens
ctgccctgggtcctgcct

SEQ ID NO: 2903268 - DNA, 21 bp, Homo sapiens
ctgccctgggtcctgcctgca

SEQ ID NO: 2903269 - DNA, 23 bp, Homo sapiens
ctgccctgggtcctgcctgcagt

SEQ ID NO: 2903270 - DNA, 21 bp, Homo sapiens
ctgccctgtgggaccccaggc

SEQ ID NO: 2903271 - DNA, 13 bp, Homo sapiens
ctgcccttgggcc

SEQ ID NO: 2903272 - DNA, 15 bp, Homo sapiens
ctgcccttgtcccac

SEQ ID NO: 2903273 - DNA, 23 bp, Homo sapiens
ctgcccttgtcccactcaagcca

SEQ ID NO: 2903274 - DNA, 13 bp, Homo sapiens
ctgcccttttcct

SEQ ID NO: 2903275 - DNA, 17 bp, Homo sapiens
ctgccgacatccctccc

SEQ ID NO: 2903276 - DNA, 23 bp, Homo sapiens
ctgccgacatccctcccccagca

SEQ ID NO: 2903277 - DNA, 15 bp, Homo sapiens
ctgccgacctcgtcc

SEQ ID NO: 2903278 - DNA, 21 bp, Homo sapiens
ctgccgagacagaccctctgc

SEQ ID NO: 2903279 - DNA, 22 bp, Homo sapiens
ctgccgagagtccatcagcctc

SEQ ID NO: 2903280 - DNA, 23 bp, Homo sapiens
ctgccgagagtccatcagcctcc

SEQ ID NO: 2903281 - DNA, 14 bp, Homo sapiens
ctgccgcaccccag

SEQ ID NO: 2903282 - DNA, 22 bp, Homo sapiens
ctgccgcccgaggtggctgcct

SEQ ID NO: 2903283 - DNA, 15 bp, Homo sapiens
ctgccgccgcccgct

SEQ ID NO: 2903284 - DNA, 13 bp, Homo sapiens
ctgccgcctcccg

SEQ ID NO: 2903285 - DNA, 18 bp, Homo sapiens
ctgccgctacctccctcc

SEQ ID NO: 2903286 - DNA, 19 bp, Homo sapiens
ctgccgctgcttccaggct

SEQ ID NO: 2903287 - DNA, 23 bp, Homo sapiens
ctgagcccctcagacagccccct

SEQ ID NO: 2903288 - DNA, 15 bp, Homo sapiens
ctgagcccctgtcta

SEQ ID NO: 2903289 - DNA, 22 bp, Homo sapiens
ctgagcccctgtctagagaggg

SEQ ID NO: 2903290 - DNA, 23 bp, Homo sapiens
ctgagcccctgtctagagaggga

SEQ ID NO: 2903291 - DNA, 12 bp, Homo sapiens
ctgagcctctgc

SEQ ID NO: 2903292 - DNA, 13 bp, Homo sapiens
ctgagcgaggaaa

SEQ ID NO: 2903293 - DNA, 15 bp, Homo sapiens
ctgagcgaggaaaaa

SEQ ID NO: 2903294 - DNA, 18 bp, Homo sapiens
ctgagcgcaagccacagc

SEQ ID NO: 2903295 - DNA, 19 bp, Homo sapiens
ctgagcgcaagccacagcc

SEQ ID NO: 2903296 - DNA, 20 bp, Homo sapiens
ctgagcgcaagccacagcct

SEQ ID NO: 2903297 - DNA, 22 bp, Homo sapiens
ctgagcgcaagccacagcctgt

SEQ ID NO: 2903298 - DNA, 15 bp, Homo sapiens
ctgagcgcctgggtc

SEQ ID NO: 2903299 - DNA, 20 bp, Homo sapiens
ctgagcgtttaaagtactga

SEQ ID NO: 2903300 - DNA, 23 bp, Homo sapiens
ctgagcgtttaaagtactgagca

SEQ ID NO: 2903301 - DNA, 18 bp, Homo sapiens
ctgagctcgcagcccccg

SEQ ID NO: 2903302 - DNA, 16 bp, Homo sapiens
ctgagctctgcctcaa

SEQ ID NO: 2903303 - DNA, 15 bp, Homo sapiens
ctgagctgagccagg

SEQ ID NO: 2903304 - DNA, 13 bp, Homo sapiens
ctgagctgccagt

SEQ ID NO: 2903305 - DNA, 13 bp, Homo sapiens
ctgagctggcttc

SEQ ID NO: 2903306 - DNA, 16 bp, Homo sapiens
ctgagctggcttcgga

SEQ ID NO: 2903307 - DNA, 11 bp, Homo sapiens
ctgagctgggg

SEQ ID NO: 2903308 - DNA, 13 bp, Homo sapiens
ctgagctggggaa

SEQ ID NO: 2903309 - DNA, 21 bp, Homo sapiens
ctgagctggggaggtgggagg

SEQ ID NO: 2903310 - DNA, 23 bp, Homo sapiens
ctgagctgtcccaagtcctccgg

SEQ ID NO: 2903311 - DNA, 19 bp, Homo sapiens
ctgagctgtgacattgctg

SEQ ID NO: 2903312 - DNA, 20 bp, Homo sapiens
ctgagctgtgacattgctgg

SEQ ID NO: 2903313 - DNA, 17 bp, Homo sapiens
ctgagctttagacagca

SEQ ID NO: 2903314 - DNA, 17 bp, Homo sapiens
ctgaggaaaggccagct

SEQ ID NO: 2903315 - DNA, 18 bp, Homo sapiens
ctgaggaaaggccagctg

SEQ ID NO: 2903316 - DNA, 20 bp, Homo sapiens
ctgaggaaaggccagctggc

SEQ ID NO: 2903317 - DNA, 22 bp, Homo sapiens
ctgaggaacccttacagtagga

SEQ ID NO: 2903318 - DNA, 17 bp, Homo sapiens
ctgaggacattccaaga

SEQ ID NO: 2903319 - DNA, 11 bp, Homo sapiens
ctgaggagaaa

SEQ ID NO: 2903320 - DNA, 20 bp, Homo sapiens
ctgaggatcccctgtcccct

SEQ ID NO: 2903321 - DNA, 22 bp, Homo sapiens
ctgaggcaagccatggagtgag

SEQ ID NO: 2903322 - DNA, 15 bp, Homo sapiens
ctgaggcacctgcat

SEQ ID NO: 2903323 - DNA, 21 bp, Homo sapiens
ctgaggcagatggccactgct

SEQ ID NO: 2903324 - DNA, 23 bp, Homo sapiens
ctgaggcagcagtgtgaggccag

SEQ ID NO: 2903325 - DNA, 13 bp, Homo sapiens
ctgaggcaggaga

SEQ ID NO: 2903326 - DNA, 21 bp, Homo sapiens
ctgaggcagggaagtccccag

SEQ ID NO: 2903327 - DNA, 14 bp, Homo sapiens
ctgaggcctccctt

SEQ ID NO: 2903328 - DNA, 20 bp, Homo sapiens
ctgaggcctgagacccagga

SEQ ID NO: 2903329 - DNA, 21 bp, Homo sapiens
ctgaggccttgtgtgtcaggc

SEQ ID NO: 2903330 - DNA, 13 bp, Homo sapiens
ctgaggctggcac

SEQ ID NO: 2903331 - DNA, 20 bp, Homo sapiens
ctgaggctggcacaggacat

SEQ ID NO: 2903332 - DNA, 14 bp, Homo sapiens
ctgaggctttggat

SEQ ID NO: 2903333 - DNA, 20 bp, Homo sapiens
ctgagggaccgagcccagca

SEQ ID NO: 2903334 - DNA, 13 bp, Homo sapiens
ctgagggcatctc

SEQ ID NO: 2903335 - DNA, 16 bp, Homo sapiens
ctgagggccctgtgga

SEQ ID NO: 2903336 - DNA, 17 bp, Homo sapiens
ctgagggccctgtggag

SEQ ID NO: 2903337 - DNA, 17 bp, Homo sapiens
ctgaggggacgggcaag

SEQ ID NO: 2903338 - DNA, 19 bp, Homo sapiens
ctgaggggtgtccgagagg

SEQ ID NO: 2903339 - DNA, 22 bp, Homo sapiens
ctgaggggtgtccgagaggctg

SEQ ID NO: 2903340 - DNA, 21 bp, Homo sapiens
ctgaggtccaagattctggag

SEQ ID NO: 2903341 - DNA, 16 bp, Homo sapiens
ctgaggtgtctggcct

SEQ ID NO: 2903342 - DNA, 20 bp, Homo sapiens
ctgaggtgtctggcctgagg

SEQ ID NO: 2903343 - DNA, 21 bp, Homo sapiens
ctgaggtgtctggcctgaggt

SEQ ID NO: 2903344 - DNA, 22 bp, Homo sapiens
ctgaggtgtctggcctgaggtc

SEQ ID NO: 2903345 - DNA, 22 bp, Homo sapiens
ctgagtagatgcgcagccccat

SEQ ID NO: 2903346 - DNA, 20 bp, Homo sapiens
ctgagtagctggaattacag

SEQ ID NO: 2903347 - DNA, 13 bp, Homo sapiens
ctgagtagctttc

SEQ ID NO: 2903348 - DNA, 14 bp, Homo sapiens
ctgagtagctttca

SEQ ID NO: 2903349 - DNA, 16 bp, Homo sapiens
ctgagtagctttcatt

SEQ ID NO: 2903350 - DNA, 15 bp, Homo sapiens
ctgagtcaagttgtt

SEQ ID NO: 2903351 - DNA, 17 bp, Homo sapiens
ctgagtcaccaggaatg

SEQ ID NO: 2903352 - DNA, 20 bp, Homo sapiens
ctgagtcagctgaccccctc

SEQ ID NO: 2903353 - DNA, 22 bp, Homo sapiens
ctgagtcagctgaccccctccc

SEQ ID NO: 2903354 - DNA, 21 bp, Homo sapiens
ctgagtcatgatctccctgcc

SEQ ID NO: 2903355 - DNA, 22 bp, Homo sapiens
ctgagtcatgatctccctgccg

SEQ ID NO: 2903356 - DNA, 17 bp, Homo sapiens
ctgagtccctggcaaga

SEQ ID NO: 2903357 - DNA, 14 bp, Homo sapiens
ctgagtccgcctgc

SEQ ID NO: 2903358 - DNA, 14 bp, Homo sapiens
ctgagtctggcaaa

SEQ ID NO: 2903359 - DNA, 17 bp, Homo sapiens
ctgagtctggcaaacat

SEQ ID NO: 2903360 - DNA, 20 bp, Homo sapiens
ctgagtctggcaaacatgtg

SEQ ID NO: 2903361 - DNA, 22 bp, Homo sapiens
ctgagtctggcaaacatgtgca

SEQ ID NO: 2903362 - DNA, 22 bp, Homo sapiens
ctgagtctgggcagctgtccct

SEQ ID NO: 2903363 - DNA, 23 bp, Homo sapiens
ctgccggttcttaaatccatcct

SEQ ID NO: 2903364 - DNA, 20 bp, Homo sapiens
ctgccgtcagtgctgtgctg

SEQ ID NO: 2903365 - DNA, 14 bp, Homo sapiens
ctgccgtctctgga

SEQ ID NO: 2903366 - DNA, 15 bp, Homo sapiens
ctgccgtgccgcctg

SEQ ID NO: 2903367 - DNA, 17 bp, Homo sapiens
ctgccgtgccgcctgca

SEQ ID NO: 2903368 - DNA, 18 bp, Homo sapiens
ctgccgtggtggcagctg

SEQ ID NO: 2903369 - DNA, 14 bp, Homo sapiens
ctgcctaagtggct

SEQ ID NO: 2903370 - DNA, 15 bp, Homo sapiens
ctgcctaagtggctg

SEQ ID NO: 2903371 - DNA, 15 bp, Homo sapiens
ctgcctaattacgat

SEQ ID NO: 2903372 - DNA, 23 bp, Homo sapiens
ctgcctaattacgataaggaaga

SEQ ID NO: 2903373 - DNA, 13 bp, Homo sapiens
ctgcctactcacg

SEQ ID NO: 2903374 - DNA, 18 bp, Homo sapiens
ctgcctagaatctttatt

SEQ ID NO: 2903375 - DNA, 20 bp, Homo sapiens
ctgcctagaatctttattca

SEQ ID NO: 2903376 - DNA, 17 bp, Homo sapiens
ctgcctataaatttact

SEQ ID NO: 2903377 - DNA, 24 bp, Homo sapiens
ctgcctcacatctcccttccacct

SEQ ID NO: 2903378 - DNA, 15 bp, Homo sapiens
ctgcctcagcctccc

SEQ ID NO: 2903379 - DNA, 18 bp, Homo sapiens
ctgcctcagcctcccgag

SEQ ID NO: 2903380 - DNA, 14 bp, Homo sapiens
ctgcctcagccttc

SEQ ID NO: 2903381 - DNA, 15 bp, Homo sapiens
ctgcctcagccttcc

SEQ ID NO: 2903382 - DNA, 11 bp, Homo sapiens
ctgcctcagct

SEQ ID NO: 2903383 - DNA, 11 bp, Homo sapiens
ctgcctcagga

SEQ ID NO: 2903384 - DNA, 12 bp, Homo sapiens
ctgcctcaggac

SEQ ID NO: 2903385 - DNA, 22 bp, Homo sapiens
ctgcctcaggaggcaggacctt

SEQ ID NO: 2903386 - DNA, 18 bp, Homo sapiens
ctgcctcaggcactctcc

SEQ ID NO: 2903387 - DNA, 21 bp, Homo sapiens
ctgcctcaggcactctcctgt

SEQ ID NO: 2903388 - DNA, 14 bp, Homo sapiens
ctgcctcagtggct

SEQ ID NO: 2903389 - DNA, 19 bp, Homo sapiens
ctgcctcagtggctctggg

SEQ ID NO: 2903390 - DNA, 22 bp, Homo sapiens
ctgcctcagtggctctgggtac

SEQ ID NO: 2903391 - DNA, 13 bp, Homo sapiens
ctgcctcatcctc

SEQ ID NO: 2903392 - DNA, 16 bp, Homo sapiens
ctgcctcatcctcctc

SEQ ID NO: 2903393 - DNA, 13 bp, Homo sapiens
ctgcctcatttag

SEQ ID NO: 2903394 - DNA, 13 bp, Homo sapiens
ctgcctccaggaa

SEQ ID NO: 2903395 - DNA, 16 bp, Homo sapiens
ctgcctccccaatcca

SEQ ID NO: 2903396 - DNA, 11 bp, Homo sapiens
ctgcctccctc

SEQ ID NO: 2903397 - DNA, 18 bp, Homo sapiens
ctgcctccctctcttccg

SEQ ID NO: 2903398 - DNA, 22 bp, Homo sapiens
ctgcctccctctcttccgggag

SEQ ID NO: 2903399 - DNA, 23 bp, Homo sapiens
ctgcctccgcgtgatcaaagcca

SEQ ID NO: 2903400 - DNA, 20 bp, Homo sapiens
ctgcctcctccctggctgca

SEQ ID NO: 2903401 - DNA, 18 bp, Homo sapiens
ctgcctcctgatgtttgt

SEQ ID NO: 2903402 - DNA, 14 bp, Homo sapiens
ctgcctcctggctc

SEQ ID NO: 2903403 - DNA, 15 bp, Homo sapiens
ctgcctcctggctca

SEQ ID NO: 2903404 - DNA, 14 bp, Homo sapiens
ctgcctccttgcca

SEQ ID NO: 2903405 - DNA, 19 bp, Homo sapiens
ctgcctcgaaacacagaaa

SEQ ID NO: 2903406 - DNA, 12 bp, Homo sapiens
ctgcctcgaggg

SEQ ID NO: 2903407 - DNA, 18 bp, Homo sapiens
ctgcctcgagggccgcct

SEQ ID NO: 2903408 - DNA, 23 bp, Homo sapiens
ctgcctcgagggccgcctgcctt

SEQ ID NO: 2903409 - DNA, 17 bp, Homo sapiens
ctgcctcgcccccactt

SEQ ID NO: 2903410 - DNA, 16 bp, Homo sapiens
ctgcctcgccttgtgt

SEQ ID NO: 2903411 - DNA, 23 bp, Homo sapiens
ctgcctcggttgattgtgcatgg

SEQ ID NO: 2903412 - DNA, 19 bp, Homo sapiens
ctgcctctaactccctcct

SEQ ID NO: 2903413 - DNA, 22 bp, Homo sapiens
ctgcctctaactccctcctcac

SEQ ID NO: 2903414 - DNA, 20 bp, Homo sapiens
ctgcctctgacagcagcctg

SEQ ID NO: 2903415 - DNA, 23 bp, Homo sapiens
ctggccagccgctctcctgccac

SEQ ID NO: 2903416 - DNA, 14 bp, Homo sapiens
ctggccagggccac

SEQ ID NO: 2903417 - DNA, 18 bp, Homo sapiens
ctggccagggccacgctc

SEQ ID NO: 2903418 - DNA, 22 bp, Homo sapiens
ctggccagggccacgctccagc

SEQ ID NO: 2903419 - DNA, 13 bp, Homo sapiens
ctggccagtcctg

SEQ ID NO: 2903420 - DNA, 16 bp, Homo sapiens
ctggccagtcttcctc

SEQ ID NO: 2903421 - DNA, 20 bp, Homo sapiens
ctggccagtgctgcccatga

SEQ ID NO: 2903422 - DNA, 18 bp, Homo sapiens
ctggccatcccacaagtg

SEQ ID NO: 2903423 - DNA, 22 bp, Homo sapiens
ctggccatctggttaggatggc

SEQ ID NO: 2903424 - DNA, 13 bp, Homo sapiens
ctggccatgctgt

SEQ ID NO: 2903425 - DNA, 15 bp, Homo sapiens
ctggccattttggaa

SEQ ID NO: 2903426 - DNA, 21 bp, Homo sapiens
ctggccattttggaaagcaag

SEQ ID NO: 2903427 - DNA, 15 bp, Homo sapiens
ctggcccagggccca

SEQ ID NO: 2903428 - DNA, 15 bp, Homo sapiens
ctggcccagggggcc

SEQ ID NO: 2903429 - DNA, 17 bp, Homo sapiens
ctggcccagggggcctg

SEQ ID NO: 2903430 - DNA, 19 bp, Homo sapiens
ctggcccagggggcctgga

SEQ ID NO: 2903431 - DNA, 20 bp, Homo sapiens
ctggcccagggggcctggag

SEQ ID NO: 2903432 - DNA, 21 bp, Homo sapiens
ctggcccagggggcctggagc

SEQ ID NO: 2903433 - DNA, 13 bp, Homo sapiens
ctggccccaggac

SEQ ID NO: 2903434 - DNA, 20 bp, Homo sapiens
ctggccccaggacctggctg

SEQ ID NO: 2903435 - DNA, 12 bp, Homo sapiens
ctggccccgccg

SEQ ID NO: 2903436 - DNA, 17 bp, Homo sapiens
ctggccccgcctgcctg

SEQ ID NO: 2903437 - DNA, 21 bp, Homo sapiens
ctggccccgcctgcctgccac

SEQ ID NO: 2903438 - DNA, 23 bp, Homo sapiens
ctggcccctgagatctctgcagg

SEQ ID NO: 2903439 - DNA, 17 bp, Homo sapiens
ctggcccctggcctgcc

SEQ ID NO: 2903440 - DNA, 13 bp, Homo sapiens
ctgggagaaatct

SEQ ID NO: 2903441 - DNA, 22 bp, Homo sapiens
ctgggagagacttggatgagga

SEQ ID NO: 2903442 - DNA, 19 bp, Homo sapiens
ctgggagattcaagggacc

SEQ ID NO: 2903443 - DNA, 15 bp, Homo sapiens
ctgggagcaagttgc

SEQ ID NO: 2903444 - DNA, 22 bp, Homo sapiens
ctgggaggaaaagaaaagaggg

SEQ ID NO: 2903445 - DNA, 17 bp, Homo sapiens
ctgggaggaatggacag

SEQ ID NO: 2903446 - DNA, 19 bp, Homo sapiens
ctgggaggaatggacagac

SEQ ID NO: 2903447 - DNA, 22 bp, Homo sapiens
ctgggaggaatggacagacaga

SEQ ID NO: 2903448 - DNA, 20 bp, Homo sapiens
ctgggaggatcctgagctgc

SEQ ID NO: 2903449 - DNA, 21 bp, Homo sapiens
ctgggaggatcctgagctgct

SEQ ID NO: 2903450 - DNA, 22 bp, Homo sapiens
ctgggaggctgcagccaggcct

SEQ ID NO: 2903451 - DNA, 11 bp, Homo sapiens
ctgggagggca

SEQ ID NO: 2903452 - DNA, 19 bp, Homo sapiens
ctgggagggcagcagggct

SEQ ID NO: 2903453 - DNA, 19 bp, Homo sapiens
ctgggagtatacggaaaca

SEQ ID NO: 2903454 - DNA, 14 bp, Homo sapiens
ctgggagtcacaca

SEQ ID NO: 2903455 - DNA, 17 bp, Homo sapiens
ctgggagtcacacagtg

SEQ ID NO: 2903456 - DNA, 16 bp, Homo sapiens
ctgggagtgtgtggtg

SEQ ID NO: 2903457 - DNA, 15 bp, Homo sapiens
ctgggtttggcccaa

SEQ ID NO: 2903458 - DNA, 17 bp, Homo sapiens
ctgggtttggcccctgg

SEQ ID NO: 2903459 - DNA, 20 bp, Homo sapiens
ctgggttttgtattctctga

SEQ ID NO: 2903460 - DNA, 21 bp, Homo sapiens
ctggtaaagaaaagcctcagc

SEQ ID NO: 2903461 - DNA, 23 bp, Homo sapiens
ctggtaaagaaaagcctcagctc

SEQ ID NO: 2903462 - DNA, 16 bp, Homo sapiens
ctggtaagcagaggct

SEQ ID NO: 2903463 - DNA, 18 bp, Homo sapiens
ctggtaagcagaggcttt

SEQ ID NO: 2903464 - DNA, 16 bp, Homo sapiens
ctggtacaacggaggc

SEQ ID NO: 2903465 - DNA, 14 bp, Homo sapiens
ctggtactcaagcc

SEQ ID NO: 2903466 - DNA, 16 bp, Homo sapiens
ctggtagctgagggga

SEQ ID NO: 2903467 - DNA, 23 bp, Homo sapiens
ctggtaggaaagggcaagtcttt

SEQ ID NO: 2903468 - DNA, 16 bp, Homo sapiens
ctggtaggaggaggca

SEQ ID NO: 2903469 - DNA, 19 bp, Homo sapiens
ctggtaggaggaggcatgg

SEQ ID NO: 2903470 - DNA, 12 bp, Homo sapiens
ctggtatctgca

SEQ ID NO: 2903471 - DNA, 14 bp, Homo sapiens
ctggtatgaataat

SEQ ID NO: 2903472 - DNA, 18 bp, Homo sapiens
ctggtatggtgctaatat

SEQ ID NO: 2903473 - DNA, 20 bp, Homo sapiens
ctggtatggtgctaatattt

SEQ ID NO: 2903474 - DNA, 22 bp, Homo sapiens
ctggtcactctgccctctgctg

SEQ ID NO: 2903475 - DNA, 13 bp, Homo sapiens
ctggtcagagtgg

SEQ ID NO: 2903476 - DNA, 20 bp, Homo sapiens
ctggtcatccttggtgctct

SEQ ID NO: 2903477 - DNA, 22 bp, Homo sapiens
ctggtcatccttggtgctcttg

SEQ ID NO: 2903478 - DNA, 19 bp, Homo sapiens
ctggtcccggggccagcac

SEQ ID NO: 2903479 - DNA, 20 bp, Homo sapiens
ctggtcccggggccagcact

SEQ ID NO: 2903480 - DNA, 16 bp, Homo sapiens
ctggtccgagctgagg

SEQ ID NO: 2903481 - DNA, 23 bp, Homo sapiens
ctggtccgagctgaggactctgc

SEQ ID NO: 2903482 - DNA, 18 bp, Homo sapiens
ctggtcctccgcctactg

SEQ ID NO: 2903483 - DNA, 21 bp, Homo sapiens
ctggtcctcggagctggttcc

SEQ ID NO: 2903484 - DNA, 23 bp, Homo sapiens
ctggtcctcggagctggttcctc

SEQ ID NO: 2903485 - DNA, 15 bp, Homo sapiens
ctggtcctggcctcc

SEQ ID NO: 2903486 - DNA, 19 bp, Homo sapiens
ctggtcctggctgcactct

SEQ ID NO: 2903487 - DNA, 22 bp, Homo sapiens
ctggtcctggctgcactcttga

SEQ ID NO: 2903488 - DNA, 17 bp, Homo sapiens
ctggtccttcactggcg

SEQ ID NO: 2903489 - DNA, 15 bp, Homo sapiens
ctggtctaatttatt

SEQ ID NO: 2903490 - DNA, 18 bp, Homo sapiens
ctggtctcaaactcctga

SEQ ID NO: 2903491 - DNA, 23 bp, Homo sapiens
ctggtctcgaactcctggcctca

SEQ ID NO: 2903492 - DNA, 15 bp, Homo sapiens
ctggtctgctcagga

SEQ ID NO: 2903493 - DNA, 18 bp, Homo sapiens
ctggtcttgaactcctgg

SEQ ID NO: 2903494 - DNA, 21 bp, Homo sapiens
ctggtcttgaagtcctggctt

SEQ ID NO: 2903495 - DNA, 16 bp, Homo sapiens
ctggtgacagccttgg

SEQ ID NO: 2903496 - DNA, 22 bp, Homo sapiens
ctggtgagacagtttactttgc

SEQ ID NO: 2903497 - DNA, 23 bp, Homo sapiens
ctggtgaggccggccctgcccct

SEQ ID NO: 2903498 - DNA, 16 bp, Homo sapiens
ctggtgcactttgtaa

SEQ ID NO: 2903499 - DNA, 18 bp, Homo sapiens
ctggtgcactttgtaaat

SEQ ID NO: 2903500 - DNA, 19 bp, Homo sapiens
ctggtgcactttgtaaatt

SEQ ID NO: 2903501 - DNA, 15 bp, Homo sapiens
ctggtgcctccagag

SEQ ID NO: 2903502 - DNA, 16 bp, Homo sapiens
ctggtgcctccagagg

SEQ ID NO: 2903503 - DNA, 14 bp, Homo sapiens
ctggtgctcctgcc

SEQ ID NO: 2903504 - DNA, 21 bp, Homo sapiens
ctggtgctcctgcccagccac

SEQ ID NO: 2903505 - DNA, 17 bp, Homo sapiens
ctggtgctgcagcaccg

SEQ ID NO: 2903506 - DNA, 19 bp, Homo sapiens
ctggtgctgcctctacctg

SEQ ID NO: 2903507 - DNA, 16 bp, Homo sapiens
ctggtggaggagctga

SEQ ID NO: 2903508 - DNA, 22 bp, Homo sapiens
ctggtggaggagctgagggagg

SEQ ID NO: 2903509 - DNA, 18 bp, Homo sapiens
ctggtggatggtgacttt

SEQ ID NO: 2903510 - DNA, 22 bp, Homo sapiens
ctggtggatggtgacttttgaa

SEQ ID NO: 2903511 - DNA, 14 bp, Homo sapiens
ctggtggcacagga

SEQ ID NO: 2903512 - DNA, 11 bp, Homo sapiens
ctggtggccca

SEQ ID NO: 2903513 - DNA, 14 bp, Homo sapiens
ctggtggcccagga

SEQ ID NO: 2903514 - DNA, 15 bp, Homo sapiens
ctggtggcctctgca

SEQ ID NO: 2903515 - DNA, 13 bp, Homo sapiens
ctggtggctgggc

SEQ ID NO: 2903516 - DNA, 16 bp, Homo sapiens
ctggtggctgggccca

SEQ ID NO: 2903517 - DNA, 18 bp, Homo sapiens
ctggtggctgggcccagc

SEQ ID NO: 2903518 - DNA, 19 bp, Homo sapiens
ctggtgggagcacctgcca

SEQ ID NO: 2903519 - DNA, 24 bp, Homo sapiens
ctggtggggcccatggaggagaca

SEQ ID NO: 2903520 - DNA, 20 bp, Homo sapiens
ctggtgtaatctcaatgcaa

SEQ ID NO: 2903521 - DNA, 22 bp, Homo sapiens
ctggtgtccagcatggatgaaa

SEQ ID NO: 2903522 - DNA, 19 bp, Homo sapiens
ctggttatcctgtgctaca

SEQ ID NO: 2903523 - DNA, 21 bp, Homo sapiens
ctggttatcttgttattattg

SEQ ID NO: 2903524 - DNA, 20 bp, Homo sapiens
ctggttcaagagacactgct

SEQ ID NO: 2903525 - DNA, 13 bp, Homo sapiens
ctggttcacctga

SEQ ID NO: 2903526 - DNA, 17 bp, Homo sapiens
ctggttcctctctccca

SEQ ID NO: 2903527 - DNA, 19 bp, Homo sapiens
ctggttcctctctcccacc

SEQ ID NO: 2903528 - DNA, 18 bp, Homo sapiens
ctggttctcaatgaaaaa

SEQ ID NO: 2903529 - DNA, 23 bp, Homo sapiens
ctggttctgttttctaaaggagc

SEQ ID NO: 2903530 - DNA, 19 bp, Homo sapiens
ctggttgaagaagatgatc

SEQ ID NO: 2903531 - DNA, 22 bp, Homo sapiens
ctggtttcctgcccagcctggg

SEQ ID NO: 2903532 - DNA, 17 bp, Homo sapiens
ctggtttgtatgatgta

SEQ ID NO: 2903533 - DNA, 18 bp, Homo sapiens
ctggttttacttacaaaa

SEQ ID NO: 2903534 - DNA, 20 bp, Homo sapiens
ctggttttcgtcatcttccc

SEQ ID NO: 2903535 - DNA, 21 bp, Homo sapiens
ctggttttcgtcatcttccct

SEQ ID NO: 2903536 - DNA, 19 bp, Homo sapiens
ctggttttgatggctgggt

SEQ ID NO: 2903537 - DNA, 18 bp, Homo sapiens
ctgtaaaaaagaaaaaca

SEQ ID NO: 2903538 - DNA, 13 bp, Homo sapiens
ctgtaaaactaag

SEQ ID NO: 2903539 - DNA, 20 bp, Homo sapiens
ctgtaaaatatagtcgctga

SEQ ID NO: 2903540 - DNA, 12 bp, Homo sapiens
ctgtaaacagaa

SEQ ID NO: 2903541 - DNA, 14 bp, Homo sapiens
ctgtaaacagaata

SEQ ID NO: 2903542 - DNA, 16 bp, Homo sapiens
ctgtaaacagaataaa

SEQ ID NO: 2903543 - DNA, 17 bp, Homo sapiens
ctgtaaagaaagagaga

SEQ ID NO: 2903544 - DNA, 21 bp, Homo sapiens
ctgtaaagaaagagagaaaat

SEQ ID NO: 2903545 - DNA, 15 bp, Homo sapiens
ctgtaaccacctctc

SEQ ID NO: 2903546 - DNA, 21 bp, Homo sapiens
ctgtaaccacctctctgtctt

SEQ ID NO: 2903547 - DNA, 15 bp, Homo sapiens
ctgtaacctcttcag

SEQ ID NO: 2903548 - DNA, 23 bp, Homo sapiens
ctgtaacctcttcagaggccctc

SEQ ID NO: 2903549 - DNA, 16 bp, Homo sapiens
ctgtaacttttaatcc

SEQ ID NO: 2903550 - DNA, 15 bp, Homo sapiens
ctgtaagatgtctgt

SEQ ID NO: 2903551 - DNA, 18 bp, Homo sapiens
ctgtaagatgtctgtttg

SEQ ID NO: 2903552 - DNA, 15 bp, Homo sapiens
ctgtaaggaactgga

SEQ ID NO: 2903553 - DNA, 17 bp, Homo sapiens
ctgtaaggaactggaac

SEQ ID NO: 2903554 - DNA, 16 bp, Homo sapiens
ctgtaaggctctagat

SEQ ID NO: 2903555 - DNA, 17 bp, Homo sapiens
ctgtaaggctctagatc

SEQ ID NO: 2903556 - DNA, 16 bp, Homo sapiens
ctgtaagttttgaatt

SEQ ID NO: 2903557 - DNA, 14 bp, Homo sapiens
ctgtaatcagcaat

SEQ ID NO: 2903558 - DNA, 20 bp, Homo sapiens
ctgtaatcatttgtttacat

SEQ ID NO: 2903559 - DNA, 15 bp, Homo sapiens
ctgtaatcccagcac

SEQ ID NO: 2903560 - DNA, 20 bp, Homo sapiens
ctgtaatctcgtttcaaaaa

SEQ ID NO: 2903561 - DNA, 13 bp, Homo sapiens
ctgtacaaaatgg

SEQ ID NO: 2903562 - DNA, 11 bp, Homo sapiens
ctgtacaataa

SEQ ID NO: 2903563 - DNA, 13 bp, Homo sapiens
ctgtacactgccc

SEQ ID NO: 2903564 - DNA, 19 bp, Homo sapiens
ctgtacagaagaaactgaa

SEQ ID NO: 2903565 - DNA, 17 bp, Homo sapiens
ctgtacagtctgtcttc

SEQ ID NO: 2903566 - DNA, 23 bp, Homo sapiens
ctgtacagtctgtcttctgtata

SEQ ID NO: 2903567 - DNA, 22 bp, Homo sapiens
ctgtacatgacatcaaaatgag

SEQ ID NO: 2903568 - DNA, 17 bp, Homo sapiens
ctgtacctgttcctccc

SEQ ID NO: 2903569 - DNA, 15 bp, Homo sapiens
ctgtactgaataggt

SEQ ID NO: 2903570 - DNA, 22 bp, Homo sapiens
ctgtacttgaagtctaaaagca

SEQ ID NO: 2903571 - DNA, 19 bp, Homo sapiens
ctgtacttttcccatttgt

SEQ ID NO: 2903572 - DNA, 15 bp, Homo sapiens
ctgtagaactgattt

SEQ ID NO: 2903573 - DNA, 19 bp, Homo sapiens
ctgtagaactgattttaca

SEQ ID NO: 2903574 - DNA, 22 bp, Homo sapiens
ctgtagaagaagtgaacactta

SEQ ID NO: 2903575 - DNA, 19 bp, Homo sapiens
ctgtagaatagcctgtggc

SEQ ID NO: 2903576 - DNA, 15 bp, Homo sapiens
ctgtagagccaatta

SEQ ID NO: 2903577 - DNA, 16 bp, Homo sapiens
ctgtagagccagcctt

SEQ ID NO: 2903578 - DNA, 17 bp, Homo sapiens
ctgtagagccagccttg

SEQ ID NO: 2903579 - DNA, 16 bp, Homo sapiens
ctgtagataacagcaa

SEQ ID NO: 2903580 - DNA, 14 bp, Homo sapiens
ctgtagatgcagaa

SEQ ID NO: 2903581 - DNA, 17 bp, Homo sapiens
ctgtagatgcagaaaaa

SEQ ID NO: 2903582 - DNA, 19 bp, Homo sapiens
ctgtagattaccaaaacaa

SEQ ID NO: 2903583 - DNA, 17 bp, Homo sapiens
ctctccaggccaggtgg

SEQ ID NO: 2903584 - DNA, 16 bp, Homo sapiens
ctctccatcttcagct

SEQ ID NO: 2903585 - DNA, 18 bp, Homo sapiens
ctctccatgcaagtgctg

SEQ ID NO: 2903586 - DNA, 20 bp, Homo sapiens
ctctccatgcaagtgctgtt

SEQ ID NO: 2903587 - DNA, 16 bp, Homo sapiens
ctctcccaacgctgaa

SEQ ID NO: 2903588 - DNA, 18 bp, Homo sapiens
ctctcccaacgctgaagc

SEQ ID NO: 2903589 - DNA, 20 bp, Homo sapiens
ctctcccacgggacctgggg

SEQ ID NO: 2903590 - DNA, 13 bp, Homo sapiens
ctctcccaggacc

SEQ ID NO: 2903591 - DNA, 16 bp, Homo sapiens
ctctcccatttcagga

SEQ ID NO: 2903592 - DNA, 21 bp, Homo sapiens
ctctccccaatatcctcgctc

SEQ ID NO: 2903593 - DNA, 19 bp, Homo sapiens
ctctccccacgagggctgg

SEQ ID NO: 2903594 - DNA, 21 bp, Homo sapiens
ctctccccacgagggctggct

SEQ ID NO: 2903595 - DNA, 11 bp, Homo sapiens
ctctccccagc

SEQ ID NO: 2903596 - DNA, 15 bp, Homo sapiens
ctctccccagcccag

SEQ ID NO: 2903597 - DNA, 18 bp, Homo sapiens
ctctccccagcccagaga

SEQ ID NO: 2903598 - DNA, 19 bp, Homo sapiens
ctctccccagcccagagac

SEQ ID NO: 2903599 - DNA, 18 bp, Homo sapiens
ctctcccgtctcgcctgc

SEQ ID NO: 2903600 - DNA, 14 bp, Homo sapiens
ctctccctaccttg

SEQ ID NO: 2903601 - DNA, 20 bp, Homo sapiens
ctctccctaccttgcctcct

SEQ ID NO: 2903602 - DNA, 13 bp, Homo sapiens
ctctccctctggc

SEQ ID NO: 2903603 - DNA, 14 bp, Homo sapiens
ctctccctgaccct

SEQ ID NO: 2903604 - DNA, 18 bp, Homo sapiens
ctctccctgacggctgcc

SEQ ID NO: 2903605 - DNA, 16 bp, Homo sapiens
ctctccctgcctcaca

SEQ ID NO: 2903606 - DNA, 14 bp, Homo sapiens
ctctcccttaccca

SEQ ID NO: 2903607 - DNA, 17 bp, Homo sapiens
ctctcccttctttacct

SEQ ID NO: 2903608 - DNA, 22 bp, Homo sapiens
ctctccgaaagaagacacagaa

SEQ ID NO: 2903609 - DNA, 22 bp, Homo sapiens
ctctccgcacacctctggctgt

SEQ ID NO: 2903610 - DNA, 15 bp, Homo sapiens
ctctcctcctgccca

SEQ ID NO: 2903611 - DNA, 12 bp, Homo sapiens
ctctcctgccac

SEQ ID NO: 2903612 - DNA, 12 bp, Homo sapiens
ctctcctgccta

SEQ ID NO: 2903613 - DNA, 14 bp, Homo sapiens
ctctcctgcctcag

SEQ ID NO: 2903614 - DNA, 15 bp, Homo sapiens
ctctcctgcctcagc

SEQ ID NO: 2903615 - DNA, 15 bp, Homo sapiens
ctctcctgtctccct

SEQ ID NO: 2903616 - DNA, 17 bp, Homo sapiens
ctctcctgtctccctcc

SEQ ID NO: 2903617 - DNA, 18 bp, Homo sapiens
ctctcctgtctgaacctg

SEQ ID NO: 2903618 - DNA, 13 bp, Homo sapiens
ctctccttcctct

SEQ ID NO: 2903619 - DNA, 21 bp, Homo sapiens
ctctccttcctcttggctgag

SEQ ID NO: 2903620 - DNA, 15 bp, Homo sapiens
ctctcctttgtatat

SEQ ID NO: 2903621 - DNA, 18 bp, Homo sapiens
ctctcctttgtatattat

SEQ ID NO: 2903622 - DNA, 20 bp, Homo sapiens
ctctcctttgtatattattt

SEQ ID NO: 2903623 - DNA, 22 bp, Homo sapiens
ctctcctttgtatattatttct

SEQ ID NO: 2903624 - DNA, 13 bp, Homo sapiens
ctctcctttttct

SEQ ID NO: 2903625 - DNA, 17 bp, Homo sapiens
ctctcgcacctttccaa

SEQ ID NO: 2903626 - DNA, 16 bp, Homo sapiens
ctctcgcatcttccca

SEQ ID NO: 2903627 - DNA, 19 bp, Homo sapiens
ctctctcagccccatcgcc

SEQ ID NO: 2903628 - DNA, 12 bp, Homo sapiens
ctctctcccacc

SEQ ID NO: 2903629 - DNA, 17 bp, Homo sapiens
ctctctcccatttcagg

SEQ ID NO: 2903630 - DNA, 18 bp, Homo sapiens
ctctctccctgcctcaca

SEQ ID NO: 2903631 - DNA, 21 bp, Homo sapiens
ctctctccctgcctcacatct

SEQ ID NO: 2903632 - DNA, 13 bp, Homo sapiens
ctctctcctggac

SEQ ID NO: 2903633 - DNA, 16 bp, Homo sapiens
ctctctcctggactgg

SEQ ID NO: 2903634 - DNA, 15 bp, Homo sapiens
ctctctcctgtactt

SEQ ID NO: 2903635 - DNA, 23 bp, Homo sapiens
ctctctcggccccctcaccccag

SEQ ID NO: 2903636 - DNA, 10 bp, Homo sapiens
ctctctctcc

SEQ ID NO: 2903637 - DNA, 10 bp, Homo sapiens
ctctctcttt

SEQ ID NO: 2903638 - DNA, 16 bp, Homo sapiens
ctctctgaacccctcc

SEQ ID NO: 2903639 - DNA, 17 bp, Homo sapiens
ctctctgagctggggag

SEQ ID NO: 2903640 - DNA, 18 bp, Homo sapiens
ctctctgagtcctggccc

SEQ ID NO: 2903641 - DNA, 16 bp, Homo sapiens
ctctctgcagccagcc

SEQ ID NO: 2903642 - DNA, 18 bp, Homo sapiens
ctctctgcagccagccca

SEQ ID NO: 2903643 - DNA, 19 bp, Homo sapiens
ctctctgcagccagcccag

SEQ ID NO: 2903644 - DNA, 12 bp, Homo sapiens
ctctctgcctgc

SEQ ID NO: 2903645 - DNA, 16 bp, Homo sapiens
ctctctgcctgctggg

SEQ ID NO: 2903646 - DNA, 10 bp, Homo sapiens
ctctctggag

SEQ ID NO: 2903647 - DNA, 16 bp, Homo sapiens
ctctctggagcccctc

SEQ ID NO: 2903648 - DNA, 20 bp, Homo sapiens
ctctctggagcccctcctcc

SEQ ID NO: 2903649 - DNA, 11 bp, Homo sapiens
ctctctgtctt

SEQ ID NO: 2903650 - DNA, 15 bp, Homo sapiens
ctctctgtctttttc

SEQ ID NO: 2903651 - DNA, 13 bp, Homo sapiens
ctctctgtggggc

SEQ ID NO: 2903652 - DNA, 23 bp, Homo sapiens
ctctctgtggtggttcattccac

SEQ ID NO: 2903653 - DNA, 22 bp, Homo sapiens
ctctcttcccttttttttctgg

SEQ ID NO: 2903654 - DNA, 20 bp, Homo sapiens
ctctcttccgggagctggtg

SEQ ID NO: 2903655 - DNA, 13 bp, Homo sapiens
ctctcttcctgca

SEQ ID NO: 2903656 - DNA, 14 bp, Homo sapiens
ctctcttcctgcag

SEQ ID NO: 2903657 - DNA, 20 bp, Homo sapiens
ctctcttgattaagatctca

SEQ ID NO: 2903658 - DNA, 18 bp, Homo sapiens
ctctcttggaattagatg

SEQ ID NO: 2903659 - DNA, 22 bp, Homo sapiens
ctctcttggaattagatgttta

SEQ ID NO: 2903660 - DNA, 21 bp, Homo sapiens
ctctctttctctctcttttcc

SEQ ID NO: 2903661 - DNA, 18 bp, Homo sapiens
ctctcttttcctctctct

SEQ ID NO: 2903662 - DNA, 19 bp, Homo sapiens
ctctcttttcctctctgtc

SEQ ID NO: 2903663 - DNA, 12 bp, Homo sapiens
ctctgaaaccag

SEQ ID NO: 2903664 - DNA, 17 bp, Homo sapiens
ctctgaaaccagtgtta

SEQ ID NO: 2903665 - DNA, 15 bp, Homo sapiens
ctctgaaaccctgga

SEQ ID NO: 2903666 - DNA, 16 bp, Homo sapiens
ctctgaaagttgtaca

SEQ ID NO: 2903667 - DNA, 18 bp, Homo sapiens
ctctgaaagttgtacatg

SEQ ID NO: 2903668 - DNA, 18 bp, Homo sapiens
ctctgaagcaaggcggtg

SEQ ID NO: 2903669 - DNA, 19 bp, Homo sapiens
ctctgaagggcatcatgca

SEQ ID NO: 2903670 - DNA, 22 bp, Homo sapiens
ctctgaagggcatcatgcatct

SEQ ID NO: 2903671 - DNA, 22 bp, Homo sapiens
ctctgaataaatacccattgaa

SEQ ID NO: 2903672 - DNA, 19 bp, Homo sapiens
ctctgaatattaagaaaca

SEQ ID NO: 2903673 - DNA, 14 bp, Homo sapiens
ctctgacaaagtgt

SEQ ID NO: 2903674 - DNA, 19 bp, Homo sapiens
ctctgacagcagcctgtga

SEQ ID NO: 2903675 - DNA, 14 bp, Homo sapiens
ctctgacccacagc

SEQ ID NO: 2903676 - DNA, 16 bp, Homo sapiens
ctctgacccacagcct

SEQ ID NO: 2903677 - DNA, 20 bp, Homo sapiens
ctctgaccccagcattctca

SEQ ID NO: 2903678 - DNA, 23 bp, Homo sapiens
ctctgaccgaaacagcgctgggt

SEQ ID NO: 2903679 - DNA, 15 bp, Homo sapiens
ctctgactcagggct

SEQ ID NO: 2903680 - DNA, 16 bp, Homo sapiens
ctctgactcagggctc

SEQ ID NO: 2903681 - DNA, 21 bp, Homo sapiens
ctctgactcagggctcctggg

SEQ ID NO: 2903682 - DNA, 12 bp, Homo sapiens
ctctgagacagg

SEQ ID NO: 2903683 - DNA, 22 bp, Homo sapiens
ctctgagagtctagattctctg

SEQ ID NO: 2903684 - DNA, 15 bp, Homo sapiens
ctctgagctggggag

SEQ ID NO: 2903685 - DNA, 16 bp, Homo sapiens
ctctgagctggggagg

SEQ ID NO: 2903686 - DNA, 15 bp, Homo sapiens
ctctgagctgtgcag

SEQ ID NO: 2903687 - DNA, 23 bp, Homo sapiens
ctctgagcttctaaactgaagct

SEQ ID NO: 2903688 - DNA, 16 bp, Homo sapiens
ctctgagtcctggccc

SEQ ID NO: 2903689 - DNA, 13 bp, Homo sapiens
ctctgagtgtctc

SEQ ID NO: 2903690 - DNA, 15 bp, Homo sapiens
ctctgagtgtctctg

SEQ ID NO: 2903691 - DNA, 18 bp, Homo sapiens
ctctgagtgtctctgcct

SEQ ID NO: 2903692 - DNA, 23 bp, Homo sapiens
ctctgagtgtctctgcctggagc

SEQ ID NO: 2903693 - DNA, 17 bp, Homo sapiens
ctctgagtgttttatga

SEQ ID NO: 2903694 - DNA, 19 bp, Homo sapiens
ctctgagtgttttatgaga

SEQ ID NO: 2903695 - DNA, 22 bp, Homo sapiens
ctctgagtgttttatgagaaag

SEQ ID NO: 2903696 - DNA, 15 bp, Homo sapiens
ctctgatcaaaatta

SEQ ID NO: 2903697 - DNA, 14 bp, Homo sapiens
ctctgatgtttggg

SEQ ID NO: 2903698 - DNA, 13 bp, Homo sapiens
ctctgcacatgtc

SEQ ID NO: 2903699 - DNA, 14 bp, Homo sapiens
ctctgcacatgtct

SEQ ID NO: 2903700 - DNA, 16 bp, Homo sapiens
ctctgcacatgtcttg

SEQ ID NO: 2903701 - DNA, 18 bp, Homo sapiens
ctctgcaccgtactgtgg

SEQ ID NO: 2903702 - DNA, 18 bp, Homo sapiens
ctctgcagacttcccagc

SEQ ID NO: 2903703 - DNA, 17 bp, Homo sapiens
ctctgcagcaatattct

SEQ ID NO: 2903704 - DNA, 14 bp, Homo sapiens
ctctgcagccagcc

SEQ ID NO: 2903705 - DNA, 20 bp, Homo sapiens
ctctgcaggaaatggctgtg

SEQ ID NO: 2903706 - DNA, 10 bp, Homo sapiens
ctctgccacc

SEQ ID NO: 2903707 - DNA, 22 bp, Homo sapiens
ctctgccagtcgggagagccag

SEQ ID NO: 2903708 - DNA, 23 bp, Homo sapiens
ctctgccagtcgggagagccagg

SEQ ID NO: 2903709 - DNA, 16 bp, Homo sapiens
ctctgcccacctctct

SEQ ID NO: 2903710 - DNA, 15 bp, Homo sapiens
ctctgcccagccggg

SEQ ID NO: 2903711 - DNA, 20 bp, Homo sapiens
ctctgcccagccgggcacag

SEQ ID NO: 2903712 - DNA, 17 bp, Homo sapiens
ctctgccccatcctcca

SEQ ID NO: 2903713 - DNA, 14 bp, Homo sapiens
ctctgcccgggagc

SEQ ID NO: 2903714 - DNA, 18 bp, Homo sapiens
ctctgccgccgcccgctg

SEQ ID NO: 2903715 - DNA, 20 bp, Homo sapiens
ctctgcctagaatctttatt

SEQ ID NO: 2903716 - DNA, 13 bp, Homo sapiens
ctctgcctcatcc

SEQ ID NO: 2903717 - DNA, 17 bp, Homo sapiens
ctctgcctcatcctcct

SEQ ID NO: 2903718 - DNA, 20 bp, Homo sapiens
ctctgcctctaactccctcc

SEQ ID NO: 2903719 - DNA, 22 bp, Homo sapiens
ctctgcctctaactccctcctc

SEQ ID NO: 2903720 - DNA, 16 bp, Homo sapiens
ctcgcacaggccctag

SEQ ID NO: 2903721 - DNA, 15 bp, Homo sapiens
ctcgcacctgtgctg

SEQ ID NO: 2903722 - DNA, 14 bp, Homo sapiens
ctcgcacctttcca

SEQ ID NO: 2903723 - DNA, 17 bp, Homo sapiens
ctcgcacttgcagagga

SEQ ID NO: 2903724 - DNA, 22 bp, Homo sapiens
ctcgcacttgcagaggagccca

SEQ ID NO: 2903725 - DNA, 17 bp, Homo sapiens
ctcgcagcccccgcgcc

SEQ ID NO: 2903726 - DNA, 12 bp, Homo sapiens
ctcgcaggacca

SEQ ID NO: 2903727 - DNA, 14 bp, Homo sapiens
ctcgcatcattgca

SEQ ID NO: 2903728 - DNA, 12 bp, Homo sapiens
ctcgccatctcc

SEQ ID NO: 2903729 - DNA, 18 bp, Homo sapiens
ctcgccatctcctgggcc

SEQ ID NO: 2903730 - DNA, 12 bp, Homo sapiens
ctcgcccaggaa

SEQ ID NO: 2903731 - DNA, 14 bp, Homo sapiens
ctcgccccagcagg

SEQ ID NO: 2903732 - DNA, 20 bp, Homo sapiens
ctcgccctgcggtagatggg

SEQ ID NO: 2903733 - DNA, 15 bp, Homo sapiens
ctcgccgtctgtgaa

SEQ ID NO: 2903734 - DNA, 15 bp, Homo sapiens
ctcgcctaggatttc

SEQ ID NO: 2903735 - DNA, 18 bp, Homo sapiens
ctatgtgtgttgtttcca

SEQ ID NO: 2903736 - DNA, 20 bp, Homo sapiens
ctatgtgtttggtttataat

SEQ ID NO: 2903737 - DNA, 13 bp, Homo sapiens
ctattaaaagttg

SEQ ID NO: 2903738 - DNA, 19 bp, Homo sapiens
ctattaaggatgtagcttt

SEQ ID NO: 2903739 - DNA, 22 bp, Homo sapiens
ctattaaggatgtagcttttca

SEQ ID NO: 2903740 - DNA, 21 bp, Homo sapiens
ctattaatcatttgatttaaa

SEQ ID NO: 2903741 - DNA, 16 bp, Homo sapiens
ctattagccacaaaat

SEQ ID NO: 2903742 - DNA, 21 bp, Homo sapiens
ctattaggtgcaatttcaagg

SEQ ID NO: 2903743 - DNA, 21 bp, Homo sapiens
ctattatactgttatccatat

SEQ ID NO: 2903744 - DNA, 20 bp, Homo sapiens
ctattatactttatcaaaga

SEQ ID NO: 2903745 - DNA, 14 bp, Homo sapiens
ctattcagttgtgt

SEQ ID NO: 2903746 - DNA, 15 bp, Homo sapiens
ctattcagttgtgtt

SEQ ID NO: 2903747 - DNA, 18 bp, Homo sapiens
ctattcccactttcattc

SEQ ID NO: 2903748 - DNA, 17 bp, Homo sapiens
ctattccttttctgtat

SEQ ID NO: 2903749 - DNA, 14 bp, Homo sapiens
ctattctctccaaa

SEQ ID NO: 2903750 - DNA, 16 bp, Homo sapiens
ctattctgagaaaaca

SEQ ID NO: 2903751 - DNA, 22 bp, Homo sapiens
ctattgcaaaggttccaactgt

SEQ ID NO: 2903752 - DNA, 21 bp, Homo sapiens
ctattgccaggaatgtttcag

SEQ ID NO: 2903753 - DNA, 15 bp, Homo sapiens
ctattggatttgtcc

SEQ ID NO: 2903754 - DNA, 14 bp, Homo sapiens
ctattgtaaggtct

SEQ ID NO: 2903755 - DNA, 19 bp, Homo sapiens
ctattgtaaggtctttgta

SEQ ID NO: 2903756 - DNA, 13 bp, Homo sapiens
ctatttaaatgaa

SEQ ID NO: 2903757 - DNA, 21 bp, Homo sapiens
ctatttaattaggaaaaaaac

SEQ ID NO: 2903758 - DNA, 15 bp, Homo sapiens
ctatttacaatgtgt

SEQ ID NO: 2903759 - DNA, 22 bp, Homo sapiens
ctatttagacactacaacatat

SEQ ID NO: 2903760 - DNA, 21 bp, Homo sapiens
ctatttatctgtagtaaacta

SEQ ID NO: 2903761 - DNA, 16 bp, Homo sapiens
ctatttatctgtgttt

SEQ ID NO: 2903762 - DNA, 16 bp, Homo sapiens
ctatttcctttgcgca

SEQ ID NO: 2903763 - DNA, 18 bp, Homo sapiens
ctatttcctttgcgcaaa

SEQ ID NO: 2903764 - DNA, 20 bp, Homo sapiens
ctatttctagggctgggaaa

SEQ ID NO: 2903765 - DNA, 18 bp, Homo sapiens
ctatttgtcttctccttc

SEQ ID NO: 2903766 - DNA, 21 bp, Homo sapiens
ctatttgtcttctccttcaaa

SEQ ID NO: 2903767 - DNA, 14 bp, Homo sapiens
ctatttgtgacttt

SEQ ID NO: 2903768 - DNA, 12 bp, Homo sapiens
ctattttcagat

SEQ ID NO: 2903769 - DNA, 22 bp, Homo sapiens
ctattttcagatgtgaaccatt

SEQ ID NO: 2903770 - DNA, 12 bp, Homo sapiens
ctatttttatca

SEQ ID NO: 2903771 - DNA, 19 bp, Homo sapiens
ctatttttatgatgacaat

SEQ ID NO: 2903772 - DNA, 12 bp, Homo sapiens
ctatttttgtac

SEQ ID NO: 2903773 - DNA, 23 bp, Homo sapiens
ctcaaaaagcagaaggagagtga

SEQ ID NO: 2903774 - DNA, 20 bp, Homo sapiens
ctcaaaaataagtcatgtgt

SEQ ID NO: 2903775 - DNA, 21 bp, Homo sapiens
ctcaaaaataatatactttta

SEQ ID NO: 2903776 - DNA, 12 bp, Homo sapiens
ctcaaaagaact

SEQ ID NO: 2903777 - DNA, 20 bp, Homo sapiens
ctcaaaatgatgcaaccaaa

SEQ ID NO: 2903778 - DNA, 14 bp, Homo sapiens
ctcaaactcctgac

SEQ ID NO: 2903779 - DNA, 16 bp, Homo sapiens
ctcaaagatctgaatt

SEQ ID NO: 2903780 - DNA, 16 bp, Homo sapiens
ctcaaatgctcagacc

SEQ ID NO: 2903781 - DNA, 19 bp, Homo sapiens
ctcaaatgctcagaccagc

SEQ ID NO: 2903782 - DNA, 16 bp, Homo sapiens
ctcaaatggggccaga

SEQ ID NO: 2903783 - DNA, 17 bp, Homo sapiens
ctcaaatggggccagat

SEQ ID NO: 2903784 - DNA, 21 bp, Homo sapiens
ctcaaatggggccagatccag

SEQ ID NO: 2903785 - DNA, 16 bp, Homo sapiens
ctcaaatgttctaagt

SEQ ID NO: 2903786 - DNA, 17 bp, Homo sapiens
ctcaaatgttctaagtt

SEQ ID NO: 2903787 - DNA, 19 bp, Homo sapiens
ctcaaatgttctaagtttc

SEQ ID NO: 2903788 - DNA, 23 bp, Homo sapiens
ctcaaatgttctaagtttctaag

SEQ ID NO: 2903789 - DNA, 24 bp, Homo sapiens
ctcaaatgttctaagtttctaaga

SEQ ID NO: 2903790 - DNA, 13 bp, Homo sapiens
ctcaaatgttttc

SEQ ID NO: 2903791 - DNA, 18 bp, Homo sapiens
ctcaacatgagtcaagag

SEQ ID NO: 2903792 - DNA, 18 bp, Homo sapiens
ctcaaccccaccacttct

SEQ ID NO: 2903793 - DNA, 19 bp, Homo sapiens
ctcaactaacccttaaaaa

SEQ ID NO: 2903794 - DNA, 20 bp, Homo sapiens
ctcaagacttatggaacagg

SEQ ID NO: 2903795 - DNA, 15 bp, Homo sapiens
ctcaagagatcccaa

SEQ ID NO: 2903796 - DNA, 18 bp, Homo sapiens
ctcaagaggaatgaaaaa

SEQ ID NO: 2903797 - DNA, 17 bp, Homo sapiens
ctcaagaggcagagttc

SEQ ID NO: 2903798 - DNA, 17 bp, Homo sapiens
ctcaagatcaatgaaat

SEQ ID NO: 2903799 - DNA, 17 bp, Homo sapiens
ctcaagcagcaaaatcc

SEQ ID NO: 2903800 - DNA, 15 bp, Homo sapiens
ctcaagcaggtttct

SEQ ID NO: 2903801 - DNA, 16 bp, Homo sapiens
ctcaagccaagcagcc

SEQ ID NO: 2903802 - DNA, 18 bp, Homo sapiens
ctcaagccaagcagccaa

SEQ ID NO: 2903803 - DNA, 22 bp, Homo sapiens
ctcaagccaagcagccaagctc

SEQ ID NO: 2903804 - DNA, 22 bp, Homo sapiens
ctcaagctggtggcctctgcag

SEQ ID NO: 2903805 - DNA, 17 bp, Homo sapiens
ctcaaggaaaggcctga

SEQ ID NO: 2903806 - DNA, 20 bp, Homo sapiens
ctcaaggcaccgcagcctgt

SEQ ID NO: 2903807 - DNA, 23 bp, Homo sapiens
ctcaaggcaccgcagcctgtcag

SEQ ID NO: 2903808 - DNA, 15 bp, Homo sapiens
ctcaagggacaagga

SEQ ID NO: 2903809 - DNA, 16 bp, Homo sapiens
ctcaagggtggcaggt

SEQ ID NO: 2903810 - DNA, 19 bp, Homo sapiens
ctcaaggttttaggttcta

SEQ ID NO: 2903811 - DNA, 17 bp, Homo sapiens
ctcaagtcttgacaatt

SEQ ID NO: 2903812 - DNA, 16 bp, Homo sapiens
ctcaagttccagtgca

SEQ ID NO: 2903813 - DNA, 24 bp, Homo sapiens
ctcaagttccagtgcagagatcct

SEQ ID NO: 2903814 - DNA, 14 bp, Homo sapiens
ctcaagttgtttaa

SEQ ID NO: 2903815 - DNA, 12 bp, Homo sapiens
ctcaagttttta

SEQ ID NO: 2903816 - DNA, 16 bp, Homo sapiens
ctcaataaatatttgt

SEQ ID NO: 2903817 - DNA, 13 bp, Homo sapiens
ctcaatagctcca

SEQ ID NO: 2903818 - DNA, 22 bp, Homo sapiens
ctcaatgaaaaatagtgtcttt

SEQ ID NO: 2903819 - DNA, 14 bp, Homo sapiens
ctcaatggcctttt

SEQ ID NO: 2903820 - DNA, 21 bp, Homo sapiens
ctcaatgtgaatcagacccta

SEQ ID NO: 2903821 - DNA, 18 bp, Homo sapiens
ctcacaccctaccttccc

SEQ ID NO: 2903822 - DNA, 22 bp, Homo sapiens
ctcacacgtttaatcccagcac

SEQ ID NO: 2903823 - DNA, 23 bp, Homo sapiens
ctcacacgtttaatcccagcact

SEQ ID NO: 2903824 - DNA, 14 bp, Homo sapiens
ctcacactcctcct

SEQ ID NO: 2903825 - DNA, 19 bp, Homo sapiens
ctcacactcctcctgccag

SEQ ID NO: 2903826 - DNA, 23 bp, Homo sapiens
ctcacactggttctcaatgaaaa

SEQ ID NO: 2903827 - DNA, 20 bp, Homo sapiens
ctcacacttactgtaagaca

SEQ ID NO: 2903828 - DNA, 15 bp, Homo sapiens
ctcacagactcttcc

SEQ ID NO: 2903829 - DNA, 22 bp, Homo sapiens
ctcacagatgctggcctcttgg

SEQ ID NO: 2903830 - DNA, 23 bp, Homo sapiens
ctcacagatgctggcctcttggc

SEQ ID NO: 2903831 - DNA, 19 bp, Homo sapiens
ctcacagattgctgcctca

SEQ ID NO: 2903832 - DNA, 18 bp, Homo sapiens
ctgtctacttgctcaggt

SEQ ID NO: 2903833 - DNA, 15 bp, Homo sapiens
ctgtctactttctct

SEQ ID NO: 2903834 - DNA, 18 bp, Homo sapiens
ctgtctagaatcctgctt

SEQ ID NO: 2903835 - DNA, 19 bp, Homo sapiens
cttccatgctcccaactcc

SEQ ID NO: 2903836 - DNA, 23 bp, Homo sapiens
cttccatggcttcctgagaaagc

SEQ ID NO: 2903837 - DNA, 16 bp, Homo sapiens
cttccattagaatgct

SEQ ID NO: 2903838 - DNA, 18 bp, Homo sapiens
cttccattctttcttcct

SEQ ID NO: 2903839 - DNA, 19 bp, Homo sapiens
cttccattctttcttcctc

SEQ ID NO: 2903840 - DNA, 20 bp, Homo sapiens
cttccattctttcttcctcc

SEQ ID NO: 2903841 - DNA, 13 bp, Homo sapiens
cttccatttgcaa

SEQ ID NO: 2903842 - DNA, 17 bp, Homo sapiens
cttcccaacttccctgt

SEQ ID NO: 2903843 - DNA, 21 bp, Homo sapiens
cttcccaacttccctgttctt

SEQ ID NO: 2903844 - DNA, 17 bp, Homo sapiens
cttcccaagaagagaga

SEQ ID NO: 2903845 - DNA, 19 bp, Homo sapiens
cttcccaaggtacagctgt

SEQ ID NO: 2903846 - DNA, 21 bp, Homo sapiens
cttcccaagtaagaggctgga

SEQ ID NO: 2903847 - DNA, 19 bp, Homo sapiens
cttcccaccctgcccctca

SEQ ID NO: 2903848 - DNA, 16 bp, Homo sapiens
cttcccagctaggaag

SEQ ID NO: 2903849 - DNA, 15 bp, Homo sapiens
cttcccagctctccc

SEQ ID NO: 2903850 - DNA, 21 bp, Homo sapiens
cttcccagctctccctctggc

SEQ ID NO: 2903851 - DNA, 16 bp, Homo sapiens
cttcccatcactggag

SEQ ID NO: 2903852 - DNA, 18 bp, Homo sapiens
cttccccaacacgcagga

SEQ ID NO: 2903853 - DNA, 20 bp, Homo sapiens
cttccccacttctgtgccac

SEQ ID NO: 2903854 - DNA, 14 bp, Homo sapiens
cttccccagacttg

SEQ ID NO: 2903855 - DNA, 21 bp, Homo sapiens
cttccccagacttgcactggg

SEQ ID NO: 2903856 - DNA, 15 bp, Homo sapiens
cttcccccaccctgg

SEQ ID NO: 2903857 - DNA, 20 bp, Homo sapiens
cttccccttgaacctcatta

SEQ ID NO: 2903858 - DNA, 16 bp, Homo sapiens
cttccccttggcctct

SEQ ID NO: 2903859 - DNA, 23 bp, Homo sapiens
cttcccgaggaactcgcctcagc

SEQ ID NO: 2903860 - DNA, 20 bp, Homo sapiens
cttcccgcctcagcctctca

SEQ ID NO: 2903861 - DNA, 12 bp, Homo sapiens
cttccctcaccc

SEQ ID NO: 2903862 - DNA, 16 bp, Homo sapiens
cttccctcactcttcc

SEQ ID NO: 2903863 - DNA, 18 bp, Homo sapiens
cttccctcactcttcctc

SEQ ID NO: 2903864 - DNA, 16 bp, Homo sapiens
cttccctctctgaaat

SEQ ID NO: 2903865 - DNA, 15 bp, Homo sapiens
cttccctcttccctc

SEQ ID NO: 2903866 - DNA, 13 bp, Homo sapiens
cttccctgcccct

SEQ ID NO: 2903867 - DNA, 14 bp, Homo sapiens
cttccctgcctcca

SEQ ID NO: 2903868 - DNA, 10 bp, Homo sapiens
cttccctggc

SEQ ID NO: 2903869 - DNA, 14 bp, Homo sapiens
cttcccttccctca

SEQ ID NO: 2903870 - DNA, 18 bp, Homo sapiens
cttcccttttaagcaagg

SEQ ID NO: 2903871 - DNA, 18 bp, Homo sapiens
cttcccttttttttctgg

SEQ ID NO: 2903872 - DNA, 21 bp, Homo sapiens
cttccgcagtgtggccaggct

SEQ ID NO: 2903873 - DNA, 15 bp, Homo sapiens
cttccgcatcctagt

SEQ ID NO: 2903874 - DNA, 15 bp, Homo sapiens
cttccgggagctggt

SEQ ID NO: 2903875 - DNA, 16 bp, Homo sapiens
cttccgggagctggtg

SEQ ID NO: 2903876 - DNA, 19 bp, Homo sapiens
cttccgggttcaagtgact

SEQ ID NO: 2903877 - DNA, 19 bp, Homo sapiens
cttcctaaatattatgaga

SEQ ID NO: 2903878 - DNA, 22 bp, Homo sapiens
cttcctaaatattatgagatgc

SEQ ID NO: 2903879 - DNA, 21 bp, Homo sapiens
cttcctaacttattgcctggg

SEQ ID NO: 2903880 - DNA, 23 bp, Homo sapiens
cttcctaacttattgcctgggca

SEQ ID NO: 2903881 - DNA, 22 bp, Homo sapiens
cttcctagaatccccttctcca

SEQ ID NO: 2903882 - DNA, 12 bp, Homo sapiens
cttcctagctta

SEQ ID NO: 2903883 - DNA, 17 bp, Homo sapiens
cttcctagcttatctcc

SEQ ID NO: 2903884 - DNA, 23 bp, Homo sapiens
cttcctagcttatctccctgctt

SEQ ID NO: 2903885 - DNA, 14 bp, Homo sapiens
cttcctatttctgg

SEQ ID NO: 2903886 - DNA, 18 bp, Homo sapiens
cttcctcaagtcttgaca

SEQ ID NO: 2903887 - DNA, 14 bp, Homo sapiens
cttcctcatctgtg

SEQ ID NO: 2903888 - DNA, 18 bp, Homo sapiens
cttcctccagaagcctcc

SEQ ID NO: 2903889 - DNA, 13 bp, Homo sapiens
cttcctccagagg

SEQ ID NO: 2903890 - DNA, 13 bp, Homo sapiens
cttcctccagtct

SEQ ID NO: 2903891 - DNA, 12 bp, Homo sapiens
cttcctcccctc

SEQ ID NO: 2903892 - DNA, 18 bp, Homo sapiens
cttcctctccacaggagc

SEQ ID NO: 2903893 - DNA, 15 bp, Homo sapiens
cttcctctgtaagat

SEQ ID NO: 2903894 - DNA, 13 bp, Homo sapiens
cttcctcttagcc

SEQ ID NO: 2903895 - DNA, 17 bp, Homo sapiens
cttcctcttagcctctg

SEQ ID NO: 2903896 - DNA, 23 bp, Homo sapiens
cttcctcttagcctctggatcta

SEQ ID NO: 2903897 - DNA, 16 bp, Homo sapiens
cttcctcttggctgag

SEQ ID NO: 2903898 - DNA, 20 bp, Homo sapiens
cttcctctttggtggcatgg

SEQ ID NO: 2903899 - DNA, 22 bp, Homo sapiens
cttcctgacccggattggccct

SEQ ID NO: 2903900 - DNA, 22 bp, Homo sapiens
cttcctgagaaacgtccatctc

SEQ ID NO: 2903901 - DNA, 23 bp, Homo sapiens
cttcctgagaaacgtccatctct

SEQ ID NO: 2903902 - DNA, 20 bp, Homo sapiens
cttcctgagaaagcccacct

SEQ ID NO: 2903903 - DNA, 22 bp, Homo sapiens
cttcctgagcagtccctgctta

SEQ ID NO: 2903904 - DNA, 15 bp, Homo sapiens
cttcctgcttcctgt

SEQ ID NO: 2903905 - DNA, 22 bp, Homo sapiens
cttcctggagactgcccagcta

SEQ ID NO: 2903906 - DNA, 12 bp, Homo sapiens
cttcctggccca

SEQ ID NO: 2903907 - DNA, 14 bp, Homo sapiens
cttcctggcccagg

SEQ ID NO: 2903908 - DNA, 15 bp, Homo sapiens
cttcctggtgagaac

SEQ ID NO: 2903909 - DNA, 22 bp, Homo sapiens
cttcctggtgagaactgaggag

SEQ ID NO: 2903910 - DNA, 16 bp, Homo sapiens
cttcctgtccagctcc

SEQ ID NO: 2903911 - DNA, 18 bp, Homo sapiens
cttcctgtccccatctgt

SEQ ID NO: 2903912 - DNA, 14 bp, Homo sapiens
cttcctgtgccttt

SEQ ID NO: 2903913 - DNA, 18 bp, Homo sapiens
cttcctgtgcctttccta

SEQ ID NO: 2903914 - DNA, 19 bp, Homo sapiens
cttcctgtgcctttcctat

SEQ ID NO: 2903915 - DNA, 23 bp, Homo sapiens
cttcctgtgtgtccaaaactgcc

SEQ ID NO: 2903916 - DNA, 18 bp, Homo sapiens
cttccttgagacacggag

SEQ ID NO: 2903917 - DNA, 20 bp, Homo sapiens
cttccttggccaagagaagg

SEQ ID NO: 2903918 - DNA, 14 bp, Homo sapiens
cttccttgggcaga

SEQ ID NO: 2903919 - DNA, 21 bp, Homo sapiens
cttccttttaagtaaggtcca

SEQ ID NO: 2903920 - DNA, 18 bp, Homo sapiens
cttcgacatgctgccagg

SEQ ID NO: 2903921 - DNA, 23 bp, Homo sapiens
cttcgaggtggatcacagaggct

SEQ ID NO: 2903922 - DNA, 16 bp, Homo sapiens
cttcgcaggcatgtcc

SEQ ID NO: 2903923 - DNA, 17 bp, Homo sapiens
cttcgcatcaaaagaca

SEQ ID NO: 2903924 - DNA, 19 bp, Homo sapiens
cttcgcatcaaaagacaat

SEQ ID NO: 2903925 - DNA, 15 bp, Homo sapiens
cttcgggaccaggat

SEQ ID NO: 2903926 - DNA, 18 bp, Homo sapiens
cttcgggcgtctgtgtgc

SEQ ID NO: 2903927 - DNA, 16 bp, Homo sapiens
cttcgggctgtgcccg

SEQ ID NO: 2903928 - DNA, 16 bp, Homo sapiens
cttcggtggaagagct

SEQ ID NO: 2903929 - DNA, 17 bp, Homo sapiens
cttcggtggaagagctc

SEQ ID NO: 2903930 - DNA, 23 bp, Homo sapiens
cttcggtgtgcagatcatccgtc

SEQ ID NO: 2903931 - DNA, 17 bp, Homo sapiens
cttcgtaacttcatatt

SEQ ID NO: 2903932 - DNA, 19 bp, Homo sapiens
cttcgttctttttaagtta

SEQ ID NO: 2903933 - DNA, 21 bp, Homo sapiens
cttcgttggtgaccagtttct

SEQ ID NO: 2903934 - DNA, 18 bp, Homo sapiens
cttcgtttactatgcctg

SEQ ID NO: 2903935 - DNA, 14 bp, Homo sapiens
cttctaaaaatgaa

SEQ ID NO: 2903936 - DNA, 18 bp, Homo sapiens
cttctaaacttccccatc

SEQ ID NO: 2903937 - DNA, 22 bp, Homo sapiens
cttctaaaggtgttgtcccttc

SEQ ID NO: 2903938 - DNA, 24 bp, Homo sapiens
cttctaaatgagtcactgagcatc

SEQ ID NO: 2903939 - DNA, 20 bp, Homo sapiens
cttctaattttgtgctcttt

SEQ ID NO: 2903940 - DNA, 19 bp, Homo sapiens
cttctacatgatgctaaag

SEQ ID NO: 2903941 - DNA, 13 bp, Homo sapiens
cttctaccagacc

SEQ ID NO: 2903942 - DNA, 17 bp, Homo sapiens
cttctaccatgaacaga

SEQ ID NO: 2903943 - DNA, 19 bp, Homo sapiens
cttctacttatcatgtaaa

SEQ ID NO: 2903944 - DNA, 19 bp, Homo sapiens
cttctagaagataacattt

SEQ ID NO: 2903945 - DNA, 22 bp, Homo sapiens
cttctagaagataacattttca

SEQ ID NO: 2903946 - DNA, 13 bp, Homo sapiens
cttctagagtttt

SEQ ID NO: 2903947 - DNA, 20 bp, Homo sapiens
cttctaggagtcaactggct

SEQ ID NO: 2903948 - DNA, 22 bp, Homo sapiens
cttctaggagtcaactggctgg

SEQ ID NO: 2903949 - DNA, 16 bp, Homo sapiens
cttctagttctgccag

SEQ ID NO: 2903950 - DNA, 19 bp, Homo sapiens
cttctatattttaatagaa

SEQ ID NO: 2903951 - DNA, 22 bp, Homo sapiens
cttctatgtaggaaaaaaatag

SEQ ID NO: 2903952 - DNA, 21 bp, Homo sapiens
cttctcaaagctgggattaca

SEQ ID NO: 2903953 - DNA, 16 bp, Homo sapiens
cttctcaagttctaag

SEQ ID NO: 2903954 - DNA, 13 bp, Homo sapiens
cttctcacattta

SEQ ID NO: 2903955 - DNA, 16 bp, Homo sapiens
cttctcaccagctgca

SEQ ID NO: 2903956 - DNA, 20 bp, Homo sapiens
cttctcaccagctgcaaagt

SEQ ID NO: 2903957 - DNA, 12 bp, Homo sapiens
cttctcagctct

SEQ ID NO: 2903958 - DNA, 11 bp, Homo sapiens
cttctcaggaa

SEQ ID NO: 2903959 - DNA, 13 bp, Homo sapiens
cttctcaggaaat

SEQ ID NO: 2903960 - DNA, 16 bp, Homo sapiens
cttctcatcacacaca

SEQ ID NO: 2903961 - DNA, 17 bp, Homo sapiens
cttctcatcacacacat

SEQ ID NO: 2903962 - DNA, 14 bp, Homo sapiens
cttctccatccaca

SEQ ID NO: 2903963 - DNA, 21 bp, Homo sapiens
cttctgggcagagcctgtccc

SEQ ID NO: 2903964 - DNA, 16 bp, Homo sapiens
cttctggggtccccag

SEQ ID NO: 2903965 - DNA, 19 bp, Homo sapiens
cttctggggtccccagggc

SEQ ID NO: 2903966 - DNA, 19 bp, Homo sapiens
cttctgggttcaagcgatt

SEQ ID NO: 2903967 - DNA, 14 bp, Homo sapiens
cttctggtcccctg

SEQ ID NO: 2903968 - DNA, 15 bp, Homo sapiens
cttctggtcccctgt

SEQ ID NO: 2903969 - DNA, 21 bp, Homo sapiens
cttctggtgaccttccaagag

SEQ ID NO: 2903970 - DNA, 18 bp, Homo sapiens
cttctgtatactgtggag

SEQ ID NO: 2903971 - DNA, 11 bp, Homo sapiens
cttctgtattt

SEQ ID NO: 2903972 - DNA, 13 bp, Homo sapiens
cttctgtattttc

SEQ ID NO: 2903973 - DNA, 14 bp, Homo sapiens
cttctgtccctcac

SEQ ID NO: 2903974 - DNA, 16 bp, Homo sapiens
cttctgtcctgtgagg

SEQ ID NO: 2903975 - DNA, 11 bp, Homo sapiens
cttctgtgaag

SEQ ID NO: 2903976 - DNA, 14 bp, Homo sapiens
cttctgtgctcatg

SEQ ID NO: 2903977 - DNA, 11 bp, Homo sapiens
cttctgtgttt

SEQ ID NO: 2903978 - DNA, 14 bp, Homo sapiens
cttcttaaagtatt

SEQ ID NO: 2903979 - DNA, 19 bp, Homo sapiens
cttcttaaagtattcttct

SEQ ID NO: 2903980 - DNA, 17 bp, Homo sapiens
cttcttatatctgaaga

SEQ ID NO: 2903981 - DNA, 21 bp, Homo sapiens
cttcttcagccacctctcttt

SEQ ID NO: 2903982 - DNA, 16 bp, Homo sapiens
cttcttcagggcctgg

SEQ ID NO: 2903983 - DNA, 19 bp, Homo sapiens
cttcttccaaggagcagag

SEQ ID NO: 2903984 - DNA, 15 bp, Homo sapiens
cttcttccacttctc

SEQ ID NO: 2903985 - DNA, 17 bp, Homo sapiens
cttcttccacttctcca

SEQ ID NO: 2903986 - DNA, 20 bp, Homo sapiens
cttcttcctcaagtcttgac

SEQ ID NO: 2903987 - DNA, 19 bp, Homo sapiens
cttcttctcctaggattcc

SEQ ID NO: 2903988 - DNA, 18 bp, Homo sapiens
cttcttggtgctgttgaa

SEQ ID NO: 2903989 - DNA, 13 bp, Homo sapiens
cttcttgtaatat

SEQ ID NO: 2903990 - DNA, 12 bp, Homo sapiens
cttcttgtgaag

SEQ ID NO: 2903991 - DNA, 18 bp, Homo sapiens
cttcttgtgtcctggctg

SEQ ID NO: 2903992 - DNA, 17 bp, Homo sapiens
cttctttatactctctt

SEQ ID NO: 2903993 - DNA, 18 bp, Homo sapiens
cttctttatactctcttc

SEQ ID NO: 2903994 - DNA, 19 bp, Homo sapiens
cttctttatactctcttcc

SEQ ID NO: 2903995 - DNA, 18 bp, Homo sapiens
cttctttcctttactcct

SEQ ID NO: 2903996 - DNA, 22 bp, Homo sapiens
cttctttcctttactcctggct

SEQ ID NO: 2903997 - DNA, 20 bp, Homo sapiens
cttctttggacttctgaaga

SEQ ID NO: 2903998 - DNA, 20 bp, Homo sapiens
cttcttttcacattcttata

SEQ ID NO: 2903999 - DNA, 16 bp, Homo sapiens
cttcttttcctgcagg

SEQ ID NO: 2904000 - DNA, 12 bp, Homo sapiens
cttgaaaaatac

SEQ ID NO: 2904001 - DNA, 20 bp, Homo sapiens
cttgaaaaatacttttcctt

SEQ ID NO: 2904002 - DNA, 22 bp, Homo sapiens
cttgaaaataagaatagaaata

SEQ ID NO: 2904003 - DNA, 17 bp, Homo sapiens
cttgaaacctgatgtca

SEQ ID NO: 2904004 - DNA, 18 bp, Homo sapiens
cttgaaatatcctgcttg

SEQ ID NO: 2904005 - DNA, 15 bp, Homo sapiens
cttgaacaaaaagtt

SEQ ID NO: 2904006 - DNA, 18 bp, Homo sapiens
cttgaacctatgaagcaa

SEQ ID NO: 2904007 - DNA, 10 bp, Homo sapiens
cttgaagaaa

SEQ ID NO: 2904008 - DNA, 16 bp, Homo sapiens
cttgaagaatattccc

SEQ ID NO: 2904009 - DNA, 22 bp, Homo sapiens
cttgaagacagagcaaagcgcc

SEQ ID NO: 2904010 - DNA, 15 bp, Homo sapiens
cttgaagactccctg

SEQ ID NO: 2904011 - DNA, 16 bp, Homo sapiens
cttgaagactccctga

SEQ ID NO: 2904012 - DNA, 12 bp, Homo sapiens
cttgaagcagtc

SEQ ID NO: 2904013 - DNA, 23 bp, Homo sapiens
cttgaagcatttcaaagccctgc

SEQ ID NO: 2904014 - DNA, 16 bp, Homo sapiens
cttgaagggccagagc

SEQ ID NO: 2904015 - DNA, 20 bp, Homo sapiens
cttgaagggccagagccagg

SEQ ID NO: 2904016 - DNA, 22 bp, Homo sapiens
cttgaaggtgctgacggccagg

SEQ ID NO: 2904017 - DNA, 22 bp, Homo sapiens
cttgaagtaactataacaaaaa

SEQ ID NO: 2904018 - DNA, 19 bp, Homo sapiens
cttgaagtcctggcttcag

SEQ ID NO: 2904019 - DNA, 19 bp, Homo sapiens
cttgaagtctaaaagcaga

SEQ ID NO: 2904020 - DNA, 20 bp, Homo sapiens
cttgaagtctaaaagcagaa

SEQ ID NO: 2904021 - DNA, 14 bp, Homo sapiens
cttgaataggaaga

SEQ ID NO: 2904022 - DNA, 20 bp, Homo sapiens
cttgaatatgggcggaagta

SEQ ID NO: 2904023 - DNA, 22 bp, Homo sapiens
cttgaatgtggcttgagaaata

SEQ ID NO: 2904024 - DNA, 13 bp, Homo sapiens
cttgaatttctga

SEQ ID NO: 2904025 - DNA, 14 bp, Homo sapiens
cttgaatttgcatg

SEQ ID NO: 2904026 - DNA, 23 bp, Homo sapiens
cttgaatttgcatgtctaattca

SEQ ID NO: 2904027 - DNA, 20 bp, Homo sapiens
cttgacaactggcaggcagg

SEQ ID NO: 2904028 - DNA, 14 bp, Homo sapiens
cttgacacctttga

SEQ ID NO: 2904029 - DNA, 20 bp, Homo sapiens
cttgacagtggaactacatt

SEQ ID NO: 2904030 - DNA, 20 bp, Homo sapiens
cttgaccaagcaggaagctc

SEQ ID NO: 2904031 - DNA, 17 bp, Homo sapiens
cttgacctgaactctgc

SEQ ID NO: 2904032 - DNA, 19 bp, Homo sapiens
cttgacctgaactctgcaa

SEQ ID NO: 2904033 - DNA, 15 bp, Homo sapiens
cttgaccttgtagag

SEQ ID NO: 2904034 - DNA, 21 bp, Homo sapiens
cttgactcctttggtatttca

SEQ ID NO: 2904035 - DNA, 18 bp, Homo sapiens
cttgactgaagcgaacat

SEQ ID NO: 2904036 - DNA, 18 bp, Homo sapiens
cttgagacaaatcctttc

SEQ ID NO: 2904037 - DNA, 18 bp, Homo sapiens
cttgtgatgtttgctcag

SEQ ID NO: 2904038 - DNA, 19 bp, Homo sapiens
cttgtgatgtttgctcaga

SEQ ID NO: 2904039 - DNA, 20 bp, Homo sapiens
cttgtgatgtttgctcagag

SEQ ID NO: 2904040 - DNA, 11 bp, Homo sapiens
cttgtgccata

SEQ ID NO: 2904041 - DNA, 17 bp, Homo sapiens
cttgtgcctcccttccc

SEQ ID NO: 2904042 - DNA, 15 bp, Homo sapiens
cttgtgcctgggagt

SEQ ID NO: 2904043 - DNA, 19 bp, Homo sapiens
cttgtggaaaaaaagtgct

SEQ ID NO: 2904044 - DNA, 16 bp, Homo sapiens
cttgtggatgttttaa

SEQ ID NO: 2904045 - DNA, 22 bp, Homo sapiens
cttgtggtctcgatgctgctgg

SEQ ID NO: 2904046 - DNA, 23 bp, Homo sapiens
cttgtggtctcgatgctgctggc

SEQ ID NO: 2904047 - DNA, 17 bp, Homo sapiens
cttgtgtatttctctgt

SEQ ID NO: 2904048 - DNA, 21 bp, Homo sapiens
cttgtgtatttctctgtgaat

SEQ ID NO: 2904049 - DNA, 20 bp, Homo sapiens
cttgtgtggcgcacttcaga

SEQ ID NO: 2904050 - DNA, 15 bp, Homo sapiens
cttgtgtgtaccaca

SEQ ID NO: 2904051 - DNA, 23 bp, Homo sapiens
cttgtgtgtaccacaccctgcct

SEQ ID NO: 2904052 - DNA, 16 bp, Homo sapiens
cttgtgtgtcaggccc

SEQ ID NO: 2904053 - DNA, 13 bp, Homo sapiens
cttgtgttccttc

SEQ ID NO: 2904054 - DNA, 17 bp, Homo sapiens
cttgttacccatgaaaa

SEQ ID NO: 2904055 - DNA, 20 bp, Homo sapiens
cttgttcatttctgtctccc

SEQ ID NO: 2904056 - DNA, 22 bp, Homo sapiens
cttgttcatttctgtctcccct

SEQ ID NO: 2904057 - DNA, 13 bp, Homo sapiens
cttgttcatttgg

SEQ ID NO: 2904058 - DNA, 17 bp, Homo sapiens
cttgttccaaggccagg

SEQ ID NO: 2904059 - DNA, 19 bp, Homo sapiens
cttgttctcagagcactgt

SEQ ID NO: 2904060 - DNA, 20 bp, Homo sapiens
cttgttgctcaaaaaatgag

SEQ ID NO: 2904061 - DNA, 15 bp, Homo sapiens
cttgttgctttgttg

SEQ ID NO: 2904062 - DNA, 17 bp, Homo sapiens
cttgttgtaaagcaata

SEQ ID NO: 2904063 - DNA, 14 bp, Homo sapiens
cttgttgtcaagta

SEQ ID NO: 2904064 - DNA, 17 bp, Homo sapiens
cttgttgtgcttttagt

SEQ ID NO: 2904065 - DNA, 15 bp, Homo sapiens
cttgttgtttatatg

SEQ ID NO: 2904066 - DNA, 23 bp, Homo sapiens
cttgttgtttgttgacagcttgg

SEQ ID NO: 2904067 - DNA, 23 bp, Homo sapiens
cttgtttaaaaaaacaaataaat

SEQ ID NO: 2904068 - DNA, 17 bp, Homo sapiens
cttgtttaaaaaaagaa

SEQ ID NO: 2904069 - DNA, 19 bp, Homo sapiens
cttgtttaaaaaaagaaaa

SEQ ID NO: 2904070 - DNA, 13 bp, Homo sapiens
cttgtttcctgtg

SEQ ID NO: 2904071 - DNA, 14 bp, Homo sapiens
cttgtttcctgtgc

SEQ ID NO: 2904072 - DNA, 16 bp, Homo sapiens
cttgtttctgtttagt

SEQ ID NO: 2904073 - DNA, 17 bp, Homo sapiens
cttgtttctgtttagtc

SEQ ID NO: 2904074 - DNA, 23 bp, Homo sapiens
cttgtttggagggatcattttct

SEQ ID NO: 2904075 - DNA, 16 bp, Homo sapiens
cttgtttgtcagcatc

SEQ ID NO: 2904076 - DNA, 18 bp, Homo sapiens
cttgtttgtcagcatctg

SEQ ID NO: 2904077 - DNA, 13 bp, Homo sapiens
cttgtttgtttta

SEQ ID NO: 2904078 - DNA, 20 bp, Homo sapiens
cttgttttcaaagggacttt

SEQ ID NO: 2904079 - DNA, 14 bp, Homo sapiens
cttgttttgccatg

SEQ ID NO: 2904080 - DNA, 12 bp, Homo sapiens
cttgtttttgag

SEQ ID NO: 2904081 - DNA, 21 bp, Homo sapiens
ctttaaaaaagaaattatctt

SEQ ID NO: 2904082 - DNA, 13 bp, Homo sapiens
ctttaaaaagaaa

SEQ ID NO: 2904083 - DNA, 14 bp, Homo sapiens
ctttaaaaagaaaa

SEQ ID NO: 2904084 - DNA, 16 bp, Homo sapiens
ctttaaaaagcaggaa

SEQ ID NO: 2904085 - DNA, 14 bp, Homo sapiens
ctttaaaaatgtat

SEQ ID NO: 2904086 - DNA, 16 bp, Homo sapiens
ctttaaaatgtaaagc

SEQ ID NO: 2904087 - DNA, 21 bp, Homo sapiens
ctttaaaatgtaaagccatgc

SEQ ID NO: 2904088 - DNA, 19 bp, Homo sapiens
ctttaaaattacaactaag

SEQ ID NO: 2904089 - DNA, 23 bp, Homo sapiens
ctttaaacctgtttttttttcat

SEQ ID NO: 2904090 - DNA, 21 bp, Homo sapiens
ctttaaaggcatctacacaat

SEQ ID NO: 2904091 - DNA, 21 bp, Homo sapiens
ctttaaagtgagtactgttaa

SEQ ID NO: 2904092 - DNA, 22 bp, Homo sapiens
ctttaaagtgagtactgttaag

SEQ ID NO: 2904093 - DNA, 20 bp, Homo sapiens
ctttaaatactccctttttg

SEQ ID NO: 2904094 - DNA, 15 bp, Homo sapiens
ctttaaatcagattt

SEQ ID NO: 2904095 - DNA, 15 bp, Homo sapiens
ctttaaattaaaatt

SEQ ID NO: 2904096 - DNA, 19 bp, Homo sapiens
ctttaacaggttttcttct

SEQ ID NO: 2904097 - DNA, 17 bp, Homo sapiens
ctttaaccgtttttcaa

SEQ ID NO: 2904098 - DNA, 19 bp, Homo sapiens
ctttaactcgttgcagtct

SEQ ID NO: 2904099 - DNA, 14 bp, Homo sapiens
ctttaactctgcgg

SEQ ID NO: 2904100 - DNA, 11 bp, Homo sapiens
ctttaagaaaa

SEQ ID NO: 2904101 - DNA, 19 bp, Homo sapiens
ctttaagcctgcattctta

SEQ ID NO: 2904102 - DNA, 20 bp, Homo sapiens
ctttaagttttatttaactt

SEQ ID NO: 2904103 - DNA, 14 bp, Homo sapiens
ctttaatgctgtct

SEQ ID NO: 2904104 - DNA, 19 bp, Homo sapiens
ctttaatgctgtctttgtg

SEQ ID NO: 2904105 - DNA, 21 bp, Homo sapiens
ctttaatgctgtctttgtgga

SEQ ID NO: 2904106 - DNA, 12 bp, Homo sapiens
ctttaatttatg

SEQ ID NO: 2904107 - DNA, 21 bp, Homo sapiens
ctttacaagggagaagacaac

SEQ ID NO: 2904108 - DNA, 19 bp, Homo sapiens
ctttacactcggctttgga

SEQ ID NO: 2904109 - DNA, 20 bp, Homo sapiens
ctttaccaaacagcaaacca

SEQ ID NO: 2904110 - DNA, 17 bp, Homo sapiens
ctttaccccatccctgt

SEQ ID NO: 2904111 - DNA, 22 bp, Homo sapiens
ctttacccttgagccctcccca

SEQ ID NO: 2904112 - DNA, 14 bp, Homo sapiens
ctttaccttcattt

SEQ ID NO: 2904113 - DNA, 22 bp, Homo sapiens
ctttaccttcctcaggtaacag

SEQ ID NO: 2904114 - DNA, 12 bp, Homo sapiens
ctttactcctgg

SEQ ID NO: 2904115 - DNA, 14 bp, Homo sapiens
ctttactcctggct

SEQ ID NO: 2904116 - DNA, 14 bp, Homo sapiens
ctttactgaccctg

SEQ ID NO: 2904117 - DNA, 13 bp, Homo sapiens
ctttactgcctga

SEQ ID NO: 2904118 - DNA, 19 bp, Homo sapiens
ctttagaaagctgacattg

SEQ ID NO: 2904119 - DNA, 16 bp, Homo sapiens
ctttagagaactgaaa

SEQ ID NO: 2904120 - DNA, 18 bp, Homo sapiens
ctttagcccctcccaagc

SEQ ID NO: 2904121 - DNA, 22 bp, Homo sapiens
ctttagcccctcccaagctggc

SEQ ID NO: 2904122 - DNA, 22 bp, Homo sapiens
ctttagcgctcaataggaccag

SEQ ID NO: 2904123 - DNA, 13 bp, Homo sapiens
ctttagctttgac

SEQ ID NO: 2904124 - DNA, 22 bp, Homo sapiens
ctttaggagatttattttttgg

SEQ ID NO: 2904125 - DNA, 13 bp, Homo sapiens
ctttaggctttca

SEQ ID NO: 2904126 - DNA, 17 bp, Homo sapiens
ctttaggctttcagctt

SEQ ID NO: 2904127 - DNA, 19 bp, Homo sapiens
ctttagggggtgggagggg

SEQ ID NO: 2904128 - DNA, 17 bp, Homo sapiens
ctttagggtttaaaata

SEQ ID NO: 2904129 - DNA, 17 bp, Homo sapiens
ctttaggtctttgtaag

SEQ ID NO: 2904130 - DNA, 16 bp, Homo sapiens
ctttagtgattgcttt

SEQ ID NO: 2904131 - DNA, 21 bp, Homo sapiens
ctttagtgtattttctgtcac

SEQ ID NO: 2904132 - DNA, 20 bp, Homo sapiens
ctttatacaacagtgctaaa

SEQ ID NO: 2904133 - DNA, 17 bp, Homo sapiens
ctttatactctcttccc

SEQ ID NO: 2904134 - DNA, 18 bp, Homo sapiens
ctttatactctcttccct

SEQ ID NO: 2904135 - DNA, 17 bp, Homo sapiens
ctttatactgtgaagtt

SEQ ID NO: 2904136 - DNA, 23 bp, Homo sapiens
ctttatacttaaacagctttttt

SEQ ID NO: 2904137 - DNA, 22 bp, Homo sapiens
ctttatataaggtcatagattc

SEQ ID NO: 2904138 - DNA, 16 bp, Homo sapiens
ctttatatacaataat

SEQ ID NO: 2904139 - DNA, 19 bp, Homo sapiens
ctttatatacaataatgga

SEQ ID NO: 2904140 - DNA, 21 bp, Homo sapiens
ctttatatacaataatggaaa

SEQ ID NO: 2904141 - DNA, 16 bp, Homo sapiens
ctttatatttcaataa

SEQ ID NO: 2904142 - DNA, 19 bp, Homo sapiens
ctttatatttcaataaatg

SEQ ID NO: 2904143 - DNA, 16 bp, Homo sapiens
ctttatattttcctct

SEQ ID NO: 2904144 - DNA, 18 bp, Homo sapiens
ctttatcaaggagatata

SEQ ID NO: 2904145 - DNA, 19 bp, Homo sapiens
ctttatcacctcattctga

SEQ ID NO: 2904146 - DNA, 15 bp, Homo sapiens
ctttatccctgctta

SEQ ID NO: 2904147 - DNA, 16 bp, Homo sapiens
ctttatccctgcttat

SEQ ID NO: 2904148 - DNA, 19 bp, Homo sapiens
ctttatccctgcttatctg

SEQ ID NO: 2904149 - DNA, 20 bp, Homo sapiens
ctttatgaggtcgtataatt

SEQ ID NO: 2904150 - DNA, 19 bp, Homo sapiens
ctttatgataatagattct

SEQ ID NO: 2904151 - DNA, 16 bp, Homo sapiens
ctttatgtagagaaaa

SEQ ID NO: 2904152 - DNA, 23 bp, Homo sapiens
ctttatgtggaaaacagaacatc

SEQ ID NO: 2904153 - DNA, 20 bp, Homo sapiens
ctttatgtttttgaggcttt

SEQ ID NO: 2904154 - DNA, 17 bp, Homo sapiens
ctttattaaaaactgag

SEQ ID NO: 2904155 - DNA, 20 bp, Homo sapiens
ctttattcttgaaagaagaa

SEQ ID NO: 2904156 - DNA, 17 bp, Homo sapiens
ctttatttttctttaaa

SEQ ID NO: 2904157 - DNA, 22 bp, Homo sapiens
ctttatttttctttaaagccag

SEQ ID NO: 2904158 - DNA, 14 bp, Homo sapiens
ctttcaaagacaat

SEQ ID NO: 2904159 - DNA, 12 bp, Homo sapiens
ctttcaaagctt

SEQ ID NO: 2904160 - DNA, 18 bp, Homo sapiens
ctttcaaattgaaatgac

SEQ ID NO: 2904161 - DNA, 19 bp, Homo sapiens
ctttcaaatttagaaacta

SEQ ID NO: 2904162 - DNA, 14 bp, Homo sapiens
ctttcaacttgcat

SEQ ID NO: 2904163 - DNA, 21 bp, Homo sapiens
ctttcaattccgtagccagct

SEQ ID NO: 2904164 - DNA, 13 bp, Homo sapiens
ctttcaattctgt

SEQ ID NO: 2904165 - DNA, 15 bp, Homo sapiens
ctttcaccccagggc

SEQ ID NO: 2904166 - DNA, 21 bp, Homo sapiens
ctttcaccccagggcctgagc

SEQ ID NO: 2904167 - DNA, 23 bp, Homo sapiens
ctttcaccccagggcctgagcct

SEQ ID NO: 2904168 - DNA, 15 bp, Homo sapiens
ctttcacgggcccca

SEQ ID NO: 2904169 - DNA, 19 bp, Homo sapiens
ctttcactacatattaaat

SEQ ID NO: 2904170 - DNA, 20 bp, Homo sapiens
ctttcagccacatgccccag

SEQ ID NO: 2904171 - DNA, 16 bp, Homo sapiens
ctttcagcgcccccag

SEQ ID NO: 2904172 - DNA, 21 bp, Homo sapiens
ctttcagggcagcccctgcag

SEQ ID NO: 2904173 - DNA, 19 bp, Homo sapiens
gaaaatacaacttaaataa

SEQ ID NO: 2904174 - DNA, 18 bp, Homo sapiens
gaaaatagggtccttgaa

SEQ ID NO: 2904175 - DNA, 16 bp, Homo sapiens
gaaaatatactgtaaa

SEQ ID NO: 2904176 - DNA, 17 bp, Homo sapiens
gaaaatatactgtaaag

SEQ ID NO: 2904177 - DNA, 15 bp, Homo sapiens
gaaaatatatgtatt

SEQ ID NO: 2904178 - DNA, 21 bp, Homo sapiens
gaaaatatttcctgacttgag

SEQ ID NO: 2904179 - DNA, 14 bp, Homo sapiens
gaaaatcaaataca

SEQ ID NO: 2904180 - DNA, 13 bp, Homo sapiens
gaaaatcctctgg

SEQ ID NO: 2904181 - DNA, 20 bp, Homo sapiens
gaaaatcttataatttaaaa

SEQ ID NO: 2904182 - DNA, 16 bp, Homo sapiens
gaaaatgaatccctct

SEQ ID NO: 2904183 - DNA, 22 bp, Homo sapiens
gaaaatgcagcagggatgccct

SEQ ID NO: 2904184 - DNA, 15 bp, Homo sapiens
gaaaatggaaccagg

SEQ ID NO: 2904185 - DNA, 21 bp, Homo sapiens
gaaaatgtaaaaaacaaaaac

SEQ ID NO: 2904186 - DNA, 17 bp, Homo sapiens
gaaaatgtatccagagg

SEQ ID NO: 2904187 - DNA, 13 bp, Homo sapiens
gaaaatgtatttg

SEQ ID NO: 2904188 - DNA, 10 bp, Homo sapiens
gaaaatgtgt

SEQ ID NO: 2904189 - DNA, 15 bp, Homo sapiens
gaaaatgttgagaat

SEQ ID NO: 2904190 - DNA, 21 bp, Homo sapiens
gaaacaaaaattgtctttatg

SEQ ID NO: 2904191 - DNA, 14 bp, Homo sapiens
gaaacaaacaaaac

SEQ ID NO: 2904192 - DNA, 15 bp, Homo sapiens
gaaacaaagcttagc

SEQ ID NO: 2904193 - DNA, 20 bp, Homo sapiens
gaaacaaataatttgaactt

SEQ ID NO: 2904194 - DNA, 15 bp, Homo sapiens
gaaacaacagcttta

SEQ ID NO: 2904195 - DNA, 20 bp, Homo sapiens
gaaacaactctttgagaaac

SEQ ID NO: 2904196 - DNA, 13 bp, Homo sapiens
gaaacaagggaag

SEQ ID NO: 2904197 - DNA, 17 bp, Homo sapiens
gaaacaataaagaaaga

SEQ ID NO: 2904198 - DNA, 21 bp, Homo sapiens
gaaacacaatacctacaataa

SEQ ID NO: 2904199 - DNA, 21 bp, Homo sapiens
gaaacacactgaggcagggaa

SEQ ID NO: 2904200 - DNA, 17 bp, Homo sapiens
gaaacactatttgtgac

SEQ ID NO: 2904201 - DNA, 20 bp, Homo sapiens
gaaacactatttgtgacttt

SEQ ID NO: 2904202 - DNA, 15 bp, Homo sapiens
gaaacactccttgca

SEQ ID NO: 2904203 - DNA, 12 bp, Homo sapiens
gaaacactgcct

SEQ ID NO: 2904204 - DNA, 13 bp, Homo sapiens
gaaacactgcttc

SEQ ID NO: 2904205 - DNA, 17 bp, Homo sapiens
gaaacagaaaaataagt

SEQ ID NO: 2904206 - DNA, 14 bp, Homo sapiens
gaaacagaggtaaa

SEQ ID NO: 2904207 - DNA, 12 bp, Homo sapiens
gaaacagcaaac

SEQ ID NO: 2904208 - DNA, 15 bp, Homo sapiens
gaaacagctgcctta

SEQ ID NO: 2904209 - DNA, 19 bp, Homo sapiens
gaaacatcagttactctga

SEQ ID NO: 2904210 - DNA, 23 bp, Homo sapiens
gaaacatgggctgtgattactgc

SEQ ID NO: 2904211 - DNA, 18 bp, Homo sapiens
gaaacattactttgagtg

SEQ ID NO: 2904212 - DNA, 16 bp, Homo sapiens
gaaacattattttaat

SEQ ID NO: 2904213 - DNA, 17 bp, Homo sapiens
gaaaccaagtgggctgg

SEQ ID NO: 2904214 - DNA, 18 bp, Homo sapiens
gaaaccagagtctgtatt

SEQ ID NO: 2904215 - DNA, 23 bp, Homo sapiens
gaaaccattttcccatcatcctt

SEQ ID NO: 2904216 - DNA, 19 bp, Homo sapiens
gaaacccataggcccacac

SEQ ID NO: 2904217 - DNA, 21 bp, Homo sapiens
gaaacccataggcccacacac

SEQ ID NO: 2904218 - DNA, 22 bp, Homo sapiens
gaaacccataggcccacacaca

SEQ ID NO: 2904219 - DNA, 15 bp, Homo sapiens
gaaacccccacacac

SEQ ID NO: 2904220 - DNA, 15 bp, Homo sapiens
gaaacccgagggttg

SEQ ID NO: 2904221 - DNA, 21 bp, Homo sapiens
gaaaccctggaccagtggtct

SEQ ID NO: 2904222 - DNA, 14 bp, Homo sapiens
gaaaccgtccctga

SEQ ID NO: 2904223 - DNA, 15 bp, Homo sapiens
gaaacctgatgtcag

SEQ ID NO: 2904224 - DNA, 14 bp, Homo sapiens
gaaacctgggagag

SEQ ID NO: 2904225 - DNA, 12 bp, Homo sapiens
gaaacctgggct

SEQ ID NO: 2904226 - DNA, 18 bp, Homo sapiens
gaaacctgggctctggtt

SEQ ID NO: 2904227 - DNA, 21 bp, Homo sapiens
gaaacctgtataaccctgtta

SEQ ID NO: 2904228 - DNA, 14 bp, Homo sapiens
gaaacctgtatctt

SEQ ID NO: 2904229 - DNA, 17 bp, Homo sapiens
gaaaccttggtgtagtt

SEQ ID NO: 2904230 - DNA, 22 bp, Homo sapiens
gaaaccttggtgtagttgaact

SEQ ID NO: 2904231 - DNA, 18 bp, Homo sapiens
gaaaccttgtttgtttta

SEQ ID NO: 2904232 - DNA, 19 bp, Homo sapiens
gaaacctttatccctgctt

SEQ ID NO: 2904233 - DNA, 21 bp, Homo sapiens
gaaacgctacctctctgtccc

SEQ ID NO: 2904234 - DNA, 23 bp, Homo sapiens
gaaacgctacctctctgtccctt

SEQ ID NO: 2904235 - DNA, 16 bp, Homo sapiens
gaaacgtcttctaaac

SEQ ID NO: 2904236 - DNA, 19 bp, Homo sapiens
gaaactaaagcaatagaaa

SEQ ID NO: 2904237 - DNA, 20 bp, Homo sapiens
gaaactaattgactttagaa

SEQ ID NO: 2904238 - DNA, 18 bp, Homo sapiens
gaaactaccagtgggcat

SEQ ID NO: 2904239 - DNA, 16 bp, Homo sapiens
gaaactagaaatctgt

SEQ ID NO: 2904240 - DNA, 20 bp, Homo sapiens
gaaactcccttgtgttcctt

SEQ ID NO: 2904241 - DNA, 20 bp, Homo sapiens
gaaactcttgctattgaatt

SEQ ID NO: 2904242 - DNA, 18 bp, Homo sapiens
gaaactgtgaatgcttct

SEQ ID NO: 2904243 - DNA, 22 bp, Homo sapiens
gaaactgtgaatgcttctgatt

SEQ ID NO: 2904244 - DNA, 19 bp, Homo sapiens
gaaacttctgtaaggggca

SEQ ID NO: 2904245 - DNA, 20 bp, Homo sapiens
gaaacttgtcacttgcatgt

SEQ ID NO: 2904246 - DNA, 21 bp, Homo sapiens
gaaacttgtcacttgcatgtc

SEQ ID NO: 2904247 - DNA, 11 bp, Homo sapiens
gaaagaaaact

SEQ ID NO: 2904248 - DNA, 21 bp, Homo sapiens
gaaagaaacccgacagaggga

SEQ ID NO: 2904249 - DNA, 22 bp, Homo sapiens
gaaagaaacccgacagagggaa

SEQ ID NO: 2904250 - DNA, 18 bp, Homo sapiens
gaaagaaagtaaaaaagg

SEQ ID NO: 2904251 - DNA, 17 bp, Homo sapiens
gaaagaagaacagctgt

SEQ ID NO: 2904252 - DNA, 19 bp, Homo sapiens
gaaagaagacacagaacca

SEQ ID NO: 2904253 - DNA, 17 bp, Homo sapiens
gaaagaatttcatatgc

SEQ ID NO: 2904254 - DNA, 13 bp, Homo sapiens
gaaagacactgcc

SEQ ID NO: 2904255 - DNA, 14 bp, Homo sapiens
gaaagacactgcct

SEQ ID NO: 2904256 - DNA, 15 bp, Homo sapiens
gaaagacactgcctg

SEQ ID NO: 2904257 - DNA, 12 bp, Homo sapiens
gaaagacaggaa

SEQ ID NO: 2904258 - DNA, 17 bp, Homo sapiens
gaaagacaggaagacca

SEQ ID NO: 2904259 - DNA, 18 bp, Homo sapiens
gaaagacaggaagaccaa

SEQ ID NO: 2904260 - DNA, 17 bp, Homo sapiens
gaaagacatctttctct

SEQ ID NO: 2904261 - DNA, 14 bp, Homo sapiens
gaaagacttccaaa

SEQ ID NO: 2904262 - DNA, 19 bp, Homo sapiens
gaaagagaaacctgagtga

SEQ ID NO: 2904263 - DNA, 14 bp, Homo sapiens
gaaagagagaaaat

SEQ ID NO: 2904264 - DNA, 16 bp, Homo sapiens
gaaagagagaaaataa

SEQ ID NO: 2904265 - DNA, 18 bp, Homo sapiens
gaaagagagaaaataaaa

SEQ ID NO: 2904266 - DNA, 20 bp, Homo sapiens
gaaagagagaaaataaaaag

SEQ ID NO: 2904267 - DNA, 21 bp, Homo sapiens
gaaagagagaaaataaaaagt

SEQ ID NO: 2904268 - DNA, 15 bp, Homo sapiens
gaaagaggggcctga

SEQ ID NO: 2904269 - DNA, 16 bp, Homo sapiens
gaaagaggtgaaaatg

SEQ ID NO: 2904270 - DNA, 21 bp, Homo sapiens
gaaagaggtgaaaatgaagaa

SEQ ID NO: 2904271 - DNA, 12 bp, Homo sapiens
gaaagattttat

SEQ ID NO: 2904272 - DNA, 13 bp, Homo sapiens
gaaagattttata

SEQ ID NO: 2904273 - DNA, 15 bp, Homo sapiens
gaaagcaaaaatgct

SEQ ID NO: 2904274 - DNA, 18 bp, Homo sapiens
gaaagcaaattattttta

SEQ ID NO: 2904275 - DNA, 21 bp, Homo sapiens
gaaagcacttaaacagaagca

SEQ ID NO: 2904276 - DNA, 19 bp, Homo sapiens
gaaagcatgtctctgcttc

SEQ ID NO: 2904277 - DNA, 21 bp, Homo sapiens
gaaagcctgtctctttccact

SEQ ID NO: 2904278 - DNA, 19 bp, Homo sapiens
gaaagctaaagtttggttt

SEQ ID NO: 2904279 - DNA, 22 bp, Homo sapiens
gaaagcttgaaaagattctgaa

SEQ ID NO: 2904280 - DNA, 15 bp, Homo sapiens
gaaagctttggcagt

SEQ ID NO: 2904281 - DNA, 22 bp, Homo sapiens
gaaaggacacgccgtctgtcct

SEQ ID NO: 2904282 - DNA, 16 bp, Homo sapiens
gaaaggacagagccag

SEQ ID NO: 2904283 - DNA, 15 bp, Homo sapiens
gaaaggagtagaaaa

SEQ ID NO: 2904284 - DNA, 20 bp, Homo sapiens
gaaaggagtttaaaaacatt

SEQ ID NO: 2904285 - DNA, 12 bp, Homo sapiens
gaaaggccagct

SEQ ID NO: 2904286 - DNA, 16 bp, Homo sapiens
gaaaggcctgtgggga

SEQ ID NO: 2904287 - DNA, 15 bp, Homo sapiens
gaaagggagagaaaa

SEQ ID NO: 2904288 - DNA, 17 bp, Homo sapiens
gaaagggagagaaaact

SEQ ID NO: 2904289 - DNA, 15 bp, Homo sapiens
gaaagggagggagga

SEQ ID NO: 2904290 - DNA, 23 bp, Homo sapiens
gaaagggcagtggacgtgctgcg

SEQ ID NO: 2904291 - DNA, 22 bp, Homo sapiens
gaaagggcctggccagtcctgg

SEQ ID NO: 2904292 - DNA, 13 bp, Homo sapiens
gaaaggggagccc

SEQ ID NO: 2904293 - DNA, 15 bp, Homo sapiens
gaaaggggagcccac

SEQ ID NO: 2904294 - DNA, 20 bp, Homo sapiens
gaaaggggctcttctgagca

SEQ ID NO: 2904295 - DNA, 14 bp, Homo sapiens
gaaaggtggtgttt

SEQ ID NO: 2904296 - DNA, 16 bp, Homo sapiens
gaaaggtggtgtttct

SEQ ID NO: 2904297 - DNA, 20 bp, Homo sapiens
gaaagtaagcatttccagcc

SEQ ID NO: 2904298 - DNA, 20 bp, Homo sapiens
gaaagtctgtcaggtttggt

SEQ ID NO: 2904299 - DNA, 19 bp, Homo sapiens
gaaagtgaagcaaatcaga

SEQ ID NO: 2904300 - DNA, 14 bp, Homo sapiens
gaaagtgtaaagca

SEQ ID NO: 2904301 - DNA, 20 bp, Homo sapiens
gaaagtttcgttatattaaa

SEQ ID NO: 2904302 - DNA, 18 bp, Homo sapiens
gaaataaaaggaagccaa

SEQ ID NO: 2904303 - DNA, 18 bp, Homo sapiens
gaaataaactagggtttt

SEQ ID NO: 2904304 - DNA, 14 bp, Homo sapiens
gaaataaatgtttc

SEQ ID NO: 2904305 - DNA, 16 bp, Homo sapiens
gaaataaatgtttcaa

SEQ ID NO: 2904306 - DNA, 15 bp, Homo sapiens
gaaataaattcctaa

SEQ ID NO: 2904307 - DNA, 17 bp, Homo sapiens
gaaataaattcctaaac

SEQ ID NO: 2904308 - DNA, 13 bp, Homo sapiens
gaaatacaaaaat

SEQ ID NO: 2904309 - DNA, 14 bp, Homo sapiens
gaaatacaaaaata

SEQ ID NO: 2904310 - DNA, 17 bp, Homo sapiens
gaaataccaactgaagt

SEQ ID NO: 2904311 - DNA, 17 bp, Homo sapiens
gaaatacctttgtagtt

SEQ ID NO: 2904312 - DNA, 23 bp, Homo sapiens
gaaatacctttgtagttactcaa

SEQ ID NO: 2904313 - DNA, 16 bp, Homo sapiens
gaaatacgtttgtgtt

SEQ ID NO: 2904314 - DNA, 22 bp, Homo sapiens
gaaatacgtttgtgtttctaga

SEQ ID NO: 2904315 - DNA, 19 bp, Homo sapiens
gaaatagccgaactccagg

SEQ ID NO: 2904316 - DNA, 21 bp, Homo sapiens
gaaatagccgaactccaggct

SEQ ID NO: 2904317 - DNA, 14 bp, Homo sapiens
gaaataggaaacaa

SEQ ID NO: 2904318 - DNA, 19 bp, Homo sapiens
gaaatagtaccttcaatac

SEQ ID NO: 2904319 - DNA, 18 bp, Homo sapiens
gaaatagttcaaagccaa

SEQ ID NO: 2904320 - DNA, 18 bp, Homo sapiens
gaaatataaacacattaa

SEQ ID NO: 2904321 - DNA, 21 bp, Homo sapiens
gaaatataaacacattaaaag

SEQ ID NO: 2904322 - DNA, 23 bp, Homo sapiens
gaaatatcagttactcagccctg

SEQ ID NO: 2904323 - DNA, 16 bp, Homo sapiens
gaaatatgtgaagccc

SEQ ID NO: 2904324 - DNA, 18 bp, Homo sapiens
gaaatattgctgtatagc

SEQ ID NO: 2904325 - DNA, 19 bp, Homo sapiens
gaaatatttagcaaataat

SEQ ID NO: 2904326 - DNA, 22 bp, Homo sapiens
gaaatatttggatgttaaatta

SEQ ID NO: 2904327 - DNA, 11 bp, Homo sapiens
gaaatccagta

SEQ ID NO: 2904328 - DNA, 14 bp, Homo sapiens
gaaatccattcaca

SEQ ID NO: 2904329 - DNA, 18 bp, Homo sapiens
gaaatccccccttcagaa

SEQ ID NO: 2904330 - DNA, 22 bp, Homo sapiens
gaaatccccccttcagaacaga

SEQ ID NO: 2904331 - DNA, 14 bp, Homo sapiens
gaaatctgtcctgt

SEQ ID NO: 2904332 - DNA, 15 bp, Homo sapiens
gaaatctgtctttgc

SEQ ID NO: 2904333 - DNA, 19 bp, Homo sapiens
gaaatcttgtaagtattta

SEQ ID NO: 2904334 - DNA, 11 bp, Homo sapiens
gaaatgaaaag

SEQ ID NO: 2904335 - DNA, 17 bp, Homo sapiens
gaaatgaggcatgagtt

SEQ ID NO: 2904336 - DNA, 22 bp, Homo sapiens
gaaatgaggtagctgacacaga

SEQ ID NO: 2904337 - DNA, 16 bp, Homo sapiens
gaaatgagtggccagc

SEQ ID NO: 2904338 - DNA, 11 bp, Homo sapiens
gaaatgatgtt

SEQ ID NO: 2904339 - DNA, 23 bp, Homo sapiens
gaaatgtattttgaaaacactta

SEQ ID NO: 2904340 - DNA, 23 bp, Homo sapiens
gaaatgtggtagcctcactttta

SEQ ID NO: 2904341 - DNA, 16 bp, Homo sapiens
gaaatgtggttttcct

SEQ ID NO: 2904342 - DNA, 18 bp, Homo sapiens
gaaattaagaaggcaaaa

SEQ ID NO: 2904343 - DNA, 22 bp, Homo sapiens
gaaattaagaaggcaaaaatgt

SEQ ID NO: 2904344 - DNA, 13 bp, Homo sapiens
gaaattagggccc

SEQ ID NO: 2904345 - DNA, 17 bp, Homo sapiens
gaaattccagttgcaat

SEQ ID NO: 2904346 - DNA, 21 bp, Homo sapiens
gaaattctgaatttgcaaagt

SEQ ID NO: 2904347 - DNA, 20 bp, Homo sapiens
gaaattctttatacattcta

SEQ ID NO: 2904348 - DNA, 21 bp, Homo sapiens
gaaattgcctatcctgctgtt

SEQ ID NO: 2904349 - DNA, 21 bp, Homo sapiens
gaaatttaatgtttctctgga

SEQ ID NO: 2904350 - DNA, 11 bp, Homo sapiens
gaaatttgaat

SEQ ID NO: 2904351 - DNA, 20 bp, Homo sapiens
gaaattttatttattttaat

SEQ ID NO: 2904352 - DNA, 21 bp, Homo sapiens
gaaattttcaagagtctaata

SEQ ID NO: 2904353 - DNA, 13 bp, Homo sapiens
gaaattttgctat

SEQ ID NO: 2904354 - DNA, 13 bp, Homo sapiens
gaaattttggttt

SEQ ID NO: 2904355 - DNA, 20 bp, Homo sapiens
gaaatttttcagatgcttct

SEQ ID NO: 2904356 - DNA, 14 bp, Homo sapiens
gaaatttttgtaaa

SEQ ID NO: 2904357 - DNA, 21 bp, Homo sapiens
gaaatttttgtaaatcacatc

SEQ ID NO: 2904358 - DNA, 17 bp, Homo sapiens
gaacaaaaagttttttt

SEQ ID NO: 2904359 - DNA, 22 bp, Homo sapiens
gaacaaaataagcaactaaatg

SEQ ID NO: 2904360 - DNA, 15 bp, Homo sapiens
gaacaaagagtgaaa

SEQ ID NO: 2904361 - DNA, 16 bp, Homo sapiens
gaacaaagcagccacg

SEQ ID NO: 2904362 - DNA, 19 bp, Homo sapiens
gaacaaagcagccacgagg

SEQ ID NO: 2904363 - DNA, 22 bp, Homo sapiens
gaacaaaggacagagtatgaac

SEQ ID NO: 2904364 - DNA, 23 bp, Homo sapiens
gaacaaagtaaaagtagtgttgt

SEQ ID NO: 2904365 - DNA, 16 bp, Homo sapiens
gaacaagacagccttc

SEQ ID NO: 2904366 - DNA, 16 bp, Homo sapiens
gaacaagcaaacccag

SEQ ID NO: 2904367 - DNA, 21 bp, Homo sapiens
gaacaagcaaacccagacggc

SEQ ID NO: 2904368 - DNA, 21 bp, Homo sapiens
gaacaatgtgctatgtgaaga

SEQ ID NO: 2904369 - DNA, 13 bp, Homo sapiens
gaacaattttctt

SEQ ID NO: 2904370 - DNA, 22 bp, Homo sapiens
gaacacaaacacattgttattt

SEQ ID NO: 2904371 - DNA, 19 bp, Homo sapiens
gaacacaaactgtaaataa

SEQ ID NO: 2904372 - DNA, 17 bp, Homo sapiens
gaacacgcgtatttaca

SEQ ID NO: 2904373 - DNA, 22 bp, Homo sapiens
gaacacggccacatcaaagagg

SEQ ID NO: 2904374 - DNA, 15 bp, Homo sapiens
gaacactagacaagc

SEQ ID NO: 2904375 - DNA, 23 bp, Homo sapiens
gaacagaaatatataaaaatata

SEQ ID NO: 2904376 - DNA, 15 bp, Homo sapiens
gaacagacaggagaa

SEQ ID NO: 2904377 - DNA, 15 bp, Homo sapiens
gaacagatgtaaatc

SEQ ID NO: 2904378 - DNA, 13 bp, Homo sapiens
gaacagcatggca

SEQ ID NO: 2904379 - DNA, 18 bp, Homo sapiens
gaacagcatggcactccc

SEQ ID NO: 2904380 - DNA, 23 bp, Homo sapiens
gaacagccagttttactgtgatt

SEQ ID NO: 2904381 - DNA, 18 bp, Homo sapiens
gaacagctcatcttcaaa

SEQ ID NO: 2904382 - DNA, 13 bp, Homo sapiens
gaacagctgttcc

SEQ ID NO: 2904383 - DNA, 17 bp, Homo sapiens
gaacagctgttcctgtg

SEQ ID NO: 2904384 - DNA, 17 bp, Homo sapiens
gaacagcttgccaggga

SEQ ID NO: 2904385 - DNA, 15 bp, Homo sapiens
gaacaggcagaaata

SEQ ID NO: 2904386 - DNA, 16 bp, Homo sapiens
gaacaggcagaaatat

SEQ ID NO: 2904387 - DNA, 20 bp, Homo sapiens
gaacagggaaaataggcagg

SEQ ID NO: 2904388 - DNA, 21 bp, Homo sapiens
gaacagggaaaataggcagga

SEQ ID NO: 2904389 - DNA, 14 bp, Homo sapiens
gaacagggcccagg

SEQ ID NO: 2904390 - DNA, 19 bp, Homo sapiens
gaacagggcccaggcctgg

SEQ ID NO: 2904391 - DNA, 22 bp, Homo sapiens
gaacagtgaaagtcaattcagt

SEQ ID NO: 2904392 - DNA, 18 bp, Homo sapiens
gaacagtgctctgcctct

SEQ ID NO: 2904393 - DNA, 19 bp, Homo sapiens
gaacagtggccttgcttct

SEQ ID NO: 2904394 - DNA, 20 bp, Homo sapiens
gaacagtgtttgatttttat

SEQ ID NO: 2904395 - DNA, 15 bp, Homo sapiens
gaacagtttggatgt

SEQ ID NO: 2904396 - DNA, 16 bp, Homo sapiens
gaacataacttctcat

SEQ ID NO: 2904397 - DNA, 17 bp, Homo sapiens
gaacatccaaccttccc

SEQ ID NO: 2904398 - DNA, 12 bp, Homo sapiens
gaacatcttcat

SEQ ID NO: 2904399 - DNA, 23 bp, Homo sapiens
gaacatgcagtttgaaattctga

SEQ ID NO: 2904400 - DNA, 19 bp, Homo sapiens
gaacatggtgtgtgtctct

SEQ ID NO: 2904401 - DNA, 21 bp, Homo sapiens
gaacatggtgtgtgtctctga

SEQ ID NO: 2904402 - DNA, 22 bp, Homo sapiens
gaacatgtcctaattcttctgt

SEQ ID NO: 2904403 - DNA, 24 bp, Homo sapiens
gaacatgtcctaattcttctgtcc

SEQ ID NO: 2904404 - DNA, 19 bp, Homo sapiens
gaacatgtgagaggtttga

SEQ ID NO: 2904405 - DNA, 16 bp, Homo sapiens
gaacatttattttatg

SEQ ID NO: 2904406 - DNA, 17 bp, Homo sapiens
gaacatttattttatga

SEQ ID NO: 2904407 - DNA, 21 bp, Homo sapiens
gaacatttattttatgagaaa

SEQ ID NO: 2904408 - DNA, 20 bp, Homo sapiens
gaaccaaagcgaattttaaa

SEQ ID NO: 2904409 - DNA, 23 bp, Homo sapiens
gaaccaaagcgaattttaaaaga

SEQ ID NO: 2904410 - DNA, 13 bp, Homo sapiens
gaaccaaagctca

SEQ ID NO: 2904411 - DNA, 14 bp, Homo sapiens
gaaccaaattgcac

SEQ ID NO: 2904412 - DNA, 21 bp, Homo sapiens
gaaccaaattgcactgaagtt

SEQ ID NO: 2904413 - DNA, 19 bp, Homo sapiens
gaaccaacccccatctccc

SEQ ID NO: 2904414 - DNA, 21 bp, Homo sapiens
gaaccaccaaaattatagctt

SEQ ID NO: 2904415 - DNA, 16 bp, Homo sapiens
gaaccagcagaacagc

SEQ ID NO: 2904416 - DNA, 20 bp, Homo sapiens
gaaccagcagaagccagagg

SEQ ID NO: 2904417 - DNA, 17 bp, Homo sapiens
gaaccaggagaagggct

SEQ ID NO: 2904418 - DNA, 22 bp, Homo sapiens
gaaccaggagaagggctggggc

SEQ ID NO: 2904419 - DNA, 22 bp, Homo sapiens
gaaccataggactgtggcaaac

SEQ ID NO: 2904420 - DNA, 21 bp, Homo sapiens
gaaccatgcaggaaggaaaac

SEQ ID NO: 2904421 - DNA, 12 bp, Homo sapiens
gaacccacctgc

SEQ ID NO: 2904422 - DNA, 14 bp, Homo sapiens
gaacccacctgctg

SEQ ID NO: 2904423 - DNA, 19 bp, Homo sapiens
gaacccacctgctgagaga

SEQ ID NO: 2904424 - DNA, 17 bp, Homo sapiens
gaacccagactcagaca

SEQ ID NO: 2904425 - DNA, 19 bp, Homo sapiens
gaacccagactcagacatt

SEQ ID NO: 2904426 - DNA, 20 bp, Homo sapiens
gaacccagctgtgcccctcc

SEQ ID NO: 2904427 - DNA, 17 bp, Homo sapiens
gaaccccaaggagggag

SEQ ID NO: 2904428 - DNA, 21 bp, Homo sapiens
gaacccctagaaaggagagaa

SEQ ID NO: 2904429 - DNA, 16 bp, Homo sapiens
gaacccgggggacaga

SEQ ID NO: 2904430 - DNA, 17 bp, Homo sapiens
gaacccgggggacagag

SEQ ID NO: 2904431 - DNA, 18 bp, Homo sapiens
gaacccgggggacagagg

SEQ ID NO: 2904432 - DNA, 17 bp, Homo sapiens
gaacccttggcttgccc

SEQ ID NO: 2904433 - DNA, 18 bp, Homo sapiens
gaacccttggcttgccca

SEQ ID NO: 2904434 - DNA, 20 bp, Homo sapiens
gaacccttggcttgcccacg

SEQ ID NO: 2904435 - DNA, 12 bp, Homo sapiens
gaaccgaggcag

SEQ ID NO: 2904436 - DNA, 14 bp, Homo sapiens
gaaccgcaggaagc

SEQ ID NO: 2904437 - DNA, 15 bp, Homo sapiens
gaaccgcaggaagct

SEQ ID NO: 2904438 - DNA, 20 bp, Homo sapiens
gaaccgcaggaagctgctcc

SEQ ID NO: 2904439 - DNA, 18 bp, Homo sapiens
gaaccgttttgaagctac

SEQ ID NO: 2904440 - DNA, 15 bp, Homo sapiens
gaacctatgaagcaa

SEQ ID NO: 2904441 - DNA, 22 bp, Homo sapiens
gaacctcaccccgaggccctgc

SEQ ID NO: 2904442 - DNA, 20 bp, Homo sapiens
gaacctcacgcacctcccat

SEQ ID NO: 2904443 - DNA, 12 bp, Homo sapiens
gaacctcagcct

SEQ ID NO: 2904444 - DNA, 15 bp, Homo sapiens
gaacctcagcctggc

SEQ ID NO: 2904445 - DNA, 17 bp, Homo sapiens
gaacctcagcctggcca

SEQ ID NO: 2904446 - DNA, 18 bp, Homo sapiens
gaacctcagcctggccag

SEQ ID NO: 2904447 - DNA, 20 bp, Homo sapiens
gaacctcgagtactgtgggc

SEQ ID NO: 2904448 - DNA, 17 bp, Homo sapiens
gaacctcggggtggggg

SEQ ID NO: 2904449 - DNA, 20 bp, Homo sapiens
gaacctgcaagccttctaaa

SEQ ID NO: 2904450 - DNA, 16 bp, Homo sapiens
gaacctggaacttggg

SEQ ID NO: 2904451 - DNA, 21 bp, Homo sapiens
gaacctgtaggatcttatttg

SEQ ID NO: 2904452 - DNA, 15 bp, Homo sapiens
gaaccttaaggaaga

SEQ ID NO: 2904453 - DNA, 17 bp, Homo sapiens
gaacgagcctggaagca

SEQ ID NO: 2904454 - DNA, 14 bp, Homo sapiens
gaacggggagaaaa

SEQ ID NO: 2904455 - DNA, 14 bp, Homo sapiens
gaacgtgactgccc

SEQ ID NO: 2904456 - DNA, 17 bp, Homo sapiens
gaacgtggctctgctgg

SEQ ID NO: 2904457 - DNA, 19 bp, Homo sapiens
gaacgttttttcctcagtg

SEQ ID NO: 2904458 - DNA, 19 bp, Homo sapiens
gaactaaaggtggccacaa

SEQ ID NO: 2904459 - DNA, 13 bp, Homo sapiens
gaactaacacgtg

SEQ ID NO: 2904460 - DNA, 20 bp, Homo sapiens
gaactaaggactccaatgtc

SEQ ID NO: 2904461 - DNA, 15 bp, Homo sapiens
gaactaagttattgt

SEQ ID NO: 2904462 - DNA, 22 bp, Homo sapiens
gaactaagttttgtgtgtatat

SEQ ID NO: 2904463 - DNA, 14 bp, Homo sapiens
gaactaatttctgt

SEQ ID NO: 2904464 - DNA, 19 bp, Homo sapiens
gaactagaatttgattatt

SEQ ID NO: 2904465 - DNA, 13 bp, Homo sapiens
gaactattgtgtt

SEQ ID NO: 2904466 - DNA, 19 bp, Homo sapiens
gaactcaaacttctggctc

SEQ ID NO: 2904467 - DNA, 16 bp, Homo sapiens
gaactcaaatggggcc

SEQ ID NO: 2904468 - DNA, 23 bp, Homo sapiens
gaactcaaatggggccagatcca

SEQ ID NO: 2904469 - DNA, 18 bp, Homo sapiens
gaactcacattggcaagt

SEQ ID NO: 2904470 - DNA, 14 bp, Homo sapiens
gaactcactggggc

SEQ ID NO: 2904471 - DNA, 16 bp, Homo sapiens
gaactcactggggcct

SEQ ID NO: 2904472 - DNA, 14 bp, Homo sapiens
gaactcagccaagc

SEQ ID NO: 2904473 - DNA, 16 bp, Homo sapiens
gaactcagccaagcac

SEQ ID NO: 2904474 - DNA, 18 bp, Homo sapiens
gaactcagccaagcacag

SEQ ID NO: 2904475 - DNA, 20 bp, Homo sapiens
gaactcagccaagcacagtg

SEQ ID NO: 2904476 - DNA, 17 bp, Homo sapiens
gaactcatcactgtggc

SEQ ID NO: 2904477 - DNA, 18 bp, Homo sapiens
gaactcgcctcagcctga

SEQ ID NO: 2904478 - DNA, 21 bp, Homo sapiens
gaactctctgtcttctctcca

SEQ ID NO: 2904479 - DNA, 12 bp, Homo sapiens
gaactctgaaat

SEQ ID NO: 2904480 - DNA, 14 bp, Homo sapiens
gaactctgggctca

SEQ ID NO: 2904481 - DNA, 22 bp, Homo sapiens
gaactctgggctcaagcaatcc

SEQ ID NO: 2904482 - DNA, 15 bp, Homo sapiens
gaactcttctttgct

SEQ ID NO: 2904483 - DNA, 13 bp, Homo sapiens
gaactgaaataaa

SEQ ID NO: 2904484 - DNA, 21 bp, Homo sapiens
gaactgaaataaaaaattatg

SEQ ID NO: 2904485 - DNA, 12 bp, Homo sapiens
gaactgaactca

SEQ ID NO: 2904486 - DNA, 21 bp, Homo sapiens
gaactgagcttggaagcttct

SEQ ID NO: 2904487 - DNA, 13 bp, Homo sapiens
gaactgaggcctt

SEQ ID NO: 2904488 - DNA, 21 bp, Homo sapiens
gaactgattcacatctcattt

SEQ ID NO: 2904489 - DNA, 23 bp, Homo sapiens
gaactgattcacatctcattttt

SEQ ID NO: 2904490 - DNA, 12 bp, Homo sapiens
gaactgatttta

SEQ ID NO: 2904491 - DNA, 11 bp, Homo sapiens
gaactgcagca

SEQ ID NO: 2904492 - DNA, 20 bp, Homo sapiens
gaactgcagcaatctttgaa

SEQ ID NO: 2904493 - DNA, 15 bp, Homo sapiens
gaactggctacagta

SEQ ID NO: 2904494 - DNA, 16 bp, Homo sapiens
gaactggcttgtacat

SEQ ID NO: 2904495 - DNA, 14 bp, Homo sapiens
gaactggttcaaga

SEQ ID NO: 2904496 - DNA, 18 bp, Homo sapiens
gaactggttcaagagaca

SEQ ID NO: 2904497 - DNA, 17 bp, Homo sapiens
gaactgtcccagctacc

SEQ ID NO: 2904498 - DNA, 18 bp, Homo sapiens
gaactgtgctcccacggg

SEQ ID NO: 2904499 - DNA, 14 bp, Homo sapiens
gaactgtgtgtaat

SEQ ID NO: 2904500 - DNA, 22 bp, Homo sapiens
gaacttacatactaggtgcctt

SEQ ID NO: 2904501 - DNA, 23 bp, Homo sapiens
gaacttacatactaggtgccttt

SEQ ID NO: 2904502 - DNA, 15 bp, Homo sapiens
gaacttattctgtag

SEQ ID NO: 2904503 - DNA, 15 bp, Homo sapiens
gaacttcacctgcaa

SEQ ID NO: 2904504 - DNA, 15 bp, Homo sapiens
gaacttgaactgatt

SEQ ID NO: 2904505 - DNA, 17 bp, Homo sapiens
gaactttagggggtggg

SEQ ID NO: 2904506 - DNA, 16 bp, Homo sapiens
gaactttgtcagtgtt

SEQ ID NO: 2904507 - DNA, 15 bp, Homo sapiens
gaactttttcttttc

SEQ ID NO: 2904508 - DNA, 14 bp, Homo sapiens
gaagaaaacatcta

SEQ ID NO: 2904509 - DNA, 15 bp, Homo sapiens
gaagaaaatggaatt

SEQ ID NO: 2904510 - DNA, 14 bp, Homo sapiens
gaagaaacagaaga

SEQ ID NO: 2904511 - DNA, 12 bp, Homo sapiens
gaagaaaggcca

SEQ ID NO: 2904512 - DNA, 22 bp, Homo sapiens
gaagaaaggccaaggtgctgga

SEQ ID NO: 2904513 - DNA, 18 bp, Homo sapiens
gaagaacaccctctaaat

SEQ ID NO: 2904514 - DNA, 21 bp, Homo sapiens
gaagaacagctgttcctgtgt

SEQ ID NO: 2904515 - DNA, 22 bp, Homo sapiens
gaagaacgaacacaagaaaaag

SEQ ID NO: 2904516 - DNA, 22 bp, Homo sapiens
gaagaacgttttttcctcagtg

SEQ ID NO: 2904517 - DNA, 14 bp, Homo sapiens
gaagaactgcatgt

SEQ ID NO: 2904518 - DNA, 13 bp, Homo sapiens
gaagaagaattta

SEQ ID NO: 2904519 - DNA, 13 bp, Homo sapiens
gaagaagatgctc

SEQ ID NO: 2904520 - DNA, 12 bp, Homo sapiens
gaagaagcagcg

SEQ ID NO: 2904521 - DNA, 13 bp, Homo sapiens
gaagaagccctgt

SEQ ID NO: 2904522 - DNA, 16 bp, Homo sapiens
gaagaagccctgttct

SEQ ID NO: 2904523 - DNA, 17 bp, Homo sapiens
gaagaagccctgttctc

SEQ ID NO: 2904524 - DNA, 21 bp, Homo sapiens
gaagaaggaagctgtgttgaa

SEQ ID NO: 2904525 - DNA, 18 bp, Homo sapiens
gaagaaggaccagtgaag

SEQ ID NO: 2904526 - DNA, 14 bp, Homo sapiens
gaagaagtcagaga

SEQ ID NO: 2904527 - DNA, 19 bp, Homo sapiens
gaagaatccttttgtagaa

SEQ ID NO: 2904528 - DNA, 19 bp, Homo sapiens
gaagaatgtgtttcaaact

SEQ ID NO: 2904529 - DNA, 22 bp, Homo sapiens
gaagaatgttaagacttgacag

SEQ ID NO: 2904530 - DNA, 23 bp, Homo sapiens
gaagaattgaacccaggaggtgg

SEQ ID NO: 2904531 - DNA, 15 bp, Homo sapiens
gaagaattttcagac

SEQ ID NO: 2904532 - DNA, 17 bp, Homo sapiens
gaagacagaagtttgca

SEQ ID NO: 2904533 - DNA, 13 bp, Homo sapiens
gaagacagagcaa

SEQ ID NO: 2904534 - DNA, 13 bp, Homo sapiens
gaagacaggaaag

SEQ ID NO: 2904535 - DNA, 18 bp, Homo sapiens
gaagacatgttttagaca

SEQ ID NO: 2904536 - DNA, 15 bp, Homo sapiens
gaagacattttttgc

SEQ ID NO: 2904537 - DNA, 21 bp, Homo sapiens
gaagacattttttgctataat

SEQ ID NO: 2904538 - DNA, 21 bp, Homo sapiens
gaagaccaaatgatagaactg

SEQ ID NO: 2904539 - DNA, 19 bp, Homo sapiens
gaagacgtcaggggcaagg

SEQ ID NO: 2904540 - DNA, 23 bp, Homo sapiens
gaagactccctgatcccagacct

SEQ ID NO: 2904541 - DNA, 17 bp, Homo sapiens
gaagactcctaggccct

SEQ ID NO: 2904542 - DNA, 18 bp, Homo sapiens
gaagactcctaggccctt

SEQ ID NO: 2904543 - DNA, 15 bp, Homo sapiens
gaagactgagccaga

SEQ ID NO: 2904544 - DNA, 14 bp, Homo sapiens
gaagactgctaaat

SEQ ID NO: 2904545 - DNA, 17 bp, Homo sapiens
gaagactggaagctaat

SEQ ID NO: 2904546 - DNA, 20 bp, Homo sapiens
gaagactgtgcggcacagga

SEQ ID NO: 2904547 - DNA, 22 bp, Homo sapiens
gaagactgtgcggcacaggaaa

SEQ ID NO: 2904548 - DNA, 19 bp, Homo sapiens
gaagactgttgtgctccat

SEQ ID NO: 2904549 - DNA, 15 bp, Homo sapiens
gaagagaaccagcca

SEQ ID NO: 2904550 - DNA, 14 bp, Homo sapiens
gaagagaggggaag

SEQ ID NO: 2904551 - DNA, 15 bp, Homo sapiens
gaagagatccaaaga

SEQ ID NO: 2904552 - DNA, 16 bp, Homo sapiens
gaagagatccaaagac

SEQ ID NO: 2904553 - DNA, 15 bp, Homo sapiens
gaagagctcaaggga

SEQ ID NO: 2904554 - DNA, 22 bp, Homo sapiens
gaagagctcccctacggaccag

SEQ ID NO: 2904555 - DNA, 12 bp, Homo sapiens
gaagaggaacca

SEQ ID NO: 2904556 - DNA, 16 bp, Homo sapiens
gaagaggagcctcaga

SEQ ID NO: 2904557 - DNA, 17 bp, Homo sapiens
gaagaggccaaaggaat

SEQ ID NO: 2904558 - DNA, 12 bp, Homo sapiens
gaagagggctgc

SEQ ID NO: 2904559 - DNA, 20 bp, Homo sapiens
gaagagggggaggggaagct

SEQ ID NO: 2904560 - DNA, 23 bp, Homo sapiens
gaagagtaagtcaacctgcctga

SEQ ID NO: 2904561 - DNA, 16 bp, Homo sapiens
gaagagtcctctgaat

SEQ ID NO: 2904562 - DNA, 17 bp, Homo sapiens
gaagagtgggtttcaca

SEQ ID NO: 2904563 - DNA, 15 bp, Homo sapiens
gaagagttggagtga

SEQ ID NO: 2904564 - DNA, 17 bp, Homo sapiens
gaagatcagatgcaatt

SEQ ID NO: 2904565 - DNA, 22 bp, Homo sapiens
gaagatgctccagcaacacagc

SEQ ID NO: 2904566 - DNA, 16 bp, Homo sapiens
gaagatggcatcctgt

SEQ ID NO: 2904567 - DNA, 12 bp, Homo sapiens
gaagatgtaagg

SEQ ID NO: 2904568 - DNA, 19 bp, Homo sapiens
gaagcaataaagaagagtg

SEQ ID NO: 2904569 - DNA, 19 bp, Homo sapiens
gaagcaataataaagtact

SEQ ID NO: 2904570 - DNA, 15 bp, Homo sapiens
gaagcaatcagcaaa

SEQ ID NO: 2904571 - DNA, 15 bp, Homo sapiens
gaagcaattatttaa

SEQ ID NO: 2904572 - DNA, 20 bp, Homo sapiens
gaagcacatgcacctaccca

SEQ ID NO: 2904573 - DNA, 12 bp, Homo sapiens
gaagcagagcaa

SEQ ID NO: 2904574 - DNA, 15 bp, Homo sapiens
gaagcagaggccttt

SEQ ID NO: 2904575 - DNA, 23 bp, Homo sapiens
gaagcagatgcaaagaggcaaga

SEQ ID NO: 2904576 - DNA, 9 bp, Homo sapiens
gaagcagct

SEQ ID NO: 2904577 - DNA, 16 bp, Homo sapiens
gaagcagctctgcctt

SEQ ID NO: 2904578 - DNA, 14 bp, Homo sapiens
gaagcatcctcccc

SEQ ID NO: 2904579 - DNA, 15 bp, Homo sapiens
gaagcatcctcccca

SEQ ID NO: 2904580 - DNA, 20 bp, Homo sapiens
gaagcatcctccccaccaga

SEQ ID NO: 2904581 - DNA, 22 bp, Homo sapiens
gaagcatcttccagaagtgtga

SEQ ID NO: 2904582 - DNA, 19 bp, Homo sapiens
gaagcatttcaaagccctg

SEQ ID NO: 2904583 - DNA, 20 bp, Homo sapiens
gaagcatttcaaagccctgc

SEQ ID NO: 2904584 - DNA, 17 bp, Homo sapiens
gaagccaccctcccagc

SEQ ID NO: 2904585 - DNA, 13 bp, Homo sapiens
gaagccactggac

SEQ ID NO: 2904586 - DNA, 16 bp, Homo sapiens
gaagccattgtcttcg

SEQ ID NO: 2904587 - DNA, 22 bp, Homo sapiens
gaagcccactgcctcctccctg

SEQ ID NO: 2904588 - DNA, 20 bp, Homo sapiens
gaagcccccaccgtgggcag

SEQ ID NO: 2904589 - DNA, 17 bp, Homo sapiens
gaagcccccagctaaga

SEQ ID NO: 2904590 - DNA, 23 bp, Homo sapiens
gaagccctgttgtgccacagagt

SEQ ID NO: 2904591 - DNA, 23 bp, Homo sapiens
gaagccctttgcctgtagagcca

SEQ ID NO: 2904592 - DNA, 21 bp, Homo sapiens
gaagccggggaagagatccaa

SEQ ID NO: 2904593 - DNA, 17 bp, Homo sapiens
gaagccgtgccctgccc

SEQ ID NO: 2904594 - DNA, 19 bp, Homo sapiens
gaagccgtgccctgccccc

SEQ ID NO: 2904595 - DNA, 21 bp, Homo sapiens
gaagcctccttacattaaaaa

SEQ ID NO: 2904596 - DNA, 22 bp, Homo sapiens
gaagcctccttacattaaaaag

SEQ ID NO: 2904597 - DNA, 21 bp, Homo sapiens
gaagcctctgggtcagtggtc

SEQ ID NO: 2904598 - DNA, 12 bp, Homo sapiens
gaagccttgctg

SEQ ID NO: 2904599 - DNA, 13 bp, Homo sapiens
gaagccttgctga

SEQ ID NO: 2904600 - DNA, 13 bp, Homo sapiens
gaagcgaacatct

SEQ ID NO: 2904601 - DNA, 22 bp, Homo sapiens
gaagcgacttttgttctcttct

SEQ ID NO: 2904602 - DNA, 13 bp, Homo sapiens
gaagcgttgtcct

SEQ ID NO: 2904603 - DNA, 15 bp, Homo sapiens
gaagctaatttgcat

SEQ ID NO: 2904604 - DNA, 21 bp, Homo sapiens
gaagctacaggttacaacaga

SEQ ID NO: 2904605 - DNA, 20 bp, Homo sapiens
gaagctatttcctttgcgca

SEQ ID NO: 2904606 - DNA, 21 bp, Homo sapiens
gaagctcctctccccagccca

SEQ ID NO: 2904607 - DNA, 19 bp, Homo sapiens
gaagctcgcatccagacag

SEQ ID NO: 2904608 - DNA, 16 bp, Homo sapiens
gaagctgctgtgactg

SEQ ID NO: 2904609 - DNA, 19 bp, Homo sapiens
gaagctgggactcattcac

SEQ ID NO: 2904610 - DNA, 22 bp, Homo sapiens
gaagctgggactcattcacatt

SEQ ID NO: 2904611 - DNA, 12 bp, Homo sapiens
gaagctgtgtcc

SEQ ID NO: 2904612 - DNA, 20 bp, Homo sapiens
gaagctgtgtccttgcacct

SEQ ID NO: 2904613 - DNA, 23 bp, Homo sapiens
gaagctgtgtccttgcacctgca

SEQ ID NO: 2904614 - DNA, 24 bp, Homo sapiens
gaagctgtgtccttgcacctgcat

SEQ ID NO: 2904615 - DNA, 18 bp, Homo sapiens
gaagctgtgttgaaacag

SEQ ID NO: 2904616 - DNA, 23 bp, Homo sapiens
gaagctgtgttgaaacagaaaaa

SEQ ID NO: 2904617 - DNA, 22 bp, Homo sapiens
gaagcttctggtgaccttccaa

SEQ ID NO: 2904618 - DNA, 19 bp, Homo sapiens
gaaggaaagcatgtctctg

SEQ ID NO: 2904619 - DNA, 20 bp, Homo sapiens
gaaggaaatgagtggccagc

SEQ ID NO: 2904620 - DNA, 15 bp, Homo sapiens
gaaggaagctgtgtt

SEQ ID NO: 2904621 - DNA, 19 bp, Homo sapiens
gaaggaagctgtgttgaaa

SEQ ID NO: 2904622 - DNA, 23 bp, Homo sapiens
gaaggaagctgtgttgaaacaga

SEQ ID NO: 2904623 - DNA, 15 bp, Homo sapiens
gaaggacagaaagga

SEQ ID NO: 2904624 - DNA, 17 bp, Homo sapiens
gaaggacagaaaggaga

SEQ ID NO: 2904625 - DNA, 18 bp, Homo sapiens
gaaggacagactggccgg

SEQ ID NO: 2904626 - DNA, 15 bp, Homo sapiens
gaaggaccagtgaag

SEQ ID NO: 2904627 - DNA, 21 bp, Homo sapiens
gaaggacccctcaccaccccc

SEQ ID NO: 2904628 - DNA, 20 bp, Homo sapiens
gaaggacggcaaggctgagg

SEQ ID NO: 2904629 - DNA, 16 bp, Homo sapiens
gaaggagaaggaagga

SEQ ID NO: 2904630 - DNA, 18 bp, Homo sapiens
gaaggagacaggcagagc

SEQ ID NO: 2904631 - DNA, 23 bp, Homo sapiens
gaaggagactcacctctgcctca

SEQ ID NO: 2904632 - DNA, 22 bp, Homo sapiens
gaaggagccccattcctgggaa

SEQ ID NO: 2904633 - DNA, 23 bp, Homo sapiens
gaaggagcccctgagtccgcctg

SEQ ID NO: 2904634 - DNA, 22 bp, Homo sapiens
gaaggatgggaaaaactgcagt

SEQ ID NO: 2904635 - DNA, 15 bp, Homo sapiens
gaaggcaaaggcaga

SEQ ID NO: 2904636 - DNA, 16 bp, Homo sapiens
gaaggcaaccattttt

SEQ ID NO: 2904637 - DNA, 17 bp, Homo sapiens
gaaggcaacttgaagaa

SEQ ID NO: 2904638 - DNA, 19 bp, Homo sapiens
gaaggcaacttgaagaaac

SEQ ID NO: 2904639 - DNA, 16 bp, Homo sapiens
gaaggcaagattggaa

SEQ ID NO: 2904640 - DNA, 21 bp, Homo sapiens
gaaggcaagccaaccttagct

SEQ ID NO: 2904641 - DNA, 22 bp, Homo sapiens
gaaggcagagaaagggacaatg

SEQ ID NO: 2904642 - DNA, 17 bp, Homo sapiens
gaaggcatcagtcccta

SEQ ID NO: 2904643 - DNA, 14 bp, Homo sapiens
gaaggcccatgaag

SEQ ID NO: 2904644 - DNA, 17 bp, Homo sapiens
gaaggccgaggtcccat

SEQ ID NO: 2904645 - DNA, 19 bp, Homo sapiens
gaaggcctcccctgaggat

SEQ ID NO: 2904646 - DNA, 17 bp, Homo sapiens
gaaggctgtccttaccc

SEQ ID NO: 2904647 - DNA, 20 bp, Homo sapiens
gaaggcttgttgtgctttta

SEQ ID NO: 2904648 - DNA, 23 bp, Homo sapiens
gaagggaattgctcagagaagga

SEQ ID NO: 2904649 - DNA, 23 bp, Homo sapiens
gaagggagagggcctctgcctgg

SEQ ID NO: 2904650 - DNA, 17 bp, Homo sapiens
gaagggagctagccaga

SEQ ID NO: 2904651 - DNA, 15 bp, Homo sapiens
gaagggaggggaagg

SEQ ID NO: 2904652 - DNA, 16 bp, Homo sapiens
gaagggaggggaaggg

SEQ ID NO: 2904653 - DNA, 11 bp, Homo sapiens
gaagggcaggc

SEQ ID NO: 2904654 - DNA, 14 bp, Homo sapiens
gaagggccagagcc

SEQ ID NO: 2904655 - DNA, 18 bp, Homo sapiens
gaaggggacccccgcccc

SEQ ID NO: 2904656 - DNA, 14 bp, Homo sapiens
gaaggggccagagg

SEQ ID NO: 2904657 - DNA, 15 bp, Homo sapiens
gaagggtcatttctc

SEQ ID NO: 2904658 - DNA, 20 bp, Homo sapiens
gaaggtcagcaaagggtggg

SEQ ID NO: 2904659 - DNA, 20 bp, Homo sapiens
gaaggtcagcgagaaggagt

SEQ ID NO: 2904660 - DNA, 17 bp, Homo sapiens
gaaggtctgatttgcag

SEQ ID NO: 2904661 - DNA, 13 bp, Homo sapiens
gaaggtctgggtc

SEQ ID NO: 2904662 - DNA, 21 bp, Homo sapiens
gaaggtgctgacggccaggga

SEQ ID NO: 2904663 - DNA, 16 bp, Homo sapiens
gaaggtggacctggca

SEQ ID NO: 2904664 - DNA, 18 bp, Homo sapiens
gaaggtggacctggcagt

SEQ ID NO: 2904665 - DNA, 23 bp, Homo sapiens
gaaggtgtccaaatttaatgtag

SEQ ID NO: 2904666 - DNA, 15 bp, Homo sapiens
gaaggtgtgctacag

SEQ ID NO: 2904667 - DNA, 14 bp, Homo sapiens
gaaggttaaaggaa

SEQ ID NO: 2904668 - DNA, 20 bp, Homo sapiens
gaaggtttgtgtttttctgc

SEQ ID NO: 2904669 - DNA, 23 bp, Homo sapiens
gaaggtttttaagggccggggat

SEQ ID NO: 2904670 - DNA, 15 bp, Homo sapiens
gaagtaactcccact

SEQ ID NO: 2904671 - DNA, 13 bp, Homo sapiens
gaagtaacttatt

SEQ ID NO: 2904672 - DNA, 17 bp, Homo sapiens
gaagtaacttattttgt

SEQ ID NO: 2904673 - DNA, 13 bp, Homo sapiens
gaagtaagaagag

SEQ ID NO: 2904674 - DNA, 14 bp, Homo sapiens
gaagtaagaagagg

SEQ ID NO: 2904675 - DNA, 23 bp, Homo sapiens
gaagtaagaagaggagcctcaga

SEQ ID NO: 2904676 - DNA, 13 bp, Homo sapiens
gaagtaatgaatt

SEQ ID NO: 2904677 - DNA, 13 bp, Homo sapiens
gaagtacttttaa

SEQ ID NO: 2904678 - DNA, 14 bp, Homo sapiens
gaagtacttttaac

SEQ ID NO: 2904679 - DNA, 17 bp, Homo sapiens
gaagtagacctcttttt

SEQ ID NO: 2904680 - DNA, 20 bp, Homo sapiens
gaagtagctgtcagatgtca

SEQ ID NO: 2904681 - DNA, 14 bp, Homo sapiens
gaagtatcagcact

SEQ ID NO: 2904682 - DNA, 17 bp, Homo sapiens
gaagtatcagcactaga

SEQ ID NO: 2904683 - DNA, 22 bp, Homo sapiens
gaagtattcttttcaattatat

SEQ ID NO: 2904684 - DNA, 16 bp, Homo sapiens
gaagtcaaagcaagga

SEQ ID NO: 2904685 - DNA, 20 bp, Homo sapiens
gaagtcagaatttttaactg

SEQ ID NO: 2904686 - DNA, 22 bp, Homo sapiens
gaagtcagaatttttaactgta

SEQ ID NO: 2904687 - DNA, 20 bp, Homo sapiens
gaagtcagagaaaacacttt

SEQ ID NO: 2904688 - DNA, 19 bp, Homo sapiens
gaagtccaggactgggtct

SEQ ID NO: 2904689 - DNA, 14 bp, Homo sapiens
gaagtccctcagag

SEQ ID NO: 2904690 - DNA, 16 bp, Homo sapiens
gaagtccctcagaggc

SEQ ID NO: 2904691 - DNA, 18 bp, Homo sapiens
gaagtccctcagaggcct

SEQ ID NO: 2904692 - DNA, 18 bp, Homo sapiens
gaagtcctatggaaaccc

SEQ ID NO: 2904693 - DNA, 22 bp, Homo sapiens
gaagtctaggagctgggaggaa

SEQ ID NO: 2904694 - DNA, 12 bp, Homo sapiens
gaagtctttaat

SEQ ID NO: 2904695 - DNA, 17 bp, Homo sapiens
gaagtctttaatatttt

SEQ ID NO: 2904696 - DNA, 17 bp, Homo sapiens
gaagtctttcaagaatg

SEQ ID NO: 2904697 - DNA, 18 bp, Homo sapiens
gaagtctttcaagaatga

SEQ ID NO: 2904698 - DNA, 14 bp, Homo sapiens
gaagtcttttgttc

SEQ ID NO: 2904699 - DNA, 13 bp, Homo sapiens
gaagtgaacactt

SEQ ID NO: 2904700 - DNA, 13 bp, Homo sapiens
gaagtgacaggga

SEQ ID NO: 2904701 - DNA, 20 bp, Homo sapiens
gaagtgacagggaagctaca

SEQ ID NO: 2904702 - DNA, 21 bp, Homo sapiens
gaagtgacagggaagctacag

SEQ ID NO: 2904703 - DNA, 14 bp, Homo sapiens
gaagtgagccagca

SEQ ID NO: 2904704 - DNA, 16 bp, Homo sapiens
gaagtgaggaagccag

SEQ ID NO: 2904705 - DNA, 20 bp, Homo sapiens
gaagtgctggcaaccactaa

SEQ ID NO: 2904706 - DNA, 18 bp, Homo sapiens
gaagtggaccaggacagg

SEQ ID NO: 2904707 - DNA, 17 bp, Homo sapiens
gaagtggcctcttggat

SEQ ID NO: 2904708 - DNA, 16 bp, Homo sapiens
gaagtgggccaggaca

SEQ ID NO: 2904709 - DNA, 19 bp, Homo sapiens
gaagtgggccaggacaggc

SEQ ID NO: 2904710 - DNA, 18 bp, Homo sapiens
gaagtggggaccccaccc

SEQ ID NO: 2904711 - DNA, 20 bp, Homo sapiens
gaagtggggaccccacccct

SEQ ID NO: 2904712 - DNA, 14 bp, Homo sapiens
gaagtggggagagg

SEQ ID NO: 2904713 - DNA, 16 bp, Homo sapiens
gaagtggggcagatgg

SEQ ID NO: 2904714 - DNA, 13 bp, Homo sapiens
gaagtgtcatgtt

SEQ ID NO: 2904715 - DNA, 15 bp, Homo sapiens
gaagtgtgtccatcc

SEQ ID NO: 2904716 - DNA, 21 bp, Homo sapiens
gaagtgtgtccatcctgacct

SEQ ID NO: 2904717 - DNA, 20 bp, Homo sapiens
cttttgcaaggttccacaga

SEQ ID NO: 2904718 - DNA, 18 bp, Homo sapiens
cttttgcagaagagggtg

SEQ ID NO: 2904719 - DNA, 19 bp, Homo sapiens
cttttgctacgtgcctccc

SEQ ID NO: 2904720 - DNA, 16 bp, Homo sapiens
cttttggcctcctgca

SEQ ID NO: 2904721 - DNA, 15 bp, Homo sapiens
cttttggcttccatg

SEQ ID NO: 2904722 - DNA, 15 bp, Homo sapiens
cttttgggggaaact

SEQ ID NO: 2904723 - DNA, 18 bp, Homo sapiens
cttttgggggtcaacagt

SEQ ID NO: 2904724 - DNA, 20 bp, Homo sapiens
cttttgggtagttgtttttt

SEQ ID NO: 2904725 - DNA, 20 bp, Homo sapiens
cttttggtaaagactggctt

SEQ ID NO: 2904726 - DNA, 21 bp, Homo sapiens
cttttggtgtcattattccat

SEQ ID NO: 2904727 - DNA, 18 bp, Homo sapiens
cttttggtgtgttggaca

SEQ ID NO: 2904728 - DNA, 12 bp, Homo sapiens
cttttgtaaagt

SEQ ID NO: 2904729 - DNA, 19 bp, Homo sapiens
cttttgtaaagtgaagaat

SEQ ID NO: 2904730 - DNA, 14 bp, Homo sapiens
cttttgtaataaac

SEQ ID NO: 2904731 - DNA, 20 bp, Homo sapiens
cttttgtaattgtgtaaaaa

SEQ ID NO: 2904732 - DNA, 21 bp, Homo sapiens
cttttgtagatggcactttag

SEQ ID NO: 2904733 - DNA, 22 bp, Homo sapiens
cttttgtagatggcactttagt

SEQ ID NO: 2904734 - DNA, 23 bp, Homo sapiens
cttttgtagtttgtattaaactt

SEQ ID NO: 2904735 - DNA, 23 bp, Homo sapiens
cttttgtgtcacttttttctgcc

SEQ ID NO: 2904736 - DNA, 13 bp, Homo sapiens
cttttgttcgcat

SEQ ID NO: 2904737 - DNA, 14 bp, Homo sapiens
cttttgttctcttc

SEQ ID NO: 2904738 - DNA, 15 bp, Homo sapiens
cttttgttctcttct

SEQ ID NO: 2904739 - DNA, 20 bp, Homo sapiens
cttttgttctcttctgcgta

SEQ ID NO: 2904740 - DNA, 16 bp, Homo sapiens
cttttgttctgagggg

SEQ ID NO: 2904741 - DNA, 17 bp, Homo sapiens
cttttgttctgaggggt

SEQ ID NO: 2904742 - DNA, 13 bp, Homo sapiens
cttttgtttttcc

SEQ ID NO: 2904743 - DNA, 19 bp, Homo sapiens
ctttttaaaaatagacact

SEQ ID NO: 2904744 - DNA, 17 bp, Homo sapiens
ctttttaaaacacatgt

SEQ ID NO: 2904745 - DNA, 12 bp, Homo sapiens
ctttttaaacag

SEQ ID NO: 2904746 - DNA, 14 bp, Homo sapiens
ctttttaaacagtg

SEQ ID NO: 2904747 - DNA, 21 bp, Homo sapiens
ctttttaaagaagtgcatgaa

SEQ ID NO: 2904748 - DNA, 21 bp, Homo sapiens
ctttttaaccctaatctttca

SEQ ID NO: 2904749 - DNA, 21 bp, Homo sapiens
gaatggctttgtcttgaaaaa

SEQ ID NO: 2904750 - DNA, 20 bp, Homo sapiens
gaatgtaaagcttgtctgat

SEQ ID NO: 2904751 - DNA, 21 bp, Homo sapiens
gaatgtagtattcaatgattt

SEQ ID NO: 2904752 - DNA, 16 bp, Homo sapiens
gaatgtatttatttgg

SEQ ID NO: 2904753 - DNA, 12 bp, Homo sapiens
gaatgtatttcc

SEQ ID NO: 2904754 - DNA, 15 bp, Homo sapiens
gaatgtcagaattaa

SEQ ID NO: 2904755 - DNA, 17 bp, Homo sapiens
gaatgtcagaattaaaa

SEQ ID NO: 2904756 - DNA, 16 bp, Homo sapiens
gaatgtcattatttga

SEQ ID NO: 2904757 - DNA, 22 bp, Homo sapiens
gaatgtccaaaatttatatttt

SEQ ID NO: 2904758 - DNA, 15 bp, Homo sapiens
gaatgtgtgccttgt

SEQ ID NO: 2904759 - DNA, 20 bp, Homo sapiens
gaatgttaagacttgacagt

SEQ ID NO: 2904760 - DNA, 14 bp, Homo sapiens
gaatgttagagcac

SEQ ID NO: 2904761 - DNA, 20 bp, Homo sapiens
gaatgttgattacagtgcag

SEQ ID NO: 2904762 - DNA, 17 bp, Homo sapiens
gaatgtttgtgtctgtg

SEQ ID NO: 2904763 - DNA, 15 bp, Homo sapiens
gaattaaaataacag

SEQ ID NO: 2904764 - DNA, 20 bp, Homo sapiens
tgtgaggtttcccaatggtg

SEQ ID NO: 2904765 - DNA, 22 bp, Homo sapiens
tgtgaggtttcccaatggtgtt

SEQ ID NO: 2904766 - DNA, 22 bp, Homo sapiens
tgtgagtaaatcagatgttgaa

SEQ ID NO: 2904767 - DNA, 17 bp, Homo sapiens
tgtgagtatcagaattg

SEQ ID NO: 2904768 - DNA, 21 bp, Homo sapiens
tgtgagtctttggttctaagg

SEQ ID NO: 2904769 - DNA, 20 bp, Homo sapiens
tgtgatagagcctttgatct

SEQ ID NO: 2904770 - DNA, 14 bp, Homo sapiens
tgtgatattctaag

SEQ ID NO: 2904771 - DNA, 15 bp, Homo sapiens
tgtgatattctaaga

SEQ ID NO: 2904772 - DNA, 19 bp, Homo sapiens
tgtgatattgaccatgtga

SEQ ID NO: 2904773 - DNA, 23 bp, Homo sapiens
tgtgatcagctttcaaagcattt

SEQ ID NO: 2904774 - DNA, 17 bp, Homo sapiens
tgtgatcatctttgctg

SEQ ID NO: 2904775 - DNA, 14 bp, Homo sapiens
tgtgatcccagctc

SEQ ID NO: 2904776 - DNA, 13 bp, Homo sapiens
tgtgatcgtctga

SEQ ID NO: 2904777 - DNA, 17 bp, Homo sapiens
tgtgatcttatttttct

SEQ ID NO: 2904778 - DNA, 14 bp, Homo sapiens
tgtgatgaatactg

SEQ ID NO: 2904779 - DNA, 17 bp, Homo sapiens
tgtgatgaatctacatt

SEQ ID NO: 2904780 - DNA, 18 bp, Homo sapiens
tgtgatgaatctacattt

SEQ ID NO: 2904781 - DNA, 21 bp, Homo sapiens
tgtgatgaatctacatttgtt

SEQ ID NO: 2904782 - DNA, 20 bp, Homo sapiens
tgtgatgggatctgtaagga

SEQ ID NO: 2904783 - DNA, 13 bp, Homo sapiens
tgtgatgttctaa

SEQ ID NO: 2904784 - DNA, 15 bp, Homo sapiens
tgtgatgttctaagg

SEQ ID NO: 2904785 - DNA, 17 bp, Homo sapiens
tgtgatgttctaaggct

SEQ ID NO: 2904786 - DNA, 19 bp, Homo sapiens
tgtgattaactcttagaag

SEQ ID NO: 2904787 - DNA, 19 bp, Homo sapiens
tgtgattactctttgcttt

SEQ ID NO: 2904788 - DNA, 22 bp, Homo sapiens
tgtgattactctttgctttgta

SEQ ID NO: 2904789 - DNA, 14 bp, Homo sapiens
tgtgattatggaca

SEQ ID NO: 2904790 - DNA, 19 bp, Homo sapiens
tgtgattcttccagatgtg

SEQ ID NO: 2904791 - DNA, 20 bp, Homo sapiens
tgtgattcttccagatgtga

SEQ ID NO: 2904792 - DNA, 22 bp, Homo sapiens
tgtgattgacagctttgctgct

SEQ ID NO: 2904793 - DNA, 23 bp, Homo sapiens
tgtgattgacagctttgctgctg

SEQ ID NO: 2904794 - DNA, 17 bp, Homo sapiens
tgtgattgggaataaat

SEQ ID NO: 2904795 - DNA, 19 bp, Homo sapiens
tgtgattgggaataaatat

SEQ ID NO: 2904796 - DNA, 14 bp, Homo sapiens
tgtgattgtggaat

SEQ ID NO: 2904797 - DNA, 15 bp, Homo sapiens
tgtgatttaatagtg

SEQ ID NO: 2904798 - DNA, 17 bp, Homo sapiens
tgtgattttaactctgt

SEQ ID NO: 2904799 - DNA, 19 bp, Homo sapiens
tgtgattttaactctgtct

SEQ ID NO: 2904800 - DNA, 20 bp, Homo sapiens
tgtgattttgtaggttattt

SEQ ID NO: 2904801 - DNA, 17 bp, Homo sapiens
tgtgattttttgttctt

SEQ ID NO: 2904802 - DNA, 18 bp, Homo sapiens
tgtgattttttgttcttg

SEQ ID NO: 2904803 - DNA, 15 bp, Homo sapiens
tgttttattcctgta

SEQ ID NO: 2904804 - DNA, 18 bp, Homo sapiens
tgttttcaaagggacttt

SEQ ID NO: 2904805 - DNA, 22 bp, Homo sapiens
tgttttcaaggaagaaaacgga

SEQ ID NO: 2904806 - DNA, 15 bp, Homo sapiens
tgttttcagactcag

SEQ ID NO: 2904807 - DNA, 20 bp, Homo sapiens
ttctccccaatgagacttgc

SEQ ID NO: 2904808 - DNA, 20 bp, Homo sapiens
ttctccccgaggctgcccca

SEQ ID NO: 2904809 - DNA, 19 bp, Homo sapiens
ttctcccggaggccccggc

SEQ ID NO: 2904810 - DNA, 15 bp, Homo sapiens
ttctccctgggaact

SEQ ID NO: 2904811 - DNA, 13 bp, Homo sapiens
ttctcccttcggt

SEQ ID NO: 2904812 - DNA, 17 bp, Homo sapiens
ttctcctaatgctctga

SEQ ID NO: 2904813 - DNA, 21 bp, Homo sapiens
ttctcctcgttggttcatgtg

SEQ ID NO: 2904814 - DNA, 14 bp, Homo sapiens
ttctcctgcctcag

SEQ ID NO: 2904815 - DNA, 15 bp, Homo sapiens
ttctcctgcctcagc

SEQ ID NO: 2904816 - DNA, 22 bp, Homo sapiens
ttctcctgtttatgggtttctt

SEQ ID NO: 2904817 - DNA, 14 bp, Homo sapiens
ttctcctttgcagt

SEQ ID NO: 2904818 - DNA, 20 bp, Homo sapiens
ttctcctttggcatgtttaa

SEQ ID NO: 2904819 - DNA, 21 bp, Homo sapiens
ttctcctttggcatgtttaat

SEQ ID NO: 2904820 - DNA, 12 bp, Homo sapiens
ttctcctttgta

SEQ ID NO: 2904821 - DNA, 17 bp, Homo sapiens
ttctcgcctaggatttc

SEQ ID NO: 2904822 - DNA, 18 bp, Homo sapiens
ttctcgcctaggatttca

SEQ ID NO: 2904823 - DNA, 22 bp, Homo sapiens
ttctctatcctctctctctcta

SEQ ID NO: 2904824 - DNA, 14 bp, Homo sapiens
ttctctcagctccc

SEQ ID NO: 2904825 - DNA, 19 bp, Homo sapiens
ttctctcagctcccaggcc

SEQ ID NO: 2904826 - DNA, 12 bp, Homo sapiens
ttctctctatgc

SEQ ID NO: 2904827 - DNA, 11 bp, Homo sapiens
ttctctctctt

SEQ ID NO: 2904828 - DNA, 17 bp, Homo sapiens
ttctctctggagcccct

SEQ ID NO: 2904829 - DNA, 18 bp, Homo sapiens
ttctctgagctgtgcagg

SEQ ID NO: 2904830 - DNA, 15 bp, Homo sapiens
ttctctgagctttgt

SEQ ID NO: 2904831 - DNA, 19 bp, Homo sapiens
ttctctgagctttgttact

SEQ ID NO: 2904832 - DNA, 16 bp, Homo sapiens
ttctctgatcaaaatt

SEQ ID NO: 2904833 - DNA, 16 bp, Homo sapiens
ttctctgcccagccgg

SEQ ID NO: 2904834 - DNA, 23 bp, Homo sapiens
ttctctgccgctacctccctccc

SEQ ID NO: 2904835 - DNA, 17 bp, Homo sapiens
ttctctgctcacagaag

SEQ ID NO: 2904836 - DNA, 18 bp, Homo sapiens
ttctctgtacttttcatt

SEQ ID NO: 2904837 - DNA, 21 bp, Homo sapiens
ttctctgtacttttcattctc

SEQ ID NO: 2904838 - DNA, 19 bp, Homo sapiens
ttctctgtatattgggctc

SEQ ID NO: 2904839 - DNA, 17 bp, Homo sapiens
ttctctgtctcatccat

SEQ ID NO: 2904840 - DNA, 13 bp, Homo sapiens
ttctctgtgaatc

SEQ ID NO: 2904841 - DNA, 16 bp, Homo sapiens
ttctctgtgtctaaga

SEQ ID NO: 2904842 - DNA, 21 bp, Homo sapiens
ttctctgtgtctaagattcta

SEQ ID NO: 2904843 - DNA, 22 bp, Homo sapiens
ttctctgtgtctaagattctag

SEQ ID NO: 2904844 - DNA, 21 bp, Homo sapiens
ttctcttccagtttctgtaag

SEQ ID NO: 2904845 - DNA, 13 bp, Homo sapiens
ttctcttctcttc

SEQ ID NO: 2904846 - DNA, 16 bp, Homo sapiens
ttctcttgacagtctg

SEQ ID NO: 2904847 - DNA, 18 bp, Homo sapiens
ttctcttgagtcacactg

SEQ ID NO: 2904848 - DNA, 17 bp, Homo sapiens
ttctcttgggaactgaa

SEQ ID NO: 2904849 - DNA, 20 bp, Homo sapiens
ttctcttgtttaaaaaaaga

SEQ ID NO: 2904850 - DNA, 15 bp, Homo sapiens
ttctcttttcctttg

SEQ ID NO: 2904851 - DNA, 15 bp, Homo sapiens
ttctgaaaagaaata

SEQ ID NO: 2904852 - DNA, 17 bp, Homo sapiens
ttctgaaaagaaataat

SEQ ID NO: 2904853 - DNA, 21 bp, Homo sapiens
ttctgaagcttatgtttctta

SEQ ID NO: 2904854 - DNA, 21 bp, Homo sapiens
ttctgaagtgtgtccatcctg

SEQ ID NO: 2904855 - DNA, 21 bp, Homo sapiens
ttctgaagttttattttaaat

SEQ ID NO: 2904856 - DNA, 23 bp, Homo sapiens
ttctgaagttttattttaaatta

SEQ ID NO: 2904857 - DNA, 17 bp, Homo sapiens
ttctgaatgtttgtgtc

SEQ ID NO: 2904858 - DNA, 22 bp, Homo sapiens
ttctgaatgtttgtgtctgtgg

SEQ ID NO: 2904859 - DNA, 14 bp, Homo sapiens
ttctgaatttgcaa

SEQ ID NO: 2904860 - DNA, 16 bp, Homo sapiens
ttctgaatttgcaaag

SEQ ID NO: 2904861 - DNA, 19 bp, Homo sapiens
ttctgaatttgcaaagtac

SEQ ID NO: 2904862 - DNA, 21 bp, Homo sapiens
ttctgaatttgcaaagtactg

SEQ ID NO: 2904863 - DNA, 22 bp, Homo sapiens
ttctgaatttgcaaagtactgt

SEQ ID NO: 2904864 - DNA, 21 bp, Homo sapiens
ttctgacagtttttctgtttt

SEQ ID NO: 2904865 - DNA, 18 bp, Homo sapiens
ttctgactttttgtttct

SEQ ID NO: 2904866 - DNA, 16 bp, Homo sapiens
ttctgagcaaagcatc

SEQ ID NO: 2904867 - DNA, 17 bp, Homo sapiens
ttctgagccttctactt

SEQ ID NO: 2904868 - DNA, 14 bp, Homo sapiens
ttctgagttcttga

SEQ ID NO: 2904869 - DNA, 14 bp, Homo sapiens
ttctgataggaggg

SEQ ID NO: 2904870 - DNA, 17 bp, Homo sapiens
ttctgataggagggggc

SEQ ID NO: 2904871 - DNA, 21 bp, Homo sapiens
ttctgataggagggggcggca

SEQ ID NO: 2904872 - DNA, 22 bp, Homo sapiens
ttctgatatgcagttttcctta

SEQ ID NO: 2904873 - DNA, 20 bp, Homo sapiens
ttctgatttagcaatgctgt

SEQ ID NO: 2904874 - DNA, 17 bp, Homo sapiens
ttctgattttaggagct

SEQ ID NO: 2904875 - DNA, 15 bp, Homo sapiens
ttctgcaactgaaat

SEQ ID NO: 2904876 - DNA, 17 bp, Homo sapiens
ttctgcacaggtctctg

SEQ ID NO: 2904877 - DNA, 19 bp, Homo sapiens
ttctgcacaggtctctgtt

SEQ ID NO: 2904878 - DNA, 22 bp, Homo sapiens
ttctgcagtaaatcttttacaa

SEQ ID NO: 2904879 - DNA, 21 bp, Homo sapiens
ttctgcatatgttgaatactt

SEQ ID NO: 2904880 - DNA, 12 bp, Homo sapiens
ttctgccaggag

SEQ ID NO: 2904881 - DNA, 14 bp, Homo sapiens
ttctgccataacag

SEQ ID NO: 2904882 - DNA, 17 bp, Homo sapiens
ttctgccccccagggct

SEQ ID NO: 2904883 - DNA, 16 bp, Homo sapiens
ttctgccccctcaggg

SEQ ID NO: 2904884 - DNA, 17 bp, Homo sapiens
ttctgccggccctgggg

SEQ ID NO: 2904885 - DNA, 16 bp, Homo sapiens
ttctgcctataaattt

SEQ ID NO: 2904886 - DNA, 21 bp, Homo sapiens
ttctgcctataaatttactct

SEQ ID NO: 2904887 - DNA, 22 bp, Homo sapiens
ttctgcctataaatttactctg

SEQ ID NO: 2904888 - DNA, 16 bp, Homo sapiens
ttctgcctgccagctg

SEQ ID NO: 2904889 - DNA, 18 bp, Homo sapiens
ttctgcctgccagctgca

SEQ ID NO: 2904890 - DNA, 22 bp, Homo sapiens
ttctgcctgccagctgcactga

SEQ ID NO: 2904891 - DNA, 14 bp, Homo sapiens
ttctgcgcctcagg

SEQ ID NO: 2904892 - DNA, 20 bp, Homo sapiens
ttctgtctggtttatttagg

SEQ ID NO: 2904893 - DNA, 11 bp, Homo sapiens
ttctgtgaaga

SEQ ID NO: 2904894 - DNA, 19 bp, Homo sapiens
ttctgtgaagaagccctgt

SEQ ID NO: 2904895 - DNA, 13 bp, Homo sapiens
ttctgtgaagagg

SEQ ID NO: 2904896 - DNA, 16 bp, Homo sapiens
ttctgtgaagcccttt

SEQ ID NO: 2904897 - DNA, 19 bp, Homo sapiens
ttctgtgcagataaacaga

SEQ ID NO: 2904898 - DNA, 15 bp, Homo sapiens
ttctgtggaaagtgt

SEQ ID NO: 2904899 - DNA, 17 bp, Homo sapiens
ttctgtggaaagtgtaa

SEQ ID NO: 2904900 - DNA, 18 bp, Homo sapiens
ttctgtggaaagtgtaaa

SEQ ID NO: 2904901 - DNA, 22 bp, Homo sapiens
ttctgtggaaagtgtaaagcat

SEQ ID NO: 2904902 - DNA, 22 bp, Homo sapiens
ttctgtggacaccactgagctc

SEQ ID NO: 2904903 - DNA, 23 bp, Homo sapiens
ttctgttactaaatccttttgtt

SEQ ID NO: 2904904 - DNA, 14 bp, Homo sapiens
ttctgttcatctct

SEQ ID NO: 2904905 - DNA, 18 bp, Homo sapiens
ttctgttcatctctttgt

SEQ ID NO: 2904906 - DNA, 16 bp, Homo sapiens
ttctgttcgaagttca

SEQ ID NO: 2904907 - DNA, 21 bp, Homo sapiens
ttctgttgtgttcaccagaga

SEQ ID NO: 2904908 - DNA, 12 bp, Homo sapiens
ttctgtttcaag

SEQ ID NO: 2904909 - DNA, 23 bp, Homo sapiens
ttctgtttcaaggcactctagat

SEQ ID NO: 2904910 - DNA, 18 bp, Homo sapiens
ttctgtttcctgtaccag

SEQ ID NO: 2904911 - DNA, 17 bp, Homo sapiens
ttctgttttcttctcag

SEQ ID NO: 2904912 - DNA, 16 bp, Homo sapiens
ttcttaaacacttgca

SEQ ID NO: 2904913 - DNA, 12 bp, Homo sapiens
ttcttaaatata

SEQ ID NO: 2904914 - DNA, 15 bp, Homo sapiens
ttcttaaatctttct

SEQ ID NO: 2904915 - DNA, 19 bp, Homo sapiens
ttcttaaatctttcttcaa

SEQ ID NO: 2904916 - DNA, 21 bp, Homo sapiens
ttcttaaatgggctactttgt

SEQ ID NO: 2904917 - DNA, 23 bp, Homo sapiens
ttcttaacaaactcttcagttaa

SEQ ID NO: 2904918 - DNA, 13 bp, Homo sapiens
ttcttaacagttt

SEQ ID NO: 2904919 - DNA, 20 bp, Homo sapiens
ttcttaaccctttccagagt

SEQ ID NO: 2904920 - DNA, 23 bp, Homo sapiens
ttcttaaggtgaggcctgtctgt

SEQ ID NO: 2904921 - DNA, 11 bp, Homo sapiens
ttcttaatttg

SEQ ID NO: 2904922 - DNA, 13 bp, Homo sapiens
ttcttataaatat

SEQ ID NO: 2904923 - DNA, 14 bp, Homo sapiens
ttcttataaatatg

SEQ ID NO: 2904924 - DNA, 17 bp, Homo sapiens
ttcttataaatatgaag

SEQ ID NO: 2904925 - DNA, 16 bp, Homo sapiens
ttcttatacgcttttc

SEQ ID NO: 2904926 - DNA, 20 bp, Homo sapiens
ttcttatacgcttttctttg

SEQ ID NO: 2904927 - DNA, 19 bp, Homo sapiens
ttcttatacgtctagccta

SEQ ID NO: 2904928 - DNA, 14 bp, Homo sapiens
ttcttatagaataa

SEQ ID NO: 2904929 - DNA, 16 bp, Homo sapiens
ttcttatagaataaaa

SEQ ID NO: 2904930 - DNA, 23 bp, Homo sapiens
ttcttatgccatgttaatttcat

SEQ ID NO: 2904931 - DNA, 17 bp, Homo sapiens
ttcttatggaattgatt

SEQ ID NO: 2904932 - DNA, 18 bp, Homo sapiens
ttcttatggaattgattt

SEQ ID NO: 2904933 - DNA, 22 bp, Homo sapiens
ttcttatggaattgatttgcat

SEQ ID NO: 2904934 - DNA, 17 bp, Homo sapiens
ttcttattaggcctcag

SEQ ID NO: 2904935 - DNA, 19 bp, Homo sapiens
ttcttattctcactccacc

SEQ ID NO: 2904936 - DNA, 17 bp, Homo sapiens
ttcttattctctgtttg

SEQ ID NO: 2904937 - DNA, 13 bp, Homo sapiens
ttcttattttgtg

SEQ ID NO: 2904938 - DNA, 14 bp, Homo sapiens
ttcttcacttttgc

SEQ ID NO: 2904939 - DNA, 14 bp, Homo sapiens
ttcttcagagatca

SEQ ID NO: 2904940 - DNA, 18 bp, Homo sapiens
ttcttcagcttgatcctg

SEQ ID NO: 2904941 - DNA, 23 bp, Homo sapiens
ttcttcaggctgcctaagacatg

SEQ ID NO: 2904942 - DNA, 19 bp, Homo sapiens
ttcttccaggtgcccagct

SEQ ID NO: 2904943 - DNA, 15 bp, Homo sapiens
ttcttccctgtcagc

SEQ ID NO: 2904944 - DNA, 20 bp, Homo sapiens
ttcttcccttttacatactg

SEQ ID NO: 2904945 - DNA, 18 bp, Homo sapiens
ttcttcctcaagtcttga

SEQ ID NO: 2904946 - DNA, 9 bp, Homo sapiens
ttcttcctt

SEQ ID NO: 2904947 - DNA, 12 bp, Homo sapiens
ttcttccttgat

SEQ ID NO: 2904948 - DNA, 22 bp, Homo sapiens
ttcttccttgattgtgtagctg

SEQ ID NO: 2904949 - DNA, 20 bp, Homo sapiens
ttcttctagaagataacatt

SEQ ID NO: 2904950 - DNA, 20 bp, Homo sapiens
ttcttctgtgtttataaaat

SEQ ID NO: 2904951 - DNA, 21 bp, Homo sapiens
ttcttctttgtggtctttttc

SEQ ID NO: 2904952 - DNA, 12 bp, Homo sapiens
ttcttcttttcc

SEQ ID NO: 2904953 - DNA, 17 bp, Homo sapiens
ttcttctttttgcttca

SEQ ID NO: 2904954 - DNA, 21 bp, Homo sapiens
ttcttctttttgcttcaaaaa

SEQ ID NO: 2904955 - DNA, 22 bp, Homo sapiens
ttcttgaaaggtccaaatgttt

SEQ ID NO: 2904956 - DNA, 18 bp, Homo sapiens
ttcttgaggtctcttttc

SEQ ID NO: 2904957 - DNA, 18 bp, Homo sapiens
ttcttgatcttaaagatc

SEQ ID NO: 2904958 - DNA, 15 bp, Homo sapiens
ttcttgcaagcatgc

SEQ ID NO: 2904959 - DNA, 14 bp, Homo sapiens
ttcttgctaacttt

SEQ ID NO: 2904960 - DNA, 20 bp, Homo sapiens
ttcttgcttaccttgactgt

SEQ ID NO: 2904961 - DNA, 22 bp, Homo sapiens
ttcttggcttaatcattttcat

SEQ ID NO: 2904962 - DNA, 15 bp, Homo sapiens
ttcttgtaaatgtgt

SEQ ID NO: 2904963 - DNA, 19 bp, Homo sapiens
ttcttgtaaggctttgatt

SEQ ID NO: 2904964 - DNA, 17 bp, Homo sapiens
ttcttgtgaaggccatg

SEQ ID NO: 2904965 - DNA, 13 bp, Homo sapiens
ttcttgtttctcc

SEQ ID NO: 2904966 - DNA, 18 bp, Homo sapiens
ttcttgtttgtcagcatc

SEQ ID NO: 2904967 - DNA, 15 bp, Homo sapiens
ttctttaaaaaagaa

SEQ ID NO: 2904968 - DNA, 16 bp, Homo sapiens
ttctttaaaagaatgg

SEQ ID NO: 2904969 - DNA, 13 bp, Homo sapiens
ttctttaaagcca

SEQ ID NO: 2904970 - DNA, 18 bp, Homo sapiens
ttctttaaagccagtcat

SEQ ID NO: 2904971 - DNA, 15 bp, Homo sapiens
ttctttaagactttt

SEQ ID NO: 2904972 - DNA, 16 bp, Homo sapiens
ttctttaatatgattc

SEQ ID NO: 2904973 - DNA, 12 bp, Homo sapiens
ttctttagaaaa

SEQ ID NO: 2904974 - DNA, 22 bp, Homo sapiens
ttctttagaaaacccaagtttt

SEQ ID NO: 2904975 - DNA, 11 bp, Homo sapiens
ttctttagaac

SEQ ID NO: 2904976 - DNA, 17 bp, Homo sapiens
ttctttagagaactgaa

SEQ ID NO: 2904977 - DNA, 22 bp, Homo sapiens
ttctttatacaacagtgctaaa

SEQ ID NO: 2904978 - DNA, 17 bp, Homo sapiens
ttctttatactctcttc

SEQ ID NO: 2904979 - DNA, 21 bp, Homo sapiens
ttctttatatacaataatgga

SEQ ID NO: 2904980 - DNA, 19 bp, Homo sapiens
ttctttctagttcagctgc

SEQ ID NO: 2904981 - DNA, 13 bp, Homo sapiens
ttctttcttcctc

SEQ ID NO: 2904982 - DNA, 15 bp, Homo sapiens
ttctttcttcctcca

SEQ ID NO: 2904983 - DNA, 20 bp, Homo sapiens
ttctttgatgttaacacatt

SEQ ID NO: 2904984 - DNA, 21 bp, Homo sapiens
ttctttgatgttaacacattt

SEQ ID NO: 2904985 - DNA, 16 bp, Homo sapiens
ttctttgcaaagtatt

SEQ ID NO: 2904986 - DNA, 21 bp, Homo sapiens
ttgaaataactggaacaaatt

SEQ ID NO: 2904987 - DNA, 18 bp, Homo sapiens
ttgaaatatcctgcttga

SEQ ID NO: 2904988 - DNA, 11 bp, Homo sapiens
ttgaaatgtaa

SEQ ID NO: 2904989 - DNA, 19 bp, Homo sapiens
ttgaaatgtaatttcagtt

SEQ ID NO: 2904990 - DNA, 18 bp, Homo sapiens
ttgaaatgtggttttcct

SEQ ID NO: 2904991 - DNA, 18 bp, Homo sapiens
ttgaaattaacctctcac

SEQ ID NO: 2904992 - DNA, 12 bp, Homo sapiens
ttgaaattctga

SEQ ID NO: 2904993 - DNA, 13 bp, Homo sapiens
ttgaaattctgaa

SEQ ID NO: 2904994 - DNA, 14 bp, Homo sapiens
ttgaaattctgaat

SEQ ID NO: 2904995 - DNA, 21 bp, Homo sapiens
ttgaaattctgaatttgcaaa

SEQ ID NO: 2904996 - DNA, 22 bp, Homo sapiens
ttgaaattctgaatttgcaaag

SEQ ID NO: 2904997 - DNA, 17 bp, Homo sapiens
ttgaaattgtattacaa

SEQ ID NO: 2904998 - DNA, 14 bp, Homo sapiens
ttgaacacaaactg

SEQ ID NO: 2904999 - DNA, 21 bp, Homo sapiens
ttgaacacaaactgtaaataa

SEQ ID NO: 2905000 - DNA, 17 bp, Homo sapiens
ttgaaccttaaaaggta

SEQ ID NO: 2905001 - DNA, 20 bp, Homo sapiens
ttgaactcttcactcttcaa

SEQ ID NO: 2905002 - DNA, 15 bp, Homo sapiens
ttgaactgatagtta

SEQ ID NO: 2905003 - DNA, 19 bp, Homo sapiens
ttgaactgatagttactgt

SEQ ID NO: 2905004 - DNA, 14 bp, Homo sapiens
ttgaagaaacgctt

SEQ ID NO: 2905005 - DNA, 20 bp, Homo sapiens
ttgaagaaattataaagata

SEQ ID NO: 2905006 - DNA, 15 bp, Homo sapiens
ttgaagaatgttaag

SEQ ID NO: 2905007 - DNA, 23 bp, Homo sapiens
ttgaagaatgttaagacttgaca

SEQ ID NO: 2905008 - DNA, 22 bp, Homo sapiens
ttgaagacagagcaaagcgccc

SEQ ID NO: 2905009 - DNA, 16 bp, Homo sapiens
ttgaagcagctctgcc

SEQ ID NO: 2905010 - DNA, 18 bp, Homo sapiens
ttgaagcagtcttgctct

SEQ ID NO: 2905011 - DNA, 22 bp, Homo sapiens
ttgaaggaaatgagtggccagc

SEQ ID NO: 2905012 - DNA, 15 bp, Homo sapiens
ttgaagggccagagc

SEQ ID NO: 2905013 - DNA, 22 bp, Homo sapiens
ttgaagtaactataacaaaaaa

SEQ ID NO: 2905014 - DNA, 16 bp, Homo sapiens
ttgaagtaatgaattt

SEQ ID NO: 2905015 - DNA, 16 bp, Homo sapiens
ttgaagtgggaaagca

SEQ ID NO: 2905016 - DNA, 20 bp, Homo sapiens
ttgaataataagcaggatgt

SEQ ID NO: 2905017 - DNA, 12 bp, Homo sapiens
ttgaataatggt

SEQ ID NO: 2905018 - DNA, 19 bp, Homo sapiens
ttgaataatggtaccagat

SEQ ID NO: 2905019 - DNA, 15 bp, Homo sapiens
ttgaatacttacatt

SEQ ID NO: 2905020 - DNA, 12 bp, Homo sapiens
ttgaatactttt

SEQ ID NO: 2905021 - DNA, 20 bp, Homo sapiens
ttgaataggaaataaaatta

SEQ ID NO: 2905022 - DNA, 22 bp, Homo sapiens
ttgaatataatatatttgtgta

SEQ ID NO: 2905023 - DNA, 15 bp, Homo sapiens
ttgaatatttagcat

SEQ ID NO: 2905024 - DNA, 10 bp, Homo sapiens
ttgaatcaat

SEQ ID NO: 2905025 - DNA, 22 bp, Homo sapiens
ttgaatcaataatatattttct

SEQ ID NO: 2905026 - DNA, 23 bp, Homo sapiens
ttgaatcaataatatattttctg

SEQ ID NO: 2905027 - DNA, 16 bp, Homo sapiens
ttgaatcaatgtatta

SEQ ID NO: 2905028 - DNA, 18 bp, Homo sapiens
ttgaatcagtttccaatt

SEQ ID NO: 2905029 - DNA, 18 bp, Homo sapiens
ttgaatgtatgcttcata

SEQ ID NO: 2905030 - DNA, 13 bp, Homo sapiens
ttgaatgtccaaa

SEQ ID NO: 2905031 - DNA, 16 bp, Homo sapiens
ttgaatgtcttttgaa

SEQ ID NO: 2905032 - DNA, 17 bp, Homo sapiens
ttgaatgtcttttgaat

SEQ ID NO: 2905033 - DNA, 19 bp, Homo sapiens
ttgaatgtggcttgagaaa

SEQ ID NO: 2905034 - DNA, 22 bp, Homo sapiens
ttgaatgtggcttgagaaatat

SEQ ID NO: 2905035 - DNA, 13 bp, Homo sapiens
ttgaatgttaaca

SEQ ID NO: 2905036 - DNA, 22 bp, Homo sapiens
ttgaattaaattaggaataaat

SEQ ID NO: 2905037 - DNA, 21 bp, Homo sapiens
ttgaattccaagtgtatttta

SEQ ID NO: 2905038 - DNA, 18 bp, Homo sapiens
ttgaattgtaactgttct

SEQ ID NO: 2905039 - DNA, 12 bp, Homo sapiens
ttgaatttgcat

SEQ ID NO: 2905040 - DNA, 13 bp, Homo sapiens
ttgaatttgcatg

SEQ ID NO: 2905041 - DNA, 15 bp, Homo sapiens
ttgaattttgactta

SEQ ID NO: 2905042 - DNA, 22 bp, Homo sapiens
ttgacaaacccggaagatcaga

SEQ ID NO: 2905043 - DNA, 18 bp, Homo sapiens
ttgacaaaggcaagcact

SEQ ID NO: 2905044 - DNA, 17 bp, Homo sapiens
ttgacaacatggcttct

SEQ ID NO: 2905045 - DNA, 22 bp, Homo sapiens
ttgacaacatggcttctccttt

SEQ ID NO: 2905046 - DNA, 18 bp, Homo sapiens
ttgacaaggtcaaattta

SEQ ID NO: 2905047 - DNA, 13 bp, Homo sapiens
ttgacacaggtct

SEQ ID NO: 2905048 - DNA, 22 bp, Homo sapiens
ttgacacaggtctttcctaagg

SEQ ID NO: 2905049 - DNA, 18 bp, Homo sapiens
ttgacagctttgctgctg

SEQ ID NO: 2905050 - DNA, 18 bp, Homo sapiens
ttgacaggttttccaaaa

SEQ ID NO: 2905051 - DNA, 20 bp, Homo sapiens
ttgacaggttttccaaaagt

SEQ ID NO: 2905052 - DNA, 18 bp, Homo sapiens
ttgacagtcactcagcca

SEQ ID NO: 2905053 - DNA, 15 bp, Homo sapiens
ttgacagttctgaag

SEQ ID NO: 2905054 - DNA, 18 bp, Homo sapiens
ttgacagttctgaagaat

SEQ ID NO: 2905055 - DNA, 13 bp, Homo sapiens
ttgacatatttaa

SEQ ID NO: 2905056 - DNA, 18 bp, Homo sapiens
ttgacatatttaatgttt

SEQ ID NO: 2905057 - DNA, 16 bp, Homo sapiens
ttgacatcagccagct

SEQ ID NO: 2905058 - DNA, 20 bp, Homo sapiens
ttgacatgaccctctgtccc

SEQ ID NO: 2905059 - DNA, 22 bp, Homo sapiens
ttgacatgaccctctgtcccca

SEQ ID NO: 2905060 - DNA, 17 bp, Homo sapiens
ttgacattctctattgt

SEQ ID NO: 2905061 - DNA, 18 bp, Homo sapiens
ttgacattgcgtttgacc

SEQ ID NO: 2905062 - DNA, 13 bp, Homo sapiens
ttgacatttaata

SEQ ID NO: 2905063 - DNA, 15 bp, Homo sapiens
ttgacatttatatta

SEQ ID NO: 2905064 - DNA, 17 bp, Homo sapiens
ttgacatttatattaaa

SEQ ID NO: 2905065 - DNA, 18 bp, Homo sapiens
ttgaccaagcaggaagct

SEQ ID NO: 2905066 - DNA, 19 bp, Homo sapiens
ttgaccactgtctttttct

SEQ ID NO: 2905067 - DNA, 23 bp, Homo sapiens
ttgaccactgtctttttcttacc

SEQ ID NO: 2905068 - DNA, 13 bp, Homo sapiens
ttgaccaggaaag

SEQ ID NO: 2905069 - DNA, 15 bp, Homo sapiens
ttgaccatgtgatta

SEQ ID NO: 2905070 - DNA, 15 bp, Homo sapiens
ttgacctgtcctctt

SEQ ID NO: 2905071 - DNA, 20 bp, Homo sapiens
ttgaccttcatttcatgtat

SEQ ID NO: 2905072 - DNA, 21 bp, Homo sapiens
ttgaccttttatgtagtaatt

SEQ ID NO: 2905073 - DNA, 23 bp, Homo sapiens
ttgacgagtgtgaagcttccttg

SEQ ID NO: 2905074 - DNA, 23 bp, Homo sapiens
ttgactgaagcgaacatcttcat

SEQ ID NO: 2905075 - DNA, 12 bp, Homo sapiens
ttgactgctgct

SEQ ID NO: 2905076 - DNA, 22 bp, Homo sapiens
ttgacttcttggtgctgttgaa

SEQ ID NO: 2905077 - DNA, 20 bp, Homo sapiens
ttgacttgtataacatcact

SEQ ID NO: 2905078 - DNA, 15 bp, Homo sapiens
ttgactttatttctg

SEQ ID NO: 2905079 - DNA, 15 bp, Homo sapiens
ttgagaacgtaaaga

SEQ ID NO: 2905080 - DNA, 19 bp, Homo sapiens
ttgagaactgcatatgttt

SEQ ID NO: 2905081 - DNA, 23 bp, Homo sapiens
ttgagaactggttttagcattta

SEQ ID NO: 2905082 - DNA, 19 bp, Homo sapiens
ttgagaaggaaaattttag

SEQ ID NO: 2905083 - DNA, 17 bp, Homo sapiens
ttgagacctcagccatg

SEQ ID NO: 2905084 - DNA, 18 bp, Homo sapiens
ttgagaggaggacttggt

SEQ ID NO: 2905085 - DNA, 15 bp, Homo sapiens
ttgagagtgtgacca

SEQ ID NO: 2905086 - DNA, 19 bp, Homo sapiens
ttgagagttcgtgaagagg

SEQ ID NO: 2905087 - DNA, 18 bp, Homo sapiens
ttgagagttttgtcttga

SEQ ID NO: 2905088 - DNA, 15 bp, Homo sapiens
ttgagatactatttt

SEQ ID NO: 2905089 - DNA, 14 bp, Homo sapiens
ttgatagaagataa

SEQ ID NO: 2905090 - DNA, 13 bp, Homo sapiens
ttgatagatgttt

SEQ ID NO: 2905091 - DNA, 19 bp, Homo sapiens
ttgatagggtctaccaata

SEQ ID NO: 2905092 - DNA, 21 bp, Homo sapiens
ttgatagtagccaaagttaaa

SEQ ID NO: 2905093 - DNA, 18 bp, Homo sapiens
ttgatatcggtgctatgt

SEQ ID NO: 2905094 - DNA, 14 bp, Homo sapiens
ttgatattatgtgg

SEQ ID NO: 2905095 - DNA, 14 bp, Homo sapiens
ttgatattgtgaac

SEQ ID NO: 2905096 - DNA, 20 bp, Homo sapiens
ttgatattgtgaacatttgt

SEQ ID NO: 2905097 - DNA, 17 bp, Homo sapiens
ttgatcatgtacttttt

SEQ ID NO: 2905098 - DNA, 13 bp, Homo sapiens
ttgatcattcata

SEQ ID NO: 2905099 - DNA, 17 bp, Homo sapiens
ttgatctacccgtgcct

SEQ ID NO: 2905100 - DNA, 20 bp, Homo sapiens
ttgatctacccgtgcctggg

SEQ ID NO: 2905101 - DNA, 17 bp, Homo sapiens
ttgatctggaacccaga

SEQ ID NO: 2905102 - DNA, 17 bp, Homo sapiens
ttgatgcttttctctca

SEQ ID NO: 2905103 - DNA, 20 bp, Homo sapiens
ttgatggaagaaaatggaat

SEQ ID NO: 2905104 - DNA, 16 bp, Homo sapiens
ttgatggctgggtcct

SEQ ID NO: 2905105 - DNA, 20 bp, Homo sapiens
ttgatgtactgattgagaag

SEQ ID NO: 2905106 - DNA, 22 bp, Homo sapiens
ttgatgtactgattgagaagtt

SEQ ID NO: 2905107 - DNA, 18 bp, Homo sapiens
ttgatgtgtttttgtatg

SEQ ID NO: 2905108 - DNA, 23 bp, Homo sapiens
ttgatgttcagacatttatgtgt

SEQ ID NO: 2905109 - DNA, 11 bp, Homo sapiens
ttgatgttttc

SEQ ID NO: 2905110 - DNA, 13 bp, Homo sapiens
ttgattaaaatct

SEQ ID NO: 2905111 - DNA, 17 bp, Homo sapiens
ttgattaaaatctcttg

SEQ ID NO: 2905112 - DNA, 14 bp, Homo sapiens
ttgattaacaatgt

SEQ ID NO: 2905113 - DNA, 15 bp, Homo sapiens
ttgattaacaatgta

SEQ ID NO: 2905114 - DNA, 22 bp, Homo sapiens
ttgattaacaatgtattttaat

SEQ ID NO: 2905115 - DNA, 14 bp, Homo sapiens
ttgattacagtgca

SEQ ID NO: 2905116 - DNA, 16 bp, Homo sapiens
ttgattagttttcttg

SEQ ID NO: 2905117 - DNA, 15 bp, Homo sapiens
ttgattataaatgtt

SEQ ID NO: 2905118 - DNA, 17 bp, Homo sapiens
ttgattcaaggctcaga

SEQ ID NO: 2905119 - DNA, 13 bp, Homo sapiens
ttgattccaacag

SEQ ID NO: 2905120 - DNA, 17 bp, Homo sapiens
ttgattccattttaagt

SEQ ID NO: 2905121 - DNA, 18 bp, Homo sapiens
ttgattctcgactgcttt

SEQ ID NO: 2905122 - DNA, 12 bp, Homo sapiens
ttgattgctaaa

SEQ ID NO: 2905123 - DNA, 23 bp, Homo sapiens
ttgattgctaaatgtaacagtct

SEQ ID NO: 2905124 - DNA, 21 bp, Homo sapiens
ttgattggggaattaaaagtc

SEQ ID NO: 2905125 - DNA, 21 bp, Homo sapiens
ttgattgtacgtagccacagg

SEQ ID NO: 2905126 - DNA, 22 bp, Homo sapiens
ttgattgttttattttggaatt

SEQ ID NO: 2905127 - DNA, 13 bp, Homo sapiens
ttgatttgaagaa

SEQ ID NO: 2905128 - DNA, 15 bp, Homo sapiens
ttgatttgtttagtt

SEQ ID NO: 2905129 - DNA, 23 bp, Homo sapiens
ttgattttacaattgaaatgact

SEQ ID NO: 2905130 - DNA, 14 bp, Homo sapiens
ttgattttcatatc

SEQ ID NO: 2905131 - DNA, 14 bp, Homo sapiens
ttgattttctggat

SEQ ID NO: 2905132 - DNA, 16 bp, Homo sapiens
ttgatttttactgtgt

SEQ ID NO: 2905133 - DNA, 15 bp, Homo sapiens
ttgatttttatttta

SEQ ID NO: 2905134 - DNA, 19 bp, Homo sapiens
ttgcaaagtggaattaaag

SEQ ID NO: 2905135 - DNA, 16 bp, Homo sapiens
ttgcaaatcagagcat

SEQ ID NO: 2905136 - DNA, 14 bp, Homo sapiens
ttgcaacctcgctg

SEQ ID NO: 2905137 - DNA, 19 bp, Homo sapiens
ttgcaagcatgcttgtgaa

SEQ ID NO: 2905138 - DNA, 17 bp, Homo sapiens
ttgcaaggttccacaga

SEQ ID NO: 2905139 - DNA, 19 bp, Homo sapiens
ttgcaaggttccacagagt

SEQ ID NO: 2905140 - DNA, 18 bp, Homo sapiens
ttgcaataacttctatat

SEQ ID NO: 2905141 - DNA, 16 bp, Homo sapiens
ttgcaataatgcagta

SEQ ID NO: 2905142 - DNA, 22 bp, Homo sapiens
ttgcaatatctgaagccctccc

SEQ ID NO: 2905143 - DNA, 11 bp, Homo sapiens
ttgcaatgcag

SEQ ID NO: 2905144 - DNA, 19 bp, Homo sapiens
ttgcaatggatcagccaag

SEQ ID NO: 2905145 - DNA, 16 bp, Homo sapiens
ttgcaattctttttgg

SEQ ID NO: 2905146 - DNA, 24 bp, Homo sapiens
ttgcacaaacttgtgagcatcaga

SEQ ID NO: 2905147 - DNA, 17 bp, Homo sapiens
ttgcacagaagtcctgt

SEQ ID NO: 2905148 - DNA, 21 bp, Homo sapiens
ttgcacagaagtcctgtatgt

SEQ ID NO: 2905149 - DNA, 16 bp, Homo sapiens
ttgcaccattctttct

SEQ ID NO: 2905150 - DNA, 15 bp, Homo sapiens
ttgcacccagcccag

SEQ ID NO: 2905151 - DNA, 19 bp, Homo sapiens
ttgcaccccatgctgttga

SEQ ID NO: 2905152 - DNA, 20 bp, Homo sapiens
ttgcacctatctcagccata

SEQ ID NO: 2905153 - DNA, 15 bp, Homo sapiens
ttgcacctttctagt

SEQ ID NO: 2905154 - DNA, 14 bp, Homo sapiens
ttgcacgcctcccc

SEQ ID NO: 2905155 - DNA, 19 bp, Homo sapiens
ttgcactcaagttgtttaa

SEQ ID NO: 2905156 - DNA, 19 bp, Homo sapiens
ttgcactgaaatggaattc

SEQ ID NO: 2905157 - DNA, 16 bp, Homo sapiens
ttgcactgaagttttt

SEQ ID NO: 2905158 - DNA, 18 bp, Homo sapiens
ttgcactgaagtttttga

SEQ ID NO: 2905159 - DNA, 12 bp, Homo sapiens
ttgcactgtctg

SEQ ID NO: 2905160 - DNA, 20 bp, Homo sapiens
ttgcacttgtgattatttat

SEQ ID NO: 2905161 - DNA, 16 bp, Homo sapiens
ttgcacttttgaatgt

SEQ ID NO: 2905162 - DNA, 18 bp, Homo sapiens
ttgcagaaaagcacctgc

SEQ ID NO: 2905163 - DNA, 19 bp, Homo sapiens
ttgcagaaaagcacctgcc

SEQ ID NO: 2905164 - DNA, 16 bp, Homo sapiens
ttgcagaagagggtgt

SEQ ID NO: 2905165 - DNA, 11 bp, Homo sapiens
ttgcagacagg

SEQ ID NO: 2905166 - DNA, 17 bp, Homo sapiens
ttgcagaggagcccagt

SEQ ID NO: 2905167 - DNA, 18 bp, Homo sapiens
ttgcagaggagcccagtg

SEQ ID NO: 2905168 - DNA, 19 bp, Homo sapiens
ttgcagatggaaagaggtg

SEQ ID NO: 2905169 - DNA, 15 bp, Homo sapiens
ttgcagcccttgtga

SEQ ID NO: 2905170 - DNA, 22 bp, Homo sapiens
ttgcagctggcccactgctggc

SEQ ID NO: 2905171 - DNA, 18 bp, Homo sapiens
ttgcaggagacattttca

SEQ ID NO: 2905172 - DNA, 14 bp, Homo sapiens
ttgcaggcggccct

SEQ ID NO: 2905173 - DNA, 21 bp, Homo sapiens
ttgcaggcggccctcagtgca

SEQ ID NO: 2905174 - DNA, 17 bp, Homo sapiens
ttgcaggctgagtccct

SEQ ID NO: 2905175 - DNA, 16 bp, Homo sapiens
ttgcaggggactgggc

SEQ ID NO: 2905176 - DNA, 17 bp, Homo sapiens
ttgcaggggactgggcc

SEQ ID NO: 2905177 - DNA, 17 bp, Homo sapiens
ttgcagtagattttctt

SEQ ID NO: 2905178 - DNA, 22 bp, Homo sapiens
ttgcagtctgtattttccacct

SEQ ID NO: 2905179 - DNA, 12 bp, Homo sapiens
ttgcagtctttc

SEQ ID NO: 2905180 - DNA, 13 bp, Homo sapiens
ttgcagtctttcc

SEQ ID NO: 2905181 - DNA, 14 bp, Homo sapiens
ttgcagtctttccc

SEQ ID NO: 2905182 - DNA, 17 bp, Homo sapiens
ttgcagtgaagtgttct

SEQ ID NO: 2905183 - DNA, 15 bp, Homo sapiens
ttgcagtggcctggc

SEQ ID NO: 2905184 - DNA, 16 bp, Homo sapiens
ttgcagtggcctggcc

SEQ ID NO: 2905185 - DNA, 17 bp, Homo sapiens
ttgcagtggcctggccg

SEQ ID NO: 2905186 - DNA, 13 bp, Homo sapiens
ttgcagttttgta

SEQ ID NO: 2905187 - DNA, 15 bp, Homo sapiens
ttgcagttttgtaag

SEQ ID NO: 2905188 - DNA, 21 bp, Homo sapiens
ttgcagttttgtaagccctct

SEQ ID NO: 2905189 - DNA, 22 bp, Homo sapiens
ttgcagttttgtaagccctctt

SEQ ID NO: 2905190 - DNA, 19 bp, Homo sapiens
ttgcataacaattcctcta

SEQ ID NO: 2905191 - DNA, 19 bp, Homo sapiens
ttgcatagcagctgctact

SEQ ID NO: 2905192 - DNA, 18 bp, Homo sapiens
ttgcatccaactccagga

SEQ ID NO: 2905193 - DNA, 17 bp, Homo sapiens
ttgcatctgaaatagga

SEQ ID NO: 2905194 - DNA, 22 bp, Homo sapiens
ttgcatgggctaatgaagatca

SEQ ID NO: 2905195 - DNA, 14 bp, Homo sapiens
ttgcatgtgaaaat

SEQ ID NO: 2905196 - DNA, 20 bp, Homo sapiens
ttgcattaaattcacaaact

SEQ ID NO: 2905197 - DNA, 20 bp, Homo sapiens
ttgcattcatggttatgaat

SEQ ID NO: 2905198 - DNA, 22 bp, Homo sapiens
ttgcattccagagttaaaatgt

SEQ ID NO: 2905199 - DNA, 19 bp, Homo sapiens
ttgccaaaattcatttcta

SEQ ID NO: 2905200 - DNA, 22 bp, Homo sapiens
ttgccaaagcagattttcctaa

SEQ ID NO: 2905201 - DNA, 19 bp, Homo sapiens
ttgccacccattcttcccg

SEQ ID NO: 2905202 - DNA, 18 bp, Homo sapiens
ttgccacgctttttgact

SEQ ID NO: 2905203 - DNA, 20 bp, Homo sapiens
ttgccacgctttttgactgc

SEQ ID NO: 2905204 - DNA, 19 bp, Homo sapiens
ttgccactgatattcagaa

SEQ ID NO: 2905205 - DNA, 15 bp, Homo sapiens
ttgccagaagttgtg

SEQ ID NO: 2905206 - DNA, 19 bp, Homo sapiens
ttgccagagatccaaaaga

SEQ ID NO: 2905207 - DNA, 18 bp, Homo sapiens
ttgccaggaatgtttcag

SEQ ID NO: 2905208 - DNA, 16 bp, Homo sapiens
ttgccagggctctggg

SEQ ID NO: 2905209 - DNA, 19 bp, Homo sapiens
ttgccagggctctgggggc

SEQ ID NO: 2905210 - DNA, 21 bp, Homo sapiens
ttgccagtagtaccttgtttt

SEQ ID NO: 2905211 - DNA, 19 bp, Homo sapiens
ttgccataactttatgaag

SEQ ID NO: 2905212 - DNA, 21 bp, Homo sapiens
ttgccataactttatgaagtg

SEQ ID NO: 2905213 - DNA, 22 bp, Homo sapiens
ttgccatactttgtctgaaaaa

SEQ ID NO: 2905214 - DNA, 19 bp, Homo sapiens
ttgccatcccaagcccagt

SEQ ID NO: 2905215 - DNA, 23 bp, Homo sapiens
ttgccatctgcgtgacaataaaa

SEQ ID NO: 2905216 - DNA, 20 bp, Homo sapiens
ttgccattatagcgcctgta

SEQ ID NO: 2905217 - DNA, 22 bp, Homo sapiens
ttgcccagagatgcctccaccg

SEQ ID NO: 2905218 - DNA, 17 bp, Homo sapiens
ttgcccagataatgata

SEQ ID NO: 2905219 - DNA, 20 bp, Homo sapiens
ttgcccaggctagagtgcaa

SEQ ID NO: 2905220 - DNA, 12 bp, Homo sapiens
ttgcccatggca

SEQ ID NO: 2905221 - DNA, 17 bp, Homo sapiens
ttgccccgtctctgttc

SEQ ID NO: 2905222 - DNA, 13 bp, Homo sapiens
ttgccctgggaaa

SEQ ID NO: 2905223 - DNA, 10 bp, Homo sapiens
ttgccctggt

SEQ ID NO: 2905224 - DNA, 12 bp, Homo sapiens
ttgcccttcctg

SEQ ID NO: 2905225 - DNA, 16 bp, Homo sapiens
ttgccctttggccagt

SEQ ID NO: 2905226 - DNA, 16 bp, Homo sapiens
ttgcctatcctgctgt

SEQ ID NO: 2905227 - DNA, 15 bp, Homo sapiens
ttgcctccaggtgca

SEQ ID NO: 2905228 - DNA, 14 bp, Homo sapiens
ttgcctccgtgtca

SEQ ID NO: 2905229 - DNA, 17 bp, Homo sapiens
ttgcctcctctctccct

SEQ ID NO: 2905230 - DNA, 20 bp, Homo sapiens
ttgcctcctctctccctgcc

SEQ ID NO: 2905231 - DNA, 23 bp, Homo sapiens
ttgcctcctctctccctgcctca

SEQ ID NO: 2905232 - DNA, 18 bp, Homo sapiens
ttgcctccttttttctta

SEQ ID NO: 2905233 - DNA, 20 bp, Homo sapiens
ttgcctcgaaagtgtcatca

SEQ ID NO: 2905234 - DNA, 19 bp, Homo sapiens
ttgcctctcggttgaaacc

SEQ ID NO: 2905235 - DNA, 20 bp, Homo sapiens
ttgcctctcggttgaaacct

SEQ ID NO: 2905236 - DNA, 13 bp, Homo sapiens
ttgcctgacaatt

SEQ ID NO: 2905237 - DNA, 23 bp, Homo sapiens
ttgcctgactaaaatgtttcatt

SEQ ID NO: 2905238 - DNA, 13 bp, Homo sapiens
ttgcctgcagggc

SEQ ID NO: 2905239 - DNA, 15 bp, Homo sapiens
ttgcctgcagggcca

SEQ ID NO: 2905240 - DNA, 14 bp, Homo sapiens
ttgcctgctttctc

SEQ ID NO: 2905241 - DNA, 15 bp, Homo sapiens
ttgcctgggcagtgc

SEQ ID NO: 2905242 - DNA, 19 bp, Homo sapiens
ttgcctgtagagccagcct

SEQ ID NO: 2905243 - DNA, 18 bp, Homo sapiens
ttgcctgtgactgtaaag

SEQ ID NO: 2905244 - DNA, 20 bp, Homo sapiens
ttgccttctcaccagctgca

SEQ ID NO: 2905245 - DNA, 15 bp, Homo sapiens
ttgccttgcatttgt

SEQ ID NO: 2905246 - DNA, 17 bp, Homo sapiens
ttgcgaatggttccatt

SEQ ID NO: 2905247 - DNA, 19 bp, Homo sapiens
ttgcgatagagtctcactg

SEQ ID NO: 2905248 - DNA, 13 bp, Homo sapiens
ttgcggggcctgt

SEQ ID NO: 2905249 - DNA, 21 bp, Homo sapiens
ttgcggggcctgtctcagtga

SEQ ID NO: 2905250 - DNA, 15 bp, Homo sapiens
ttgcgtggactctgc

SEQ ID NO: 2905251 - DNA, 20 bp, Homo sapiens
ttgcgttggtctctgcattt

SEQ ID NO: 2905252 - DNA, 13 bp, Homo sapiens
ttgctaactgaac

SEQ ID NO: 2905253 - DNA, 15 bp, Homo sapiens
ttgctaactgaactt

SEQ ID NO: 2905254 - DNA, 16 bp, Homo sapiens
ttgctaactgaacttt

SEQ ID NO: 2905255 - DNA, 19 bp, Homo sapiens
ttgctaactgaactttgaa

SEQ ID NO: 2905256 - DNA, 13 bp, Homo sapiens
ttgctaagatgct

SEQ ID NO: 2905257 - DNA, 17 bp, Homo sapiens
ttgctaattaataaaaa

SEQ ID NO: 2905258 - DNA, 18 bp, Homo sapiens
ttgctaattgctgttgaa

SEQ ID NO: 2905259 - DNA, 13 bp, Homo sapiens
ttgctacgtgcct

SEQ ID NO: 2905260 - DNA, 14 bp, Homo sapiens
ttgctacgtgcctc

SEQ ID NO: 2905261 - DNA, 18 bp, Homo sapiens
ttgctagtctagtttcct

SEQ ID NO: 2905262 - DNA, 22 bp, Homo sapiens
ttgctatcaacaataaaatttt

SEQ ID NO: 2905263 - DNA, 16 bp, Homo sapiens
ttgctatcggggaagc

SEQ ID NO: 2905264 - DNA, 14 bp, Homo sapiens
ttgctatcttaatt

SEQ ID NO: 2905265 - DNA, 15 bp, Homo sapiens
ttgctatcttaattt

SEQ ID NO: 2905266 - DNA, 21 bp, Homo sapiens
ttgctattgtaaggtctttgt

SEQ ID NO: 2905267 - DNA, 17 bp, Homo sapiens
ttgctcaaaaaatgagc

SEQ ID NO: 2905268 - DNA, 15 bp, Homo sapiens
ttgctcacctggggt

SEQ ID NO: 2905269 - DNA, 19 bp, Homo sapiens
ttgctccaataaaggaaca

SEQ ID NO: 2905270 - DNA, 16 bp, Homo sapiens
ttgctccattttcttg

SEQ ID NO: 2905271 - DNA, 20 bp, Homo sapiens
ttgctcctggggagaaagag

SEQ ID NO: 2905272 - DNA, 14 bp, Homo sapiens
ttgctctaggaaga

SEQ ID NO: 2905273 - DNA, 14 bp, Homo sapiens
ttgctcttctcctt

SEQ ID NO: 2905274 - DNA, 18 bp, Homo sapiens
ttgctgaatgtcattatt

SEQ ID NO: 2905275 - DNA, 21 bp, Homo sapiens
ttgctgaatgtcattatttga

SEQ ID NO: 2905276 - DNA, 22 bp, Homo sapiens
ttgctgacctcagcggttgcca

SEQ ID NO: 2905277 - DNA, 22 bp, Homo sapiens
ttgctgagcctctgctccccag

SEQ ID NO: 2905278 - DNA, 19 bp, Homo sapiens
ttgctgagtttcccttcct

SEQ ID NO: 2905279 - DNA, 12 bp, Homo sapiens
ttgctgcagtgt

SEQ ID NO: 2905280 - DNA, 21 bp, Homo sapiens
ttgctgccaagtcctgccttt

SEQ ID NO: 2905281 - DNA, 20 bp, Homo sapiens
ttgctgccactttttaacta

SEQ ID NO: 2905282 - DNA, 15 bp, Homo sapiens
ttgctgcgcttgcat

SEQ ID NO: 2905283 - DNA, 22 bp, Homo sapiens
ttgctgctataattctatactg

SEQ ID NO: 2905284 - DNA, 15 bp, Homo sapiens
ttgctgctccatggt

SEQ ID NO: 2905285 - DNA, 14 bp, Homo sapiens
ttgctgctgctgct

SEQ ID NO: 2905286 - DNA, 19 bp, Homo sapiens
ttgctgctgtgcgtggaaa

SEQ ID NO: 2905287 - DNA, 14 bp, Homo sapiens
ttgctgctgtggaa

SEQ ID NO: 2905288 - DNA, 11 bp, Homo sapiens
ttgctggaaaa

SEQ ID NO: 2905289 - DNA, 17 bp, Homo sapiens
ttgctggaaaatctgta

SEQ ID NO: 2905290 - DNA, 21 bp, Homo sapiens
ttgctggaaaccaagtcaggc

SEQ ID NO: 2905291 - DNA, 21 bp, Homo sapiens
ttgctggagtcatgtgcctct

SEQ ID NO: 2905292 - DNA, 12 bp, Homo sapiens
ttgctggggatt

SEQ ID NO: 2905293 - DNA, 14 bp, Homo sapiens
ttgctggtcatcct

SEQ ID NO: 2905294 - DNA, 14 bp, Homo sapiens
ttgctgtagagact

SEQ ID NO: 2905295 - DNA, 15 bp, Homo sapiens
ttgctgtagagactt

SEQ ID NO: 2905296 - DNA, 16 bp, Homo sapiens
ttgctgtaggatctaa

SEQ ID NO: 2905297 - DNA, 21 bp, Homo sapiens
ttgctgtatgctgatcatcgc

SEQ ID NO: 2905298 - DNA, 16 bp, Homo sapiens
ttgctgtctagcctta

SEQ ID NO: 2905299 - DNA, 20 bp, Homo sapiens
ttgctgtttagcttcctcca

SEQ ID NO: 2905300 - DNA, 22 bp, Homo sapiens
ttgctgtttagcttcctccaga

SEQ ID NO: 2905301 - DNA, 14 bp, Homo sapiens
ttgctgttttcctc

SEQ ID NO: 2905302 - DNA, 16 bp, Homo sapiens
ttgctgttttcctccc

SEQ ID NO: 2905303 - DNA, 19 bp, Homo sapiens
ttgctgttttcctcccttc

SEQ ID NO: 2905304 - DNA, 19 bp, Homo sapiens
ttgcttaaggcatactttt

SEQ ID NO: 2905305 - DNA, 14 bp, Homo sapiens
ttgcttaattgtga

SEQ ID NO: 2905306 - DNA, 21 bp, Homo sapiens
ttgcttccaagaccatttgta

SEQ ID NO: 2905307 - DNA, 16 bp, Homo sapiens
ttgcttccccttttgc

SEQ ID NO: 2905308 - DNA, 16 bp, Homo sapiens
ttgcttctaaatgccc

SEQ ID NO: 2905309 - DNA, 21 bp, Homo sapiens
ttgcttctaggagtcaactgg

SEQ ID NO: 2905310 - DNA, 23 bp, Homo sapiens
ttgcttctaggagtcaactggct

SEQ ID NO: 2905311 - DNA, 15 bp, Homo sapiens
ttgcttcttgtgaag

SEQ ID NO: 2905312 - DNA, 17 bp, Homo sapiens
ttgcttgacttcagtta

SEQ ID NO: 2905313 - DNA, 20 bp, Homo sapiens
ttgcttgcagtagattttct

SEQ ID NO: 2905314 - DNA, 20 bp, Homo sapiens
ttgcttggtgctggtttatt

SEQ ID NO: 2905315 - DNA, 15 bp, Homo sapiens
ttgctttattccaga

SEQ ID NO: 2905316 - DNA, 22 bp, Homo sapiens
ttgctttgaccatggaaagaaa

SEQ ID NO: 2905317 - DNA, 12 bp, Homo sapiens
ttgctttgtagg

SEQ ID NO: 2905318 - DNA, 20 bp, Homo sapiens
ttggaaaaagaaagaaacac

SEQ ID NO: 2905319 - DNA, 16 bp, Homo sapiens
ttggaaaagaaatcaa

SEQ ID NO: 2905320 - DNA, 19 bp, Homo sapiens
ttggaaaagaaatcaattt

SEQ ID NO: 2905321 - DNA, 21 bp, Homo sapiens
ttggaaagacaggaagaccaa

SEQ ID NO: 2905322 - DNA, 21 bp, Homo sapiens
ttggaaataaaccattggaca

SEQ ID NO: 2905323 - DNA, 12 bp, Homo sapiens
ttggaacttttc

SEQ ID NO: 2905324 - DNA, 17 bp, Homo sapiens
ttggaagacatatatta

SEQ ID NO: 2905325 - DNA, 20 bp, Homo sapiens
ttggaagacatatattatat

SEQ ID NO: 2905326 - DNA, 21 bp, Homo sapiens
ttggaagacatatattatata

SEQ ID NO: 2905327 - DNA, 19 bp, Homo sapiens
ttggaagatcctgtgagga

SEQ ID NO: 2905328 - DNA, 17 bp, Homo sapiens
ttggaagatgcagaagc

SEQ ID NO: 2905329 - DNA, 13 bp, Homo sapiens
ttggaaggagaca

SEQ ID NO: 2905330 - DNA, 18 bp, Homo sapiens
ttggaaggagacacagat

SEQ ID NO: 2905331 - DNA, 19 bp, Homo sapiens
ttggaaggagacacagatg

SEQ ID NO: 2905332 - DNA, 13 bp, Homo sapiens
ttggaatactttt

SEQ ID NO: 2905333 - DNA, 15 bp, Homo sapiens
ttggacaaatgtgaa

SEQ ID NO: 2905334 - DNA, 17 bp, Homo sapiens
ttggacaaatgtgaaga

SEQ ID NO: 2905335 - DNA, 19 bp, Homo sapiens
ttggacaaatgtgaagatg

SEQ ID NO: 2905336 - DNA, 23 bp, Homo sapiens
ttggacagatttcagtaatgtct

SEQ ID NO: 2905337 - DNA, 22 bp, Homo sapiens
ttgtggaatggagattcagttt

SEQ ID NO: 2905338 - DNA, 13 bp, Homo sapiens
ttgtggactgagc

SEQ ID NO: 2905339 - DNA, 16 bp, Homo sapiens
ttgtggactgagcgag

SEQ ID NO: 2905340 - DNA, 15 bp, Homo sapiens
ttgtggactgtgggt

SEQ ID NO: 2905341 - DNA, 21 bp, Homo sapiens
ttgtggcccccgccccctccc

SEQ ID NO: 2905342 - DNA, 21 bp, Homo sapiens
ttgtggtctcgatgctgctgg

SEQ ID NO: 2905343 - DNA, 22 bp, Homo sapiens
ttgtggtgtgagtatcagaatt

SEQ ID NO: 2905344 - DNA, 13 bp, Homo sapiens
ttgtggtgtgcca

SEQ ID NO: 2905345 - DNA, 14 bp, Homo sapiens
ttgtggtttaaata

SEQ ID NO: 2905346 - DNA, 18 bp, Homo sapiens
ttgtgtaaaaaatggaaa

SEQ ID NO: 2905347 - DNA, 19 bp, Homo sapiens
ttgtgtaaaaaatggaaaa

SEQ ID NO: 2905348 - DNA, 22 bp, Homo sapiens
ttgtgtatccattatcatgtgt

SEQ ID NO: 2905349 - DNA, 23 bp, Homo sapiens
ttgtgtatccattatcatgtgta

SEQ ID NO: 2905350 - DNA, 14 bp, Homo sapiens
ttgtgtatttaaca

SEQ ID NO: 2905351 - DNA, 19 bp, Homo sapiens
ttgtgtatttacgctttga

SEQ ID NO: 2905352 - DNA, 23 bp, Homo sapiens
ttgtgtatttacgctttgattca

SEQ ID NO: 2905353 - DNA, 15 bp, Homo sapiens
ttgtgtatttctctg

SEQ ID NO: 2905354 - DNA, 17 bp, Homo sapiens
ttgtgtatttctctgtg

SEQ ID NO: 2905355 - DNA, 19 bp, Homo sapiens
ttgtgtatttctctgtgaa

SEQ ID NO: 2905356 - DNA, 20 bp, Homo sapiens
ttgtgtatttctctgtgaat

SEQ ID NO: 2905357 - DNA, 21 bp, Homo sapiens
ttgtgtatttctctgtgaatc

SEQ ID NO: 2905358 - DNA, 17 bp, Homo sapiens
ttgtgtcactgtacagt

SEQ ID NO: 2905359 - DNA, 20 bp, Homo sapiens
ttgtgtcactgtacagtttt

SEQ ID NO: 2905360 - DNA, 22 bp, Homo sapiens
ttgtgtctcatttagaaacaat

SEQ ID NO: 2905361 - DNA, 22 bp, Homo sapiens
ttgtgtctccttatggtacact

SEQ ID NO: 2905362 - DNA, 13 bp, Homo sapiens
ttgtgtctgtaca

SEQ ID NO: 2905363 - DNA, 14 bp, Homo sapiens
ttgtgtctgtacac

SEQ ID NO: 2905364 - DNA, 12 bp, Homo sapiens
ttgtgtctgtgg

SEQ ID NO: 2905365 - DNA, 14 bp, Homo sapiens
ttgtgtctgtggtt

SEQ ID NO: 2905366 - DNA, 16 bp, Homo sapiens
ttgtgtgcgctgcctg

SEQ ID NO: 2905367 - DNA, 13 bp, Homo sapiens
ttgtgtgttgtct

SEQ ID NO: 2905368 - DNA, 12 bp, Homo sapiens
ttgtgttcacca

SEQ ID NO: 2905369 - DNA, 17 bp, Homo sapiens
ttgtgttcagttccagc

SEQ ID NO: 2905370 - DNA, 17 bp, Homo sapiens
ttgtgttccttctgtga

SEQ ID NO: 2905371 - DNA, 19 bp, Homo sapiens
ttgtgttccttctgtgaag

SEQ ID NO: 2905372 - DNA, 11 bp, Homo sapiens
ttgtgttgtca

SEQ ID NO: 2905373 - DNA, 14 bp, Homo sapiens
ttgttaacagagca

SEQ ID NO: 2905374 - DNA, 20 bp, Homo sapiens
ttgttaccactggtaacatg

SEQ ID NO: 2905375 - DNA, 13 bp, Homo sapiens
ttgttactttgaa

SEQ ID NO: 2905376 - DNA, 22 bp, Homo sapiens
ttgttactttgaatagtcctaa

SEQ ID NO: 2905377 - DNA, 17 bp, Homo sapiens
ttgttaggctgtaaaga

SEQ ID NO: 2905378 - DNA, 17 bp, Homo sapiens
ttgttagtttagtgtgt

SEQ ID NO: 2905379 - DNA, 16 bp, Homo sapiens
ttgttatcagtcaata

SEQ ID NO: 2905380 - DNA, 22 bp, Homo sapiens
ttgttatcagtcaatattttta

SEQ ID NO: 2905381 - DNA, 17 bp, Homo sapiens
ttgttattcttttccag

SEQ ID NO: 2905382 - DNA, 19 bp, Homo sapiens
ttgttattgatgttgctgt

SEQ ID NO: 2905383 - DNA, 23 bp, Homo sapiens
ttgttattgatgttgctgttatt

SEQ ID NO: 2905384 - DNA, 15 bp, Homo sapiens
ttgttattttgcaac

SEQ ID NO: 2905385 - DNA, 22 bp, Homo sapiens
ttgttattttgcaacctcgctg

SEQ ID NO: 2905386 - DNA, 23 bp, Homo sapiens
ttgttcacataacgccaccatca

SEQ ID NO: 2905387 - DNA, 17 bp, Homo sapiens
ttgttcatttctgtctc

SEQ ID NO: 2905388 - DNA, 22 bp, Homo sapiens
ttgttcctgctttctctttcag

SEQ ID NO: 2905389 - DNA, 14 bp, Homo sapiens
ttgttctctgtcca

SEQ ID NO: 2905390 - DNA, 21 bp, Homo sapiens
ttgttcttgatagtagccaaa

SEQ ID NO: 2905391 - DNA, 13 bp, Homo sapiens
ttgttcttgtcat

SEQ ID NO: 2905392 - DNA, 15 bp, Homo sapiens
ttgttctttgttctt

SEQ ID NO: 2905393 - DNA, 21 bp, Homo sapiens
ttgttgacagttctgaagaat

SEQ ID NO: 2905394 - DNA, 18 bp, Homo sapiens
ttgttgagctattgctgt

SEQ ID NO: 2905395 - DNA, 22 bp, Homo sapiens
ttgttgagctgtcatcaacatt

SEQ ID NO: 2905396 - DNA, 18 bp, Homo sapiens
ttgttgctgctgctgctc

SEQ ID NO: 2905397 - DNA, 18 bp, Homo sapiens
ttgttgcttcttgtgaag

SEQ ID NO: 2905398 - DNA, 18 bp, Homo sapiens
ttgttggcccttccagtg

SEQ ID NO: 2905399 - DNA, 19 bp, Homo sapiens
ttgttggcccttccagtgg

SEQ ID NO: 2905400 - DNA, 23 bp, Homo sapiens
ttgttggctttcccttatcaaac

SEQ ID NO: 2905401 - DNA, 21 bp, Homo sapiens
ttgttgtaaagcaataaaatt

SEQ ID NO: 2905402 - DNA, 19 bp, Homo sapiens
ttgttgtcaagtataaagt

SEQ ID NO: 2905403 - DNA, 23 bp, Homo sapiens
ttgttgtttgccatactttgtct

SEQ ID NO: 2905404 - DNA, 17 bp, Homo sapiens
ttgtttaaaaaaagaaa

SEQ ID NO: 2905405 - DNA, 16 bp, Homo sapiens
ttgtttacttaaagat

SEQ ID NO: 2905406 - DNA, 18 bp, Homo sapiens
ttgtttatgatatttctt

SEQ ID NO: 2905407 - DNA, 12 bp, Homo sapiens
ttgtttatgtaa

SEQ ID NO: 2905408 - DNA, 18 bp, Homo sapiens
ttgtttattaaatagtta

SEQ ID NO: 2905409 - DNA, 18 bp, Homo sapiens
ttgtttcaaacacaaatg

SEQ ID NO: 2905410 - DNA, 16 bp, Homo sapiens
ttgtttcattaagttg

SEQ ID NO: 2905411 - DNA, 14 bp, Homo sapiens
ttgtttcctgtgcc

SEQ ID NO: 2905412 - DNA, 14 bp, Homo sapiens
ttgtttctactttg

SEQ ID NO: 2905413 - DNA, 19 bp, Homo sapiens
ttgtttctgtcaagcatat

SEQ ID NO: 2905414 - DNA, 13 bp, Homo sapiens
ttgtttctgttta

SEQ ID NO: 2905415 - DNA, 15 bp, Homo sapiens
ttgtttctgtttagt

SEQ ID NO: 2905416 - DNA, 13 bp, Homo sapiens
ttgtttgcacaga

SEQ ID NO: 2905417 - DNA, 16 bp, Homo sapiens
ttgtttgctatcttaa

SEQ ID NO: 2905418 - DNA, 15 bp, Homo sapiens
ttgtttggatttcct

SEQ ID NO: 2905419 - DNA, 17 bp, Homo sapiens
ttgtttggcaaggaaag

SEQ ID NO: 2905420 - DNA, 18 bp, Homo sapiens
ttgtttggcaaggaaagg

SEQ ID NO: 2905421 - DNA, 19 bp, Homo sapiens
ttgtttgggtggtttgtga

SEQ ID NO: 2905422 - DNA, 17 bp, Homo sapiens
ttgtttgtagctttcct

SEQ ID NO: 2905423 - DNA, 13 bp, Homo sapiens
ttgtttgtcagca

SEQ ID NO: 2905424 - DNA, 14 bp, Homo sapiens
ttgtttgtcagcat

SEQ ID NO: 2905425 - DNA, 12 bp, Homo sapiens
ttgtttgtttta

SEQ ID NO: 2905426 - DNA, 15 bp, Homo sapiens
ttgtttgtttttgct

SEQ ID NO: 2905427 - DNA, 23 bp, Homo sapiens
ttgttttaaaataagttaaaggc

SEQ ID NO: 2905428 - DNA, 20 bp, Homo sapiens
ttgttttaaaattaaagcta

SEQ ID NO: 2905429 - DNA, 16 bp, Homo sapiens
ttgttttaagcaaatg

SEQ ID NO: 2905430 - DNA, 22 bp, Homo sapiens
ttgttttaaggaaaaaagattt

SEQ ID NO: 2905431 - DNA, 15 bp, Homo sapiens
ttgttttaattttag

SEQ ID NO: 2905432 - DNA, 22 bp, Homo sapiens
ttgttttattcaccatcatgta

SEQ ID NO: 2905433 - DNA, 13 bp, Homo sapiens
ttgttttgcaaaa

SEQ ID NO: 2905434 - DNA, 18 bp, Homo sapiens
ttgtttttattttcaaga

SEQ ID NO: 2905435 - DNA, 13 bp, Homo sapiens
ttgtttttctcac

SEQ ID NO: 2905436 - DNA, 13 bp, Homo sapiens
ttgtttttgcttt

SEQ ID NO: 2905437 - DNA, 15 bp, Homo sapiens
ttgtttttgctttct

SEQ ID NO: 2905438 - DNA, 19 bp, Homo sapiens
ttgtttttgctttctgaaa

SEQ ID NO: 2905439 - DNA, 13 bp, Homo sapiens
ttgtttttttgag

SEQ ID NO: 2905440 - DNA, 21 bp, Homo sapiens
tttaaaaaaacaaataaataa

SEQ ID NO: 2905441 - DNA, 19 bp, Homo sapiens
tttaaaaaaacattattgt

SEQ ID NO: 2905442 - DNA, 12 bp, Homo sapiens
tttaaaaaagaa

SEQ ID NO: 2905443 - DNA, 11 bp, Homo sapiens
tttaaaaagaa

SEQ ID NO: 2905444 - DNA, 17 bp, Homo sapiens
tttaaaaagcaaatctt

SEQ ID NO: 2905445 - DNA, 13 bp, Homo sapiens
tttaaaaatagaa

SEQ ID NO: 2905446 - DNA, 11 bp, Homo sapiens
tttaaaaatgg

SEQ ID NO: 2905447 - DNA, 12 bp, Homo sapiens
tttaaaaatgta

SEQ ID NO: 2905448 - DNA, 13 bp, Homo sapiens
tttaaaaatgtat

SEQ ID NO: 2905449 - DNA, 12 bp, Homo sapiens
tttaaaaatgtc

SEQ ID NO: 2905450 - DNA, 13 bp, Homo sapiens
tttaaaaatgtct

SEQ ID NO: 2905451 - DNA, 23 bp, Homo sapiens
tttaaaacacatgtttttataca

SEQ ID NO: 2905452 - DNA, 13 bp, Homo sapiens
tttaaaaccacta

SEQ ID NO: 2905453 - DNA, 20 bp, Homo sapiens
tttaaaactgtatttaagga

SEQ ID NO: 2905454 - DNA, 11 bp, Homo sapiens
tttaaaacttg

SEQ ID NO: 2905455 - DNA, 18 bp, Homo sapiens
tttaaaagaatgggcagt

SEQ ID NO: 2905456 - DNA, 12 bp, Homo sapiens
tttaaaagactt

SEQ ID NO: 2905457 - DNA, 13 bp, Homo sapiens
tttaaaagatctt

SEQ ID NO: 2905458 - DNA, 17 bp, Homo sapiens
tttaaaagatgctttta

SEQ ID NO: 2905459 - DNA, 14 bp, Homo sapiens
tttaaaagattcat

SEQ ID NO: 2905460 - DNA, 21 bp, Homo sapiens
tttaaaaggttgactcaagtt

SEQ ID NO: 2905461 - DNA, 17 bp, Homo sapiens
tttaaaataaattccta

SEQ ID NO: 2905462 - DNA, 19 bp, Homo sapiens
tttaaaataaattcctaca

SEQ ID NO: 2905463 - DNA, 17 bp, Homo sapiens
tttaaaattaagtagaa

SEQ ID NO: 2905464 - DNA, 20 bp, Homo sapiens
tttaaaatttatattgtaaa

SEQ ID NO: 2905465 - DNA, 14 bp, Homo sapiens
tttaaaccactaat

SEQ ID NO: 2905466 - DNA, 15 bp, Homo sapiens
tttaaacctttttct

SEQ ID NO: 2905467 - DNA, 16 bp, Homo sapiens
tttaaacctttttctt

SEQ ID NO: 2905468 - DNA, 20 bp, Homo sapiens
tttaaactaaccttttatca

SEQ ID NO: 2905469 - DNA, 12 bp, Homo sapiens
tttaaagagaag

SEQ ID NO: 2905470 - DNA, 13 bp, Homo sapiens
tttaaagagtcta

SEQ ID NO: 2905471 - DNA, 16 bp, Homo sapiens
tttaaagagtctagat

SEQ ID NO: 2905472 - DNA, 17 bp, Homo sapiens
tttaaagagtctagatt

SEQ ID NO: 2905473 - DNA, 13 bp, Homo sapiens
tttaaaggacaaa

SEQ ID NO: 2905474 - DNA, 17 bp, Homo sapiens
tttaaagtaaatctctt

SEQ ID NO: 2905475 - DNA, 13 bp, Homo sapiens
ttggacccttcca

SEQ ID NO: 2905476 - DNA, 16 bp, Homo sapiens
ttggacccttccatgg

SEQ ID NO: 2905477 - DNA, 17 bp, Homo sapiens
ttggacggctgggcaca

SEQ ID NO: 2905478 - DNA, 16 bp, Homo sapiens
ttggactgagatttct

SEQ ID NO: 2905479 - DNA, 19 bp, Homo sapiens
ttggactgagatttcttaa

SEQ ID NO: 2905480 - DNA, 22 bp, Homo sapiens
ttggagactttctttaaattat

SEQ ID NO: 2905481 - DNA, 18 bp, Homo sapiens
ttggagagtttcctgaaa

SEQ ID NO: 2905482 - DNA, 17 bp, Homo sapiens
ttggagatgcagccttc

SEQ ID NO: 2905483 - DNA, 22 bp, Homo sapiens
ttggagatgctgagggtgtttc

SEQ ID NO: 2905484 - DNA, 18 bp, Homo sapiens
ttggagcatttatgtaga

SEQ ID NO: 2905485 - DNA, 20 bp, Homo sapiens
ttggagcatttatgtagaca

SEQ ID NO: 2905486 - DNA, 11 bp, Homo sapiens
ttggagcctgc

SEQ ID NO: 2905487 - DNA, 20 bp, Homo sapiens
ttggagctttgcaattcttt

SEQ ID NO: 2905488 - DNA, 11 bp, Homo sapiens
ttggaggacag

SEQ ID NO: 2905489 - DNA, 11 bp, Homo sapiens
ttggagggcac

SEQ ID NO: 2905490 - DNA, 16 bp, Homo sapiens
ttggataataaaaatt

SEQ ID NO: 2905491 - DNA, 17 bp, Homo sapiens
ttggataccagctcagg

SEQ ID NO: 2905492 - DNA, 18 bp, Homo sapiens
ttggataccagctcaggg

SEQ ID NO: 2905493 - DNA, 17 bp, Homo sapiens
ttggatctgcttgctgt

SEQ ID NO: 2905494 - DNA, 16 bp, Homo sapiens
ttggatgcatttctat

SEQ ID NO: 2905495 - DNA, 19 bp, Homo sapiens
ttggattactttgttttaa

SEQ ID NO: 2905496 - DNA, 16 bp, Homo sapiens
ttggattagtgaacta

SEQ ID NO: 2905497 - DNA, 15 bp, Homo sapiens
ttggattcttatgta

SEQ ID NO: 2905498 - DNA, 14 bp, Homo sapiens
ttggatttgtttaa

SEQ ID NO: 2905499 - DNA, 23 bp, Homo sapiens
ttggatttttaattaaaaactag

SEQ ID NO: 2905500 - DNA, 20 bp, Homo sapiens
ttggcaaactctccaccaca

SEQ ID NO: 2905501 - DNA, 23 bp, Homo sapiens
ttggcaaactctccaccacacgt

SEQ ID NO: 2905502 - DNA, 17 bp, Homo sapiens
ttggcaatgccatcatc

SEQ ID NO: 2905503 - DNA, 17 bp, Homo sapiens
ttggcaccagacaccca

SEQ ID NO: 2905504 - DNA, 20 bp, Homo sapiens
ttggcaccagacacccagga

SEQ ID NO: 2905505 - DNA, 19 bp, Homo sapiens
ttggcacctaatccaggca

SEQ ID NO: 2905506 - DNA, 19 bp, Homo sapiens
ttggcagaactgctggggc

SEQ ID NO: 2905507 - DNA, 20 bp, Homo sapiens
ttggcagaactgctggggct

SEQ ID NO: 2905508 - DNA, 11 bp, Homo sapiens
ttggcagtgtt

SEQ ID NO: 2905509 - DNA, 20 bp, Homo sapiens
ttggcataatagtcaatttc

SEQ ID NO: 2905510 - DNA, 14 bp, Homo sapiens
ttggcatctgtgtg

SEQ ID NO: 2905511 - DNA, 15 bp, Homo sapiens
ttggcatgtttaatt

SEQ ID NO: 2905512 - DNA, 18 bp, Homo sapiens
ttggcatgtttaattgtg

SEQ ID NO: 2905513 - DNA, 17 bp, Homo sapiens
ttggcatttgctggcct

SEQ ID NO: 2905514 - DNA, 18 bp, Homo sapiens
ttggcatttgctggcctg

SEQ ID NO: 2905515 - DNA, 12 bp, Homo sapiens
ttggccaggctg

SEQ ID NO: 2905516 - DNA, 14 bp, Homo sapiens
ttggccctgcccct

SEQ ID NO: 2905517 - DNA, 15 bp, Homo sapiens
ttggccctgcccctc

SEQ ID NO: 2905518 - DNA, 16 bp, Homo sapiens
ttggccctgcccctcc

SEQ ID NO: 2905519 - DNA, 20 bp, Homo sapiens
ttggcctcagggccaggaag

SEQ ID NO: 2905520 - DNA, 17 bp, Homo sapiens
ttggcctgatcagacca

SEQ ID NO: 2905521 - DNA, 14 bp, Homo sapiens
ttggccttgcagct

SEQ ID NO: 2905522 - DNA, 15 bp, Homo sapiens
ttggctactgactgt

SEQ ID NO: 2905523 - DNA, 18 bp, Homo sapiens
ttggctatataaaatgtg

SEQ ID NO: 2905524 - DNA, 16 bp, Homo sapiens
ttggctatttaaaact

SEQ ID NO: 2905525 - DNA, 13 bp, Homo sapiens
ttggctcagacat

SEQ ID NO: 2905526 - DNA, 14 bp, Homo sapiens
ttggctcagacatg

SEQ ID NO: 2905527 - DNA, 21 bp, Homo sapiens
ttggctctattggatttgtcc

SEQ ID NO: 2905528 - DNA, 22 bp, Homo sapiens
ttggctgcaggcagcaaaaaca

SEQ ID NO: 2905529 - DNA, 17 bp, Homo sapiens
ttggcttgttattgcct

SEQ ID NO: 2905530 - DNA, 22 bp, Homo sapiens
ttggctttaaccgtttttcaag

SEQ ID NO: 2905531 - DNA, 22 bp, Homo sapiens
ttgggaaagatggataaactga

SEQ ID NO: 2905532 - DNA, 22 bp, Homo sapiens
ttgggaacagcatggaggcaga

SEQ ID NO: 2905533 - DNA, 21 bp, Homo sapiens
ttgggaaggggacccccgccc

SEQ ID NO: 2905534 - DNA, 17 bp, Homo sapiens
ttgggaataaatatgcc

SEQ ID NO: 2905535 - DNA, 14 bp, Homo sapiens
ttgggacccctggt

SEQ ID NO: 2905536 - DNA, 15 bp, Homo sapiens
ttgggacccctggtg

SEQ ID NO: 2905537 - DNA, 16 bp, Homo sapiens
ttgggacccctggtgg

SEQ ID NO: 2905538 - DNA, 13 bp, Homo sapiens
ttgggagaaagca

SEQ ID NO: 2905539 - DNA, 17 bp, Homo sapiens
ttgggaggccccactgg

SEQ ID NO: 2905540 - DNA, 23 bp, Homo sapiens
ttgggatcgtcctggattcactg

SEQ ID NO: 2905541 - DNA, 19 bp, Homo sapiens
ttgggcagaatcctgggcc

SEQ ID NO: 2905542 - DNA, 11 bp, Homo sapiens
ttgggcagggt

SEQ ID NO: 2905543 - DNA, 23 bp, Homo sapiens
ttgggccatggctttcatcctgt

SEQ ID NO: 2905544 - DNA, 21 bp, Homo sapiens
ttgggcctgacctccagtcct

SEQ ID NO: 2905545 - DNA, 14 bp, Homo sapiens
ttgggcctggccag

SEQ ID NO: 2905546 - DNA, 20 bp, Homo sapiens
ttgggcctggccagtcttcc

SEQ ID NO: 2905547 - DNA, 12 bp, Homo sapiens
ttgggctcagag

SEQ ID NO: 2905548 - DNA, 13 bp, Homo sapiens
ttgggctgtgcct

SEQ ID NO: 2905549 - DNA, 21 bp, Homo sapiens
ttgggcttatttagaaaaaag

SEQ ID NO: 2905550 - DNA, 20 bp, Homo sapiens
ttggggagttaagacctggc

SEQ ID NO: 2905551 - DNA, 17 bp, Homo sapiens
ttggggcactgggcgtc

SEQ ID NO: 2905552 - DNA, 23 bp, Homo sapiens
ttgggggacatgctaaataacta

SEQ ID NO: 2905553 - DNA, 21 bp, Homo sapiens
ttgggggggctcccgtggcct

SEQ ID NO: 2905554 - DNA, 18 bp, Homo sapiens
ttgggggttaccaaaaat

SEQ ID NO: 2905555 - DNA, 21 bp, Homo sapiens
ttggggtagctagaggaacca

SEQ ID NO: 2905556 - DNA, 20 bp, Homo sapiens
ttggggtgggggccaggcct

SEQ ID NO: 2905557 - DNA, 15 bp, Homo sapiens
ttggggtttgatttg

SEQ ID NO: 2905558 - DNA, 21 bp, Homo sapiens
ttgggtcatttagaagcctga

SEQ ID NO: 2905559 - DNA, 11 bp, Homo sapiens
ttgggtccagt

SEQ ID NO: 2905560 - DNA, 19 bp, Homo sapiens
ttgggtcctgggcaggtgg

SEQ ID NO: 2905561 - DNA, 15 bp, Homo sapiens
ttgggtctattccag

SEQ ID NO: 2905562 - DNA, 14 bp, Homo sapiens
ttgggtggagaagc

SEQ ID NO: 2905563 - DNA, 15 bp, Homo sapiens
ttgggtggagaagcc

SEQ ID NO: 2905564 - DNA, 22 bp, Homo sapiens
ttgggtggtttgtgagccttgc

SEQ ID NO: 2905565 - DNA, 22 bp, Homo sapiens
ttgggtttcacgagtgttcctg

SEQ ID NO: 2905566 - DNA, 16 bp, Homo sapiens
ttgggtttttaactca

SEQ ID NO: 2905567 - DNA, 16 bp, Homo sapiens
ttggtaaagactggct

SEQ ID NO: 2905568 - DNA, 23 bp, Homo sapiens
ttggtaaaggaaccagtcagctg

SEQ ID NO: 2905569 - DNA, 15 bp, Homo sapiens
ttggtaaagtccttt

SEQ ID NO: 2905570 - DNA, 20 bp, Homo sapiens
ttggtaaagtccttttcttg

SEQ ID NO: 2905571 - DNA, 22 bp, Homo sapiens
ttggtaaatttccccaacagtg

SEQ ID NO: 2905572 - DNA, 22 bp, Homo sapiens
ttggtaatgatgttgataattt

SEQ ID NO: 2905573 - DNA, 22 bp, Homo sapiens
ttggtacagttgcaggagcgtg

SEQ ID NO: 2905574 - DNA, 13 bp, Homo sapiens
ttggtagagttta

SEQ ID NO: 2905575 - DNA, 15 bp, Homo sapiens
ttggtagagtttatt

SEQ ID NO: 2905576 - DNA, 22 bp, Homo sapiens
ttggtagatcttcaatttggat

SEQ ID NO: 2905577 - DNA, 14 bp, Homo sapiens
ttggtaggtaaatc

SEQ ID NO: 2905578 - DNA, 13 bp, Homo sapiens
ttggtatgtgcca

SEQ ID NO: 2905579 - DNA, 20 bp, Homo sapiens
ttggtatttgtttgtagctt

SEQ ID NO: 2905580 - DNA, 22 bp, Homo sapiens
ttggtcattcctaatgcattag

SEQ ID NO: 2905581 - DNA, 13 bp, Homo sapiens
ttggtccaaaaaa

SEQ ID NO: 2905582 - DNA, 16 bp, Homo sapiens
ttggtccaaaaaaagg

SEQ ID NO: 2905583 - DNA, 17 bp, Homo sapiens
ttggtccaaaaaaagga

SEQ ID NO: 2905584 - DNA, 21 bp, Homo sapiens
ttggtcccgtggatgctcttt

SEQ ID NO: 2905585 - DNA, 20 bp, Homo sapiens
ttggtcctacctattatcct

SEQ ID NO: 2905586 - DNA, 15 bp, Homo sapiens
ttggtcctctctctg

SEQ ID NO: 2905587 - DNA, 14 bp, Homo sapiens
ttggtcctgtcccc

SEQ ID NO: 2905588 - DNA, 17 bp, Homo sapiens
ttggtcctgtccccgca

SEQ ID NO: 2905589 - DNA, 17 bp, Homo sapiens
ttggtgaatttcacaag

SEQ ID NO: 2905590 - DNA, 20 bp, Homo sapiens
ttggtgcaattaactctgga

SEQ ID NO: 2905591 - DNA, 14 bp, Homo sapiens
ttggtgccctgaac

SEQ ID NO: 2905592 - DNA, 13 bp, Homo sapiens
ttggtgcctggcc

SEQ ID NO: 2905593 - DNA, 20 bp, Homo sapiens
ttggtgcctggcctggcaca

SEQ ID NO: 2905594 - DNA, 13 bp, Homo sapiens
ttggtgctggttt

SEQ ID NO: 2905595 - DNA, 18 bp, Homo sapiens
ttggtgctgttgaaaata

SEQ ID NO: 2905596 - DNA, 16 bp, Homo sapiens
ttggtgctttgcattt

SEQ ID NO: 2905597 - DNA, 14 bp, Homo sapiens
ttggtgtacagact

SEQ ID NO: 2905598 - DNA, 14 bp, Homo sapiens
ttggtgttaaaaca

SEQ ID NO: 2905599 - DNA, 12 bp, Homo sapiens
ttggttcatgtg

SEQ ID NO: 2905600 - DNA, 14 bp, Homo sapiens
ttggttctaaggac

SEQ ID NO: 2905601 - DNA, 18 bp, Homo sapiens
ttggttctaaggacctga

SEQ ID NO: 2905602 - DNA, 12 bp, Homo sapiens
ttggttgtattc

SEQ ID NO: 2905603 - DNA, 13 bp, Homo sapiens
ttggttgtattct

SEQ ID NO: 2905604 - DNA, 14 bp, Homo sapiens
ttggtttgccttcc

SEQ ID NO: 2905605 - DNA, 12 bp, Homo sapiens
ttggttttgaca

SEQ ID NO: 2905606 - DNA, 13 bp, Homo sapiens
ttggttttgactg

SEQ ID NO: 2905607 - DNA, 14 bp, Homo sapiens
ttggttttggaaaa

SEQ ID NO: 2905608 - DNA, 13 bp, Homo sapiens
ttggtttttactc

SEQ ID NO: 2905609 - DNA, 16 bp, Homo sapiens
ttggtttttttgtaca

SEQ ID NO: 2905610 - DNA, 23 bp, Homo sapiens
ttggtttttttgtacaatatgaa

SEQ ID NO: 2905611 - DNA, 19 bp, Homo sapiens
ttgtaaaaacagcattgct

SEQ ID NO: 2905612 - DNA, 17 bp, Homo sapiens
tttagaacaattttctt

SEQ ID NO: 2905613 - DNA, 19 bp, Homo sapiens
tttagaacaattttcttgt

SEQ ID NO: 2905614 - DNA, 20 bp, Homo sapiens
tttagaacgagcctggaagc

SEQ ID NO: 2905615 - DNA, 11 bp, Homo sapiens
tttagaagcct

SEQ ID NO: 2905616 - DNA, 23 bp, Homo sapiens
tttagaagcctgacaactcattt

SEQ ID NO: 2905617 - DNA, 14 bp, Homo sapiens
tttagaagtagaat

SEQ ID NO: 2905618 - DNA, 18 bp, Homo sapiens
tttagaatggttgagtta

SEQ ID NO: 2905619 - DNA, 19 bp, Homo sapiens
tttagacaaatactcatgt

SEQ ID NO: 2905620 - DNA, 20 bp, Homo sapiens
tttagacaaatactcatgtg

SEQ ID NO: 2905621 - DNA, 14 bp, Homo sapiens
tttagacaccttca

SEQ ID NO: 2905622 - DNA, 19 bp, Homo sapiens
tttagacaccttcattttg

SEQ ID NO: 2905623 - DNA, 15 bp, Homo sapiens
tttagaccatttatc

SEQ ID NO: 2905624 - DNA, 15 bp, Homo sapiens
tttagactgtagcct

SEQ ID NO: 2905625 - DNA, 15 bp, Homo sapiens
tttagagaaactttg

SEQ ID NO: 2905626 - DNA, 15 bp, Homo sapiens
tttagagaactgaaa

SEQ ID NO: 2905627 - DNA, 20 bp, Homo sapiens
tttagagaactgaaaagaga

SEQ ID NO: 2905628 - DNA, 15 bp, Homo sapiens
tttagagaggaaaag

SEQ ID NO: 2905629 - DNA, 22 bp, Homo sapiens
tttagagcattaaaataactat

SEQ ID NO: 2905630 - DNA, 18 bp, Homo sapiens
tttagaggcattgttagt

SEQ ID NO: 2905631 - DNA, 17 bp, Homo sapiens
tttagattattttatct

SEQ ID NO: 2905632 - DNA, 15 bp, Homo sapiens
tttcaaaattaatag

SEQ ID NO: 2905633 - DNA, 13 bp, Homo sapiens
tttcaaacatttg

SEQ ID NO: 2905634 - DNA, 23 bp, Homo sapiens
tttcaaagacaatcactgaaaca

SEQ ID NO: 2905635 - DNA, 13 bp, Homo sapiens
tttcaaagactgc

SEQ ID NO: 2905636 - DNA, 19 bp, Homo sapiens
tttcaaccccaccctgttt

SEQ ID NO: 2905637 - DNA, 21 bp, Homo sapiens
tttcaaccccaccctgtttgg

SEQ ID NO: 2905638 - DNA, 19 bp, Homo sapiens
tttcaactgggttttcagc

SEQ ID NO: 2905639 - DNA, 20 bp, Homo sapiens
tttcaacttggaaaaagaaa

SEQ ID NO: 2905640 - DNA, 13 bp, Homo sapiens
tttcaagaaaact

SEQ ID NO: 2905641 - DNA, 14 bp, Homo sapiens
tttcaagaaaactg

SEQ ID NO: 2905642 - DNA, 16 bp, Homo sapiens
tttcaagaaaactgga

SEQ ID NO: 2905643 - DNA, 22 bp, Homo sapiens
tttcaagagtctaatagtcttt

SEQ ID NO: 2905644 - DNA, 20 bp, Homo sapiens
tttcaattatattgttagtg

SEQ ID NO: 2905645 - DNA, 13 bp, Homo sapiens
tttcaatttactt

SEQ ID NO: 2905646 - DNA, 23 bp, Homo sapiens
tttcaatttactttttaaacagt

SEQ ID NO: 2905647 - DNA, 14 bp, Homo sapiens
tttcacaaatttgt

SEQ ID NO: 2905648 - DNA, 23 bp, Homo sapiens
tttcacacatctgggtgccctga

SEQ ID NO: 2905649 - DNA, 23 bp, Homo sapiens
tttcacagagcacgcctgccatc

SEQ ID NO: 2905650 - DNA, 16 bp, Homo sapiens
tttcacagatgctgtg

SEQ ID NO: 2905651 - DNA, 15 bp, Homo sapiens
tttcacataaatgca

SEQ ID NO: 2905652 - DNA, 14 bp, Homo sapiens
tttcacatgccttg

SEQ ID NO: 2905653 - DNA, 13 bp, Homo sapiens
tttcacattctta

SEQ ID NO: 2905654 - DNA, 21 bp, Homo sapiens
tttcacattcttataaatatg

SEQ ID NO: 2905655 - DNA, 16 bp, Homo sapiens
tttcacattgaatcat

SEQ ID NO: 2905656 - DNA, 22 bp, Homo sapiens
tttcacctggaagcatttgttt

SEQ ID NO: 2905657 - DNA, 15 bp, Homo sapiens
tttcacgagtgttcc

SEQ ID NO: 2905658 - DNA, 15 bp, Homo sapiens
tttcacgggagattt

SEQ ID NO: 2905659 - DNA, 15 bp, Homo sapiens
tttcactaaaagtgt

SEQ ID NO: 2905660 - DNA, 14 bp, Homo sapiens
tttctagttaactt

SEQ ID NO: 2905661 - DNA, 13 bp, Homo sapiens
tttctagtttgtt

SEQ ID NO: 2905662 - DNA, 14 bp, Homo sapiens
tttctagtttgttt

SEQ ID NO: 2905663 - DNA, 18 bp, Homo sapiens
tttctagtttgtttagtt

SEQ ID NO: 2905664 - DNA, 18 bp, Homo sapiens
tttctagtttttaatttt

SEQ ID NO: 2905665 - DNA, 13 bp, Homo sapiens
tttctatacaaat

SEQ ID NO: 2905666 - DNA, 21 bp, Homo sapiens
tttctatcagacgtgctccct

SEQ ID NO: 2905667 - DNA, 13 bp, Homo sapiens
tttctatttagac

SEQ ID NO: 2905668 - DNA, 19 bp, Homo sapiens
tttctcagactggtctcga

SEQ ID NO: 2905669 - DNA, 19 bp, Homo sapiens
tttctcagactttggaaaa

SEQ ID NO: 2905670 - DNA, 15 bp, Homo sapiens
tttctccagggtcag

SEQ ID NO: 2905671 - DNA, 14 bp, Homo sapiens
tttctcctccatgg

SEQ ID NO: 2905672 - DNA, 18 bp, Homo sapiens
tttctcctctttgaacat

SEQ ID NO: 2905673 - DNA, 20 bp, Homo sapiens
tttctcctgcatgtgtatat

SEQ ID NO: 2905674 - DNA, 22 bp, Homo sapiens
tttctcgctgtcctttctagag

SEQ ID NO: 2905675 - DNA, 16 bp, Homo sapiens
tttctctattatgtta

SEQ ID NO: 2905676 - DNA, 14 bp, Homo sapiens
tttctctcagcata

SEQ ID NO: 2905677 - DNA, 23 bp, Homo sapiens
tttctctgccgctacctccctcc

SEQ ID NO: 2905678 - DNA, 13 bp, Homo sapiens
tttctctgtatat

SEQ ID NO: 2905679 - DNA, 14 bp, Homo sapiens
tttctcttctgtcc

SEQ ID NO: 2905680 - DNA, 15 bp, Homo sapiens
tttctcttctgtcca

SEQ ID NO: 2905681 - DNA, 13 bp, Homo sapiens
tttctgaaattca

SEQ ID NO: 2905682 - DNA, 17 bp, Homo sapiens
tttctgaaggctttgtg

SEQ ID NO: 2905683 - DNA, 21 bp, Homo sapiens
tttctgaatgtttgtgtctgt

SEQ ID NO: 2905684 - DNA, 22 bp, Homo sapiens
tttctgaatgtttgtgtctgtg

SEQ ID NO: 2905685 - DNA, 14 bp, Homo sapiens
tttctgacatcagc

SEQ ID NO: 2905686 - DNA, 15 bp, Homo sapiens
tttctgacatcagca

SEQ ID NO: 2905687 - DNA, 16 bp, Homo sapiens
tttctgacatcagcac

SEQ ID NO: 2905688 - DNA, 22 bp, Homo sapiens
tttctgaccatgtgcggagcag

SEQ ID NO: 2905689 - DNA, 18 bp, Homo sapiens
tttctgaggagaaacaaa

SEQ ID NO: 2905690 - DNA, 22 bp, Homo sapiens
tttctgatgggaggaaagtagc

SEQ ID NO: 2905691 - DNA, 18 bp, Homo sapiens
tttctgcagactggcagt

SEQ ID NO: 2905692 - DNA, 19 bp, Homo sapiens
tttctgcccaactttcatt

SEQ ID NO: 2905693 - DNA, 18 bp, Homo sapiens
tttctgccccccagggct

SEQ ID NO: 2905694 - DNA, 15 bp, Homo sapiens
tttctgctcagcttc

SEQ ID NO: 2905695 - DNA, 17 bp, Homo sapiens
tttctgctttaaattaa

SEQ ID NO: 2905696 - DNA, 16 bp, Homo sapiens
tttctggaggttgata

SEQ ID NO: 2905697 - DNA, 12 bp, Homo sapiens
tttctggcaccg

SEQ ID NO: 2905698 - DNA, 23 bp, Homo sapiens
tttctgggagacagaaaacatgt

SEQ ID NO: 2905699 - DNA, 16 bp, Homo sapiens
tttctgggggaaaaag

SEQ ID NO: 2905700 - DNA, 14 bp, Homo sapiens
tttctgtaaatgaa

SEQ ID NO: 2905701 - DNA, 21 bp, Homo sapiens
tttctgtatatgattctctgt

SEQ ID NO: 2905702 - DNA, 19 bp, Homo sapiens
tttctgtggacaccactga

SEQ ID NO: 2905703 - DNA, 22 bp, Homo sapiens
tttctgttcgaagttcattttt

SEQ ID NO: 2905704 - DNA, 20 bp, Homo sapiens
tttctgttctgccccctcag

SEQ ID NO: 2905705 - DNA, 19 bp, Homo sapiens
tttctgttctgtggaaagt

SEQ ID NO: 2905706 - DNA, 12 bp, Homo sapiens
tttcttaaatat

SEQ ID NO: 2905707 - DNA, 21 bp, Homo sapiens
tttcttaaccagttgtggtgt

SEQ ID NO: 2905708 - DNA, 16 bp, Homo sapiens
tttcttaaggtgaggc

SEQ ID NO: 2905709 - DNA, 12 bp, Homo sapiens
tttcttaatttg

SEQ ID NO: 2905710 - DNA, 14 bp, Homo sapiens
tttcttaccagtct

SEQ ID NO: 2905711 - DNA, 22 bp, Homo sapiens
tttcttaccctagttctcttat

SEQ ID NO: 2905712 - DNA, 22 bp, Homo sapiens
tttcttattaggcctcagaaag

SEQ ID NO: 2905713 - DNA, 20 bp, Homo sapiens
tttcttcaagtgagtggcat

SEQ ID NO: 2905714 - DNA, 13 bp, Homo sapiens
tttcttcctccag

SEQ ID NO: 2905715 - DNA, 12 bp, Homo sapiens
tttcttctttgt

SEQ ID NO: 2905716 - DNA, 18 bp, Homo sapiens
tttcttctttgtggtctt

SEQ ID NO: 2905717 - DNA, 18 bp, Homo sapiens
tttcttgatcttaaagat

SEQ ID NO: 2905718 - DNA, 13 bp, Homo sapiens
tttcttgcattga

SEQ ID NO: 2905719 - DNA, 19 bp, Homo sapiens
tttcttggcccccttccca

SEQ ID NO: 2905720 - DNA, 14 bp, Homo sapiens
tttcttgtctgtta

SEQ ID NO: 2905721 - DNA, 16 bp, Homo sapiens
tttcttgttgctttgt

SEQ ID NO: 2905722 - DNA, 15 bp, Homo sapiens
tttcttgtttgtcag

SEQ ID NO: 2905723 - DNA, 17 bp, Homo sapiens
tttctttaaaaaagaaa

SEQ ID NO: 2905724 - DNA, 20 bp, Homo sapiens
tttctttaaaaaagaaatta

SEQ ID NO: 2905725 - DNA, 15 bp, Homo sapiens
tttctttaaaagaat

SEQ ID NO: 2905726 - DNA, 16 bp, Homo sapiens
tttctttaaagccagt

SEQ ID NO: 2905727 - DNA, 18 bp, Homo sapiens
tttctttagagaactgaa

SEQ ID NO: 2905728 - DNA, 18 bp, Homo sapiens
tttctttaggagatttat

SEQ ID NO: 2905729 - DNA, 18 bp, Homo sapiens
tttctttatcattgctaa

SEQ ID NO: 2905730 - DNA, 22 bp, Homo sapiens
tttctttatcctaaagattatt

SEQ ID NO: 2905731 - DNA, 13 bp, Homo sapiens
tttctttcaactt

SEQ ID NO: 2905732 - DNA, 21 bp, Homo sapiens
tttctttccccaaaaattgac

SEQ ID NO: 2905733 - DNA, 16 bp, Homo sapiens
tttctttgatttaact

SEQ ID NO: 2905734 - DNA, 14 bp, Homo sapiens
tttctttgctgctg

SEQ ID NO: 2905735 - DNA, 17 bp, Homo sapiens
tttctttggggaaaaat

SEQ ID NO: 2905736 - DNA, 14 bp, Homo sapiens
tttcttttgtaata

SEQ ID NO: 2905737 - DNA, 14 bp, Homo sapiens
tttcttttgtaatt

SEQ ID NO: 2905738 - DNA, 16 bp, Homo sapiens
tttcttttgtaattgt

SEQ ID NO: 2905739 - DNA, 16 bp, Homo sapiens
tttcttttgttcttga

SEQ ID NO: 2905740 - DNA, 13 bp, Homo sapiens
tttctttttaatt

SEQ ID NO: 2905741 - DNA, 20 bp, Homo sapiens
tttctttttaattattttaa

SEQ ID NO: 2905742 - DNA, 17 bp, Homo sapiens
tttcttttttattacca

SEQ ID NO: 2905743 - DNA, 14 bp, Homo sapiens
tttctttttttcct

SEQ ID NO: 2905744 - DNA, 22 bp, Homo sapiens
tttgaaaaaagttactgcaact

SEQ ID NO: 2905745 - DNA, 12 bp, Homo sapiens
tttgaaaaaatt

SEQ ID NO: 2905746 - DNA, 13 bp, Homo sapiens
tttgaaaaagtta

SEQ ID NO: 2905747 - DNA, 15 bp, Homo sapiens
tttgaaaacatataa

SEQ ID NO: 2905748 - DNA, 13 bp, Homo sapiens
tttgaaactagaa

SEQ ID NO: 2905749 - DNA, 15 bp, Homo sapiens
tttgaaactagaaat

SEQ ID NO: 2905750 - DNA, 13 bp, Homo sapiens
tttgaaatacctt

SEQ ID NO: 2905751 - DNA, 23 bp, Homo sapiens
tttgaaatgtggttttcctgaaa

SEQ ID NO: 2905752 - DNA, 21 bp, Homo sapiens
tttgtcagcatctgaccatct

SEQ ID NO: 2905753 - DNA, 17 bp, Homo sapiens
tttgtcattaaaattgt

SEQ ID NO: 2905754 - DNA, 21 bp, Homo sapiens
tttgtccaaacaggtgctggc

SEQ ID NO: 2905755 - DNA, 22 bp, Homo sapiens
tttgtccaaacaggtgctggcc

SEQ ID NO: 2905756 - DNA, 23 bp, Homo sapiens
tttgtccaaacaggtgctggccc

SEQ ID NO: 2905757 - DNA, 23 bp, Homo sapiens
tttgtcctgaatggctttgtctt

SEQ ID NO: 2905758 - DNA, 18 bp, Homo sapiens
tttgtctcctactctgtg

SEQ ID NO: 2905759 - DNA, 19 bp, Homo sapiens
tttgtctcctactctgtgt

SEQ ID NO: 2905760 - DNA, 14 bp, Homo sapiens
tttgtgaagccctg

SEQ ID NO: 2905761 - DNA, 22 bp, Homo sapiens
tttgtgactaattgtataacag

SEQ ID NO: 2905762 - DNA, 16 bp, Homo sapiens
tttgtgagccttgctg

SEQ ID NO: 2905763 - DNA, 20 bp, Homo sapiens
tttgtgagccttgctgccaa

SEQ ID NO: 2905764 - DNA, 21 bp, Homo sapiens
tttgtgatgaatctacatttg

SEQ ID NO: 2905765 - DNA, 14 bp, Homo sapiens
tttgtgcagaatct

SEQ ID NO: 2905766 - DNA, 15 bp, Homo sapiens
tttgtgcagaatctc

SEQ ID NO: 2905767 - DNA, 20 bp, Homo sapiens
tttgtgctagaaattttcaa

SEQ ID NO: 2905768 - DNA, 21 bp, Homo sapiens
tttgtgctagaaattttcaag

SEQ ID NO: 2905769 - DNA, 23 bp, Homo sapiens
tttgtgctatcagactgtaggat

SEQ ID NO: 2905770 - DNA, 16 bp, Homo sapiens
tttgtgctctttcctg

SEQ ID NO: 2905771 - DNA, 15 bp, Homo sapiens
tttgtgctttgaaaa

SEQ ID NO: 2905772 - DNA, 23 bp, Homo sapiens
tttgtgcttttagtaaaaacatt

SEQ ID NO: 2905773 - DNA, 23 bp, Homo sapiens
tttgtggactgtgggtctggact

SEQ ID NO: 2905774 - DNA, 12 bp, Homo sapiens
tttgtggcttct

SEQ ID NO: 2905775 - DNA, 17 bp, Homo sapiens
tttgtgggaatttaaga

SEQ ID NO: 2905776 - DNA, 18 bp, Homo sapiens
tttgtgtaaatttctcaa

SEQ ID NO: 2905777 - DNA, 19 bp, Homo sapiens
tttgtgtcactgtacagtt

SEQ ID NO: 2905778 - DNA, 23 bp, Homo sapiens
tttgtgtcactgtacagttttgt

SEQ ID NO: 2905779 - DNA, 23 bp, Homo sapiens
tttgtgtgcaggctgtctcattt

SEQ ID NO: 2905780 - DNA, 13 bp, Homo sapiens
tttgtgtgtatat

SEQ ID NO: 2905781 - DNA, 15 bp, Homo sapiens
tttgtgtgtatatat

SEQ ID NO: 2905782 - DNA, 15 bp, Homo sapiens
tttgtgtgttgtctt

SEQ ID NO: 2905783 - DNA, 13 bp, Homo sapiens
tttgtgtttgctt

SEQ ID NO: 2905784 - DNA, 14 bp, Homo sapiens
tttgttaaaaataa

SEQ ID NO: 2905785 - DNA, 14 bp, Homo sapiens
tttgttacaataaa

SEQ ID NO: 2905786 - DNA, 21 bp, Homo sapiens
tttgttacaataaaactaaat

SEQ ID NO: 2905787 - DNA, 13 bp, Homo sapiens
tttgttactttga

SEQ ID NO: 2905788 - DNA, 14 bp, Homo sapiens
tttgttactttgaa

SEQ ID NO: 2905789 - DNA, 15 bp, Homo sapiens
tttgttactttgaat

SEQ ID NO: 2905790 - DNA, 16 bp, Homo sapiens
tttgttactttgaata

SEQ ID NO: 2905791 - DNA, 22 bp, Homo sapiens
tttgttaggattttcacattct

SEQ ID NO: 2905792 - DNA, 17 bp, Homo sapiens
tttgttataccatttcc

SEQ ID NO: 2905793 - DNA, 15 bp, Homo sapiens
tttgttattttgcaa

SEQ ID NO: 2905794 - DNA, 16 bp, Homo sapiens
tttgttattttgcaac

SEQ ID NO: 2905795 - DNA, 13 bp, Homo sapiens
tttgttcctgttt

SEQ ID NO: 2905796 - DNA, 20 bp, Homo sapiens
tttgttcgcatggtcacaca

SEQ ID NO: 2905797 - DNA, 23 bp, Homo sapiens
tttgttctcctaatgctctgaaa

SEQ ID NO: 2905798 - DNA, 12 bp, Homo sapiens
tttgttctctgt

SEQ ID NO: 2905799 - DNA, 13 bp, Homo sapiens
tttgttctcttct

SEQ ID NO: 2905800 - DNA, 22 bp, Homo sapiens
tttgttgacagcttggaaaggg

SEQ ID NO: 2905801 - DNA, 14 bp, Homo sapiens
tttgttgctgctgc

SEQ ID NO: 2905802 - DNA, 16 bp, Homo sapiens
tttgttgctgctgctg

SEQ ID NO: 2905803 - DNA, 15 bp, Homo sapiens
tttgttggagatgca

SEQ ID NO: 2905804 - DNA, 16 bp, Homo sapiens
tttgttggcccttcca

SEQ ID NO: 2905805 - DNA, 15 bp, Homo sapiens
tttgttggtcacatg

SEQ ID NO: 2905806 - DNA, 12 bp, Homo sapiens
tttgttgtaaaa

SEQ ID NO: 2905807 - DNA, 14 bp, Homo sapiens
tttgttgtcatgtg

SEQ ID NO: 2905808 - DNA, 12 bp, Homo sapiens
tttgttgtttat

SEQ ID NO: 2905809 - DNA, 14 bp, Homo sapiens
tttgtttcactgga

SEQ ID NO: 2905810 - DNA, 13 bp, Homo sapiens
tttgtttctgtat

SEQ ID NO: 2905811 - DNA, 18 bp, Homo sapiens
tttgtttcttgatagtta

SEQ ID NO: 2905812 - DNA, 23 bp, Homo sapiens
tttgttttaaaacgtgtaaatga

SEQ ID NO: 2905813 - DNA, 15 bp, Homo sapiens
tttgttttaaaatta

SEQ ID NO: 2905814 - DNA, 12 bp, Homo sapiens
tttgttttcctt

SEQ ID NO: 2905815 - DNA, 13 bp, Homo sapiens
tttgtttttgctt

SEQ ID NO: 2905816 - DNA, 17 bp, Homo sapiens
tttgtttttgctttctg

SEQ ID NO: 2905817 - DNA, 18 bp, Homo sapiens
tttgtttttgctttctga

SEQ ID NO: 2905818 - DNA, 14 bp, Homo sapiens
ttttaaaaaaaatg

SEQ ID NO: 2905819 - DNA, 22 bp, Homo sapiens
ttttaaaaagaaacaagatgct

SEQ ID NO: 2905820 - DNA, 15 bp, Homo sapiens
ttttaaaaagcaaat

SEQ ID NO: 2905821 - DNA, 17 bp, Homo sapiens
ttttaaaaagcaaatct

SEQ ID NO: 2905822 - DNA, 11 bp, Homo sapiens
ttttaaaacac

SEQ ID NO: 2905823 - DNA, 13 bp, Homo sapiens
ttttaaaacacat

SEQ ID NO: 2905824 - DNA, 14 bp, Homo sapiens
ttttaaaagacttt

SEQ ID NO: 2905825 - DNA, 16 bp, Homo sapiens
ttttaaaagactttga

SEQ ID NO: 2905826 - DNA, 21 bp, Homo sapiens
ttttaaaagttgttaccaaat

SEQ ID NO: 2905827 - DNA, 22 bp, Homo sapiens
ttttaaaagttgttaccaaata

SEQ ID NO: 2905828 - DNA, 21 bp, Homo sapiens
ttttaaaataagttaaaggca

SEQ ID NO: 2905829 - DNA, 16 bp, Homo sapiens
ttttaaaataatatgt

SEQ ID NO: 2905830 - DNA, 16 bp, Homo sapiens
ttttaaaatgcaatgt

SEQ ID NO: 2905831 - DNA, 14 bp, Homo sapiens
ttttaaaattatat

SEQ ID NO: 2905832 - DNA, 22 bp, Homo sapiens
ttttaaaattatatagcaaaga

SEQ ID NO: 2905833 - DNA, 16 bp, Homo sapiens
ttttaaacagatattc

SEQ ID NO: 2905834 - DNA, 17 bp, Homo sapiens
ttttaaactagatgacc

SEQ ID NO: 2905835 - DNA, 20 bp, Homo sapiens
ttttaaactagatgacctca

SEQ ID NO: 2905836 - DNA, 20 bp, Homo sapiens
ttttaaagaaaatgtgtctg

SEQ ID NO: 2905837 - DNA, 16 bp, Homo sapiens
ttttaaagaagtctct

SEQ ID NO: 2905838 - DNA, 17 bp, Homo sapiens
ttttaaaggacaaacag

SEQ ID NO: 2905839 - DNA, 17 bp, Homo sapiens
ttttaaagtaaatctct

SEQ ID NO: 2905840 - DNA, 17 bp, Homo sapiens
ttttaaatattttctat

SEQ ID NO: 2905841 - DNA, 15 bp, Homo sapiens
ttttaaattttctcc

SEQ ID NO: 2905842 - DNA, 15 bp, Homo sapiens
ttttaaattttgtaa

SEQ ID NO: 2905843 - DNA, 14 bp, Homo sapiens
ttttaacaagaaga

SEQ ID NO: 2905844 - DNA, 21 bp, Homo sapiens
ttttaacatcagaactgaaat

SEQ ID NO: 2905845 - DNA, 22 bp, Homo sapiens
ttttaacatttatctaaaagaa

SEQ ID NO: 2905846 - DNA, 17 bp, Homo sapiens
ttttaaccctaatcttt

SEQ ID NO: 2905847 - DNA, 19 bp, Homo sapiens
ttttaagacgtgtttgtgt

SEQ ID NO: 2905848 - DNA, 16 bp, Homo sapiens
ttttaagcaaatgcat

SEQ ID NO: 2905849 - DNA, 22 bp, Homo sapiens
ttttaagcagctctaaaacata

SEQ ID NO: 2905850 - DNA, 15 bp, Homo sapiens
ttttaaggaaaacta

SEQ ID NO: 2905851 - DNA, 17 bp, Homo sapiens
ttttaaggtctttcagt

SEQ ID NO: 2905852 - DNA, 21 bp, Homo sapiens
ttttaaggtctttcagtactt

SEQ ID NO: 2905853 - DNA, 23 bp, Homo sapiens
ttttaaggtctttcagtactttt

SEQ ID NO: 2905854 - DNA, 21 bp, Homo sapiens
ttttaaggtgagttctcacta

SEQ ID NO: 2905855 - DNA, 14 bp, Homo sapiens
ttttaagttcccag

SEQ ID NO: 2905856 - DNA, 18 bp, Homo sapiens
ttttaagttgtttgcatg

SEQ ID NO: 2905857 - DNA, 21 bp, Homo sapiens
ttttaataacatatctaaagt

SEQ ID NO: 2905858 - DNA, 22 bp, Homo sapiens
ttttaatattattactgttgat

SEQ ID NO: 2905859 - DNA, 14 bp, Homo sapiens
ttttaatcatgaaa

SEQ ID NO: 2905860 - DNA, 19 bp, Homo sapiens
ttttaatcatgagcctgtt

SEQ ID NO: 2905861 - DNA, 16 bp, Homo sapiens
ttttaatgaacaaatg

SEQ ID NO: 2905862 - DNA, 17 bp, Homo sapiens
ttttaatgatgacaaaa

SEQ ID NO: 2905863 - DNA, 11 bp, Homo sapiens
ttttaatgtga

SEQ ID NO: 2905864 - DNA, 14 bp, Homo sapiens
ttttaatgtgaaga

SEQ ID NO: 2905865 - DNA, 13 bp, Homo sapiens
ttttaatgtgctg

SEQ ID NO: 2905866 - DNA, 17 bp, Homo sapiens
ttttaatgtgctgtgta

SEQ ID NO: 2905867 - DNA, 16 bp, Homo sapiens
ttttaattaaaaacta

SEQ ID NO: 2905868 - DNA, 11 bp, Homo sapiens
ttttaattcca

SEQ ID NO: 2905869 - DNA, 10 bp, Homo sapiens
ttttaattta

SEQ ID NO: 2905870 - DNA, 18 bp, Homo sapiens
ttttaatttagtaaatgt

SEQ ID NO: 2905871 - DNA, 21 bp, Homo sapiens
ttttacaaattaatatttgtg

SEQ ID NO: 2905872 - DNA, 17 bp, Homo sapiens
ttttacacagcaatttt

SEQ ID NO: 2905873 - DNA, 13 bp, Homo sapiens
ttttacattctgt

SEQ ID NO: 2905874 - DNA, 17 bp, Homo sapiens
ttttacccctgcacagt

SEQ ID NO: 2905875 - DNA, 21 bp, Homo sapiens
ttttactccctgatcccagtt

SEQ ID NO: 2905876 - DNA, 19 bp, Homo sapiens
ttttactgaagcctttctt

SEQ ID NO: 2905877 - DNA, 21 bp, Homo sapiens
ttttacttggtgtaattaata

SEQ ID NO: 2905878 - DNA, 17 bp, Homo sapiens
ttttacttttttacact

SEQ ID NO: 2905879 - DNA, 21 bp, Homo sapiens
ttttagacagtctcactttgt

SEQ ID NO: 2905880 - DNA, 13 bp, Homo sapiens
ttttagagcatta

SEQ ID NO: 2905881 - DNA, 15 bp, Homo sapiens
ttttagagcattaaa

SEQ ID NO: 2905882 - DNA, 21 bp, Homo sapiens
ttttagagcattaaaataact

SEQ ID NO: 2905883 - DNA, 23 bp, Homo sapiens
ttttagagcattaaaataactat

SEQ ID NO: 2905884 - DNA, 21 bp, Homo sapiens
ttttagccattgtcgtttcat

SEQ ID NO: 2905885 - DNA, 21 bp, Homo sapiens
ttttagctgatgaacttattc

SEQ ID NO: 2905886 - DNA, 23 bp, Homo sapiens
ttttaggagctaaggctctatga

SEQ ID NO: 2905887 - DNA, 16 bp, Homo sapiens
ttttaggatctcgcct

SEQ ID NO: 2905888 - DNA, 14 bp, Homo sapiens
ttttaggttctaaa

SEQ ID NO: 2905889 - DNA, 16 bp, Homo sapiens
tttgagtggatgatgt

SEQ ID NO: 2905890 - DNA, 16 bp, Homo sapiens
tttgagtttcagctgg

SEQ ID NO: 2905891 - DNA, 21 bp, Homo sapiens
tttgagtttcagctggaaact

SEQ ID NO: 2905892 - DNA, 17 bp, Homo sapiens
tttgagtttgacattta

SEQ ID NO: 2905893 - DNA, 14 bp, Homo sapiens
tttgataaagtagt

SEQ ID NO: 2905894 - DNA, 19 bp, Homo sapiens
tttgataaagtagtaaaaa

SEQ ID NO: 2905895 - DNA, 20 bp, Homo sapiens
tttgataaagtagtaaaaat

SEQ ID NO: 2905896 - DNA, 18 bp, Homo sapiens
tttgataagcacattaaa

SEQ ID NO: 2905897 - DNA, 14 bp, Homo sapiens
tttgatcagacagc

SEQ ID NO: 2905898 - DNA, 18 bp, Homo sapiens
tttgatcaggtggggagt

SEQ ID NO: 2905899 - DNA, 19 bp, Homo sapiens
tttgatctattaagggatt

SEQ ID NO: 2905900 - DNA, 12 bp, Homo sapiens
tttgatctctgc

SEQ ID NO: 2905901 - DNA, 21 bp, Homo sapiens
tttgatgagatattaaattct

SEQ ID NO: 2905902 - DNA, 15 bp, Homo sapiens
tttgatgcttttctc

SEQ ID NO: 2905903 - DNA, 12 bp, Homo sapiens
tttgatggctgg

SEQ ID NO: 2905904 - DNA, 20 bp, Homo sapiens
tttgatgtataaaacttgat

SEQ ID NO: 2905905 - DNA, 14 bp, Homo sapiens
tttgatgttaacac

SEQ ID NO: 2905906 - DNA, 15 bp, Homo sapiens
tttgattcaaaatat

SEQ ID NO: 2905907 - DNA, 22 bp, Homo sapiens
tttgattcaaaatatttaaaaa

SEQ ID NO: 2905908 - DNA, 15 bp, Homo sapiens
tttgattcatagtaa

SEQ ID NO: 2905909 - DNA, 19 bp, Homo sapiens
tttgcaaagtattgtaaat

SEQ ID NO: 2905910 - DNA, 23 bp, Homo sapiens
tttgcaacttcaagggacaagta

SEQ ID NO: 2905911 - DNA, 21 bp, Homo sapiens
tttgcaagggaaaagtctctt

SEQ ID NO: 2905912 - DNA, 18 bp, Homo sapiens
tttgcaataaaaatgata

SEQ ID NO: 2905913 - DNA, 19 bp, Homo sapiens
tttgcaataacttctatat

SEQ ID NO: 2905914 - DNA, 13 bp, Homo sapiens
tttgcaataatgc

SEQ ID NO: 2905915 - DNA, 15 bp, Homo sapiens
tttgcaataatgcag

SEQ ID NO: 2905916 - DNA, 17 bp, Homo sapiens
tttgcaataatgcagta

SEQ ID NO: 2905917 - DNA, 13 bp, Homo sapiens
tttgcaatactgc

SEQ ID NO: 2905918 - DNA, 20 bp, Homo sapiens
tttgcacccactgaaaggaa

SEQ ID NO: 2905919 - DNA, 17 bp, Homo sapiens
tttgcaccgcctgccct

SEQ ID NO: 2905920 - DNA, 18 bp, Homo sapiens
tttgcaccgcctgccctc

SEQ ID NO: 2905921 - DNA, 16 bp, Homo sapiens
tttgcacctttctagt

SEQ ID NO: 2905922 - DNA, 20 bp, Homo sapiens
tttgcactggagttctatgc

SEQ ID NO: 2905923 - DNA, 12 bp, Homo sapiens
tttgcactgtct

SEQ ID NO: 2905924 - DNA, 21 bp, Homo sapiens
tttgcacttgtgattatttat

SEQ ID NO: 2905925 - DNA, 23 bp, Homo sapiens
tttgcaggatttttagagcatta

SEQ ID NO: 2905926 - DNA, 22 bp, Homo sapiens
tttgcagggtcctcttctgggc

SEQ ID NO: 2905927 - DNA, 17 bp, Homo sapiens
tttgcataacaattcct

SEQ ID NO: 2905928 - DNA, 14 bp, Homo sapiens
tttgcatctgaaat

SEQ ID NO: 2905929 - DNA, 21 bp, Homo sapiens
tttgcatgtgaaaatcaaata

SEQ ID NO: 2905930 - DNA, 17 bp, Homo sapiens
tttgcattaaattcaca

SEQ ID NO: 2905931 - DNA, 14 bp, Homo sapiens
tttgcatttggaat

SEQ ID NO: 2905932 - DNA, 23 bp, Homo sapiens
tttgccaaaattcatttctaatt

SEQ ID NO: 2905933 - DNA, 13 bp, Homo sapiens
tttgcctgtaaca

SEQ ID NO: 2905934 - DNA, 16 bp, Homo sapiens
tttgctcacctggggt

SEQ ID NO: 2905935 - DNA, 13 bp, Homo sapiens
tttgctctttctt

SEQ ID NO: 2905936 - DNA, 21 bp, Homo sapiens
tttgctgaatgtcattatttg

SEQ ID NO: 2905937 - DNA, 11 bp, Homo sapiens
tttgctgccct

SEQ ID NO: 2905938 - DNA, 15 bp, Homo sapiens
tttgctggaaaatct

SEQ ID NO: 2905939 - DNA, 19 bp, Homo sapiens
tttgctggaaaatctgtaa

SEQ ID NO: 2905940 - DNA, 19 bp, Homo sapiens
tttgctggagaaatcattt

SEQ ID NO: 2905941 - DNA, 13 bp, Homo sapiens
tttgctgttccac

SEQ ID NO: 2905942 - DNA, 10 bp, Homo sapiens
tttgctgttt

SEQ ID NO: 2905943 - DNA, 15 bp, Homo sapiens
tttgcttcaaaaaca

SEQ ID NO: 2905944 - DNA, 17 bp, Homo sapiens
tttgcttgcagtagatt

SEQ ID NO: 2905945 - DNA, 20 bp, Homo sapiens
tttgcttgcagtagattttc

SEQ ID NO: 2905946 - DNA, 18 bp, Homo sapiens
tttgcttggtgctggttt

SEQ ID NO: 2905947 - DNA, 15 bp, Homo sapiens
tttgctttgctttct

SEQ ID NO: 2905948 - DNA, 18 bp, Homo sapiens
tttgctttgctttctgct

SEQ ID NO: 2905949 - DNA, 20 bp, Homo sapiens
tttggaaaaagaaaaaaggg

SEQ ID NO: 2905950 - DNA, 19 bp, Homo sapiens
tttggaaaagagctgggat

SEQ ID NO: 2905951 - DNA, 22 bp, Homo sapiens
tttggaaccaaagtctaaactg

SEQ ID NO: 2905952 - DNA, 19 bp, Homo sapiens
tttggaagacatatattat

SEQ ID NO: 2905953 - DNA, 20 bp, Homo sapiens
tttggaagatcctgtgagga

SEQ ID NO: 2905954 - DNA, 15 bp, Homo sapiens
tttggaatacttttt

SEQ ID NO: 2905955 - DNA, 17 bp, Homo sapiens
tttggaatactttttgt

SEQ ID NO: 2905956 - DNA, 16 bp, Homo sapiens
tttggagggatcattt

SEQ ID NO: 2905957 - DNA, 22 bp, Homo sapiens
tttggatgtcctcaaagaagtg

SEQ ID NO: 2905958 - DNA, 23 bp, Homo sapiens
tttggattctcttagctactgta

SEQ ID NO: 2905959 - DNA, 20 bp, Homo sapiens
tttggattggggtccctcta

SEQ ID NO: 2905960 - DNA, 14 bp, Homo sapiens
tttggatttgacat

SEQ ID NO: 2905961 - DNA, 17 bp, Homo sapiens
tttggcagaactgctgg

SEQ ID NO: 2905962 - DNA, 20 bp, Homo sapiens
tttggcagaactgctggggc

SEQ ID NO: 2905963 - DNA, 21 bp, Homo sapiens
tttggcagaactgctggggct

SEQ ID NO: 2905964 - DNA, 13 bp, Homo sapiens
tttggcagagttc

SEQ ID NO: 2905965 - DNA, 21 bp, Homo sapiens
tttggcatctaattcttattt

SEQ ID NO: 2905966 - DNA, 13 bp, Homo sapiens
tttggcatttgca

SEQ ID NO: 2905967 - DNA, 12 bp, Homo sapiens
tttggcccaaga

SEQ ID NO: 2905968 - DNA, 12 bp, Homo sapiens
tttggcctgcct

SEQ ID NO: 2905969 - DNA, 16 bp, Homo sapiens
tttggctagtccttgt

SEQ ID NO: 2905970 - DNA, 18 bp, Homo sapiens
tttggctccttaccaata

SEQ ID NO: 2905971 - DNA, 16 bp, Homo sapiens
tttggctctattggat

SEQ ID NO: 2905972 - DNA, 19 bp, Homo sapiens
tttggctctattggatttg

SEQ ID NO: 2905973 - DNA, 23 bp, Homo sapiens
ttttaggttctaaagttctaaga

SEQ ID NO: 2905974 - DNA, 17 bp, Homo sapiens
ttttagtaacctttaaa

SEQ ID NO: 2905975 - DNA, 14 bp, Homo sapiens
ttttagtcactttt

SEQ ID NO: 2905976 - DNA, 17 bp, Homo sapiens
ttttagttgcatgaaat

SEQ ID NO: 2905977 - DNA, 14 bp, Homo sapiens
ttttagttggaatg

SEQ ID NO: 2905978 - DNA, 20 bp, Homo sapiens
ttttagtttaaaatcttgca

SEQ ID NO: 2905979 - DNA, 20 bp, Homo sapiens
ttttagtttctgttctgtgg

SEQ ID NO: 2905980 - DNA, 22 bp, Homo sapiens
ttttagtttctgttctgtggaa

SEQ ID NO: 2905981 - DNA, 22 bp, Homo sapiens
ttttataaaatggctgtaatca

SEQ ID NO: 2905982 - DNA, 20 bp, Homo sapiens
ttttataactagtcctttac

SEQ ID NO: 2905983 - DNA, 17 bp, Homo sapiens
ttttatagcctggactg

SEQ ID NO: 2905984 - DNA, 15 bp, Homo sapiens
ttttatagttgtatt

SEQ ID NO: 2905985 - DNA, 22 bp, Homo sapiens
ttttatataatatctaaagtta

SEQ ID NO: 2905986 - DNA, 15 bp, Homo sapiens
ttttatatctgtatg

SEQ ID NO: 2905987 - DNA, 16 bp, Homo sapiens
ttttatatctgtatgt

SEQ ID NO: 2905988 - DNA, 17 bp, Homo sapiens
ttttatatctgtatgta

SEQ ID NO: 2905989 - DNA, 14 bp, Homo sapiens
ttttatattgaaaa

SEQ ID NO: 2905990 - DNA, 19 bp, Homo sapiens
ttttatatttgaaaaaatt

SEQ ID NO: 2905991 - DNA, 18 bp, Homo sapiens
ttttatattttatactgc

SEQ ID NO: 2905992 - DNA, 16 bp, Homo sapiens
ttttatattttctatt

SEQ ID NO: 2905993 - DNA, 17 bp, Homo sapiens
ttttatcatttctactg

SEQ ID NO: 2905994 - DNA, 20 bp, Homo sapiens
ttttatcatttctactgaag

SEQ ID NO: 2905995 - DNA, 16 bp, Homo sapiens
ttttatctagaacatt

SEQ ID NO: 2905996 - DNA, 22 bp, Homo sapiens
ttttatctggtatggtgctaat

SEQ ID NO: 2905997 - DNA, 19 bp, Homo sapiens
ttttatctttcgtgataaa

SEQ ID NO: 2905998 - DNA, 12 bp, Homo sapiens
ttttatgagaaa

SEQ ID NO: 2905999 - DNA, 19 bp, Homo sapiens
ttttatgtagtaattgaca

SEQ ID NO: 2906000 - DNA, 18 bp, Homo sapiens
ttttatgtgagagaaagt

SEQ ID NO: 2906001 - DNA, 15 bp, Homo sapiens
ttttatgtttgtaca

SEQ ID NO: 2906002 - DNA, 23 bp, Homo sapiens
ttttattaaatttatttgaaaat

SEQ ID NO: 2906003 - DNA, 12 bp, Homo sapiens
ttttattaagaa

SEQ ID NO: 2906004 - DNA, 21 bp, Homo sapiens
ttttattaagccaggaaacat

SEQ ID NO: 2906005 - DNA, 11 bp, Homo sapiens
ttttattaatg

SEQ ID NO: 2906006 - DNA, 15 bp, Homo sapiens
ttttattaattataa

SEQ ID NO: 2906007 - DNA, 19 bp, Homo sapiens
ttttattaattataaaatg

SEQ ID NO: 2906008 - DNA, 18 bp, Homo sapiens
ttttattcctgtatgttg

SEQ ID NO: 2906009 - DNA, 16 bp, Homo sapiens
ttttattgacacagaa

SEQ ID NO: 2906010 - DNA, 12 bp, Homo sapiens
ttttattgcctt

SEQ ID NO: 2906011 - DNA, 14 bp, Homo sapiens
ttttattgccttct

SEQ ID NO: 2906012 - DNA, 15 bp, Homo sapiens
ttttattgccttctc

SEQ ID NO: 2906013 - DNA, 20 bp, Homo sapiens
ttttattgtattttgatgag

SEQ ID NO: 2906014 - DNA, 14 bp, Homo sapiens
ttttatttcattgg

SEQ ID NO: 2906015 - DNA, 14 bp, Homo sapiens
ttttatttgaaaaa

SEQ ID NO: 2906016 - DNA, 20 bp, Homo sapiens
ttttattttcaccctctgta

SEQ ID NO: 2906017 - DNA, 15 bp, Homo sapiens
ttttattttggaatt

SEQ ID NO: 2906018 - DNA, 16 bp, Homo sapiens
ttttattttgtctctg

SEQ ID NO: 2906019 - DNA, 18 bp, Homo sapiens
ttttattttttcttttgt

SEQ ID NO: 2906020 - DNA, 20 bp, Homo sapiens
ttttcaaaatccaaaaagaa

SEQ ID NO: 2906021 - DNA, 14 bp, Homo sapiens
ttttcaacaattag

SEQ ID NO: 2906022 - DNA, 22 bp, Homo sapiens
ttttcaacactgaaaaaatact

SEQ ID NO: 2906023 - DNA, 16 bp, Homo sapiens
ttttcaaccagattta

SEQ ID NO: 2906024 - DNA, 12 bp, Homo sapiens
ttttcaacccca

SEQ ID NO: 2906025 - DNA, 19 bp, Homo sapiens
ttttcaaccccaccctgtt

SEQ ID NO: 2906026 - DNA, 13 bp, Homo sapiens
ttttcaactgcca

SEQ ID NO: 2906027 - DNA, 23 bp, Homo sapiens
ttttcaactgccaaaatgctcta

SEQ ID NO: 2906028 - DNA, 15 bp, Homo sapiens
ttttcaactttgaat

SEQ ID NO: 2906029 - DNA, 21 bp, Homo sapiens
ttttcaactttgaataaagaa

SEQ ID NO: 2906030 - DNA, 22 bp, Homo sapiens
ttttcacattcttataaatatg

SEQ ID NO: 2906031 - DNA, 16 bp, Homo sapiens
ttttcactgctgctcc

SEQ ID NO: 2906032 - DNA, 23 bp, Homo sapiens
ttttcacttagaacctttctgtg

SEQ ID NO: 2906033 - DNA, 19 bp, Homo sapiens
ttttcacttgtcttgctct

SEQ ID NO: 2906034 - DNA, 11 bp, Homo sapiens
ttttcagaccc

SEQ ID NO: 2906035 - DNA, 14 bp, Homo sapiens
ttttcagactcaga

SEQ ID NO: 2906036 - DNA, 18 bp, Homo sapiens
ttttcagatgtgaaccat

SEQ ID NO: 2906037 - DNA, 21 bp, Homo sapiens
ttttcagcataaatgggaact

SEQ ID NO: 2906038 - DNA, 19 bp, Homo sapiens
ttttcagccaatttgtctc

SEQ ID NO: 2906039 - DNA, 15 bp, Homo sapiens
ttttcagtcatataa

SEQ ID NO: 2906040 - DNA, 16 bp, Homo sapiens
ttttgacacatgtgtg

SEQ ID NO: 2906041 - DNA, 19 bp, Homo sapiens
ttttgacaggttttccaaa

SEQ ID NO: 2906042 - DNA, 19 bp, Homo sapiens
ttttgagaacgtaaagaac

SEQ ID NO: 2906043 - DNA, 18 bp, Homo sapiens
ttttgagtggatgatgtt

SEQ ID NO: 2906044 - DNA, 12 bp, Homo sapiens
ttttgataaaat

SEQ ID NO: 2906045 - DNA, 20 bp, Homo sapiens
ttttgataaaatgttccttt

SEQ ID NO: 2906046 - DNA, 19 bp, Homo sapiens
ttttgataaagtttctcag

SEQ ID NO: 2906047 - DNA, 20 bp, Homo sapiens
ttttgatgactggcatttta

SEQ ID NO: 2906048 - DNA, 22 bp, Homo sapiens
ttttgatgagatattaaattct

SEQ ID NO: 2906049 - DNA, 17 bp, Homo sapiens
ttttgcaaaataagttt

SEQ ID NO: 2906050 - DNA, 17 bp, Homo sapiens
ttttgcaataacttcta

SEQ ID NO: 2906051 - DNA, 18 bp, Homo sapiens
ttttgcaataatgcagta

SEQ ID NO: 2906052 - DNA, 13 bp, Homo sapiens
ttttgcagaagag

SEQ ID NO: 2906053 - DNA, 15 bp, Homo sapiens
ttttgcaggggactg

SEQ ID NO: 2906054 - DNA, 16 bp, Homo sapiens
ttttgcaggggactgg

SEQ ID NO: 2906055 - DNA, 18 bp, Homo sapiens
ttttgcccatataaaatg

SEQ ID NO: 2906056 - DNA, 13 bp, Homo sapiens
ttttgccctttga

SEQ ID NO: 2906057 - DNA, 23 bp, Homo sapiens
ttttgcctgtgactgtaaagagt

SEQ ID NO: 2906058 - DNA, 13 bp, Homo sapiens
ttttgccttcatt

SEQ ID NO: 2906059 - DNA, 16 bp, Homo sapiens
ttttgctggagggaag

SEQ ID NO: 2906060 - DNA, 18 bp, Homo sapiens
ttttgctgtttcctttta

SEQ ID NO: 2906061 - DNA, 16 bp, Homo sapiens
ttttgcttgcaatgta

SEQ ID NO: 2906062 - DNA, 17 bp, Homo sapiens
ttttgctttctgaaatt

SEQ ID NO: 2906063 - DNA, 17 bp, Homo sapiens
ttttggaagacatatat

SEQ ID NO: 2906064 - DNA, 19 bp, Homo sapiens
ttttggaattggtgtatat

SEQ ID NO: 2906065 - DNA, 17 bp, Homo sapiens
ttttggactccatctct

SEQ ID NO: 2906066 - DNA, 16 bp, Homo sapiens
ttttggagtgttatgt

SEQ ID NO: 2906067 - DNA, 16 bp, Homo sapiens
ttttggattgtatatt

SEQ ID NO: 2906068 - DNA, 13 bp, Homo sapiens
ttttggcctgcct

SEQ ID NO: 2906069 - DNA, 14 bp, Homo sapiens
ttttggctctgaag

SEQ ID NO: 2906070 - DNA, 18 bp, Homo sapiens
ttttgggggtgtgagtgt

SEQ ID NO: 2906071 - DNA, 16 bp, Homo sapiens
ttttggtacaaaaata

SEQ ID NO: 2906072 - DNA, 14 bp, Homo sapiens
ttttggtagagatg

SEQ ID NO: 2906073 - DNA, 14 bp, Homo sapiens
ttttggtcattgta

SEQ ID NO: 2906074 - DNA, 11 bp, Homo sapiens
ttttggttgtg

SEQ ID NO: 2906075 - DNA, 15 bp, Homo sapiens
ttttggttgtttgct

SEQ ID NO: 2906076 - DNA, 15 bp, Homo sapiens
ttttgtaaaatcaaa

SEQ ID NO: 2906077 - DNA, 19 bp, Homo sapiens
ttttgtaaatgtactggta

SEQ ID NO: 2906078 - DNA, 18 bp, Homo sapiens
ttttgtaattgtgtaaaa

SEQ ID NO: 2906079 - DNA, 14 bp, Homo sapiens
ttttgtaatttaaa

SEQ ID NO: 2906080 - DNA, 23 bp, Homo sapiens
ttttgtataaatgacaaagtgtt

SEQ ID NO: 2906081 - DNA, 19 bp, Homo sapiens
ttttgtatctacatctttt

SEQ ID NO: 2906082 - DNA, 10 bp, Homo sapiens
ttttgtattt

SEQ ID NO: 2906083 - DNA, 15 bp, Homo sapiens
ttttgtatttaatga

SEQ ID NO: 2906084 - DNA, 15 bp, Homo sapiens
ttttgtcaacattgt

SEQ ID NO: 2906085 - DNA, 19 bp, Homo sapiens
ttttgtcacagctcttgtt

SEQ ID NO: 2906086 - DNA, 18 bp, Homo sapiens
ttttgtccaagttcacag

SEQ ID NO: 2906087 - DNA, 15 bp, Homo sapiens
ttttgtctctgagat

SEQ ID NO: 2906088 - DNA, 13 bp, Homo sapiens
ttttgtcttgaat

SEQ ID NO: 2906089 - DNA, 13 bp, Homo sapiens
ttttgtgagatgt

SEQ ID NO: 2906090 - DNA, 17 bp, Homo sapiens
ttttgtgagcctctttg

SEQ ID NO: 2906091 - DNA, 16 bp, Homo sapiens
ttttgtgctctttcct

SEQ ID NO: 2906092 - DNA, 16 bp, Homo sapiens
ttttgtggaggcagtg

SEQ ID NO: 2906093 - DNA, 16 bp, Homo sapiens
ttttgtgtctcattta

SEQ ID NO: 2906094 - DNA, 18 bp, Homo sapiens
ttttgttatcagtcaata

SEQ ID NO: 2906095 - DNA, 20 bp, Homo sapiens
ttttgttccaatgtcaatgt

SEQ ID NO: 2906096 - DNA, 14 bp, Homo sapiens
ttttgttcttcaga

SEQ ID NO: 2906097 - DNA, 19 bp, Homo sapiens
ttttgttcttcagagatca

SEQ ID NO: 2906098 - DNA, 16 bp, Homo sapiens
ttttgttggtgctttg

SEQ ID NO: 2906099 - DNA, 15 bp, Homo sapiens
tgccagagataaact

SEQ ID NO: 2906100 - DNA, 12 bp, Homo sapiens
tgccagatgctg

SEQ ID NO: 2906101 - DNA, 21 bp, Homo sapiens
tgccagatgctgatgttcagt

SEQ ID NO: 2906102 - DNA, 22 bp, Homo sapiens
tgccagatgctgatgttcagtg

SEQ ID NO: 2906103 - DNA, 16 bp, Homo sapiens
tgccagcagcctcgca

SEQ ID NO: 2906104 - DNA, 13 bp, Homo sapiens
tgccagcccggct

SEQ ID NO: 2906105 - DNA, 21 bp, Homo sapiens
tgccagcccggctcggcccag

SEQ ID NO: 2906106 - DNA, 22 bp, Homo sapiens
tgccagcccggctcggcccagc

SEQ ID NO: 2906107 - DNA, 23 bp, Homo sapiens
tgccagcccggctcggcccagca

SEQ ID NO: 2906108 - DNA, 20 bp, Homo sapiens
tgccaggaaacaagggaagg

SEQ ID NO: 2906109 - DNA, 21 bp, Homo sapiens
tgccaggaaacaagggaaggg

SEQ ID NO: 2906110 - DNA, 15 bp, Homo sapiens
tgccaggaatgtttc

SEQ ID NO: 2906111 - DNA, 17 bp, Homo sapiens
tgccaggaatgtttcag

SEQ ID NO: 2906112 - DNA, 16 bp, Homo sapiens
tgccaggaggcggcag

SEQ ID NO: 2906113 - DNA, 22 bp, Homo sapiens
tgccaggaggcggcagctcttc

SEQ ID NO: 2906114 - DNA, 11 bp, Homo sapiens
tgccaggcccc

SEQ ID NO: 2906115 - DNA, 15 bp, Homo sapiens
tgccaggctgcggtg

SEQ ID NO: 2906116 - DNA, 13 bp, Homo sapiens
tgccaggcttgcc

SEQ ID NO: 2906117 - DNA, 18 bp, Homo sapiens
tgccagggatgggcagcc

SEQ ID NO: 2906118 - DNA, 16 bp, Homo sapiens
tgccagggcagggccc

SEQ ID NO: 2906119 - DNA, 16 bp, Homo sapiens
tgccagggccgaccag

SEQ ID NO: 2906120 - DNA, 11 bp, Homo sapiens
tgccagggctc

SEQ ID NO: 2906121 - DNA, 20 bp, Homo sapiens
tgccagggctctgggggcag

SEQ ID NO: 2906122 - DNA, 22 bp, Homo sapiens
tgccagggctctgggggcagat

SEQ ID NO: 2906123 - DNA, 18 bp, Homo sapiens
tgccagggcttcctcttc

SEQ ID NO: 2906124 - DNA, 19 bp, Homo sapiens
tgccaggttctatttggaa

SEQ ID NO: 2906125 - DNA, 20 bp, Homo sapiens
tgccaggttctatttggaat

SEQ ID NO: 2906126 - DNA, 18 bp, Homo sapiens
tgccagtcgggagagcca

SEQ ID NO: 2906127 - DNA, 23 bp, Homo sapiens
tgccagtcgggagagccaggctt

SEQ ID NO: 2906128 - DNA, 19 bp, Homo sapiens
tgccagtgtgctgatgggc

SEQ ID NO: 2906129 - DNA, 21 bp, Homo sapiens
tgccagtgtgttactcatctt

SEQ ID NO: 2906130 - DNA, 22 bp, Homo sapiens
tgccagtgtgttactcatcttt

SEQ ID NO: 2906131 - DNA, 13 bp, Homo sapiens
tgccatacatgtt

SEQ ID NO: 2906132 - DNA, 16 bp, Homo sapiens
tgccatacatgttatt

SEQ ID NO: 2906133 - DNA, 23 bp, Homo sapiens
tgccatacatgttattgttttca

SEQ ID NO: 2906134 - DNA, 15 bp, Homo sapiens
tgccatactttgtct

SEQ ID NO: 2906135 - DNA, 22 bp, Homo sapiens
tgccatactttgtctgaaaaat

SEQ ID NO: 2906136 - DNA, 17 bp, Homo sapiens
tgccatagtcacatggc

SEQ ID NO: 2906137 - DNA, 18 bp, Homo sapiens
tgccatagtcacatggcc

SEQ ID NO: 2906138 - DNA, 15 bp, Homo sapiens
tgccatcaaactgta

SEQ ID NO: 2906139 - DNA, 13 bp, Homo sapiens
tgccatcatctcc

SEQ ID NO: 2906140 - DNA, 15 bp, Homo sapiens
tgccatcatgcctga

SEQ ID NO: 2906141 - DNA, 16 bp, Homo sapiens
tgccatcattgctgtc

SEQ ID NO: 2906142 - DNA, 18 bp, Homo sapiens
tgccatcattgctgtctg

SEQ ID NO: 2906143 - DNA, 21 bp, Homo sapiens
tgccatcattgctgtctgcag

SEQ ID NO: 2906144 - DNA, 20 bp, Homo sapiens
tgccatccccctctcacgcc

SEQ ID NO: 2906145 - DNA, 21 bp, Homo sapiens
tgccatccccctctcacgcca

SEQ ID NO: 2906146 - DNA, 18 bp, Homo sapiens
tgccatcgggtgccaaat

SEQ ID NO: 2906147 - DNA, 22 bp, Homo sapiens
tgccatctgcgtgacaataaaa

SEQ ID NO: 2906148 - DNA, 21 bp, Homo sapiens
tgccatcttctccccgaggct

SEQ ID NO: 2906149 - DNA, 20 bp, Homo sapiens
tgccatgatgcctctgtctt

SEQ ID NO: 2906150 - DNA, 17 bp, Homo sapiens
tgccatgcatacatgct

SEQ ID NO: 2906151 - DNA, 17 bp, Homo sapiens
tgccatgtctttactag

SEQ ID NO: 2906152 - DNA, 21 bp, Homo sapiens
tgccatgtgactctggcttgg

SEQ ID NO: 2906153 - DNA, 14 bp, Homo sapiens
tgccatgtgctggg

SEQ ID NO: 2906154 - DNA, 18 bp, Homo sapiens
tgccattggaacctgtta

SEQ ID NO: 2906155 - DNA, 17 bp, Homo sapiens
tgccattgtactccagc

SEQ ID NO: 2906156 - DNA, 16 bp, Homo sapiens
tgccattttaaggaaa

SEQ ID NO: 2906157 - DNA, 20 bp, Homo sapiens
tgccattttaaggaaaacta

SEQ ID NO: 2906158 - DNA, 14 bp, Homo sapiens
tgccattttaaggt

SEQ ID NO: 2906159 - DNA, 19 bp, Homo sapiens
tgcccaacccttccctcac

SEQ ID NO: 2906160 - DNA, 22 bp, Homo sapiens
tgcccaactactatctcagaga

SEQ ID NO: 2906161 - DNA, 9 bp, Homo sapiens
tgcccaagt

SEQ ID NO: 2906162 - DNA, 16 bp, Homo sapiens
tgcccaagtgaccagg

SEQ ID NO: 2906163 - DNA, 19 bp, Homo sapiens
tgcccacacacactccttc

SEQ ID NO: 2906164 - DNA, 21 bp, Homo sapiens
tgcccacaggccgccctgcgg

SEQ ID NO: 2906165 - DNA, 18 bp, Homo sapiens
tgcccacatttagtctct

SEQ ID NO: 2906166 - DNA, 17 bp, Homo sapiens
tgcccaccaacatccca

SEQ ID NO: 2906167 - DNA, 12 bp, Homo sapiens
tgcccacccccg

SEQ ID NO: 2906168 - DNA, 22 bp, Homo sapiens
tgcccacctcagcctcccaaag

SEQ ID NO: 2906169 - DNA, 11 bp, Homo sapiens
tgcccacctgc

SEQ ID NO: 2906170 - DNA, 13 bp, Homo sapiens
tgcccacctgcct

SEQ ID NO: 2906171 - DNA, 16 bp, Homo sapiens
tgcccacctgcctggc

SEQ ID NO: 2906172 - DNA, 22 bp, Homo sapiens
tgcccacctgcctggccggcca

SEQ ID NO: 2906173 - DNA, 19 bp, Homo sapiens
tgcccagaataagttattg

SEQ ID NO: 2906174 - DNA, 21 bp, Homo sapiens
tgcccagaataagttattgca

SEQ ID NO: 2906175 - DNA, 17 bp, Homo sapiens
tgcccagagatgcctcc

SEQ ID NO: 2906176 - DNA, 19 bp, Homo sapiens
tgcccagagatgcctccac

SEQ ID NO: 2906177 - DNA, 21 bp, Homo sapiens
tgcccagagatgcctccaccg

SEQ ID NO: 2906178 - DNA, 17 bp, Homo sapiens
tgcccagccacccctca

SEQ ID NO: 2906179 - DNA, 19 bp, Homo sapiens
tgcccagccacccctcaga

SEQ ID NO: 2906180 - DNA, 20 bp, Homo sapiens
tgcccagctatacctgtgcc

SEQ ID NO: 2906181 - DNA, 21 bp, Homo sapiens
tgcccagctatacctgtgcct

SEQ ID NO: 2906182 - DNA, 17 bp, Homo sapiens
tgcccaggagagccagc

SEQ ID NO: 2906183 - DNA, 18 bp, Homo sapiens
tgcccaggagagccagcc

SEQ ID NO: 2906184 - DNA, 19 bp, Homo sapiens
tgcccaggagagccagccc

SEQ ID NO: 2906185 - DNA, 20 bp, Homo sapiens
tgcccaggagagccagccct

SEQ ID NO: 2906186 - DNA, 14 bp, Homo sapiens
tgcccaggatttga

SEQ ID NO: 2906187 - DNA, 20 bp, Homo sapiens
tgcccaggcctctcggtgct

SEQ ID NO: 2906188 - DNA, 21 bp, Homo sapiens
tgcccagggtcagtgtatcta

SEQ ID NO: 2906189 - DNA, 19 bp, Homo sapiens
tgcccagggtgcagtgtga

SEQ ID NO: 2906190 - DNA, 22 bp, Homo sapiens
tgcccaggtggggtttcctgca

SEQ ID NO: 2906191 - DNA, 17 bp, Homo sapiens
tgcccagtctttcatgt

SEQ ID NO: 2906192 - DNA, 11 bp, Homo sapiens
tgcccatcctc

SEQ ID NO: 2906193 - DNA, 12 bp, Homo sapiens
tgcccatcctcc

SEQ ID NO: 2906194 - DNA, 14 bp, Homo sapiens
tgcccatgagcaag

SEQ ID NO: 2906195 - DNA, 18 bp, Homo sapiens
tgcccatggcatgtcttt

SEQ ID NO: 2906196 - DNA, 19 bp, Homo sapiens
tgcccattcttttcacttc

SEQ ID NO: 2906197 - DNA, 12 bp, Homo sapiens
tgcccatttcat

SEQ ID NO: 2906198 - DNA, 12 bp, Homo sapiens
tgccccagactg

SEQ ID NO: 2906199 - DNA, 17 bp, Homo sapiens
tgccccagactgagctc

SEQ ID NO: 2906200 - DNA, 19 bp, Homo sapiens
tgccccagactgagctctc

SEQ ID NO: 2906201 - DNA, 14 bp, Homo sapiens
tgccccaggaccag

SEQ ID NO: 2906202 - DNA, 23 bp, Homo sapiens
tgccccatgaagccacagcccag

SEQ ID NO: 2906203 - DNA, 20 bp, Homo sapiens
tgcccccaaagcccatgccc

SEQ ID NO: 2906204 - DNA, 17 bp, Homo sapiens
tgcccccactgaccaga

SEQ ID NO: 2906205 - DNA, 18 bp, Homo sapiens
tgcccccagacagctgct

SEQ ID NO: 2906206 - DNA, 16 bp, Homo sapiens
tgcccccagctggccc

SEQ ID NO: 2906207 - DNA, 22 bp, Homo sapiens
tgccccctcgggggcctgtggt

SEQ ID NO: 2906208 - DNA, 21 bp, Homo sapiens
tgccccgcaggcctgccttct

SEQ ID NO: 2906209 - DNA, 20 bp, Homo sapiens
tgcccctaaagatgggagga

SEQ ID NO: 2906210 - DNA, 17 bp, Homo sapiens
tgcccctccccctaccg

SEQ ID NO: 2906211 - DNA, 22 bp, Homo sapiens
tgcccctccctagatccaggct

SEQ ID NO: 2906212 - DNA, 14 bp, Homo sapiens
tgcccctccctgcc

SEQ ID NO: 2906213 - DNA, 13 bp, Homo sapiens
tgcccctcctgga

SEQ ID NO: 2906214 - DNA, 18 bp, Homo sapiens
tgcccctcctggagcaga

SEQ ID NO: 2906215 - DNA, 16 bp, Homo sapiens
tgcccctggcacctgt

SEQ ID NO: 2906216 - DNA, 13 bp, Homo sapiens
tgcccctggctgg

SEQ ID NO: 2906217 - DNA, 13 bp, Homo sapiens
tgcccctgttcat

SEQ ID NO: 2906218 - DNA, 19 bp, Homo sapiens
tgccccttctctttaatct

SEQ ID NO: 2906219 - DNA, 21 bp, Homo sapiens
tgccccttgacaactggcagg

SEQ ID NO: 2906220 - DNA, 14 bp, Homo sapiens
tgcccgcctgccca

SEQ ID NO: 2906221 - DNA, 17 bp, Homo sapiens
tgcccgcctgcccacct

SEQ ID NO: 2906222 - DNA, 15 bp, Homo sapiens
tgcccgctcagccca

SEQ ID NO: 2906223 - DNA, 16 bp, Homo sapiens
tgcccggcgcctgccc

SEQ ID NO: 2906224 - DNA, 19 bp, Homo sapiens
tgcccggcgcctgccctgc

SEQ ID NO: 2906225 - DNA, 24 bp, Homo sapiens
tgcccggcgcctgccctgcccaag

SEQ ID NO: 2906226 - DNA, 18 bp, Homo sapiens
tgcccggggaaaggcaag

SEQ ID NO: 2906227 - DNA, 21 bp, Homo sapiens
tgcccggggaaaggcaaggtc

SEQ ID NO: 2906228 - DNA, 23 bp, Homo sapiens
tgcccgtaaacacgcctgcaaac

SEQ ID NO: 2906229 - DNA, 16 bp, Homo sapiens
tgcccgtaatcccagc

SEQ ID NO: 2906230 - DNA, 18 bp, Homo sapiens
tgcccgtaatcccagcta

SEQ ID NO: 2906231 - DNA, 17 bp, Homo sapiens
tgccctaacctgacaga

SEQ ID NO: 2906232 - DNA, 23 bp, Homo sapiens
tgccctaagtgatttccacaggt

SEQ ID NO: 2906233 - DNA, 19 bp, Homo sapiens
tgccctaattcatctttta

SEQ ID NO: 2906234 - DNA, 15 bp, Homo sapiens
tgcgcatcttgcctc

SEQ ID NO: 2906235 - DNA, 14 bp, Homo sapiens
tgcgccaccatgcc

SEQ ID NO: 2906236 - DNA, 18 bp, Homo sapiens
tgcgccaccatgccctat

SEQ ID NO: 2906237 - DNA, 17 bp, Homo sapiens
tgcgccaccgcccagag

SEQ ID NO: 2906238 - DNA, 12 bp, Homo sapiens
tgcgccaggcag

SEQ ID NO: 2906239 - DNA, 18 bp, Homo sapiens
tgcgcccagtccttccac

SEQ ID NO: 2906240 - DNA, 17 bp, Homo sapiens
tgcgcctcaggctgctg

SEQ ID NO: 2906241 - DNA, 19 bp, Homo sapiens
tgcgcctccatccatctgt

SEQ ID NO: 2906242 - DNA, 20 bp, Homo sapiens
tgcgcctccatccatctgtc

SEQ ID NO: 2906243 - DNA, 17 bp, Homo sapiens
tgcgcgcgctctctctc

SEQ ID NO: 2906244 - DNA, 17 bp, Homo sapiens
tgcgcgtggcgtggccc

SEQ ID NO: 2906245 - DNA, 11 bp, Homo sapiens
tgcgctgcctg

SEQ ID NO: 2906246 - DNA, 15 bp, Homo sapiens
tgcggaaaggtattt

SEQ ID NO: 2906247 - DNA, 14 bp, Homo sapiens
tgcggaatcagctt

SEQ ID NO: 2906248 - DNA, 15 bp, Homo sapiens
tgcggaatcagcttc

SEQ ID NO: 2906249 - DNA, 15 bp, Homo sapiens
tgcggagcagccttt

SEQ ID NO: 2906250 - DNA, 17 bp, Homo sapiens
tgcggcacaggaaacag

SEQ ID NO: 2906251 - DNA, 22 bp, Homo sapiens
tgcggcgtggagactggcaggc

SEQ ID NO: 2906252 - DNA, 23 bp, Homo sapiens
tgcgggcattttgaatgtgatca

SEQ ID NO: 2906253 - DNA, 17 bp, Homo sapiens
tgcgggctcgcccatac

SEQ ID NO: 2906254 - DNA, 13 bp, Homo sapiens
tgcggggacaggc

SEQ ID NO: 2906255 - DNA, 23 bp, Homo sapiens
tgcggggacaggctggaatgagg

SEQ ID NO: 2906256 - DNA, 21 bp, Homo sapiens
tgcggggcctgaggcaagcca

SEQ ID NO: 2906257 - DNA, 17 bp, Homo sapiens
tgcggggcctgtctcag

SEQ ID NO: 2906258 - DNA, 19 bp, Homo sapiens
tgcgggtcctcagctgctc

SEQ ID NO: 2906259 - DNA, 21 bp, Homo sapiens
tgcggtacaggagtcagccat

SEQ ID NO: 2906260 - DNA, 17 bp, Homo sapiens
tgcggtagccagcacac

SEQ ID NO: 2906261 - DNA, 16 bp, Homo sapiens
tgcggtgggcagccat

SEQ ID NO: 2906262 - DNA, 20 bp, Homo sapiens
tgcgtattctgtggccgcca

SEQ ID NO: 2906263 - DNA, 15 bp, Homo sapiens
tgcgtccaccaggcc

SEQ ID NO: 2906264 - DNA, 21 bp, Homo sapiens
tgcgtccaccaggcctcactg

SEQ ID NO: 2906265 - DNA, 19 bp, Homo sapiens
tgcgtccacgagctgttta

SEQ ID NO: 2906266 - DNA, 15 bp, Homo sapiens
tgcgtgacaataaaa

SEQ ID NO: 2906267 - DNA, 15 bp, Homo sapiens
tgcgtgacactctcc

SEQ ID NO: 2906268 - DNA, 15 bp, Homo sapiens
tgcgtggaaaaagac

SEQ ID NO: 2906269 - DNA, 19 bp, Homo sapiens
tgcgtggaagtgttcctgt

SEQ ID NO: 2906270 - DNA, 20 bp, Homo sapiens
tgcgtggaagtgttcctgtc

SEQ ID NO: 2906271 - DNA, 17 bp, Homo sapiens
tgcgtggactctgcaca

SEQ ID NO: 2906272 - DNA, 15 bp, Homo sapiens
tgcgtggcgtggccc

SEQ ID NO: 2906273 - DNA, 18 bp, Homo sapiens
tgcgtgtccgtctgtctg

SEQ ID NO: 2906274 - DNA, 14 bp, Homo sapiens
tgcgtgtttgcacg

SEQ ID NO: 2906275 - DNA, 16 bp, Homo sapiens
tgcgtgtttgcacgtt

SEQ ID NO: 2906276 - DNA, 19 bp, Homo sapiens
tgcgttcccttcagtactg

SEQ ID NO: 2906277 - DNA, 17 bp, Homo sapiens
tgcgttggtctctgcat

SEQ ID NO: 2906278 - DNA, 13 bp, Homo sapiens
tgcgtttttacag

SEQ ID NO: 2906279 - DNA, 15 bp, Homo sapiens
tgctaaaaatgggac

SEQ ID NO: 2906280 - DNA, 11 bp, Homo sapiens
tgctaaaattc

SEQ ID NO: 2906281 - DNA, 17 bp, Homo sapiens
tgctaaaattctataga

SEQ ID NO: 2906282 - DNA, 21 bp, Homo sapiens
tgctaaaattctatagagata

SEQ ID NO: 2906283 - DNA, 22 bp, Homo sapiens
tgctaaacatttgctggagaaa

SEQ ID NO: 2906284 - DNA, 17 bp, Homo sapiens
tgctaaataaaatttgt

SEQ ID NO: 2906285 - DNA, 21 bp, Homo sapiens
tgctaaataaaatttgttgca

SEQ ID NO: 2906286 - DNA, 23 bp, Homo sapiens
tgctaaataaaatttgttgcata

SEQ ID NO: 2906287 - DNA, 13 bp, Homo sapiens
tgctaaataacta

SEQ ID NO: 2906288 - DNA, 15 bp, Homo sapiens
tgctaaataactata

SEQ ID NO: 2906289 - DNA, 14 bp, Homo sapiens
tgctaaatgtaaca

SEQ ID NO: 2906290 - DNA, 18 bp, Homo sapiens
tgctaaatgtaacagtct

SEQ ID NO: 2906291 - DNA, 15 bp, Homo sapiens
tgctaaatgtgtaat

SEQ ID NO: 2906292 - DNA, 12 bp, Homo sapiens
tgctaactgaac

SEQ ID NO: 2906293 - DNA, 17 bp, Homo sapiens
tgctaaggagaagctaa

SEQ ID NO: 2906294 - DNA, 15 bp, Homo sapiens
tgctaaggttctaag

SEQ ID NO: 2906295 - DNA, 17 bp, Homo sapiens
tgctaaggttctaaggc

SEQ ID NO: 2906296 - DNA, 21 bp, Homo sapiens
tgctaatattttatttgaaaa

SEQ ID NO: 2906297 - DNA, 16 bp, Homo sapiens
tgctaattgctgttga

SEQ ID NO: 2906298 - DNA, 17 bp, Homo sapiens
tgctaattgctgttgaa

SEQ ID NO: 2906299 - DNA, 16 bp, Homo sapiens
tgctacaaagaagaca

SEQ ID NO: 2906300 - DNA, 11 bp, Homo sapiens
tgctacacttc

SEQ ID NO: 2906301 - DNA, 12 bp, Homo sapiens
tgctacacttct

SEQ ID NO: 2906302 - DNA, 15 bp, Homo sapiens
tgctaccttctttgg

SEQ ID NO: 2906303 - DNA, 13 bp, Homo sapiens
tgctacgtgtgat

SEQ ID NO: 2906304 - DNA, 18 bp, Homo sapiens
tgctactagctctttgag

SEQ ID NO: 2906305 - DNA, 13 bp, Homo sapiens
tgctactgaaact

SEQ ID NO: 2906306 - DNA, 16 bp, Homo sapiens
tgctactgcccctctc

SEQ ID NO: 2906307 - DNA, 22 bp, Homo sapiens
tgctactgtctcactgaaacat

SEQ ID NO: 2906308 - DNA, 15 bp, Homo sapiens
tgctacttgctctgc

SEQ ID NO: 2906309 - DNA, 17 bp, Homo sapiens
tgctacttttacttgtt

SEQ ID NO: 2906310 - DNA, 19 bp, Homo sapiens
tgctacttttacttgttca

SEQ ID NO: 2906311 - DNA, 20 bp, Homo sapiens
tgctacttttacttgttcat

SEQ ID NO: 2906312 - DNA, 22 bp, Homo sapiens
tgctacttttacttgttcattt

SEQ ID NO: 2906313 - DNA, 15 bp, Homo sapiens
tgctagaaattttca

SEQ ID NO: 2906314 - DNA, 15 bp, Homo sapiens
tgctagaagaaaaca

SEQ ID NO: 2906315 - DNA, 15 bp, Homo sapiens
tgctagagcagacag

SEQ ID NO: 2906316 - DNA, 16 bp, Homo sapiens
tgctagagcagacagg

SEQ ID NO: 2906317 - DNA, 16 bp, Homo sapiens
tgctagctagccagcc

SEQ ID NO: 2906318 - DNA, 17 bp, Homo sapiens
tgctagctagccagcca

SEQ ID NO: 2906319 - DNA, 18 bp, Homo sapiens
tgctagctagccagccaa

SEQ ID NO: 2906320 - DNA, 12 bp, Homo sapiens
tgctagctttcc

SEQ ID NO: 2906321 - DNA, 18 bp, Homo sapiens
tgctaggggaaggactgg

SEQ ID NO: 2906322 - DNA, 23 bp, Homo sapiens
tgctaggggaaggactggccgtg

SEQ ID NO: 2906323 - DNA, 19 bp, Homo sapiens
tgctgccaccaaatctgtc

SEQ ID NO: 2906324 - DNA, 22 bp, Homo sapiens
tgctgccaccaaatctgtctag

SEQ ID NO: 2906325 - DNA, 17 bp, Homo sapiens
tgctgccactctgctgc

SEQ ID NO: 2906326 - DNA, 12 bp, Homo sapiens
tgctgcccctcc

SEQ ID NO: 2906327 - DNA, 16 bp, Homo sapiens
tgctgcccctccctgc

SEQ ID NO: 2906328 - DNA, 17 bp, Homo sapiens
tgctgcccttggtttct

SEQ ID NO: 2906329 - DNA, 15 bp, Homo sapiens
tgctgcctcagctca

SEQ ID NO: 2906330 - DNA, 20 bp, Homo sapiens
tgctgcgcatgttttcttca

SEQ ID NO: 2906331 - DNA, 15 bp, Homo sapiens
tgctgctactgcccc

SEQ ID NO: 2906332 - DNA, 19 bp, Homo sapiens
tgctgctcatactggtctc

SEQ ID NO: 2906333 - DNA, 15 bp, Homo sapiens
tgctgctccatgttt

SEQ ID NO: 2906334 - DNA, 12 bp, Homo sapiens
tgctgctcctct

SEQ ID NO: 2906335 - DNA, 13 bp, Homo sapiens
tgctgctcctctt

SEQ ID NO: 2906336 - DNA, 21 bp, Homo sapiens
tgctgctgaatttataaaaat

SEQ ID NO: 2906337 - DNA, 13 bp, Homo sapiens
tgctgctgtcacc

SEQ ID NO: 2906338 - DNA, 18 bp, Homo sapiens
tgctgctgtgcgtggaaa

SEQ ID NO: 2906339 - DNA, 13 bp, Homo sapiens
tgctgctgtgctt

SEQ ID NO: 2906340 - DNA, 22 bp, Homo sapiens
tgctgctgtgcttttgatctct

SEQ ID NO: 2906341 - DNA, 18 bp, Homo sapiens
tgctgcttgtgcctccct

SEQ ID NO: 2906342 - DNA, 21 bp, Homo sapiens
tgctgctttgttgttctgcct

SEQ ID NO: 2906343 - DNA, 21 bp, Homo sapiens
tgctggaaaatctgtaaaaaa

SEQ ID NO: 2906344 - DNA, 19 bp, Homo sapiens
tgctggaacctgcaaaaaa

SEQ ID NO: 2906345 - DNA, 14 bp, Homo sapiens
tgctggaagaggtg

SEQ ID NO: 2906346 - DNA, 23 bp, Homo sapiens
tgctggagcccgcactgtcccag

SEQ ID NO: 2906347 - DNA, 17 bp, Homo sapiens
tgctggagtcatgtgcc

SEQ ID NO: 2906348 - DNA, 22 bp, Homo sapiens
tgctggatgtctgccaattttt

SEQ ID NO: 2906349 - DNA, 13 bp, Homo sapiens
tgctggcatgtct

SEQ ID NO: 2906350 - DNA, 13 bp, Homo sapiens
tgctggcccagca

SEQ ID NO: 2906351 - DNA, 14 bp, Homo sapiens
tgctggcccagcat

SEQ ID NO: 2906352 - DNA, 14 bp, Homo sapiens
tgctggcccagggc

SEQ ID NO: 2906353 - DNA, 18 bp, Homo sapiens
tgctggcccagggcccag

SEQ ID NO: 2906354 - DNA, 15 bp, Homo sapiens
tgcttgtttcttggt

SEQ ID NO: 2906355 - DNA, 15 bp, Homo sapiens
tgctttaagaatgaa

SEQ ID NO: 2906356 - DNA, 13 bp, Homo sapiens
tgctttacaggat

SEQ ID NO: 2906357 - DNA, 22 bp, Homo sapiens
tgctttacaggatcatgtaaat

SEQ ID NO: 2906358 - DNA, 18 bp, Homo sapiens
tgctttaccaaacagcaa

SEQ ID NO: 2906359 - DNA, 19 bp, Homo sapiens
tgctttaccaaacagcaaa

SEQ ID NO: 2906360 - DNA, 17 bp, Homo sapiens
tgctttattccagaatg

SEQ ID NO: 2906361 - DNA, 12 bp, Homo sapiens
tgctttcactct

SEQ ID NO: 2906362 - DNA, 14 bp, Homo sapiens
tgctttcattatgt

SEQ ID NO: 2906363 - DNA, 20 bp, Homo sapiens
tgctttccagaataatatga

SEQ ID NO: 2906364 - DNA, 17 bp, Homo sapiens
tgctttccgtggcactg

SEQ ID NO: 2906365 - DNA, 21 bp, Homo sapiens
tgctttccgtggcactgcata

SEQ ID NO: 2906366 - DNA, 18 bp, Homo sapiens
tgctttcctcttactttc

SEQ ID NO: 2906367 - DNA, 22 bp, Homo sapiens
tgctttcctcttactttcagtt

SEQ ID NO: 2906368 - DNA, 18 bp, Homo sapiens
tgctttcgaactgctagt

SEQ ID NO: 2906369 - DNA, 15 bp, Homo sapiens
tgctttctctttcag

SEQ ID NO: 2906370 - DNA, 18 bp, Homo sapiens
tgctttctctttcagtat

SEQ ID NO: 2906371 - DNA, 13 bp, Homo sapiens
tgctttctgaaat

SEQ ID NO: 2906372 - DNA, 19 bp, Homo sapiens
tgctttctgatgttgcctt

SEQ ID NO: 2906373 - DNA, 14 bp, Homo sapiens
tgctttctgctcag

SEQ ID NO: 2906374 - DNA, 20 bp, Homo sapiens
tgctttctgctcagcttctc

SEQ ID NO: 2906375 - DNA, 12 bp, Homo sapiens
tgctttctgtgg

SEQ ID NO: 2906376 - DNA, 13 bp, Homo sapiens
tgctttctgtgga

SEQ ID NO: 2906377 - DNA, 14 bp, Homo sapiens
tgctttctgttcat

SEQ ID NO: 2906378 - DNA, 18 bp, Homo sapiens
tgctttgacgggccaggc

SEQ ID NO: 2906379 - DNA, 17 bp, Homo sapiens
tgctttgcctcgaaagt

SEQ ID NO: 2906380 - DNA, 18 bp, Homo sapiens
tgctttgcctcgaaagtg

SEQ ID NO: 2906381 - DNA, 19 bp, Homo sapiens
tgctttgctttctgctcag

SEQ ID NO: 2906382 - DNA, 16 bp, Homo sapiens
tgcttttaaatctgca

SEQ ID NO: 2906383 - DNA, 15 bp, Homo sapiens
tgcttttatatctgt

SEQ ID NO: 2906384 - DNA, 15 bp, Homo sapiens
tgcttttatccactg

SEQ ID NO: 2906385 - DNA, 17 bp, Homo sapiens
tgcttttatgtttgtac

SEQ ID NO: 2906386 - DNA, 16 bp, Homo sapiens
tgcttttcttcctagt

SEQ ID NO: 2906387 - DNA, 13 bp, Homo sapiens
tgcttttggcctg

SEQ ID NO: 2906388 - DNA, 16 bp, Homo sapiens
tggaaaaaaaaaaaag

SEQ ID NO: 2906389 - DNA, 17 bp, Homo sapiens
tggaaaaaaaaaaaaga

SEQ ID NO: 2906390 - DNA, 17 bp, Homo sapiens
tggaaaaaaaaaagaca

SEQ ID NO: 2906391 - DNA, 12 bp, Homo sapiens
tggaaaaaaaca

SEQ ID NO: 2906392 - DNA, 20 bp, Homo sapiens
tggaaaaaccacccccaaat

SEQ ID NO: 2906393 - DNA, 18 bp, Homo sapiens
tggaaaaagaaagaaaca

SEQ ID NO: 2906394 - DNA, 21 bp, Homo sapiens
tggaaaaagaaagaaacactc

SEQ ID NO: 2906395 - DNA, 11 bp, Homo sapiens
tggaaaaatga

SEQ ID NO: 2906396 - DNA, 17 bp, Homo sapiens
tggaaaacaaggaagtc

SEQ ID NO: 2906397 - DNA, 21 bp, Homo sapiens
tggaaaactaagaaaattgct

SEQ ID NO: 2906398 - DNA, 14 bp, Homo sapiens
tggaaaagaaatca

SEQ ID NO: 2906399 - DNA, 19 bp, Homo sapiens
tggaaaagggtcttgggaa

SEQ ID NO: 2906400 - DNA, 22 bp, Homo sapiens
tggaaaagggtcttgggaaata

SEQ ID NO: 2906401 - DNA, 15 bp, Homo sapiens
tggaaacagaggtaa

SEQ ID NO: 2906402 - DNA, 22 bp, Homo sapiens
tggaaaccaagtcaggccaggt

SEQ ID NO: 2906403 - DNA, 17 bp, Homo sapiens
tggaaacccataggccc

SEQ ID NO: 2906404 - DNA, 21 bp, Homo sapiens
tggaaacccataggcccacac

SEQ ID NO: 2906405 - DNA, 14 bp, Homo sapiens
tggaaacttctgta

SEQ ID NO: 2906406 - DNA, 13 bp, Homo sapiens
tggaaagactggg

SEQ ID NO: 2906407 - DNA, 21 bp, Homo sapiens
tggaaagatagagattgtttt

SEQ ID NO: 2906408 - DNA, 20 bp, Homo sapiens
tggaaaggaagaatgcagag

SEQ ID NO: 2906409 - DNA, 15 bp, Homo sapiens
tggaaaggatcacag

SEQ ID NO: 2906410 - DNA, 20 bp, Homo sapiens
tggaaaggattctaaacaga

SEQ ID NO: 2906411 - DNA, 21 bp, Homo sapiens
tggaaaggattctaaacagat

SEQ ID NO: 2906412 - DNA, 16 bp, Homo sapiens
tggaaaggtttcaaga

SEQ ID NO: 2906413 - DNA, 15 bp, Homo sapiens
tggaaagtttttgta

SEQ ID NO: 2906414 - DNA, 21 bp, Homo sapiens
tggaacaagacagccttcact

SEQ ID NO: 2906415 - DNA, 23 bp, Homo sapiens
tggaacacaaatgaaaatgaata

SEQ ID NO: 2906416 - DNA, 15 bp, Homo sapiens
tggaacacggccaca

SEQ ID NO: 2906417 - DNA, 21 bp, Homo sapiens
tggaacactagacaagccaga

SEQ ID NO: 2906418 - DNA, 22 bp, Homo sapiens
tggaacactagacaagccagaa

SEQ ID NO: 2906419 - DNA, 22 bp, Homo sapiens
tggaacagtgaaagtcaattca

SEQ ID NO: 2906420 - DNA, 14 bp, Homo sapiens
tggaacatccttgg

SEQ ID NO: 2906421 - DNA, 17 bp, Homo sapiens
tggaacatgcttttact

SEQ ID NO: 2906422 - DNA, 20 bp, Homo sapiens
tggaaccagcaagtcccaga

SEQ ID NO: 2906423 - DNA, 16 bp, Homo sapiens
tggaacccagactcag

SEQ ID NO: 2906424 - DNA, 16 bp, Homo sapiens
tggaacctgcaaaaaa

SEQ ID NO: 2906425 - DNA, 22 bp, Homo sapiens
tggaactaaggactccaatgtc

SEQ ID NO: 2906426 - DNA, 16 bp, Homo sapiens
tggaactgtcccagct

SEQ ID NO: 2906427 - DNA, 13 bp, Homo sapiens
tggaacttgaact

SEQ ID NO: 2906428 - DNA, 15 bp, Homo sapiens
tggaacttgaactga

SEQ ID NO: 2906429 - DNA, 16 bp, Homo sapiens
tggaacttgaactgat

SEQ ID NO: 2906430 - DNA, 17 bp, Homo sapiens
tggaagaaaatggaatt

SEQ ID NO: 2906431 - DNA, 23 bp, Homo sapiens
tggaagaaaatggaattactcca

SEQ ID NO: 2906432 - DNA, 14 bp, Homo sapiens
tggaagatcctgtg

SEQ ID NO: 2906433 - DNA, 17 bp, Homo sapiens
tggaagatcctgtgagg

SEQ ID NO: 2906434 - DNA, 12 bp, Homo sapiens
tggaagcagagc

SEQ ID NO: 2906435 - DNA, 17 bp, Homo sapiens
tggaagcatgtaggaga

SEQ ID NO: 2906436 - DNA, 22 bp, Homo sapiens
tggaagcatgtaggagaatcca

SEQ ID NO: 2906437 - DNA, 16 bp, Homo sapiens
tggaagctaatttgca

SEQ ID NO: 2906438 - DNA, 18 bp, Homo sapiens
tggaagctaatttgcatt

SEQ ID NO: 2906439 - DNA, 16 bp, Homo sapiens
tggaagctgtgtcctt

SEQ ID NO: 2906440 - DNA, 18 bp, Homo sapiens
tggaagcttgttttccag

SEQ ID NO: 2906441 - DNA, 17 bp, Homo sapiens
tggaaggagacacagat

SEQ ID NO: 2906442 - DNA, 19 bp, Homo sapiens
tggaaggagacacagatgt

SEQ ID NO: 2906443 - DNA, 12 bp, Homo sapiens
tggaaggagcac

SEQ ID NO: 2906444 - DNA, 23 bp, Homo sapiens
tggaaggtgaggcgttctcctgc

SEQ ID NO: 2906445 - DNA, 14 bp, Homo sapiens
tggaaggtgccaga

SEQ ID NO: 2906446 - DNA, 20 bp, Homo sapiens
tggaagtaaccatttgcact

SEQ ID NO: 2906447 - DNA, 16 bp, Homo sapiens
tggaagtattttcctc

SEQ ID NO: 2906448 - DNA, 22 bp, Homo sapiens
tggaagtattttcctccaaagt

SEQ ID NO: 2906449 - DNA, 21 bp, Homo sapiens
tggaagtcaaataaatgtttc

SEQ ID NO: 2906450 - DNA, 15 bp, Homo sapiens
tggaagtccctcaga

SEQ ID NO: 2906451 - DNA, 18 bp, Homo sapiens
tggaagtgtgtgtggcag

SEQ ID NO: 2906452 - DNA, 18 bp, Homo sapiens
tggaagtgttcctgtctc

SEQ ID NO: 2906453 - DNA, 19 bp, Homo sapiens
tggaagtgttcctgtctca

SEQ ID NO: 2906454 - DNA, 22 bp, Homo sapiens
tggaataatcctaaacatatga

SEQ ID NO: 2906455 - DNA, 20 bp, Homo sapiens
tggaatactaaaaatcatga

SEQ ID NO: 2906456 - DNA, 18 bp, Homo sapiens
tggaatataaggaaagca

SEQ ID NO: 2906457 - DNA, 20 bp, Homo sapiens
tggaatattgtccattgtcc

SEQ ID NO: 2906458 - DNA, 12 bp, Homo sapiens
tggaatcaacac

SEQ ID NO: 2906459 - DNA, 18 bp, Homo sapiens
tggaatctggagaccagg

SEQ ID NO: 2906460 - DNA, 13 bp, Homo sapiens
tggaatgagggag

SEQ ID NO: 2906461 - DNA, 15 bp, Homo sapiens
tggaatgcacacagc

SEQ ID NO: 2906462 - DNA, 20 bp, Homo sapiens
tggaatgcacacagcggctg

SEQ ID NO: 2906463 - DNA, 13 bp, Homo sapiens
tggaatgcttctt

SEQ ID NO: 2906464 - DNA, 17 bp, Homo sapiens
tggaattactccaaaaa

SEQ ID NO: 2906465 - DNA, 13 bp, Homo sapiens
tggaattagatgt

SEQ ID NO: 2906466 - DNA, 15 bp, Homo sapiens
tggaattagatgttt

SEQ ID NO: 2906467 - DNA, 20 bp, Homo sapiens
tggaattagcttggggccag

SEQ ID NO: 2906468 - DNA, 17 bp, Homo sapiens
ggcgtggcccgtggcct

SEQ ID NO: 2906469 - DNA, 20 bp, Homo sapiens
ggcgtggggaatgggcaggt

SEQ ID NO: 2906470 - DNA, 22 bp, Homo sapiens
ggcgtgtgcatagcgtcctgcc

SEQ ID NO: 2906471 - DNA, 14 bp, Homo sapiens
ggcgttctcctgct

SEQ ID NO: 2906472 - DNA, 16 bp, Homo sapiens
ggcgttggatttaaaa

SEQ ID NO: 2906473 - DNA, 11 bp, Homo sapiens
ggctaaatgaa

SEQ ID NO: 2906474 - DNA, 12 bp, Homo sapiens
ggctaaatgaag

SEQ ID NO: 2906475 - DNA, 21 bp, Homo sapiens
ggctaagatactgctgatgct

SEQ ID NO: 2906476 - DNA, 23 bp, Homo sapiens
ggctaagggggaccatggggagg

SEQ ID NO: 2906477 - DNA, 13 bp, Homo sapiens
ggctaatttttgt

SEQ ID NO: 2906478 - DNA, 16 bp, Homo sapiens
ggctacaaaggaggac

SEQ ID NO: 2906479 - DNA, 16 bp, Homo sapiens
ggctactcagcagccc

SEQ ID NO: 2906480 - DNA, 18 bp, Homo sapiens
ggctactcagcagccctc

SEQ ID NO: 2906481 - DNA, 17 bp, Homo sapiens
ggctagagggcccaaag

SEQ ID NO: 2906482 - DNA, 19 bp, Homo sapiens
ggctagattctaacatatt

SEQ ID NO: 2906483 - DNA, 15 bp, Homo sapiens
ggctagctggagcct

SEQ ID NO: 2906484 - DNA, 17 bp, Homo sapiens
ggctagctggagcctgg

SEQ ID NO: 2906485 - DNA, 20 bp, Homo sapiens
ggctaggacgttggcctcag

SEQ ID NO: 2906486 - DNA, 15 bp, Homo sapiens
ggctagggaggacca

SEQ ID NO: 2906487 - DNA, 16 bp, Homo sapiens
ggctagggtggggaga

SEQ ID NO: 2906488 - DNA, 23 bp, Homo sapiens
ggctaggtatcattcaactctcc

SEQ ID NO: 2906489 - DNA, 23 bp, Homo sapiens
ggctagtggggtgaacagctggt

SEQ ID NO: 2906490 - DNA, 13 bp, Homo sapiens
ggctattcacaac

SEQ ID NO: 2906491 - DNA, 13 bp, Homo sapiens
ggctcacacctgt

SEQ ID NO: 2906492 - DNA, 22 bp, Homo sapiens
ggctcacgccccgctgtgtcct

SEQ ID NO: 2906493 - DNA, 22 bp, Homo sapiens
ggctcacgcctgtaatcccagc

SEQ ID NO: 2906494 - DNA, 19 bp, Homo sapiens
ggctcagaagagcagcttc

SEQ ID NO: 2906495 - DNA, 23 bp, Homo sapiens
ggctcagagagtacactgtgtct

SEQ ID NO: 2906496 - DNA, 15 bp, Homo sapiens
ggctcagccagcact

SEQ ID NO: 2906497 - DNA, 20 bp, Homo sapiens
ggctcagctcggggagcctt

SEQ ID NO: 2906498 - DNA, 14 bp, Homo sapiens
ggctcaggcccagc

SEQ ID NO: 2906499 - DNA, 12 bp, Homo sapiens
ggctcagggtgg

SEQ ID NO: 2906500 - DNA, 17 bp, Homo sapiens
ggctccagaatgtgctg

SEQ ID NO: 2906501 - DNA, 18 bp, Homo sapiens
ggctccagaatgtgctgc

SEQ ID NO: 2906502 - DNA, 11 bp, Homo sapiens
ggctccccagg

SEQ ID NO: 2906503 - DNA, 19 bp, Homo sapiens
ggctccccaggaagcccac

SEQ ID NO: 2906504 - DNA, 15 bp, Homo sapiens
ggctcccggaattcc

SEQ ID NO: 2906505 - DNA, 14 bp, Homo sapiens
ggctccctctctcc

SEQ ID NO: 2906506 - DNA, 16 bp, Homo sapiens
ggctccctctctcctg

SEQ ID NO: 2906507 - DNA, 20 bp, Homo sapiens
ggctccctctctcctggact

SEQ ID NO: 2906508 - DNA, 16 bp, Homo sapiens
ggctccctcttctttc

SEQ ID NO: 2906509 - DNA, 21 bp, Homo sapiens
ggctccctgtaacctcttcag

SEQ ID NO: 2906510 - DNA, 15 bp, Homo sapiens
ggctccggcctctgc

SEQ ID NO: 2906511 - DNA, 12 bp, Homo sapiens
ggctcctccctc

SEQ ID NO: 2906512 - DNA, 16 bp, Homo sapiens
ggctcctccctccctc

SEQ ID NO: 2906513 - DNA, 12 bp, Homo sapiens
ggctcctctcag

SEQ ID NO: 2906514 - DNA, 21 bp, Homo sapiens
ggctcctgttagctcctcact

SEQ ID NO: 2906515 - DNA, 18 bp, Homo sapiens
ggctcgttgactggctgt

SEQ ID NO: 2906516 - DNA, 17 bp, Homo sapiens
tgcaccgcctgccctcc

SEQ ID NO: 2906517 - DNA, 18 bp, Homo sapiens
tgcaccgcctgccctccc

SEQ ID NO: 2906518 - DNA, 13 bp, Homo sapiens
tgcaccggacagt

SEQ ID NO: 2906519 - DNA, 12 bp, Homo sapiens
tgcaccggggcc

SEQ ID NO: 2906520 - DNA, 16 bp, Homo sapiens
tgcaccggggcctggg

SEQ ID NO: 2906521 - DNA, 14 bp, Homo sapiens
tgcacctcccccca

SEQ ID NO: 2906522 - DNA, 19 bp, Homo sapiens
tgcacctccccccactgca

SEQ ID NO: 2906523 - DNA, 11 bp, Homo sapiens
tgcacctgcat

SEQ ID NO: 2906524 - DNA, 12 bp, Homo sapiens
tgcacctgcctc

SEQ ID NO: 2906525 - DNA, 16 bp, Homo sapiens
tgcacctgcctcagct

SEQ ID NO: 2906526 - DNA, 16 bp, Homo sapiens
tgcacgctcccctcca

SEQ ID NO: 2906527 - DNA, 22 bp, Homo sapiens
tgcacgctcccctccatcccca

SEQ ID NO: 2906528 - DNA, 20 bp, Homo sapiens
tgcacggttcaatggtagat

SEQ ID NO: 2906529 - DNA, 22 bp, Homo sapiens
tgcacggtttcgaagtcattaa

SEQ ID NO: 2906530 - DNA, 19 bp, Homo sapiens
tgcacggtttctgttctgc

SEQ ID NO: 2906531 - DNA, 21 bp, Homo sapiens
tgcacgttaacagcgtgtcaa

SEQ ID NO: 2906532 - DNA, 20 bp, Homo sapiens
tgcacgttatggtgtttctc

SEQ ID NO: 2906533 - DNA, 15 bp, Homo sapiens
tgcacgttgcttcag

SEQ ID NO: 2906534 - DNA, 16 bp, Homo sapiens
tgcactcaagttgttt

SEQ ID NO: 2906535 - DNA, 12 bp, Homo sapiens
tgcactccagcc

SEQ ID NO: 2906536 - DNA, 14 bp, Homo sapiens
tgcactccagcctg

SEQ ID NO: 2906537 - DNA, 15 bp, Homo sapiens
tgcactccagcctgg

SEQ ID NO: 2906538 - DNA, 13 bp, Homo sapiens
tgcactccctggc

SEQ ID NO: 2906539 - DNA, 16 bp, Homo sapiens
tgcactcctcagggca

SEQ ID NO: 2906540 - DNA, 17 bp, Homo sapiens
tgcactgatgctgcccc

SEQ ID NO: 2906541 - DNA, 21 bp, Homo sapiens
tgcactgatgctgcccctcat

SEQ ID NO: 2906542 - DNA, 22 bp, Homo sapiens
tgcactgatgctgcccctcatc

SEQ ID NO: 2906543 - DNA, 13 bp, Homo sapiens
tgcactgctgtaa

SEQ ID NO: 2906544 - DNA, 17 bp, Homo sapiens
tgcactggagccacagg

SEQ ID NO: 2906545 - DNA, 18 bp, Homo sapiens
tgcactggagccacaggc

SEQ ID NO: 2906546 - DNA, 22 bp, Homo sapiens
tgcactggagccacaggcaggg

SEQ ID NO: 2906547 - DNA, 15 bp, Homo sapiens
tgcactggggtggga

SEQ ID NO: 2906548 - DNA, 11 bp, Homo sapiens
tgcactgtctg

SEQ ID NO: 2906549 - DNA, 15 bp, Homo sapiens
tgcactgtgaaggac

SEQ ID NO: 2906550 - DNA, 19 bp, Homo sapiens
tgcactgtgaatcctggca

SEQ ID NO: 2906551 - DNA, 13 bp, Homo sapiens
tgcactgttcccc

SEQ ID NO: 2906552 - DNA, 14 bp, Homo sapiens
tgcactgttccccc

SEQ ID NO: 2906553 - DNA, 21 bp, Homo sapiens
tgcacttaaggcactctgtta

SEQ ID NO: 2906554 - DNA, 12 bp, Homo sapiens
tgcactttgtaa

SEQ ID NO: 2906555 - DNA, 13 bp, Homo sapiens
tgcactttgtaaa

SEQ ID NO: 2906556 - DNA, 13 bp, Homo sapiens
tgcagaaaaagaa

SEQ ID NO: 2906557 - DNA, 14 bp, Homo sapiens
tgcagaaaaagaaa

SEQ ID NO: 2906558 - DNA, 16 bp, Homo sapiens
tgcagaaaaagaaaaa

SEQ ID NO: 2906559 - DNA, 17 bp, Homo sapiens
tgcagaaaagcacctgc

SEQ ID NO: 2906560 - DNA, 18 bp, Homo sapiens
tgcagaaaagcacctgcc

SEQ ID NO: 2906561 - DNA, 20 bp, Homo sapiens
tgcagaaaagcacctgccga

SEQ ID NO: 2906562 - DNA, 21 bp, Homo sapiens
tgcagaaaagcacctgccgac

SEQ ID NO: 2906563 - DNA, 23 bp, Homo sapiens
tgcagaagtattcttttcaatta

SEQ ID NO: 2906564 - DNA, 24 bp, Homo sapiens
tgcagaatctctgcctagaatctt

SEQ ID NO: 2906565 - DNA, 11 bp, Homo sapiens
tgcagaatgta

SEQ ID NO: 2906566 - DNA, 20 bp, Homo sapiens
tgcagaatgtaagtgggccc

SEQ ID NO: 2906567 - DNA, 13 bp, Homo sapiens
tgcagacaggaat

SEQ ID NO: 2906568 - DNA, 15 bp, Homo sapiens
tgcagacaggaatct

SEQ ID NO: 2906569 - DNA, 18 bp, Homo sapiens
tgcagacaggaatcttaa

SEQ ID NO: 2906570 - DNA, 14 bp, Homo sapiens
tgcagaccttactc

SEQ ID NO: 2906571 - DNA, 12 bp, Homo sapiens
tgcagagatcct

SEQ ID NO: 2906572 - DNA, 21 bp, Homo sapiens
tgcagaggaagtacaaactaa

SEQ ID NO: 2906573 - DNA, 16 bp, Homo sapiens
tgcagaggagcccagt

SEQ ID NO: 2906574 - DNA, 17 bp, Homo sapiens
tgcagaggagcccagtg

SEQ ID NO: 2906575 - DNA, 18 bp, Homo sapiens
tgcagaggagcccagtgg

SEQ ID NO: 2906576 - DNA, 14 bp, Homo sapiens
tgcagaggcctggg

SEQ ID NO: 2906577 - DNA, 17 bp, Homo sapiens
tgcagaggtaccctggg

SEQ ID NO: 2906578 - DNA, 11 bp, Homo sapiens
tgcagagtaag

SEQ ID NO: 2906579 - DNA, 20 bp, Homo sapiens
tgcagagtccatttcccaca

SEQ ID NO: 2906580 - DNA, 17 bp, Homo sapiens
tgcagattgcagttctg

SEQ ID NO: 2906581 - DNA, 20 bp, Homo sapiens
tgcagatttctgccttgaaa

SEQ ID NO: 2906582 - DNA, 14 bp, Homo sapiens
tgcagcaatattct

SEQ ID NO: 2906583 - DNA, 18 bp, Homo sapiens
tgcagcaattaaaaattg

SEQ ID NO: 2906584 - DNA, 18 bp, Homo sapiens
tgcagcacatgcgggctc

SEQ ID NO: 2906585 - DNA, 23 bp, Homo sapiens
tgcagcacatgcgggctcgccca

SEQ ID NO: 2906586 - DNA, 21 bp, Homo sapiens
tgcagcaccgaggggcctttg

SEQ ID NO: 2906587 - DNA, 18 bp, Homo sapiens
tgcagcactgctgcctca

SEQ ID NO: 2906588 - DNA, 22 bp, Homo sapiens
tgcagcagattggaaggagaca

SEQ ID NO: 2906589 - DNA, 18 bp, Homo sapiens
tgcagcagggatgccctg

SEQ ID NO: 2906590 - DNA, 19 bp, Homo sapiens
tgcagccagcccagcccag

SEQ ID NO: 2906591 - DNA, 23 bp, Homo sapiens
tgcagccagcccagcccagctgg

SEQ ID NO: 2906592 - DNA, 12 bp, Homo sapiens
tgcagccaggcc

SEQ ID NO: 2906593 - DNA, 13 bp, Homo sapiens
tgcagccaggcct

SEQ ID NO: 2906594 - DNA, 19 bp, Homo sapiens
tgcagcccaccaggagcac

SEQ ID NO: 2906595 - DNA, 15 bp, Homo sapiens
tgcagcccatttctc

SEQ ID NO: 2906596 - DNA, 22 bp, Homo sapiens
tgcagccctgagaaagccctgt

SEQ ID NO: 2906597 - DNA, 21 bp, Homo sapiens
tgcagccttgaactctgggct

SEQ ID NO: 2906598 - DNA, 19 bp, Homo sapiens
tgcagctagtcctagtgaa

SEQ ID NO: 2906599 - DNA, 13 bp, Homo sapiens
tgcagctatctgg

SEQ ID NO: 2906600 - DNA, 14 bp, Homo sapiens
tgcagctcctcagc

SEQ ID NO: 2906601 - DNA, 13 bp, Homo sapiens
tgcagctctgcag

SEQ ID NO: 2906602 - DNA, 20 bp, Homo sapiens
tgcagctctgcagcaatatt

SEQ ID NO: 2906603 - DNA, 15 bp, Homo sapiens
tgcagctggcccact

SEQ ID NO: 2906604 - DNA, 21 bp, Homo sapiens
tgcagctggcccactgctggc

SEQ ID NO: 2906605 - DNA, 23 bp, Homo sapiens
tgcagctggcccactgctggctg

SEQ ID NO: 2906606 - DNA, 17 bp, Homo sapiens
tgcaggaaatggctgtg

SEQ ID NO: 2906607 - DNA, 16 bp, Homo sapiens
tgcaggaaggaaaact

SEQ ID NO: 2906608 - DNA, 15 bp, Homo sapiens
tgcaggacagctctt

SEQ ID NO: 2906609 - DNA, 16 bp, Homo sapiens
tgcaggacctgcctgt

SEQ ID NO: 2906610 - DNA, 13 bp, Homo sapiens
tgcaggacttgag

SEQ ID NO: 2906611 - DNA, 17 bp, Homo sapiens
tgcaggagacattttca

SEQ ID NO: 2906612 - DNA, 17 bp, Homo sapiens
tgcaggagcagggcggc

SEQ ID NO: 2906613 - DNA, 14 bp, Homo sapiens
tgcaggagctagtt

SEQ ID NO: 2906614 - DNA, 13 bp, Homo sapiens
tgcaggagggcac

SEQ ID NO: 2906615 - DNA, 20 bp, Homo sapiens
tgcaggatttttagagcatt

SEQ ID NO: 2906616 - DNA, 22 bp, Homo sapiens
tgcaggatttttagagcattaa

SEQ ID NO: 2906617 - DNA, 12 bp, Homo sapiens
tgcaggcagtgt

SEQ ID NO: 2906618 - DNA, 19 bp, Homo sapiens
tgcaggccccgcttgtcca

SEQ ID NO: 2906619 - DNA, 17 bp, Homo sapiens
tgcaggcctaggtgcag

SEQ ID NO: 2906620 - DNA, 14 bp, Homo sapiens
tgcaggcggccctc

SEQ ID NO: 2906621 - DNA, 17 bp, Homo sapiens
tgcaggcggccctcagt

SEQ ID NO: 2906622 - DNA, 18 bp, Homo sapiens
tgcaggcggccctcagtg

SEQ ID NO: 2906623 - DNA, 19 bp, Homo sapiens
tgcaggctgcaggagggca

SEQ ID NO: 2906624 - DNA, 19 bp, Homo sapiens
tgcaggctggccagccgct

SEQ ID NO: 2906625 - DNA, 19 bp, Homo sapiens
tgcagggccatggctcagg

SEQ ID NO: 2906626 - DNA, 12 bp, Homo sapiens
tgcagggctggt

SEQ ID NO: 2906627 - DNA, 15 bp, Homo sapiens
tgcaggggactgggc

SEQ ID NO: 2906628 - DNA, 17 bp, Homo sapiens
tgcaggggactgggcca

SEQ ID NO: 2906629 - DNA, 20 bp, Homo sapiens
tgcaggggactgggccatgg

SEQ ID NO: 2906630 - DNA, 15 bp, Homo sapiens
tgcagggtcctcttc

SEQ ID NO: 2906631 - DNA, 16 bp, Homo sapiens
tgcaggtgaaacccag

SEQ ID NO: 2906632 - DNA, 23 bp, Homo sapiens
tgcaggtgtggagagagaggctt

SEQ ID NO: 2906633 - DNA, 20 bp, Homo sapiens
tgcaggtttgaccaggaaag

SEQ ID NO: 2906634 - DNA, 18 bp, Homo sapiens
tgcagtaaatcttttaca

SEQ ID NO: 2906635 - DNA, 20 bp, Homo sapiens
tgcagtagattttctttaaa

SEQ ID NO: 2906636 - DNA, 16 bp, Homo sapiens
tgcagtaggggaggag

SEQ ID NO: 2906637 - DNA, 13 bp, Homo sapiens
tgcagtatatttc

SEQ ID NO: 2906638 - DNA, 17 bp, Homo sapiens
tgcagtatggtacattt

SEQ ID NO: 2906639 - DNA, 18 bp, Homo sapiens
tgcagtcatcaacaatga

SEQ ID NO: 2906640 - DNA, 17 bp, Homo sapiens
tgcagtccatttcctaa

SEQ ID NO: 2906641 - DNA, 22 bp, Homo sapiens
tgcagtcgcttgccaaagcaga

SEQ ID NO: 2906642 - DNA, 15 bp, Homo sapiens
tgcagtcggcatgcc

SEQ ID NO: 2906643 - DNA, 21 bp, Homo sapiens
tgcagtcggcatgccaggacc

SEQ ID NO: 2906644 - DNA, 14 bp, Homo sapiens
tgcagtctccgcct

SEQ ID NO: 2906645 - DNA, 18 bp, Homo sapiens
tgcagtctccgcctcctg

SEQ ID NO: 2906646 - DNA, 16 bp, Homo sapiens
tgcagtctttccccca

SEQ ID NO: 2906647 - DNA, 16 bp, Homo sapiens
tgcagtggcctggccg

SEQ ID NO: 2906648 - DNA, 18 bp, Homo sapiens
tgcagtggcgcattctag

SEQ ID NO: 2906649 - DNA, 13 bp, Homo sapiens
tgcagtggggttt

SEQ ID NO: 2906650 - DNA, 23 bp, Homo sapiens
tgcagtggggtttcgcagcctga

SEQ ID NO: 2906651 - DNA, 13 bp, Homo sapiens
tgcagttcttgag

SEQ ID NO: 2906652 - DNA, 16 bp, Homo sapiens
tgcagtttaagatgac

SEQ ID NO: 2906653 - DNA, 19 bp, Homo sapiens
tgcagtttaagatgacact

SEQ ID NO: 2906654 - DNA, 21 bp, Homo sapiens
tgcagtttatatatatgctac

SEQ ID NO: 2906655 - DNA, 16 bp, Homo sapiens
tgcagtttatcattca

SEQ ID NO: 2906656 - DNA, 17 bp, Homo sapiens
tgcagtttatcattcaa

SEQ ID NO: 2906657 - DNA, 19 bp, Homo sapiens
tgcagtttatcattcaagt

SEQ ID NO: 2906658 - DNA, 14 bp, Homo sapiens
tgcagtttgaaatt

SEQ ID NO: 2906659 - DNA, 21 bp, Homo sapiens
tgcagttttggtttgatgtaa

SEQ ID NO: 2906660 - DNA, 13 bp, Homo sapiens
tgcagttttgtaa

SEQ ID NO: 2906661 - DNA, 22 bp, Homo sapiens
tgcataaaagggtcaaacctgt

SEQ ID NO: 2906662 - DNA, 19 bp, Homo sapiens
tgcataaacaatccaaatg

SEQ ID NO: 2906663 - DNA, 18 bp, Homo sapiens
tgcataagtgaaaatctt

SEQ ID NO: 2906664 - DNA, 22 bp, Homo sapiens
tgcataagtgaaaatcttacaa

SEQ ID NO: 2906665 - DNA, 12 bp, Homo sapiens
tgcatacacaca

SEQ ID NO: 2906666 - DNA, 13 bp, Homo sapiens
tgcatacacacac

SEQ ID NO: 2906667 - DNA, 16 bp, Homo sapiens
tgcatacgtacattcc

SEQ ID NO: 2906668 - DNA, 15 bp, Homo sapiens
tgcatacttcaaaag

SEQ ID NO: 2906669 - DNA, 18 bp, Homo sapiens
tgcatacttcaaaagtat

SEQ ID NO: 2906670 - DNA, 19 bp, Homo sapiens
tgcatacttcaaaagtatt

SEQ ID NO: 2906671 - DNA, 21 bp, Homo sapiens
tgcatacttcaaaagtatttt

SEQ ID NO: 2906672 - DNA, 22 bp, Homo sapiens
tgcatagcagatggtttccaca

SEQ ID NO: 2906673 - DNA, 16 bp, Homo sapiens
tgcatagcagctgcta

SEQ ID NO: 2906674 - DNA, 18 bp, Homo sapiens
tgcatagcgtcctgccct

SEQ ID NO: 2906675 - DNA, 14 bp, Homo sapiens
tgcatatagaaaac

SEQ ID NO: 2906676 - DNA, 18 bp, Homo sapiens
tgcatatctctagtccct

SEQ ID NO: 2906677 - DNA, 13 bp, Homo sapiens
tgcatatgttgaa

SEQ ID NO: 2906678 - DNA, 15 bp, Homo sapiens
tgcatatgttgaata

SEQ ID NO: 2906679 - DNA, 15 bp, Homo sapiens
tgcatattcaacaca

SEQ ID NO: 2906680 - DNA, 18 bp, Homo sapiens
tgcatattcaacacactg

SEQ ID NO: 2906681 - DNA, 13 bp, Homo sapiens
tgcatattgtaca

SEQ ID NO: 2906682 - DNA, 16 bp, Homo sapiens
tgcatattgtacactt

SEQ ID NO: 2906683 - DNA, 17 bp, Homo sapiens
tgcatattgtacacttt

SEQ ID NO: 2906684 - DNA, 19 bp, Homo sapiens
tgcatattgtacacttttt

SEQ ID NO: 2906685 - DNA, 14 bp, Homo sapiens
tgcatccagaggca

SEQ ID NO: 2906686 - DNA, 14 bp, Homo sapiens
tgcatccattcctc

SEQ ID NO: 2906687 - DNA, 15 bp, Homo sapiens
tgcatctaagcccat

SEQ ID NO: 2906688 - DNA, 16 bp, Homo sapiens
tgcatctaagcccatg

SEQ ID NO: 2906689 - DNA, 17 bp, Homo sapiens
tgcatctaagcccatgg

SEQ ID NO: 2906690 - DNA, 15 bp, Homo sapiens
tgcatctgaccagca

SEQ ID NO: 2906691 - DNA, 17 bp, Homo sapiens
tgcatctgaccagcagc

SEQ ID NO: 2906692 - DNA, 21 bp, Homo sapiens
tgcatctgaccagcagcgcct

SEQ ID NO: 2906693 - DNA, 16 bp, Homo sapiens
tgcatctgataaagtt

SEQ ID NO: 2906694 - DNA, 14 bp, Homo sapiens
tgcatcttactgaa

SEQ ID NO: 2906695 - DNA, 17 bp, Homo sapiens
tgcatcttactgaaggt

SEQ ID NO: 2906696 - DNA, 18 bp, Homo sapiens
tgcatctttttttcattt

SEQ ID NO: 2906697 - DNA, 18 bp, Homo sapiens
tgcatgacacttccaaag

SEQ ID NO: 2906698 - DNA, 17 bp, Homo sapiens
tgcatgacgtttaaggc

SEQ ID NO: 2906699 - DNA, 15 bp, Homo sapiens
tgcatgcaggtctcc

SEQ ID NO: 2906700 - DNA, 23 bp, Homo sapiens
tgcatgctaaattattatttagc

SEQ ID NO: 2906701 - DNA, 14 bp, Homo sapiens
tgcatggagtgttt

SEQ ID NO: 2906702 - DNA, 16 bp, Homo sapiens
tgcatggagtgtttga

SEQ ID NO: 2906703 - DNA, 17 bp, Homo sapiens
tgcatggagtgtttgac

SEQ ID NO: 2906704 - DNA, 22 bp, Homo sapiens
tgcatggcattaattgttcctt

SEQ ID NO: 2906705 - DNA, 16 bp, Homo sapiens
tgcatgggccagcccc

SEQ ID NO: 2906706 - DNA, 18 bp, Homo sapiens
tgcatggtgccccaggac

SEQ ID NO: 2906707 - DNA, 13 bp, Homo sapiens
tgcatggtggcca

SEQ ID NO: 2906708 - DNA, 22 bp, Homo sapiens
tgcatgtaaaatcttcagctgg

SEQ ID NO: 2906709 - DNA, 20 bp, Homo sapiens
tgcatgtaaacacgcctgca

SEQ ID NO: 2906710 - DNA, 13 bp, Homo sapiens
tgcatgtatgtct

SEQ ID NO: 2906711 - DNA, 20 bp, Homo sapiens
tgcatgtcaaacatgagatg

SEQ ID NO: 2906712 - DNA, 16 bp, Homo sapiens
tgcatgtgaagaaagg

SEQ ID NO: 2906713 - DNA, 13 bp, Homo sapiens
tgcatgtgactct

SEQ ID NO: 2906714 - DNA, 14 bp, Homo sapiens
tgcatgtgactctg

SEQ ID NO: 2906715 - DNA, 17 bp, Homo sapiens
tgcatgtgactctgaag

SEQ ID NO: 2906716 - DNA, 19 bp, Homo sapiens
tgcatgtgcgtggaagtgt

SEQ ID NO: 2906717 - DNA, 22 bp, Homo sapiens
tgcatgtgcgtggaagtgttcc

SEQ ID NO: 2906718 - DNA, 23 bp, Homo sapiens
tgcatgtgcgtggaagtgttcct

SEQ ID NO: 2906719 - DNA, 12 bp, Homo sapiens
tgcatgtgtata

SEQ ID NO: 2906720 - DNA, 17 bp, Homo sapiens
tgcatgtgtatatatgt

SEQ ID NO: 2906721 - DNA, 22 bp, Homo sapiens
tgcatgtgtgcgtgtctccatg

SEQ ID NO: 2906722 - DNA, 14 bp, Homo sapiens
tgcatgtttgctgt

SEQ ID NO: 2906723 - DNA, 14 bp, Homo sapiens
tgcattaaattcac

SEQ ID NO: 2906724 - DNA, 15 bp, Homo sapiens
tgcattaaattcaca

SEQ ID NO: 2906725 - DNA, 20 bp, Homo sapiens
tgcattaaattcacaaactt

SEQ ID NO: 2906726 - DNA, 23 bp, Homo sapiens
tgcattcctgtaacttttaatcc

SEQ ID NO: 2906727 - DNA, 13 bp, Homo sapiens
tgcattctatcgt

SEQ ID NO: 2906728 - DNA, 13 bp, Homo sapiens
tgcattgaacaca

SEQ ID NO: 2906729 - DNA, 22 bp, Homo sapiens
tgcattgaacacaaactgtaaa

SEQ ID NO: 2906730 - DNA, 17 bp, Homo sapiens
tgcattgatattgtgaa

SEQ ID NO: 2906731 - DNA, 18 bp, Homo sapiens
tgcattgggattttagaa

SEQ ID NO: 2906732 - DNA, 22 bp, Homo sapiens
tgcatttaaatacagtcttcca

SEQ ID NO: 2906733 - DNA, 24 bp, Homo sapiens
tgcatttaaatacagtcttccatt

SEQ ID NO: 2906734 - DNA, 19 bp, Homo sapiens
tgcatttattgcagtttat

SEQ ID NO: 2906735 - DNA, 20 bp, Homo sapiens
tgcatttcacatgccttgca

SEQ ID NO: 2906736 - DNA, 19 bp, Homo sapiens
tgcatttctatgccatttt

SEQ ID NO: 2906737 - DNA, 18 bp, Homo sapiens
tgcatttgatttgtttag

SEQ ID NO: 2906738 - DNA, 17 bp, Homo sapiens
tgcatttgtaccttatt

SEQ ID NO: 2906739 - DNA, 18 bp, Homo sapiens
tgcatttgtgctagaaat

SEQ ID NO: 2906740 - DNA, 23 bp, Homo sapiens
tgcattttggagagtttcctgaa

SEQ ID NO: 2906741 - DNA, 16 bp, Homo sapiens
tgcattttgtgtacag

SEQ ID NO: 2906742 - DNA, 13 bp, Homo sapiens
tgcattttgtttg

SEQ ID NO: 2906743 - DNA, 14 bp, Homo sapiens
tgcatttttctgca

SEQ ID NO: 2906744 - DNA, 21 bp, Homo sapiens
tgcatttttttcattactgtt

SEQ ID NO: 2906745 - DNA, 20 bp, Homo sapiens
tgccaaaaaaagacagggct

SEQ ID NO: 2906746 - DNA, 19 bp, Homo sapiens
tgccaaaaaggatacataa

SEQ ID NO: 2906747 - DNA, 19 bp, Homo sapiens
tgccaaaacatttatgaca

SEQ ID NO: 2906748 - DNA, 17 bp, Homo sapiens
tgccaaatataaataaa

SEQ ID NO: 2906749 - DNA, 18 bp, Homo sapiens
tgccaaatataaataaaa

SEQ ID NO: 2906750 - DNA, 18 bp, Homo sapiens
tgccaaattgattgtcat

SEQ ID NO: 2906751 - DNA, 18 bp, Homo sapiens
tgccaacaagaatgcatt

SEQ ID NO: 2906752 - DNA, 19 bp, Homo sapiens
tgccaaccccacccagctc

SEQ ID NO: 2906753 - DNA, 21 bp, Homo sapiens
tgccaaccccacccagctcca

SEQ ID NO: 2906754 - DNA, 14 bp, Homo sapiens
tgccaactgtggct

SEQ ID NO: 2906755 - DNA, 17 bp, Homo sapiens
tgccaactgtggctggt

SEQ ID NO: 2906756 - DNA, 16 bp, Homo sapiens
tgccaagaaaatgaag

SEQ ID NO: 2906757 - DNA, 19 bp, Homo sapiens
tgccaagaaatcgccttat

SEQ ID NO: 2906758 - DNA, 23 bp, Homo sapiens
tgccaagcaaggaaaacttattt

SEQ ID NO: 2906759 - DNA, 15 bp, Homo sapiens
tgccaagcagtgcac

SEQ ID NO: 2906760 - DNA, 21 bp, Homo sapiens
tgccaagggctttgttttgca

SEQ ID NO: 2906761 - DNA, 18 bp, Homo sapiens
tgccaagtcctgcctttg

SEQ ID NO: 2906762 - DNA, 19 bp, Homo sapiens
tgccaatattaaatctgct

SEQ ID NO: 2906763 - DNA, 21 bp, Homo sapiens
tgccaatattaaatctgctgg

SEQ ID NO: 2906764 - DNA, 16 bp, Homo sapiens
tgccaatctgtacaaa

SEQ ID NO: 2906765 - DNA, 22 bp, Homo sapiens
tgccaatgttgtgtgttgcact

SEQ ID NO: 2906766 - DNA, 17 bp, Homo sapiens
tgccaatttttgccttc

SEQ ID NO: 2906767 - DNA, 18 bp, Homo sapiens
tgccacaacgcctggcta

SEQ ID NO: 2906768 - DNA, 18 bp, Homo sapiens
tgccacacattgtgcttg

SEQ ID NO: 2906769 - DNA, 18 bp, Homo sapiens
tgccacagagtgtagcca

SEQ ID NO: 2906770 - DNA, 16 bp, Homo sapiens
tgccacatcttaaact

SEQ ID NO: 2906771 - DNA, 15 bp, Homo sapiens
tgccacattagaact

SEQ ID NO: 2906772 - DNA, 18 bp, Homo sapiens
tgccaccactataaaatg

SEQ ID NO: 2906773 - DNA, 16 bp, Homo sapiens
tgccacccacctccct

SEQ ID NO: 2906774 - DNA, 20 bp, Homo sapiens
tgccacccacctccctgcct

SEQ ID NO: 2906775 - DNA, 21 bp, Homo sapiens
tgccacccacctccctgcctc

SEQ ID NO: 2906776 - DNA, 22 bp, Homo sapiens
tgccacccacctccctgcctcc

SEQ ID NO: 2906777 - DNA, 22 bp, Homo sapiens
tgccacccccagccctggcccc

SEQ ID NO: 2906778 - DNA, 15 bp, Homo sapiens
tgccaccgactgccc

SEQ ID NO: 2906779 - DNA, 21 bp, Homo sapiens
tgccacctcccctatccaccc

SEQ ID NO: 2906780 - DNA, 22 bp, Homo sapiens
tgccacctcccctatccaccca

SEQ ID NO: 2906781 - DNA, 23 bp, Homo sapiens
tgccactaagagattgcacagtc

SEQ ID NO: 2906782 - DNA, 17 bp, Homo sapiens
tgccactcctccctccg

SEQ ID NO: 2906783 - DNA, 12 bp, Homo sapiens
tgccactctgct

SEQ ID NO: 2906784 - DNA, 20 bp, Homo sapiens
tgccactctgctgcctgtac

SEQ ID NO: 2906785 - DNA, 16 bp, Homo sapiens
tgccactgcactccag

SEQ ID NO: 2906786 - DNA, 20 bp, Homo sapiens
tgccactggcaaatgtaact

SEQ ID NO: 2906787 - DNA, 19 bp, Homo sapiens
tgccactggggaaaactcc

SEQ ID NO: 2906788 - DNA, 13 bp, Homo sapiens
tgccactttttca

SEQ ID NO: 2906789 - DNA, 13 bp, Homo sapiens
tgccagaaggaag

SEQ ID NO: 2906790 - DNA, 18 bp, Homo sapiens
tggagttttttgtaccaa

SEQ ID NO: 2906791 - DNA, 15 bp, Homo sapiens
tggataaaaaagaaa

SEQ ID NO: 2906792 - DNA, 16 bp, Homo sapiens
tggataaaaaagaaaa

SEQ ID NO: 2906793 - DNA, 17 bp, Homo sapiens
tggataaaaaagaaaac

SEQ ID NO: 2906794 - DNA, 14 bp, Homo sapiens
tggataaactgagc

SEQ ID NO: 2906795 - DNA, 15 bp, Homo sapiens
tggataaactgagcc

SEQ ID NO: 2906796 - DNA, 16 bp, Homo sapiens
tggataaactgagcct

SEQ ID NO: 2906797 - DNA, 15 bp, Homo sapiens
tggataaatttgaac

SEQ ID NO: 2906798 - DNA, 14 bp, Homo sapiens
tggataaccaggct

SEQ ID NO: 2906799 - DNA, 21 bp, Homo sapiens
tggataaccaggctgggctca

SEQ ID NO: 2906800 - DNA, 16 bp, Homo sapiens
tggataataaaaattg

SEQ ID NO: 2906801 - DNA, 19 bp, Homo sapiens
tggataatcttaaattttg

SEQ ID NO: 2906802 - DNA, 18 bp, Homo sapiens
tggataatgctgttgcct

SEQ ID NO: 2906803 - DNA, 18 bp, Homo sapiens
tggatacagcagtagaca

SEQ ID NO: 2906804 - DNA, 18 bp, Homo sapiens
tggatacatacaccagca

SEQ ID NO: 2906805 - DNA, 17 bp, Homo sapiens
tggataccagctcaggg

SEQ ID NO: 2906806 - DNA, 18 bp, Homo sapiens
tggataccagctcagggg

SEQ ID NO: 2906807 - DNA, 12 bp, Homo sapiens
tggatagccttg

SEQ ID NO: 2906808 - DNA, 18 bp, Homo sapiens
tggatagccttgaaaaca

SEQ ID NO: 2906809 - DNA, 19 bp, Homo sapiens
tggatataaattaattgtg

SEQ ID NO: 2906810 - DNA, 22 bp, Homo sapiens
tggatcccgttcagaaaaccac

SEQ ID NO: 2906811 - DNA, 18 bp, Homo sapiens
tggatcctcagttctcaa

SEQ ID NO: 2906812 - DNA, 19 bp, Homo sapiens
tggatcctgggctgggtgg

SEQ ID NO: 2906813 - DNA, 11 bp, Homo sapiens
tggatctattt

SEQ ID NO: 2906814 - DNA, 15 bp, Homo sapiens
tggatctggggactg

SEQ ID NO: 2906815 - DNA, 19 bp, Homo sapiens
tggatcttttctaaatgtt

SEQ ID NO: 2906816 - DNA, 17 bp, Homo sapiens
tggatgagccctcagaa

SEQ ID NO: 2906817 - DNA, 16 bp, Homo sapiens
tggatgatacagtgtt

SEQ ID NO: 2906818 - DNA, 20 bp, Homo sapiens
tggatgatggtcttcagcct

SEQ ID NO: 2906819 - DNA, 17 bp, Homo sapiens
tggatgatgtttcgtga

SEQ ID NO: 2906820 - DNA, 21 bp, Homo sapiens
tggatgccaatattaaatctg

SEQ ID NO: 2906821 - DNA, 18 bp, Homo sapiens
tggatgcggccattcaag

SEQ ID NO: 2906822 - DNA, 16 bp, Homo sapiens
tggatgctctttcaat

SEQ ID NO: 2906823 - DNA, 16 bp, Homo sapiens
tggatgcttagaggga

SEQ ID NO: 2906824 - DNA, 21 bp, Homo sapiens
tggatgcttagagggatttct

SEQ ID NO: 2906825 - DNA, 15 bp, Homo sapiens
tggatgggaatttgt

SEQ ID NO: 2906826 - DNA, 17 bp, Homo sapiens
tggatgggaatttgtca

SEQ ID NO: 2906827 - DNA, 14 bp, Homo sapiens
tggatggtgacttt

SEQ ID NO: 2906828 - DNA, 18 bp, Homo sapiens
tggatggtgacttttgaa

SEQ ID NO: 2906829 - DNA, 16 bp, Homo sapiens
tggatgtctgaacttt

SEQ ID NO: 2906830 - DNA, 13 bp, Homo sapiens
tggatgtgagcag

SEQ ID NO: 2906831 - DNA, 16 bp, Homo sapiens
tggatgtgttgcccct

SEQ ID NO: 2906832 - DNA, 15 bp, Homo sapiens
tggattaaacttatg

SEQ ID NO: 2906833 - DNA, 17 bp, Homo sapiens
tggattaaacttatgaa

SEQ ID NO: 2906834 - DNA, 17 bp, Homo sapiens
tggattagcctttgaca

SEQ ID NO: 2906835 - DNA, 22 bp, Homo sapiens
tggattagtgaactaagttatt

SEQ ID NO: 2906836 - DNA, 14 bp, Homo sapiens
tggattccaaacca

SEQ ID NO: 2906837 - DNA, 19 bp, Homo sapiens
tggattccccatctcaggc

SEQ ID NO: 2906838 - DNA, 19 bp, Homo sapiens
tggattctccctgggcctc

SEQ ID NO: 2906839 - DNA, 22 bp, Homo sapiens
tggattctcttagctactgtat

SEQ ID NO: 2906840 - DNA, 15 bp, Homo sapiens
tggatttccactgct

SEQ ID NO: 2906841 - DNA, 20 bp, Homo sapiens
tggatttccttctaacatgt

SEQ ID NO: 2906842 - DNA, 14 bp, Homo sapiens
tggatttcttttgt

SEQ ID NO: 2906843 - DNA, 14 bp, Homo sapiens
tggatttgtccaaa

SEQ ID NO: 2906844 - DNA, 21 bp, Homo sapiens
tggatttgtccaaacaggtgc

SEQ ID NO: 2906845 - DNA, 16 bp, Homo sapiens
tggatttttaattaaa

SEQ ID NO: 2906846 - DNA, 19 bp, Homo sapiens
tggatttttaattaaaaac

SEQ ID NO: 2906847 - DNA, 22 bp, Homo sapiens
tggatttttttgtcattaaaat

SEQ ID NO: 2906848 - DNA, 21 bp, Homo sapiens
tggcaaaaggatctttgtggc

SEQ ID NO: 2906849 - DNA, 14 bp, Homo sapiens
tggcaaacatgtgc

SEQ ID NO: 2906850 - DNA, 16 bp, Homo sapiens
tggcaaacgggcttga

SEQ ID NO: 2906851 - DNA, 19 bp, Homo sapiens
tggcaacactgaaggaaca

SEQ ID NO: 2906852 - DNA, 20 bp, Homo sapiens
tggcaacagaaaacaattgt

SEQ ID NO: 2906853 - DNA, 18 bp, Homo sapiens
tggcaacagatctggaac

SEQ ID NO: 2906854 - DNA, 22 bp, Homo sapiens
tggcaacagatctggaacctca

SEQ ID NO: 2906855 - DNA, 16 bp, Homo sapiens
tggcaacattcattgc

SEQ ID NO: 2906856 - DNA, 16 bp, Homo sapiens
tggcaacattccaaga

SEQ ID NO: 2906857 - DNA, 16 bp, Homo sapiens
tggcaagactgtctta

SEQ ID NO: 2906858 - DNA, 11 bp, Homo sapiens
tggcaaggaaa

SEQ ID NO: 2906859 - DNA, 16 bp, Homo sapiens
tggcaaggaaaaacag

SEQ ID NO: 2906860 - DNA, 19 bp, Homo sapiens
tggcaatgccatcatctcc

SEQ ID NO: 2906861 - DNA, 20 bp, Homo sapiens
tggcacatagtgggccttca

SEQ ID NO: 2906862 - DNA, 19 bp, Homo sapiens
tggcacatcctatgcaata

SEQ ID NO: 2906863 - DNA, 14 bp, Homo sapiens
tggcaccagacacc

SEQ ID NO: 2906864 - DNA, 16 bp, Homo sapiens
tggcaccagacaccca

SEQ ID NO: 2906865 - DNA, 20 bp, Homo sapiens
tggcaccagacacccaggac

SEQ ID NO: 2906866 - DNA, 21 bp, Homo sapiens
tggcaccagacacccaggact

SEQ ID NO: 2906867 - DNA, 23 bp, Homo sapiens
tggcaccagacacccaggactta

SEQ ID NO: 2906868 - DNA, 23 bp, Homo sapiens
tggcaccgcctccccacctccag

SEQ ID NO: 2906869 - DNA, 16 bp, Homo sapiens
tggcacgatctcagct

SEQ ID NO: 2906870 - DNA, 18 bp, Homo sapiens
tggcacgatctcagctca

SEQ ID NO: 2906871 - DNA, 22 bp, Homo sapiens
tggcacgcacctgtagtcccag

SEQ ID NO: 2906872 - DNA, 23 bp, Homo sapiens
tggcacgcacctgtagtcccagc

SEQ ID NO: 2906873 - DNA, 12 bp, Homo sapiens
tggcactaggga

SEQ ID NO: 2906874 - DNA, 15 bp, Homo sapiens
tggcactatttttat

SEQ ID NO: 2906875 - DNA, 15 bp, Homo sapiens
tggcactccctccag

SEQ ID NO: 2906876 - DNA, 20 bp, Homo sapiens
tggcactccctccagcacaa

SEQ ID NO: 2906877 - DNA, 14 bp, Homo sapiens
tggcactttagtga

SEQ ID NO: 2906878 - DNA, 19 bp, Homo sapiens
tggcagaactgctggggct

SEQ ID NO: 2906879 - DNA, 15 bp, Homo sapiens
tggcagactgtgtaa

SEQ ID NO: 2906880 - DNA, 13 bp, Homo sapiens
tggcagagcttct

SEQ ID NO: 2906881 - DNA, 17 bp, Homo sapiens
tggcagagtttgtgtgt

SEQ ID NO: 2906882 - DNA, 20 bp, Homo sapiens
tggcagcagagtgtggcctt

SEQ ID NO: 2906883 - DNA, 15 bp, Homo sapiens
tggcagccacacgca

SEQ ID NO: 2906884 - DNA, 15 bp, Homo sapiens
tggcagccccagcac

SEQ ID NO: 2906885 - DNA, 15 bp, Homo sapiens
tggcagcctgcacct

SEQ ID NO: 2906886 - DNA, 22 bp, Homo sapiens
tggcagctctggacagccccac

SEQ ID NO: 2906887 - DNA, 23 bp, Homo sapiens
tggcagctgcccctcctggagca

SEQ ID NO: 2906888 - DNA, 20 bp, Homo sapiens
tggcagctgcccctggcacc

SEQ ID NO: 2906889 - DNA, 13 bp, Homo sapiens
tggcagctgggcc

SEQ ID NO: 2906890 - DNA, 12 bp, Homo sapiens
tggcaggaaggc

SEQ ID NO: 2906891 - DNA, 15 bp, Homo sapiens
tggcaggaaggcttg

SEQ ID NO: 2906892 - DNA, 12 bp, Homo sapiens
tggcaggatcca

SEQ ID NO: 2906893 - DNA, 20 bp, Homo sapiens
tggcaggcaggctcccaggg

SEQ ID NO: 2906894 - DNA, 18 bp, Homo sapiens
tggcaggcggggggggcg

SEQ ID NO: 2906895 - DNA, 14 bp, Homo sapiens
tggcagggcctagc

SEQ ID NO: 2906896 - DNA, 21 bp, Homo sapiens
tggcagggggtgaaggcagga

SEQ ID NO: 2906897 - DNA, 15 bp, Homo sapiens
tggcaggtcactgtc

SEQ ID NO: 2906898 - DNA, 22 bp, Homo sapiens
tggcaggtcactgtcactgccg

SEQ ID NO: 2906899 - DNA, 14 bp, Homo sapiens
tggcagtgatgaat

SEQ ID NO: 2906900 - DNA, 11 bp, Homo sapiens
tggcagtgttt

SEQ ID NO: 2906901 - DNA, 18 bp, Homo sapiens
tggcagtgttttgagaac

SEQ ID NO: 2906902 - DNA, 20 bp, Homo sapiens
tggcagttggaggacacagt

SEQ ID NO: 2906903 - DNA, 21 bp, Homo sapiens
tggcagttttgacatcagcca

SEQ ID NO: 2906904 - DNA, 16 bp, Homo sapiens
tggcatatagtgccct

SEQ ID NO: 2906905 - DNA, 21 bp, Homo sapiens
tggcatccagagtccctgcct

SEQ ID NO: 2906906 - DNA, 20 bp, Homo sapiens
tggcatccagggctgccagg

SEQ ID NO: 2906907 - DNA, 22 bp, Homo sapiens
tggcatccagggctgccaggag

SEQ ID NO: 2906908 - DNA, 13 bp, Homo sapiens
tggcatcctgtga

SEQ ID NO: 2906909 - DNA, 14 bp, Homo sapiens
tggcatctgtgtgc

SEQ ID NO: 2906910 - DNA, 23 bp, Homo sapiens
tggcatcttcgtcttcactctta

SEQ ID NO: 2906911 - DNA, 18 bp, Homo sapiens
tggcatggaaggggcttc

SEQ ID NO: 2906912 - DNA, 23 bp, Homo sapiens
tggcatgtgggttgtgatattga

SEQ ID NO: 2906913 - DNA, 12 bp, Homo sapiens
tggcatgtttaa

SEQ ID NO: 2906914 - DNA, 17 bp, Homo sapiens
tggcatgtttaattgtg

SEQ ID NO: 2906915 - DNA, 16 bp, Homo sapiens
tggcattctacacctg

SEQ ID NO: 2906916 - DNA, 14 bp, Homo sapiens
tggcattgatctta

SEQ ID NO: 2906917 - DNA, 21 bp, Homo sapiens
tggcatttcaattcctggccc

SEQ ID NO: 2906918 - DNA, 14 bp, Homo sapiens
tggcatttgaacta

SEQ ID NO: 2906919 - DNA, 18 bp, Homo sapiens
tggcatttgctggcctgg

SEQ ID NO: 2906920 - DNA, 17 bp, Homo sapiens
tggcatttttagctcct

SEQ ID NO: 2906921 - DNA, 14 bp, Homo sapiens
tggccaaagagcct

SEQ ID NO: 2906922 - DNA, 11 bp, Homo sapiens
tggggctgaac

SEQ ID NO: 2906923 - DNA, 14 bp, Homo sapiens
tggggctgctcctc

SEQ ID NO: 2906924 - DNA, 13 bp, Homo sapiens
tggggctggtgga

SEQ ID NO: 2906925 - DNA, 17 bp, Homo sapiens
tggggcttgaatttgca

SEQ ID NO: 2906926 - DNA, 18 bp, Homo sapiens
tggggcttgaatttgcat

SEQ ID NO: 2906927 - DNA, 22 bp, Homo sapiens
tggggcttgaatttgcatgtct

SEQ ID NO: 2906928 - DNA, 23 bp, Homo sapiens
tggggctttcgtccacagcttcc

SEQ ID NO: 2906929 - DNA, 12 bp, Homo sapiens
tgggggaaaaag

SEQ ID NO: 2906930 - DNA, 21 bp, Homo sapiens
tgggggacatgctaaataact

SEQ ID NO: 2906931 - DNA, 23 bp, Homo sapiens
tgggggacatgctaaataactat

SEQ ID NO: 2906932 - DNA, 17 bp, Homo sapiens
tgggggacgtttctcat

SEQ ID NO: 2906933 - DNA, 18 bp, Homo sapiens
tgggggagattgaacttt

SEQ ID NO: 2906934 - DNA, 12 bp, Homo sapiens
tgggggagccag

SEQ ID NO: 2906935 - DNA, 21 bp, Homo sapiens
tgggggagggactgctgaccc

SEQ ID NO: 2906936 - DNA, 14 bp, Homo sapiens
tgggggccaggcct

SEQ ID NO: 2906937 - DNA, 20 bp, Homo sapiens
tgggggctagaaaaaacata

SEQ ID NO: 2906938 - DNA, 16 bp, Homo sapiens
tgggggctggaggtgc

SEQ ID NO: 2906939 - DNA, 21 bp, Homo sapiens
tgggggctgtctttgcagggc

SEQ ID NO: 2906940 - DNA, 20 bp, Homo sapiens
tggggggaaataccttgagc

SEQ ID NO: 2906941 - DNA, 19 bp, Homo sapiens
tgggggggagaaggcctcc

SEQ ID NO: 2906942 - DNA, 17 bp, Homo sapiens
tgggggggctgcctttg

SEQ ID NO: 2906943 - DNA, 19 bp, Homo sapiens
tgggggggtgttaatttat

SEQ ID NO: 2906944 - DNA, 20 bp, Homo sapiens
tgggggtaaaaaatatagcc

SEQ ID NO: 2906945 - DNA, 14 bp, Homo sapiens
tgggggtgccagga

SEQ ID NO: 2906946 - DNA, 16 bp, Homo sapiens
tgggggttcaggcccg

SEQ ID NO: 2906947 - DNA, 21 bp, Homo sapiens
tggggtaagcggaataaacta

SEQ ID NO: 2906948 - DNA, 22 bp, Homo sapiens
tggggtaccagccactggaggg

SEQ ID NO: 2906949 - DNA, 22 bp, Homo sapiens
tggggtcaagctgagctggctt

SEQ ID NO: 2906950 - DNA, 18 bp, Homo sapiens
tggggtcatgccctcctc

SEQ ID NO: 2906951 - DNA, 17 bp, Homo sapiens
tggggtcccactgctcg

SEQ ID NO: 2906952 - DNA, 21 bp, Homo sapiens
tggggtcctagcccagtgctt

SEQ ID NO: 2906953 - DNA, 16 bp, Homo sapiens
tggggtcctggccatc

SEQ ID NO: 2906954 - DNA, 19 bp, Homo sapiens
tggggtctccctctcctgc

SEQ ID NO: 2906955 - DNA, 21 bp, Homo sapiens
tggggtctccctctcctgcct

SEQ ID NO: 2906956 - DNA, 20 bp, Homo sapiens
tggggtgaacagctggtgcc

SEQ ID NO: 2906957 - DNA, 20 bp, Homo sapiens
tggggtggcgcgcctgcctt

SEQ ID NO: 2906958 - DNA, 15 bp, Homo sapiens
tggggtgggggccag

SEQ ID NO: 2906959 - DNA, 16 bp, Homo sapiens
tggggtgggggtgggc

SEQ ID NO: 2906960 - DNA, 14 bp, Homo sapiens
tggggttcagcccc

SEQ ID NO: 2906961 - DNA, 17 bp, Homo sapiens
tggggttcagcccctcc

SEQ ID NO: 2906962 - DNA, 19 bp, Homo sapiens
tggggttcataggggcagg

SEQ ID NO: 2906963 - DNA, 14 bp, Homo sapiens
tggggttgtgttgt

SEQ ID NO: 2906964 - DNA, 14 bp, Homo sapiens
tgggtaaaattaga

SEQ ID NO: 2906965 - DNA, 15 bp, Homo sapiens
tgggtaaaattagat

SEQ ID NO: 2906966 - DNA, 19 bp, Homo sapiens
tgggtacttcttgaaggtg

SEQ ID NO: 2906967 - DNA, 22 bp, Homo sapiens
tgggtagaagccacccttccct

SEQ ID NO: 2906968 - DNA, 23 bp, Homo sapiens
tgggtagaagccacccttccctg

SEQ ID NO: 2906969 - DNA, 16 bp, Homo sapiens
tgggtaggccccacaa

SEQ ID NO: 2906970 - DNA, 20 bp, Homo sapiens
tgggtatcaagacatagcat

SEQ ID NO: 2906971 - DNA, 19 bp, Homo sapiens
tgggtcacacacggaggca

SEQ ID NO: 2906972 - DNA, 14 bp, Homo sapiens
tgggtcacaggaag

SEQ ID NO: 2906973 - DNA, 15 bp, Homo sapiens
tgggtcacaggaagg

SEQ ID NO: 2906974 - DNA, 23 bp, Homo sapiens
tgggtcagatttatttgtttgat

SEQ ID NO: 2906975 - DNA, 13 bp, Homo sapiens
tgggtcattttta

SEQ ID NO: 2906976 - DNA, 15 bp, Homo sapiens
tgggtcctgcctgca

SEQ ID NO: 2906977 - DNA, 15 bp, Homo sapiens
tgggtcctgggcagg

SEQ ID NO: 2906978 - DNA, 19 bp, Homo sapiens
tgggtcgggagaggggacg

SEQ ID NO: 2906979 - DNA, 18 bp, Homo sapiens
tgggtctattccagctca

SEQ ID NO: 2906980 - DNA, 14 bp, Homo sapiens
tgggtctctggaag

SEQ ID NO: 2906981 - DNA, 20 bp, Homo sapiens
tgggtcttgccatgtgctgg

SEQ ID NO: 2906982 - DNA, 17 bp, Homo sapiens
tgggtctttttctcttc

SEQ ID NO: 2906983 - DNA, 14 bp, Homo sapiens
tgggtgaaggctgg

SEQ ID NO: 2906984 - DNA, 15 bp, Homo sapiens
tgggtgaaggctggc

SEQ ID NO: 2906985 - DNA, 13 bp, Homo sapiens
tgggtgccctgaa

SEQ ID NO: 2906986 - DNA, 14 bp, Homo sapiens
tgggtggagaagcc

SEQ ID NO: 2906987 - DNA, 17 bp, Homo sapiens
tgggtggagaagccatt

SEQ ID NO: 2906988 - DNA, 21 bp, Homo sapiens
tgggtggggctgctcctccag

SEQ ID NO: 2906989 - DNA, 21 bp, Homo sapiens
tgggtggggggcttcatacac

SEQ ID NO: 2906990 - DNA, 22 bp, Homo sapiens
tgggtggtgtcctgaagctgct

SEQ ID NO: 2906991 - DNA, 21 bp, Homo sapiens
tgggtggtttgtgagccttgc

SEQ ID NO: 2906992 - DNA, 19 bp, Homo sapiens
tgggtggtttttattttta

SEQ ID NO: 2906993 - DNA, 15 bp, Homo sapiens
tgggtgtttcagttt

SEQ ID NO: 2906994 - DNA, 23 bp, Homo sapiens
tgggttacagtatgcttgctcta

SEQ ID NO: 2906995 - DNA, 22 bp, Homo sapiens
tgggttctgcctgccagctgca

SEQ ID NO: 2906996 - DNA, 15 bp, Homo sapiens
tgggttgctaactga

SEQ ID NO: 2906997 - DNA, 17 bp, Homo sapiens
tgggttgctaactgaac

SEQ ID NO: 2906998 - DNA, 20 bp, Homo sapiens
tgggtttacaacaaacactg

SEQ ID NO: 2906999 - DNA, 14 bp, Homo sapiens
tgggtttggcccct

SEQ ID NO: 2907000 - DNA, 14 bp, Homo sapiens
tgggtttttaactc

SEQ ID NO: 2907001 - DNA, 22 bp, Homo sapiens
tggtaaaatagtggatctcagt

SEQ ID NO: 2907002 - DNA, 23 bp, Homo sapiens
tggtaaaatagtggatctcagtt

SEQ ID NO: 2907003 - DNA, 21 bp, Homo sapiens
tggtaaagaaaagcctcagct

SEQ ID NO: 2907004 - DNA, 17 bp, Homo sapiens
tggtaaagactggcttt

SEQ ID NO: 2907005 - DNA, 20 bp, Homo sapiens
tggtaaatttccccaacagt

SEQ ID NO: 2907006 - DNA, 23 bp, Homo sapiens
tggtaaatttccccaacagtgtg

SEQ ID NO: 2907007 - DNA, 13 bp, Homo sapiens
tggtaacagctat

SEQ ID NO: 2907008 - DNA, 13 bp, Homo sapiens
tggtaagcagagg

SEQ ID NO: 2907009 - DNA, 16 bp, Homo sapiens
tggtaagcagaggctt

SEQ ID NO: 2907010 - DNA, 14 bp, Homo sapiens
tggtaatatatata

SEQ ID NO: 2907011 - DNA, 15 bp, Homo sapiens
tggtacaacggaggc

SEQ ID NO: 2907012 - DNA, 15 bp, Homo sapiens
tggtacaggtatatt

SEQ ID NO: 2907013 - DNA, 15 bp, Homo sapiens
tggtaccagataaaa

SEQ ID NO: 2907014 - DNA, 20 bp, Homo sapiens
tggtacgtgaccctctgctg

SEQ ID NO: 2907015 - DNA, 17 bp, Homo sapiens
tggtactccctctcagg

SEQ ID NO: 2907016 - DNA, 16 bp, Homo sapiens
tggtagaaaatgcacc

SEQ ID NO: 2907017 - DNA, 14 bp, Homo sapiens
tggtagagtttatt

SEQ ID NO: 2907018 - DNA, 21 bp, Homo sapiens
tggtagatttcctcctcccag

SEQ ID NO: 2907019 - DNA, 20 bp, Homo sapiens
tggtagccatcaagcacttc

SEQ ID NO: 2907020 - DNA, 14 bp, Homo sapiens
tggtagctccagcg

SEQ ID NO: 2907021 - DNA, 18 bp, Homo sapiens
tggtagctccagcgatgg

SEQ ID NO: 2907022 - DNA, 22 bp, Homo sapiens
tggtagctgaaaaaactatatt

SEQ ID NO: 2907023 - DNA, 21 bp, Homo sapiens
tggtagctgaggggacgggca

SEQ ID NO: 2907024 - DNA, 16 bp, Homo sapiens
tggtaggcatttccta

SEQ ID NO: 2907025 - DNA, 15 bp, Homo sapiens
tggtaggtaaatcta

SEQ ID NO: 2907026 - DNA, 22 bp, Homo sapiens
tggtaggtactttttgtgaaga

SEQ ID NO: 2907027 - DNA, 14 bp, Homo sapiens
tggtagtaaaacac

SEQ ID NO: 2907028 - DNA, 19 bp, Homo sapiens
tggtagtaaaacacagagg

SEQ ID NO: 2907029 - DNA, 15 bp, Homo sapiens
tggtataagtaactt

SEQ ID NO: 2907030 - DNA, 13 bp, Homo sapiens
tggtatatataca

SEQ ID NO: 2907031 - DNA, 14 bp, Homo sapiens
tggtatatatacat

SEQ ID NO: 2907032 - DNA, 22 bp, Homo sapiens
tggtatctagacccatcttctt

SEQ ID NO: 2907033 - DNA, 14 bp, Homo sapiens
tggtatgtgccagg

SEQ ID NO: 2907034 - DNA, 17 bp, Homo sapiens
tggtattgtgagatgat

SEQ ID NO: 2907035 - DNA, 22 bp, Homo sapiens
tggtatttgtttgtagctttcc

SEQ ID NO: 2907036 - DNA, 16 bp, Homo sapiens
tggtcaacctcctgga

SEQ ID NO: 2907037 - DNA, 12 bp, Homo sapiens
tggtcacatgga

SEQ ID NO: 2907038 - DNA, 13 bp, Homo sapiens
tggtcacatggag

SEQ ID NO: 2907039 - DNA, 16 bp, Homo sapiens
tggtcactctgccctc

SEQ ID NO: 2907040 - DNA, 15 bp, Homo sapiens
tggtcagccctaggg

SEQ ID NO: 2907041 - DNA, 19 bp, Homo sapiens
tggtcagccctagggtgga

SEQ ID NO: 2907042 - DNA, 20 bp, Homo sapiens
tggtcatgaattcatactct

SEQ ID NO: 2907043 - DNA, 16 bp, Homo sapiens
tggtccaaaaaaagga

SEQ ID NO: 2907044 - DNA, 18 bp, Homo sapiens
tggtccaaaaaaaggaaa

SEQ ID NO: 2907045 - DNA, 19 bp, Homo sapiens
tggtccaaaaaaaggaaaa

SEQ ID NO: 2907046 - DNA, 20 bp, Homo sapiens
tggtccaaaaaaaggaaaaa

SEQ ID NO: 2907047 - DNA, 21 bp, Homo sapiens
tggtccaaaaaaaggaaaaat

SEQ ID NO: 2907048 - DNA, 14 bp, Homo sapiens
tggtccacagggca

SEQ ID NO: 2907049 - DNA, 21 bp, Homo sapiens
tggtccacagggcacctgcca

SEQ ID NO: 2907050 - DNA, 12 bp, Homo sapiens
tggtccaccctt

SEQ ID NO: 2907051 - DNA, 16 bp, Homo sapiens
tggtccaggagaaggc

SEQ ID NO: 2907052 - DNA, 16 bp, Homo sapiens
tggtccaggccctgtg

SEQ ID NO: 2907053 - DNA, 20 bp, Homo sapiens
tggtcccacccaggaaggga

SEQ ID NO: 2907054 - DNA, 22 bp, Homo sapiens
tggtccctccagaaccaccccg

SEQ ID NO: 2907055 - DNA, 14 bp, Homo sapiens
tggtccctgggagg

SEQ ID NO: 2907056 - DNA, 18 bp, Homo sapiens
tggtccctggtccttcac

SEQ ID NO: 2907057 - DNA, 20 bp, Homo sapiens
tggtcctatttttgtgaaga

SEQ ID NO: 2907058 - DNA, 16 bp, Homo sapiens
tggtgtttctccctct

SEQ ID NO: 2907059 - DNA, 20 bp, Homo sapiens
tggtgttttggggatgagag

SEQ ID NO: 2907060 - DNA, 15 bp, Homo sapiens
tggtgtttttacaga

SEQ ID NO: 2907061 - DNA, 16 bp, Homo sapiens
tggtgtttttcttgta

SEQ ID NO: 2907062 - DNA, 18 bp, Homo sapiens
tggtgtttttcttgtaaa

SEQ ID NO: 2907063 - DNA, 13 bp, Homo sapiens
tggttaagagtcc

SEQ ID NO: 2907064 - DNA, 15 bp, Homo sapiens
tggttataaaagtga

SEQ ID NO: 2907065 - DNA, 20 bp, Homo sapiens
tggttataaaagtgattgtt

SEQ ID NO: 2907066 - DNA, 14 bp, Homo sapiens
tggttatcttgtta

SEQ ID NO: 2907067 - DNA, 12 bp, Homo sapiens
tggttatgaact

SEQ ID NO: 2907068 - DNA, 22 bp, Homo sapiens
tggttatttagggaactgcttg

SEQ ID NO: 2907069 - DNA, 17 bp, Homo sapiens
tggttcactcttggagc

SEQ ID NO: 2907070 - DNA, 22 bp, Homo sapiens
tggttcactcttggagcctgca

SEQ ID NO: 2907071 - DNA, 14 bp, Homo sapiens
tggttcagtctaga

SEQ ID NO: 2907072 - DNA, 14 bp, Homo sapiens
tggttcattccaca

SEQ ID NO: 2907073 - DNA, 19 bp, Homo sapiens
tggttccagatacttcagc

SEQ ID NO: 2907074 - DNA, 22 bp, Homo sapiens
tggttctaaggacctgaaattc

SEQ ID NO: 2907075 - DNA, 14 bp, Homo sapiens
tggttctcaatgaa

SEQ ID NO: 2907076 - DNA, 15 bp, Homo sapiens
tggttctcaatgaaa

SEQ ID NO: 2907077 - DNA, 12 bp, Homo sapiens
tggttgaagaag

SEQ ID NO: 2907078 - DNA, 15 bp, Homo sapiens
tggttgatgtttaaa

SEQ ID NO: 2907079 - DNA, 20 bp, Homo sapiens
tggttgcacttatgatttca

SEQ ID NO: 2907080 - DNA, 22 bp, Homo sapiens
tggttgcagtctttcccccagg

SEQ ID NO: 2907081 - DNA, 22 bp, Homo sapiens
tggttgccagtagtaccttgtt

SEQ ID NO: 2907082 - DNA, 23 bp, Homo sapiens
tggttgccagtagtaccttgttt

SEQ ID NO: 2907083 - DNA, 13 bp, Homo sapiens
tggttgtatataa

SEQ ID NO: 2907084 - DNA, 17 bp, Homo sapiens
tggttgtatataaagtt

SEQ ID NO: 2907085 - DNA, 12 bp, Homo sapiens
tggttgtgtagg

SEQ ID NO: 2907086 - DNA, 15 bp, Homo sapiens
tggttgtttctctga

SEQ ID NO: 2907087 - DNA, 23 bp, Homo sapiens
tggtttaatgcaatagaagtgct

SEQ ID NO: 2907088 - DNA, 24 bp, Homo sapiens
tggtttataatttgatagatgttt

SEQ ID NO: 2907089 - DNA, 16 bp, Homo sapiens
tggtttatttgttgtt

SEQ ID NO: 2907090 - DNA, 21 bp, Homo sapiens
tggtttcctgcccagcctggg

SEQ ID NO: 2907091 - DNA, 11 bp, Homo sapiens
tggtttcttat

SEQ ID NO: 2907092 - DNA, 16 bp, Homo sapiens
tggtttcttattcaaa

SEQ ID NO: 2907093 - DNA, 16 bp, Homo sapiens
tggtttgggaaagatg

SEQ ID NO: 2907094 - DNA, 22 bp, Homo sapiens
tggtttgtgagccttgctgcca

SEQ ID NO: 2907095 - DNA, 11 bp, Homo sapiens
tggtttgtgtg

SEQ ID NO: 2907096 - DNA, 11 bp, Homo sapiens
tggttttacta

SEQ ID NO: 2907097 - DNA, 20 bp, Homo sapiens
tggttttcgtcatcttccct

SEQ ID NO: 2907098 - DNA, 22 bp, Homo sapiens
tggttttcgtcatcttccctgc

SEQ ID NO: 2907099 - DNA, 14 bp, Homo sapiens
tggttttcttaagg

SEQ ID NO: 2907100 - DNA, 11 bp, Homo sapiens
tggttttggaa

SEQ ID NO: 2907101 - DNA, 20 bp, Homo sapiens
tggtttttaaattttgtaat

SEQ ID NO: 2907102 - DNA, 14 bp, Homo sapiens
tggtttttgctctc

SEQ ID NO: 2907103 - DNA, 13 bp, Homo sapiens
tgtatacttaata

SEQ ID NO: 2907104 - DNA, 23 bp, Homo sapiens
tgtatacttaatactgaatttct

SEQ ID NO: 2907105 - DNA, 14 bp, Homo sapiens
tgtatagttcacgt

SEQ ID NO: 2907106 - DNA, 17 bp, Homo sapiens
tgtatagttttccctat

SEQ ID NO: 2907107 - DNA, 16 bp, Homo sapiens
tgtatataaagttttt

SEQ ID NO: 2907108 - DNA, 12 bp, Homo sapiens
tgtatataaata

SEQ ID NO: 2907109 - DNA, 19 bp, Homo sapiens
tgtatataaatgggaacat

SEQ ID NO: 2907110 - DNA, 20 bp, Homo sapiens
tgtatataaatgggaacatt

SEQ ID NO: 2907111 - DNA, 15 bp, Homo sapiens
tgtatatatatatat

SEQ ID NO: 2907112 - DNA, 21 bp, Homo sapiens
tgtatatatatgtgaggatgt

SEQ ID NO: 2907113 - DNA, 15 bp, Homo sapiens
tgtatatatgtattt

SEQ ID NO: 2907114 - DNA, 17 bp, Homo sapiens
tgtatatatgtatttct

SEQ ID NO: 2907115 - DNA, 15 bp, Homo sapiens
tgtatatatgtcaaa

SEQ ID NO: 2907116 - DNA, 19 bp, Homo sapiens
tgtatatatgtcaaattgt

SEQ ID NO: 2907117 - DNA, 14 bp, Homo sapiens
tgtatatatttaaa

SEQ ID NO: 2907118 - DNA, 15 bp, Homo sapiens
tgtatatgactgcat

SEQ ID NO: 2907119 - DNA, 17 bp, Homo sapiens
tgtatatgactgcattt

SEQ ID NO: 2907120 - DNA, 17 bp, Homo sapiens
tgtatatgattctctgt

SEQ ID NO: 2907121 - DNA, 18 bp, Homo sapiens
tgtatatgattctctgtg

SEQ ID NO: 2907122 - DNA, 20 bp, Homo sapiens
tgtatatggtatatatacat

SEQ ID NO: 2907123 - DNA, 22 bp, Homo sapiens
tgtatatggtattgtgagatga

SEQ ID NO: 2907124 - DNA, 14 bp, Homo sapiens
tgtatatgtgcttg

SEQ ID NO: 2907125 - DNA, 19 bp, Homo sapiens
tgtatatgtgcttgtgctc

SEQ ID NO: 2907126 - DNA, 16 bp, Homo sapiens
tgtatattaaggtgtg

SEQ ID NO: 2907127 - DNA, 20 bp, Homo sapiens
tgtatattacccaatggaaa

SEQ ID NO: 2907128 - DNA, 13 bp, Homo sapiens
tgtatatttaagg

SEQ ID NO: 2907129 - DNA, 15 bp, Homo sapiens
tgtatatttaaggta

SEQ ID NO: 2907130 - DNA, 14 bp, Homo sapiens
tgtatatttatgac

SEQ ID NO: 2907131 - DNA, 19 bp, Homo sapiens
tgtatcagaagagagggga

SEQ ID NO: 2907132 - DNA, 16 bp, Homo sapiens
tgtatcataattacca

SEQ ID NO: 2907133 - DNA, 19 bp, Homo sapiens
tgtatcataattaccaagt

SEQ ID NO: 2907134 - DNA, 22 bp, Homo sapiens
tgtatcatgtgctagattggag

SEQ ID NO: 2907135 - DNA, 17 bp, Homo sapiens
tgtatccattatcatgt

SEQ ID NO: 2907136 - DNA, 20 bp, Homo sapiens
tgtatccattatcatgtgta

SEQ ID NO: 2907137 - DNA, 14 bp, Homo sapiens
tgtatccatttaaa

SEQ ID NO: 2907138 - DNA, 18 bp, Homo sapiens
tgtatcccgggaaggacc

SEQ ID NO: 2907139 - DNA, 19 bp, Homo sapiens
tgtatcctccctggcagac

SEQ ID NO: 2907140 - DNA, 21 bp, Homo sapiens
tgtatcctttatttctgataa

SEQ ID NO: 2907141 - DNA, 20 bp, Homo sapiens
tgtatcgggaagatttctaa

SEQ ID NO: 2907142 - DNA, 15 bp, Homo sapiens
tgtatcgtatagctg

SEQ ID NO: 2907143 - DNA, 22 bp, Homo sapiens
tgtatcgtatagctgtattgaa

SEQ ID NO: 2907144 - DNA, 20 bp, Homo sapiens
tgtatctacatcttttttca

SEQ ID NO: 2907145 - DNA, 13 bp, Homo sapiens
tgtatctcttaaa

SEQ ID NO: 2907146 - DNA, 12 bp, Homo sapiens
tgtatctgtcta

SEQ ID NO: 2907147 - DNA, 14 bp, Homo sapiens
tgtatgaagtactt

SEQ ID NO: 2907148 - DNA, 21 bp, Homo sapiens
tgtatgaagtacttttaacgt

SEQ ID NO: 2907149 - DNA, 17 bp, Homo sapiens
tgtatgagaagtacttt

SEQ ID NO: 2907150 - DNA, 11 bp, Homo sapiens
tgtatgagaca

SEQ ID NO: 2907151 - DNA, 15 bp, Homo sapiens
tgtatgatttataaa

SEQ ID NO: 2907152 - DNA, 12 bp, Homo sapiens
tgtatgcagcta

SEQ ID NO: 2907153 - DNA, 18 bp, Homo sapiens
tgtatgcagctatctggt

SEQ ID NO: 2907154 - DNA, 16 bp, Homo sapiens
tgtatgccaagtgaga

SEQ ID NO: 2907155 - DNA, 14 bp, Homo sapiens
tgtatgctgatcat

SEQ ID NO: 2907156 - DNA, 19 bp, Homo sapiens
tgtatgcttcatacaggga

SEQ ID NO: 2907157 - DNA, 19 bp, Homo sapiens
tgtatggaatcccactgta

SEQ ID NO: 2907158 - DNA, 17 bp, Homo sapiens
tgtatggggaatctaag

SEQ ID NO: 2907159 - DNA, 23 bp, Homo sapiens
tgtatgggggagattgaactttc

SEQ ID NO: 2907160 - DNA, 23 bp, Homo sapiens
tgtatgtaaagttcctgctgtaa

SEQ ID NO: 2907161 - DNA, 14 bp, Homo sapiens
tgtatgtagaagca

SEQ ID NO: 2907162 - DNA, 11 bp, Homo sapiens
tgtatgtctgt

SEQ ID NO: 2907163 - DNA, 13 bp, Homo sapiens
tgtatgtctgtca

SEQ ID NO: 2907164 - DNA, 19 bp, Homo sapiens
tgtatgtcttggacactgt

SEQ ID NO: 2907165 - DNA, 17 bp, Homo sapiens
tgtcacatcaagcatca

SEQ ID NO: 2907166 - DNA, 21 bp, Homo sapiens
tgtcacatcacgaaggaaaac

SEQ ID NO: 2907167 - DNA, 21 bp, Homo sapiens
tgtcacatctatccacactgt

SEQ ID NO: 2907168 - DNA, 15 bp, Homo sapiens
tgtcaccaaggaaac

SEQ ID NO: 2907169 - DNA, 23 bp, Homo sapiens
tgtcaccaaggaaacgctacctc

SEQ ID NO: 2907170 - DNA, 23 bp, Homo sapiens
tgtcaccaccttcccagctctcc

SEQ ID NO: 2907171 - DNA, 23 bp, Homo sapiens
tgtcacccaaaccggcaggtgcg

SEQ ID NO: 2907172 - DNA, 13 bp, Homo sapiens
tgtcacccaaagc

SEQ ID NO: 2907173 - DNA, 18 bp, Homo sapiens
tgtcacccaaagcctgtc

SEQ ID NO: 2907174 - DNA, 22 bp, Homo sapiens
tgtcacccaaagcctgtcccag

SEQ ID NO: 2907175 - DNA, 21 bp, Homo sapiens
tgtcaccccagagccacacat

SEQ ID NO: 2907176 - DNA, 21 bp, Homo sapiens
tgtcaccctggccaccaccca

SEQ ID NO: 2907177 - DNA, 22 bp, Homo sapiens
tgtcacctttcttcttgtgtct

SEQ ID NO: 2907178 - DNA, 13 bp, Homo sapiens
tgtcaccttttct

SEQ ID NO: 2907179 - DNA, 16 bp, Homo sapiens
tgtcaccttttcttgc

SEQ ID NO: 2907180 - DNA, 20 bp, Homo sapiens
tgtcaccttttcttgcctga

SEQ ID NO: 2907181 - DNA, 14 bp, Homo sapiens
tgtcacgaatatgg

SEQ ID NO: 2907182 - DNA, 18 bp, Homo sapiens
tgtcacgaatatggacat

SEQ ID NO: 2907183 - DNA, 19 bp, Homo sapiens
tgtcacgaatatggacata

SEQ ID NO: 2907184 - DNA, 20 bp, Homo sapiens
tgtcactcaaggcggtgctt

SEQ ID NO: 2907185 - DNA, 12 bp, Homo sapiens
tgtcactcaggc

SEQ ID NO: 2907186 - DNA, 16 bp, Homo sapiens
tgtcactcattgctga

SEQ ID NO: 2907187 - DNA, 21 bp, Homo sapiens
tgtcactcattgctgagcctc

SEQ ID NO: 2907188 - DNA, 19 bp, Homo sapiens
tgtcactgccgacatccct

SEQ ID NO: 2907189 - DNA, 13 bp, Homo sapiens
tgtcactgctttt

SEQ ID NO: 2907190 - DNA, 18 bp, Homo sapiens
tgtcactgtacagttttg

SEQ ID NO: 2907191 - DNA, 13 bp, Homo sapiens
tgtcacttgcatg

SEQ ID NO: 2907192 - DNA, 22 bp, Homo sapiens
tgtcagagaagaaaaacgtgag

SEQ ID NO: 2907193 - DNA, 16 bp, Homo sapiens
tgtcagagcccagccc

SEQ ID NO: 2907194 - DNA, 20 bp, Homo sapiens
tgtcagagcccagcccagga

SEQ ID NO: 2907195 - DNA, 15 bp, Homo sapiens
tgtcagagcccaggg

SEQ ID NO: 2907196 - DNA, 15 bp, Homo sapiens
tgtcagatacaatgt

SEQ ID NO: 2907197 - DNA, 12 bp, Homo sapiens
tgtcagcatctg

SEQ ID NO: 2907198 - DNA, 13 bp, Homo sapiens
tgtcagcatctga

SEQ ID NO: 2907199 - DNA, 20 bp, Homo sapiens
tgtcagccaacattgccttg

SEQ ID NO: 2907200 - DNA, 13 bp, Homo sapiens
tgtcagccacctc

SEQ ID NO: 2907201 - DNA, 15 bp, Homo sapiens
tgtcagccacctccc

SEQ ID NO: 2907202 - DNA, 21 bp, Homo sapiens
tgtcagcgcctggcctaccca

SEQ ID NO: 2907203 - DNA, 20 bp, Homo sapiens
tgtcagcgttctaccaggca

SEQ ID NO: 2907204 - DNA, 17 bp, Homo sapiens
tgtcagctctcatctga

SEQ ID NO: 2907205 - DNA, 16 bp, Homo sapiens
tgtcagctgctgttga

SEQ ID NO: 2907206 - DNA, 22 bp, Homo sapiens
tgtcagctgctgttgaactttt

SEQ ID NO: 2907207 - DNA, 15 bp, Homo sapiens
tgtcaggccctctgc

SEQ ID NO: 2907208 - DNA, 16 bp, Homo sapiens
tgtcaggccctctgcc

SEQ ID NO: 2907209 - DNA, 17 bp, Homo sapiens
tgtcaggccctctgcct

SEQ ID NO: 2907210 - DNA, 18 bp, Homo sapiens
tgtcaggccctctgcctg

SEQ ID NO: 2907211 - DNA, 19 bp, Homo sapiens
tgtcaggccctctgcctgc

SEQ ID NO: 2907212 - DNA, 19 bp, Homo sapiens
tgtcagggagggccaggga

SEQ ID NO: 2907213 - DNA, 22 bp, Homo sapiens
tgtcaggggcggggagggtgac

SEQ ID NO: 2907214 - DNA, 16 bp, Homo sapiens
tgtcaggtcccagcga

SEQ ID NO: 2907215 - DNA, 20 bp, Homo sapiens
tgtcaggtcccagcgagcca

SEQ ID NO: 2907216 - DNA, 20 bp, Homo sapiens
tgtcagtactaaggtgactt

SEQ ID NO: 2907217 - DNA, 16 bp, Homo sapiens
tgtcagtcacagccac

SEQ ID NO: 2907218 - DNA, 20 bp, Homo sapiens
tgtcagtggggctctctgag

SEQ ID NO: 2907219 - DNA, 11 bp, Homo sapiens
tgtcagtgttg

SEQ ID NO: 2907220 - DNA, 23 bp, Homo sapiens
tgtcagtgttgcctcttgcaatg

SEQ ID NO: 2907221 - DNA, 19 bp, Homo sapiens
tgtcagtttcagatcctga

SEQ ID NO: 2907222 - DNA, 13 bp, Homo sapiens
tgtcataagcatt

SEQ ID NO: 2907223 - DNA, 23 bp, Homo sapiens
tgtcatagttctgagctgccagt

SEQ ID NO: 2907224 - DNA, 17 bp, Homo sapiens
tgtcatcaacattcttg

SEQ ID NO: 2907225 - DNA, 15 bp, Homo sapiens
tgtcatcagccacca

SEQ ID NO: 2907226 - DNA, 16 bp, Homo sapiens
tgtcatcagtaagtat

SEQ ID NO: 2907227 - DNA, 18 bp, Homo sapiens
tgtcatcgttccccaccc

SEQ ID NO: 2907228 - DNA, 18 bp, Homo sapiens
tgtcatctgcatgtctac

SEQ ID NO: 2907229 - DNA, 12 bp, Homo sapiens
tgtcatgtgtat

SEQ ID NO: 2907230 - DNA, 12 bp, Homo sapiens
tgtcattattcc

SEQ ID NO: 2907231 - DNA, 23 bp, Homo sapiens
tgtcattcccctcttttgtcttc

SEQ ID NO: 2907232 - DNA, 21 bp, Homo sapiens
tgtcatttactcaaaatctgt

SEQ ID NO: 2907233 - DNA, 13 bp, Homo sapiens
tgtcatttctcat

SEQ ID NO: 2907234 - DNA, 15 bp, Homo sapiens
tgtcatttttgaatg

SEQ ID NO: 2907235 - DNA, 23 bp, Homo sapiens
tgtctccatgaggtactggtccc

SEQ ID NO: 2907236 - DNA, 19 bp, Homo sapiens
tgtctcccctaccaggctg

SEQ ID NO: 2907237 - DNA, 20 bp, Homo sapiens
tgtctcccctttccccgcgt

SEQ ID NO: 2907238 - DNA, 23 bp, Homo sapiens
tgtctcgccagaagactcctagg

SEQ ID NO: 2907239 - DNA, 15 bp, Homo sapiens
tgtctctaaaaagaa

SEQ ID NO: 2907240 - DNA, 22 bp, Homo sapiens
tgtctctccttgttgcccccaa

SEQ ID NO: 2907241 - DNA, 14 bp, Homo sapiens
tgtctctgacaaag

SEQ ID NO: 2907242 - DNA, 15 bp, Homo sapiens
tgtctctgagatttt

SEQ ID NO: 2907243 - DNA, 17 bp, Homo sapiens
tgtctctgcctggagca

SEQ ID NO: 2907244 - DNA, 19 bp, Homo sapiens
tgtctctgtatatagctct

SEQ ID NO: 2907245 - DNA, 13 bp, Homo sapiens
tgtctctttcatg

SEQ ID NO: 2907246 - DNA, 22 bp, Homo sapiens
tgtctgaaaaattcctttgtgt

SEQ ID NO: 2907247 - DNA, 14 bp, Homo sapiens
tgtctgagagacca

SEQ ID NO: 2907248 - DNA, 21 bp, Homo sapiens
tgtctgatcgttcaaagcatg

SEQ ID NO: 2907249 - DNA, 14 bp, Homo sapiens
tgtctgcaacatgg

SEQ ID NO: 2907250 - DNA, 12 bp, Homo sapiens
tgtctgcagccc

SEQ ID NO: 2907251 - DNA, 18 bp, Homo sapiens
tgtctgcagccctgagaa

SEQ ID NO: 2907252 - DNA, 21 bp, Homo sapiens
tgtctgcatttcggtggctag

SEQ ID NO: 2907253 - DNA, 16 bp, Homo sapiens
tgtctgccaatttttg

SEQ ID NO: 2907254 - DNA, 23 bp, Homo sapiens
tgtctgcgaagtcctatggaaac

SEQ ID NO: 2907255 - DNA, 14 bp, Homo sapiens
tgtctgctcaatgc

SEQ ID NO: 2907256 - DNA, 18 bp, Homo sapiens
tgtctggaagaagcagcg

SEQ ID NO: 2907257 - DNA, 15 bp, Homo sapiens
tgtctggaggttcct

SEQ ID NO: 2907258 - DNA, 18 bp, Homo sapiens
tgtctggcaaaagaaaaa

SEQ ID NO: 2907259 - DNA, 17 bp, Homo sapiens
tgtctggcacagcctgg

SEQ ID NO: 2907260 - DNA, 15 bp, Homo sapiens
tgtctggccaggcct

SEQ ID NO: 2907261 - DNA, 18 bp, Homo sapiens
tgtctggcctgaggtcaa

SEQ ID NO: 2907262 - DNA, 19 bp, Homo sapiens
tgtctgggtttggcccaag

SEQ ID NO: 2907263 - DNA, 22 bp, Homo sapiens
tgtctgggtttggcccaagact

SEQ ID NO: 2907264 - DNA, 14 bp, Homo sapiens
tgtctgtaaaaaat

SEQ ID NO: 2907265 - DNA, 17 bp, Homo sapiens
tgtctgtaaatatgttt

SEQ ID NO: 2907266 - DNA, 15 bp, Homo sapiens
tgtctgtacacgtgt

SEQ ID NO: 2907267 - DNA, 13 bp, Homo sapiens
tgtctgtcattgt

SEQ ID NO: 2907268 - DNA, 11 bp, Homo sapiens
tgtctgtcttc

SEQ ID NO: 2907269 - DNA, 14 bp, Homo sapiens
tgtctgtcttctcc

SEQ ID NO: 2907270 - DNA, 15 bp, Homo sapiens
tgtctgtcttctcct

SEQ ID NO: 2907271 - DNA, 23 bp, Homo sapiens
tgtctgtggttgcagtctttccc

SEQ ID NO: 2907272 - DNA, 17 bp, Homo sapiens
tgtctgtgtgattttca

SEQ ID NO: 2907273 - DNA, 12 bp, Homo sapiens
tgtctgttacac

SEQ ID NO: 2907274 - DNA, 17 bp, Homo sapiens
tgtctgttacactggag

SEQ ID NO: 2907275 - DNA, 14 bp, Homo sapiens
tgtcttaaatcagt

SEQ ID NO: 2907276 - DNA, 17 bp, Homo sapiens
tgtcttaaatcagttta

SEQ ID NO: 2907277 - DNA, 19 bp, Homo sapiens
tgtcttaaatcagtttatt

SEQ ID NO: 2907278 - DNA, 17 bp, Homo sapiens
tgtcttaaggagactgg

SEQ ID NO: 2907279 - DNA, 17 bp, Homo sapiens
tgtcttaatactgtcct

SEQ ID NO: 2907280 - DNA, 17 bp, Homo sapiens
tgtcttatggattcatt

SEQ ID NO: 2907281 - DNA, 13 bp, Homo sapiens
tgtcttcaaggct

SEQ ID NO: 2907282 - DNA, 19 bp, Homo sapiens
tgtcttcggccgagctggt

SEQ ID NO: 2907283 - DNA, 17 bp, Homo sapiens
tgtggccaaggagctgc

SEQ ID NO: 2907284 - DNA, 18 bp, Homo sapiens
tgtggccaaggagctgct

SEQ ID NO: 2907285 - DNA, 20 bp, Homo sapiens
tgtggccaaggagctgctat

SEQ ID NO: 2907286 - DNA, 17 bp, Homo sapiens
tgtggcccccgccccct

SEQ ID NO: 2907287 - DNA, 17 bp, Homo sapiens
tgtggccctggcctgct

SEQ ID NO: 2907288 - DNA, 16 bp, Homo sapiens
tgtggccctgtcctgc

SEQ ID NO: 2907289 - DNA, 17 bp, Homo sapiens
tgtggcctgcacagtga

SEQ ID NO: 2907290 - DNA, 13 bp, Homo sapiens
tgtggcctgccca

SEQ ID NO: 2907291 - DNA, 15 bp, Homo sapiens
tgtggcctgcccagc

SEQ ID NO: 2907292 - DNA, 17 bp, Homo sapiens
tgtggcctgcccagcct

SEQ ID NO: 2907293 - DNA, 13 bp, Homo sapiens
tgtggctccctct

SEQ ID NO: 2907294 - DNA, 14 bp, Homo sapiens
tgtggctccctctc

SEQ ID NO: 2907295 - DNA, 22 bp, Homo sapiens
tgtggctccctctctcctggac

SEQ ID NO: 2907296 - DNA, 13 bp, Homo sapiens
tgtggctgtgccc

SEQ ID NO: 2907297 - DNA, 22 bp, Homo sapiens
tgtggcttctctgtctctgtgg

SEQ ID NO: 2907298 - DNA, 16 bp, Homo sapiens
tgtgggaaaaaagaaa

SEQ ID NO: 2907299 - DNA, 17 bp, Homo sapiens
tgtgggaaaaaagaaaa

SEQ ID NO: 2907300 - DNA, 17 bp, Homo sapiens
tgtgggaatctcccaga

SEQ ID NO: 2907301 - DNA, 15 bp, Homo sapiens
tgtgggaatttaaga

SEQ ID NO: 2907302 - DNA, 18 bp, Homo sapiens
tgtgggaccccaggccca

SEQ ID NO: 2907303 - DNA, 15 bp, Homo sapiens
tgtggggaggctgca

SEQ ID NO: 2907304 - DNA, 15 bp, Homo sapiens
tgtgggttgtgatat

SEQ ID NO: 2907305 - DNA, 18 bp, Homo sapiens
tgtggtcagcggtatgtg

SEQ ID NO: 2907306 - DNA, 23 bp, Homo sapiens
tgtggtctgccaatctgtacaaa

SEQ ID NO: 2907307 - DNA, 17 bp, Homo sapiens
tgtggtctttttcctga

SEQ ID NO: 2907308 - DNA, 18 bp, Homo sapiens
tgtggtgggcgctgggga

SEQ ID NO: 2907309 - DNA, 15 bp, Homo sapiens
tgtggtgtctgcctg

SEQ ID NO: 2907310 - DNA, 13 bp, Homo sapiens
tgtggtgtgccat

SEQ ID NO: 2907311 - DNA, 17 bp, Homo sapiens
tgtggtgttagggtgca

SEQ ID NO: 2907312 - DNA, 16 bp, Homo sapiens
tgtgtaaaaaatggaa

SEQ ID NO: 2907313 - DNA, 17 bp, Homo sapiens
tgtgtaaaaaatggaaa

SEQ ID NO: 2907314 - DNA, 20 bp, Homo sapiens
tgtgtaaaaaatggaaaaaa

SEQ ID NO: 2907315 - DNA, 23 bp, Homo sapiens
tgttattaaacgtatgcatgtga

SEQ ID NO: 2907316 - DNA, 14 bp, Homo sapiens
tgttattagatgtt

SEQ ID NO: 2907317 - DNA, 16 bp, Homo sapiens
tgttattcttttccag

SEQ ID NO: 2907318 - DNA, 13 bp, Homo sapiens
tgttatttctcag

SEQ ID NO: 2907319 - DNA, 18 bp, Homo sapiens
tgttattttctgttgaag

SEQ ID NO: 2907320 - DNA, 17 bp, Homo sapiens
tgttatttttgtatttt

SEQ ID NO: 2907321 - DNA, 22 bp, Homo sapiens
tgttcaaacacaacctactctg

SEQ ID NO: 2907322 - DNA, 17 bp, Homo sapiens
tgttcaacatcactgaa

SEQ ID NO: 2907323 - DNA, 14 bp, Homo sapiens
tgttcacaacctgg

SEQ ID NO: 2907324 - DNA, 14 bp, Homo sapiens
tgttcacactccta

SEQ ID NO: 2907325 - DNA, 17 bp, Homo sapiens
tgttcacagaaaaagca

SEQ ID NO: 2907326 - DNA, 17 bp, Homo sapiens
tgttcacttttgacaaa

SEQ ID NO: 2907327 - DNA, 15 bp, Homo sapiens
tgttcagtgtaaata

SEQ ID NO: 2907328 - DNA, 15 bp, Homo sapiens
tgttcagtgtaattt

SEQ ID NO: 2907329 - DNA, 17 bp, Homo sapiens
tgttcagttacagaaag

SEQ ID NO: 2907330 - DNA, 16 bp, Homo sapiens
tgttcatctctttgtc

SEQ ID NO: 2907331 - DNA, 18 bp, Homo sapiens
tgttcatctctttgtcct

SEQ ID NO: 2907332 - DNA, 18 bp, Homo sapiens
tgttcatgaaggtcctag

SEQ ID NO: 2907333 - DNA, 22 bp, Homo sapiens
tgttcatttagattgaaaactt

SEQ ID NO: 2907334 - DNA, 15 bp, Homo sapiens
tgttccaatgaaaaa

SEQ ID NO: 2907335 - DNA, 18 bp, Homo sapiens
tgttccaatgtcaatgtg

SEQ ID NO: 2907336 - DNA, 14 bp, Homo sapiens
tgttccagtgttta

SEQ ID NO: 2907337 - DNA, 16 bp, Homo sapiens
tgttcccattggatgc

SEQ ID NO: 2907338 - DNA, 20 bp, Homo sapiens
tgttcccattggatgcattt

SEQ ID NO: 2907339 - DNA, 16 bp, Homo sapiens
tgttccccctgtgcag

SEQ ID NO: 2907340 - DNA, 22 bp, Homo sapiens
tgttcccttgaccattggctgc

SEQ ID NO: 2907341 - DNA, 18 bp, Homo sapiens
tgttcctccctcccacac

SEQ ID NO: 2907342 - DNA, 12 bp, Homo sapiens
tgttcctgtctc

SEQ ID NO: 2907343 - DNA, 13 bp, Homo sapiens
tgttcctgtctca

SEQ ID NO: 2907344 - DNA, 18 bp, Homo sapiens
tgttcctgtttattttta

SEQ ID NO: 2907345 - DNA, 22 bp, Homo sapiens
tgttccttagtggtagaggtgt

SEQ ID NO: 2907346 - DNA, 14 bp, Homo sapiens
tgttccttctgtga

SEQ ID NO: 2907347 - DNA, 18 bp, Homo sapiens
tgttccttctgtgaagaa

SEQ ID NO: 2907348 - DNA, 12 bp, Homo sapiens
tgttccttttga

SEQ ID NO: 2907349 - DNA, 21 bp, Homo sapiens
tgttcctttttaaatgtgaat

SEQ ID NO: 2907350 - DNA, 16 bp, Homo sapiens
tgttcgaagttcattt

SEQ ID NO: 2907351 - DNA, 22 bp, Homo sapiens
tgttcgcatggtcacacactga

SEQ ID NO: 2907352 - DNA, 13 bp, Homo sapiens
tgttcggagctct

SEQ ID NO: 2907353 - DNA, 18 bp, Homo sapiens
tgttcggttttgttgttc

SEQ ID NO: 2907354 - DNA, 14 bp, Homo sapiens
tgttctaagatgtg

SEQ ID NO: 2907355 - DNA, 22 bp, Homo sapiens
tgttctaagatgtgatattcta

SEQ ID NO: 2907356 - DNA, 12 bp, Homo sapiens
tgttctaaggct

SEQ ID NO: 2907357 - DNA, 18 bp, Homo sapiens
tgttctaaggctctgaga

SEQ ID NO: 2907358 - DNA, 19 bp, Homo sapiens
tgttctaaggctctgagag

SEQ ID NO: 2907359 - DNA, 17 bp, Homo sapiens
tgttctaagtctttcca

SEQ ID NO: 2907360 - DNA, 12 bp, Homo sapiens
tgttctaagttt

SEQ ID NO: 2907361 - DNA, 16 bp, Homo sapiens
tgttctaagtttctaa

SEQ ID NO: 2907362 - DNA, 19 bp, Homo sapiens
tgttctaagtttctaagat

SEQ ID NO: 2907363 - DNA, 13 bp, Homo sapiens
tgttctacttgat

SEQ ID NO: 2907364 - DNA, 20 bp, Homo sapiens
tgttctacttgatatttcct

SEQ ID NO: 2907365 - DNA, 17 bp, Homo sapiens
tgttctcggagtgtgta

SEQ ID NO: 2907366 - DNA, 16 bp, Homo sapiens
tgttctcgttgcccta

SEQ ID NO: 2907367 - DNA, 17 bp, Homo sapiens
tgttctcgttgccctaa

SEQ ID NO: 2907368 - DNA, 11 bp, Homo sapiens
tgttctgcctg

SEQ ID NO: 2907369 - DNA, 15 bp, Homo sapiens
tgttctgctgagact

SEQ ID NO: 2907370 - DNA, 21 bp, Homo sapiens
tgttctggggggacccagtgc

SEQ ID NO: 2907371 - DNA, 23 bp, Homo sapiens
tgttctggggggacccagtgcag

SEQ ID NO: 2907372 - DNA, 21 bp, Homo sapiens
tgttctgggtgatttctagaa

SEQ ID NO: 2907373 - DNA, 22 bp, Homo sapiens
tgttctgtggaaagtgtaaagc

SEQ ID NO: 2907374 - DNA, 16 bp, Homo sapiens
tgttcttatagaataa

SEQ ID NO: 2907375 - DNA, 13 bp, Homo sapiens
tgttcttcagaga

SEQ ID NO: 2907376 - DNA, 14 bp, Homo sapiens
tgttcttcgtatat

SEQ ID NO: 2907377 - DNA, 13 bp, Homo sapiens
tgttcttgaagca

SEQ ID NO: 2907378 - DNA, 17 bp, Homo sapiens
tgttcttgaggtctctt

SEQ ID NO: 2907379 - DNA, 11 bp, Homo sapiens
tgttctttata

SEQ ID NO: 2907380 - DNA, 20 bp, Homo sapiens
tgttctttggaaatacacag

SEQ ID NO: 2907381 - DNA, 22 bp, Homo sapiens
tgttcttttaaagactacctgg

SEQ ID NO: 2907382 - DNA, 14 bp, Homo sapiens
tgttctttttattg

SEQ ID NO: 2907383 - DNA, 21 bp, Homo sapiens
tgttgaaaaatatctttgcat

SEQ ID NO: 2907384 - DNA, 19 bp, Homo sapiens
tgttgaaaataatccattt

SEQ ID NO: 2907385 - DNA, 21 bp, Homo sapiens
tgttgaaaatgtatttcctga

SEQ ID NO: 2907386 - DNA, 23 bp, Homo sapiens
tgttgaaagcaaaaatgctaata

SEQ ID NO: 2907387 - DNA, 20 bp, Homo sapiens
tgttgaactttttaaagaag

SEQ ID NO: 2907388 - DNA, 13 bp, Homo sapiens
tgttgaatacttt

SEQ ID NO: 2907389 - DNA, 14 bp, Homo sapiens
tgttgaataggaaa

SEQ ID NO: 2907390 - DNA, 16 bp, Homo sapiens
tgttgacacaggtctt

SEQ ID NO: 2907391 - DNA, 16 bp, Homo sapiens
tgttgacagttctgaa

SEQ ID NO: 2907392 - DNA, 18 bp, Homo sapiens
tgttgacataccttttat

SEQ ID NO: 2907393 - DNA, 18 bp, Homo sapiens
tgttgacatatttaatgt

SEQ ID NO: 2907394 - DNA, 21 bp, Homo sapiens
tgttgacatatttaatgtttt

SEQ ID NO: 2907395 - DNA, 18 bp, Homo sapiens
tgttgaccatgtctatga

SEQ ID NO: 2907396 - DNA, 22 bp, Homo sapiens
tgttgagaatcccaaatttgat

SEQ ID NO: 2907397 - DNA, 23 bp, Homo sapiens
tgttgagcaagcagtagcatttg

SEQ ID NO: 2907398 - DNA, 16 bp, Homo sapiens
tgttgagcatcacaga

SEQ ID NO: 2907399 - DNA, 20 bp, Homo sapiens
tgttgagcatcacagaatgt

SEQ ID NO: 2907400 - DNA, 13 bp, Homo sapiens
tgttgagctgtca

SEQ ID NO: 2907401 - DNA, 19 bp, Homo sapiens
tgttgatcatgtacttttt

SEQ ID NO: 2907402 - DNA, 22 bp, Homo sapiens
tgttgatcatgtactttttagt

SEQ ID NO: 2907403 - DNA, 20 bp, Homo sapiens
tgttgatccatccagcttgc

SEQ ID NO: 2907404 - DNA, 19 bp, Homo sapiens
tgttgattgctaaatgtaa

SEQ ID NO: 2907405 - DNA, 22 bp, Homo sapiens
tgttgatttttactgtgtttta

SEQ ID NO: 2907406 - DNA, 19 bp, Homo sapiens
tgttgcaagtactgctgta

SEQ ID NO: 2907407 - DNA, 17 bp, Homo sapiens
tgttgcaagtgcaataa

SEQ ID NO: 2907408 - DNA, 22 bp, Homo sapiens
tgttgcacacccactcagctcc

SEQ ID NO: 2907409 - DNA, 22 bp, Homo sapiens
tgttgcacttttgaatgtccaa

SEQ ID NO: 2907410 - DNA, 24 bp, Homo sapiens
tgttgcacttttgaatgtccaaaa

SEQ ID NO: 2907411 - DNA, 19 bp, Homo sapiens
tgttgcagtggcctggccg

SEQ ID NO: 2907412 - DNA, 20 bp, Homo sapiens
tgttgcattacgataaacat

SEQ ID NO: 2907413 - DNA, 14 bp, Homo sapiens
tgttgcccaggctg

SEQ ID NO: 2907414 - DNA, 21 bp, Homo sapiens
tgttgcccaggctggagtgca

SEQ ID NO: 2907415 - DNA, 21 bp, Homo sapiens
tgttgccctgtttcctgctgc

SEQ ID NO: 2907416 - DNA, 13 bp, Homo sapiens
tgttgcctcctct

SEQ ID NO: 2907417 - DNA, 15 bp, Homo sapiens
tgttgcctcctctct

SEQ ID NO: 2907418 - DNA, 19 bp, Homo sapiens
tgttgcctcctctctccct

SEQ ID NO: 2907419 - DNA, 20 bp, Homo sapiens
tgttgcctcctctctccctg

SEQ ID NO: 2907420 - DNA, 15 bp, Homo sapiens
tgttgcctcttgcaa

SEQ ID NO: 2907421 - DNA, 18 bp, Homo sapiens
tgttgcctcttgcaatgc

SEQ ID NO: 2907422 - DNA, 21 bp, Homo sapiens
tgttgcgtgacactctccttg

SEQ ID NO: 2907423 - DNA, 17 bp, Homo sapiens
tgttgctctaggaagac

SEQ ID NO: 2907424 - DNA, 21 bp, Homo sapiens
tgttgctctctgtgtctgaga

SEQ ID NO: 2907425 - DNA, 12 bp, Homo sapiens
tgttgctgctgc

SEQ ID NO: 2907426 - DNA, 13 bp, Homo sapiens
tgttgctgctgct

SEQ ID NO: 2907427 - DNA, 14 bp, Homo sapiens
tgttgcttaattgt

SEQ ID NO: 2907428 - DNA, 13 bp, Homo sapiens
tgttgcttacaat

SEQ ID NO: 2907429 - DNA, 12 bp, Homo sapiens
tgaaaatacaac

SEQ ID NO: 2907430 - DNA, 22 bp, Homo sapiens
tgaaaatatgttggaaaaaaga

SEQ ID NO: 2907431 - DNA, 15 bp, Homo sapiens
tgaaaatcactggcc

SEQ ID NO: 2907432 - DNA, 20 bp, Homo sapiens
tgaaaatgaagaaggaagct

SEQ ID NO: 2907433 - DNA, 18 bp, Homo sapiens
tgaaaatgtatttcctga

SEQ ID NO: 2907434 - DNA, 21 bp, Homo sapiens
tgaaaatgtatttcctgaaat

SEQ ID NO: 2907435 - DNA, 13 bp, Homo sapiens
tgaaaatgtcttg

SEQ ID NO: 2907436 - DNA, 15 bp, Homo sapiens
tgaaaatgtcttgtg

SEQ ID NO: 2907437 - DNA, 17 bp, Homo sapiens
tgaaaattgtataaatt

SEQ ID NO: 2907438 - DNA, 22 bp, Homo sapiens
tgaaacaccaagatgtctgtct

SEQ ID NO: 2907439 - DNA, 13 bp, Homo sapiens
tgaaacacttttt

SEQ ID NO: 2907440 - DNA, 12 bp, Homo sapiens
tgaaacagaaaa

SEQ ID NO: 2907441 - DNA, 22 bp, Homo sapiens
tgaaacagaaaaataagtcaaa

SEQ ID NO: 2907442 - DNA, 17 bp, Homo sapiens
tgaaacagctgccttag

SEQ ID NO: 2907443 - DNA, 22 bp, Homo sapiens
tgaaacagctgccttagcttca

SEQ ID NO: 2907444 - DNA, 17 bp, Homo sapiens
tgatttgaagaacatgt

SEQ ID NO: 2907445 - DNA, 23 bp, Homo sapiens
tgatttgcaatgggatgtatgaa

SEQ ID NO: 2907446 - DNA, 14 bp, Homo sapiens
tgatttgcaggatt

SEQ ID NO: 2907447 - DNA, 12 bp, Homo sapiens
tgatttgcattg

SEQ ID NO: 2907448 - DNA, 20 bp, Homo sapiens
tgatttggtgaccaactgtc

SEQ ID NO: 2907449 - DNA, 20 bp, Homo sapiens
tgatttgttgggaccttctg

SEQ ID NO: 2907450 - DNA, 23 bp, Homo sapiens
tgatttgtttagttttgattgtt

SEQ ID NO: 2907451 - DNA, 15 bp, Homo sapiens
tgattttaaaaggtt

SEQ ID NO: 2907452 - DNA, 12 bp, Homo sapiens
tgattttaagag

SEQ ID NO: 2907453 - DNA, 22 bp, Homo sapiens
tgattttacaaattaatatttg

SEQ ID NO: 2907454 - DNA, 23 bp, Homo sapiens
tgattttacaaattaatatttgt

SEQ ID NO: 2907455 - DNA, 20 bp, Homo sapiens
tgattttaggagctaaggct

SEQ ID NO: 2907456 - DNA, 17 bp, Homo sapiens
tgattttatttttgcaa

SEQ ID NO: 2907457 - DNA, 19 bp, Homo sapiens
tgattttatttttgcaaaa

SEQ ID NO: 2907458 - DNA, 10 bp, Homo sapiens
tgattttcat

SEQ ID NO: 2907459 - DNA, 14 bp, Homo sapiens
tgatttttgtgtat

SEQ ID NO: 2907460 - DNA, 20 bp, Homo sapiens
tgatttttgtgtatccagta

SEQ ID NO: 2907461 - DNA, 13 bp, Homo sapiens
tgatttttttcca

SEQ ID NO: 2907462 - DNA, 18 bp, Homo sapiens
tgcaaaaaaattaaaatg

SEQ ID NO: 2907463 - DNA, 19 bp, Homo sapiens
tgcaaaaactacaaccaat

SEQ ID NO: 2907464 - DNA, 23 bp, Homo sapiens
tgcaaaaaggactggaaaaatga

SEQ ID NO: 2907465 - DNA, 13 bp, Homo sapiens
tgcaaaacatttc

SEQ ID NO: 2907466 - DNA, 23 bp, Homo sapiens
tgcaaaagtggggctaaatgaag

SEQ ID NO: 2907467 - DNA, 14 bp, Homo sapiens
tgcaaaatgtctgt

SEQ ID NO: 2907468 - DNA, 21 bp, Homo sapiens
tgcaaaatgtcttgtgtattt

SEQ ID NO: 2907469 - DNA, 22 bp, Homo sapiens
tgcaaacactgtgattactctt

SEQ ID NO: 2907470 - DNA, 12 bp, Homo sapiens
tgcaaacagtgt

SEQ ID NO: 2907471 - DNA, 19 bp, Homo sapiens
tgcaaacgctgcctgccca

SEQ ID NO: 2907472 - DNA, 19 bp, Homo sapiens
tgcaaacttgtatctgaag

SEQ ID NO: 2907473 - DNA, 19 bp, Homo sapiens
tgcaaagaggcaagaggct

SEQ ID NO: 2907474 - DNA, 12 bp, Homo sapiens
tgcaaagtattg

SEQ ID NO: 2907475 - DNA, 16 bp, Homo sapiens
tgcaaagtattgtaaa

SEQ ID NO: 2907476 - DNA, 22 bp, Homo sapiens
tgcaaagtctccagaagaaaat

SEQ ID NO: 2907477 - DNA, 19 bp, Homo sapiens
tgcaaagtggaattaaagg

SEQ ID NO: 2907478 - DNA, 19 bp, Homo sapiens
tgcaaagtttgtgtcaata

SEQ ID NO: 2907479 - DNA, 21 bp, Homo sapiens
tgcaaataagactcttaccta

SEQ ID NO: 2907480 - DNA, 19 bp, Homo sapiens
tgcaaatattagcaaagaa

SEQ ID NO: 2907481 - DNA, 23 bp, Homo sapiens
tgcaaatattagcaaagaagctt

SEQ ID NO: 2907482 - DNA, 17 bp, Homo sapiens
tgcaaatcctatgtgat

SEQ ID NO: 2907483 - DNA, 18 bp, Homo sapiens
tgcaaatcctatgtgatt

SEQ ID NO: 2907484 - DNA, 19 bp, Homo sapiens
tgcaacaacctttccagct

SEQ ID NO: 2907485 - DNA, 13 bp, Homo sapiens
tgcaacacaacat

SEQ ID NO: 2907486 - DNA, 13 bp, Homo sapiens
tgcaacctccgcc

SEQ ID NO: 2907487 - DNA, 21 bp, Homo sapiens
tgcaacctccgccttccgggt

SEQ ID NO: 2907488 - DNA, 14 bp, Homo sapiens
tgcaacctcgctgg

SEQ ID NO: 2907489 - DNA, 20 bp, Homo sapiens
tgcaacctcgctggactctc

SEQ ID NO: 2907490 - DNA, 14 bp, Homo sapiens
tgcaacctctgcct

SEQ ID NO: 2907491 - DNA, 21 bp, Homo sapiens
tgcaacctctgcctcccaggt

SEQ ID NO: 2907492 - DNA, 21 bp, Homo sapiens
tgcaacctctgcctcctgggt

SEQ ID NO: 2907493 - DNA, 14 bp, Homo sapiens
tgcaacctgttgat

SEQ ID NO: 2907494 - DNA, 14 bp, Homo sapiens
tgcaaccttcacct

SEQ ID NO: 2907495 - DNA, 21 bp, Homo sapiens
tgcaacggtctcctgactggt

SEQ ID NO: 2907496 - DNA, 20 bp, Homo sapiens
tgcaactgctcagctctggt

SEQ ID NO: 2907497 - DNA, 14 bp, Homo sapiens
tgcaacttctgcct

SEQ ID NO: 2907498 - DNA, 21 bp, Homo sapiens
tgcaagaactcatcactgtgg

SEQ ID NO: 2907499 - DNA, 23 bp, Homo sapiens
tgcaagaactcatcactgtggct

SEQ ID NO: 2907500 - DNA, 21 bp, Homo sapiens
tgcaagccccaactttcttat

SEQ ID NO: 2907501 - DNA, 23 bp, Homo sapiens
tgcaaggccgctgttcacccaca

SEQ ID NO: 2907502 - DNA, 17 bp, Homo sapiens
tgcaagggcccagagtg

SEQ ID NO: 2907503 - DNA, 15 bp, Homo sapiens
tgcaaggtggctcca

SEQ ID NO: 2907504 - DNA, 14 bp, Homo sapiens
tgcaaggttccaca

SEQ ID NO: 2907505 - DNA, 17 bp, Homo sapiens
tgcaaggttccacagag

SEQ ID NO: 2907506 - DNA, 15 bp, Homo sapiens
tgcaagtactgctgt

SEQ ID NO: 2907507 - DNA, 16 bp, Homo sapiens
tgcaagtgacatctct

SEQ ID NO: 2907508 - DNA, 17 bp, Homo sapiens
tgcaagtgggagatgaa

SEQ ID NO: 2907509 - DNA, 15 bp, Homo sapiens
tgcaagtgtctggag

SEQ ID NO: 2907510 - DNA, 19 bp, Homo sapiens
tgcaagtgtctggagcggc

SEQ ID NO: 2907511 - DNA, 20 bp, Homo sapiens
tgcaagtgtctggagcggct

SEQ ID NO: 2907512 - DNA, 22 bp, Homo sapiens
tgcaagtgtctggagcggctgc

SEQ ID NO: 2907513 - DNA, 17 bp, Homo sapiens
tgcaataacttctatat

SEQ ID NO: 2907514 - DNA, 22 bp, Homo sapiens
tgcaataacttctatattttaa

SEQ ID NO: 2907515 - DNA, 15 bp, Homo sapiens
tgcaataatgcagta

SEQ ID NO: 2907516 - DNA, 18 bp, Homo sapiens
tgcaataatgcagtatgg

SEQ ID NO: 2907517 - DNA, 20 bp, Homo sapiens
tgcaataatgcagtatggta

SEQ ID NO: 2907518 - DNA, 23 bp, Homo sapiens
tgcaatacgggagtgacccagct

SEQ ID NO: 2907519 - DNA, 17 bp, Homo sapiens
tgcaatagtcagagtgt

SEQ ID NO: 2907520 - DNA, 20 bp, Homo sapiens
tgcaatatatctaaattgaa

SEQ ID NO: 2907521 - DNA, 21 bp, Homo sapiens
tgcaatatatctaaattgaat

SEQ ID NO: 2907522 - DNA, 22 bp, Homo sapiens
tgcaatatatctaaattgaata

SEQ ID NO: 2907523 - DNA, 13 bp, Homo sapiens
tgcaatcactgtg

SEQ ID NO: 2907524 - DNA, 14 bp, Homo sapiens
tgcaatcactgtgc

SEQ ID NO: 2907525 - DNA, 16 bp, Homo sapiens
tgcaatcactgtgcta

SEQ ID NO: 2907526 - DNA, 17 bp, Homo sapiens
tgcaatgggatgtatga

SEQ ID NO: 2907527 - DNA, 18 bp, Homo sapiens
tgcaatgggatgtatgaa

SEQ ID NO: 2907528 - DNA, 22 bp, Homo sapiens
tgcaatgggatgtatgaataca

SEQ ID NO: 2907529 - DNA, 19 bp, Homo sapiens
tgcaatggtgactgatttc

SEQ ID NO: 2907530 - DNA, 14 bp, Homo sapiens
tgcaattcaaaagt

SEQ ID NO: 2907531 - DNA, 16 bp, Homo sapiens
tgcaattcaaaagttc

SEQ ID NO: 2907532 - DNA, 15 bp, Homo sapiens
tgcaattcagtgttc

SEQ ID NO: 2907533 - DNA, 14 bp, Homo sapiens
tgcaattctttttg

SEQ ID NO: 2907534 - DNA, 21 bp, Homo sapiens
tgcaattctttttggaaaaga

SEQ ID NO: 2907535 - DNA, 17 bp, Homo sapiens
tgcaatttcaaggttct

SEQ ID NO: 2907536 - DNA, 20 bp, Homo sapiens
tgcaatttcaaggttctaac

SEQ ID NO: 2907537 - DNA, 14 bp, Homo sapiens
tgcaatttctacta

SEQ ID NO: 2907538 - DNA, 18 bp, Homo sapiens
tgcacaaaacccagacct

SEQ ID NO: 2907539 - DNA, 18 bp, Homo sapiens
tgcacaaacttgtgagca

SEQ ID NO: 2907540 - DNA, 19 bp, Homo sapiens
tgcacacagcggctgcctc

SEQ ID NO: 2907541 - DNA, 20 bp, Homo sapiens
tgcacacatcaccaggtgca

SEQ ID NO: 2907542 - DNA, 14 bp, Homo sapiens
tgcacacccactca

SEQ ID NO: 2907543 - DNA, 17 bp, Homo sapiens
tgcacacccactcagct

SEQ ID NO: 2907544 - DNA, 18 bp, Homo sapiens
tgcacacccactcagctc

SEQ ID NO: 2907545 - DNA, 18 bp, Homo sapiens
tgcacacggctggtcact

SEQ ID NO: 2907546 - DNA, 21 bp, Homo sapiens
tgcacacggctggtcactctg

SEQ ID NO: 2907547 - DNA, 23 bp, Homo sapiens
tgcacacggctggtcactctgcc

SEQ ID NO: 2907548 - DNA, 14 bp, Homo sapiens
tgcacagaagtcct

SEQ ID NO: 2907549 - DNA, 22 bp, Homo sapiens
tgcacagaagtcctgtatgtct

SEQ ID NO: 2907550 - DNA, 10 bp, Homo sapiens
tgcacagagg

SEQ ID NO: 2907551 - DNA, 12 bp, Homo sapiens
tgcacagagggc

SEQ ID NO: 2907552 - DNA, 18 bp, Homo sapiens
tgcacagagggcgctcct

SEQ ID NO: 2907553 - DNA, 19 bp, Homo sapiens
tgcacagagggcgctcctg

SEQ ID NO: 2907554 - DNA, 16 bp, Homo sapiens
tgcacagattcccagg

SEQ ID NO: 2907555 - DNA, 17 bp, Homo sapiens
tgcacagattcccaggc

SEQ ID NO: 2907556 - DNA, 19 bp, Homo sapiens
tgcacagattcccaggcca

SEQ ID NO: 2907557 - DNA, 20 bp, Homo sapiens
tgcacagattcccaggccag

SEQ ID NO: 2907558 - DNA, 16 bp, Homo sapiens
tgcacagggcaattga

SEQ ID NO: 2907559 - DNA, 15 bp, Homo sapiens
tgcacaggtctctgt

SEQ ID NO: 2907560 - DNA, 19 bp, Homo sapiens
tgcacaggtggctgtttct

SEQ ID NO: 2907561 - DNA, 18 bp, Homo sapiens
tgcacagtcagaaggacg

SEQ ID NO: 2907562 - DNA, 19 bp, Homo sapiens
tgcacatagcagactagaa

SEQ ID NO: 2907563 - DNA, 15 bp, Homo sapiens
tgcacatatggactc

SEQ ID NO: 2907564 - DNA, 16 bp, Homo sapiens
tgcacatgaagaaata

SEQ ID NO: 2907565 - DNA, 19 bp, Homo sapiens
tgcacatgtcttgtacatg

SEQ ID NO: 2907566 - DNA, 12 bp, Homo sapiens
tgcacattgttc

SEQ ID NO: 2907567 - DNA, 13 bp, Homo sapiens
tgcaccaaatagg

SEQ ID NO: 2907568 - DNA, 14 bp, Homo sapiens
tgcaccaagcagga

SEQ ID NO: 2907569 - DNA, 14 bp, Homo sapiens
tgcaccaccatgcc

SEQ ID NO: 2907570 - DNA, 16 bp, Homo sapiens
tgcaccaccatgccca

SEQ ID NO: 2907571 - DNA, 23 bp, Homo sapiens
tgcaccagggttgaccccagagg

SEQ ID NO: 2907572 - DNA, 15 bp, Homo sapiens
tgcaccattgctgct

SEQ ID NO: 2907573 - DNA, 15 bp, Homo sapiens
tgcacccacctactt

SEQ ID NO: 2907574 - DNA, 15 bp, Homo sapiens
tgcacccactgaaag

SEQ ID NO: 2907575 - DNA, 14 bp, Homo sapiens
tgcacccagcccag

SEQ ID NO: 2907576 - DNA, 14 bp, Homo sapiens
tgcacccccctggg

SEQ ID NO: 2907577 - DNA, 20 bp, Homo sapiens
tgcaccctcttctcctctgg

SEQ ID NO: 2907578 - DNA, 21 bp, Homo sapiens
tgcaccgacccgaggcccaga

SEQ ID NO: 2907579 - DNA, 14 bp, Homo sapiens
tgcaccgcctgccc

SEQ ID NO: 2907580 - DNA, 15 bp, Homo sapiens
tgaccaatacatttg

SEQ ID NO: 2907581 - DNA, 17 bp, Homo sapiens
tgaccaatacatttgta

SEQ ID NO: 2907582 - DNA, 18 bp, Homo sapiens
tgaccaatacatttgtat

SEQ ID NO: 2907583 - DNA, 14 bp, Homo sapiens
tgaccaatgtcttg

SEQ ID NO: 2907584 - DNA, 15 bp, Homo sapiens
tgaccacgcacctcc

SEQ ID NO: 2907585 - DNA, 20 bp, Homo sapiens
tgaccacgcacctccacgcc

SEQ ID NO: 2907586 - DNA, 15 bp, Homo sapiens
tgaccagagcaaaaa

SEQ ID NO: 2907587 - DNA, 12 bp, Homo sapiens
tgaccagggaag

SEQ ID NO: 2907588 - DNA, 13 bp, Homo sapiens
tgaccagggaagt

SEQ ID NO: 2907589 - DNA, 15 bp, Homo sapiens
tgaccagtttctttt

SEQ ID NO: 2907590 - DNA, 14 bp, Homo sapiens
tgaccatactcaga

SEQ ID NO: 2907591 - DNA, 13 bp, Homo sapiens
tgaccatgtgaat

SEQ ID NO: 2907592 - DNA, 12 bp, Homo sapiens
tgaccatgtgat

SEQ ID NO: 2907593 - DNA, 19 bp, Homo sapiens
tgacccacagcctccaagt

SEQ ID NO: 2907594 - DNA, 22 bp, Homo sapiens
tgacccacttctcatcacacac

SEQ ID NO: 2907595 - DNA, 14 bp, Homo sapiens
tgacccagtccctg

SEQ ID NO: 2907596 - DNA, 18 bp, Homo sapiens
tgacccagtgcccccact

SEQ ID NO: 2907597 - DNA, 14 bp, Homo sapiens
tgacccccagctcc

SEQ ID NO: 2907598 - DNA, 14 bp, Homo sapiens
tgacccctaccccc

SEQ ID NO: 2907599 - DNA, 13 bp, Homo sapiens
tgacccctcctgg

SEQ ID NO: 2907600 - DNA, 20 bp, Homo sapiens
tgacccggattggccctgcc

SEQ ID NO: 2907601 - DNA, 22 bp, Homo sapiens
tgacccggattggccctgcccc

SEQ ID NO: 2907602 - DNA, 12 bp, Homo sapiens
tgaccctctcac

SEQ ID NO: 2907603 - DNA, 20 bp, Homo sapiens
tgaccctctgtccccaggcc

SEQ ID NO: 2907604 - DNA, 21 bp, Homo sapiens
tgaccctctgtccccaggcct

SEQ ID NO: 2907605 - DNA, 15 bp, Homo sapiens
tgaccctggggctgg

SEQ ID NO: 2907606 - DNA, 17 bp, Homo sapiens
tgaccctggggctggct

SEQ ID NO: 2907607 - DNA, 17 bp, Homo sapiens
tgaccctgtatatagcc

SEQ ID NO: 2907608 - DNA, 22 bp, Homo sapiens
tgacccttacagcctctgactt

SEQ ID NO: 2907609 - DNA, 19 bp, Homo sapiens
tgaccgaaacagcgctggg

SEQ ID NO: 2907610 - DNA, 18 bp, Homo sapiens
tgaccgcccagctctccc

SEQ ID NO: 2907611 - DNA, 19 bp, Homo sapiens
tgaccgcctcctgctctgc

SEQ ID NO: 2907612 - DNA, 18 bp, Homo sapiens
tgaccgctgcccaggtgg

SEQ ID NO: 2907613 - DNA, 17 bp, Homo sapiens
tgacctcacctggtcct

SEQ ID NO: 2907614 - DNA, 19 bp, Homo sapiens
tgacctcacctggtcctcc

SEQ ID NO: 2907615 - DNA, 14 bp, Homo sapiens
tgacctccacagct

SEQ ID NO: 2907616 - DNA, 16 bp, Homo sapiens
tgacctccagtcctgc

SEQ ID NO: 2907617 - DNA, 19 bp, Homo sapiens
tgacctccagtcctgctgg

SEQ ID NO: 2907618 - DNA, 15 bp, Homo sapiens
tgacctcccaactct

SEQ ID NO: 2907619 - DNA, 14 bp, Homo sapiens
tgacctgaactctg

SEQ ID NO: 2907620 - DNA, 13 bp, Homo sapiens
tgacctgaagttc

SEQ ID NO: 2907621 - DNA, 17 bp, Homo sapiens
tgacctgcaaaaatgct

SEQ ID NO: 2907622 - DNA, 20 bp, Homo sapiens
tgacctgcgggtcctcagct

SEQ ID NO: 2907623 - DNA, 20 bp, Homo sapiens
tgacctggtccacagggcac

SEQ ID NO: 2907624 - DNA, 20 bp, Homo sapiens
tgacctggttaaacaaacca

SEQ ID NO: 2907625 - DNA, 20 bp, Homo sapiens
tgacctgtgagcccagctgg

SEQ ID NO: 2907626 - DNA, 22 bp, Homo sapiens
tgaccttagtgtttctgtgcat

SEQ ID NO: 2907627 - DNA, 19 bp, Homo sapiens
tgaccttatccttcctctc

SEQ ID NO: 2907628 - DNA, 22 bp, Homo sapiens
tgaccttatgagaaactgcatg

SEQ ID NO: 2907629 - DNA, 19 bp, Homo sapiens
tgaccttcagctcacgctt

SEQ ID NO: 2907630 - DNA, 14 bp, Homo sapiens
tgacctttgtacag

SEQ ID NO: 2907631 - DNA, 12 bp, Homo sapiens
tgacgaactggc

SEQ ID NO: 2907632 - DNA, 13 bp, Homo sapiens
tgacgaactggct

SEQ ID NO: 2907633 - DNA, 19 bp, Homo sapiens
tgacgaacttccatggccc

SEQ ID NO: 2907634 - DNA, 15 bp, Homo sapiens
tgacgaatcctgctc

SEQ ID NO: 2907635 - DNA, 14 bp, Homo sapiens
tgacgcagccggag

SEQ ID NO: 2907636 - DNA, 17 bp, Homo sapiens
tgacgctgaataaatgt

SEQ ID NO: 2907637 - DNA, 21 bp, Homo sapiens
tgacgtcaagtgatctgcctg

SEQ ID NO: 2907638 - DNA, 16 bp, Homo sapiens
tgacgtgactcagagc

SEQ ID NO: 2907639 - DNA, 14 bp, Homo sapiens
tgacgtgcactgtg

SEQ ID NO: 2907640 - DNA, 23 bp, Homo sapiens
tgactaaagtaccagattataat

SEQ ID NO: 2907641 - DNA, 23 bp, Homo sapiens
tgactaactagacaccaaagttc

SEQ ID NO: 2907642 - DNA, 20 bp, Homo sapiens
tgactaagccaagctgtgtt

SEQ ID NO: 2907643 - DNA, 21 bp, Homo sapiens
tgactaagccaagctgtgttc

SEQ ID NO: 2907644 - DNA, 23 bp, Homo sapiens
tgactaatagggataatccaggt

SEQ ID NO: 2907645 - DNA, 17 bp, Homo sapiens
tgactaattgtataaca

SEQ ID NO: 2907646 - DNA, 21 bp, Homo sapiens
tgactaattgtataacaggtt

SEQ ID NO: 2907647 - DNA, 22 bp, Homo sapiens
tgactaattttacatgtttata

SEQ ID NO: 2907648 - DNA, 22 bp, Homo sapiens
tgactacctactggtgtaatct

SEQ ID NO: 2907649 - DNA, 15 bp, Homo sapiens
tgactagaaattctt

SEQ ID NO: 2907650 - DNA, 16 bp, Homo sapiens
tgactagaaattctta

SEQ ID NO: 2907651 - DNA, 18 bp, Homo sapiens
tgactagggagccatgtt

SEQ ID NO: 2907652 - DNA, 20 bp, Homo sapiens
tgactagggagccatgtttc

SEQ ID NO: 2907653 - DNA, 14 bp, Homo sapiens
tgactataaagctg

SEQ ID NO: 2907654 - DNA, 21 bp, Homo sapiens
tgactatcacacactttctct

SEQ ID NO: 2907655 - DNA, 21 bp, Homo sapiens
tgactatcccaacagtcatgt

SEQ ID NO: 2907656 - DNA, 23 bp, Homo sapiens
tgactatcccaacagtcatgttt

SEQ ID NO: 2907657 - DNA, 24 bp, Homo sapiens
tgactatgcagaggcctgggggac

SEQ ID NO: 2907658 - DNA, 22 bp, Homo sapiens
tgactattacagttgcattttt

SEQ ID NO: 2907659 - DNA, 22 bp, Homo sapiens
tgactattatgttgttagagaa

SEQ ID NO: 2907660 - DNA, 17 bp, Homo sapiens
tgactcagcagaggcag

SEQ ID NO: 2907661 - DNA, 21 bp, Homo sapiens
tgactcaggcgggcaccaagg

SEQ ID NO: 2907662 - DNA, 18 bp, Homo sapiens
tgactcagggctcctggg

SEQ ID NO: 2907663 - DNA, 15 bp, Homo sapiens
tgactcatcatttgt

SEQ ID NO: 2907664 - DNA, 18 bp, Homo sapiens
tgactcatgcctctgagc

SEQ ID NO: 2907665 - DNA, 21 bp, Homo sapiens
tgactccctccccacccaaga

SEQ ID NO: 2907666 - DNA, 22 bp, Homo sapiens
tgactcgggccttagaactttg

SEQ ID NO: 2907667 - DNA, 14 bp, Homo sapiens
tgactctcctgcct

SEQ ID NO: 2907668 - DNA, 17 bp, Homo sapiens
tgagccgcatcttctcc

SEQ ID NO: 2907669 - DNA, 16 bp, Homo sapiens
tgagccgccgcgcctg

SEQ ID NO: 2907670 - DNA, 21 bp, Homo sapiens
tgagccggagggcaccaggga

SEQ ID NO: 2907671 - DNA, 12 bp, Homo sapiens
tgagcctctgct

SEQ ID NO: 2907672 - DNA, 16 bp, Homo sapiens
tgagcctggccagcct

SEQ ID NO: 2907673 - DNA, 16 bp, Homo sapiens
tgagcctgggaaataa

SEQ ID NO: 2907674 - DNA, 18 bp, Homo sapiens
tgagcctgtttattgcca

SEQ ID NO: 2907675 - DNA, 15 bp, Homo sapiens
tgagccttgctgcca

SEQ ID NO: 2907676 - DNA, 16 bp, Homo sapiens
tgagcgacaaagatga

SEQ ID NO: 2907677 - DNA, 19 bp, Homo sapiens
tgagcgaggaaaaacaaca

SEQ ID NO: 2907678 - DNA, 20 bp, Homo sapiens
tgagcgaggaaaaacaacaa

SEQ ID NO: 2907679 - DNA, 15 bp, Homo sapiens
tgagcgagtggatgc

SEQ ID NO: 2907680 - DNA, 21 bp, Homo sapiens
tgagcgagtggatgctgtgct

SEQ ID NO: 2907681 - DNA, 17 bp, Homo sapiens
tgagcgcaagccacagc

SEQ ID NO: 2907682 - DNA, 21 bp, Homo sapiens
tgagcgcaagccacagcctgt

SEQ ID NO: 2907683 - DNA, 12 bp, Homo sapiens
tgagcgccagga

SEQ ID NO: 2907684 - DNA, 14 bp, Homo sapiens
tgagctaaataagt

SEQ ID NO: 2907685 - DNA, 16 bp, Homo sapiens
tgagctaggaagagtc

SEQ ID NO: 2907686 - DNA, 23 bp, Homo sapiens
tgagctatgataagattgaaatt

SEQ ID NO: 2907687 - DNA, 19 bp, Homo sapiens
tgagctcagacccccactc

SEQ ID NO: 2907688 - DNA, 20 bp, Homo sapiens
tgagctcagacccccactct

SEQ ID NO: 2907689 - DNA, 22 bp, Homo sapiens
tgagctcaggagtttgagacca

SEQ ID NO: 2907690 - DNA, 23 bp, Homo sapiens
tgagctcccaggtgcagccagag

SEQ ID NO: 2907691 - DNA, 14 bp, Homo sapiens
tgagctctccaggc

SEQ ID NO: 2907692 - DNA, 21 bp, Homo sapiens
tgagctgcccggcgcctgccc

SEQ ID NO: 2907693 - DNA, 14 bp, Homo sapiens
tgagctgggccgga

SEQ ID NO: 2907694 - DNA, 18 bp, Homo sapiens
tgagctgggccggagggt

SEQ ID NO: 2907695 - DNA, 16 bp, Homo sapiens
tgagctggggaggtgg

SEQ ID NO: 2907696 - DNA, 16 bp, Homo sapiens
tgagctggtgcctgct

SEQ ID NO: 2907697 - DNA, 14 bp, Homo sapiens
tgagctgtcccaag

SEQ ID NO: 2907698 - DNA, 21 bp, Homo sapiens
tgagctgtgacattgctggtc

SEQ ID NO: 2907699 - DNA, 20 bp, Homo sapiens
tgagcttctaaactgaagct

SEQ ID NO: 2907700 - DNA, 14 bp, Homo sapiens
tgagcttgagagtt

SEQ ID NO: 2907701 - DNA, 23 bp, Homo sapiens
tgaggaaaaaaatcgtccaggga

SEQ ID NO: 2907702 - DNA, 21 bp, Homo sapiens
tgaggaactgtagatgatgta

SEQ ID NO: 2907703 - DNA, 12 bp, Homo sapiens
tgaggaccaggg

SEQ ID NO: 2907704 - DNA, 20 bp, Homo sapiens
tgaggaccagggtggagctg

SEQ ID NO: 2907705 - DNA, 22 bp, Homo sapiens
tgaggaccagggtggagctgag

SEQ ID NO: 2907706 - DNA, 24 bp, Homo sapiens
tgaggactctgcaagtgtctggag

SEQ ID NO: 2907707 - DNA, 15 bp, Homo sapiens
tgaggagaagtgggg

SEQ ID NO: 2907708 - DNA, 21 bp, Homo sapiens
tgaggagcggactcacttgat

SEQ ID NO: 2907709 - DNA, 22 bp, Homo sapiens
tgaggagtggttgggctgtgcc

SEQ ID NO: 2907710 - DNA, 20 bp, Homo sapiens
tgaggataaaaaggaaggag

SEQ ID NO: 2907711 - DNA, 21 bp, Homo sapiens
tgaggataaaaaggaaggaga

SEQ ID NO: 2907712 - DNA, 18 bp, Homo sapiens
tgaggataaggggtgggg

SEQ ID NO: 2907713 - DNA, 17 bp, Homo sapiens
tgaggatcccctgtccc

SEQ ID NO: 2907714 - DNA, 17 bp, Homo sapiens
tgaggcaagccatggag

SEQ ID NO: 2907715 - DNA, 13 bp, Homo sapiens
tgaggcagaagaa

SEQ ID NO: 2907716 - DNA, 22 bp, Homo sapiens
tgaggcagatggccactgctct

SEQ ID NO: 2907717 - DNA, 13 bp, Homo sapiens
tgaggcaggagaa

SEQ ID NO: 2907718 - DNA, 17 bp, Homo sapiens
tgaggcatgagttactg

SEQ ID NO: 2907719 - DNA, 12 bp, Homo sapiens
tgaggccacact

SEQ ID NO: 2907720 - DNA, 13 bp, Homo sapiens
tgaggccagggca

SEQ ID NO: 2907721 - DNA, 15 bp, Homo sapiens
tgaggccagggcaga

SEQ ID NO: 2907722 - DNA, 16 bp, Homo sapiens
tgaggccagggcagag

SEQ ID NO: 2907723 - DNA, 14 bp, Homo sapiens
tgaggccggccctg

SEQ ID NO: 2907724 - DNA, 16 bp, Homo sapiens
tgatcccagctcactg

SEQ ID NO: 2907725 - DNA, 21 bp, Homo sapiens
tgatcccctttggttttacta

SEQ ID NO: 2907726 - DNA, 22 bp, Homo sapiens
tgatcccctttggttttactac

SEQ ID NO: 2907727 - DNA, 17 bp, Homo sapiens
tgatcccgttttcccca

SEQ ID NO: 2907728 - DNA, 12 bp, Homo sapiens
tgatcctcagtg

SEQ ID NO: 2907729 - DNA, 15 bp, Homo sapiens
tgatcctgccaatct

SEQ ID NO: 2907730 - DNA, 16 bp, Homo sapiens
tgatcctggaggccca

SEQ ID NO: 2907731 - DNA, 21 bp, Homo sapiens
tgatcctgtattcagacagat

SEQ ID NO: 2907732 - DNA, 19 bp, Homo sapiens
tgatcgtgacgctgaataa

SEQ ID NO: 2907733 - DNA, 23 bp, Homo sapiens
tgatcgtgacgctgaataaatgt

SEQ ID NO: 2907734 - DNA, 19 bp, Homo sapiens
tgatctacccgtgcctggg

SEQ ID NO: 2907735 - DNA, 13 bp, Homo sapiens
tgatctccctgcc

SEQ ID NO: 2907736 - DNA, 14 bp, Homo sapiens
tgatctccctgccg

SEQ ID NO: 2907737 - DNA, 11 bp, Homo sapiens
tgatctcctga

SEQ ID NO: 2907738 - DNA, 18 bp, Homo sapiens
tgatctcgaactcctaac

SEQ ID NO: 2907739 - DNA, 16 bp, Homo sapiens
tgatctgaacatctgg

SEQ ID NO: 2907740 - DNA, 15 bp, Homo sapiens
tgatctggaacccag

SEQ ID NO: 2907741 - DNA, 17 bp, Homo sapiens
tgatctggaacccagac

SEQ ID NO: 2907742 - DNA, 18 bp, Homo sapiens
tgatctggaacccagact

SEQ ID NO: 2907743 - DNA, 14 bp, Homo sapiens
tgatctgtccacct

SEQ ID NO: 2907744 - DNA, 17 bp, Homo sapiens
tgatcttatttttctaa

SEQ ID NO: 2907745 - DNA, 20 bp, Homo sapiens
tgatcttatttttctaaacg

SEQ ID NO: 2907746 - DNA, 14 bp, Homo sapiens
tgatgaaaatattt

SEQ ID NO: 2907747 - DNA, 17 bp, Homo sapiens
tgatgaatctacatttg

SEQ ID NO: 2907748 - DNA, 20 bp, Homo sapiens
tgatgaatgaggaacaatca

SEQ ID NO: 2907749 - DNA, 20 bp, Homo sapiens
tgatgacaaaaaatgtttta

SEQ ID NO: 2907750 - DNA, 17 bp, Homo sapiens
tgatgactggcatttta

SEQ ID NO: 2907751 - DNA, 18 bp, Homo sapiens
tgatgactggcattttat

SEQ ID NO: 2907752 - DNA, 20 bp, Homo sapiens
tgatgagatattaaattctc

SEQ ID NO: 2907753 - DNA, 21 bp, Homo sapiens
tgatgaggccgcggcctcccc

SEQ ID NO: 2907754 - DNA, 22 bp, Homo sapiens
tgatgaggccgcggcctccccg

SEQ ID NO: 2907755 - DNA, 19 bp, Homo sapiens
tgatgaggtattttttcct

SEQ ID NO: 2907756 - DNA, 16 bp, Homo sapiens
tgatgatgataataat

SEQ ID NO: 2907757 - DNA, 16 bp, Homo sapiens
tgatgatgatgataat

SEQ ID NO: 2907758 - DNA, 14 bp, Homo sapiens
tgatgatgcatgga

SEQ ID NO: 2907759 - DNA, 16 bp, Homo sapiens
tgatgcaaggattaca

SEQ ID NO: 2907760 - DNA, 20 bp, Homo sapiens
tgatgcaaggattacagaaa

SEQ ID NO: 2907761 - DNA, 22 bp, Homo sapiens
tgatgcaaggattacagaaact

SEQ ID NO: 2907762 - DNA, 23 bp, Homo sapiens
tgatgcaaggattacagaaactg

SEQ ID NO: 2907763 - DNA, 17 bp, Homo sapiens
tgatgcatgcactgttc

SEQ ID NO: 2907764 - DNA, 20 bp, Homo sapiens
tgatgcatggagtgtttgac

SEQ ID NO: 2907765 - DNA, 16 bp, Homo sapiens
tgatgcatgtctttta

SEQ ID NO: 2907766 - DNA, 16 bp, Homo sapiens
tgatgccaaggggctg

SEQ ID NO: 2907767 - DNA, 14 bp, Homo sapiens
tgatgcctctgtct

SEQ ID NO: 2907768 - DNA, 12 bp, Homo sapiens
tgatgctcagtt

SEQ ID NO: 2907769 - DNA, 13 bp, Homo sapiens
tgatgctgaaata

SEQ ID NO: 2907770 - DNA, 20 bp, Homo sapiens
tgatgctgtgctatgaattt

SEQ ID NO: 2907771 - DNA, 22 bp, Homo sapiens
tgatgctttggaagatgcagaa

SEQ ID NO: 2907772 - DNA, 19 bp, Homo sapiens
tgatggaacagtgaaagtc

SEQ ID NO: 2907773 - DNA, 11 bp, Homo sapiens
tgatggaggag

SEQ ID NO: 2907774 - DNA, 15 bp, Homo sapiens
tgatggcaacactga

SEQ ID NO: 2907775 - DNA, 18 bp, Homo sapiens
tgatggcaacagatctgg

SEQ ID NO: 2907776 - DNA, 22 bp, Homo sapiens
tgatggctaagatactgctgat

SEQ ID NO: 2907777 - DNA, 16 bp, Homo sapiens
tgatggctagattcta

SEQ ID NO: 2907778 - DNA, 13 bp, Homo sapiens
tgatgggaaaact

SEQ ID NO: 2907779 - DNA, 15 bp, Homo sapiens
tgatgggaaaatatt

SEQ ID NO: 2907780 - DNA, 24 bp, Homo sapiens
tgatgggattctggacaggatgtg

SEQ ID NO: 2907781 - DNA, 23 bp, Homo sapiens
tgatgggcttttgttctgagggg

SEQ ID NO: 2907782 - DNA, 14 bp, Homo sapiens
tgatggggaaggag

SEQ ID NO: 2907783 - DNA, 22 bp, Homo sapiens
tgatgtaatcttgaattgtaac

SEQ ID NO: 2907784 - DNA, 13 bp, Homo sapiens
tgatgtcatttga

SEQ ID NO: 2907785 - DNA, 14 bp, Homo sapiens
tgatgtgaagccaa

SEQ ID NO: 2907786 - DNA, 15 bp, Homo sapiens
tgatgtgttcggttt

SEQ ID NO: 2907787 - DNA, 16 bp, Homo sapiens
tgatgtgtttttgtat

SEQ ID NO: 2907788 - DNA, 15 bp, Homo sapiens
tgatgttaaagcatt

SEQ ID NO: 2907789 - DNA, 15 bp, Homo sapiens
tgatgttaacacatt

SEQ ID NO: 2907790 - DNA, 16 bp, Homo sapiens
tgatgttaacacattt

SEQ ID NO: 2907791 - DNA, 17 bp, Homo sapiens
tgatgttaacacatttt

SEQ ID NO: 2907792 - DNA, 13 bp, Homo sapiens
tgatgttcagtgt

SEQ ID NO: 2907793 - DNA, 14 bp, Homo sapiens
tgatgttcagtgta

SEQ ID NO: 2907794 - DNA, 12 bp, Homo sapiens
tgatgttctaag

SEQ ID NO: 2907795 - DNA, 14 bp, Homo sapiens
tgatgttctaaggc

SEQ ID NO: 2907796 - DNA, 15 bp, Homo sapiens
tgatgttctaaggct

SEQ ID NO: 2907797 - DNA, 21 bp, Homo sapiens
tgatgttctaaggctctgaga

SEQ ID NO: 2907798 - DNA, 14 bp, Homo sapiens
tgatgtttcctgga

SEQ ID NO: 2907799 - DNA, 11 bp, Homo sapiens
tgattaaaatc

SEQ ID NO: 2907800 - DNA, 15 bp, Homo sapiens
tgattaaaatctctt

SEQ ID NO: 2907801 - DNA, 15 bp, Homo sapiens
tgattaaaatggtga

SEQ ID NO: 2907802 - DNA, 13 bp, Homo sapiens
tgattaaagaaaa

SEQ ID NO: 2907803 - DNA, 19 bp, Homo sapiens
tgattaaataagattctaa

SEQ ID NO: 2907804 - DNA, 20 bp, Homo sapiens
tgattaaataagattctaac

SEQ ID NO: 2907805 - DNA, 14 bp, Homo sapiens
tgattaacaatgta

SEQ ID NO: 2907806 - DNA, 15 bp, Homo sapiens
tgattaacaatgtat

SEQ ID NO: 2907807 - DNA, 16 bp, Homo sapiens
tgattaacaatgtatt

SEQ ID NO: 2907808 - DNA, 23 bp, Homo sapiens
tgattaacaatgtattttaataa

SEQ ID NO: 2907809 - DNA, 14 bp, Homo sapiens
tgattacagtgcag

SEQ ID NO: 2907810 - DNA, 15 bp, Homo sapiens
tgattactctttgct

SEQ ID NO: 2907811 - DNA, 19 bp, Homo sapiens
tgattagaaaggaaatgaa

SEQ ID NO: 2907812 - DNA, 18 bp, Homo sapiens
tgattagcaagttacagt

SEQ ID NO: 2907813 - DNA, 13 bp, Homo sapiens
tgattataaatgt

SEQ ID NO: 2907814 - DNA, 21 bp, Homo sapiens
tgattatagcaatgtgatttt

SEQ ID NO: 2907815 - DNA, 14 bp, Homo sapiens
tgattattcagtgt

SEQ ID NO: 2907816 - DNA, 16 bp, Homo sapiens
tgattattcagtgtca

SEQ ID NO: 2907817 - DNA, 16 bp, Homo sapiens
tgattatttattattt

SEQ ID NO: 2907818 - DNA, 16 bp, Homo sapiens
tgattcaaggctcaga

SEQ ID NO: 2907819 - DNA, 21 bp, Homo sapiens
tgattcaaggctcagaaggaa

SEQ ID NO: 2907820 - DNA, 23 bp, Homo sapiens
tgattcaaggctcagaaggaatg

SEQ ID NO: 2907821 - DNA, 12 bp, Homo sapiens
tgattcactgca

SEQ ID NO: 2907822 - DNA, 17 bp, Homo sapiens
tgattcactgcatggct

SEQ ID NO: 2907823 - DNA, 14 bp, Homo sapiens
tgattcaggtgcag

SEQ ID NO: 2907824 - DNA, 13 bp, Homo sapiens
tgattcataaaga

SEQ ID NO: 2907825 - DNA, 18 bp, Homo sapiens
tgattcatagtaacttct

SEQ ID NO: 2907826 - DNA, 16 bp, Homo sapiens
tgattcatttgaataa

SEQ ID NO: 2907827 - DNA, 20 bp, Homo sapiens
tgattcatttgaataaaaag

SEQ ID NO: 2907828 - DNA, 17 bp, Homo sapiens
tgattcgtctgcgattt

SEQ ID NO: 2907829 - DNA, 20 bp, Homo sapiens
tgattctagtacataattga

SEQ ID NO: 2907830 - DNA, 21 bp, Homo sapiens
tgattctatttatatgtacat

SEQ ID NO: 2907831 - DNA, 17 bp, Homo sapiens
tgattctcgactgcttt

SEQ ID NO: 2907832 - DNA, 14 bp, Homo sapiens
tgattctctgtggt

SEQ ID NO: 2907833 - DNA, 19 bp, Homo sapiens
tgattctctgtggtttttt

SEQ ID NO: 2907834 - DNA, 22 bp, Homo sapiens
tgattctcttagacacttttat

SEQ ID NO: 2907835 - DNA, 18 bp, Homo sapiens
tgattctgaagcttatgt

SEQ ID NO: 2907836 - DNA, 19 bp, Homo sapiens
tgattgacagctttgctgc

SEQ ID NO: 2907837 - DNA, 21 bp, Homo sapiens
tgattgacagctttgctgctg

SEQ ID NO: 2907838 - DNA, 14 bp, Homo sapiens
tgattgatttgaag

SEQ ID NO: 2907839 - DNA, 19 bp, Homo sapiens
tgattgctaaatgtaacag

SEQ ID NO: 2907840 - DNA, 16 bp, Homo sapiens
tgattgggaataaata

SEQ ID NO: 2907841 - DNA, 18 bp, Homo sapiens
tgattgggaataaatatg

SEQ ID NO: 2907842 - DNA, 13 bp, Homo sapiens
tgattgtcagcca

SEQ ID NO: 2907843 - DNA, 22 bp, Homo sapiens
tgattgtcagccacctccctct

SEQ ID NO: 2907844 - DNA, 14 bp, Homo sapiens
tgattgtggaatgg

SEQ ID NO: 2907845 - DNA, 20 bp, Homo sapiens
tgattgttcttttgtttcat

SEQ ID NO: 2907846 - DNA, 22 bp, Homo sapiens
tgattgttcttttgtttcatta

SEQ ID NO: 2907847 - DNA, 17 bp, Homo sapiens
tgattgtttgcacagag

SEQ ID NO: 2907848 - DNA, 14 bp, Homo sapiens
tgattgttttaaca

SEQ ID NO: 2907849 - DNA, 14 bp, Homo sapiens
tgatttaaaacatg

SEQ ID NO: 2907850 - DNA, 16 bp, Homo sapiens
tgatttaaaacatgta

SEQ ID NO: 2907851 - DNA, 18 bp, Homo sapiens
tgatttaatagtgttaat

SEQ ID NO: 2907852 - DNA, 22 bp, Homo sapiens
tgatttaatagtgttaatcaat

SEQ ID NO: 2907853 - DNA, 20 bp, Homo sapiens
tgatttatcctcacataaaa

SEQ ID NO: 2907854 - DNA, 14 bp, Homo sapiens
tgatttccaaagag

SEQ ID NO: 2907855 - DNA, 15 bp, Homo sapiens
tgatttcccactgca

SEQ ID NO: 2907856 - DNA, 14 bp, Homo sapiens
tgatttccttgaat

SEQ ID NO: 2907857 - DNA, 15 bp, Homo sapiens
tgatttccttgaatg

SEQ ID NO: 2907858 - DNA, 13 bp, Homo sapiens
tgatttctagaat

SEQ ID NO: 2907859 - DNA, 18 bp, Homo sapiens
tgatttctagaatggttt

SEQ ID NO: 2907860 - DNA, 11 bp, Homo sapiens
tgatttctagg

SEQ ID NO: 2907861 - DNA, 21 bp, Homo sapiens
tgatttcttttcttcctggct

SEQ ID NO: 2907862 - DNA, 13 bp, Homo sapiens
tctgcctcctccc

SEQ ID NO: 2907863 - DNA, 18 bp, Homo sapiens
tctgcctctaactccctc

SEQ ID NO: 2907864 - DNA, 18 bp, Homo sapiens
tctgcctcttctgggagg

SEQ ID NO: 2907865 - DNA, 18 bp, Homo sapiens
tctgcctgcactccctgg

SEQ ID NO: 2907866 - DNA, 23 bp, Homo sapiens
tctgcctgcactccctggccttg

SEQ ID NO: 2907867 - DNA, 17 bp, Homo sapiens
tctgcctgccagctgca

SEQ ID NO: 2907868 - DNA, 18 bp, Homo sapiens
tctgcctgccagctgcac

SEQ ID NO: 2907869 - DNA, 22 bp, Homo sapiens
tctgcctgccagctgcactgat

SEQ ID NO: 2907870 - DNA, 17 bp, Homo sapiens
tctgcctgctgggctct

SEQ ID NO: 2907871 - DNA, 12 bp, Homo sapiens
tctgcctggagt

SEQ ID NO: 2907872 - DNA, 13 bp, Homo sapiens
tctgccttagcct

SEQ ID NO: 2907873 - DNA, 11 bp, Homo sapiens
tctgccttcca

SEQ ID NO: 2907874 - DNA, 19 bp, Homo sapiens
tctgcctttagctttgaca

SEQ ID NO: 2907875 - DNA, 14 bp, Homo sapiens
tctgcgccaggcag

SEQ ID NO: 2907876 - DNA, 13 bp, Homo sapiens
tctgcgcctcagg

SEQ ID NO: 2907877 - DNA, 17 bp, Homo sapiens
tctgcgtccaccaggcc

SEQ ID NO: 2907878 - DNA, 18 bp, Homo sapiens
tctgcgtccaccaggcct

SEQ ID NO: 2907879 - DNA, 20 bp, Homo sapiens
tctgcgtccaccaggcctca

SEQ ID NO: 2907880 - DNA, 22 bp, Homo sapiens
tctgcgtccaccaggcctcact

SEQ ID NO: 2907881 - DNA, 20 bp, Homo sapiens
tctgcgtgtcacctgtgctt

SEQ ID NO: 2907882 - DNA, 17 bp, Homo sapiens
tctgctagagcagacag

SEQ ID NO: 2907883 - DNA, 18 bp, Homo sapiens
tctgctcagatagaatga

SEQ ID NO: 2907884 - DNA, 14 bp, Homo sapiens
tctgctcagctctg

SEQ ID NO: 2907885 - DNA, 14 bp, Homo sapiens
tctgctcagcttct

SEQ ID NO: 2907886 - DNA, 18 bp, Homo sapiens
tctgctcaggtaaatctt

SEQ ID NO: 2907887 - DNA, 18 bp, Homo sapiens
tctgctctattatataaa

SEQ ID NO: 2907888 - DNA, 21 bp, Homo sapiens
tctgctctgcgtgtcacctgt

SEQ ID NO: 2907889 - DNA, 16 bp, Homo sapiens
tctgctgatataatat

SEQ ID NO: 2907890 - DNA, 18 bp, Homo sapiens
tctgctggtctctggctc

SEQ ID NO: 2907891 - DNA, 19 bp, Homo sapiens
tctgctggtctctggctct

SEQ ID NO: 2907892 - DNA, 20 bp, Homo sapiens
tctgcttaccgttcaagagg

SEQ ID NO: 2907893 - DNA, 22 bp, Homo sapiens
tctgcttccatggcttcctgag

SEQ ID NO: 2907894 - DNA, 12 bp, Homo sapiens
tctgcttcccag

SEQ ID NO: 2907895 - DNA, 23 bp, Homo sapiens
tctgcttctcggggtccagtgca

SEQ ID NO: 2907896 - DNA, 21 bp, Homo sapiens
tctgctttaaattaaaatttt

SEQ ID NO: 2907897 - DNA, 14 bp, Homo sapiens
tctgctttctgttc

SEQ ID NO: 2907898 - DNA, 16 bp, Homo sapiens
tctgctttctgttcat

SEQ ID NO: 2907899 - DNA, 18 bp, Homo sapiens
tctgctttctgttcatct

SEQ ID NO: 2907900 - DNA, 21 bp, Homo sapiens
tctgctttctgttcatctctt

SEQ ID NO: 2907901 - DNA, 20 bp, Homo sapiens
tctgctttgctcttcaagaa

SEQ ID NO: 2907902 - DNA, 13 bp, Homo sapiens
tctggaacccaga

SEQ ID NO: 2907903 - DNA, 19 bp, Homo sapiens
tctggaagtattttcctcc

SEQ ID NO: 2907904 - DNA, 13 bp, Homo sapiens
tctggaagtccaa

SEQ ID NO: 2907905 - DNA, 18 bp, Homo sapiens
tctggacagatggacgca

SEQ ID NO: 2907906 - DNA, 17 bp, Homo sapiens
tctggacagtcagctct

SEQ ID NO: 2907907 - DNA, 13 bp, Homo sapiens
tctggacctcagg

SEQ ID NO: 2907908 - DNA, 16 bp, Homo sapiens
tctggacctctcttgt

SEQ ID NO: 2907909 - DNA, 19 bp, Homo sapiens
tctggactaaccctgtggt

SEQ ID NO: 2907910 - DNA, 16 bp, Homo sapiens
tctggagaagcagtga

SEQ ID NO: 2907911 - DNA, 12 bp, Homo sapiens
tctggagagctg

SEQ ID NO: 2907912 - DNA, 21 bp, Homo sapiens
tctggagcaatctgacccttc

SEQ ID NO: 2907913 - DNA, 18 bp, Homo sapiens
tctggagcccctcctccc

SEQ ID NO: 2907914 - DNA, 14 bp, Homo sapiens
tctggagcggctgc

SEQ ID NO: 2907915 - DNA, 15 bp, Homo sapiens
tctggagcggctgct

SEQ ID NO: 2907916 - DNA, 17 bp, Homo sapiens
tctggagcggctgctcg

SEQ ID NO: 2907917 - DNA, 20 bp, Homo sapiens
tctggagtgcccccagccca

SEQ ID NO: 2907918 - DNA, 14 bp, Homo sapiens
tctggagtggccac

SEQ ID NO: 2907919 - DNA, 16 bp, Homo sapiens
tctggagttgatctgg

SEQ ID NO: 2907920 - DNA, 21 bp, Homo sapiens
tctggagttgatctggaaccc

SEQ ID NO: 2907921 - DNA, 17 bp, Homo sapiens
tctggattaggtctctg

SEQ ID NO: 2907922 - DNA, 17 bp, Homo sapiens
tctggcaaacatgtgca

SEQ ID NO: 2907923 - DNA, 18 bp, Homo sapiens
tctggcaaacatgtgcaa

SEQ ID NO: 2907924 - DNA, 20 bp, Homo sapiens
tctggcagggtgggatggag

SEQ ID NO: 2907925 - DNA, 16 bp, Homo sapiens
tctggcatctcccaca

SEQ ID NO: 2907926 - DNA, 20 bp, Homo sapiens
tctggcattctacacctgga

SEQ ID NO: 2907927 - DNA, 17 bp, Homo sapiens
tctggccaggaagcttt

SEQ ID NO: 2907928 - DNA, 11 bp, Homo sapiens
tctggccaggc

SEQ ID NO: 2907929 - DNA, 20 bp, Homo sapiens
tctggccctggcgggtggct

SEQ ID NO: 2907930 - DNA, 23 bp, Homo sapiens
tctggccctggcgggtggctgca

SEQ ID NO: 2907931 - DNA, 13 bp, Homo sapiens
tctggcctcccac

SEQ ID NO: 2907932 - DNA, 12 bp, Homo sapiens
tctggcctgagg

SEQ ID NO: 2907933 - DNA, 14 bp, Homo sapiens
tctggcgagccctt

SEQ ID NO: 2907934 - DNA, 15 bp, Homo sapiens
tctggcgagccctta

SEQ ID NO: 2907935 - DNA, 14 bp, Homo sapiens
tctggctcagctgt

SEQ ID NO: 2907936 - DNA, 21 bp, Homo sapiens
tctggctcagctgtggtccca

SEQ ID NO: 2907937 - DNA, 15 bp, Homo sapiens
tctggctctccccaa

SEQ ID NO: 2907938 - DNA, 15 bp, Homo sapiens
tctggcttctggcca

SEQ ID NO: 2907939 - DNA, 13 bp, Homo sapiens
tctggcttggcct

SEQ ID NO: 2907940 - DNA, 15 bp, Homo sapiens
tctggctttgttctt

SEQ ID NO: 2907941 - DNA, 19 bp, Homo sapiens
tctggctttgttcttgtca

SEQ ID NO: 2907942 - DNA, 23 bp, Homo sapiens
tctgggaactgaatcaggaaact

SEQ ID NO: 2907943 - DNA, 20 bp, Homo sapiens
tctgggaagggagagggcct

SEQ ID NO: 2907944 - DNA, 15 bp, Homo sapiens
tctgggaccctttcc

SEQ ID NO: 2907945 - DNA, 19 bp, Homo sapiens
tctgggagggcagcagggc

SEQ ID NO: 2907946 - DNA, 18 bp, Homo sapiens
tctgggagtcacacagtg

SEQ ID NO: 2907947 - DNA, 19 bp, Homo sapiens
tctgggccaccaggatcag

SEQ ID NO: 2907948 - DNA, 21 bp, Homo sapiens
tctgggccattctccacagca

SEQ ID NO: 2907949 - DNA, 20 bp, Homo sapiens
tctggggaaagacactgcct

SEQ ID NO: 2907950 - DNA, 23 bp, Homo sapiens
tctggggaaagacactgcctggg

SEQ ID NO: 2907951 - DNA, 15 bp, Homo sapiens
tctgggggaaaaagc

SEQ ID NO: 2907952 - DNA, 13 bp, Homo sapiens
tctgggggctggt

SEQ ID NO: 2907953 - DNA, 15 bp, Homo sapiens
tctgggggctggttg

SEQ ID NO: 2907954 - DNA, 21 bp, Homo sapiens
tctggggggacccagtgcaga

SEQ ID NO: 2907955 - DNA, 15 bp, Homo sapiens
tctggggtccccagg

SEQ ID NO: 2907956 - DNA, 21 bp, Homo sapiens
tctgggtacctgcaagcagaa

SEQ ID NO: 2907957 - DNA, 20 bp, Homo sapiens
tctgggtagaagccaccctt

SEQ ID NO: 2907958 - DNA, 21 bp, Homo sapiens
tctgggtagaagccacccttc

SEQ ID NO: 2907959 - DNA, 23 bp, Homo sapiens
tctgggtagaagccacccttccc

SEQ ID NO: 2907960 - DNA, 15 bp, Homo sapiens
tctgggtcagtggtc

SEQ ID NO: 2907961 - DNA, 13 bp, Homo sapiens
tctgggtcccggg

SEQ ID NO: 2907962 - DNA, 23 bp, Homo sapiens
tctgggtgaaagggatactttta

SEQ ID NO: 2907963 - DNA, 14 bp, Homo sapiens
tctgggtgccctga

SEQ ID NO: 2907964 - DNA, 20 bp, Homo sapiens
tctgggtggatgtgagcaga

SEQ ID NO: 2907965 - DNA, 21 bp, Homo sapiens
tctgggtggatgtgagcagaa

SEQ ID NO: 2907966 - DNA, 22 bp, Homo sapiens
tctgggtggatgtgagcagaag

SEQ ID NO: 2907967 - DNA, 23 bp, Homo sapiens
tctgggtttacaacaaacactgt

SEQ ID NO: 2907968 - DNA, 13 bp, Homo sapiens
tctgggtttggat

SEQ ID NO: 2907969 - DNA, 22 bp, Homo sapiens
tctggtatggtgctaatatttt

SEQ ID NO: 2907970 - DNA, 13 bp, Homo sapiens
tctggtcctaccc

SEQ ID NO: 2907971 - DNA, 12 bp, Homo sapiens
tctggtcctcgg

SEQ ID NO: 2907972 - DNA, 16 bp, Homo sapiens
tctggtcctcggagct

SEQ ID NO: 2907973 - DNA, 21 bp, Homo sapiens
tctggtcctgttttctaaaaa

SEQ ID NO: 2907974 - DNA, 16 bp, Homo sapiens
tctggtgataaggaca

SEQ ID NO: 2907975 - DNA, 13 bp, Homo sapiens
tctggtgcctcca

SEQ ID NO: 2907976 - DNA, 22 bp, Homo sapiens
tctggtggaggagctgagggag

SEQ ID NO: 2907977 - DNA, 15 bp, Homo sapiens
tctggtggtctcctc

SEQ ID NO: 2907978 - DNA, 13 bp, Homo sapiens
tctggttctaaca

SEQ ID NO: 2907979 - DNA, 14 bp, Homo sapiens
tctgtaaaactaag

SEQ ID NO: 2907980 - DNA, 21 bp, Homo sapiens
tctgtaaaactaagaaactta

SEQ ID NO: 2907981 - DNA, 17 bp, Homo sapiens
tctgtaaacagaataaa

SEQ ID NO: 2907982 - DNA, 16 bp, Homo sapiens
tctgtaaatatgtttt

SEQ ID NO: 2907983 - DNA, 21 bp, Homo sapiens
tctgtaaccacctctctgtct

SEQ ID NO: 2907984 - DNA, 22 bp, Homo sapiens
tctgtaaccacctctctgtctt

SEQ ID NO: 2907985 - DNA, 18 bp, Homo sapiens
tctgtaaggaactggaac

SEQ ID NO: 2907986 - DNA, 15 bp, Homo sapiens
tctgtaatctcgttt

SEQ ID NO: 2907987 - DNA, 17 bp, Homo sapiens
tctgtaattgtgtgtga

SEQ ID NO: 2907988 - DNA, 14 bp, Homo sapiens
tctgtacactgccc

SEQ ID NO: 2907989 - DNA, 22 bp, Homo sapiens
tctgtacattttttctttatca

SEQ ID NO: 2907990 - DNA, 12 bp, Homo sapiens
tctgtacttggt

SEQ ID NO: 2907991 - DNA, 20 bp, Homo sapiens
tctgtacttttcattctctt

SEQ ID NO: 2907992 - DNA, 15 bp, Homo sapiens
tctgtagagccaatt

SEQ ID NO: 2907993 - DNA, 15 bp, Homo sapiens
tctgtaggtacgttt

SEQ ID NO: 2907994 - DNA, 21 bp, Homo sapiens
tcttaaaaagttgttcaacta

SEQ ID NO: 2907995 - DNA, 13 bp, Homo sapiens
tcttaaatcagaa

SEQ ID NO: 2907996 - DNA, 15 bp, Homo sapiens
tcttaaatcagaata

SEQ ID NO: 2907997 - DNA, 14 bp, Homo sapiens
tcttaaatttttca

SEQ ID NO: 2907998 - DNA, 12 bp, Homo sapiens
tcttaacactga

SEQ ID NO: 2907999 - DNA, 16 bp, Homo sapiens
tcttaacctttgctat

SEQ ID NO: 2908000 - DNA, 19 bp, Homo sapiens
tcttaactgaagaaagaga

SEQ ID NO: 2908001 - DNA, 14 bp, Homo sapiens
tcttaactgttgct

SEQ ID NO: 2908002 - DNA, 16 bp, Homo sapiens
tcttaagatgtccagg

SEQ ID NO: 2908003 - DNA, 19 bp, Homo sapiens
tcttaagcagagataaata

SEQ ID NO: 2908004 - DNA, 23 bp, Homo sapiens
tcttaagccatcttggtaaattt

SEQ ID NO: 2908005 - DNA, 19 bp, Homo sapiens
tcttaaggacaaagtgcca

SEQ ID NO: 2908006 - DNA, 15 bp, Homo sapiens
tcttaaggagactgg

SEQ ID NO: 2908007 - DNA, 23 bp, Homo sapiens
tcttaaggtgaggcctgtctgtg

SEQ ID NO: 2908008 - DNA, 23 bp, Homo sapiens
tcttaagttttgtttagcaatgt

SEQ ID NO: 2908009 - DNA, 20 bp, Homo sapiens
tcttaatgatgttatcttaa

SEQ ID NO: 2908010 - DNA, 15 bp, Homo sapiens
tcttaatttggataa

SEQ ID NO: 2908011 - DNA, 18 bp, Homo sapiens
tcttaatttggataataa

SEQ ID NO: 2908012 - DNA, 20 bp, Homo sapiens
tcttaattttggttgtattc

SEQ ID NO: 2908013 - DNA, 19 bp, Homo sapiens
tcttacaaataaagtttgt

SEQ ID NO: 2908014 - DNA, 16 bp, Homo sapiens
tcttacacaagagctg

SEQ ID NO: 2908015 - DNA, 19 bp, Homo sapiens
tcttacacaagagctggag

SEQ ID NO: 2908016 - DNA, 14 bp, Homo sapiens
tcttaccagtctcc

SEQ ID NO: 2908017 - DNA, 18 bp, Homo sapiens
tcttaccctagttctctt

SEQ ID NO: 2908018 - DNA, 19 bp, Homo sapiens
tcttaccctagttctctta

SEQ ID NO: 2908019 - DNA, 16 bp, Homo sapiens
tcttactgataatttt

SEQ ID NO: 2908020 - DNA, 18 bp, Homo sapiens
tcttactgtacctgttcc

SEQ ID NO: 2908021 - DNA, 19 bp, Homo sapiens
tcttactttgtgcaaaagc

SEQ ID NO: 2908022 - DNA, 23 bp, Homo sapiens
tcttactttgtgcaaaagcaggc

SEQ ID NO: 2908023 - DNA, 19 bp, Homo sapiens
tcttagaagtggaccagga

SEQ ID NO: 2908024 - DNA, 21 bp, Homo sapiens
tcttagatctggtgtccagca

SEQ ID NO: 2908025 - DNA, 12 bp, Homo sapiens
tcttagattctc

SEQ ID NO: 2908026 - DNA, 18 bp, Homo sapiens
tcttagctactgtatgca

SEQ ID NO: 2908027 - DNA, 21 bp, Homo sapiens
tcttagctatcattgcttcct

SEQ ID NO: 2908028 - DNA, 20 bp, Homo sapiens
tcttagctgaggctgagaaa

SEQ ID NO: 2908029 - DNA, 11 bp, Homo sapiens
tcttaggtctt

SEQ ID NO: 2908030 - DNA, 14 bp, Homo sapiens
tcttaggtcttcct

SEQ ID NO: 2908031 - DNA, 18 bp, Homo sapiens
tcttaggtcttcctgtgg

SEQ ID NO: 2908032 - DNA, 20 bp, Homo sapiens
tcttaggtcttcctgtggct

SEQ ID NO: 2908033 - DNA, 21 bp, Homo sapiens
tcttaggtcttcctgtggctc

SEQ ID NO: 2908034 - DNA, 21 bp, Homo sapiens
tcttagtttggattcttatgt

SEQ ID NO: 2908035 - DNA, 20 bp, Homo sapiens
tcttataaaccttgtcaata

SEQ ID NO: 2908036 - DNA, 13 bp, Homo sapiens
tcttataaatatg

SEQ ID NO: 2908037 - DNA, 21 bp, Homo sapiens
tcttataaatatgaagctcac

SEQ ID NO: 2908038 - DNA, 20 bp, Homo sapiens
tcttatacgcttttctttgt

SEQ ID NO: 2908039 - DNA, 17 bp, Homo sapiens
tcttatagaataaaagc

SEQ ID NO: 2908040 - DNA, 20 bp, Homo sapiens
tcttatagattttttaaaaa

SEQ ID NO: 2908041 - DNA, 24 bp, Homo sapiens
tcttatccaactttttcatagtaa

SEQ ID NO: 2908042 - DNA, 17 bp, Homo sapiens
tcttatcttgctttgga

SEQ ID NO: 2908043 - DNA, 13 bp, Homo sapiens
tcttatctttgat

SEQ ID NO: 2908044 - DNA, 22 bp, Homo sapiens
tcttatgagtataatgaacact

SEQ ID NO: 2908045 - DNA, 17 bp, Homo sapiens
tcttatgcaaaactttt

SEQ ID NO: 2908046 - DNA, 15 bp, Homo sapiens
tcttatggaattgat

SEQ ID NO: 2908047 - DNA, 22 bp, Homo sapiens
tcttatggaattgatttgcatt

SEQ ID NO: 2908048 - DNA, 17 bp, Homo sapiens
tcttattcaaagatgat

SEQ ID NO: 2908049 - DNA, 18 bp, Homo sapiens
tcttattcctttaaagtg

SEQ ID NO: 2908050 - DNA, 15 bp, Homo sapiens
tcttattctcactcc

SEQ ID NO: 2908051 - DNA, 15 bp, Homo sapiens
tcttattgaaatgca

SEQ ID NO: 2908052 - DNA, 19 bp, Homo sapiens
tcttatttggaattgacat

SEQ ID NO: 2908053 - DNA, 20 bp, Homo sapiens
tcttcaaaagtaatgcctct

SEQ ID NO: 2908054 - DNA, 21 bp, Homo sapiens
tcttcaaatctcccacaagta

SEQ ID NO: 2908055 - DNA, 22 bp, Homo sapiens
tcttcaaatctcccacaagtat

SEQ ID NO: 2908056 - DNA, 20 bp, Homo sapiens
tcttcaacatgtcacactgg

SEQ ID NO: 2908057 - DNA, 16 bp, Homo sapiens
tcttcaaggcttcagt

SEQ ID NO: 2908058 - DNA, 21 bp, Homo sapiens
tcttcacctgattcaactaaa

SEQ ID NO: 2908059 - DNA, 23 bp, Homo sapiens
tcttcacctgggcgccaactgct

SEQ ID NO: 2908060 - DNA, 13 bp, Homo sapiens
tcttcaccttggt

SEQ ID NO: 2908061 - DNA, 20 bp, Homo sapiens
tcttcactgcaattttgtgt

SEQ ID NO: 2908062 - DNA, 12 bp, Homo sapiens
tcttcacttcct

SEQ ID NO: 2908063 - DNA, 13 bp, Homo sapiens
tcttcacttcctc

SEQ ID NO: 2908064 - DNA, 18 bp, Homo sapiens
tcttcagagatcatggaa

SEQ ID NO: 2908065 - DNA, 16 bp, Homo sapiens
tcttcagccacctctc

SEQ ID NO: 2908066 - DNA, 19 bp, Homo sapiens
tcttcagccacctctcttt

SEQ ID NO: 2908067 - DNA, 13 bp, Homo sapiens
tcttcagcttctt

SEQ ID NO: 2908068 - DNA, 23 bp, Homo sapiens
tcttcaggatgcacggtttctgt

SEQ ID NO: 2908069 - DNA, 17 bp, Homo sapiens
tcttcaggctctgccca

SEQ ID NO: 2908070 - DNA, 18 bp, Homo sapiens
tcttcaggctctgcccag

SEQ ID NO: 2908071 - DNA, 13 bp, Homo sapiens
tcttcagggcctg

SEQ ID NO: 2908072 - DNA, 22 bp, Homo sapiens
tcttcagggcctggttgaagaa

SEQ ID NO: 2908073 - DNA, 16 bp, Homo sapiens
tcttcaggtggaaaaa

SEQ ID NO: 2908074 - DNA, 20 bp, Homo sapiens
tcttcagtgtaatgtgactt

SEQ ID NO: 2908075 - DNA, 22 bp, Homo sapiens
tcttcagtgtaatgtgacttca

SEQ ID NO: 2908076 - DNA, 16 bp, Homo sapiens
tcttcagttaattctt

SEQ ID NO: 2908077 - DNA, 12 bp, Homo sapiens
tcttcatataaa

SEQ ID NO: 2908078 - DNA, 16 bp, Homo sapiens
tcttcatctccctgcc

SEQ ID NO: 2908079 - DNA, 18 bp, Homo sapiens
tcttcatcttcaccagag

SEQ ID NO: 2908080 - DNA, 20 bp, Homo sapiens
tcttccacaaaaaatacttt

SEQ ID NO: 2908081 - DNA, 11 bp, Homo sapiens
tcttccagaag

SEQ ID NO: 2908082 - DNA, 16 bp, Homo sapiens
tcttccagaagtgtga

SEQ ID NO: 2908083 - DNA, 18 bp, Homo sapiens
tcttcccgaaccccaagg

SEQ ID NO: 2908084 - DNA, 15 bp, Homo sapiens
tcttcccgcctcagc

SEQ ID NO: 2908085 - DNA, 14 bp, Homo sapiens
tcttccctgcccct

SEQ ID NO: 2908086 - DNA, 21 bp, Homo sapiens
tcttcccttttacatactgct

SEQ ID NO: 2908087 - DNA, 15 bp, Homo sapiens
tcttccgggcagaaa

SEQ ID NO: 2908088 - DNA, 14 bp, Homo sapiens
tcttcctcaagtct

SEQ ID NO: 2908089 - DNA, 14 bp, Homo sapiens
tcttcctcatcctg

SEQ ID NO: 2908090 - DNA, 20 bp, Homo sapiens
tcttcctccagtctgttctc

SEQ ID NO: 2908091 - DNA, 18 bp, Homo sapiens
tcttcctcttagcctctg

SEQ ID NO: 2908092 - DNA, 13 bp, Homo sapiens
tcttcctgtggct

SEQ ID NO: 2908093 - DNA, 19 bp, Homo sapiens
tcttcctgtggctccctct

SEQ ID NO: 2908094 - DNA, 17 bp, Homo sapiens
tcttcgggaccaggatt

SEQ ID NO: 2908095 - DNA, 22 bp, Homo sapiens
tcttcgtaacttcatattaata

SEQ ID NO: 2908096 - DNA, 15 bp, Homo sapiens
tcttctaattgctgt

SEQ ID NO: 2908097 - DNA, 20 bp, Homo sapiens
tcttctagaagataacattt

SEQ ID NO: 2908098 - DNA, 21 bp, Homo sapiens
tcttctagatggaccccagca

SEQ ID NO: 2908099 - DNA, 11 bp, Homo sapiens
tcttctcaagt

SEQ ID NO: 2908100 - DNA, 14 bp, Homo sapiens
tcttctcaagttct

SEQ ID NO: 2908101 - DNA, 15 bp, Homo sapiens
tcttctcaagttcta

SEQ ID NO: 2908102 - DNA, 17 bp, Homo sapiens
tcttctcaagttctaag

SEQ ID NO: 2908103 - DNA, 13 bp, Homo sapiens
tcttctcctctgg

SEQ ID NO: 2908104 - DNA, 15 bp, Homo sapiens
tcttctccttggagg

SEQ ID NO: 2908105 - DNA, 15 bp, Homo sapiens
tcttctcgcctagga

SEQ ID NO: 2908106 - DNA, 13 bp, Homo sapiens
tcttctctccact

SEQ ID NO: 2908107 - DNA, 16 bp, Homo sapiens
tcttctcttctttggg

SEQ ID NO: 2908108 - DNA, 17 bp, Homo sapiens
tcttctgcgcctcaggc

SEQ ID NO: 2908109 - DNA, 12 bp, Homo sapiens
tcttctggctca

SEQ ID NO: 2908110 - DNA, 13 bp, Homo sapiens
tcttctggctcaa

SEQ ID NO: 2908111 - DNA, 18 bp, Homo sapiens
tcttctggctcaaaaaga

SEQ ID NO: 2908112 - DNA, 17 bp, Homo sapiens
tcttctgggagggcagc

SEQ ID NO: 2908113 - DNA, 22 bp, Homo sapiens
tcttctgggagggcagcagggc

SEQ ID NO: 2908114 - DNA, 19 bp, Homo sapiens
tcttctgggcagagcctgt

SEQ ID NO: 2908115 - DNA, 15 bp, Homo sapiens
tcttcttcaccattt

SEQ ID NO: 2908116 - DNA, 13 bp, Homo sapiens
tcttcttgaaaaa

SEQ ID NO: 2908117 - DNA, 20 bp, Homo sapiens
tcttcttggggcccagtgca

SEQ ID NO: 2908118 - DNA, 23 bp, Homo sapiens
tcttctttgggatgctatttcag

SEQ ID NO: 2908119 - DNA, 15 bp, Homo sapiens
tcttcttttcctgca

SEQ ID NO: 2908120 - DNA, 16 bp, Homo sapiens
tcttcttttggcttcc

SEQ ID NO: 2908121 - DNA, 18 bp, Homo sapiens
tcttcttttggcttccat

SEQ ID NO: 2908122 - DNA, 21 bp, Homo sapiens
tcttctttttgaaatcagcat

SEQ ID NO: 2908123 - DNA, 19 bp, Homo sapiens
tcttctttttgcttcaaaa

SEQ ID NO: 2908124 - DNA, 13 bp, Homo sapiens
tctctaacatatg

SEQ ID NO: 2908125 - DNA, 21 bp, Homo sapiens
tctctaactcagaaacatcag

SEQ ID NO: 2908126 - DNA, 15 bp, Homo sapiens
tctctaataagaaaa

SEQ ID NO: 2908127 - DNA, 15 bp, Homo sapiens
tctctacccctttct

SEQ ID NO: 2908128 - DNA, 16 bp, Homo sapiens
tctctactccatggtt

SEQ ID NO: 2908129 - DNA, 21 bp, Homo sapiens
tctctactccatggttctcaa

SEQ ID NO: 2908130 - DNA, 22 bp, Homo sapiens
tctctacttttccctgtacttt

SEQ ID NO: 2908131 - DNA, 15 bp, Homo sapiens
tctctagtagttaaa

SEQ ID NO: 2908132 - DNA, 20 bp, Homo sapiens
tctctagtccctgtgttctg

SEQ ID NO: 2908133 - DNA, 14 bp, Homo sapiens
tctctatcattaaa

SEQ ID NO: 2908134 - DNA, 20 bp, Homo sapiens
tctctatgcaaaatgtctgt

SEQ ID NO: 2908135 - DNA, 14 bp, Homo sapiens
tctctcagccccat

SEQ ID NO: 2908136 - DNA, 12 bp, Homo sapiens
tctctcagctcc

SEQ ID NO: 2908137 - DNA, 16 bp, Homo sapiens
tctctcatagtgtcat

SEQ ID NO: 2908138 - DNA, 16 bp, Homo sapiens
tctctcattgtctgtg

SEQ ID NO: 2908139 - DNA, 12 bp, Homo sapiens
tctctccagcct

SEQ ID NO: 2908140 - DNA, 18 bp, Homo sapiens
tctctccagcctcacaga

SEQ ID NO: 2908141 - DNA, 17 bp, Homo sapiens
tctctcccaacgctgaa

SEQ ID NO: 2908142 - DNA, 19 bp, Homo sapiens
tctctcccaccccctcccc

SEQ ID NO: 2908143 - DNA, 19 bp, Homo sapiens
tctctcccaccctaagggc

SEQ ID NO: 2908144 - DNA, 22 bp, Homo sapiens
tctctcccaccctaagggcagc

SEQ ID NO: 2908145 - DNA, 19 bp, Homo sapiens
tctctccctctttctagcc

SEQ ID NO: 2908146 - DNA, 12 bp, Homo sapiens
tctctccctgcc

SEQ ID NO: 2908147 - DNA, 22 bp, Homo sapiens
tctctcccttactattcccact

SEQ ID NO: 2908148 - DNA, 13 bp, Homo sapiens
tctctcccttctt

SEQ ID NO: 2908149 - DNA, 15 bp, Homo sapiens
tctctcccttcttta

SEQ ID NO: 2908150 - DNA, 11 bp, Homo sapiens
tctctcctcct

SEQ ID NO: 2908151 - DNA, 12 bp, Homo sapiens
tctctcctggac

SEQ ID NO: 2908152 - DNA, 13 bp, Homo sapiens
tctctcctgtcca

SEQ ID NO: 2908153 - DNA, 14 bp, Homo sapiens
tctctcctgtccaa

SEQ ID NO: 2908154 - DNA, 17 bp, Homo sapiens
tctctctaacataacaa

SEQ ID NO: 2908155 - DNA, 19 bp, Homo sapiens
tctctctccctctttctag

SEQ ID NO: 2908156 - DNA, 13 bp, Homo sapiens
tctctctccctta

SEQ ID NO: 2908157 - DNA, 15 bp, Homo sapiens
tctctctcccttact

SEQ ID NO: 2908158 - DNA, 11 bp, Homo sapiens
tctctctcctg

SEQ ID NO: 2908159 - DNA, 10 bp, Homo sapiens
tctctctctt

SEQ ID NO: 2908160 - DNA, 14 bp, Homo sapiens
tctctctgcccaac

SEQ ID NO: 2908161 - DNA, 14 bp, Homo sapiens
tctctctgcctgct

SEQ ID NO: 2908162 - DNA, 15 bp, Homo sapiens
tctctctgcctgctg

SEQ ID NO: 2908163 - DNA, 17 bp, Homo sapiens
tctctctggagcccctc

SEQ ID NO: 2908164 - DNA, 20 bp, Homo sapiens
tctctctgtggtggttcatt

SEQ ID NO: 2908165 - DNA, 14 bp, Homo sapiens
tctctcttggaatt

SEQ ID NO: 2908166 - DNA, 14 bp, Homo sapiens
tctctgagcagtga

SEQ ID NO: 2908167 - DNA, 18 bp, Homo sapiens
tctctgagtcagctgacc

SEQ ID NO: 2908168 - DNA, 18 bp, Homo sapiens
tctctgatatacaaaggg

SEQ ID NO: 2908169 - DNA, 23 bp, Homo sapiens
tctctgatcaaaattacttttct

SEQ ID NO: 2908170 - DNA, 15 bp, Homo sapiens
tctctgcagccagcc

SEQ ID NO: 2908171 - DNA, 14 bp, Homo sapiens
tctctgcccagccg

SEQ ID NO: 2908172 - DNA, 16 bp, Homo sapiens
tctctgccgctacctc

SEQ ID NO: 2908173 - DNA, 18 bp, Homo sapiens
tctctgcctagaatcttt

SEQ ID NO: 2908174 - DNA, 15 bp, Homo sapiens
tctctgcctggagca

SEQ ID NO: 2908175 - DNA, 18 bp, Homo sapiens
tctctgcctggagcaggg

SEQ ID NO: 2908176 - DNA, 15 bp, Homo sapiens
tctctgccttgcctt

SEQ ID NO: 2908177 - DNA, 13 bp, Homo sapiens
tctctgcctttga

SEQ ID NO: 2908178 - DNA, 13 bp, Homo sapiens
tctctgcttaccg

SEQ ID NO: 2908179 - DNA, 12 bp, Homo sapiens
tctctgcttcca

SEQ ID NO: 2908180 - DNA, 22 bp, Homo sapiens
tctctgcttccatggcttcctg

SEQ ID NO: 2908181 - DNA, 11 bp, Homo sapiens
tctctggagcc

SEQ ID NO: 2908182 - DNA, 20 bp, Homo sapiens
tctctggagcccctcctccc

SEQ ID NO: 2908183 - DNA, 14 bp, Homo sapiens
tctctggcatttgt

SEQ ID NO: 2908184 - DNA, 16 bp, Homo sapiens
tctctggcgacagttt

SEQ ID NO: 2908185 - DNA, 17 bp, Homo sapiens
tctctggctcagctgtg

SEQ ID NO: 2908186 - DNA, 19 bp, Homo sapiens
tctctggctcagctgtggt

SEQ ID NO: 2908187 - DNA, 19 bp, Homo sapiens
tctctggctgtaaggctct

SEQ ID NO: 2908188 - DNA, 20 bp, Homo sapiens
tctctggctgtaaggctcta

SEQ ID NO: 2908189 - DNA, 22 bp, Homo sapiens
tctctggctgtaaggctctaga

SEQ ID NO: 2908190 - DNA, 23 bp, Homo sapiens
tctctggctgtaaggctctagat

SEQ ID NO: 2908191 - DNA, 21 bp, Homo sapiens
tctctgggtttacaacaaaca

SEQ ID NO: 2908192 - DNA, 16 bp, Homo sapiens
tctctgtacttttcat

SEQ ID NO: 2908193 - DNA, 21 bp, Homo sapiens
tctctgtacttttcattctct

SEQ ID NO: 2908194 - DNA, 16 bp, Homo sapiens
tctctgtatatttatg

SEQ ID NO: 2908195 - DNA, 22 bp, Homo sapiens
tctctgtcagtgtgaaaattca

SEQ ID NO: 2908196 - DNA, 14 bp, Homo sapiens
tctctgtcccttgc

SEQ ID NO: 2908197 - DNA, 17 bp, Homo sapiens
tctctgtcccttgctgt

SEQ ID NO: 2908198 - DNA, 11 bp, Homo sapiens
tctctgtcctc

SEQ ID NO: 2908199 - DNA, 15 bp, Homo sapiens
tctctgtctctgtgg

SEQ ID NO: 2908200 - DNA, 14 bp, Homo sapiens
tctctgtcttctct

SEQ ID NO: 2908201 - DNA, 22 bp, Homo sapiens
tctctgtctttttccttcctga

SEQ ID NO: 2908202 - DNA, 13 bp, Homo sapiens
tctctgtgaatcc

SEQ ID NO: 2908203 - DNA, 17 bp, Homo sapiens
tctctgtgaatccatgg

SEQ ID NO: 2908204 - DNA, 19 bp, Homo sapiens
tctctgtgaatccatgggt

SEQ ID NO: 2908205 - DNA, 18 bp, Homo sapiens
tctctgttgactggctgt

SEQ ID NO: 2908206 - DNA, 14 bp, Homo sapiens
tctcttaaactctc

SEQ ID NO: 2908207 - DNA, 20 bp, Homo sapiens
tctcttagctactgtatgca

SEQ ID NO: 2908208 - DNA, 20 bp, Homo sapiens
tctcttcaagcatcctcaga

SEQ ID NO: 2908209 - DNA, 16 bp, Homo sapiens
tctcttcactgctaca

SEQ ID NO: 2908210 - DNA, 22 bp, Homo sapiens
tctcttcccttttttttctggg

SEQ ID NO: 2908211 - DNA, 20 bp, Homo sapiens
tctcttctgtccatcagtgc

SEQ ID NO: 2908212 - DNA, 22 bp, Homo sapiens
tctcttcttccctgtcagcctg

SEQ ID NO: 2908213 - DNA, 15 bp, Homo sapiens
tctcttcttgtttct

SEQ ID NO: 2908214 - DNA, 15 bp, Homo sapiens
tctcttgcccttcct

SEQ ID NO: 2908215 - DNA, 22 bp, Homo sapiens
tctcttggaattagatgtttat

SEQ ID NO: 2908216 - DNA, 14 bp, Homo sapiens
tctcttgtcacatg

SEQ ID NO: 2908217 - DNA, 19 bp, Homo sapiens
tctcttgtgacgtgcactg

SEQ ID NO: 2908218 - DNA, 20 bp, Homo sapiens
tctcttgtgacgtgcactgt

SEQ ID NO: 2908219 - DNA, 15 bp, Homo sapiens
tctcttgtgactcag

SEQ ID NO: 2908220 - DNA, 22 bp, Homo sapiens
tctcttgtttaaaaaaagaaaa

SEQ ID NO: 2908221 - DNA, 16 bp, Homo sapiens
tctctttccactttgt

SEQ ID NO: 2908222 - DNA, 12 bp, Homo sapiens
tctctttctctc

SEQ ID NO: 2908223 - DNA, 17 bp, Homo sapiens
tctctttgttctaaaga

SEQ ID NO: 2908224 - DNA, 12 bp, Homo sapiens
tctcttttccac

SEQ ID NO: 2908225 - DNA, 21 bp, Homo sapiens
tctttcagacttgccatgtga

SEQ ID NO: 2908226 - DNA, 23 bp, Homo sapiens
tctttcagtattaaactctcctt

SEQ ID NO: 2908227 - DNA, 12 bp, Homo sapiens
tctttcatgagt

SEQ ID NO: 2908228 - DNA, 19 bp, Homo sapiens
tctttccaaccggctttgt

SEQ ID NO: 2908229 - DNA, 19 bp, Homo sapiens
tctttccacggagccactc

SEQ ID NO: 2908230 - DNA, 14 bp, Homo sapiens
tctttccactttgt

SEQ ID NO: 2908231 - DNA, 17 bp, Homo sapiens
tccgacctctctcggcc

SEQ ID NO: 2908232 - DNA, 20 bp, Homo sapiens
tccgagagcagtgggcaggt

SEQ ID NO: 2908233 - DNA, 13 bp, Homo sapiens
tccgagaggctgg

SEQ ID NO: 2908234 - DNA, 20 bp, Homo sapiens
tccgcagactgcttggccag

SEQ ID NO: 2908235 - DNA, 22 bp, Homo sapiens
tccgcagactgcttggccagat

SEQ ID NO: 2908236 - DNA, 19 bp, Homo sapiens
tccgcagtgtggccaggct

SEQ ID NO: 2908237 - DNA, 13 bp, Homo sapiens
tccgcataagaaa

SEQ ID NO: 2908238 - DNA, 19 bp, Homo sapiens
tccgcataagaaaaagaat

SEQ ID NO: 2908239 - DNA, 16 bp, Homo sapiens
tccgcatccctgcttc

SEQ ID NO: 2908240 - DNA, 15 bp, Homo sapiens
tccgccaggcgctgc

SEQ ID NO: 2908241 - DNA, 16 bp, Homo sapiens
tccgcctactgtccct

SEQ ID NO: 2908242 - DNA, 15 bp, Homo sapiens
tccgcctccacactg

SEQ ID NO: 2908243 - DNA, 16 bp, Homo sapiens
tccgcctcccatcccg

SEQ ID NO: 2908244 - DNA, 14 bp, Homo sapiens
tccgcctgcgcctc

SEQ ID NO: 2908245 - DNA, 11 bp, Homo sapiens
tccgccttcac

SEQ ID NO: 2908246 - DNA, 17 bp, Homo sapiens
tccgccttcacattccc

SEQ ID NO: 2908247 - DNA, 20 bp, Homo sapiens
tccgcgcggagacctcctga

SEQ ID NO: 2908248 - DNA, 14 bp, Homo sapiens
tccgctgccgtgcc

SEQ ID NO: 2908249 - DNA, 15 bp, Homo sapiens
tccgcttatcctgct

SEQ ID NO: 2908250 - DNA, 16 bp, Homo sapiens
tccgcttatcctgcta

SEQ ID NO: 2908251 - DNA, 16 bp, Homo sapiens
tccggaatgccaccca

SEQ ID NO: 2908252 - DNA, 17 bp, Homo sapiens
tccggaatgccacccac

SEQ ID NO: 2908253 - DNA, 18 bp, Homo sapiens
tccggaatgccacccaca

SEQ ID NO: 2908254 - DNA, 16 bp, Homo sapiens
tccggatcctaagcat

SEQ ID NO: 2908255 - DNA, 21 bp, Homo sapiens
tccggcctgggtgacagagtg

SEQ ID NO: 2908256 - DNA, 14 bp, Homo sapiens
tccggcgcagacag

SEQ ID NO: 2908257 - DNA, 21 bp, Homo sapiens
tccggcttgacctgtttctct

SEQ ID NO: 2908258 - DNA, 12 bp, Homo sapiens
tccgggcagaaa

SEQ ID NO: 2908259 - DNA, 19 bp, Homo sapiens
tccgggcaggggagccagg

SEQ ID NO: 2908260 - DNA, 23 bp, Homo sapiens
tcctccccctgccagtgccttac

SEQ ID NO: 2908261 - DNA, 24 bp, Homo sapiens
tcctccccctgccagtgccttacc

SEQ ID NO: 2908262 - DNA, 18 bp, Homo sapiens
tcctcccctgccgcctcc

SEQ ID NO: 2908263 - DNA, 13 bp, Homo sapiens
tcctccctccctc

SEQ ID NO: 2908264 - DNA, 14 bp, Homo sapiens
tcctccctgcatct

SEQ ID NO: 2908265 - DNA, 14 bp, Homo sapiens
tcctccctggctgc

SEQ ID NO: 2908266 - DNA, 15 bp, Homo sapiens
tcctccctggctgca

SEQ ID NO: 2908267 - DNA, 19 bp, Homo sapiens
tcctccctggctgcagcct

SEQ ID NO: 2908268 - DNA, 12 bp, Homo sapiens
tcctccctgtta

SEQ ID NO: 2908269 - DNA, 16 bp, Homo sapiens
tcctcccttctgctac

SEQ ID NO: 2908270 - DNA, 14 bp, Homo sapiens
tcctccgaggccag

SEQ ID NO: 2908271 - DNA, 15 bp, Homo sapiens
tcctccgcatgccaa

SEQ ID NO: 2908272 - DNA, 19 bp, Homo sapiens
tcctccgcctactgtccct

SEQ ID NO: 2908273 - DNA, 19 bp, Homo sapiens
tcctccggttcttcctcgg

SEQ ID NO: 2908274 - DNA, 13 bp, Homo sapiens
tcctccgtggcac

SEQ ID NO: 2908275 - DNA, 14 bp, Homo sapiens
tcctccgtggcaca

SEQ ID NO: 2908276 - DNA, 15 bp, Homo sapiens
tcctccgtggcacat

SEQ ID NO: 2908277 - DNA, 23 bp, Homo sapiens
tcctcctacctcagcctcctggg

SEQ ID NO: 2908278 - DNA, 15 bp, Homo sapiens
tcctcctccaccacc

SEQ ID NO: 2908279 - DNA, 18 bp, Homo sapiens
tcctcctccaccaccgcc

SEQ ID NO: 2908280 - DNA, 19 bp, Homo sapiens
tcctcctccctcctcactc

SEQ ID NO: 2908281 - DNA, 20 bp, Homo sapiens
tctacccgtgcctgggcccc

SEQ ID NO: 2908282 - DNA, 20 bp, Homo sapiens
tctacctgagcattcaggca

SEQ ID NO: 2908283 - DNA, 18 bp, Homo sapiens
tctacctgcaacacaaca

SEQ ID NO: 2908284 - DNA, 13 bp, Homo sapiens
tctacctgttctg

SEQ ID NO: 2908285 - DNA, 14 bp, Homo sapiens
tctacctgttctgt

SEQ ID NO: 2908286 - DNA, 15 bp, Homo sapiens
tctacctgttctgta

SEQ ID NO: 2908287 - DNA, 19 bp, Homo sapiens
tctacgcaattgacaaacc

SEQ ID NO: 2908288 - DNA, 18 bp, Homo sapiens
tctactaaaaataccaaa

SEQ ID NO: 2908289 - DNA, 15 bp, Homo sapiens
tctactaagttattt

SEQ ID NO: 2908290 - DNA, 20 bp, Homo sapiens
tctactaagttattttatga

SEQ ID NO: 2908291 - DNA, 20 bp, Homo sapiens
tctactaagtttccttttaa

SEQ ID NO: 2908292 - DNA, 18 bp, Homo sapiens
tctactaattccacacct

SEQ ID NO: 2908293 - DNA, 18 bp, Homo sapiens
tctactcagcatttgatt

SEQ ID NO: 2908294 - DNA, 16 bp, Homo sapiens
tctactgggagcctac

SEQ ID NO: 2908295 - DNA, 19 bp, Homo sapiens
tctacttctgcccttgcca

SEQ ID NO: 2908296 - DNA, 15 bp, Homo sapiens
tctacttctgtgtct

SEQ ID NO: 2908297 - DNA, 20 bp, Homo sapiens
tctacttctgtgtctgtcac

SEQ ID NO: 2908298 - DNA, 20 bp, Homo sapiens
tctacttgtccagttcaaat

SEQ ID NO: 2908299 - DNA, 17 bp, Homo sapiens
tctacttgttcatttgg

SEQ ID NO: 2908300 - DNA, 22 bp, Homo sapiens
tctactttagaatgagagtgtg

SEQ ID NO: 2908301 - DNA, 12 bp, Homo sapiens
tctactttctct

SEQ ID NO: 2908302 - DNA, 17 bp, Homo sapiens
tctactttctcttgttt

SEQ ID NO: 2908303 - DNA, 16 bp, Homo sapiens
tctagaaaagcttcct

SEQ ID NO: 2908304 - DNA, 20 bp, Homo sapiens
tctagaaaagcttcctagct

SEQ ID NO: 2908305 - DNA, 17 bp, Homo sapiens
tctagaagaattaagct

SEQ ID NO: 2908306 - DNA, 13 bp, Homo sapiens
tctagaagataac

SEQ ID NO: 2908307 - DNA, 17 bp, Homo sapiens
tctagaagataacattt

SEQ ID NO: 2908308 - DNA, 18 bp, Homo sapiens
tctagaagataacatttt

SEQ ID NO: 2908309 - DNA, 16 bp, Homo sapiens
tctagaagttgtttgt

SEQ ID NO: 2908310 - DNA, 17 bp, Homo sapiens
tctagaatcctgcttta

SEQ ID NO: 2908311 - DNA, 22 bp, Homo sapiens
tctagaatctgcaattcaaaag

SEQ ID NO: 2908312 - DNA, 23 bp, Homo sapiens
tctagagagggaggcaagccctg

SEQ ID NO: 2908313 - DNA, 13 bp, Homo sapiens
tctagagtccaag

SEQ ID NO: 2908314 - DNA, 22 bp, Homo sapiens
tctagagtttatacagtgtaca

SEQ ID NO: 2908315 - DNA, 15 bp, Homo sapiens
tctagatacctaaaa

SEQ ID NO: 2908316 - DNA, 18 bp, Homo sapiens
tctagatacctaaaacat

SEQ ID NO: 2908317 - DNA, 18 bp, Homo sapiens
tctagatcagatgctcca

SEQ ID NO: 2908318 - DNA, 22 bp, Homo sapiens
tctagatcagatgctccaagat

SEQ ID NO: 2908319 - DNA, 14 bp, Homo sapiens
tctagatctcagcc

SEQ ID NO: 2908320 - DNA, 22 bp, Homo sapiens
tctagatgaagttttacattgt

SEQ ID NO: 2908321 - DNA, 23 bp, Homo sapiens
tctagatgaagttttacattgtt

SEQ ID NO: 2908322 - DNA, 14 bp, Homo sapiens
tctagatgacataa

SEQ ID NO: 2908323 - DNA, 16 bp, Homo sapiens
tctagatgagctgggc

SEQ ID NO: 2908324 - DNA, 19 bp, Homo sapiens
tctagatggctcctctcag

SEQ ID NO: 2908325 - DNA, 23 bp, Homo sapiens
tctagatgtttattcttctagag

SEQ ID NO: 2908326 - DNA, 17 bp, Homo sapiens
tctagattcaaaggttc

SEQ ID NO: 2908327 - DNA, 19 bp, Homo sapiens
tctagattcaaaggttcta

SEQ ID NO: 2908328 - DNA, 23 bp, Homo sapiens
tctagattcaaaggttctaggtt

SEQ ID NO: 2908329 - DNA, 21 bp, Homo sapiens
tctagattccattggtccaag

SEQ ID NO: 2908330 - DNA, 23 bp, Homo sapiens
tctagattccattggtccaagat

SEQ ID NO: 2908331 - DNA, 11 bp, Homo sapiens
tctagattctc

SEQ ID NO: 2908332 - DNA, 15 bp, Homo sapiens
tctagcaaatgttat

SEQ ID NO: 2908333 - DNA, 22 bp, Homo sapiens
tctagcatgccaacaagaatgc

SEQ ID NO: 2908334 - DNA, 18 bp, Homo sapiens
tctagccgctgccctggg

SEQ ID NO: 2908335 - DNA, 20 bp, Homo sapiens
tctagccgctgccctgggtc

SEQ ID NO: 2908336 - DNA, 13 bp, Homo sapiens
tctagctgtatga

SEQ ID NO: 2908337 - DNA, 19 bp, Homo sapiens
tctagctgtatgatttgtt

SEQ ID NO: 2908338 - DNA, 17 bp, Homo sapiens
tctagcttttttcctcc

SEQ ID NO: 2908339 - DNA, 23 bp, Homo sapiens
tctagcttttttcctcctttctc

SEQ ID NO: 2908340 - DNA, 22 bp, Homo sapiens
tctaggaagaattttaaaaatg

SEQ ID NO: 2908341 - DNA, 17 bp, Homo sapiens
tctaggagctgggagga

SEQ ID NO: 2908342 - DNA, 15 bp, Homo sapiens
tctaggcaaaagaaa

SEQ ID NO: 2908343 - DNA, 17 bp, Homo sapiens
tctaggctctgccttcg

SEQ ID NO: 2908344 - DNA, 14 bp, Homo sapiens
tctagggcagggtg

SEQ ID NO: 2908345 - DNA, 13 bp, Homo sapiens
tctagggctggga

SEQ ID NO: 2908346 - DNA, 18 bp, Homo sapiens
tctagggttattgcattt

SEQ ID NO: 2908347 - DNA, 21 bp, Homo sapiens
tctaggtcttggttagagaag

SEQ ID NO: 2908348 - DNA, 15 bp, Homo sapiens
tctaggtttcaaaga

SEQ ID NO: 2908349 - DNA, 15 bp, Homo sapiens
tctagtagttaaaaa

SEQ ID NO: 2908350 - DNA, 15 bp, Homo sapiens
tctagtctgagcttc

SEQ ID NO: 2908351 - DNA, 18 bp, Homo sapiens
tctagtgccttctaaagg

SEQ ID NO: 2908352 - DNA, 18 bp, Homo sapiens
tctagttgcttgtaaaat

SEQ ID NO: 2908353 - DNA, 15 bp, Homo sapiens
tctagtttgcaactt

SEQ ID NO: 2908354 - DNA, 13 bp, Homo sapiens
tctagtttgcatt

SEQ ID NO: 2908355 - DNA, 18 bp, Homo sapiens
tctagtttgcattcctga

SEQ ID NO: 2908356 - DNA, 12 bp, Homo sapiens
tctagtttgttt

SEQ ID NO: 2908357 - DNA, 16 bp, Homo sapiens
tctataaattgtccgt

SEQ ID NO: 2908358 - DNA, 16 bp, Homo sapiens
tctataaggccataaa

SEQ ID NO: 2908359 - DNA, 15 bp, Homo sapiens
tctatacctgtgtcc

SEQ ID NO: 2908360 - DNA, 17 bp, Homo sapiens
tctatagaactgaatga

SEQ ID NO: 2908361 - DNA, 21 bp, Homo sapiens
tctataggaacatatgaaaat

SEQ ID NO: 2908362 - DNA, 14 bp, Homo sapiens
tctatagttctaga

SEQ ID NO: 2908363 - DNA, 15 bp, Homo sapiens
tctatagttctagac

SEQ ID NO: 2908364 - DNA, 14 bp, Homo sapiens
tctatatagacttg

SEQ ID NO: 2908365 - DNA, 13 bp, Homo sapiens
tctatatgtactt

SEQ ID NO: 2908366 - DNA, 18 bp, Homo sapiens
tctatattttaatagaaa

SEQ ID NO: 2908367 - DNA, 22 bp, Homo sapiens
tctatcaaccccagacactggt

SEQ ID NO: 2908368 - DNA, 14 bp, Homo sapiens
tctatcattaaagt

SEQ ID NO: 2908369 - DNA, 15 bp, Homo sapiens
tctatcctctctctc

SEQ ID NO: 2908370 - DNA, 18 bp, Homo sapiens
tctatcgttattataaat

SEQ ID NO: 2908371 - DNA, 14 bp, Homo sapiens
tctatcttgttcca

SEQ ID NO: 2908372 - DNA, 22 bp, Homo sapiens
tctatgatgtttcttttgcaat

SEQ ID NO: 2908373 - DNA, 22 bp, Homo sapiens
tctatgattccaggtggcatca

SEQ ID NO: 2908374 - DNA, 22 bp, Homo sapiens
tctatgcaaaatgtctgtttta

SEQ ID NO: 2908375 - DNA, 21 bp, Homo sapiens
tctatgccatttttagtttaa

SEQ ID NO: 2908376 - DNA, 15 bp, Homo sapiens
tctatgtaggaaaaa

SEQ ID NO: 2908377 - DNA, 19 bp, Homo sapiens
tctatgtaggaaaaaaata

SEQ ID NO: 2908378 - DNA, 20 bp, Homo sapiens
tctatgtcgtgttttcaagg

SEQ ID NO: 2908379 - DNA, 18 bp, Homo sapiens
tctatgtgaatatttgta

SEQ ID NO: 2908380 - DNA, 12 bp, Homo sapiens
tctatgttgcta

SEQ ID NO: 2908381 - DNA, 17 bp, Homo sapiens
tctatgttttaaaataa

SEQ ID NO: 2908382 - DNA, 15 bp, Homo sapiens
tctattaagggatta

SEQ ID NO: 2908383 - DNA, 16 bp, Homo sapiens
tctattacccctcatt

SEQ ID NO: 2908384 - DNA, 23 bp, Homo sapiens
tctattattatgaagaattgcca

SEQ ID NO: 2908385 - DNA, 13 bp, Homo sapiens
tctattccagctc

SEQ ID NO: 2908386 - DNA, 15 bp, Homo sapiens
tctattccagctcat

SEQ ID NO: 2908387 - DNA, 13 bp, Homo sapiens
tctattctctcca

SEQ ID NO: 2908388 - DNA, 19 bp, Homo sapiens
tctattctgagaaaacaag

SEQ ID NO: 2908389 - DNA, 22 bp, Homo sapiens
tctattgacttcaatgatagta

SEQ ID NO: 2908390 - DNA, 22 bp, Homo sapiens
tctattgtaattttgttcctgt

SEQ ID NO: 2908391 - DNA, 23 bp, Homo sapiens
tctattgtcatggggatcaattt

SEQ ID NO: 2908392 - DNA, 12 bp, Homo sapiens
tctatttagtta

SEQ ID NO: 2908393 - DNA, 13 bp, Homo sapiens
tctatttatgttt

SEQ ID NO: 2908394 - DNA, 15 bp, Homo sapiens
tctatttcctggaat

SEQ ID NO: 2908395 - DNA, 15 bp, Homo sapiens
tctatttctcctcca

SEQ ID NO: 2908396 - DNA, 16 bp, Homo sapiens
tctatttctctgtgta

SEQ ID NO: 2908397 - DNA, 12 bp, Homo sapiens
tctattttaaga

SEQ ID NO: 2908398 - DNA, 15 bp, Homo sapiens
tctattttggattgt

SEQ ID NO: 2908399 - DNA, 13 bp, Homo sapiens
tctcaaagctggg

SEQ ID NO: 2908400 - DNA, 12 bp, Homo sapiens
tctcaaagtttt

SEQ ID NO: 2908401 - DNA, 14 bp, Homo sapiens
tctcaaagttttat

SEQ ID NO: 2908402 - DNA, 23 bp, Homo sapiens
tctcaaatccctctccaactgcc

SEQ ID NO: 2908403 - DNA, 12 bp, Homo sapiens
tctcaaatgtgt

SEQ ID NO: 2908404 - DNA, 22 bp, Homo sapiens
tctcaaatgtgtgtggcagcca

SEQ ID NO: 2908405 - DNA, 12 bp, Homo sapiens
tctcaagactga

SEQ ID NO: 2908406 - DNA, 20 bp, Homo sapiens
tctcaagggtggcaggtcac

SEQ ID NO: 2908407 - DNA, 13 bp, Homo sapiens
tctcaagttctaa

SEQ ID NO: 2908408 - DNA, 20 bp, Homo sapiens
tctcaatagctccaagctgt

SEQ ID NO: 2908409 - DNA, 21 bp, Homo sapiens
tctcaatagctccaagctgtt

SEQ ID NO: 2908410 - DNA, 16 bp, Homo sapiens
tctcctcatgttctgc

SEQ ID NO: 2908411 - DNA, 16 bp, Homo sapiens
tctcctccatgggaga

SEQ ID NO: 2908412 - DNA, 13 bp, Homo sapiens
tctcctccgtggc

SEQ ID NO: 2908413 - DNA, 14 bp, Homo sapiens
tctcctcctcctcc

SEQ ID NO: 2908414 - DNA, 16 bp, Homo sapiens
tctcctcctgcccacc

SEQ ID NO: 2908415 - DNA, 18 bp, Homo sapiens
tctcctccttgggcaggg

SEQ ID NO: 2908416 - DNA, 21 bp, Homo sapiens
tctcctccttgggcagggtct

SEQ ID NO: 2908417 - DNA, 22 bp, Homo sapiens
tctcctcgttggttcatgtgtt

SEQ ID NO: 2908418 - DNA, 12 bp, Homo sapiens
tctcctctcagc

SEQ ID NO: 2908419 - DNA, 13 bp, Homo sapiens
tctcctctcagct

SEQ ID NO: 2908420 - DNA, 16 bp, Homo sapiens
tctcctctcttggcat

SEQ ID NO: 2908421 - DNA, 15 bp, Homo sapiens
tctcctctggcttcc

SEQ ID NO: 2908422 - DNA, 15 bp, Homo sapiens
tctcctcttgtaaat

SEQ ID NO: 2908423 - DNA, 20 bp, Homo sapiens
tctcctctttgaacatggtc

SEQ ID NO: 2908424 - DNA, 17 bp, Homo sapiens
tctcctgaagatactta

SEQ ID NO: 2908425 - DNA, 15 bp, Homo sapiens
tctcctgactggtgc

SEQ ID NO: 2908426 - DNA, 14 bp, Homo sapiens
tctcctgagctagg

SEQ ID NO: 2908427 - DNA, 14 bp, Homo sapiens
tctcctgcatggca

SEQ ID NO: 2908428 - DNA, 12 bp, Homo sapiens
tctcctgcctac

SEQ ID NO: 2908429 - DNA, 12 bp, Homo sapiens
tctcctgcctca

SEQ ID NO: 2908430 - DNA, 14 bp, Homo sapiens
tctcctgcctcagc

SEQ ID NO: 2908431 - DNA, 16 bp, Homo sapiens
tctcctgcctcagcct

SEQ ID NO: 2908432 - DNA, 20 bp, Homo sapiens
tctcctgcctcagcctccca

SEQ ID NO: 2908433 - DNA, 20 bp, Homo sapiens
tctcctgccttcctcctggg

SEQ ID NO: 2908434 - DNA, 16 bp, Homo sapiens
tctcctgcttgtacta

SEQ ID NO: 2908435 - DNA, 22 bp, Homo sapiens
tctcctgcttgtactaagccag

SEQ ID NO: 2908436 - DNA, 19 bp, Homo sapiens
tcagctcttggctccactg

SEQ ID NO: 2908437 - DNA, 15 bp, Homo sapiens
tcagctgaccccctc

SEQ ID NO: 2908438 - DNA, 16 bp, Homo sapiens
tcagctgaccccctcc

SEQ ID NO: 2908439 - DNA, 21 bp, Homo sapiens
tcagctgcatttcacatgcct

SEQ ID NO: 2908440 - DNA, 23 bp, Homo sapiens
tcagctgcatttcacatgccttg

SEQ ID NO: 2908441 - DNA, 13 bp, Homo sapiens
tcagctgctccca

SEQ ID NO: 2908442 - DNA, 17 bp, Homo sapiens
tcagctgctcccacact

SEQ ID NO: 2908443 - DNA, 19 bp, Homo sapiens
tcagctgctgttgaacttt

SEQ ID NO: 2908444 - DNA, 22 bp, Homo sapiens
tcagctgctgttgaacttttta

SEQ ID NO: 2908445 - DNA, 20 bp, Homo sapiens
tcagctgggcagtgccagcc

SEQ ID NO: 2908446 - DNA, 11 bp, Homo sapiens
tcagctggtgg

SEQ ID NO: 2908447 - DNA, 15 bp, Homo sapiens
tcagctgtctgtcat

SEQ ID NO: 2908448 - DNA, 18 bp, Homo sapiens
tcagctgttgcaggcagt

SEQ ID NO: 2908449 - DNA, 19 bp, Homo sapiens
tcagctgttgcaggcagtg

SEQ ID NO: 2908450 - DNA, 22 bp, Homo sapiens
tcagctgttgcaggcagtgtct

SEQ ID NO: 2908451 - DNA, 13 bp, Homo sapiens
tcagcttatctct

SEQ ID NO: 2908452 - DNA, 15 bp, Homo sapiens
tcagcttcgtgcctg

SEQ ID NO: 2908453 - DNA, 14 bp, Homo sapiens
tcagcttcttcatc

SEQ ID NO: 2908454 - DNA, 20 bp, Homo sapiens
tcagctttatttttctttaa

SEQ ID NO: 2908455 - DNA, 19 bp, Homo sapiens
tcagctttgcttcatgttc

SEQ ID NO: 2908456 - DNA, 16 bp, Homo sapiens
tcagcttttcagtgaa

SEQ ID NO: 2908457 - DNA, 18 bp, Homo sapiens
tcagcttttgttgtttat

SEQ ID NO: 2908458 - DNA, 22 bp, Homo sapiens
tcaggaaaactgacagaggagg

SEQ ID NO: 2908459 - DNA, 17 bp, Homo sapiens
tcaggaaacatatttaa

SEQ ID NO: 2908460 - DNA, 20 bp, Homo sapiens
tcaggaaacatatttaagaa

SEQ ID NO: 2908461 - DNA, 22 bp, Homo sapiens
tcaggaaaccacaaccttgcag

SEQ ID NO: 2908462 - DNA, 15 bp, Homo sapiens
tcaggaaaggaatca

SEQ ID NO: 2908463 - DNA, 21 bp, Homo sapiens
tcaggaacctcgagtactgtg

SEQ ID NO: 2908464 - DNA, 13 bp, Homo sapiens
tcaggaagaacac

SEQ ID NO: 2908465 - DNA, 18 bp, Homo sapiens
tcaggaatcagaaatcat

SEQ ID NO: 2908466 - DNA, 20 bp, Homo sapiens
tcaggaatttaaaattaagt

SEQ ID NO: 2908467 - DNA, 20 bp, Homo sapiens
tcaggacctccaagccactg

SEQ ID NO: 2908468 - DNA, 14 bp, Homo sapiens
tcaggacctggctt

SEQ ID NO: 2908469 - DNA, 18 bp, Homo sapiens
tcaggagaattagatttc

SEQ ID NO: 2908470 - DNA, 18 bp, Homo sapiens
tcaggaggaggctgccct

SEQ ID NO: 2908471 - DNA, 18 bp, Homo sapiens
tcaggaggctgagacagg

SEQ ID NO: 2908472 - DNA, 18 bp, Homo sapiens
tcaggaggctgaggcaga

SEQ ID NO: 2908473 - DNA, 17 bp, Homo sapiens
tcaggagttcaagacta

SEQ ID NO: 2908474 - DNA, 22 bp, Homo sapiens
tcaggagtttgagaccaggctg

SEQ ID NO: 2908475 - DNA, 22 bp, Homo sapiens
tcaggatccaagctaagcactg

SEQ ID NO: 2908476 - DNA, 19 bp, Homo sapiens
tcaggcaattctcctgcct

SEQ ID NO: 2908477 - DNA, 19 bp, Homo sapiens
tcaggcaattgattgtgaa

SEQ ID NO: 2908478 - DNA, 13 bp, Homo sapiens
tcaggcacaggtc

SEQ ID NO: 2908479 - DNA, 15 bp, Homo sapiens
tcaggcacaggtcag

SEQ ID NO: 2908480 - DNA, 19 bp, Homo sapiens
tcaggcaccagtccctgtc

SEQ ID NO: 2908481 - DNA, 14 bp, Homo sapiens
tcaggccagagcca

SEQ ID NO: 2908482 - DNA, 11 bp, Homo sapiens
tcaggccaggt

SEQ ID NO: 2908483 - DNA, 22 bp, Homo sapiens
tcaggccaggtagcagcaaata

SEQ ID NO: 2908484 - DNA, 20 bp, Homo sapiens
tcaggcccgtcggagctgcc

SEQ ID NO: 2908485 - DNA, 17 bp, Homo sapiens
tcaggccctcagctgtc

SEQ ID NO: 2908486 - DNA, 13 bp, Homo sapiens
tcaggccctctgc

SEQ ID NO: 2908487 - DNA, 14 bp, Homo sapiens
tcaggccctctgcc

SEQ ID NO: 2908488 - DNA, 15 bp, Homo sapiens
tcaggccctctgcct

SEQ ID NO: 2908489 - DNA, 24 bp, Homo sapiens
tcaggctgctggggcctcagacga

SEQ ID NO: 2908490 - DNA, 14 bp, Homo sapiens
tcaggctggtctcg

SEQ ID NO: 2908491 - DNA, 18 bp, Homo sapiens
tcaggcttataacaaata

SEQ ID NO: 2908492 - DNA, 20 bp, Homo sapiens
tcaggcttcctggtgagaac

SEQ ID NO: 2908493 - DNA, 16 bp, Homo sapiens
tcagggaaaagcagct

SEQ ID NO: 2908494 - DNA, 17 bp, Homo sapiens
tcagggaacatatttaa

SEQ ID NO: 2908495 - DNA, 17 bp, Homo sapiens
tcagggaactgcttgcc

SEQ ID NO: 2908496 - DNA, 19 bp, Homo sapiens
tcagggaactgcttgccca

SEQ ID NO: 2908497 - DNA, 14 bp, Homo sapiens
tcagggagggccag

SEQ ID NO: 2908498 - DNA, 22 bp, Homo sapiens
tcagggaggggccggctggcct

SEQ ID NO: 2908499 - DNA, 24 bp, Homo sapiens
tcagggcagcccctgcagacgtct

SEQ ID NO: 2908500 - DNA, 15 bp, Homo sapiens
tcagggcagcgccag

SEQ ID NO: 2908501 - DNA, 12 bp, Homo sapiens
tcagggcagctg

SEQ ID NO: 2908502 - DNA, 20 bp, Homo sapiens
tcagggcagctgcctggcca

SEQ ID NO: 2908503 - DNA, 14 bp, Homo sapiens
tcagggcaggtggg

SEQ ID NO: 2908504 - DNA, 13 bp, Homo sapiens
tcagggccaggaa

SEQ ID NO: 2908505 - DNA, 14 bp, Homo sapiens
tcagggctcctggg

SEQ ID NO: 2908506 - DNA, 17 bp, Homo sapiens
tcaggggctgacacttc

SEQ ID NO: 2908507 - DNA, 19 bp, Homo sapiens
tcaggggtcaggtgtcagg

SEQ ID NO: 2908508 - DNA, 21 bp, Homo sapiens
tcaggggtcaggtgtcaggcc

SEQ ID NO: 2908509 - DNA, 15 bp, Homo sapiens
tcaggggtgacacag

SEQ ID NO: 2908510 - DNA, 14 bp, Homo sapiens
tcaggggtgcacag

SEQ ID NO: 2908511 - DNA, 14 bp, Homo sapiens
tcagggtattgctt

SEQ ID NO: 2908512 - DNA, 15 bp, Homo sapiens
tcagggtcatagcat

SEQ ID NO: 2908513 - DNA, 16 bp, Homo sapiens
tcaggtagtactaaga

SEQ ID NO: 2908514 - DNA, 15 bp, Homo sapiens
tcaggtatgttgcct

SEQ ID NO: 2908515 - DNA, 18 bp, Homo sapiens
tcaggtcacataaaactt

SEQ ID NO: 2908516 - DNA, 22 bp, Homo sapiens
tcaggtcccagcgagccacagg

SEQ ID NO: 2908517 - DNA, 13 bp, Homo sapiens
tcaggtggaccct

SEQ ID NO: 2908518 - DNA, 20 bp, Homo sapiens
tcaggtggaccctgtaaata

SEQ ID NO: 2908519 - DNA, 11 bp, Homo sapiens
tcaggtggcca

SEQ ID NO: 2908520 - DNA, 23 bp, Homo sapiens
tcaggtgtagtagttctgtgttg

SEQ ID NO: 2908521 - DNA, 16 bp, Homo sapiens
tcagtaagctgtgtgg

SEQ ID NO: 2908522 - DNA, 19 bp, Homo sapiens
tcagtaatgctaaatgtgt

SEQ ID NO: 2908523 - DNA, 16 bp, Homo sapiens
tcagtacttcagcaag

SEQ ID NO: 2908524 - DNA, 23 bp, Homo sapiens
tcagtaggtgcccagaataagtt

SEQ ID NO: 2908525 - DNA, 16 bp, Homo sapiens
tcagtataatttttta

SEQ ID NO: 2908526 - DNA, 18 bp, Homo sapiens
tcagtatgttttacactg

SEQ ID NO: 2908527 - DNA, 19 bp, Homo sapiens
tcagtatgttttacactgt

SEQ ID NO: 2908528 - DNA, 16 bp, Homo sapiens
tcagtattaaactctc

SEQ ID NO: 2908529 - DNA, 17 bp, Homo sapiens
tcagtattaaactctcc

SEQ ID NO: 2908530 - DNA, 22 bp, Homo sapiens
tcagtattaaactctcctttga

SEQ ID NO: 2908531 - DNA, 23 bp, Homo sapiens
tcagtattaaactctcctttgat

SEQ ID NO: 2908532 - DNA, 17 bp, Homo sapiens
tcagtattatgtagttg

SEQ ID NO: 2908533 - DNA, 16 bp, Homo sapiens
tcagtcaatattttta

SEQ ID NO: 2908534 - DNA, 13 bp, Homo sapiens
tcagtcacagcca

SEQ ID NO: 2908535 - DNA, 14 bp, Homo sapiens
tcagtcacagccac

SEQ ID NO: 2908536 - DNA, 20 bp, Homo sapiens
tcagtccagcagtttccagt

SEQ ID NO: 2908537 - DNA, 16 bp, Homo sapiens
tcagtccctatgtatt

SEQ ID NO: 2908538 - DNA, 13 bp, Homo sapiens
tcagtctctgagc

SEQ ID NO: 2908539 - DNA, 20 bp, Homo sapiens
tcagtctctgagcagtgaat

SEQ ID NO: 2908540 - DNA, 15 bp, Homo sapiens
tcagtctgctttctc

SEQ ID NO: 2908541 - DNA, 14 bp, Homo sapiens
tcagtctgttcact

SEQ ID NO: 2908542 - DNA, 21 bp, Homo sapiens
tcagtgaaaaacattagtata

SEQ ID NO: 2908543 - DNA, 12 bp, Homo sapiens
tcagtgactgaa

SEQ ID NO: 2908544 - DNA, 20 bp, Homo sapiens
tcagtgatggcaacactgaa

SEQ ID NO: 2908545 - DNA, 14 bp, Homo sapiens
tcagtgcaaaatgt

SEQ ID NO: 2908546 - DNA, 17 bp, Homo sapiens
tcagtgcaacctctgct

SEQ ID NO: 2908547 - DNA, 18 bp, Homo sapiens
tcagtgcacctgcctcag

SEQ ID NO: 2908548 - DNA, 15 bp, Homo sapiens
tcagtgccagcccct

SEQ ID NO: 2908549 - DNA, 16 bp, Homo sapiens
tccatcttcagcttct

SEQ ID NO: 2908550 - DNA, 18 bp, Homo sapiens
tccatgaatcgcttctct

SEQ ID NO: 2908551 - DNA, 19 bp, Homo sapiens
tccatgaatcgcttctctt

SEQ ID NO: 2908552 - DNA, 19 bp, Homo sapiens
tccatgacatttttcctct

SEQ ID NO: 2908553 - DNA, 18 bp, Homo sapiens
tccatgaggtactggtcc

SEQ ID NO: 2908554 - DNA, 14 bp, Homo sapiens
tccatgcaagtgct

SEQ ID NO: 2908555 - DNA, 16 bp, Homo sapiens
tccatgcaagtgctgt

SEQ ID NO: 2908556 - DNA, 17 bp, Homo sapiens
tccatgcggagtccatt

SEQ ID NO: 2908557 - DNA, 13 bp, Homo sapiens
tccatgctcccaa

SEQ ID NO: 2908558 - DNA, 14 bp, Homo sapiens
tccatggcttcctg

SEQ ID NO: 2908559 - DNA, 18 bp, Homo sapiens
tccatgggagaaaataga

SEQ ID NO: 2908560 - DNA, 18 bp, Homo sapiens
tccatgggattttatctg

SEQ ID NO: 2908561 - DNA, 18 bp, Homo sapiens
tccatgggcagagcccaa

SEQ ID NO: 2908562 - DNA, 16 bp, Homo sapiens
tccatgggtctggcct

SEQ ID NO: 2908563 - DNA, 17 bp, Homo sapiens
tccatgggtctggctag

SEQ ID NO: 2908564 - DNA, 14 bp, Homo sapiens
tccatggttctcaa

SEQ ID NO: 2908565 - DNA, 16 bp, Homo sapiens
tccatgtaatgatctt

SEQ ID NO: 2908566 - DNA, 15 bp, Homo sapiens
tccatgtagcaggac

SEQ ID NO: 2908567 - DNA, 17 bp, Homo sapiens
tccatgtagcaggactg

SEQ ID NO: 2908568 - DNA, 18 bp, Homo sapiens
tccatgtgttttgctttt

SEQ ID NO: 2908569 - DNA, 18 bp, Homo sapiens
tccatgtttccaccaaat

SEQ ID NO: 2908570 - DNA, 17 bp, Homo sapiens
tccatgttttaaaatta

SEQ ID NO: 2908571 - DNA, 13 bp, Homo sapiens
tccattatcatgt

SEQ ID NO: 2908572 - DNA, 14 bp, Homo sapiens
tccattatcatgtg

SEQ ID NO: 2908573 - DNA, 15 bp, Homo sapiens
tccattatcatgtgt

SEQ ID NO: 2908574 - DNA, 12 bp, Homo sapiens
tccattctgttt

SEQ ID NO: 2908575 - DNA, 17 bp, Homo sapiens
tccattcttggcatcta

SEQ ID NO: 2908576 - DNA, 18 bp, Homo sapiens
tccattctttcttcctcc

SEQ ID NO: 2908577 - DNA, 15 bp, Homo sapiens
tccattgaaagtgct

SEQ ID NO: 2908578 - DNA, 22 bp, Homo sapiens
tccattggtttacctgtgaaat

SEQ ID NO: 2908579 - DNA, 22 bp, Homo sapiens
tccattgtagtggcctgtgctt

SEQ ID NO: 2908580 - DNA, 14 bp, Homo sapiens
tccattgtttgaaa

SEQ ID NO: 2908581 - DNA, 23 bp, Homo sapiens
tccattgtttgaaacaaagaagg

SEQ ID NO: 2908582 - DNA, 22 bp, Homo sapiens
tccatttacaaactacttgatt

SEQ ID NO: 2908583 - DNA, 18 bp, Homo sapiens
tccatttatgttttttct

SEQ ID NO: 2908584 - DNA, 19 bp, Homo sapiens
tccatttatgttttttctg

SEQ ID NO: 2908585 - DNA, 15 bp, Homo sapiens
tccatttctttcttc

SEQ ID NO: 2908586 - DNA, 12 bp, Homo sapiens
tccatttgagga

SEQ ID NO: 2908587 - DNA, 12 bp, Homo sapiens
tccatttgcaag

SEQ ID NO: 2908588 - DNA, 21 bp, Homo sapiens
tccatttggcagaactgctgg

SEQ ID NO: 2908589 - DNA, 14 bp, Homo sapiens
tccattttcttgtc

SEQ ID NO: 2908590 - DNA, 15 bp, Homo sapiens
tccattttgtgaagc

SEQ ID NO: 2908591 - DNA, 19 bp, Homo sapiens
tccattttgtgaagccctg

SEQ ID NO: 2908592 - DNA, 21 bp, Homo sapiens
tcccaaacgcctcccctgccc

SEQ ID NO: 2908593 - DNA, 13 bp, Homo sapiens
tcccaaagcaagg

SEQ ID NO: 2908594 - DNA, 14 bp, Homo sapiens
tcccaaagggcaca

SEQ ID NO: 2908595 - DNA, 19 bp, Homo sapiens
tcccaaatccgccagtgtt

SEQ ID NO: 2908596 - DNA, 22 bp, Homo sapiens
tcccaaatccgccagtgtttct

SEQ ID NO: 2908597 - DNA, 16 bp, Homo sapiens
tcccaaatccttccca

SEQ ID NO: 2908598 - DNA, 22 bp, Homo sapiens
tcccaaatttgattgatttgaa

SEQ ID NO: 2908599 - DNA, 18 bp, Homo sapiens
tcccaacaggaggacaat

SEQ ID NO: 2908600 - DNA, 22 bp, Homo sapiens
tcccaacaggaggacaattcat

SEQ ID NO: 2908601 - DNA, 16 bp, Homo sapiens
tcccaacagtcatgtt

SEQ ID NO: 2908602 - DNA, 18 bp, Homo sapiens
tcccaacttccctgttct

SEQ ID NO: 2908603 - DNA, 13 bp, Homo sapiens
tcccaagctggct

SEQ ID NO: 2908604 - DNA, 15 bp, Homo sapiens
tcccaagctggctgg

SEQ ID NO: 2908605 - DNA, 16 bp, Homo sapiens
tcccaagtagaatctc

SEQ ID NO: 2908606 - DNA, 17 bp, Homo sapiens
tcccaagtagaatctca

SEQ ID NO: 2908607 - DNA, 19 bp, Homo sapiens
tcccaagtagaatctcagt

SEQ ID NO: 2908608 - DNA, 20 bp, Homo sapiens
tcccaagtagctgggattac

SEQ ID NO: 2908609 - DNA, 21 bp, Homo sapiens
tcccaagtagctgggattaca

SEQ ID NO: 2908610 - DNA, 23 bp, Homo sapiens
tcccaagtagctgggattacagg

SEQ ID NO: 2908611 - DNA, 15 bp, Homo sapiens
tcccaagtcctccgg

SEQ ID NO: 2908612 - DNA, 21 bp, Homo sapiens
tcccaatacaggcatgaacca

SEQ ID NO: 2908613 - DNA, 13 bp, Homo sapiens
tcccaatggtgtt

SEQ ID NO: 2908614 - DNA, 18 bp, Homo sapiens
tcccaatttcagactccc

SEQ ID NO: 2908615 - DNA, 18 bp, Homo sapiens
tcccacaagcctgcctcg

SEQ ID NO: 2908616 - DNA, 14 bp, Homo sapiens
tcccacaagtggtg

SEQ ID NO: 2908617 - DNA, 23 bp, Homo sapiens
tcccacacaagacccaagtagct

SEQ ID NO: 2908618 - DNA, 12 bp, Homo sapiens
tcccacacccaa

SEQ ID NO: 2908619 - DNA, 18 bp, Homo sapiens
tcccacacttgtgccagc

SEQ ID NO: 2908620 - DNA, 13 bp, Homo sapiens
tcccaccacccca

SEQ ID NO: 2908621 - DNA, 19 bp, Homo sapiens
tcccacccaattcaaaaca

SEQ ID NO: 2908622 - DNA, 13 bp, Homo sapiens
tcccacccaggaa

SEQ ID NO: 2908623 - DNA, 14 bp, Homo sapiens
tcccacccaggaag

SEQ ID NO: 2908624 - DNA, 16 bp, Homo sapiens
tcccaccccaccccct

SEQ ID NO: 2908625 - DNA, 14 bp, Homo sapiens
tcccaccccctccc

SEQ ID NO: 2908626 - DNA, 19 bp, Homo sapiens
tcccaccctaagggcagcc

SEQ ID NO: 2908627 - DNA, 20 bp, Homo sapiens
tcccaccctaagggcagccc

SEQ ID NO: 2908628 - DNA, 16 bp, Homo sapiens
tcccacctagcagcac

SEQ ID NO: 2908629 - DNA, 15 bp, Homo sapiens
tcccacctagtgccc

SEQ ID NO: 2908630 - DNA, 17 bp, Homo sapiens
tcccacctagtgcccca

SEQ ID NO: 2908631 - DNA, 18 bp, Homo sapiens
tcccacctagtgccccag

SEQ ID NO: 2908632 - DNA, 20 bp, Homo sapiens
tcccacctagtgccccagac

SEQ ID NO: 2908633 - DNA, 15 bp, Homo sapiens
tcccacctccatccc

SEQ ID NO: 2908634 - DNA, 17 bp, Homo sapiens
tcccaccttggagcatt

SEQ ID NO: 2908635 - DNA, 18 bp, Homo sapiens
tcccacgggacctggggc

SEQ ID NO: 2908636 - DNA, 21 bp, Homo sapiens
tcccacggggaccactgggcc

SEQ ID NO: 2908637 - DNA, 18 bp, Homo sapiens
tcccactcaagccaagca

SEQ ID NO: 2908638 - DNA, 17 bp, Homo sapiens
tcccactgcactccagc

SEQ ID NO: 2908639 - DNA, 19 bp, Homo sapiens
tcccactgcactccagcct

SEQ ID NO: 2908640 - DNA, 18 bp, Homo sapiens
tcccactgccaggatttt

SEQ ID NO: 2908641 - DNA, 14 bp, Homo sapiens
tcccactgccctgg

SEQ ID NO: 2908642 - DNA, 16 bp, Homo sapiens
tcccacttcccaccct

SEQ ID NO: 2908643 - DNA, 13 bp, Homo sapiens
tcccactttcatt

SEQ ID NO: 2908644 - DNA, 20 bp, Homo sapiens
tcccagaacacactccatca

SEQ ID NO: 2908645 - DNA, 23 bp, Homo sapiens
tcccagaactttgggaggccaag

SEQ ID NO: 2908646 - DNA, 15 bp, Homo sapiens
tcccagacttgtttc

SEQ ID NO: 2908647 - DNA, 18 bp, Homo sapiens
tcccagacttgtttcctg

SEQ ID NO: 2908648 - DNA, 20 bp, Homo sapiens
tcccagagacaggaaaatcc

SEQ ID NO: 2908649 - DNA, 19 bp, Homo sapiens
tcccagagctggtggaccc

SEQ ID NO: 2908650 - DNA, 21 bp, Homo sapiens
tcccagagctggtggacccag

SEQ ID NO: 2908651 - DNA, 16 bp, Homo sapiens
tcccagataatgtgaa

SEQ ID NO: 2908652 - DNA, 20 bp, Homo sapiens
tcccagatcgctcccttggc

SEQ ID NO: 2908653 - DNA, 18 bp, Homo sapiens
tcccagccttgagatgct

SEQ ID NO: 2908654 - DNA, 18 bp, Homo sapiens
tcccagcgagccacagga

SEQ ID NO: 2908655 - DNA, 20 bp, Homo sapiens
tcccagctaccaagtcagac

SEQ ID NO: 2908656 - DNA, 16 bp, Homo sapiens
tcccagctactcagga

SEQ ID NO: 2908657 - DNA, 23 bp, Homo sapiens
tcccagctactcaggaggctgag

SEQ ID NO: 2908658 - DNA, 23 bp, Homo sapiens
tcccagctacttgggagcctgag

SEQ ID NO: 2908659 - DNA, 21 bp, Homo sapiens
tcccagctctccctctggccc

SEQ ID NO: 2908660 - DNA, 22 bp, Homo sapiens
tcccagctctccctctggccct

SEQ ID NO: 2908661 - DNA, 23 bp, Homo sapiens
tcccagctctccctctggccctg

SEQ ID NO: 2908662 - DNA, 17 bp, Homo sapiens
tcccaggaagcagggag

SEQ ID NO: 2908663 - DNA, 11 bp, Homo sapiens
tcccaggaccc

SEQ ID NO: 2908664 - DNA, 13 bp, Homo sapiens
tcccaggaccctg

SEQ ID NO: 2908665 - DNA, 18 bp, Homo sapiens
tcccaggatctgctccaa

SEQ ID NO: 2908666 - DNA, 20 bp, Homo sapiens
tcccaggccaacagtagcca

SEQ ID NO: 2908667 - DNA, 18 bp, Homo sapiens
tcccaggccagggctggg

SEQ ID NO: 2908668 - DNA, 21 bp, Homo sapiens
tcccaggccagggctgggtca

SEQ ID NO: 2908669 - DNA, 16 bp, Homo sapiens
tcccaggggcagccac

SEQ ID NO: 2908670 - DNA, 17 bp, Homo sapiens
tcccaggggcagccaca

SEQ ID NO: 2908671 - DNA, 14 bp, Homo sapiens
tcccagtgccttct

SEQ ID NO: 2908672 - DNA, 15 bp, Homo sapiens
tcccagtttctgctg

SEQ ID NO: 2908673 - DNA, 13 bp, Homo sapiens
tcccatccagggc

SEQ ID NO: 2908674 - DNA, 14 bp, Homo sapiens
tcccatccagggcc

SEQ ID NO: 2908675 - DNA, 14 bp, Homo sapiens
tcccatcggaagtt

SEQ ID NO: 2908676 - DNA, 16 bp, Homo sapiens
tcccatctccactgtt

SEQ ID NO: 2908677 - DNA, 16 bp, Homo sapiens
tcccatgcctgcaacc

SEQ ID NO: 2908678 - DNA, 22 bp, Homo sapiens
tcccatgtagccccctggcctc

SEQ ID NO: 2908679 - DNA, 18 bp, Homo sapiens
tcccattcacttctgcat

SEQ ID NO: 2908680 - DNA, 19 bp, Homo sapiens
tcccattcacttctgcatt

SEQ ID NO: 2908681 - DNA, 23 bp, Homo sapiens
tcccattcacttctgcattcctg

SEQ ID NO: 2908682 - DNA, 13 bp, Homo sapiens
tcccattcctgaa

SEQ ID NO: 2908683 - DNA, 14 bp, Homo sapiens
tcccattcctgaag

SEQ ID NO: 2908684 - DNA, 15 bp, Homo sapiens
tcccattgccctggt

SEQ ID NO: 2908685 - DNA, 16 bp, Homo sapiens
tcccattggatgcatt

SEQ ID NO: 2908686 - DNA, 18 bp, Homo sapiens
tccccttacccttagaat

SEQ ID NO: 2908687 - DNA, 13 bp, Homo sapiens
tccccttcatcct

SEQ ID NO: 2908688 - DNA, 13 bp, Homo sapiens
tccccttccactg

SEQ ID NO: 2908689 - DNA, 18 bp, Homo sapiens
tccccttccactgagggc

SEQ ID NO: 2908690 - DNA, 17 bp, Homo sapiens
tccccttcccaggggcg

SEQ ID NO: 2908691 - DNA, 16 bp, Homo sapiens
tccccttcctcactgc

SEQ ID NO: 2908692 - DNA, 19 bp, Homo sapiens
tccccttgaacctcattaa

SEQ ID NO: 2908693 - DNA, 15 bp, Homo sapiens
tccccttgcagcctg

SEQ ID NO: 2908694 - DNA, 16 bp, Homo sapiens
tccccttgcagcctgg

SEQ ID NO: 2908695 - DNA, 17 bp, Homo sapiens
tccccttgtccctgggg

SEQ ID NO: 2908696 - DNA, 19 bp, Homo sapiens
tccccttgtccctggggca

SEQ ID NO: 2908697 - DNA, 18 bp, Homo sapiens
tcccctttggttttacta

SEQ ID NO: 2908698 - DNA, 17 bp, Homo sapiens
tccccttttattgctgc

SEQ ID NO: 2908699 - DNA, 17 bp, Homo sapiens
tcccgacaccagaagct

SEQ ID NO: 2908700 - DNA, 22 bp, Homo sapiens
tcccgagcacctccacatcctc

SEQ ID NO: 2908701 - DNA, 22 bp, Homo sapiens
tcccgaggaactcgcctcagcc

SEQ ID NO: 2908702 - DNA, 15 bp, Homo sapiens
tcccgagtagctggg

SEQ ID NO: 2908703 - DNA, 17 bp, Homo sapiens
tcccgcaccttcctcct

SEQ ID NO: 2908704 - DNA, 20 bp, Homo sapiens
tcccgcaccttcctcctccc

SEQ ID NO: 2908705 - DNA, 20 bp, Homo sapiens
tcccgccccgggctggccct

SEQ ID NO: 2908706 - DNA, 23 bp, Homo sapiens
tcccgccccgggctggccctgtg

SEQ ID NO: 2908707 - DNA, 13 bp, Homo sapiens
tcccgcctcagcc

SEQ ID NO: 2908708 - DNA, 17 bp, Homo sapiens
tcccgcctcagcctctc

SEQ ID NO: 2908709 - DNA, 22 bp, Homo sapiens
tcccggagggaaactgtgaatg

SEQ ID NO: 2908710 - DNA, 19 bp, Homo sapiens
tcccggctgaccctgtgcc

SEQ ID NO: 2908711 - DNA, 22 bp, Homo sapiens
tcccgggaagcatcctccccac

SEQ ID NO: 2908712 - DNA, 22 bp, Homo sapiens
tcccgggactcactggcagccc

SEQ ID NO: 2908713 - DNA, 19 bp, Homo sapiens
tcccgttttccccatgaca

SEQ ID NO: 2908714 - DNA, 14 bp, Homo sapiens
tccctaattcttca

SEQ ID NO: 2908715 - DNA, 14 bp, Homo sapiens
tccctacactgatg

SEQ ID NO: 2908716 - DNA, 20 bp, Homo sapiens
tccctacaggaggaacagtg

SEQ ID NO: 2908717 - DNA, 14 bp, Homo sapiens
tccctaccttgcct

SEQ ID NO: 2908718 - DNA, 15 bp, Homo sapiens
tccctaccttgcctc

SEQ ID NO: 2908719 - DNA, 17 bp, Homo sapiens
tccctaccttgcctcct

SEQ ID NO: 2908720 - DNA, 20 bp, Homo sapiens
tccctaccttgcctcctttt

SEQ ID NO: 2908721 - DNA, 18 bp, Homo sapiens
tccctagaaacttccaaa

SEQ ID NO: 2908722 - DNA, 22 bp, Homo sapiens
tccctagactttaggctttcag

SEQ ID NO: 2908723 - DNA, 17 bp, Homo sapiens
tccctagatccaggctt

SEQ ID NO: 2908724 - DNA, 21 bp, Homo sapiens
tccctagatccaggcttctcc

SEQ ID NO: 2908725 - DNA, 16 bp, Homo sapiens
tccctagcaaaatgct

SEQ ID NO: 2908726 - DNA, 17 bp, Homo sapiens
tccctagcagcccaccc

SEQ ID NO: 2908727 - DNA, 22 bp, Homo sapiens
tccctagccagcacttgtatat

SEQ ID NO: 2908728 - DNA, 21 bp, Homo sapiens
tccctagttagcatccaggct

SEQ ID NO: 2908729 - DNA, 16 bp, Homo sapiens
tccctatcttgtgaag

SEQ ID NO: 2908730 - DNA, 16 bp, Homo sapiens
tccctcaaccccacca

SEQ ID NO: 2908731 - DNA, 17 bp, Homo sapiens
tccctcactcttcctca

SEQ ID NO: 2908732 - DNA, 20 bp, Homo sapiens
tccctcagccgtcagccatc

SEQ ID NO: 2908733 - DNA, 13 bp, Homo sapiens
tccctccactcct

SEQ ID NO: 2908734 - DNA, 16 bp, Homo sapiens
tccctccactcctctc

SEQ ID NO: 2908735 - DNA, 17 bp, Homo sapiens
tccctccagcacaaaca

SEQ ID NO: 2908736 - DNA, 14 bp, Homo sapiens
tccctcccaggact

SEQ ID NO: 2908737 - DNA, 22 bp, Homo sapiens
tccctcccatcctccagccctg

SEQ ID NO: 2908738 - DNA, 13 bp, Homo sapiens
tccctccccaccc

SEQ ID NO: 2908739 - DNA, 14 bp, Homo sapiens
tccctccccaccca

SEQ ID NO: 2908740 - DNA, 14 bp, Homo sapiens
tccctcccccagca

SEQ ID NO: 2908741 - DNA, 12 bp, Homo sapiens
tccctccccccc

SEQ ID NO: 2908742 - DNA, 21 bp, Homo sapiens
tccctcccccccatgcactgt

SEQ ID NO: 2908743 - DNA, 16 bp, Homo sapiens
tccctccctctgccgg

SEQ ID NO: 2908744 - DNA, 12 bp, Homo sapiens
tccctccctgcc

SEQ ID NO: 2908745 - DNA, 16 bp, Homo sapiens
tccctccgcctcccat

SEQ ID NO: 2908746 - DNA, 15 bp, Homo sapiens
tccctccgggacctg

SEQ ID NO: 2908747 - DNA, 15 bp, Homo sapiens
tccctccgggcaggg

SEQ ID NO: 2908748 - DNA, 22 bp, Homo sapiens
tccctccgggcaggggagccag

SEQ ID NO: 2908749 - DNA, 12 bp, Homo sapiens
tccctcctcaca

SEQ ID NO: 2908750 - DNA, 15 bp, Homo sapiens
tccctcctcacactc

SEQ ID NO: 2908751 - DNA, 18 bp, Homo sapiens
tccctcctcacactccag

SEQ ID NO: 2908752 - DNA, 16 bp, Homo sapiens
tccctcctctgcccgg

SEQ ID NO: 2908753 - DNA, 14 bp, Homo sapiens
tccctcctgctact

SEQ ID NO: 2908754 - DNA, 14 bp, Homo sapiens
tccctcctggagct

SEQ ID NO: 2908755 - DNA, 19 bp, Homo sapiens
tccctcctggagctctgtg

SEQ ID NO: 2908756 - DNA, 21 bp, Homo sapiens
tccctcctggagctctgtggg

SEQ ID NO: 2908757 - DNA, 20 bp, Homo sapiens
tccctcctggtgtcacccca

SEQ ID NO: 2908758 - DNA, 21 bp, Homo sapiens
tccctcctggtgtcaccccag

SEQ ID NO: 2908759 - DNA, 21 bp, Homo sapiens
tccctcgtcttcagctgcatt

SEQ ID NO: 2908760 - DNA, 17 bp, Homo sapiens
tccctctaacccagtgg

SEQ ID NO: 2908761 - DNA, 19 bp, Homo sapiens
tccctctaacccagtggct

SEQ ID NO: 2908762 - DNA, 22 bp, Homo sapiens
tccctctacagagcttccctga

SEQ ID NO: 2908763 - DNA, 17 bp, Homo sapiens
tccctctactgggagcc

SEQ ID NO: 2908764 - DNA, 23 bp, Homo sapiens
tccctctactgggagcctaccca

SEQ ID NO: 2908765 - DNA, 21 bp, Homo sapiens
tccctctcagtgccttctctc

SEQ ID NO: 2908766 - DNA, 13 bp, Homo sapiens
tccctctcctgcc

SEQ ID NO: 2908767 - DNA, 16 bp, Homo sapiens
tccctctcctgcctac

SEQ ID NO: 2908768 - DNA, 17 bp, Homo sapiens
tccctctctcccatttc

SEQ ID NO: 2908769 - DNA, 19 bp, Homo sapiens
tccctctcttccgggagct

SEQ ID NO: 2908770 - DNA, 12 bp, Homo sapiens
tccctctgccag

SEQ ID NO: 2908771 - DNA, 11 bp, Homo sapiens
tccctctgcct

SEQ ID NO: 2908772 - DNA, 12 bp, Homo sapiens
tccctctgcctc

SEQ ID NO: 2908773 - DNA, 13 bp, Homo sapiens
tccctctgcctca

SEQ ID NO: 2908774 - DNA, 18 bp, Homo sapiens
tccctctgcctcatcctc

SEQ ID NO: 2908775 - DNA, 20 bp, Homo sapiens
tccctctggggggtggggac

SEQ ID NO: 2908776 - DNA, 20 bp, Homo sapiens
tccctctgtcatcctcagga

SEQ ID NO: 2908777 - DNA, 16 bp, Homo sapiens
tccctcttctttcaga

SEQ ID NO: 2908778 - DNA, 18 bp, Homo sapiens
tccctcttgtgctcagtc

SEQ ID NO: 2908779 - DNA, 12 bp, Homo sapiens
tccctctttcta

SEQ ID NO: 2908780 - DNA, 18 bp, Homo sapiens
tccctctttctagcctgg

SEQ ID NO: 2908781 - DNA, 17 bp, Homo sapiens
tccctgaaaacccagag

SEQ ID NO: 2908782 - DNA, 20 bp, Homo sapiens
tccctgaaacactgcttctc

SEQ ID NO: 2908783 - DNA, 17 bp, Homo sapiens
tccctgaccctgtatat

SEQ ID NO: 2908784 - DNA, 22 bp, Homo sapiens
tccctgaccctgtatatagccc

SEQ ID NO: 2908785 - DNA, 19 bp, Homo sapiens
tccctgactcattctgaag

SEQ ID NO: 2908786 - DNA, 18 bp, Homo sapiens
tccctgagcagtctactt

SEQ ID NO: 2908787 - DNA, 22 bp, Homo sapiens
tccctgagcagtctacttctgt

SEQ ID NO: 2908788 - DNA, 21 bp, Homo sapiens
tccctgagttgcaccattctt

SEQ ID NO: 2908789 - DNA, 15 bp, Homo sapiens
tccctgatcccagac

SEQ ID NO: 2908790 - DNA, 20 bp, Homo sapiens
tccctgatcccagtttctgc

SEQ ID NO: 2908791 - DNA, 22 bp, Homo sapiens
tccctgcatctgaccagcagcg

SEQ ID NO: 2908792 - DNA, 14 bp, Homo sapiens
tccctgcccctgtg

SEQ ID NO: 2908793 - DNA, 15 bp, Homo sapiens
tccctgcctaaggaa

SEQ ID NO: 2908794 - DNA, 17 bp, Homo sapiens
tccctgcctccacccac

SEQ ID NO: 2908795 - DNA, 13 bp, Homo sapiens
tccctgcctccag

SEQ ID NO: 2908796 - DNA, 17 bp, Homo sapiens
tccctgcctccagctgt

SEQ ID NO: 2908797 - DNA, 19 bp, Homo sapiens
tccctgcctccagctgtca

SEQ ID NO: 2908798 - DNA, 22 bp, Homo sapiens
tccctgcctcggttgattgtgc

SEQ ID NO: 2908799 - DNA, 13 bp, Homo sapiens
tccctgcctggac

SEQ ID NO: 2908800 - DNA, 11 bp, Homo sapiens
tccctgccttc

SEQ ID NO: 2908801 - DNA, 22 bp, Homo sapiens
tccctgccttcactgtgctcca

SEQ ID NO: 2908802 - DNA, 15 bp, Homo sapiens
tccctgcgcttcctg

SEQ ID NO: 2908803 - DNA, 16 bp, Homo sapiens
tccctgcttcatatct

SEQ ID NO: 2908804 - DNA, 20 bp, Homo sapiens
tccctgcttcatatctctcc

SEQ ID NO: 2908805 - DNA, 22 bp, Homo sapiens
tccctgcttcatatctctccct

SEQ ID NO: 2908806 - DNA, 14 bp, Homo sapiens
tccctgctttctgg

SEQ ID NO: 2908807 - DNA, 18 bp, Homo sapiens
tccctggaaggacatcca

SEQ ID NO: 2908808 - DNA, 14 bp, Homo sapiens
tccctggccttgcc

SEQ ID NO: 2908809 - DNA, 19 bp, Homo sapiens
tccctggctgcagcctccg

SEQ ID NO: 2908810 - DNA, 21 bp, Homo sapiens
tccctggctgcagcctccggg

SEQ ID NO: 2908811 - DNA, 21 bp, Homo sapiens
tccctggcttgtaactccacc

SEQ ID NO: 2908812 - DNA, 17 bp, Homo sapiens
tccctgggcattgcttt

SEQ ID NO: 2908813 - DNA, 18 bp, Homo sapiens
tccctgggcattgctttc

SEQ ID NO: 2908814 - DNA, 17 bp, Homo sapiens
tccctggggcactcccc

SEQ ID NO: 2908815 - DNA, 20 bp, Homo sapiens
tccctggggctagggggagc

SEQ ID NO: 2908816 - DNA, 20 bp, Homo sapiens
tccctgggggaagccctgga

SEQ ID NO: 2908817 - DNA, 14 bp, Homo sapiens
tccctggtccttca

SEQ ID NO: 2908818 - DNA, 16 bp, Homo sapiens
tcacccttggtagagt

SEQ ID NO: 2908819 - DNA, 20 bp, Homo sapiens
tcaccgagagtagccgagag

SEQ ID NO: 2908820 - DNA, 21 bp, Homo sapiens
tcaccgtggattcgcttgagt

SEQ ID NO: 2908821 - DNA, 16 bp, Homo sapiens
tcaccgtgggctccct

SEQ ID NO: 2908822 - DNA, 15 bp, Homo sapiens
tcacctaaccctctg

SEQ ID NO: 2908823 - DNA, 22 bp, Homo sapiens
tcacctaagagattctgatttg

SEQ ID NO: 2908824 - DNA, 12 bp, Homo sapiens
tcacctcagcct

SEQ ID NO: 2908825 - DNA, 14 bp, Homo sapiens
tcacctcattctga

SEQ ID NO: 2908826 - DNA, 14 bp, Homo sapiens
tcacctccttcaat

SEQ ID NO: 2908827 - DNA, 24 bp, Homo sapiens
tcacctcgagaagtaattatcagt

SEQ ID NO: 2908828 - DNA, 13 bp, Homo sapiens
tcacctctcccac

SEQ ID NO: 2908829 - DNA, 16 bp, Homo sapiens
tcacctctctcactga

SEQ ID NO: 2908830 - DNA, 14 bp, Homo sapiens
tcacctctgcctca

SEQ ID NO: 2908831 - DNA, 17 bp, Homo sapiens
tcacctgaaccccagag

SEQ ID NO: 2908832 - DNA, 19 bp, Homo sapiens
tcacctgaaccccagaggc

SEQ ID NO: 2908833 - DNA, 23 bp, Homo sapiens
tcacctgaaccccagaggcagag

SEQ ID NO: 2908834 - DNA, 22 bp, Homo sapiens
tcacctgagcaggacctctgaa

SEQ ID NO: 2908835 - DNA, 12 bp, Homo sapiens
tcacctgaggtc

SEQ ID NO: 2908836 - DNA, 17 bp, Homo sapiens
tcacctgaggtcgggag

SEQ ID NO: 2908837 - DNA, 21 bp, Homo sapiens
tcacctgcaaagctctgtggc

SEQ ID NO: 2908838 - DNA, 16 bp, Homo sapiens
tcacctgccccaactc

SEQ ID NO: 2908839 - DNA, 19 bp, Homo sapiens
tcacctggaagcatttgtt

SEQ ID NO: 2908840 - DNA, 14 bp, Homo sapiens
tcacctgtgcttcg

SEQ ID NO: 2908841 - DNA, 21 bp, Homo sapiens
tcacctgtgcttcgggccctt

SEQ ID NO: 2908842 - DNA, 16 bp, Homo sapiens
tcaccttcagtaaccc

SEQ ID NO: 2908843 - DNA, 23 bp, Homo sapiens
tcaccttggcaccagacacccag

SEQ ID NO: 2908844 - DNA, 18 bp, Homo sapiens
tcaccttgtttctcaact

SEQ ID NO: 2908845 - DNA, 19 bp, Homo sapiens
tcacctttcccactttctt

SEQ ID NO: 2908846 - DNA, 19 bp, Homo sapiens
tcacctttctccactgggt

SEQ ID NO: 2908847 - DNA, 21 bp, Homo sapiens
tcacgaattccatcttgtaaa

SEQ ID NO: 2908848 - DNA, 15 bp, Homo sapiens
tcacgagtgttcctg

SEQ ID NO: 2908849 - DNA, 20 bp, Homo sapiens
tcacgattatgactaaagta

SEQ ID NO: 2908850 - DNA, 15 bp, Homo sapiens
tcacgcacctcccat

SEQ ID NO: 2908851 - DNA, 14 bp, Homo sapiens
tcacgcacctgggt

SEQ ID NO: 2908852 - DNA, 12 bp, Homo sapiens
tcacgccacccc

SEQ ID NO: 2908853 - DNA, 13 bp, Homo sapiens
tcacgccaccccc

SEQ ID NO: 2908854 - DNA, 17 bp, Homo sapiens
tcacgccattctcctgc

SEQ ID NO: 2908855 - DNA, 21 bp, Homo sapiens
tcacgccgggagaagccacct

SEQ ID NO: 2908856 - DNA, 21 bp, Homo sapiens
tcacgcctgtaatcccagcac

SEQ ID NO: 2908857 - DNA, 23 bp, Homo sapiens
tcacgcctgtaatcccagcactt

SEQ ID NO: 2908858 - DNA, 18 bp, Homo sapiens
tcacgggcagtagctgtg

SEQ ID NO: 2908859 - DNA, 18 bp, Homo sapiens
tcacgggcggtcctgcac

SEQ ID NO: 2908860 - DNA, 21 bp, Homo sapiens
tcacgggcggtcctgcacaga

SEQ ID NO: 2908861 - DNA, 18 bp, Homo sapiens
tcacgtatttcacagagc

SEQ ID NO: 2908862 - DNA, 19 bp, Homo sapiens
tcacgtgcaggacagctct

SEQ ID NO: 2908863 - DNA, 16 bp, Homo sapiens
tcacgtgcgctgggca

SEQ ID NO: 2908864 - DNA, 12 bp, Homo sapiens
tcactaaggact

SEQ ID NO: 2908865 - DNA, 15 bp, Homo sapiens
tcactaatacacagt

SEQ ID NO: 2908866 - DNA, 16 bp, Homo sapiens
tcactaatttttgtat

SEQ ID NO: 2908867 - DNA, 13 bp, Homo sapiens
tcactacaactga

SEQ ID NO: 2908868 - DNA, 16 bp, Homo sapiens
tcactactcgagccca

SEQ ID NO: 2908869 - DNA, 15 bp, Homo sapiens
tcactagttgtcagc

SEQ ID NO: 2908870 - DNA, 14 bp, Homo sapiens
tcactatgtttctc

SEQ ID NO: 2908871 - DNA, 15 bp, Homo sapiens
tcactatgtttctca

SEQ ID NO: 2908872 - DNA, 23 bp, Homo sapiens
tcactcaacaacatctttgtgtt

SEQ ID NO: 2908873 - DNA, 12 bp, Homo sapiens
tcactcaaggcg

SEQ ID NO: 2908874 - DNA, 22 bp, Homo sapiens
tcactcagcccctacccctgcc

SEQ ID NO: 2908875 - DNA, 13 bp, Homo sapiens
tcactcattgctg

SEQ ID NO: 2908876 - DNA, 18 bp, Homo sapiens
tcactcattgctgagcct

SEQ ID NO: 2908877 - DNA, 22 bp, Homo sapiens
tcactcattgctgagcctctgc

SEQ ID NO: 2908878 - DNA, 21 bp, Homo sapiens
tcactcccatacctttaatgg

SEQ ID NO: 2908879 - DNA, 14 bp, Homo sapiens
tcactcgcaggacc

SEQ ID NO: 2908880 - DNA, 23 bp, Homo sapiens
tcactctctattgtcatggggat

SEQ ID NO: 2908881 - DNA, 16 bp, Homo sapiens
tcactctgccctctgc

SEQ ID NO: 2908882 - DNA, 17 bp, Homo sapiens
tcactctgccctctgct

SEQ ID NO: 2908883 - DNA, 20 bp, Homo sapiens
tcactctgccctctgctgct

SEQ ID NO: 2908884 - DNA, 12 bp, Homo sapiens
tcactcttaggc

SEQ ID NO: 2908885 - DNA, 20 bp, Homo sapiens
tcactcttcctcatcctgct

SEQ ID NO: 2908886 - DNA, 23 bp, Homo sapiens
tcactcttcctcatcctgcttct

SEQ ID NO: 2908887 - DNA, 17 bp, Homo sapiens
tcactcttgaagtccag

SEQ ID NO: 2908888 - DNA, 21 bp, Homo sapiens
tcactcttgaagtccaggact

SEQ ID NO: 2908889 - DNA, 17 bp, Homo sapiens
tcactgaaaacatctgg

SEQ ID NO: 2908890 - DNA, 12 bp, Homo sapiens
tcactgaagacg

SEQ ID NO: 2908891 - DNA, 14 bp, Homo sapiens
tcactgaagacgcc

SEQ ID NO: 2908892 - DNA, 19 bp, Homo sapiens
tcactgaagcccagacctc

SEQ ID NO: 2908893 - DNA, 17 bp, Homo sapiens
tcactgacacatcagca

SEQ ID NO: 2908894 - DNA, 16 bp, Homo sapiens
tcactgaggcctgaga

SEQ ID NO: 2908895 - DNA, 17 bp, Homo sapiens
tcactgagttttccatg

SEQ ID NO: 2908896 - DNA, 21 bp, Homo sapiens
tcactgcaagctccaactccc

SEQ ID NO: 2908897 - DNA, 18 bp, Homo sapiens
tcactgcaattttgtgta

SEQ ID NO: 2908898 - DNA, 22 bp, Homo sapiens
tcactgcagcctcaacctcctg

SEQ ID NO: 2908899 - DNA, 20 bp, Homo sapiens
tcactgccagagataaacta

SEQ ID NO: 2908900 - DNA, 20 bp, Homo sapiens
tcactgccgacatccctccc

SEQ ID NO: 2908901 - DNA, 14 bp, Homo sapiens
tcactgctacatgt

SEQ ID NO: 2908902 - DNA, 14 bp, Homo sapiens
tcactgctgctcct

SEQ ID NO: 2908903 - DNA, 16 bp, Homo sapiens
tcactggaaaggaaag

SEQ ID NO: 2908904 - DNA, 21 bp, Homo sapiens
tcactggaaaggaaagatgat

SEQ ID NO: 2908905 - DNA, 17 bp, Homo sapiens
tcactggagcaccaggc

SEQ ID NO: 2908906 - DNA, 19 bp, Homo sapiens
tcactggattggtcattta

SEQ ID NO: 2908907 - DNA, 14 bp, Homo sapiens
tcactggcagcctg

SEQ ID NO: 2908908 - DNA, 20 bp, Homo sapiens
tcactggcgacacgtagcag

SEQ ID NO: 2908909 - DNA, 22 bp, Homo sapiens
tcactggcgacacgtagcagct

SEQ ID NO: 2908910 - DNA, 13 bp, Homo sapiens
tcactggcgcctt

SEQ ID NO: 2908911 - DNA, 19 bp, Homo sapiens
tcactggcgccttctcgga

SEQ ID NO: 2908912 - DNA, 20 bp, Homo sapiens
tcactgtacagttttgtgga

SEQ ID NO: 2908913 - DNA, 21 bp, Homo sapiens
tcactgtataccgatcaggaa

SEQ ID NO: 2908914 - DNA, 14 bp, Homo sapiens
tcactgtcactgcc

SEQ ID NO: 2908915 - DNA, 16 bp, Homo sapiens
tcactgtccctcctgg

SEQ ID NO: 2908916 - DNA, 16 bp, Homo sapiens
tcactgtcctccaagc

SEQ ID NO: 2908917 - DNA, 19 bp, Homo sapiens
tcactgtcctccaagccag

SEQ ID NO: 2908918 - DNA, 15 bp, Homo sapiens
tcactgtctgagagt

SEQ ID NO: 2908919 - DNA, 14 bp, Homo sapiens
tcactgtcttttaa

SEQ ID NO: 2908920 - DNA, 17 bp, Homo sapiens
tcactgtcttttaaaaa

SEQ ID NO: 2908921 - DNA, 23 bp, Homo sapiens
tcactgtgaaccaacccccatct

SEQ ID NO: 2908922 - DNA, 18 bp, Homo sapiens
tcactgtgggaaggccag

SEQ ID NO: 2908923 - DNA, 20 bp, Homo sapiens
tcactgtggtaaatgccaca

SEQ ID NO: 2908924 - DNA, 22 bp, Homo sapiens
tcactgtttgtttttaaaaagc

SEQ ID NO: 2908925 - DNA, 17 bp, Homo sapiens
tcactgtttttagacac

SEQ ID NO: 2908926 - DNA, 18 bp, Homo sapiens
tcacttaaaacttttaaa

SEQ ID NO: 2908927 - DNA, 19 bp, Homo sapiens
tcacttagaacctttctgt

SEQ ID NO: 2908928 - DNA, 21 bp, Homo sapiens
tcacttagaacctttctgtgt

SEQ ID NO: 2908929 - DNA, 14 bp, Homo sapiens
tcacttcctccaga

SEQ ID NO: 2908930 - DNA, 19 bp, Homo sapiens
tcacttcctctccacagga

SEQ ID NO: 2908931 - DNA, 14 bp, Homo sapiens
tcacttccttgccc

SEQ ID NO: 2908932 - DNA, 22 bp, Homo sapiens
tcacttctgcattcctgtaact

SEQ ID NO: 2908933 - DNA, 22 bp, Homo sapiens
tcacttgaacccgggaggcaga

SEQ ID NO: 2908934 - DNA, 21 bp, Homo sapiens
tcacttgaatccattgaaagt

SEQ ID NO: 2908935 - DNA, 21 bp, Homo sapiens
tcacttgatgtttcctggaag

SEQ ID NO: 2908936 - DNA, 22 bp, Homo sapiens
tcacttgatgtttcctggaagc

SEQ ID NO: 2908937 - DNA, 18 bp, Homo sapiens
tcacttgtcttgctctta

SEQ ID NO: 2908938 - DNA, 18 bp, Homo sapiens
tcacttttgacaaaggca

SEQ ID NO: 2908939 - DNA, 13 bp, Homo sapiens
tcactttttaata

SEQ ID NO: 2908940 - DNA, 16 bp, Homo sapiens
tcagaaaaaaattcat

SEQ ID NO: 2908941 - DNA, 18 bp, Homo sapiens
tcagaaacatcagttact

SEQ ID NO: 2908942 - DNA, 16 bp, Homo sapiens
tcagaaacttgtgaag

SEQ ID NO: 2908943 - DNA, 21 bp, Homo sapiens
tcagaaatttaattcatgttt

SEQ ID NO: 2908944 - DNA, 15 bp, Homo sapiens
tcagaacagaggcat

SEQ ID NO: 2908945 - DNA, 20 bp, Homo sapiens
tcagaacagatgctgagcca

SEQ ID NO: 2908946 - DNA, 23 bp, Homo sapiens
tcagaacagcagactcagctctg

SEQ ID NO: 2908947 - DNA, 22 bp, Homo sapiens
tcagaaccatccatagtagtat

SEQ ID NO: 2908948 - DNA, 16 bp, Homo sapiens
tcagaacccttggctt

SEQ ID NO: 2908949 - DNA, 21 bp, Homo sapiens
tcagaactcaaatggggccag

SEQ ID NO: 2908950 - DNA, 20 bp, Homo sapiens
tcagaactgtcggaggaaag

SEQ ID NO: 2908951 - DNA, 17 bp, Homo sapiens
tcagaacttcaggtgtg

SEQ ID NO: 2908952 - DNA, 13 bp, Homo sapiens
tcagaagagcagc

SEQ ID NO: 2908953 - DNA, 16 bp, Homo sapiens
tcagagcccagcccag

SEQ ID NO: 2908954 - DNA, 12 bp, Homo sapiens
tcagagcccagg

SEQ ID NO: 2908955 - DNA, 13 bp, Homo sapiens
tcagagcccaggg

SEQ ID NO: 2908956 - DNA, 17 bp, Homo sapiens
tcagagcccaggggaga

SEQ ID NO: 2908957 - DNA, 18 bp, Homo sapiens
tcagagcccaggggagaa

SEQ ID NO: 2908958 - DNA, 12 bp, Homo sapiens
tcagagcccatg

SEQ ID NO: 2908959 - DNA, 13 bp, Homo sapiens
tcagagctgcggg

SEQ ID NO: 2908960 - DNA, 14 bp, Homo sapiens
tcagagctgcgggc

SEQ ID NO: 2908961 - DNA, 15 bp, Homo sapiens
tcagagctgcgggct

SEQ ID NO: 2908962 - DNA, 16 bp, Homo sapiens
tcagagctgcgggctg

SEQ ID NO: 2908963 - DNA, 17 bp, Homo sapiens
tcagagctgcgggctga

SEQ ID NO: 2908964 - DNA, 23 bp, Homo sapiens
tcagagctgcgggctgagggcat

SEQ ID NO: 2908965 - DNA, 22 bp, Homo sapiens
tcagagcttttcgaactgtgct

SEQ ID NO: 2908966 - DNA, 21 bp, Homo sapiens
tcagaggaacagtcctgttca

SEQ ID NO: 2908967 - DNA, 21 bp, Homo sapiens
tcagaggagagatagcctgtg

SEQ ID NO: 2908968 - DNA, 22 bp, Homo sapiens
tcagaggagagatagcctgtgg

SEQ ID NO: 2908969 - DNA, 23 bp, Homo sapiens
tcagaggagagatagcctgtggc

SEQ ID NO: 2908970 - DNA, 18 bp, Homo sapiens
tcagaggccctcgctgcc

SEQ ID NO: 2908971 - DNA, 22 bp, Homo sapiens
tcagaggccctcgctgccagct

SEQ ID NO: 2908972 - DNA, 22 bp, Homo sapiens
tcagaggccttatgagggtcct

SEQ ID NO: 2908973 - DNA, 19 bp, Homo sapiens
tcagagggtgtcctgcacc

SEQ ID NO: 2908974 - DNA, 16 bp, Homo sapiens
tcagagtctataacag

SEQ ID NO: 2908975 - DNA, 19 bp, Homo sapiens
tcagagtctataacagaaa

SEQ ID NO: 2908976 - DNA, 23 bp, Homo sapiens
tcagagtgacacccaagagggct

SEQ ID NO: 2908977 - DNA, 20 bp, Homo sapiens
tcagagtggcgtgagctgcc

SEQ ID NO: 2908978 - DNA, 23 bp, Homo sapiens
tcagagtggcgtgagctgcccgg

SEQ ID NO: 2908979 - DNA, 22 bp, Homo sapiens
tcagataaggtaaaatgccatg

SEQ ID NO: 2908980 - DNA, 23 bp, Homo sapiens
tcagataaggtaaaatgccatga

SEQ ID NO: 2908981 - DNA, 17 bp, Homo sapiens
tcagatagaatgacagt

SEQ ID NO: 2908982 - DNA, 18 bp, Homo sapiens
tcagatattctgctctat

SEQ ID NO: 2908983 - DNA, 21 bp, Homo sapiens
tcagatcatttcaaaactcat

SEQ ID NO: 2908984 - DNA, 14 bp, Homo sapiens
tcagatccagggac

SEQ ID NO: 2908985 - DNA, 16 bp, Homo sapiens
tcagatccttgtttca

SEQ ID NO: 2908986 - DNA, 17 bp, Homo sapiens
tcagatccttgtttcaa

SEQ ID NO: 2908987 - DNA, 23 bp, Homo sapiens
tcagatgactatgcagaggcctg

SEQ ID NO: 2908988 - DNA, 23 bp, Homo sapiens
tcagatgcaattgctcccatcag

SEQ ID NO: 2908989 - DNA, 14 bp, Homo sapiens
tcagatgctccaag

SEQ ID NO: 2908990 - DNA, 15 bp, Homo sapiens
tcagatgctccaaga

SEQ ID NO: 2908991 - DNA, 22 bp, Homo sapiens
tcagatgctccaagattctaga

SEQ ID NO: 2908992 - DNA, 14 bp, Homo sapiens
tcagatgctcttgg

SEQ ID NO: 2908993 - DNA, 13 bp, Homo sapiens
tcagatgcttctg

SEQ ID NO: 2908994 - DNA, 23 bp, Homo sapiens
tcagatggaaccgcaggaagctg

SEQ ID NO: 2908995 - DNA, 22 bp, Homo sapiens
tcagatggattgataattgcat

SEQ ID NO: 2908996 - DNA, 13 bp, Homo sapiens
tcagatgtaatgt

SEQ ID NO: 2908997 - DNA, 15 bp, Homo sapiens
tcagatgtaatgttt

SEQ ID NO: 2908998 - DNA, 17 bp, Homo sapiens
tcagatgtggagccagg

SEQ ID NO: 2908999 - DNA, 20 bp, Homo sapiens
tcagatgtggagccaggcgt

SEQ ID NO: 2909000 - DNA, 11 bp, Homo sapiens
tcagatgtttt

SEQ ID NO: 2909001 - DNA, 13 bp, Homo sapiens
tcagattattaaa

SEQ ID NO: 2909002 - DNA, 15 bp, Homo sapiens
tcagattgcatgtga

SEQ ID NO: 2909003 - DNA, 17 bp, Homo sapiens
tcagattgcatgtgact

SEQ ID NO: 2909004 - DNA, 21 bp, Homo sapiens
tcagattgcatgtgactctga

SEQ ID NO: 2909005 - DNA, 18 bp, Homo sapiens
tcagatttatttgtttga

SEQ ID NO: 2909006 - DNA, 23 bp, Homo sapiens
tcagatttctagttttttttcta

SEQ ID NO: 2909007 - DNA, 21 bp, Homo sapiens
tcagattttatattttctatt

SEQ ID NO: 2909008 - DNA, 14 bp, Homo sapiens
tcagcaaacacaat

SEQ ID NO: 2909009 - DNA, 15 bp, Homo sapiens
tcagcaaattccaga

SEQ ID NO: 2909010 - DNA, 14 bp, Homo sapiens
tcagcaatgaagaa

SEQ ID NO: 2909011 - DNA, 13 bp, Homo sapiens
tcagcacaaggcc

SEQ ID NO: 2909012 - DNA, 19 bp, Homo sapiens
tcagcaccttggcccagga

SEQ ID NO: 2909013 - DNA, 20 bp, Homo sapiens
tcagcaccttggcccaggag

SEQ ID NO: 2909014 - DNA, 22 bp, Homo sapiens
tcagcaccttggcccaggagct

SEQ ID NO: 2909015 - DNA, 23 bp, Homo sapiens
tcagcaccttggcccaggagctc

SEQ ID NO: 2909016 - DNA, 13 bp, Homo sapiens
tcagcagaacctg

SEQ ID NO: 2909017 - DNA, 14 bp, Homo sapiens
tcagcagcagctca

SEQ ID NO: 2909018 - DNA, 18 bp, Homo sapiens
tcagcagcagctcacacc

SEQ ID NO: 2909019 - DNA, 12 bp, Homo sapiens
tcagcagccctc

SEQ ID NO: 2909020 - DNA, 16 bp, Homo sapiens
tcagcagccctcctca

SEQ ID NO: 2909021 - DNA, 17 bp, Homo sapiens
tcagcagccctcctcac

SEQ ID NO: 2909022 - DNA, 18 bp, Homo sapiens
tcagcagccctcctcacc

SEQ ID NO: 2909023 - DNA, 22 bp, Homo sapiens
tcagcagcctgcgctcggcagg

SEQ ID NO: 2909024 - DNA, 22 bp, Homo sapiens
tcagcaggttggcttttttccc

SEQ ID NO: 2909025 - DNA, 16 bp, Homo sapiens
tcagcatcaaacatga

SEQ ID NO: 2909026 - DNA, 18 bp, Homo sapiens
tcagcatcaaacatgaaa

SEQ ID NO: 2909027 - DNA, 16 bp, Homo sapiens
tcagcatcaagcccca

SEQ ID NO: 2909028 - DNA, 14 bp, Homo sapiens
tcagcatctgacca

SEQ ID NO: 2909029 - DNA, 17 bp, Homo sapiens
tcagcatctgaccatct

SEQ ID NO: 2909030 - DNA, 18 bp, Homo sapiens
tcagcatctgaccatctg

SEQ ID NO: 2909031 - DNA, 14 bp, Homo sapiens
tcagcatgttttct

SEQ ID NO: 2909032 - DNA, 15 bp, Homo sapiens
tcagcatgttttctg

SEQ ID NO: 2909033 - DNA, 17 bp, Homo sapiens
tcagcatgttttctgct

SEQ ID NO: 2909034 - DNA, 14 bp, Homo sapiens
tcagcattgtaatt

SEQ ID NO: 2909035 - DNA, 23 bp, Homo sapiens
tcagccaacattgccttgcattt

SEQ ID NO: 2909036 - DNA, 15 bp, Homo sapiens
tcagccaagcacagt

SEQ ID NO: 2909037 - DNA, 20 bp, Homo sapiens
tcagccaagcacagtggtgg

SEQ ID NO: 2909038 - DNA, 21 bp, Homo sapiens
tcagccaatctggacacttct

SEQ ID NO: 2909039 - DNA, 21 bp, Homo sapiens
tcagccacatgccccaggctc

SEQ ID NO: 2909040 - DNA, 21 bp, Homo sapiens
tcagccatgaggagttgctgt

SEQ ID NO: 2909041 - DNA, 14 bp, Homo sapiens
tcagccatgtacag

SEQ ID NO: 2909042 - DNA, 16 bp, Homo sapiens
tcagccatgtctgtgc

SEQ ID NO: 2909043 - DNA, 21 bp, Homo sapiens
tcagccatgtctgtgctgtgt

SEQ ID NO: 2909044 - DNA, 13 bp, Homo sapiens
tcagccccatcgc

SEQ ID NO: 2909045 - DNA, 13 bp, Homo sapiens
tcagcccctcctc

SEQ ID NO: 2909046 - DNA, 18 bp, Homo sapiens
tcagcccctcctctgcca

SEQ ID NO: 2909047 - DNA, 21 bp, Homo sapiens
tcagcccctcctctgccacct

SEQ ID NO: 2909048 - DNA, 16 bp, Homo sapiens
tcagccctgaccctgt

SEQ ID NO: 2909049 - DNA, 17 bp, Homo sapiens
tcagccgaattgtggtg

SEQ ID NO: 2909050 - DNA, 20 bp, Homo sapiens
tcagcctcccgagtagctgg

SEQ ID NO: 2909051 - DNA, 13 bp, Homo sapiens
tcagcctcctgag

SEQ ID NO: 2909052 - DNA, 21 bp, Homo sapiens
tcagcctcctgagtagctgga

SEQ ID NO: 2909053 - DNA, 13 bp, Homo sapiens
tcagcctcctggg

SEQ ID NO: 2909054 - DNA, 15 bp, Homo sapiens
tcagcctcctgtctc

SEQ ID NO: 2909055 - DNA, 21 bp, Homo sapiens
tcagcctctcaaatagctggg

SEQ ID NO: 2909056 - DNA, 20 bp, Homo sapiens
tcagcctgcagttaattagc

SEQ ID NO: 2909057 - DNA, 21 bp, Homo sapiens
tatttgcataacaattcctct

SEQ ID NO: 2909058 - DNA, 16 bp, Homo sapiens
tatttgctaaatattt

SEQ ID NO: 2909059 - DNA, 20 bp, Homo sapiens
tatttggaagcaacgtgtta

SEQ ID NO: 2909060 - DNA, 16 bp, Homo sapiens
tatttgggaaacttgt

SEQ ID NO: 2909061 - DNA, 23 bp, Homo sapiens
tatttgtactgtttaatgttctg

SEQ ID NO: 2909062 - DNA, 12 bp, Homo sapiens
tatttgtgaata

SEQ ID NO: 2909063 - DNA, 21 bp, Homo sapiens
tatttgtgctatagtatttga

SEQ ID NO: 2909064 - DNA, 15 bp, Homo sapiens
tatttgtgctttgaa

SEQ ID NO: 2909065 - DNA, 17 bp, Homo sapiens
tatttgtgtatttaaca

SEQ ID NO: 2909066 - DNA, 13 bp, Homo sapiens
tatttgtgttcag

SEQ ID NO: 2909067 - DNA, 16 bp, Homo sapiens
tatttgtgttcagttc

SEQ ID NO: 2909068 - DNA, 22 bp, Homo sapiens
tatttgttgttttctgggggaa

SEQ ID NO: 2909069 - DNA, 21 bp, Homo sapiens
tattttaaaagataaatatta

SEQ ID NO: 2909070 - DNA, 15 bp, Homo sapiens
tattttaaaatattt

SEQ ID NO: 2909071 - DNA, 22 bp, Homo sapiens
tattttaaaatatttaaacctt

SEQ ID NO: 2909072 - DNA, 22 bp, Homo sapiens
tattttaaaggggtctgaaatt

SEQ ID NO: 2909073 - DNA, 22 bp, Homo sapiens
tattttaaattactatatatgt

SEQ ID NO: 2909074 - DNA, 11 bp, Homo sapiens
tattttacaca

SEQ ID NO: 2909075 - DNA, 14 bp, Homo sapiens
tattttacacagaa

SEQ ID NO: 2909076 - DNA, 17 bp, Homo sapiens
tattttacacagaaaca

SEQ ID NO: 2909077 - DNA, 11 bp, Homo sapiens
tattttacatc

SEQ ID NO: 2909078 - DNA, 14 bp, Homo sapiens
tattttacttgaat

SEQ ID NO: 2909079 - DNA, 21 bp, Homo sapiens
tattttagtgaacttgaaata

SEQ ID NO: 2909080 - DNA, 14 bp, Homo sapiens
tattttagtttctg

SEQ ID NO: 2909081 - DNA, 20 bp, Homo sapiens
tattttagtttctgttctgt

SEQ ID NO: 2909082 - DNA, 22 bp, Homo sapiens
tattttatatctgagcaaggag

SEQ ID NO: 2909083 - DNA, 16 bp, Homo sapiens
tattttatgagaaatg

SEQ ID NO: 2909084 - DNA, 17 bp, Homo sapiens
tattttatgagaaatgt

SEQ ID NO: 2909085 - DNA, 20 bp, Homo sapiens
tattttattcagtagtttga

SEQ ID NO: 2909086 - DNA, 13 bp, Homo sapiens
tattttatttgaa

SEQ ID NO: 2909087 - DNA, 11 bp, Homo sapiens
tattttcaaga

SEQ ID NO: 2909088 - DNA, 14 bp, Homo sapiens
tattttccaagtgt

SEQ ID NO: 2909089 - DNA, 16 bp, Homo sapiens
tattttccctacctaa

SEQ ID NO: 2909090 - DNA, 17 bp, Homo sapiens
tattttccctacctaag

SEQ ID NO: 2909091 - DNA, 14 bp, Homo sapiens
tattttctgttttt

SEQ ID NO: 2909092 - DNA, 12 bp, Homo sapiens
tattttctttct

SEQ ID NO: 2909093 - DNA, 14 bp, Homo sapiens
tattttctttctag

SEQ ID NO: 2909094 - DNA, 13 bp, Homo sapiens
tattttgaaaaca

SEQ ID NO: 2909095 - DNA, 14 bp, Homo sapiens
tattttgaaatgaa

SEQ ID NO: 2909096 - DNA, 18 bp, Homo sapiens
tattttgagaactccagc

SEQ ID NO: 2909097 - DNA, 22 bp, Homo sapiens
tattttgatgagatattaaatt

SEQ ID NO: 2909098 - DNA, 15 bp, Homo sapiens
tattttgatgagctt

SEQ ID NO: 2909099 - DNA, 12 bp, Homo sapiens
tattttgcaaac

SEQ ID NO: 2909100 - DNA, 22 bp, Homo sapiens
tattttgcaaacactgtgatta

SEQ ID NO: 2909101 - DNA, 15 bp, Homo sapiens
tattttgctcttgtt

SEQ ID NO: 2909102 - DNA, 16 bp, Homo sapiens
tattttgctcttgttt

SEQ ID NO: 2909103 - DNA, 16 bp, Homo sapiens
tattttgctgatttaa

SEQ ID NO: 2909104 - DNA, 14 bp, Homo sapiens
tattttggaaagtt

SEQ ID NO: 2909105 - DNA, 21 bp, Homo sapiens
tattttggaagacatatatta

SEQ ID NO: 2909106 - DNA, 20 bp, Homo sapiens
tattttggattgtatattgt

SEQ ID NO: 2909107 - DNA, 23 bp, Homo sapiens
tattttggattgtatattgtgtt

SEQ ID NO: 2909108 - DNA, 17 bp, Homo sapiens
tattttgtacattttgg

SEQ ID NO: 2909109 - DNA, 21 bp, Homo sapiens
tattttgtggaggcagtgtca

SEQ ID NO: 2909110 - DNA, 21 bp, Homo sapiens
tattttgttttgtgcagagat

SEQ ID NO: 2909111 - DNA, 17 bp, Homo sapiens
tatttttaaaagatctt

SEQ ID NO: 2909112 - DNA, 13 bp, Homo sapiens
tatttttaaattt

SEQ ID NO: 2909113 - DNA, 11 bp, Homo sapiens
tatttttaatt

SEQ ID NO: 2909114 - DNA, 15 bp, Homo sapiens
tatttttaatttaaa

SEQ ID NO: 2909115 - DNA, 18 bp, Homo sapiens
tatttttatataatatct

SEQ ID NO: 2909116 - DNA, 19 bp, Homo sapiens
tatttttatataatatcta

SEQ ID NO: 2909117 - DNA, 23 bp, Homo sapiens
tatttttatataatatctaaagt

SEQ ID NO: 2909118 - DNA, 23 bp, Homo sapiens
tatttttattcaaactacctata

SEQ ID NO: 2909119 - DNA, 23 bp, Homo sapiens
tatttttcagatataaatactga

SEQ ID NO: 2909120 - DNA, 13 bp, Homo sapiens
tatttttctgtga

SEQ ID NO: 2909121 - DNA, 18 bp, Homo sapiens
tatttttctgtgaccatc

SEQ ID NO: 2909122 - DNA, 13 bp, Homo sapiens
tatttttctttaa

SEQ ID NO: 2909123 - DNA, 19 bp, Homo sapiens
tatttttgcaaaataagtt

SEQ ID NO: 2909124 - DNA, 18 bp, Homo sapiens
tattttttcttgcattga

SEQ ID NO: 2909125 - DNA, 14 bp, Homo sapiens
tattttttcttttg

SEQ ID NO: 2909126 - DNA, 21 bp, Homo sapiens
tattttttcttttgtaattgt

SEQ ID NO: 2909127 - DNA, 15 bp, Homo sapiens
tatttttttaactgt

SEQ ID NO: 2909128 - DNA, 16 bp, Homo sapiens
tatttttttaactgtg

SEQ ID NO: 2909129 - DNA, 17 bp, Homo sapiens
tatttttttaactgtga

SEQ ID NO: 2909130 - DNA, 19 bp, Homo sapiens
tatttttttaactgtgata

SEQ ID NO: 2909131 - DNA, 16 bp, Homo sapiens
tcaaaaaaaaaaaaga

SEQ ID NO: 2909132 - DNA, 15 bp, Homo sapiens
tcaaaaaacttgtaa

SEQ ID NO: 2909133 - DNA, 23 bp, Homo sapiens
tcaaaaacacagtgtttttgtaa

SEQ ID NO: 2909134 - DNA, 13 bp, Homo sapiens
tcaaaaataatat

SEQ ID NO: 2909135 - DNA, 18 bp, Homo sapiens
tcaaaaattacactacaa

SEQ ID NO: 2909136 - DNA, 19 bp, Homo sapiens
tcaaaacagattgtttgca

SEQ ID NO: 2909137 - DNA, 23 bp, Homo sapiens
tcaaaacagttacttaagattca

SEQ ID NO: 2909138 - DNA, 23 bp, Homo sapiens
tcaaaaccagcctcatgctctga

SEQ ID NO: 2909139 - DNA, 18 bp, Homo sapiens
tcaaaactcatttcctat

SEQ ID NO: 2909140 - DNA, 15 bp, Homo sapiens
tcaaaagcattgtct

SEQ ID NO: 2909141 - DNA, 11 bp, Homo sapiens
tcaaaaggaac

SEQ ID NO: 2909142 - DNA, 17 bp, Homo sapiens
tcaaaagtaatgcctct

SEQ ID NO: 2909143 - DNA, 14 bp, Homo sapiens
tcaaaagtattttc

SEQ ID NO: 2909144 - DNA, 15 bp, Homo sapiens
tcaaaagtattttcc

SEQ ID NO: 2909145 - DNA, 16 bp, Homo sapiens
tcaaaagttgaaatta

SEQ ID NO: 2909146 - DNA, 19 bp, Homo sapiens
tcaaaatagaaaagttatt

SEQ ID NO: 2909147 - DNA, 19 bp, Homo sapiens
tcaaaataggatttcttaa

SEQ ID NO: 2909148 - DNA, 22 bp, Homo sapiens
tcaaaatatttaaaaatgtctt

SEQ ID NO: 2909149 - DNA, 23 bp, Homo sapiens
tcaaaatatttaaaaatgtcttg

SEQ ID NO: 2909150 - DNA, 18 bp, Homo sapiens
tcaaaatatttttaaaag

SEQ ID NO: 2909151 - DNA, 14 bp, Homo sapiens
tcaaaatctgtcat

SEQ ID NO: 2909152 - DNA, 15 bp, Homo sapiens
tcaaaatctgtcata

SEQ ID NO: 2909153 - DNA, 14 bp, Homo sapiens
tcaaacaaagccag

SEQ ID NO: 2909154 - DNA, 12 bp, Homo sapiens
tcaaataagaaa

SEQ ID NO: 2909155 - DNA, 15 bp, Homo sapiens
tcaaatacaaaaatg

SEQ ID NO: 2909156 - DNA, 16 bp, Homo sapiens
tcaaatattagatgtg

SEQ ID NO: 2909157 - DNA, 19 bp, Homo sapiens
tcaaatattagatgtgatt

SEQ ID NO: 2909158 - DNA, 20 bp, Homo sapiens
tcaaatcaatctgtaaaact

SEQ ID NO: 2909159 - DNA, 15 bp, Homo sapiens
tcaaatcagtcagtg

SEQ ID NO: 2909160 - DNA, 18 bp, Homo sapiens
tcaaatctcccacaagta

SEQ ID NO: 2909161 - DNA, 19 bp, Homo sapiens
tcaaatctgtaatcagcaa

SEQ ID NO: 2909162 - DNA, 17 bp, Homo sapiens
tcaaatcttacaaaatc

SEQ ID NO: 2909163 - DNA, 16 bp, Homo sapiens
tcaaatgaaggtggtt

SEQ ID NO: 2909164 - DNA, 16 bp, Homo sapiens
tcaaatgcagtatatt

SEQ ID NO: 2909165 - DNA, 19 bp, Homo sapiens
tcaaatgcagtatatttct

SEQ ID NO: 2909166 - DNA, 20 bp, Homo sapiens
tcaaatgcagtatatttctt

SEQ ID NO: 2909167 - DNA, 19 bp, Homo sapiens
tcaaatggggccagatcca

SEQ ID NO: 2909168 - DNA, 19 bp, Homo sapiens
tcaaatgttctaagtttct

SEQ ID NO: 2909169 - DNA, 13 bp, Homo sapiens
tcaaatgttttct

SEQ ID NO: 2909170 - DNA, 16 bp, Homo sapiens
tcaaatgttttctgca

SEQ ID NO: 2909171 - DNA, 18 bp, Homo sapiens
tcaaattaaagtgctgtt

SEQ ID NO: 2909172 - DNA, 15 bp, Homo sapiens
tcaaattaagattct

SEQ ID NO: 2909173 - DNA, 22 bp, Homo sapiens
tcaaattaagattctctgccca

SEQ ID NO: 2909174 - DNA, 19 bp, Homo sapiens
tcaaattaggcaaatcttt

SEQ ID NO: 2909175 - DNA, 19 bp, Homo sapiens
tcaaatttactgtcttaaa

SEQ ID NO: 2909176 - DNA, 23 bp, Homo sapiens
tcaaatttactgtcttaaatcag

SEQ ID NO: 2909177 - DNA, 15 bp, Homo sapiens
tcaacaaacagtgta

SEQ ID NO: 2909178 - DNA, 17 bp, Homo sapiens
tcaacaataaaattttt

SEQ ID NO: 2909179 - DNA, 22 bp, Homo sapiens
tcaacaatttgggcttcctgtt

SEQ ID NO: 2909180 - DNA, 23 bp, Homo sapiens
tcaacactaccagcgtatatata

SEQ ID NO: 2909181 - DNA, 12 bp, Homo sapiens
tcaacagaatga

SEQ ID NO: 2909182 - DNA, 19 bp, Homo sapiens
tcaacagagaggaccaaca

SEQ ID NO: 2909183 - DNA, 17 bp, Homo sapiens
tcaacagtgaagacaga

SEQ ID NO: 2909184 - DNA, 22 bp, Homo sapiens
tcaacagtgaagacagaagttt

SEQ ID NO: 2909185 - DNA, 17 bp, Homo sapiens
tcaacagttttcctatg

SEQ ID NO: 2909186 - DNA, 20 bp, Homo sapiens
tcaacagttttcctatgctt

SEQ ID NO: 2909187 - DNA, 23 bp, Homo sapiens
tcaacagttttcctatgctttga

SEQ ID NO: 2909188 - DNA, 13 bp, Homo sapiens
tcaacatcactga

SEQ ID NO: 2909189 - DNA, 17 bp, Homo sapiens
tcaacatcactgaaacc

SEQ ID NO: 2909190 - DNA, 14 bp, Homo sapiens
tcaacatttacatg

SEQ ID NO: 2909191 - DNA, 16 bp, Homo sapiens
tcaacatttacatgta

SEQ ID NO: 2909192 - DNA, 17 bp, Homo sapiens
tcaacatttacatgtat

SEQ ID NO: 2909193 - DNA, 17 bp, Homo sapiens
tcaaccaatgccaaaaa

SEQ ID NO: 2909194 - DNA, 15 bp, Homo sapiens
tcaaccaatgtagaa

SEQ ID NO: 2909195 - DNA, 13 bp, Homo sapiens
tcaaccccaccct

SEQ ID NO: 2909196 - DNA, 17 bp, Homo sapiens
tcaaccccagacactgg

SEQ ID NO: 2909197 - DNA, 17 bp, Homo sapiens
tcaacctcttctggctc

SEQ ID NO: 2909198 - DNA, 18 bp, Homo sapiens
tcaacctcttctggctca

SEQ ID NO: 2909199 - DNA, 17 bp, Homo sapiens
tcaacctgggcaaagcc

SEQ ID NO: 2909200 - DNA, 18 bp, Homo sapiens
tcaacctgggcaaagcct

SEQ ID NO: 2909201 - DNA, 21 bp, Homo sapiens
tcaactccaaggcacactgtt

SEQ ID NO: 2909202 - DNA, 19 bp, Homo sapiens
tcaactcctcgacatcact

SEQ ID NO: 2909203 - DNA, 20 bp, Homo sapiens
tcaactctccaatgttctat

SEQ ID NO: 2909204 - DNA, 19 bp, Homo sapiens
tcaactgccaaaatgctct

SEQ ID NO: 2909205 - DNA, 22 bp, Homo sapiens
tcaactggggggaccaaatagc

SEQ ID NO: 2909206 - DNA, 17 bp, Homo sapiens
tcaactgggttttcagc

SEQ ID NO: 2909207 - DNA, 15 bp, Homo sapiens
tcaacttaaaagtca

SEQ ID NO: 2909208 - DNA, 15 bp, Homo sapiens
tcaacttaaagtgaa

SEQ ID NO: 2909209 - DNA, 21 bp, Homo sapiens
tcaacttggaaaaagaaagaa

SEQ ID NO: 2909210 - DNA, 16 bp, Homo sapiens
tcaactttcatttgaa

SEQ ID NO: 2909211 - DNA, 18 bp, Homo sapiens
tcaactttgaataaagaa

SEQ ID NO: 2909212 - DNA, 16 bp, Homo sapiens
tcaagaaaactggaaa

SEQ ID NO: 2909213 - DNA, 21 bp, Homo sapiens
tcaagaaataaaaggaagcca

SEQ ID NO: 2909214 - DNA, 18 bp, Homo sapiens
tcaagaagaaagtgttca

SEQ ID NO: 2909215 - DNA, 19 bp, Homo sapiens
tcaagaagtcagagaaaac

SEQ ID NO: 2909216 - DNA, 23 bp, Homo sapiens
tcaagaagtcagagaaaacactt

SEQ ID NO: 2909217 - DNA, 14 bp, Homo sapiens
tcaagacatagcat

SEQ ID NO: 2909218 - DNA, 12 bp, Homo sapiens
tcaagactgaaa

SEQ ID NO: 2909219 - DNA, 16 bp, Homo sapiens
tcaagagactcctgaa

SEQ ID NO: 2909220 - DNA, 22 bp, Homo sapiens
tcaagaggaatgaaaaaagctt

SEQ ID NO: 2909221 - DNA, 18 bp, Homo sapiens
tcaagaggctgagacagg

SEQ ID NO: 2909222 - DNA, 22 bp, Homo sapiens
tcaagatcaatgaaatgatgtc

SEQ ID NO: 2909223 - DNA, 13 bp, Homo sapiens
tcaagatccaaat

SEQ ID NO: 2909224 - DNA, 14 bp, Homo sapiens
tcaagcacttccca

SEQ ID NO: 2909225 - DNA, 17 bp, Homo sapiens
tcaagcacttcccagga

SEQ ID NO: 2909226 - DNA, 21 bp, Homo sapiens
tcaagcacttcccaggatctg

SEQ ID NO: 2909227 - DNA, 22 bp, Homo sapiens
tcaagcaggtttcttgcttctg

SEQ ID NO: 2909228 - DNA, 17 bp, Homo sapiens
tcaagcatattggaaag

SEQ ID NO: 2909229 - DNA, 18 bp, Homo sapiens
tcaagcatattggaaagt

SEQ ID NO: 2909230 - DNA, 15 bp, Homo sapiens
tcaagccaagcagcc

SEQ ID NO: 2909231 - DNA, 16 bp, Homo sapiens
tcaagccaagcagcca

SEQ ID NO: 2909232 - DNA, 16 bp, Homo sapiens
tcaagccatcttcccg

SEQ ID NO: 2909233 - DNA, 16 bp, Homo sapiens
tcaagcccgcggggac

SEQ ID NO: 2909234 - DNA, 13 bp, Homo sapiens
tcaagctcctcct

SEQ ID NO: 2909235 - DNA, 20 bp, Homo sapiens
tcaagctcctcctccctgca

SEQ ID NO: 2909236 - DNA, 17 bp, Homo sapiens
tcaaggaacttgaaaaa

SEQ ID NO: 2909237 - DNA, 18 bp, Homo sapiens
tcaaggaacttgaaaaat

SEQ ID NO: 2909238 - DNA, 20 bp, Homo sapiens
tcaaggaacttgaaaaatac

SEQ ID NO: 2909239 - DNA, 15 bp, Homo sapiens
tcaaggaagaaaacg

SEQ ID NO: 2909240 - DNA, 20 bp, Homo sapiens
tcaaggactttctgaagcct

SEQ ID NO: 2909241 - DNA, 15 bp, Homo sapiens
tcaaggcactctaga

SEQ ID NO: 2909242 - DNA, 17 bp, Homo sapiens
ggctggtgcctgaagac

SEQ ID NO: 2909243 - DNA, 14 bp, Homo sapiens
ggctggtggcccag

SEQ ID NO: 2909244 - DNA, 16 bp, Homo sapiens
ggctggtggcccagga

SEQ ID NO: 2909245 - DNA, 23 bp, Homo sapiens
ggctgtagttacattaatgccca

SEQ ID NO: 2909246 - DNA, 17 bp, Homo sapiens
ggctgtcatctgtgcac

SEQ ID NO: 2909247 - DNA, 13 bp, Homo sapiens
ggctgtctggatc

SEQ ID NO: 2909248 - DNA, 17 bp, Homo sapiens
ggctgtctttgcagggc

SEQ ID NO: 2909249 - DNA, 21 bp, Homo sapiens
ggctgtgactctgggcaggga

SEQ ID NO: 2909250 - DNA, 22 bp, Homo sapiens
ggctgtgactctgggcagggac

SEQ ID NO: 2909251 - DNA, 15 bp, Homo sapiens
ggctgtgagcattta

SEQ ID NO: 2909252 - DNA, 15 bp, Homo sapiens
ggctgtgctcagaga

SEQ ID NO: 2909253 - DNA, 14 bp, Homo sapiens
ggctgtgggaccag

SEQ ID NO: 2909254 - DNA, 18 bp, Homo sapiens
ggctgtgtaaccttgggt

SEQ ID NO: 2909255 - DNA, 18 bp, Homo sapiens
ggctgtgtttccatctca

SEQ ID NO: 2909256 - DNA, 20 bp, Homo sapiens
ggctgtttcttgtctgttat

SEQ ID NO: 2909257 - DNA, 19 bp, Homo sapiens
ggctgttttagtgccaggc

SEQ ID NO: 2909258 - DNA, 14 bp, Homo sapiens
ggcttagctgccat

SEQ ID NO: 2909259 - DNA, 21 bp, Homo sapiens
ggcttagctgccatcttgctt

SEQ ID NO: 2909260 - DNA, 22 bp, Homo sapiens
ggcttatattttcagcaaagaa

SEQ ID NO: 2909261 - DNA, 13 bp, Homo sapiens
ggcttcagcctag

SEQ ID NO: 2909262 - DNA, 13 bp, Homo sapiens
ggcttcaggtcca

SEQ ID NO: 2909263 - DNA, 11 bp, Homo sapiens
ggcttcataca

SEQ ID NO: 2909264 - DNA, 14 bp, Homo sapiens
ggcttccctctctg

SEQ ID NO: 2909265 - DNA, 23 bp, Homo sapiens
ggcttcctgagaaagcccacctg

SEQ ID NO: 2909266 - DNA, 20 bp, Homo sapiens
ggcttcctggtgagaactga

SEQ ID NO: 2909267 - DNA, 13 bp, Homo sapiens
ggcttctcccgga

SEQ ID NO: 2909268 - DNA, 14 bp, Homo sapiens
ggcttctctctgtg

SEQ ID NO: 2909269 - DNA, 19 bp, Homo sapiens
ggcttctgcgtccaccagg

SEQ ID NO: 2909270 - DNA, 20 bp, Homo sapiens
ggcttcttcagatcagtgct

SEQ ID NO: 2909271 - DNA, 16 bp, Homo sapiens
ggcttgaatttgcatg

SEQ ID NO: 2909272 - DNA, 17 bp, Homo sapiens
ggcttgacacctttgaa

SEQ ID NO: 2909273 - DNA, 20 bp, Homo sapiens
ggcttgagcccccgcgccca

SEQ ID NO: 2909274 - DNA, 22 bp, Homo sapiens
ggcttgagtttaaattgtaata

SEQ ID NO: 2909275 - DNA, 16 bp, Homo sapiens
ggcttgcctgggctgg

SEQ ID NO: 2909276 - DNA, 19 bp, Homo sapiens
ggcttgcctgggctgggca

SEQ ID NO: 2909277 - DNA, 15 bp, Homo sapiens
ggcttggatcctggg

SEQ ID NO: 2909278 - DNA, 17 bp, Homo sapiens
ggcttggatcctgggct

SEQ ID NO: 2909279 - DNA, 17 bp, Homo sapiens
ggcttggcctatctcct

SEQ ID NO: 2909280 - DNA, 18 bp, Homo sapiens
ggcttgtaactccaccaa

SEQ ID NO: 2909281 - DNA, 15 bp, Homo sapiens
ggcttgtacattttt

SEQ ID NO: 2909282 - DNA, 16 bp, Homo sapiens
ggcttgttttattttg

SEQ ID NO: 2909283 - DNA, 18 bp, Homo sapiens
ggctttaagctccagctt

SEQ ID NO: 2909284 - DNA, 20 bp, Homo sapiens
ggctttatgataatagattc

SEQ ID NO: 2909285 - DNA, 22 bp, Homo sapiens
tacttaagtttgtaagacagtg

SEQ ID NO: 2909286 - DNA, 14 bp, Homo sapiens
tacttaataaaaca

SEQ ID NO: 2909287 - DNA, 19 bp, Homo sapiens
tacttaatactgaatttct

SEQ ID NO: 2909288 - DNA, 22 bp, Homo sapiens
tacttacattctctaataagaa

SEQ ID NO: 2909289 - DNA, 13 bp, Homo sapiens
tacttagatattt

SEQ ID NO: 2909290 - DNA, 16 bp, Homo sapiens
tacttagatatttcat

SEQ ID NO: 2909291 - DNA, 21 bp, Homo sapiens
tacttagatatttcatgtgct

SEQ ID NO: 2909292 - DNA, 15 bp, Homo sapiens
tacttagctggccaa

SEQ ID NO: 2909293 - DNA, 23 bp, Homo sapiens
tacttaggactacattttgctct

SEQ ID NO: 2909294 - DNA, 16 bp, Homo sapiens
tacttatatggaaatt

SEQ ID NO: 2909295 - DNA, 15 bp, Homo sapiens
tacttatccctgccc

SEQ ID NO: 2909296 - DNA, 17 bp, Homo sapiens
tacttatccctgcccat

SEQ ID NO: 2909297 - DNA, 18 bp, Homo sapiens
tacttatccctgcccatt

SEQ ID NO: 2909298 - DNA, 14 bp, Homo sapiens
tacttatctctaaa

SEQ ID NO: 2909299 - DNA, 19 bp, Homo sapiens
tacttcaaaagtattttcc

SEQ ID NO: 2909300 - DNA, 20 bp, Homo sapiens
tacttcactatacaaacaaa

SEQ ID NO: 2909301 - DNA, 13 bp, Homo sapiens
tacttcagcaaga

SEQ ID NO: 2909302 - DNA, 21 bp, Homo sapiens
tacttcagcaagagagaacct

SEQ ID NO: 2909303 - DNA, 16 bp, Homo sapiens
tacttcagctttgtgt

SEQ ID NO: 2909304 - DNA, 22 bp, Homo sapiens
tacttcaggggcacttcattga

SEQ ID NO: 2909305 - DNA, 18 bp, Homo sapiens
tacttcattttcagagtg

SEQ ID NO: 2909306 - DNA, 19 bp, Homo sapiens
tacttcattttcagagtga

SEQ ID NO: 2909307 - DNA, 18 bp, Homo sapiens
tacttcccccaccctggg

SEQ ID NO: 2909308 - DNA, 18 bp, Homo sapiens
tacttctgtgtctgtcac

SEQ ID NO: 2909309 - DNA, 15 bp, Homo sapiens
tacttcttattcact

SEQ ID NO: 2909310 - DNA, 11 bp, Homo sapiens
tacttgaaggg

SEQ ID NO: 2909311 - DNA, 14 bp, Homo sapiens
tacttgaagggcca

SEQ ID NO: 2909312 - DNA, 16 bp, Homo sapiens
tacttgaagggccaga

SEQ ID NO: 2909313 - DNA, 22 bp, Homo sapiens
tacttgaagggccagagccagg

SEQ ID NO: 2909314 - DNA, 22 bp, Homo sapiens
tacttgaagtaactataacaaa

SEQ ID NO: 2909315 - DNA, 17 bp, Homo sapiens
tacttgctcaggtactt

SEQ ID NO: 2909316 - DNA, 14 bp, Homo sapiens
tacttgggagcctg

SEQ ID NO: 2909317 - DNA, 16 bp, Homo sapiens
tacttgggagcctgag

SEQ ID NO: 2909318 - DNA, 18 bp, Homo sapiens
tacttgtcaaagaaggtt

SEQ ID NO: 2909319 - DNA, 21 bp, Homo sapiens
tacttgtgttacttgccaagc

SEQ ID NO: 2909320 - DNA, 14 bp, Homo sapiens
tacttgttcatttc

SEQ ID NO: 2909321 - DNA, 15 bp, Homo sapiens
tacttgttcatttct

SEQ ID NO: 2909322 - DNA, 17 bp, Homo sapiens
tacttgttcatttctgt

SEQ ID NO: 2909323 - DNA, 17 bp, Homo sapiens
tactttaaaaatcagtt

SEQ ID NO: 2909324 - DNA, 14 bp, Homo sapiens
tactttatttctga

SEQ ID NO: 2909325 - DNA, 10 bp, Homo sapiens
tactttcaaa

SEQ ID NO: 2909326 - DNA, 23 bp, Homo sapiens
tactttcaaaagagtagaaagct

SEQ ID NO: 2909327 - DNA, 16 bp, Homo sapiens
tactttcggagaaatt

SEQ ID NO: 2909328 - DNA, 20 bp, Homo sapiens
tactttcggagaaattctct

SEQ ID NO: 2909329 - DNA, 20 bp, Homo sapiens
tactttcgtaatagctcaga

SEQ ID NO: 2909330 - DNA, 18 bp, Homo sapiens
tactttctcttgtttaaa

SEQ ID NO: 2909331 - DNA, 14 bp, Homo sapiens
tactttgaagtcat

SEQ ID NO: 2909332 - DNA, 18 bp, Homo sapiens
tactttgaagtcatacca

SEQ ID NO: 2909333 - DNA, 18 bp, Homo sapiens
tactttgaatagtcctaa

SEQ ID NO: 2909334 - DNA, 18 bp, Homo sapiens
tactttgattccatttta

SEQ ID NO: 2909335 - DNA, 21 bp, Homo sapiens
tactttgattccattttaagt

SEQ ID NO: 2909336 - DNA, 15 bp, Homo sapiens
tactttgtttttcca

SEQ ID NO: 2909337 - DNA, 13 bp, Homo sapiens
tacttttaaataa

SEQ ID NO: 2909338 - DNA, 19 bp, Homo sapiens
tacttttaaataaattatg

SEQ ID NO: 2909339 - DNA, 18 bp, Homo sapiens
tacttttaccagtttctt

SEQ ID NO: 2909340 - DNA, 21 bp, Homo sapiens
tacttttacttgttcatttct

SEQ ID NO: 2909341 - DNA, 23 bp, Homo sapiens
tacttttattttacacagaaaca

SEQ ID NO: 2909342 - DNA, 19 bp, Homo sapiens
tacttttcccatttgtaat

SEQ ID NO: 2909343 - DNA, 14 bp, Homo sapiens
tacttttgataata

SEQ ID NO: 2909344 - DNA, 18 bp, Homo sapiens
tacttttgataatagata

SEQ ID NO: 2909345 - DNA, 19 bp, Homo sapiens
tacttttggtgtcattatt

SEQ ID NO: 2909346 - DNA, 13 bp, Homo sapiens
tactttttaaaca

SEQ ID NO: 2909347 - DNA, 13 bp, Homo sapiens
tactttttctaat

SEQ ID NO: 2909348 - DNA, 14 bp, Homo sapiens
tactttttctaatg

SEQ ID NO: 2909349 - DNA, 16 bp, Homo sapiens
tactttttctaatgag

SEQ ID NO: 2909350 - DNA, 13 bp, Homo sapiens
tactttttgtgaa

SEQ ID NO: 2909351 - DNA, 13 bp, Homo sapiens
tactttttgttat

SEQ ID NO: 2909352 - DNA, 19 bp, Homo sapiens
tactttttgttccagagct

SEQ ID NO: 2909353 - DNA, 22 bp, Homo sapiens
tacttttttaaatattttctat

SEQ ID NO: 2909354 - DNA, 21 bp, Homo sapiens
tacttttttttttttttggta

SEQ ID NO: 2909355 - DNA, 18 bp, Homo sapiens
tagaaaaatagcaacttg

SEQ ID NO: 2909356 - DNA, 17 bp, Homo sapiens
tagaaacactttctcac

SEQ ID NO: 2909357 - DNA, 16 bp, Homo sapiens
tagaaacagtgtttgc

SEQ ID NO: 2909358 - DNA, 18 bp, Homo sapiens
tagaaacctctctatttt

SEQ ID NO: 2909359 - DNA, 15 bp, Homo sapiens
tagaaacttccaaat

SEQ ID NO: 2909360 - DNA, 15 bp, Homo sapiens
tagaaagcattacat

SEQ ID NO: 2909361 - DNA, 19 bp, Homo sapiens
tagaaagcttgaaaagatt

SEQ ID NO: 2909362 - DNA, 21 bp, Homo sapiens
tagaaagcttgaaaagattct

SEQ ID NO: 2909363 - DNA, 20 bp, Homo sapiens
tagaaaggagagaacgggcg

SEQ ID NO: 2909364 - DNA, 19 bp, Homo sapiens
tagaaataaaggatgtgat

SEQ ID NO: 2909365 - DNA, 15 bp, Homo sapiens
tagaaatctgtcctg

SEQ ID NO: 2909366 - DNA, 16 bp, Homo sapiens
tagaaatctgtcctgt

SEQ ID NO: 2909367 - DNA, 21 bp, Homo sapiens
tagaaatggaaattttgctat

SEQ ID NO: 2909368 - DNA, 21 bp, Homo sapiens
tagaaatggtttcctctggat

SEQ ID NO: 2909369 - DNA, 13 bp, Homo sapiens
tagaaattttcaa

SEQ ID NO: 2909370 - DNA, 22 bp, Homo sapiens
tagaaatttttcagatgcttct

SEQ ID NO: 2909371 - DNA, 16 bp, Homo sapiens
tagaacaaaggacaga

SEQ ID NO: 2909372 - DNA, 19 bp, Homo sapiens
tagaacagaaatatataaa

SEQ ID NO: 2909373 - DNA, 22 bp, Homo sapiens
tagaacagtcattaattttcaa

SEQ ID NO: 2909374 - DNA, 14 bp, Homo sapiens
tagaacatccctgc

SEQ ID NO: 2909375 - DNA, 18 bp, Homo sapiens
tagaacatccctgccagc

SEQ ID NO: 2909376 - DNA, 19 bp, Homo sapiens
tagaaccagcagaagccag

SEQ ID NO: 2909377 - DNA, 22 bp, Homo sapiens
tagaacttggatgtacctgccc

SEQ ID NO: 2909378 - DNA, 22 bp, Homo sapiens
tagaagagaagagccatcttgg

SEQ ID NO: 2909379 - DNA, 17 bp, Homo sapiens
tagaagataacattttc

SEQ ID NO: 2909380 - DNA, 19 bp, Homo sapiens
tagaagataacattttcaa

SEQ ID NO: 2909381 - DNA, 22 bp, Homo sapiens
tagaagccacccttccctgcct

SEQ ID NO: 2909382 - DNA, 18 bp, Homo sapiens
tagaagcctgacaactca

SEQ ID NO: 2909383 - DNA, 24 bp, Homo sapiens
tagaagcgatttaagttacaatgt

SEQ ID NO: 2909384 - DNA, 19 bp, Homo sapiens
tagattttctttaaaagaa

SEQ ID NO: 2909385 - DNA, 12 bp, Homo sapiens
tagattttttca

SEQ ID NO: 2909386 - DNA, 22 bp, Homo sapiens
tagcaaaactaaatacttgctc

SEQ ID NO: 2909387 - DNA, 16 bp, Homo sapiens
tagcaaaacttttaaa

SEQ ID NO: 2909388 - DNA, 18 bp, Homo sapiens
tagcaaaacttttaaact

SEQ ID NO: 2909389 - DNA, 14 bp, Homo sapiens
tagcaatgctgtga

SEQ ID NO: 2909390 - DNA, 17 bp, Homo sapiens
tagcaatgctgtgaata

SEQ ID NO: 2909391 - DNA, 13 bp, Homo sapiens
tagcacaagttat

SEQ ID NO: 2909392 - DNA, 16 bp, Homo sapiens
tagcacatgcttcaat

SEQ ID NO: 2909393 - DNA, 17 bp, Homo sapiens
tagcaccaaataaatta

SEQ ID NO: 2909394 - DNA, 13 bp, Homo sapiens
tagcaccatggca

SEQ ID NO: 2909395 - DNA, 23 bp, Homo sapiens
tagcagaaggttgcacctccccc

SEQ ID NO: 2909396 - DNA, 12 bp, Homo sapiens
tagcagatggtt

SEQ ID NO: 2909397 - DNA, 15 bp, Homo sapiens
tagcagcccaccctg

SEQ ID NO: 2909398 - DNA, 21 bp, Homo sapiens
tagcagcccaccctgctgctg

SEQ ID NO: 2909399 - DNA, 21 bp, Homo sapiens
tagcagctgctactagctctt

SEQ ID NO: 2909400 - DNA, 15 bp, Homo sapiens
tagcaggtttcacta

SEQ ID NO: 2909401 - DNA, 12 bp, Homo sapiens
tagcataaattt

SEQ ID NO: 2909402 - DNA, 16 bp, Homo sapiens
tagcataaatttaatg

SEQ ID NO: 2909403 - DNA, 19 bp, Homo sapiens
tagcataaatttaatgtag

SEQ ID NO: 2909404 - DNA, 19 bp, Homo sapiens
tagcatgaggccactgctg

SEQ ID NO: 2909405 - DNA, 22 bp, Homo sapiens
taggccctggttcctgctgtcc

SEQ ID NO: 2909406 - DNA, 19 bp, Homo sapiens
taggccggtgtgcctgact

SEQ ID NO: 2909407 - DNA, 15 bp, Homo sapiens
taggctagggtgggg

SEQ ID NO: 2909408 - DNA, 15 bp, Homo sapiens
taggctctgccttcg

SEQ ID NO: 2909409 - DNA, 15 bp, Homo sapiens
tagggacctttaaaa

SEQ ID NO: 2909410 - DNA, 17 bp, Homo sapiens
tagggacctttaaaaag

SEQ ID NO: 2909411 - DNA, 22 bp, Homo sapiens
tagggagccccaaaacctacca

SEQ ID NO: 2909412 - DNA, 13 bp, Homo sapiens
tagggaggaccac

SEQ ID NO: 2909413 - DNA, 23 bp, Homo sapiens
tagggaggaccagggcagggcca

SEQ ID NO: 2909414 - DNA, 21 bp, Homo sapiens
tagggaggcctttagcttaag

SEQ ID NO: 2909415 - DNA, 17 bp, Homo sapiens
tagggatccctcatctg

SEQ ID NO: 2909416 - DNA, 15 bp, Homo sapiens
tagggatgcctcctt

SEQ ID NO: 2909417 - DNA, 16 bp, Homo sapiens
tagggcctcggaggct

SEQ ID NO: 2909418 - DNA, 23 bp, Homo sapiens
tagggcctcggaggctcctccct

SEQ ID NO: 2909419 - DNA, 21 bp, Homo sapiens
tagggcctggtccctgggagg

SEQ ID NO: 2909420 - DNA, 20 bp, Homo sapiens
tagggcttttattttttctt

SEQ ID NO: 2909421 - DNA, 13 bp, Homo sapiens
tagggtccttgaa

SEQ ID NO: 2909422 - DNA, 15 bp, Homo sapiens
tagggtcggaaccca

SEQ ID NO: 2909423 - DNA, 17 bp, Homo sapiens
tagggtggcacatctgt

SEQ ID NO: 2909424 - DNA, 19 bp, Homo sapiens
tagggttctgcttttaagt

SEQ ID NO: 2909425 - DNA, 16 bp, Homo sapiens
tagggttttggcctgc

SEQ ID NO: 2909426 - DNA, 11 bp, Homo sapiens
taggtaaatct

SEQ ID NO: 2909427 - DNA, 14 bp, Homo sapiens
taggtaggaaatgt

SEQ ID NO: 2909428 - DNA, 20 bp, Homo sapiens
taggtcattgcacctatctc

SEQ ID NO: 2909429 - DNA, 18 bp, Homo sapiens
taggtcttcctgtggctc

SEQ ID NO: 2909430 - DNA, 22 bp, Homo sapiens
taggtgcaatttcaaggttcta

SEQ ID NO: 2909431 - DNA, 17 bp, Homo sapiens
taggtgcagctcctcag

SEQ ID NO: 2909432 - DNA, 13 bp, Homo sapiens
taggttaaaaaaa

SEQ ID NO: 2909433 - DNA, 15 bp, Homo sapiens
taggttatttaaaat

SEQ ID NO: 2909434 - DNA, 17 bp, Homo sapiens
taggttccccaatccat

SEQ ID NO: 2909435 - DNA, 22 bp, Homo sapiens
taggttctaaagttctaagatt

SEQ ID NO: 2909436 - DNA, 15 bp, Homo sapiens
taggttggactggaa

SEQ ID NO: 2909437 - DNA, 21 bp, Homo sapiens
tagtaaaaaatcaattaacca

SEQ ID NO: 2909438 - DNA, 16 bp, Homo sapiens
tagtaaaacacagagg

SEQ ID NO: 2909439 - DNA, 22 bp, Homo sapiens
tagtaacctttaaaaatgtata

SEQ ID NO: 2909440 - DNA, 14 bp, Homo sapiens
tagtaactgctgtc

SEQ ID NO: 2909441 - DNA, 19 bp, Homo sapiens
tagtaacttcttatggaat

SEQ ID NO: 2909442 - DNA, 21 bp, Homo sapiens
tagtaagaaatttgcagtttt

SEQ ID NO: 2909443 - DNA, 16 bp, Homo sapiens
tagtaagcatctactt

SEQ ID NO: 2909444 - DNA, 20 bp, Homo sapiens
tagtaagtttttcttcatga

SEQ ID NO: 2909445 - DNA, 15 bp, Homo sapiens
tagtaatgagtttaa

SEQ ID NO: 2909446 - DNA, 22 bp, Homo sapiens
tagtaatgctacgtgtgatttt

SEQ ID NO: 2909447 - DNA, 13 bp, Homo sapiens
tagtaatggtgct

SEQ ID NO: 2909448 - DNA, 14 bp, Homo sapiens
tagtaatttctttt

SEQ ID NO: 2909449 - DNA, 18 bp, Homo sapiens
tagtacataattgattaa

SEQ ID NO: 2909450 - DNA, 15 bp, Homo sapiens
tagtacctgaaaagt

SEQ ID NO: 2909451 - DNA, 18 bp, Homo sapiens
tagtacctgaaaagtaac

SEQ ID NO: 2909452 - DNA, 15 bp, Homo sapiens
tagtactaagcattt

SEQ ID NO: 2909453 - DNA, 15 bp, Homo sapiens
tagtactagaaactg

SEQ ID NO: 2909454 - DNA, 13 bp, Homo sapiens
tagtactgctctt

SEQ ID NO: 2909455 - DNA, 23 bp, Homo sapiens
tagtagagcaacccattaatctt

SEQ ID NO: 2909456 - DNA, 23 bp, Homo sapiens
tagtagccaaagttaaatgtatc

SEQ ID NO: 2909457 - DNA, 22 bp, Homo sapiens
tagtagcccttcagtcttaata

SEQ ID NO: 2909458 - DNA, 16 bp, Homo sapiens
tagtaggcatttttac

SEQ ID NO: 2909459 - DNA, 14 bp, Homo sapiens
tagtagttctcttg

SEQ ID NO: 2909460 - DNA, 14 bp, Homo sapiens
tagtatcaaatatt

SEQ ID NO: 2909461 - DNA, 20 bp, Homo sapiens
tagtatcaaatattagatgt

SEQ ID NO: 2909462 - DNA, 16 bp, Homo sapiens
tagtatcaagtgttct

SEQ ID NO: 2909463 - DNA, 18 bp, Homo sapiens
tagtatcatcagatagca

SEQ ID NO: 2909464 - DNA, 16 bp, Homo sapiens
tagtatttatttatgt

SEQ ID NO: 2909465 - DNA, 23 bp, Homo sapiens
tagtatttgattcaaaatattta

SEQ ID NO: 2909466 - DNA, 19 bp, Homo sapiens
tagtcaaatatttattgga

SEQ ID NO: 2909467 - DNA, 23 bp, Homo sapiens
tagtcaaggtgctcaataaatat

SEQ ID NO: 2909468 - DNA, 18 bp, Homo sapiens
tagtcaatcaagtctgtt

SEQ ID NO: 2909469 - DNA, 21 bp, Homo sapiens
tagtcacatggcctatgcaca

SEQ ID NO: 2909470 - DNA, 15 bp, Homo sapiens
tagtcacctctgggc

SEQ ID NO: 2909471 - DNA, 19 bp, Homo sapiens
tagtcactggcagcctgca

SEQ ID NO: 2909472 - DNA, 17 bp, Homo sapiens
tagtcagagtgtccctt

SEQ ID NO: 2909473 - DNA, 22 bp, Homo sapiens
tagtcattaaaaacatagaaaa

SEQ ID NO: 2909474 - DNA, 14 bp, Homo sapiens
tagtcccccaaagg

SEQ ID NO: 2909475 - DNA, 14 bp, Homo sapiens
tagtccctgtgttc

SEQ ID NO: 2909476 - DNA, 23 bp, Homo sapiens
tagtccgtgctgacagctgctcc

SEQ ID NO: 2909477 - DNA, 22 bp, Homo sapiens
tagtcctttataagttgctttc

SEQ ID NO: 2909478 - DNA, 20 bp, Homo sapiens
tagtctactcttaagccatc

SEQ ID NO: 2909479 - DNA, 21 bp, Homo sapiens
tagtctactcttaagccatct

SEQ ID NO: 2909480 - DNA, 18 bp, Homo sapiens
tagtctagatggctcctc

SEQ ID NO: 2909481 - DNA, 16 bp, Homo sapiens
tagtctagtgtagtat

SEQ ID NO: 2909482 - DNA, 20 bp, Homo sapiens
tagtctctatcattaaagtt

SEQ ID NO: 2909483 - DNA, 13 bp, Homo sapiens
tagtctctttatt

SEQ ID NO: 2909484 - DNA, 12 bp, Homo sapiens
tagtctgggtca

SEQ ID NO: 2909485 - DNA, 22 bp, Homo sapiens
tagtctgggtcagacccatctc

SEQ ID NO: 2909486 - DNA, 22 bp, Homo sapiens
tagtcttccacaaaaaatactt

SEQ ID NO: 2909487 - DNA, 18 bp, Homo sapiens
tagtgaacacagcagacc

SEQ ID NO: 2909488 - DNA, 20 bp, Homo sapiens
tagtgaactaagttattgtt

SEQ ID NO: 2909489 - DNA, 12 bp, Homo sapiens
tagtgagccaag

SEQ ID NO: 2909490 - DNA, 21 bp, Homo sapiens
tagtgagcgagtggatgctgt

SEQ ID NO: 2909491 - DNA, 21 bp, Homo sapiens
tagtgatttttatgccacctg

SEQ ID NO: 2909492 - DNA, 23 bp, Homo sapiens
tagtgcatagaattctagctttt

SEQ ID NO: 2909493 - DNA, 11 bp, Homo sapiens
tagtgccaggc

SEQ ID NO: 2909494 - DNA, 22 bp, Homo sapiens
tagtgcttcttgtaatatttct

SEQ ID NO: 2909495 - DNA, 19 bp, Homo sapiens
tagtggatctcagttttta

SEQ ID NO: 2909496 - DNA, 23 bp, Homo sapiens
tagtggggtctccctctcctgcc

SEQ ID NO: 2909497 - DNA, 20 bp, Homo sapiens
tagtggtttatcagcaaaaa

SEQ ID NO: 2909498 - DNA, 20 bp, Homo sapiens
tagtgtacctattaaaagtt

SEQ ID NO: 2909499 - DNA, 21 bp, Homo sapiens
tagtgtacctcctctcagtgt

SEQ ID NO: 2909500 - DNA, 23 bp, Homo sapiens
tagtgtacctcctctcagtgttt

SEQ ID NO: 2909501 - DNA, 23 bp, Homo sapiens
tagtgtccattttgtgaagccct

SEQ ID NO: 2909502 - DNA, 21 bp, Homo sapiens
tagtgtctgggtttggcccaa

SEQ ID NO: 2909503 - DNA, 16 bp, Homo sapiens
tagtgttaatcaattt

SEQ ID NO: 2909504 - DNA, 23 bp, Homo sapiens
tagtgttaatcaatttaaaccca

SEQ ID NO: 2909505 - DNA, 14 bp, Homo sapiens
tagtgttgtccagg

SEQ ID NO: 2909506 - DNA, 16 bp, Homo sapiens
tagtgttgtccaggaa

SEQ ID NO: 2909507 - DNA, 17 bp, Homo sapiens
tagtgtttctgtgcatg

SEQ ID NO: 2909508 - DNA, 19 bp, Homo sapiens
tagtgtttggaattttctg

SEQ ID NO: 2909509 - DNA, 13 bp, Homo sapiens
tagttactcaagc

SEQ ID NO: 2909510 - DNA, 17 bp, Homo sapiens
tagttactgttgtgacc

SEQ ID NO: 2909511 - DNA, 15 bp, Homo sapiens
tagttatataattgt

SEQ ID NO: 2909512 - DNA, 20 bp, Homo sapiens
tagttatttaagaagaatga

SEQ ID NO: 2909513 - DNA, 23 bp, Homo sapiens
tagttccctgaaaacccagagag

SEQ ID NO: 2909514 - DNA, 17 bp, Homo sapiens
tagttcttactgcttaa

SEQ ID NO: 2909515 - DNA, 13 bp, Homo sapiens
tagttctttgttc

SEQ ID NO: 2909516 - DNA, 21 bp, Homo sapiens
tagttctttgttcctgctttc

SEQ ID NO: 2909517 - DNA, 18 bp, Homo sapiens
tagttgaactgatagtta

SEQ ID NO: 2909518 - DNA, 20 bp, Homo sapiens
tagttgaactgatagttact

SEQ ID NO: 2909519 - DNA, 14 bp, Homo sapiens
tagttgaattccaa

SEQ ID NO: 2909520 - DNA, 18 bp, Homo sapiens
tagttgaattccaagtgt

SEQ ID NO: 2909521 - DNA, 14 bp, Homo sapiens
tagttgcaattgaa

SEQ ID NO: 2909522 - DNA, 22 bp, Homo sapiens
tagttgcttgctaatatttcca

SEQ ID NO: 2909523 - DNA, 22 bp, Homo sapiens
tagttggaatgactgaaagaag

SEQ ID NO: 2909524 - DNA, 21 bp, Homo sapiens
tagttgtctttctttgctgct

SEQ ID NO: 2909525 - DNA, 18 bp, Homo sapiens
tagttgtgaccttagtgt

SEQ ID NO: 2909526 - DNA, 22 bp, Homo sapiens
tagtttaaccatatgcccacat

SEQ ID NO: 2909527 - DNA, 21 bp, Homo sapiens
tagaaggaaagcatgtctctg

SEQ ID NO: 2909528 - DNA, 21 bp, Homo sapiens
tagaaggatgtacatttccaa

SEQ ID NO: 2909529 - DNA, 17 bp, Homo sapiens
tagaagtagaattgaca

SEQ ID NO: 2909530 - DNA, 19 bp, Homo sapiens
tagaagtggaccaggacag

SEQ ID NO: 2909531 - DNA, 15 bp, Homo sapiens
tagaataaaagctgt

SEQ ID NO: 2909532 - DNA, 16 bp, Homo sapiens
tagaataaaagctgtg

SEQ ID NO: 2909533 - DNA, 14 bp, Homo sapiens
tagaataaatgaag

SEQ ID NO: 2909534 - DNA, 15 bp, Homo sapiens
tagaatcctgcttta

SEQ ID NO: 2909535 - DNA, 17 bp, Homo sapiens
tagaatcgttggactca

SEQ ID NO: 2909536 - DNA, 12 bp, Homo sapiens
tagaatgacagt

SEQ ID NO: 2909537 - DNA, 13 bp, Homo sapiens
tagaatgataaat

SEQ ID NO: 2909538 - DNA, 20 bp, Homo sapiens
tagaatgctacaagtaactc

SEQ ID NO: 2909539 - DNA, 18 bp, Homo sapiens
tagaatggttgagttaca

SEQ ID NO: 2909540 - DNA, 22 bp, Homo sapiens
tagaatgtattgtaccttttaa

SEQ ID NO: 2909541 - DNA, 14 bp, Homo sapiens
tagaattagctttt

SEQ ID NO: 2909542 - DNA, 20 bp, Homo sapiens
tagaattatttcacaaataa

SEQ ID NO: 2909543 - DNA, 17 bp, Homo sapiens
tagaattctagcttttt

SEQ ID NO: 2909544 - DNA, 22 bp, Homo sapiens
tagaattctagcttttttcctc

SEQ ID NO: 2909545 - DNA, 14 bp, Homo sapiens
tagaattgcattga

SEQ ID NO: 2909546 - DNA, 13 bp, Homo sapiens
tagaattgttaga

SEQ ID NO: 2909547 - DNA, 16 bp, Homo sapiens
tagaattgttagatgg

SEQ ID NO: 2909548 - DNA, 13 bp, Homo sapiens
tagacaaaatcaa

SEQ ID NO: 2909549 - DNA, 16 bp, Homo sapiens
tagacaaatactcatg

SEQ ID NO: 2909550 - DNA, 19 bp, Homo sapiens
tagacaaatatttggaggg

SEQ ID NO: 2909551 - DNA, 17 bp, Homo sapiens
tagacaccaaagttcta

SEQ ID NO: 2909552 - DNA, 18 bp, Homo sapiens
tagacaccaaagttctaa

SEQ ID NO: 2909553 - DNA, 20 bp, Homo sapiens
tagacaccaaagttctaata

SEQ ID NO: 2909554 - DNA, 16 bp, Homo sapiens
tagacaccaaggaggc

SEQ ID NO: 2909555 - DNA, 20 bp, Homo sapiens
tagacatggaggttctaagg

SEQ ID NO: 2909556 - DNA, 14 bp, Homo sapiens
tatctcactgctgt

SEQ ID NO: 2909557 - DNA, 15 bp, Homo sapiens
tatctccatactttg

SEQ ID NO: 2909558 - DNA, 20 bp, Homo sapiens
tatctccctgcttcatatct

SEQ ID NO: 2909559 - DNA, 14 bp, Homo sapiens
tatctctcccttct

SEQ ID NO: 2909560 - DNA, 19 bp, Homo sapiens
tatctgaatgatcctgtct

SEQ ID NO: 2909561 - DNA, 12 bp, Homo sapiens
tatctgaatgtt

SEQ ID NO: 2909562 - DNA, 21 bp, Homo sapiens
tatctgcaatgtttttgtgta

SEQ ID NO: 2909563 - DNA, 11 bp, Homo sapiens
tatgtatttcc

SEQ ID NO: 2909564 - DNA, 15 bp, Homo sapiens
tatgtattttaaaat

SEQ ID NO: 2909565 - DNA, 18 bp, Homo sapiens
tatgtattttttgaatct

SEQ ID NO: 2909566 - DNA, 21 bp, Homo sapiens
tatgtcaaattgtcagcatga

SEQ ID NO: 2909567 - DNA, 17 bp, Homo sapiens
tatgtccactgtgtata

SEQ ID NO: 2909568 - DNA, 22 bp, Homo sapiens
tatgtcgtgttttcaaggaaga

SEQ ID NO: 2909569 - DNA, 23 bp, Homo sapiens
tatgtcttttgatgaatagaagt

SEQ ID NO: 2909570 - DNA, 22 bp, Homo sapiens
tatgtgaatatttgtaaaaata

SEQ ID NO: 2909571 - DNA, 17 bp, Homo sapiens
tatgtgccaaaactagt

SEQ ID NO: 2909572 - DNA, 13 bp, Homo sapiens
tatgtgccaggct

SEQ ID NO: 2909573 - DNA, 18 bp, Homo sapiens
tatgtgccaggcttgcct

SEQ ID NO: 2909574 - DNA, 15 bp, Homo sapiens
tatgtgctgtaattt

SEQ ID NO: 2909575 - DNA, 13 bp, Homo sapiens
tatgtggctttta

SEQ ID NO: 2909576 - DNA, 20 bp, Homo sapiens
tatgtggcttttatttcagt

SEQ ID NO: 2909577 - DNA, 16 bp, Homo sapiens
tatgtggttttagatt

SEQ ID NO: 2909578 - DNA, 18 bp, Homo sapiens
tatgtggttttagatttt

SEQ ID NO: 2909579 - DNA, 13 bp, Homo sapiens
tatgtgtaggcag

SEQ ID NO: 2909580 - DNA, 12 bp, Homo sapiens
tatgtgtatgta

SEQ ID NO: 2909581 - DNA, 19 bp, Homo sapiens
tatgtgtcagttcatttgt

SEQ ID NO: 2909582 - DNA, 15 bp, Homo sapiens
tatgtgtctggaaga

SEQ ID NO: 2909583 - DNA, 14 bp, Homo sapiens
tatgtgtgtagaca

SEQ ID NO: 2909584 - DNA, 13 bp, Homo sapiens
tatgttaaagttt

SEQ ID NO: 2909585 - DNA, 22 bp, Homo sapiens
tatgttaagcagctaaattttc

SEQ ID NO: 2909586 - DNA, 19 bp, Homo sapiens
tatgttacttaaacatcat

SEQ ID NO: 2909587 - DNA, 18 bp, Homo sapiens
tatgttatcatcctccct

SEQ ID NO: 2909588 - DNA, 19 bp, Homo sapiens
tatgttcttatagaataaa

SEQ ID NO: 2909589 - DNA, 18 bp, Homo sapiens
tatgttgaatacttttta

SEQ ID NO: 2909590 - DNA, 18 bp, Homo sapiens
tatgttgcctttatggtt

SEQ ID NO: 2909591 - DNA, 17 bp, Homo sapiens
tatgttgttagagaaaa

SEQ ID NO: 2909592 - DNA, 19 bp, Homo sapiens
tatgttgttagagaaaaat

SEQ ID NO: 2909593 - DNA, 18 bp, Homo sapiens
tatgtttaaaaaaacatt

SEQ ID NO: 2909594 - DNA, 17 bp, Homo sapiens
tatgtttgtctcacttt

SEQ ID NO: 2909595 - DNA, 18 bp, Homo sapiens
tatgtttgtctcactttt

SEQ ID NO: 2909596 - DNA, 14 bp, Homo sapiens
tattaaaaaaatgc

SEQ ID NO: 2909597 - DNA, 21 bp, Homo sapiens
tattaaaaaacaattaactgc

SEQ ID NO: 2909598 - DNA, 16 bp, Homo sapiens
tattaaaaatatacaa

SEQ ID NO: 2909599 - DNA, 17 bp, Homo sapiens
tattaaaaatatacaag

SEQ ID NO: 2909600 - DNA, 14 bp, Homo sapiens
tattaaaagtcaca

SEQ ID NO: 2909601 - DNA, 22 bp, Homo sapiens
tattaaaagtcacaatgttctt

SEQ ID NO: 2909602 - DNA, 15 bp, Homo sapiens
tattaaaatatgaag

SEQ ID NO: 2909603 - DNA, 17 bp, Homo sapiens
tattaaactctcctttg

SEQ ID NO: 2909604 - DNA, 13 bp, Homo sapiens
tattaaacttgaa

SEQ ID NO: 2909605 - DNA, 23 bp, Homo sapiens
tattaaaggtgaaaattgtataa

SEQ ID NO: 2909606 - DNA, 22 bp, Homo sapiens
tattaaagtgctaaggttctaa

SEQ ID NO: 2909607 - DNA, 24 bp, Homo sapiens
tattaaagtgctaaggttctaagg

SEQ ID NO: 2909608 - DNA, 22 bp, Homo sapiens
tattaaatcgtttaatgtttat

SEQ ID NO: 2909609 - DNA, 16 bp, Homo sapiens
tattaaatctgaattt

SEQ ID NO: 2909610 - DNA, 20 bp, Homo sapiens
tattaaattaattgaatcta

SEQ ID NO: 2909611 - DNA, 19 bp, Homo sapiens
tattaaattctcaaagttt

SEQ ID NO: 2909612 - DNA, 17 bp, Homo sapiens
tattaaatttatttgaa

SEQ ID NO: 2909613 - DNA, 20 bp, Homo sapiens
tattaactactgtagaactg

SEQ ID NO: 2909614 - DNA, 20 bp, Homo sapiens
tattaactctgtaaaagtgt

SEQ ID NO: 2909615 - DNA, 21 bp, Homo sapiens
tattaactctgtaaaagtgtc

SEQ ID NO: 2909616 - DNA, 21 bp, Homo sapiens
tattaagaatagtctctgggt

SEQ ID NO: 2909617 - DNA, 15 bp, Homo sapiens
tattaatactggtat

SEQ ID NO: 2909618 - DNA, 13 bp, Homo sapiens
tattaattgcttt

SEQ ID NO: 2909619 - DNA, 20 bp, Homo sapiens
tattacataactgatctatt

SEQ ID NO: 2909620 - DNA, 12 bp, Homo sapiens
tattacatcttt

SEQ ID NO: 2909621 - DNA, 20 bp, Homo sapiens
tattacatttaaatccttgt

SEQ ID NO: 2909622 - DNA, 14 bp, Homo sapiens
tattacccctcatt

SEQ ID NO: 2909623 - DNA, 17 bp, Homo sapiens
tattaccttaagatttt

SEQ ID NO: 2909624 - DNA, 19 bp, Homo sapiens
tattaccttaagatttttc

SEQ ID NO: 2909625 - DNA, 23 bp, Homo sapiens
tattaccttaagatttttctttt

SEQ ID NO: 2909626 - DNA, 22 bp, Homo sapiens
tattactaaggagtaatctgtg

SEQ ID NO: 2909627 - DNA, 22 bp, Homo sapiens
tattactggcgtggattaaact

SEQ ID NO: 2909628 - DNA, 14 bp, Homo sapiens
tattactgtctttt

SEQ ID NO: 2909629 - DNA, 14 bp, Homo sapiens
tattacttttcatc

SEQ ID NO: 2909630 - DNA, 18 bp, Homo sapiens
tattagagtgtctttcca

SEQ ID NO: 2909631 - DNA, 21 bp, Homo sapiens
tattagatcccatatttactt

SEQ ID NO: 2909632 - DNA, 13 bp, Homo sapiens
tattagatgtgat

SEQ ID NO: 2909633 - DNA, 16 bp, Homo sapiens
tattagatgtgattta

SEQ ID NO: 2909634 - DNA, 15 bp, Homo sapiens
tattagccacaaaat

SEQ ID NO: 2909635 - DNA, 17 bp, Homo sapiens
tattagtattgtgaata

SEQ ID NO: 2909636 - DNA, 17 bp, Homo sapiens
tattagtcagagtttca

SEQ ID NO: 2909637 - DNA, 14 bp, Homo sapiens
tattagtgatattt
